United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 76

SEQ ID NO: 3208186 - DNA, 13 bp, Homo sapiens
agggttttgtatt

SEQ ID NO: 3208187 - DNA, 19 bp, Homo sapiens
aggtaaaatgtatttttct

SEQ ID NO: 3208188 - DNA, 12 bp, Homo sapiens
aggtaaagatat

SEQ ID NO: 3208189 - DNA, 13 bp, Homo sapiens
aggtaacagaaca

SEQ ID NO: 3208190 - DNA, 15 bp, Homo sapiens
aggtaacagaacagc

SEQ ID NO: 3208191 - DNA, 17 bp, Homo sapiens
aggtaacagaacagctt

SEQ ID NO: 3208192 - DNA, 19 bp, Homo sapiens
aggtaacagaacagcttca

SEQ ID NO: 3208193 - DNA, 18 bp, Homo sapiens
aggtaatataaaaagctt

SEQ ID NO: 3208194 - DNA, 12 bp, Homo sapiens
aggtaatgtttt

SEQ ID NO: 3208195 - DNA, 15 bp, Homo sapiens
aggtaatgttttgta

SEQ ID NO: 3208196 - DNA, 20 bp, Homo sapiens
aggtaattgttttttaaagc

SEQ ID NO: 3208197 - DNA, 21 bp, Homo sapiens
aggtaatttttaccctaatgt

SEQ ID NO: 3208198 - DNA, 22 bp, Homo sapiens
aggtacaacagaataatgcatg

SEQ ID NO: 3208199 - DNA, 20 bp, Homo sapiens
aggtaccacccttcagaccc

SEQ ID NO: 3208200 - DNA, 16 bp, Homo sapiens
aggtaccagctgcgct

SEQ ID NO: 3208201 - DNA, 14 bp, Homo sapiens
aggtacggagaaga

SEQ ID NO: 3208202 - DNA, 13 bp, Homo sapiens
aggtactctcctg

SEQ ID NO: 3208203 - DNA, 20 bp, Homo sapiens
aggtacttcctcctgatggc

SEQ ID NO: 3208204 - DNA, 19 bp, Homo sapiens
aggtagaaatatctgaaaa

SEQ ID NO: 3208205 - DNA, 22 bp, Homo sapiens
aggtagaattatctaatttata

SEQ ID NO: 3208206 - DNA, 20 bp, Homo sapiens
aggtagatcgcttgagccca

SEQ ID NO: 3208207 - DNA, 16 bp, Homo sapiens
aggtagccttgtgttc

SEQ ID NO: 3208208 - DNA, 18 bp, Homo sapiens
aggtagcttacctgacac

SEQ ID NO: 3208209 - DNA, 13 bp, Homo sapiens
aggtagcttcagc

SEQ ID NO: 3208210 - DNA, 18 bp, Homo sapiens
aggtaggcccttgtcctg

SEQ ID NO: 3208211 - DNA, 22 bp, Homo sapiens
aggtaggcccttgtcctgccag

SEQ ID NO: 3208212 - DNA, 15 bp, Homo sapiens
aggtagtttcaaagg

SEQ ID NO: 3208213 - DNA, 14 bp, Homo sapiens
aggtagtttctcat

SEQ ID NO: 3208214 - DNA, 19 bp, Homo sapiens
aggtagtttggatattttt

SEQ ID NO: 3208215 - DNA, 13 bp, Homo sapiens
aggtataattaaa

SEQ ID NO: 3208216 - DNA, 11 bp, Homo sapiens
aggtataattt

SEQ ID NO: 3208217 - DNA, 20 bp, Homo sapiens
aggtatggaagggtttgtgg

SEQ ID NO: 3208218 - DNA, 23 bp, Homo sapiens
aggtatggctctgcacccctctg

SEQ ID NO: 3208219 - DNA, 15 bp, Homo sapiens
aggtattagcaaagc

SEQ ID NO: 3208220 - DNA, 14 bp, Homo sapiens
aggtatttcaaaac

SEQ ID NO: 3208221 - DNA, 12 bp, Homo sapiens
aggtatttgaaa

SEQ ID NO: 3208222 - DNA, 17 bp, Homo sapiens
aggtattttgaatacca

SEQ ID NO: 3208223 - DNA, 20 bp, Homo sapiens
aggtcaagggcttactattt

SEQ ID NO: 3208224 - DNA, 14 bp, Homo sapiens
aggtcaaggtcatt

SEQ ID NO: 3208225 - DNA, 17 bp, Homo sapiens
aggtcaagtaagaagac

SEQ ID NO: 3208226 - DNA, 19 bp, Homo sapiens
aggtcaagtaagaagacat

SEQ ID NO: 3208227 - DNA, 23 bp, Homo sapiens
aggtcacacgaccggggccagca

SEQ ID NO: 3208228 - DNA, 15 bp, Homo sapiens
aggtcacataaaact

SEQ ID NO: 3208229 - DNA, 22 bp, Homo sapiens
aggtcaccaggggaggagcctg

SEQ ID NO: 3208230 - DNA, 14 bp, Homo sapiens
aggtcactccacca

SEQ ID NO: 3208231 - DNA, 18 bp, Homo sapiens
aggtcactccaccatccc

SEQ ID NO: 3208232 - DNA, 18 bp, Homo sapiens
aggtcactcctggggcct

SEQ ID NO: 3208233 - DNA, 19 bp, Homo sapiens
aggtcactcctggggcctc

SEQ ID NO: 3208234 - DNA, 18 bp, Homo sapiens
aggtcactggctctccaa

SEQ ID NO: 3208235 - DNA, 23 bp, Homo sapiens
aggtcacttgatcatgctgcagt

SEQ ID NO: 3208236 - DNA, 15 bp, Homo sapiens
aggtcagagcctgca

SEQ ID NO: 3208237 - DNA, 13 bp, Homo sapiens
aggtcagatggag

SEQ ID NO: 3208238 - DNA, 16 bp, Homo sapiens
aggtcagcatgtctat

SEQ ID NO: 3208239 - DNA, 20 bp, Homo sapiens
aggtcagctgttactttctt

SEQ ID NO: 3208240 - DNA, 23 bp, Homo sapiens
aggtcaggatgcacatttctgga

SEQ ID NO: 3208241 - DNA, 17 bp, Homo sapiens
aggtcaggccccactcc

SEQ ID NO: 3208242 - DNA, 12 bp, Homo sapiens
aggtcaggccct

SEQ ID NO: 3208243 - DNA, 14 bp, Homo sapiens
aggtcagggacttg

SEQ ID NO: 3208244 - DNA, 20 bp, Homo sapiens
aggtcagggagtgctggctc

SEQ ID NO: 3208245 - DNA, 19 bp, Homo sapiens
aggtcagttgtgtttttta

SEQ ID NO: 3208246 - DNA, 17 bp, Homo sapiens
aggtcatagctgagatt

SEQ ID NO: 3208247 - DNA, 19 bp, Homo sapiens
aggtcatgcagttcctggc

SEQ ID NO: 3208248 - DNA, 17 bp, Homo sapiens
aggtccaagccccccac

SEQ ID NO: 3208249 - DNA, 21 bp, Homo sapiens
aggtccaagccccccacacct

SEQ ID NO: 3208250 - DNA, 16 bp, Homo sapiens
aggtccaatttgtaaa

SEQ ID NO: 3208251 - DNA, 19 bp, Homo sapiens
aggtccacaggtctagact

SEQ ID NO: 3208252 - DNA, 17 bp, Homo sapiens
aggtccaccggcccctg

SEQ ID NO: 3208253 - DNA, 19 bp, Homo sapiens
aggtccactccctgctcca

SEQ ID NO: 3208254 - DNA, 20 bp, Homo sapiens
aggtccactccctgctccac

SEQ ID NO: 3208255 - DNA, 15 bp, Homo sapiens
aggtccagacccact

SEQ ID NO: 3208256 - DNA, 16 bp, Homo sapiens
aggtccagcccatctc

SEQ ID NO: 3208257 - DNA, 17 bp, Homo sapiens
aggtccagctctggagg

SEQ ID NO: 3208258 - DNA, 23 bp, Homo sapiens
aggtccagctctggaggggaggg

SEQ ID NO: 3208259 - DNA, 14 bp, Homo sapiens
aggtcccacctcca

SEQ ID NO: 3208260 - DNA, 16 bp, Homo sapiens
aggtcccacctccagc

SEQ ID NO: 3208261 - DNA, 14 bp, Homo sapiens
aggtcccacgtctg

SEQ ID NO: 3208262 - DNA, 22 bp, Homo sapiens
aggtccctccgcggctggagcg

SEQ ID NO: 3208263 - DNA, 21 bp, Homo sapiens
aggtccctgtatgtctacctc

SEQ ID NO: 3208264 - DNA, 15 bp, Homo sapiens
aggtcctgcccatgt

SEQ ID NO: 3208265 - DNA, 13 bp, Homo sapiens
aggtctcacgggc

SEQ ID NO: 3208266 - DNA, 15 bp, Homo sapiens
aggtctcatctcttc

SEQ ID NO: 3208267 - DNA, 22 bp, Homo sapiens
aggtctcatctcttcaggttct

SEQ ID NO: 3208268 - DNA, 18 bp, Homo sapiens
aggtctcattgcttctga

SEQ ID NO: 3208269 - DNA, 21 bp, Homo sapiens
aggtctccaggggcctgcaga

SEQ ID NO: 3208270 - DNA, 16 bp, Homo sapiens
aggtctccccatcccc

SEQ ID NO: 3208271 - DNA, 19 bp, Homo sapiens
aggtctccttactctgagc

SEQ ID NO: 3208272 - DNA, 21 bp, Homo sapiens
aggtctccttactctgagccc

SEQ ID NO: 3208273 - DNA, 24 bp, Homo sapiens
aggtctccttactctgagcccagg

SEQ ID NO: 3208274 - DNA, 23 bp, Homo sapiens
aggtctcttctcccagaatccca

SEQ ID NO: 3208275 - DNA, 13 bp, Homo sapiens
aggtctgaaatgg

SEQ ID NO: 3208276 - DNA, 15 bp, Homo sapiens
aggtctgaaatggag

SEQ ID NO: 3208277 - DNA, 21 bp, Homo sapiens
aggtctgaaatggaggtcctt

SEQ ID NO: 3208278 - DNA, 14 bp, Homo sapiens
aggtctgagccctg

SEQ ID NO: 3208279 - DNA, 15 bp, Homo sapiens
aggtcttccagacct

SEQ ID NO: 3208280 - DNA, 18 bp, Homo sapiens
aggtcttccagacctgct

SEQ ID NO: 3208281 - DNA, 16 bp, Homo sapiens
aggtcttgaactcctg

SEQ ID NO: 3208282 - DNA, 18 bp, Homo sapiens
aggtcttgaactcctggc

SEQ ID NO: 3208283 - DNA, 23 bp, Homo sapiens
aggtcttgaactcctggcctcaa

SEQ ID NO: 3208284 - DNA, 17 bp, Homo sapiens
aggtctttgttatgaca

SEQ ID NO: 3208285 - DNA, 14 bp, Homo sapiens
aggtcttttgacat

SEQ ID NO: 3208286 - DNA, 18 bp, Homo sapiens
aggtcttttgacatgtgg

SEQ ID NO: 3208287 - DNA, 19 bp, Homo sapiens
aggtcttttgacatgtgga

SEQ ID NO: 3208288 - DNA, 15 bp, Homo sapiens
aggtgaaaatgaaga

SEQ ID NO: 3208289 - DNA, 20 bp, Homo sapiens
aggtgaaaatgaagaaggaa

SEQ ID NO: 3208290 - DNA, 14 bp, Homo sapiens
aggtgaaagggagc

SEQ ID NO: 3208291 - DNA, 17 bp, Homo sapiens
aggtgaacacttagtga

SEQ ID NO: 3208292 - DNA, 16 bp, Homo sapiens
aggtgaagatgaagaa

SEQ ID NO: 3208293 - DNA, 22 bp, Homo sapiens
aggtgaaggctctcacccccat

SEQ ID NO: 3208294 - DNA, 18 bp, Homo sapiens
aggtgacagaaggaccag

SEQ ID NO: 3208295 - DNA, 15 bp, Homo sapiens
aggtgacagagtgag

SEQ ID NO: 3208296 - DNA, 22 bp, Homo sapiens
aggtgacagagtgagactctgt

SEQ ID NO: 3208297 - DNA, 13 bp, Homo sapiens
aggtgaccccagg

SEQ ID NO: 3208298 - DNA, 17 bp, Homo sapiens
aggtgaggtctgttcct

SEQ ID NO: 3208299 - DNA, 20 bp, Homo sapiens
aggtgagtttgagctgcctt

SEQ ID NO: 3208300 - DNA, 16 bp, Homo sapiens
aggtgatatatttaaa

SEQ ID NO: 3208301 - DNA, 18 bp, Homo sapiens
aggtgatatatttaaaaa

SEQ ID NO: 3208302 - DNA, 21 bp, Homo sapiens
aggtgatccacccacctcagc

SEQ ID NO: 3208303 - DNA, 23 bp, Homo sapiens
aggtgatccacccacctcagcct

SEQ ID NO: 3208304 - DNA, 23 bp, Homo sapiens
aggtgattctaatcatctgcagt

SEQ ID NO: 3208305 - DNA, 16 bp, Homo sapiens
aggttgctgtttcaca

SEQ ID NO: 3208306 - DNA, 18 bp, Homo sapiens
aggttggaagagaatcac

SEQ ID NO: 3208307 - DNA, 20 bp, Homo sapiens
aggttggaaggggccttgct

SEQ ID NO: 3208308 - DNA, 16 bp, Homo sapiens
aggttggacagccccc

SEQ ID NO: 3208309 - DNA, 18 bp, Homo sapiens
aggttggacagccccctt

SEQ ID NO: 3208310 - DNA, 20 bp, Homo sapiens
aggttggatgggagtgggca

SEQ ID NO: 3208311 - DNA, 17 bp, Homo sapiens
aggttggggataggttt

SEQ ID NO: 3208312 - DNA, 14 bp, Homo sapiens
aggttgtctccagg

SEQ ID NO: 3208313 - DNA, 17 bp, Homo sapiens
aggttgtctccaggcca

SEQ ID NO: 3208314 - DNA, 16 bp, Homo sapiens
aggttgtctgaagtca

SEQ ID NO: 3208315 - DNA, 16 bp, Homo sapiens
aggtttaaagagtcta

SEQ ID NO: 3208316 - DNA, 14 bp, Homo sapiens
aggtttcaaagatg

SEQ ID NO: 3208317 - DNA, 20 bp, Homo sapiens
aggtttctttttttttcctt

SEQ ID NO: 3208318 - DNA, 19 bp, Homo sapiens
aggtttgcagggagctcaa

SEQ ID NO: 3208319 - DNA, 17 bp, Homo sapiens
aggtttgcttcctcagt

SEQ ID NO: 3208320 - DNA, 12 bp, Homo sapiens
aggtttgtatat

SEQ ID NO: 3208321 - DNA, 13 bp, Homo sapiens
aggtttgtatatt

SEQ ID NO: 3208322 - DNA, 20 bp, Homo sapiens
aggtttgtatattgtcagat

SEQ ID NO: 3208323 - DNA, 22 bp, Homo sapiens
aggtttgtgagagcgaggctga

SEQ ID NO: 3208324 - DNA, 21 bp, Homo sapiens
aggttttaaagtgattaaacg

SEQ ID NO: 3208325 - DNA, 19 bp, Homo sapiens
aggttttaagtggtttgat

SEQ ID NO: 3208326 - DNA, 15 bp, Homo sapiens
aggttttagcattgt

SEQ ID NO: 3208327 - DNA, 17 bp, Homo sapiens
aggttttaggttctaaa

SEQ ID NO: 3208328 - DNA, 18 bp, Homo sapiens
aggttttaggttctaaag

SEQ ID NO: 3208329 - DNA, 23 bp, Homo sapiens
aggttttaggttctaaagttcta

SEQ ID NO: 3208330 - DNA, 17 bp, Homo sapiens
aggttttataaggctga

SEQ ID NO: 3208331 - DNA, 22 bp, Homo sapiens
aggttttcctcttctattttgt

SEQ ID NO: 3208332 - DNA, 12 bp, Homo sapiens
aggttttgtatt

SEQ ID NO: 3208333 - DNA, 23 bp, Homo sapiens
aggtttttaaacactaaaatata

SEQ ID NO: 3208334 - DNA, 21 bp, Homo sapiens
aggtttttaaagtaaatctct

SEQ ID NO: 3208335 - DNA, 20 bp, Homo sapiens
aggtttttattagtaccata

SEQ ID NO: 3208336 - DNA, 20 bp, Homo sapiens
aggtttttcctactgtcctc

SEQ ID NO: 3208337 - DNA, 22 bp, Homo sapiens
aggtttttcctactgtcctcag

SEQ ID NO: 3208338 - DNA, 23 bp, Homo sapiens
aggtttttcctactgtcctcaga

SEQ ID NO: 3208339 - DNA, 20 bp, Homo sapiens
aggtttttccttatttgctt

SEQ ID NO: 3208340 - DNA, 19 bp, Homo sapiens
aggtttttctcatgtatct

SEQ ID NO: 3208341 - DNA, 19 bp, Homo sapiens
aggtttttgtttgtttcct

SEQ ID NO: 3208342 - DNA, 14 bp, Homo sapiens
aggtttttttaatg

SEQ ID NO: 3208343 - DNA, 17 bp, Homo sapiens
agtaaaaccttgttcta

SEQ ID NO: 3208344 - DNA, 19 bp, Homo sapiens
agtaaaagtcataaatgca

SEQ ID NO: 3208345 - DNA, 20 bp, Homo sapiens
agtaaaattatcctctttgt

SEQ ID NO: 3208346 - DNA, 22 bp, Homo sapiens
agtaaaattatcctctttgtaa

SEQ ID NO: 3208347 - DNA, 14 bp, Homo sapiens
agtaaagagaaact

SEQ ID NO: 3208348 - DNA, 14 bp, Homo sapiens
agtaaagctaaaat

SEQ ID NO: 3208349 - DNA, 22 bp, Homo sapiens
agtaaaggcctcctcccccacc

SEQ ID NO: 3208350 - DNA, 14 bp, Homo sapiens
agtaaataaactgt

SEQ ID NO: 3208351 - DNA, 14 bp, Homo sapiens
agtaaataatgaaa

SEQ ID NO: 3208352 - DNA, 16 bp, Homo sapiens
agtaaatacaagactg

SEQ ID NO: 3208353 - DNA, 17 bp, Homo sapiens
agtaaatacaagactgt

SEQ ID NO: 3208354 - DNA, 19 bp, Homo sapiens
agtaaatacaagactgttg

SEQ ID NO: 3208355 - DNA, 19 bp, Homo sapiens
agtaaatagtttgaattca

SEQ ID NO: 3208356 - DNA, 23 bp, Homo sapiens
agtaaatagtttgaattcagtaa

SEQ ID NO: 3208357 - DNA, 13 bp, Homo sapiens
agtaaattatgta

SEQ ID NO: 3208358 - DNA, 13 bp, Homo sapiens
agtaacaaataaa

SEQ ID NO: 3208359 - DNA, 19 bp, Homo sapiens
agtaacaatacaaatggat

SEQ ID NO: 3208360 - DNA, 20 bp, Homo sapiens
agtaacatgcatactttatt

SEQ ID NO: 3208361 - DNA, 14 bp, Homo sapiens
agtaacattctact

SEQ ID NO: 3208362 - DNA, 19 bp, Homo sapiens
agtaacattctacttgctt

SEQ ID NO: 3208363 - DNA, 15 bp, Homo sapiens
agtaacatttctgtt

SEQ ID NO: 3208364 - DNA, 16 bp, Homo sapiens
agtaacatttctgttc

SEQ ID NO: 3208365 - DNA, 17 bp, Homo sapiens
agtaacatttgctgttt

SEQ ID NO: 3208366 - DNA, 19 bp, Homo sapiens
agtaacccccttaaattta

SEQ ID NO: 3208367 - DNA, 16 bp, Homo sapiens
agtaacgcgtcttcct

SEQ ID NO: 3208368 - DNA, 18 bp, Homo sapiens
agtaacgcgtcttcctga

SEQ ID NO: 3208369 - DNA, 19 bp, Homo sapiens
agtaactaattttgttgaa

SEQ ID NO: 3208370 - DNA, 15 bp, Homo sapiens
agtaactattattat

SEQ ID NO: 3208371 - DNA, 17 bp, Homo sapiens
agtaactgttttttaag

SEQ ID NO: 3208372 - DNA, 20 bp, Homo sapiens
agtaactttactctgtgttt

SEQ ID NO: 3208373 - DNA, 23 bp, Homo sapiens
agtaactttactctgtgtttaaa

SEQ ID NO: 3208374 - DNA, 18 bp, Homo sapiens
agtaacttttttgtgtat

SEQ ID NO: 3208375 - DNA, 21 bp, Homo sapiens
agtaagaaagtgaagcaaatc

SEQ ID NO: 3208376 - DNA, 21 bp, Homo sapiens
agtaagaacatccctgtctta

SEQ ID NO: 3208377 - DNA, 15 bp, Homo sapiens
agtaagaagacatga

SEQ ID NO: 3208378 - DNA, 16 bp, Homo sapiens
agtaagaagacatgaa

SEQ ID NO: 3208379 - DNA, 16 bp, Homo sapiens
agtaagatgcactgaa

SEQ ID NO: 3208380 - DNA, 14 bp, Homo sapiens
agtaagcaaacaaa

SEQ ID NO: 3208381 - DNA, 20 bp, Homo sapiens
agtaagctgctctattgtag

SEQ ID NO: 3208382 - DNA, 19 bp, Homo sapiens
agtaagttaatgtatataa

SEQ ID NO: 3208383 - DNA, 16 bp, Homo sapiens
agtaataaaacatctt

SEQ ID NO: 3208384 - DNA, 17 bp, Homo sapiens
agtaataaactgtgttt

SEQ ID NO: 3208385 - DNA, 14 bp, Homo sapiens
agtaatagagcaaa

SEQ ID NO: 3208386 - DNA, 15 bp, Homo sapiens
agtaatcaataaaga

SEQ ID NO: 3208387 - DNA, 19 bp, Homo sapiens
agtaatcccgccacctatc

SEQ ID NO: 3208388 - DNA, 19 bp, Homo sapiens
agtaatctaatatggccac

SEQ ID NO: 3208389 - DNA, 23 bp, Homo sapiens
agtaatctgtacattttgttgta

SEQ ID NO: 3208390 - DNA, 15 bp, Homo sapiens
agtaatctttaaact

SEQ ID NO: 3208391 - DNA, 12 bp, Homo sapiens
agtaatgaattt

SEQ ID NO: 3208392 - DNA, 21 bp, Homo sapiens
agtaatgaatttttatgatat

SEQ ID NO: 3208393 - DNA, 13 bp, Homo sapiens
agtaatggcagag

SEQ ID NO: 3208394 - DNA, 12 bp, Homo sapiens
agtaatgtatta

SEQ ID NO: 3208395 - DNA, 13 bp, Homo sapiens
agtaattatcggg

SEQ ID NO: 3208396 - DNA, 22 bp, Homo sapiens
agtaattatcgggaacagtgtt

SEQ ID NO: 3208397 - DNA, 21 bp, Homo sapiens
agtaattatgcactaaatatg

SEQ ID NO: 3208398 - DNA, 15 bp, Homo sapiens
agtaattgtgaaaaa

SEQ ID NO: 3208399 - DNA, 12 bp, Homo sapiens
agtaatttcagt

SEQ ID NO: 3208400 - DNA, 21 bp, Homo sapiens
agtaatttctttttttccttt

SEQ ID NO: 3208401 - DNA, 15 bp, Homo sapiens
agtaatttgaggaca

SEQ ID NO: 3208402 - DNA, 17 bp, Homo sapiens
agtacaaattataaaaa

SEQ ID NO: 3208403 - DNA, 12 bp, Homo sapiens
agtacaatcagc

SEQ ID NO: 3208404 - DNA, 17 bp, Homo sapiens
agtacaatgaactgctt

SEQ ID NO: 3208405 - DNA, 15 bp, Homo sapiens
agtacactctgctgt

SEQ ID NO: 3208406 - DNA, 19 bp, Homo sapiens
agtacacttggtgtactgg

SEQ ID NO: 3208407 - DNA, 14 bp, Homo sapiens
agtacagaatttga

SEQ ID NO: 3208408 - DNA, 13 bp, Homo sapiens
agtacatttaata

SEQ ID NO: 3208409 - DNA, 16 bp, Homo sapiens
agtacatttggagaca

SEQ ID NO: 3208410 - DNA, 18 bp, Homo sapiens
agtaccaaagttttatca

SEQ ID NO: 3208411 - DNA, 15 bp, Homo sapiens
agtaccaatgctgtt

SEQ ID NO: 3208412 - DNA, 19 bp, Homo sapiens
agtaccaatgctgttgtaa

SEQ ID NO: 3208413 - DNA, 15 bp, Homo sapiens
agtaccactcttggt

SEQ ID NO: 3208414 - DNA, 22 bp, Homo sapiens
agtaccagcgctctaaaagcac

SEQ ID NO: 3208415 - DNA, 17 bp, Homo sapiens
agtaccataatcttaga

SEQ ID NO: 3208416 - DNA, 21 bp, Homo sapiens
agtaccatagtaccatttata

SEQ ID NO: 3208417 - DNA, 21 bp, Homo sapiens
agtaccatttatacaaattag

SEQ ID NO: 3208418 - DNA, 18 bp, Homo sapiens
agtacccatctagtactt

SEQ ID NO: 3208419 - DNA, 20 bp, Homo sapiens
agtacctctgtatagaaatc

SEQ ID NO: 3208420 - DNA, 13 bp, Homo sapiens
agtacctgctgcc

SEQ ID NO: 3208421 - DNA, 18 bp, Homo sapiens
agtactaacacaaggaca

SEQ ID NO: 3208422 - DNA, 12 bp, Homo sapiens
agtactcaaatt

SEQ ID NO: 3208423 - DNA, 15 bp, Homo sapiens
agtactcaaattcaa

SEQ ID NO: 3208424 - DNA, 16 bp, Homo sapiens
agtactcctgcaaaat

SEQ ID NO: 3208425 - DNA, 19 bp, Homo sapiens
agtactcctgcaaaatttt

SEQ ID NO: 3208426 - DNA, 20 bp, Homo sapiens
agtactcctgcaaaatttta

SEQ ID NO: 3208427 - DNA, 18 bp, Homo sapiens
agtactccttaagaacac

SEQ ID NO: 3208428 - DNA, 20 bp, Homo sapiens
agtactctctgctctagcca

SEQ ID NO: 3208429 - DNA, 23 bp, Homo sapiens
agtactctctgctctagccagga

SEQ ID NO: 3208430 - DNA, 20 bp, Homo sapiens
agtactgtaataatacctca

SEQ ID NO: 3208431 - DNA, 13 bp, Homo sapiens
agtcaccttccag

SEQ ID NO: 3208432 - DNA, 18 bp, Homo sapiens
agtcactgccactttgca

SEQ ID NO: 3208433 - DNA, 19 bp, Homo sapiens
agtcactgccactttgcac

SEQ ID NO: 3208434 - DNA, 22 bp, Homo sapiens
agtcactggaggttgaagccaa

SEQ ID NO: 3208435 - DNA, 13 bp, Homo sapiens
agtcagaaaactt

SEQ ID NO: 3208436 - DNA, 23 bp, Homo sapiens
agtcagaaaactttaaaaaatat

SEQ ID NO: 3208437 - DNA, 22 bp, Homo sapiens
agtcagaaaattggcagtggca

SEQ ID NO: 3208438 - DNA, 23 bp, Homo sapiens
agtcagagcccctacagcattgt

SEQ ID NO: 3208439 - DNA, 12 bp, Homo sapiens
agtcagagccct

SEQ ID NO: 3208440 - DNA, 13 bp, Homo sapiens
agtcagaggagaa

SEQ ID NO: 3208441 - DNA, 17 bp, Homo sapiens
agtcagaggatggccag

SEQ ID NO: 3208442 - DNA, 20 bp, Homo sapiens
agtcagaggatggccagtgt

SEQ ID NO: 3208443 - DNA, 14 bp, Homo sapiens
agtcagatgcccag

SEQ ID NO: 3208444 - DNA, 16 bp, Homo sapiens
agtcagatttttaaag

SEQ ID NO: 3208445 - DNA, 18 bp, Homo sapiens
agtcagatttttaaagtt

SEQ ID NO: 3208446 - DNA, 18 bp, Homo sapiens
agtcagcatgcttcccag

SEQ ID NO: 3208447 - DNA, 14 bp, Homo sapiens
agtcagccagtggc

SEQ ID NO: 3208448 - DNA, 17 bp, Homo sapiens
agtcaggaatggctgca

SEQ ID NO: 3208449 - DNA, 22 bp, Homo sapiens
agtcaggccttaattttcagta

SEQ ID NO: 3208450 - DNA, 15 bp, Homo sapiens
agtcagggcccagag

SEQ ID NO: 3208451 - DNA, 21 bp, Homo sapiens
agtcagggtgggaagaaagaa

SEQ ID NO: 3208452 - DNA, 15 bp, Homo sapiens
agtcagtacccctgg

SEQ ID NO: 3208453 - DNA, 19 bp, Homo sapiens
agtcagtaggtccaagggc

SEQ ID NO: 3208454 - DNA, 16 bp, Homo sapiens
agtcagtgtctggctt

SEQ ID NO: 3208455 - DNA, 17 bp, Homo sapiens
agtcagtgtctggcttt

SEQ ID NO: 3208456 - DNA, 16 bp, Homo sapiens
agtcagttgaaattct

SEQ ID NO: 3208457 - DNA, 14 bp, Homo sapiens
agtcataaatgcat

SEQ ID NO: 3208458 - DNA, 16 bp, Homo sapiens
agtcataggttaatat

SEQ ID NO: 3208459 - DNA, 15 bp, Homo sapiens
agtcatattttgatt

SEQ ID NO: 3208460 - DNA, 20 bp, Homo sapiens
agtcatattttgattattgt

SEQ ID NO: 3208461 - DNA, 21 bp, Homo sapiens
agtcatattttgattattgta

SEQ ID NO: 3208462 - DNA, 14 bp, Homo sapiens
agtcatcatcaggg

SEQ ID NO: 3208463 - DNA, 18 bp, Homo sapiens
agtcatcatcagggcctg

SEQ ID NO: 3208464 - DNA, 18 bp, Homo sapiens
agtcatctccatcagctg

SEQ ID NO: 3208465 - DNA, 19 bp, Homo sapiens
agtcatctccatcagctgt

SEQ ID NO: 3208466 - DNA, 14 bp, Homo sapiens
agtcatctgtttaa

SEQ ID NO: 3208467 - DNA, 14 bp, Homo sapiens
agtcatgcataaat

SEQ ID NO: 3208468 - DNA, 13 bp, Homo sapiens
agtcatgtgcatt

SEQ ID NO: 3208469 - DNA, 22 bp, Homo sapiens
agtcattatgagaggcaatgat

SEQ ID NO: 3208470 - DNA, 13 bp, Homo sapiens
agtcattctttaa

SEQ ID NO: 3208471 - DNA, 15 bp, Homo sapiens
agtcattgtcataag

SEQ ID NO: 3208472 - DNA, 18 bp, Homo sapiens
agtcatttactaaacata

SEQ ID NO: 3208473 - DNA, 15 bp, Homo sapiens
agtcatttattttaa

SEQ ID NO: 3208474 - DNA, 18 bp, Homo sapiens
agtcatttcgttccctga

SEQ ID NO: 3208475 - DNA, 15 bp, Homo sapiens
agtcattttcatgtg

SEQ ID NO: 3208476 - DNA, 21 bp, Homo sapiens
agtcattttcatgtgtgtgag

SEQ ID NO: 3208477 - DNA, 19 bp, Homo sapiens
agtccaaatgtttacaggg

SEQ ID NO: 3208478 - DNA, 19 bp, Homo sapiens
agtccaagagggtccttta

SEQ ID NO: 3208479 - DNA, 14 bp, Homo sapiens
agtccaatgtggca

SEQ ID NO: 3208480 - DNA, 14 bp, Homo sapiens
agtccacggacccc

SEQ ID NO: 3208481 - DNA, 14 bp, Homo sapiens
agtccaggagctca

SEQ ID NO: 3208482 - DNA, 22 bp, Homo sapiens
agtccaggatgctaacatctaa

SEQ ID NO: 3208483 - DNA, 17 bp, Homo sapiens
agtccaggctgccgtgg

SEQ ID NO: 3208484 - DNA, 17 bp, Homo sapiens
agtccagtgacctgctg

SEQ ID NO: 3208485 - DNA, 21 bp, Homo sapiens
agtccatcaccctttccggca

SEQ ID NO: 3208486 - DNA, 20 bp, Homo sapiens
agtccatttcccacatcttt

SEQ ID NO: 3208487 - DNA, 20 bp, Homo sapiens
agtccattttttaaaaatgt

SEQ ID NO: 3208488 - DNA, 14 bp, Homo sapiens
agtcccaaaaccct

SEQ ID NO: 3208489 - DNA, 13 bp, Homo sapiens
agtcccaaattca

SEQ ID NO: 3208490 - DNA, 19 bp, Homo sapiens
agtcccaccttggctgcag

SEQ ID NO: 3208491 - DNA, 23 bp, Homo sapiens
agtcccaccttggctgcagggag

SEQ ID NO: 3208492 - DNA, 18 bp, Homo sapiens
agtcccactgcctcaggt

SEQ ID NO: 3208493 - DNA, 22 bp, Homo sapiens
agtcccagctactcagaagcct

SEQ ID NO: 3208494 - DNA, 19 bp, Homo sapiens
agtcccagtatacctcatt

SEQ ID NO: 3208495 - DNA, 12 bp, Homo sapiens
agtccccacccc

SEQ ID NO: 3208496 - DNA, 16 bp, Homo sapiens
agtccccacccctgcc

SEQ ID NO: 3208497 - DNA, 17 bp, Homo sapiens
agtccccacccctgccc

SEQ ID NO: 3208498 - DNA, 13 bp, Homo sapiens
agtccccagccct

SEQ ID NO: 3208499 - DNA, 20 bp, Homo sapiens
agtccccagcccttctgcct

SEQ ID NO: 3208500 - DNA, 21 bp, Homo sapiens
agtcccccctcccacctccag

SEQ ID NO: 3208501 - DNA, 22 bp, Homo sapiens
agttacagcctgttagtaacat

SEQ ID NO: 3208502 - DNA, 16 bp, Homo sapiens
agttacagttctgtgg

SEQ ID NO: 3208503 - DNA, 18 bp, Homo sapiens
agttacattaaaataaac

SEQ ID NO: 3208504 - DNA, 13 bp, Homo sapiens
agttacccactga

SEQ ID NO: 3208505 - DNA, 16 bp, Homo sapiens
agttaccttatagtta

SEQ ID NO: 3208506 - DNA, 16 bp, Homo sapiens
agttactaggtaactt

SEQ ID NO: 3208507 - DNA, 18 bp, Homo sapiens
agttactaggtaacttca

SEQ ID NO: 3208508 - DNA, 16 bp, Homo sapiens
agttactcaagcagtt

SEQ ID NO: 3208509 - DNA, 17 bp, Homo sapiens
agttactccctacactg

SEQ ID NO: 3208510 - DNA, 22 bp, Homo sapiens
agttactccctacactgatgca

SEQ ID NO: 3208511 - DNA, 14 bp, Homo sapiens
agttactgtgtaat

SEQ ID NO: 3208512 - DNA, 16 bp, Homo sapiens
agttactgtgtaatta

SEQ ID NO: 3208513 - DNA, 18 bp, Homo sapiens
agttactgtgtaattagt

SEQ ID NO: 3208514 - DNA, 14 bp, Homo sapiens
agttacttcctatc

SEQ ID NO: 3208515 - DNA, 15 bp, Homo sapiens
agttacttgtctgag

SEQ ID NO: 3208516 - DNA, 13 bp, Homo sapiens
agttactttgtaa

SEQ ID NO: 3208517 - DNA, 16 bp, Homo sapiens
agttagagaatatatt

SEQ ID NO: 3208518 - DNA, 23 bp, Homo sapiens
agttagccatctaatgcttgttt

SEQ ID NO: 3208519 - DNA, 15 bp, Homo sapiens
agttagcctccacca

SEQ ID NO: 3208520 - DNA, 14 bp, Homo sapiens
agttagctcaggag

SEQ ID NO: 3208521 - DNA, 17 bp, Homo sapiens
agttaggaaataaaacc

SEQ ID NO: 3208522 - DNA, 18 bp, Homo sapiens
agttaggaaataaaacct

SEQ ID NO: 3208523 - DNA, 20 bp, Homo sapiens
agttaggaaataaaaccttt

SEQ ID NO: 3208524 - DNA, 21 bp, Homo sapiens
agttaggaaataaaacctttc

SEQ ID NO: 3208525 - DNA, 16 bp, Homo sapiens
agttaggatagcattt

SEQ ID NO: 3208526 - DNA, 18 bp, Homo sapiens
agttagggttttgcaata

SEQ ID NO: 3208527 - DNA, 17 bp, Homo sapiens
agttagtttttaggtca

SEQ ID NO: 3208528 - DNA, 21 bp, Homo sapiens
agttgagtacagtgaggaggg

SEQ ID NO: 3208529 - DNA, 20 bp, Homo sapiens
agttgagtcgtcatcacttt

SEQ ID NO: 3208530 - DNA, 18 bp, Homo sapiens
agttgcaattgaattaaa

SEQ ID NO: 3208531 - DNA, 15 bp, Homo sapiens
agttgcactgatatt

SEQ ID NO: 3208532 - DNA, 16 bp, Homo sapiens
agttgcagactcagtt

SEQ ID NO: 3208533 - DNA, 17 bp, Homo sapiens
agttgcagactcagttt

SEQ ID NO: 3208534 - DNA, 18 bp, Homo sapiens
agttgcagactcagtttg

SEQ ID NO: 3208535 - DNA, 12 bp, Homo sapiens
agttgcaggagc

SEQ ID NO: 3208536 - DNA, 18 bp, Homo sapiens
agttgcatagcagtatat

SEQ ID NO: 3208537 - DNA, 20 bp, Homo sapiens
agttgccaaagttttgctgt

SEQ ID NO: 3208538 - DNA, 19 bp, Homo sapiens
agttgccaccacctctgtg

SEQ ID NO: 3208539 - DNA, 15 bp, Homo sapiens
agttgcccagagcac

SEQ ID NO: 3208540 - DNA, 21 bp, Homo sapiens
agttgcccagagcactttagc

SEQ ID NO: 3208541 - DNA, 18 bp, Homo sapiens
agttgccctagcccagac

SEQ ID NO: 3208542 - DNA, 13 bp, Homo sapiens
agttgccttttat

SEQ ID NO: 3208543 - DNA, 20 bp, Homo sapiens
agttgcgacggagagaaaaa

SEQ ID NO: 3208544 - DNA, 15 bp, Homo sapiens
agttgctcaaaaaga

SEQ ID NO: 3208545 - DNA, 12 bp, Homo sapiens
agttgctgagag

SEQ ID NO: 3208546 - DNA, 17 bp, Homo sapiens
agttgctgcaaacctga

SEQ ID NO: 3208547 - DNA, 14 bp, Homo sapiens
agttgctgtcataa

SEQ ID NO: 3208548 - DNA, 14 bp, Homo sapiens
agttgctgtttatt

SEQ ID NO: 3208549 - DNA, 20 bp, Homo sapiens
agttggactaaatgcctagt

SEQ ID NO: 3208550 - DNA, 14 bp, Homo sapiens
agttggactctcag

SEQ ID NO: 3208551 - DNA, 15 bp, Homo sapiens
agttggactctcagg

SEQ ID NO: 3208552 - DNA, 13 bp, Homo sapiens
agttggactgggt

SEQ ID NO: 3208553 - DNA, 18 bp, Homo sapiens
agttggagtactatattt

SEQ ID NO: 3208554 - DNA, 14 bp, Homo sapiens
agttggcagagaag

SEQ ID NO: 3208555 - DNA, 21 bp, Homo sapiens
agttggcagagaaggcctctt

SEQ ID NO: 3208556 - DNA, 16 bp, Homo sapiens
agttggccagagagcc

SEQ ID NO: 3208557 - DNA, 19 bp, Homo sapiens
agttggcttctgtttctag

SEQ ID NO: 3208558 - DNA, 22 bp, Homo sapiens
agttggcttctgtttctagttg

SEQ ID NO: 3208559 - DNA, 23 bp, Homo sapiens
agttgggaacttcagatggacct

SEQ ID NO: 3208560 - DNA, 19 bp, Homo sapiens
agttgggcttcctcatagt

SEQ ID NO: 3208561 - DNA, 20 bp, Homo sapiens
agttggtaacttttgtgaat

SEQ ID NO: 3208562 - DNA, 14 bp, Homo sapiens
agttggtggggcca

SEQ ID NO: 3208563 - DNA, 13 bp, Homo sapiens
agttggtgtgttt

SEQ ID NO: 3208564 - DNA, 14 bp, Homo sapiens
agttggtttgtatg

SEQ ID NO: 3208565 - DNA, 18 bp, Homo sapiens
agttgtaaaaatgaaagt

SEQ ID NO: 3208566 - DNA, 13 bp, Homo sapiens
agttgtacaaatg

SEQ ID NO: 3208567 - DNA, 17 bp, Homo sapiens
agttgtacaaatgtatt

SEQ ID NO: 3208568 - DNA, 23 bp, Homo sapiens
agttgtagacaaagtacattctg

SEQ ID NO: 3208569 - DNA, 19 bp, Homo sapiens
agttgtcaagtctctgctg

SEQ ID NO: 3208570 - DNA, 20 bp, Homo sapiens
agttgtcctatggacaactt

SEQ ID NO: 3208571 - DNA, 21 bp, Homo sapiens
agttgtcctatggacaactta

SEQ ID NO: 3208572 - DNA, 18 bp, Homo sapiens
agttgtctattctgagcc

SEQ ID NO: 3208573 - DNA, 21 bp, Homo sapiens
agttgtctattctgagccttg

SEQ ID NO: 3208574 - DNA, 20 bp, Homo sapiens
agttgtgaaagaaagctgag

SEQ ID NO: 3208575 - DNA, 14 bp, Homo sapiens
agttgtgaaagttt

SEQ ID NO: 3208576 - DNA, 20 bp, Homo sapiens
agttgtgaaagttttgagta

SEQ ID NO: 3208577 - DNA, 22 bp, Homo sapiens
agttgtgagtttaccttgtata

SEQ ID NO: 3208578 - DNA, 18 bp, Homo sapiens
agttgtgccttttatagc

SEQ ID NO: 3208579 - DNA, 14 bp, Homo sapiens
agttgtgcttgagc

SEQ ID NO: 3208580 - DNA, 18 bp, Homo sapiens
agttgtggaaagcctctg

SEQ ID NO: 3208581 - DNA, 19 bp, Homo sapiens
agttgtgttcatgctgaat

SEQ ID NO: 3208582 - DNA, 21 bp, Homo sapiens
agttgtgttttttaagatggc

SEQ ID NO: 3208583 - DNA, 22 bp, Homo sapiens
agttgttaccaaatacacattt

SEQ ID NO: 3208584 - DNA, 17 bp, Homo sapiens
agttgttattgttgaac

SEQ ID NO: 3208585 - DNA, 17 bp, Homo sapiens
agttgttcaactatttt

SEQ ID NO: 3208586 - DNA, 18 bp, Homo sapiens
agttgttctttttagaaa

SEQ ID NO: 3208587 - DNA, 23 bp, Homo sapiens
agttgtttgaggcaaattaactg

SEQ ID NO: 3208588 - DNA, 14 bp, Homo sapiens
agtttaaaaaaatt

SEQ ID NO: 3208589 - DNA, 15 bp, Homo sapiens
agtttaaaaaaattg

SEQ ID NO: 3208590 - DNA, 13 bp, Homo sapiens
agtttaaaagcca

SEQ ID NO: 3208591 - DNA, 15 bp, Homo sapiens
agtttaaaagccatg

SEQ ID NO: 3208592 - DNA, 12 bp, Homo sapiens
agtttaacacaa

SEQ ID NO: 3208593 - DNA, 15 bp, Homo sapiens
agtttaatgtctcct

SEQ ID NO: 3208594 - DNA, 17 bp, Homo sapiens
agtttacaagtgtatat

SEQ ID NO: 3208595 - DNA, 21 bp, Homo sapiens
agtttacaagtgtatatcaga

SEQ ID NO: 3208596 - DNA, 23 bp, Homo sapiens
agtttacaagtgtatatcagaaa

SEQ ID NO: 3208597 - DNA, 20 bp, Homo sapiens
agtttaccagttgcctttta

SEQ ID NO: 3208598 - DNA, 16 bp, Homo sapiens
agtttacccggtttct

SEQ ID NO: 3208599 - DNA, 16 bp, Homo sapiens
agtttacctctttaaa

SEQ ID NO: 3208600 - DNA, 20 bp, Homo sapiens
agtttaccttgtatactgta

SEQ ID NO: 3208601 - DNA, 20 bp, Homo sapiens
agtttactagcttttcaaac

SEQ ID NO: 3208602 - DNA, 14 bp, Homo sapiens
agtttagatttcaa

SEQ ID NO: 3208603 - DNA, 20 bp, Homo sapiens
agtttagtgtgataaaggca

SEQ ID NO: 3208604 - DNA, 20 bp, Homo sapiens
agtttagtgtgtgtgcagag

SEQ ID NO: 3208605 - DNA, 15 bp, Homo sapiens
agtttatattctgaa

SEQ ID NO: 3208606 - DNA, 17 bp, Homo sapiens
agtttatccaaatcttg

SEQ ID NO: 3208607 - DNA, 18 bp, Homo sapiens
agtttattggaagtgttc

SEQ ID NO: 3208608 - DNA, 12 bp, Homo sapiens
agtttatttctc

SEQ ID NO: 3208609 - DNA, 17 bp, Homo sapiens
agtttattttgttacac

SEQ ID NO: 3208610 - DNA, 16 bp, Homo sapiens
agtttatttttaaaga

SEQ ID NO: 3208611 - DNA, 19 bp, Homo sapiens
agtttcaaacttactattt

SEQ ID NO: 3208612 - DNA, 12 bp, Homo sapiens
agtttcaaaggc

SEQ ID NO: 3208613 - DNA, 15 bp, Homo sapiens
agtttcaagttttaa

SEQ ID NO: 3208614 - DNA, 21 bp, Homo sapiens
agtttcaatgtagtctgtagc

SEQ ID NO: 3208615 - DNA, 15 bp, Homo sapiens
agtttcaatgtgatt

SEQ ID NO: 3208616 - DNA, 17 bp, Homo sapiens
agtttcacaggtcaata

SEQ ID NO: 3208617 - DNA, 15 bp, Homo sapiens
agtttcagacagggt

SEQ ID NO: 3208618 - DNA, 22 bp, Homo sapiens
agtttcagagaccttaatttat

SEQ ID NO: 3208619 - DNA, 17 bp, Homo sapiens
agtttcagagtatattg

SEQ ID NO: 3208620 - DNA, 14 bp, Homo sapiens
agtttcagatatat

SEQ ID NO: 3208621 - DNA, 15 bp, Homo sapiens
agtttcagcttaaaa

SEQ ID NO: 3208622 - DNA, 16 bp, Homo sapiens
agtttcaggtgacatg

SEQ ID NO: 3208623 - DNA, 21 bp, Homo sapiens
agtttcaggtgacatgtgaaa

SEQ ID NO: 3208624 - DNA, 18 bp, Homo sapiens
agtttcaggtgtttagtt

SEQ ID NO: 3208625 - DNA, 20 bp, Homo sapiens
agtttcagtattagatgcac

SEQ ID NO: 3208626 - DNA, 18 bp, Homo sapiens
agtttcagtttgttggaa

SEQ ID NO: 3208627 - DNA, 21 bp, Homo sapiens
agtttcatgaaatgattggaa

SEQ ID NO: 3208628 - DNA, 15 bp, Homo sapiens
agtttcattattctc

SEQ ID NO: 3208629 - DNA, 22 bp, Homo sapiens
agtttccgtttccaggtgttta

SEQ ID NO: 3208630 - DNA, 12 bp, Homo sapiens
agtttccttttt

SEQ ID NO: 3208631 - DNA, 20 bp, Homo sapiens
agtttcgtttctgtttttta

SEQ ID NO: 3208632 - DNA, 17 bp, Homo sapiens
agtttctaagattctaa

SEQ ID NO: 3208633 - DNA, 11 bp, Homo sapiens
agtttctaagg

SEQ ID NO: 3208634 - DNA, 16 bp, Homo sapiens
agtttctagaggcctc

SEQ ID NO: 3208635 - DNA, 18 bp, Homo sapiens
agtttctagaggcctcag

SEQ ID NO: 3208636 - DNA, 17 bp, Homo sapiens
agtttgaggctgcagcg

SEQ ID NO: 3208637 - DNA, 20 bp, Homo sapiens
agtttgatacagtattgaaa

SEQ ID NO: 3208638 - DNA, 17 bp, Homo sapiens
agtttgatcaaatctaa

SEQ ID NO: 3208639 - DNA, 16 bp, Homo sapiens
agtttgattattatgt

SEQ ID NO: 3208640 - DNA, 17 bp, Homo sapiens
agtttgattattatgtt

SEQ ID NO: 3208641 - DNA, 21 bp, Homo sapiens
agtttgattgaggagctgcac

SEQ ID NO: 3208642 - DNA, 22 bp, Homo sapiens
agtttgattgaggagctgcact

SEQ ID NO: 3208643 - DNA, 13 bp, Homo sapiens
agtttgatttttg

SEQ ID NO: 3208644 - DNA, 23 bp, Homo sapiens
agtttgatttttgtttttgtaat

SEQ ID NO: 3208645 - DNA, 22 bp, Homo sapiens
agtttgccggatacaaactggt

SEQ ID NO: 3208646 - DNA, 23 bp, Homo sapiens
agtttgctagcagaaatctagaa

SEQ ID NO: 3208647 - DNA, 18 bp, Homo sapiens
agtttgctgtactagaga

SEQ ID NO: 3208648 - DNA, 18 bp, Homo sapiens
agtttggattcttatgta

SEQ ID NO: 3208649 - DNA, 17 bp, Homo sapiens
agtttggcaatagtttg

SEQ ID NO: 3208650 - DNA, 15 bp, Homo sapiens
agtttggtatttgcg

SEQ ID NO: 3208651 - DNA, 16 bp, Homo sapiens
agtttggtttgacttg

SEQ ID NO: 3208652 - DNA, 15 bp, Homo sapiens
agtttgtacatgcat

SEQ ID NO: 3208653 - DNA, 18 bp, Homo sapiens
agtttgtacatgcattca

SEQ ID NO: 3208654 - DNA, 19 bp, Homo sapiens
agtttgtaggtaaaatgta

SEQ ID NO: 3208655 - DNA, 16 bp, Homo sapiens
agtttgtcctgtagag

SEQ ID NO: 3208656 - DNA, 17 bp, Homo sapiens
agtttgtgtgtatttgt

SEQ ID NO: 3208657 - DNA, 20 bp, Homo sapiens
agtttgtgtgtatttgtatt

SEQ ID NO: 3208658 - DNA, 21 bp, Homo sapiens
agtttgttctccgggtgtggc

SEQ ID NO: 3208659 - DNA, 20 bp, Homo sapiens
agtttgtttaatgtgaactt

SEQ ID NO: 3208660 - DNA, 18 bp, Homo sapiens
agttttaactagaattta

SEQ ID NO: 3208661 - DNA, 18 bp, Homo sapiens
agttttaactgtggatat

SEQ ID NO: 3208662 - DNA, 20 bp, Homo sapiens
agttttacacgaactgaaat

SEQ ID NO: 3208663 - DNA, 13 bp, Homo sapiens
agttttacagatt

SEQ ID NO: 3208664 - DNA, 20 bp, Homo sapiens
agttttacagattgcctcct

SEQ ID NO: 3208665 - DNA, 21 bp, Homo sapiens
agttttacagattgcctcctt

SEQ ID NO: 3208666 - DNA, 17 bp, Homo sapiens
agttttagaataaggag

SEQ ID NO: 3208667 - DNA, 20 bp, Homo sapiens
agttttagggtacagtttgg

SEQ ID NO: 3208668 - DNA, 15 bp, Homo sapiens
agttttagttttctc

SEQ ID NO: 3208669 - DNA, 14 bp, Homo sapiens
agttttatatgctt

SEQ ID NO: 3208670 - DNA, 16 bp, Homo sapiens
agttttatatgcttta

SEQ ID NO: 3208671 - DNA, 13 bp, Homo sapiens
agttttatcattt

SEQ ID NO: 3208672 - DNA, 20 bp, Homo sapiens
agttttatcattttcaaaat

SEQ ID NO: 3208673 - DNA, 21 bp, Homo sapiens
agttttatgctcttttttact

SEQ ID NO: 3208674 - DNA, 21 bp, Homo sapiens
agttttcaagtcaaattaata

SEQ ID NO: 3208675 - DNA, 21 bp, Homo sapiens
agttttcagctgctcagaatt

SEQ ID NO: 3208676 - DNA, 15 bp, Homo sapiens
agttttcattaaatc

SEQ ID NO: 3208677 - DNA, 18 bp, Homo sapiens
agttttccagtattgaaa

SEQ ID NO: 3208678 - DNA, 13 bp, Homo sapiens
agttttcccctgg

SEQ ID NO: 3208679 - DNA, 17 bp, Homo sapiens
agttttctcctcccagg

SEQ ID NO: 3208680 - DNA, 17 bp, Homo sapiens
agttttctccttttact

SEQ ID NO: 3208681 - DNA, 21 bp, Homo sapiens
agttttctctttgtggggctt

SEQ ID NO: 3208682 - DNA, 12 bp, Homo sapiens
agttttctttag

SEQ ID NO: 3208683 - DNA, 22 bp, Homo sapiens
agttttctttgcttatgttgaa

SEQ ID NO: 3208684 - DNA, 12 bp, Homo sapiens
agttttgaaaag

SEQ ID NO: 3208685 - DNA, 16 bp, Homo sapiens
agttttgaaaagctat

SEQ ID NO: 3208686 - DNA, 15 bp, Homo sapiens
agttttgaaagaaaa

SEQ ID NO: 3208687 - DNA, 21 bp, Homo sapiens
agttttgatgaaattcttgaa

SEQ ID NO: 3208688 - DNA, 18 bp, Homo sapiens
agttttgatgtgtgggct

SEQ ID NO: 3208689 - DNA, 20 bp, Homo sapiens
agttttgattttggaaagat

SEQ ID NO: 3208690 - DNA, 15 bp, Homo sapiens
agttttggcagccag

SEQ ID NO: 3208691 - DNA, 22 bp, Homo sapiens
agttttgtacaaagttttcctt

SEQ ID NO: 3208692 - DNA, 17 bp, Homo sapiens
agttttgtataaataat

SEQ ID NO: 3208693 - DNA, 23 bp, Homo sapiens
agttttgtttggtttactttcaa

SEQ ID NO: 3208694 - DNA, 17 bp, Homo sapiens
agtttttacctaccaca

SEQ ID NO: 3208695 - DNA, 16 bp, Homo sapiens
agtttttatggttcca

SEQ ID NO: 3208696 - DNA, 20 bp, Homo sapiens
agtttttcaggagcgcaaga

SEQ ID NO: 3208697 - DNA, 23 bp, Homo sapiens
agtttttcatttgttttgctttt

SEQ ID NO: 3208698 - DNA, 15 bp, Homo sapiens
agtttttcattttaa

SEQ ID NO: 3208699 - DNA, 22 bp, Homo sapiens
agtttttctgttttgtttggca

SEQ ID NO: 3208700 - DNA, 23 bp, Homo sapiens
agtttttctgttttgtttggcaa

SEQ ID NO: 3208701 - DNA, 14 bp, Homo sapiens
agtttttgaaatac

SEQ ID NO: 3208702 - DNA, 15 bp, Homo sapiens
agtttttgtatcttg

SEQ ID NO: 3208703 - DNA, 17 bp, Homo sapiens
agttttttattatgcat

SEQ ID NO: 3208704 - DNA, 21 bp, Homo sapiens
agtttttttcatttttttgaa

SEQ ID NO: 3208705 - DNA, 14 bp, Homo sapiens
agttttttttgtaa

SEQ ID NO: 3208706 - DNA, 14 bp, Homo sapiens
agttttttttttct

SEQ ID NO: 3208707 - DNA, 17 bp, Homo sapiens
ataaaaaaacaatcatt

SEQ ID NO: 3208708 - DNA, 13 bp, Homo sapiens
ataaaaaatagac

SEQ ID NO: 3208709 - DNA, 14 bp, Homo sapiens
ataaaaaatagaca

SEQ ID NO: 3208710 - DNA, 17 bp, Homo sapiens
ataaaaaatctgaagag

SEQ ID NO: 3208711 - DNA, 15 bp, Homo sapiens
ataaaaaatgtaaca

SEQ ID NO: 3208712 - DNA, 16 bp, Homo sapiens
ataaaaaatgtaacat

SEQ ID NO: 3208713 - DNA, 17 bp, Homo sapiens
ataaaaaatgtaacatc

SEQ ID NO: 3208714 - DNA, 13 bp, Homo sapiens
ataaaaaattatg

SEQ ID NO: 3208715 - DNA, 18 bp, Homo sapiens
ataaaaacccacaaaaat

SEQ ID NO: 3208716 - DNA, 12 bp, Homo sapiens
ataaaaactaaa

SEQ ID NO: 3208717 - DNA, 16 bp, Homo sapiens
ataaaaactaaattgt

SEQ ID NO: 3208718 - DNA, 18 bp, Homo sapiens
ataaaaactaaattgtaa

SEQ ID NO: 3208719 - DNA, 17 bp, Homo sapiens
ataaaaactaatttcat

SEQ ID NO: 3208720 - DNA, 13 bp, Homo sapiens
ataaaaacttgaa

SEQ ID NO: 3208721 - DNA, 19 bp, Homo sapiens
ataaaaagataatctcagt

SEQ ID NO: 3208722 - DNA, 12 bp, Homo sapiens
ataaaaagcaaa

SEQ ID NO: 3208723 - DNA, 18 bp, Homo sapiens
ataaaaagcagaatttta

SEQ ID NO: 3208724 - DNA, 20 bp, Homo sapiens
ataaaaagcctgcaatttca

SEQ ID NO: 3208725 - DNA, 15 bp, Homo sapiens
ataaaaagcgctgca

SEQ ID NO: 3208726 - DNA, 20 bp, Homo sapiens
ataaaaagtgacacagcagc

SEQ ID NO: 3208727 - DNA, 11 bp, Homo sapiens
ataaaaagttc

SEQ ID NO: 3208728 - DNA, 22 bp, Homo sapiens
ataaaaataaatttggttctaa

SEQ ID NO: 3208729 - DNA, 22 bp, Homo sapiens
ataaaaatattgtgttgtgaat

SEQ ID NO: 3208730 - DNA, 22 bp, Homo sapiens
ataaaacattatgctccagaaa

SEQ ID NO: 3208731 - DNA, 11 bp, Homo sapiens
ataaaaccttt

SEQ ID NO: 3208732 - DNA, 11 bp, Homo sapiens
ataaaactgaa

SEQ ID NO: 3208733 - DNA, 19 bp, Homo sapiens
ataaaacttatgctagttt

SEQ ID NO: 3208734 - DNA, 17 bp, Homo sapiens
ataaaagataaattatt

SEQ ID NO: 3208735 - DNA, 18 bp, Homo sapiens
ataaaagggcaaatctgc

SEQ ID NO: 3208736 - DNA, 20 bp, Homo sapiens
ataaaagggggtccgtggaa

SEQ ID NO: 3208737 - DNA, 23 bp, Homo sapiens
ataaaaggtttctttttttttcc

SEQ ID NO: 3208738 - DNA, 22 bp, Homo sapiens
ataaaagtgatcaataaaatgt

SEQ ID NO: 3208739 - DNA, 16 bp, Homo sapiens
ataaaataaagtatat

SEQ ID NO: 3208740 - DNA, 17 bp, Homo sapiens
ataaaataactaaaatg

SEQ ID NO: 3208741 - DNA, 22 bp, Homo sapiens
ataaaatactctagcctgggcc

SEQ ID NO: 3208742 - DNA, 20 bp, Homo sapiens
ataaaatcctaagacacaaa

SEQ ID NO: 3208743 - DNA, 11 bp, Homo sapiens
ataaaatctgt

SEQ ID NO: 3208744 - DNA, 19 bp, Homo sapiens
ataaaatgaggacatgttt

SEQ ID NO: 3208745 - DNA, 21 bp, Homo sapiens
ataaaatggacacaaattttc

SEQ ID NO: 3208746 - DNA, 13 bp, Homo sapiens
ataaaatgtgatt

SEQ ID NO: 3208747 - DNA, 14 bp, Homo sapiens
ataaaatgtgtaca

SEQ ID NO: 3208748 - DNA, 19 bp, Homo sapiens
ataaaatgtgtacagtgaa

SEQ ID NO: 3208749 - DNA, 14 bp, Homo sapiens
agtgctggctcaca

SEQ ID NO: 3208750 - DNA, 21 bp, Homo sapiens
agtgctggctcacagtacagc

SEQ ID NO: 3208751 - DNA, 18 bp, Homo sapiens
agtgctgggaccagagcc

SEQ ID NO: 3208752 - DNA, 19 bp, Homo sapiens
agtgctgggattacaggct

SEQ ID NO: 3208753 - DNA, 21 bp, Homo sapiens
agtgctgtacccttccacctc

SEQ ID NO: 3208754 - DNA, 19 bp, Homo sapiens
agtgctgtccatgcttctc

SEQ ID NO: 3208755 - DNA, 22 bp, Homo sapiens
agtgctgtccatgcttctcatc

SEQ ID NO: 3208756 - DNA, 18 bp, Homo sapiens
agtgctgtcttgatgact

SEQ ID NO: 3208757 - DNA, 23 bp, Homo sapiens
agtgctgtcttgatgactgctga

SEQ ID NO: 3208758 - DNA, 14 bp, Homo sapiens
agtgctgtggcctg

SEQ ID NO: 3208759 - DNA, 16 bp, Homo sapiens
agtgctgtggcctggg

SEQ ID NO: 3208760 - DNA, 18 bp, Homo sapiens
agtgctgtggcctgggca

SEQ ID NO: 3208761 - DNA, 17 bp, Homo sapiens
agtgcttaaaaatcatt

SEQ ID NO: 3208762 - DNA, 23 bp, Homo sapiens
agtgcttcagagtttgtgtgtat

SEQ ID NO: 3208763 - DNA, 16 bp, Homo sapiens
agtgcttcagcctgag

SEQ ID NO: 3208764 - DNA, 14 bp, Homo sapiens
agtgcttctctaca

SEQ ID NO: 3208765 - DNA, 14 bp, Homo sapiens
agtgcttcttacta

SEQ ID NO: 3208766 - DNA, 19 bp, Homo sapiens
agtgcttgttagagagaaa

SEQ ID NO: 3208767 - DNA, 19 bp, Homo sapiens
agtgctttacatgctgtgc

SEQ ID NO: 3208768 - DNA, 13 bp, Homo sapiens
agtgctttgtaat

SEQ ID NO: 3208769 - DNA, 20 bp, Homo sapiens
agtgcttttttttttttgac

SEQ ID NO: 3208770 - DNA, 15 bp, Homo sapiens
agtggaaaaaagaga

SEQ ID NO: 3208771 - DNA, 20 bp, Homo sapiens
agtggaaaaaagagaaaaac

SEQ ID NO: 3208772 - DNA, 23 bp, Homo sapiens
agtggaaaaaagagaaaaaccaa

SEQ ID NO: 3208773 - DNA, 13 bp, Homo sapiens
agtggaaaacaaa

SEQ ID NO: 3208774 - DNA, 14 bp, Homo sapiens
agtggaaaacaaag

SEQ ID NO: 3208775 - DNA, 24 bp, Homo sapiens
agtggaacgaaaatgaaagctact

SEQ ID NO: 3208776 - DNA, 13 bp, Homo sapiens
agtggaagaaaca

SEQ ID NO: 3208777 - DNA, 14 bp, Homo sapiens
agtggaagagcagc

SEQ ID NO: 3208778 - DNA, 17 bp, Homo sapiens
agtggaagagcagcctg

SEQ ID NO: 3208779 - DNA, 20 bp, Homo sapiens
agtggaagagcagcctgatg

SEQ ID NO: 3208780 - DNA, 22 bp, Homo sapiens
agtggaagagcagcctgatggc

SEQ ID NO: 3208781 - DNA, 16 bp, Homo sapiens
agtggaaggactgtgg

SEQ ID NO: 3208782 - DNA, 21 bp, Homo sapiens
agtggaagtgcttgatatgta

SEQ ID NO: 3208783 - DNA, 22 bp, Homo sapiens
agtggaatagtgaatacttact

SEQ ID NO: 3208784 - DNA, 17 bp, Homo sapiens
agtggaatgcagggaag

SEQ ID NO: 3208785 - DNA, 20 bp, Homo sapiens
agtggaatgcagggaagagg

SEQ ID NO: 3208786 - DNA, 19 bp, Homo sapiens
agtggacaaattttgagtt

SEQ ID NO: 3208787 - DNA, 17 bp, Homo sapiens
agtggaccttaggcctt

SEQ ID NO: 3208788 - DNA, 14 bp, Homo sapiens
agtggactcagcag

SEQ ID NO: 3208789 - DNA, 17 bp, Homo sapiens
agtggactcagcagtga

SEQ ID NO: 3208790 - DNA, 16 bp, Homo sapiens
agtggagaattatata

SEQ ID NO: 3208791 - DNA, 12 bp, Homo sapiens
agtggagacagt

SEQ ID NO: 3208792 - DNA, 15 bp, Homo sapiens
agtggagacagtcct

SEQ ID NO: 3208793 - DNA, 14 bp, Homo sapiens
agtggaggtttgtc

SEQ ID NO: 3208794 - DNA, 15 bp, Homo sapiens
agtggagtatttgga

SEQ ID NO: 3208795 - DNA, 23 bp, Homo sapiens
agtggatcccctgcggtcaggct

SEQ ID NO: 3208796 - DNA, 14 bp, Homo sapiens
agtggatcttcaga

SEQ ID NO: 3208797 - DNA, 19 bp, Homo sapiens
agtggatcttcagaactgc

SEQ ID NO: 3208798 - DNA, 17 bp, Homo sapiens
agtggatgggaatttgt

SEQ ID NO: 3208799 - DNA, 21 bp, Homo sapiens
agtggatgtttttaatgacca

SEQ ID NO: 3208800 - DNA, 21 bp, Homo sapiens
agtggcaagaccaaaatgaca

SEQ ID NO: 3208801 - DNA, 12 bp, Homo sapiens
agtggcagccat

SEQ ID NO: 3208802 - DNA, 17 bp, Homo sapiens
agtggcagccatgcctc

SEQ ID NO: 3208803 - DNA, 14 bp, Homo sapiens
agtggcagctgctt

SEQ ID NO: 3208804 - DNA, 14 bp, Homo sapiens
agtggcaggggagc

SEQ ID NO: 3208805 - DNA, 19 bp, Homo sapiens
agtggccagccagtgccat

SEQ ID NO: 3208806 - DNA, 14 bp, Homo sapiens
agtggcctccctgc

SEQ ID NO: 3208807 - DNA, 23 bp, Homo sapiens
agtggcctgctaaggctcctcct

SEQ ID NO: 3208808 - DNA, 13 bp, Homo sapiens
agtggcctggcca

SEQ ID NO: 3208809 - DNA, 15 bp, Homo sapiens
agtggcctggccagg

SEQ ID NO: 3208810 - DNA, 19 bp, Homo sapiens
agtggcctggccaggagct

SEQ ID NO: 3208811 - DNA, 22 bp, Homo sapiens
agtggcctggccaggagctctt

SEQ ID NO: 3208812 - DNA, 17 bp, Homo sapiens
agtggctcctcccggtg

SEQ ID NO: 3208813 - DNA, 12 bp, Homo sapiens
agtggctgggtg

SEQ ID NO: 3208814 - DNA, 17 bp, Homo sapiens
agtggctggtccagggc

SEQ ID NO: 3208815 - DNA, 18 bp, Homo sapiens
agtggctggtccagggct

SEQ ID NO: 3208816 - DNA, 19 bp, Homo sapiens
agtggctggtccagggcta

SEQ ID NO: 3208817 - DNA, 18 bp, Homo sapiens
agtggcttcccagctctg

SEQ ID NO: 3208818 - DNA, 20 bp, Homo sapiens
agtggcttcttttgaactgt

SEQ ID NO: 3208819 - DNA, 12 bp, Homo sapiens
agtggcttttca

SEQ ID NO: 3208820 - DNA, 15 bp, Homo sapiens
agtgggaagtgaatc

SEQ ID NO: 3208821 - DNA, 15 bp, Homo sapiens
agtgggacagcccag

SEQ ID NO: 3208822 - DNA, 22 bp, Homo sapiens
agtgggacagcccagagcctgg

SEQ ID NO: 3208823 - DNA, 18 bp, Homo sapiens
agtgggacccatagatct

SEQ ID NO: 3208824 - DNA, 21 bp, Homo sapiens
agtgggacccatagatcttct

SEQ ID NO: 3208825 - DNA, 15 bp, Homo sapiens
agtgggagaaggcag

SEQ ID NO: 3208826 - DNA, 16 bp, Homo sapiens
agtgggagctgagctg

SEQ ID NO: 3208827 - DNA, 14 bp, Homo sapiens
agtgggagctgcct

SEQ ID NO: 3208828 - DNA, 16 bp, Homo sapiens
agtgggagctgcctgt

SEQ ID NO: 3208829 - DNA, 12 bp, Homo sapiens
agtgggaggggc

SEQ ID NO: 3208830 - DNA, 16 bp, Homo sapiens
agtgggaggggcaggc

SEQ ID NO: 3208831 - DNA, 18 bp, Homo sapiens
agtgggaggggcaggctg

SEQ ID NO: 3208832 - DNA, 16 bp, Homo sapiens
agtgggcacctcagaa

SEQ ID NO: 3208833 - DNA, 20 bp, Homo sapiens
agtgggcagagcccccagga

SEQ ID NO: 3208834 - DNA, 19 bp, Homo sapiens
agtgggcagaggtggcgcc

SEQ ID NO: 3208835 - DNA, 19 bp, Homo sapiens
agtgggccccgggctggag

SEQ ID NO: 3208836 - DNA, 19 bp, Homo sapiens
agtgggccctccgacagcc

SEQ ID NO: 3208837 - DNA, 23 bp, Homo sapiens
agtggggagcagttttcccctgg

SEQ ID NO: 3208838 - DNA, 15 bp, Homo sapiens
ataatatttctgaaa

SEQ ID NO: 3208839 - DNA, 14 bp, Homo sapiens
ataatcaaatgatt

SEQ ID NO: 3208840 - DNA, 12 bp, Homo sapiens
ataatcaagatt

SEQ ID NO: 3208841 - DNA, 13 bp, Homo sapiens
ataatcaagattt

SEQ ID NO: 3208842 - DNA, 14 bp, Homo sapiens
ataatcaagatttt

SEQ ID NO: 3208843 - DNA, 22 bp, Homo sapiens
ataatcactctaattaattgta

SEQ ID NO: 3208844 - DNA, 16 bp, Homo sapiens
ataatcagtgactgaa

SEQ ID NO: 3208845 - DNA, 23 bp, Homo sapiens
ataatcagtgactgaaaccattt

SEQ ID NO: 3208846 - DNA, 23 bp, Homo sapiens
ataatcattagttttagaggcat

SEQ ID NO: 3208847 - DNA, 17 bp, Homo sapiens
ataatcccagcactttg

SEQ ID NO: 3208848 - DNA, 15 bp, Homo sapiens
ataatccttctgcaa

SEQ ID NO: 3208849 - DNA, 18 bp, Homo sapiens
ataatcgactcaaaaata

SEQ ID NO: 3208850 - DNA, 23 bp, Homo sapiens
ataatctagtttacagaaaaatc

SEQ ID NO: 3208851 - DNA, 18 bp, Homo sapiens
ataatctcaaaggagaaa

SEQ ID NO: 3208852 - DNA, 21 bp, Homo sapiens
ataatctcaaaggagaaaaaa

SEQ ID NO: 3208853 - DNA, 12 bp, Homo sapiens
ataatctgtcaa

SEQ ID NO: 3208854 - DNA, 17 bp, Homo sapiens
ataatctgtcaaaacac

SEQ ID NO: 3208855 - DNA, 20 bp, Homo sapiens
ataatctgtttttacgtatg

SEQ ID NO: 3208856 - DNA, 17 bp, Homo sapiens
ataatcttgtagacact

SEQ ID NO: 3208857 - DNA, 22 bp, Homo sapiens
ataatcttgtagacacttactt

SEQ ID NO: 3208858 - DNA, 13 bp, Homo sapiens
ataatgaacccat

SEQ ID NO: 3208859 - DNA, 15 bp, Homo sapiens
ataatgaataaactg

SEQ ID NO: 3208860 - DNA, 16 bp, Homo sapiens
ataatgaataaactga

SEQ ID NO: 3208861 - DNA, 15 bp, Homo sapiens
ataatgaatactttc

SEQ ID NO: 3208862 - DNA, 17 bp, Homo sapiens
ataatgaggagtttatg

SEQ ID NO: 3208863 - DNA, 18 bp, Homo sapiens
ataatgaggagtttatga

SEQ ID NO: 3208864 - DNA, 16 bp, Homo sapiens
ataatgatgatgatga

SEQ ID NO: 3208865 - DNA, 14 bp, Homo sapiens
ataatgcaatcaaa

SEQ ID NO: 3208866 - DNA, 14 bp, Homo sapiens
ataatgctacaatt

SEQ ID NO: 3208867 - DNA, 15 bp, Homo sapiens
ataatgctactgtct

SEQ ID NO: 3208868 - DNA, 17 bp, Homo sapiens
ataatgcttaatttcta

SEQ ID NO: 3208869 - DNA, 16 bp, Homo sapiens
ataatggaaaatgcca

SEQ ID NO: 3208870 - DNA, 17 bp, Homo sapiens
ataatggtcccatccag

SEQ ID NO: 3208871 - DNA, 20 bp, Homo sapiens
ataatggtcccatccaggca

SEQ ID NO: 3208872 - DNA, 18 bp, Homo sapiens
ataatggtgaatgttcaa

SEQ ID NO: 3208873 - DNA, 15 bp, Homo sapiens
ataatgtaagctcta

SEQ ID NO: 3208874 - DNA, 16 bp, Homo sapiens
ataatgtgaaatatga

SEQ ID NO: 3208875 - DNA, 13 bp, Homo sapiens
ataatgtgtgtat

SEQ ID NO: 3208876 - DNA, 16 bp, Homo sapiens
ataatgtgtgtatgtg

SEQ ID NO: 3208877 - DNA, 12 bp, Homo sapiens
ataatgttaaat

SEQ ID NO: 3208878 - DNA, 19 bp, Homo sapiens
ataatgttaaatttgtaag

SEQ ID NO: 3208879 - DNA, 12 bp, Homo sapiens
ataatgttaaca

SEQ ID NO: 3208880 - DNA, 14 bp, Homo sapiens
ataatgttgttatt

SEQ ID NO: 3208881 - DNA, 20 bp, Homo sapiens
ataatgtttaaatcatgtat

SEQ ID NO: 3208882 - DNA, 19 bp, Homo sapiens
ataatgtttaatattgaga

SEQ ID NO: 3208883 - DNA, 16 bp, Homo sapiens
ataatgtttattaaat

SEQ ID NO: 3208884 - DNA, 17 bp, Homo sapiens
ataatgtttattaaatg

SEQ ID NO: 3208885 - DNA, 19 bp, Homo sapiens
ataatgtttattaaatgct

SEQ ID NO: 3208886 - DNA, 14 bp, Homo sapiens
ataatgtttttcct

SEQ ID NO: 3208887 - DNA, 15 bp, Homo sapiens
ataatgtttttcctt

SEQ ID NO: 3208888 - DNA, 23 bp, Homo sapiens
ataattaaaaaccactgaacatt

SEQ ID NO: 3208889 - DNA, 14 bp, Homo sapiens
ataattaaacttct

SEQ ID NO: 3208890 - DNA, 16 bp, Homo sapiens
ataattacattcctaa

SEQ ID NO: 3208891 - DNA, 18 bp, Homo sapiens
ataattacattcctaact

SEQ ID NO: 3208892 - DNA, 18 bp, Homo sapiens
ataattatgacagttata

SEQ ID NO: 3208893 - DNA, 22 bp, Homo sapiens
ataattatttattacataattt

SEQ ID NO: 3208894 - DNA, 22 bp, Homo sapiens
ataattcactcaagcactgata

SEQ ID NO: 3208895 - DNA, 16 bp, Homo sapiens
ataattcatttgtatt

SEQ ID NO: 3208896 - DNA, 17 bp, Homo sapiens
ataattccctatctttt

SEQ ID NO: 3208897 - DNA, 13 bp, Homo sapiens
ataattgcatcta

SEQ ID NO: 3208898 - DNA, 16 bp, Homo sapiens
ataattggtgctattt

SEQ ID NO: 3208899 - DNA, 19 bp, Homo sapiens
ataattggtgctatttgaa

SEQ ID NO: 3208900 - DNA, 20 bp, Homo sapiens
ataattggtgctatttgaag

SEQ ID NO: 3208901 - DNA, 24 bp, Homo sapiens
ataattgtacaaaattaagcaaat

SEQ ID NO: 3208902 - DNA, 12 bp, Homo sapiens
ataattgtttcc

SEQ ID NO: 3208903 - DNA, 12 bp, Homo sapiens
ataatttaagag

SEQ ID NO: 3208904 - DNA, 13 bp, Homo sapiens
ataatttacctaa

SEQ ID NO: 3208905 - DNA, 20 bp, Homo sapiens
ataatttatttccactaaaa

SEQ ID NO: 3208906 - DNA, 18 bp, Homo sapiens
ataatttcccaattagga

SEQ ID NO: 3208907 - DNA, 23 bp, Homo sapiens
ataatttctactctgtcttaaat

SEQ ID NO: 3208908 - DNA, 12 bp, Homo sapiens
ataatttgaaaa

SEQ ID NO: 3208909 - DNA, 18 bp, Homo sapiens
ataatttgcatattctat

SEQ ID NO: 3208910 - DNA, 21 bp, Homo sapiens
ataatttgcatattctattgt

SEQ ID NO: 3208911 - DNA, 15 bp, Homo sapiens
ataattttaaacaaa

SEQ ID NO: 3208912 - DNA, 15 bp, Homo sapiens
ataattttatgaatg

SEQ ID NO: 3208913 - DNA, 19 bp, Homo sapiens
ataattttattagaataat

SEQ ID NO: 3208914 - DNA, 14 bp, Homo sapiens
ataattttctgaaa

SEQ ID NO: 3208915 - DNA, 15 bp, Homo sapiens
ataattttctgaaag

SEQ ID NO: 3208916 - DNA, 17 bp, Homo sapiens
ataattttcttcatgca

SEQ ID NO: 3208917 - DNA, 13 bp, Homo sapiens
ataattttgcata

SEQ ID NO: 3208918 - DNA, 15 bp, Homo sapiens
ataattttgcatact

SEQ ID NO: 3208919 - DNA, 20 bp, Homo sapiens
ataatttttttcaatattta

SEQ ID NO: 3208920 - DNA, 21 bp, Homo sapiens
ataatttttttcaatatttat

SEQ ID NO: 3208921 - DNA, 16 bp, Homo sapiens
ataattttttttaaag

SEQ ID NO: 3208922 - DNA, 19 bp, Homo sapiens
atacaaaaaattagccaag

SEQ ID NO: 3208923 - DNA, 23 bp, Homo sapiens
atacaaaagagcatggatgcatt

SEQ ID NO: 3208924 - DNA, 16 bp, Homo sapiens
atacaaaataaaactg

SEQ ID NO: 3208925 - DNA, 12 bp, Homo sapiens
atacaaagtaaa

SEQ ID NO: 3208926 - DNA, 18 bp, Homo sapiens
atacaaagtaaatacaag

SEQ ID NO: 3208927 - DNA, 21 bp, Homo sapiens
atacaaagtaaatacaagact

SEQ ID NO: 3208928 - DNA, 17 bp, Homo sapiens
atacaaatataaatctt

SEQ ID NO: 3208929 - DNA, 16 bp, Homo sapiens
atacaaatatattgtt

SEQ ID NO: 3208930 - DNA, 13 bp, Homo sapiens
atacaaatggatt

SEQ ID NO: 3208931 - DNA, 14 bp, Homo sapiens
atacaaatggattt

SEQ ID NO: 3208932 - DNA, 19 bp, Homo sapiens
atacaaattttcagaaggt

SEQ ID NO: 3208933 - DNA, 18 bp, Homo sapiens
atacaacagaaaccagaa

SEQ ID NO: 3208934 - DNA, 16 bp, Homo sapiens
atacaacctccctctt

SEQ ID NO: 3208935 - DNA, 18 bp, Homo sapiens
atacaacctccctcttgt

SEQ ID NO: 3208936 - DNA, 21 bp, Homo sapiens
atacaacctccctcttgtttt

SEQ ID NO: 3208937 - DNA, 23 bp, Homo sapiens
atacaacctccctcttgttttgt

SEQ ID NO: 3208938 - DNA, 19 bp, Homo sapiens
atacaagactgttgtgatc

SEQ ID NO: 3208939 - DNA, 12 bp, Homo sapiens
atacaaggcaag

SEQ ID NO: 3208940 - DNA, 18 bp, Homo sapiens
atacaagtttcagacagg

SEQ ID NO: 3208941 - DNA, 15 bp, Homo sapiens
atacaatatcatcca

SEQ ID NO: 3208942 - DNA, 18 bp, Homo sapiens
atacaatgaacacttata

SEQ ID NO: 3208943 - DNA, 11 bp, Homo sapiens
atacaattaaa

SEQ ID NO: 3208944 - DNA, 22 bp, Homo sapiens
atacaattaaaggtcctgccct

SEQ ID NO: 3208945 - DNA, 23 bp, Homo sapiens
atacaattaaaggtcctgccctc

SEQ ID NO: 3208946 - DNA, 15 bp, Homo sapiens
atacaattctacatt

SEQ ID NO: 3208947 - DNA, 18 bp, Homo sapiens
atacaatttttatttctt

SEQ ID NO: 3208948 - DNA, 15 bp, Homo sapiens
atacacaatcctcca

SEQ ID NO: 3208949 - DNA, 14 bp, Homo sapiens
atacacacacacac

SEQ ID NO: 3208950 - DNA, 20 bp, Homo sapiens
atacacaccctgcccctgca

SEQ ID NO: 3208951 - DNA, 14 bp, Homo sapiens
atacacatatacct

SEQ ID NO: 3208952 - DNA, 14 bp, Homo sapiens
atacacatttcaca

SEQ ID NO: 3208953 - DNA, 18 bp, Homo sapiens
atacaccgggcctggaga

SEQ ID NO: 3208954 - DNA, 12 bp, Homo sapiens
atacactaatga

SEQ ID NO: 3208955 - DNA, 21 bp, Homo sapiens
atacactaatgagtatttggt

SEQ ID NO: 3208956 - DNA, 22 bp, Homo sapiens
atacactaatgagtatttggta

SEQ ID NO: 3208957 - DNA, 21 bp, Homo sapiens
atacactatgaagatgtttca

SEQ ID NO: 3208958 - DNA, 22 bp, Homo sapiens
atacacttattggaactctgct

SEQ ID NO: 3208959 - DNA, 20 bp, Homo sapiens
atacacttcttttgaacatc

SEQ ID NO: 3208960 - DNA, 19 bp, Homo sapiens
atacacttgtataaatgta

SEQ ID NO: 3208961 - DNA, 17 bp, Homo sapiens
atacacttttttccaaa

SEQ ID NO: 3208962 - DNA, 16 bp, Homo sapiens
atacagaaatgcaaaa

SEQ ID NO: 3208963 - DNA, 18 bp, Homo sapiens
atacagaatcttgttttg

SEQ ID NO: 3208964 - DNA, 12 bp, Homo sapiens
atacagacacta

SEQ ID NO: 3208965 - DNA, 15 bp, Homo sapiens
atacagatgaaaatt

SEQ ID NO: 3208966 - DNA, 14 bp, Homo sapiens
atacaggaaaagct

SEQ ID NO: 3208967 - DNA, 20 bp, Homo sapiens
atacaggaaaagctgctgac

SEQ ID NO: 3208968 - DNA, 22 bp, Homo sapiens
atacaggaaaagctgctgacag

SEQ ID NO: 3208969 - DNA, 23 bp, Homo sapiens
atacaggaaaagctgctgacagt

SEQ ID NO: 3208970 - DNA, 11 bp, Homo sapiens
atacaggtgct

SEQ ID NO: 3208971 - DNA, 18 bp, Homo sapiens
atacagtaactttatgtg

SEQ ID NO: 3208972 - DNA, 13 bp, Homo sapiens
atacagtaagcat

SEQ ID NO: 3208973 - DNA, 12 bp, Homo sapiens
atacagtgcctt

SEQ ID NO: 3208974 - DNA, 13 bp, Homo sapiens
atacagtgccttg

SEQ ID NO: 3208975 - DNA, 22 bp, Homo sapiens
atacagttaggcaccagaagaa

SEQ ID NO: 3208976 - DNA, 12 bp, Homo sapiens
atacagttattt

SEQ ID NO: 3208977 - DNA, 20 bp, Homo sapiens
atacagttattttggatata

SEQ ID NO: 3208978 - DNA, 22 bp, Homo sapiens
atacagttattttggatatatt

SEQ ID NO: 3208979 - DNA, 19 bp, Homo sapiens
atacagttttatgctcttt

SEQ ID NO: 3208980 - DNA, 13 bp, Homo sapiens
atacagttttcta

SEQ ID NO: 3208981 - DNA, 15 bp, Homo sapiens
atacataactaaatt

SEQ ID NO: 3208982 - DNA, 21 bp, Homo sapiens
atacataactaaatttgatac

SEQ ID NO: 3208983 - DNA, 21 bp, Homo sapiens
atacataatgtttttcctttc

SEQ ID NO: 3208984 - DNA, 19 bp, Homo sapiens
atacatacacttgtataaa

SEQ ID NO: 3208985 - DNA, 20 bp, Homo sapiens
atacatacggtcaggtttaa

SEQ ID NO: 3208986 - DNA, 21 bp, Homo sapiens
atacatatcgctgacttcatg

SEQ ID NO: 3208987 - DNA, 18 bp, Homo sapiens
atacatatgtagactata

SEQ ID NO: 3208988 - DNA, 22 bp, Homo sapiens
atacatatgtagactatataca

SEQ ID NO: 3208989 - DNA, 12 bp, Homo sapiens
atacatcactgc

SEQ ID NO: 3208990 - DNA, 15 bp, Homo sapiens
atacatcactgcttg

SEQ ID NO: 3208991 - DNA, 14 bp, Homo sapiens
atacatcctgggta

SEQ ID NO: 3208992 - DNA, 15 bp, Homo sapiens
atacatcctgggtaa

SEQ ID NO: 3208993 - DNA, 17 bp, Homo sapiens
atacatgccacatcaaa

SEQ ID NO: 3208994 - DNA, 12 bp, Homo sapiens
atacatgtgtgt

SEQ ID NO: 3208995 - DNA, 22 bp, Homo sapiens
atacatgtgtgtatatatgtgt

SEQ ID NO: 3208996 - DNA, 23 bp, Homo sapiens
atacatgtgtgtatatatgtgta

SEQ ID NO: 3208997 - DNA, 14 bp, Homo sapiens
atacattaaaacta

SEQ ID NO: 3208998 - DNA, 15 bp, Homo sapiens
atacattaaaactag

SEQ ID NO: 3208999 - DNA, 17 bp, Homo sapiens
atacattgtgtgaaaaa

SEQ ID NO: 3209000 - DNA, 19 bp, Homo sapiens
atacatttgaggggaaaac

SEQ ID NO: 3209001 - DNA, 16 bp, Homo sapiens
atacatttgataaagt

SEQ ID NO: 3209002 - DNA, 17 bp, Homo sapiens
ataccaagtatttatta

SEQ ID NO: 3209003 - DNA, 20 bp, Homo sapiens
ataccaatgcttttatcaaa

SEQ ID NO: 3209004 - DNA, 14 bp, Homo sapiens
ataccacgaggaaa

SEQ ID NO: 3209005 - DNA, 20 bp, Homo sapiens
ataccactttgacacgcttc

SEQ ID NO: 3209006 - DNA, 15 bp, Homo sapiens
ataccagactgcagg

SEQ ID NO: 3209007 - DNA, 16 bp, Homo sapiens
ataccagactgcaggt

SEQ ID NO: 3209008 - DNA, 21 bp, Homo sapiens
ataccagagccttcaagtgcc

SEQ ID NO: 3209009 - DNA, 23 bp, Homo sapiens
ataccagagccttcaagtgccaa

SEQ ID NO: 3209010 - DNA, 14 bp, Homo sapiens
ataccaggttgaaa

SEQ ID NO: 3209011 - DNA, 16 bp, Homo sapiens
ataccaggttgaaaga

SEQ ID NO: 3209012 - DNA, 19 bp, Homo sapiens
ataccatactcatttctaa

SEQ ID NO: 3209013 - DNA, 21 bp, Homo sapiens
ataccatactcatttctaaaa

SEQ ID NO: 3209014 - DNA, 15 bp, Homo sapiens
ataccatgtctctaa

SEQ ID NO: 3209015 - DNA, 13 bp, Homo sapiens
atacccccctctg

SEQ ID NO: 3209016 - DNA, 13 bp, Homo sapiens
atacctaagtact

SEQ ID NO: 3209017 - DNA, 16 bp, Homo sapiens
atacctaagtactgta

SEQ ID NO: 3209018 - DNA, 17 bp, Homo sapiens
atacctaagtactgtaa

SEQ ID NO: 3209019 - DNA, 20 bp, Homo sapiens
atacctaagtactgtaataa

SEQ ID NO: 3209020 - DNA, 17 bp, Homo sapiens
atacctaattgtggatg

SEQ ID NO: 3209021 - DNA, 18 bp, Homo sapiens
atacctacaataaactgg

SEQ ID NO: 3209022 - DNA, 17 bp, Homo sapiens
atacctataatgtgtgt

SEQ ID NO: 3209023 - DNA, 19 bp, Homo sapiens
atacctataatgtgtgtat

SEQ ID NO: 3209024 - DNA, 16 bp, Homo sapiens
atacctcaatgtttga

SEQ ID NO: 3209025 - DNA, 17 bp, Homo sapiens
atacctcatgtttatga

SEQ ID NO: 3209026 - DNA, 12 bp, Homo sapiens
atacctcatttt

SEQ ID NO: 3209027 - DNA, 14 bp, Homo sapiens
atacctctgaccaa

SEQ ID NO: 3209028 - DNA, 15 bp, Homo sapiens
atacctctgaccaac

SEQ ID NO: 3209029 - DNA, 18 bp, Homo sapiens
atacctggcttttacttt

SEQ ID NO: 3209030 - DNA, 19 bp, Homo sapiens
atacctggcttttacttta

SEQ ID NO: 3209031 - DNA, 22 bp, Homo sapiens
atacctggcttttactttatta

SEQ ID NO: 3209032 - DNA, 22 bp, Homo sapiens
atacctttgtagttactcaagc

SEQ ID NO: 3209033 - DNA, 16 bp, Homo sapiens
atacgcactacatgtg

SEQ ID NO: 3209034 - DNA, 17 bp, Homo sapiens
atacgcactacatgtgg

SEQ ID NO: 3209035 - DNA, 18 bp, Homo sapiens
atacggtcaggtttaaca

SEQ ID NO: 3209036 - DNA, 19 bp, Homo sapiens
atacgtagttgtgcttttg

SEQ ID NO: 3209037 - DNA, 16 bp, Homo sapiens
atacgtattacaaaca

SEQ ID NO: 3209038 - DNA, 19 bp, Homo sapiens
atacgtattacaaacaagt

SEQ ID NO: 3209039 - DNA, 22 bp, Homo sapiens
atacgtgttttgaattgcaaac

SEQ ID NO: 3209040 - DNA, 13 bp, Homo sapiens
atacgttttgaca

SEQ ID NO: 3209041 - DNA, 13 bp, Homo sapiens
atactaaaagcaa

SEQ ID NO: 3209042 - DNA, 21 bp, Homo sapiens
atactaaaagttcttctccaa

SEQ ID NO: 3209043 - DNA, 13 bp, Homo sapiens
atactaaaatatg

SEQ ID NO: 3209044 - DNA, 16 bp, Homo sapiens
atactaaaatatgtct

SEQ ID NO: 3209045 - DNA, 18 bp, Homo sapiens
atactaaaccaactctaa

SEQ ID NO: 3209046 - DNA, 19 bp, Homo sapiens
atactaaaccaactctaat

SEQ ID NO: 3209047 - DNA, 21 bp, Homo sapiens
atactaaaccaactctaatat

SEQ ID NO: 3209048 - DNA, 15 bp, Homo sapiens
atactacatctttaa

SEQ ID NO: 3209049 - DNA, 23 bp, Homo sapiens
atactacctcactactacatctg

SEQ ID NO: 3209050 - DNA, 17 bp, Homo sapiens
atactaggatacagaaa

SEQ ID NO: 3209051 - DNA, 14 bp, Homo sapiens
atactatatttatg

SEQ ID NO: 3209052 - DNA, 17 bp, Homo sapiens
atactatgaaataaaaa

SEQ ID NO: 3209053 - DNA, 17 bp, Homo sapiens
atactcaagtttcaggt

SEQ ID NO: 3209054 - DNA, 18 bp, Homo sapiens
atactcaagtttcaggta

SEQ ID NO: 3209055 - DNA, 16 bp, Homo sapiens
atactcagcctgctgc

SEQ ID NO: 3209056 - DNA, 17 bp, Homo sapiens
atactcatcagagcagc

SEQ ID NO: 3209057 - DNA, 23 bp, Homo sapiens
atactcatttctaaaagaatatt

SEQ ID NO: 3209058 - DNA, 17 bp, Homo sapiens
atactctagatgaagtt

SEQ ID NO: 3209059 - DNA, 23 bp, Homo sapiens
atactctagatgaagttttacat

SEQ ID NO: 3209060 - DNA, 14 bp, Homo sapiens
atactctttctgta

SEQ ID NO: 3209061 - DNA, 15 bp, Homo sapiens
atactctttctgtat

SEQ ID NO: 3209062 - DNA, 22 bp, Homo sapiens
atactctttctgtatatacttt

SEQ ID NO: 3209063 - DNA, 23 bp, Homo sapiens
atactctttctgtatatactttt

SEQ ID NO: 3209064 - DNA, 15 bp, Homo sapiens
atactctttgtcttt

SEQ ID NO: 3209065 - DNA, 23 bp, Homo sapiens
atactgaaaatccaataatcaga

SEQ ID NO: 3209066 - DNA, 18 bp, Homo sapiens
atactgaaattattttct

SEQ ID NO: 3209067 - DNA, 14 bp, Homo sapiens
atactgaaggaaaa

SEQ ID NO: 3209068 - DNA, 20 bp, Homo sapiens
atactgaaggaaaaacacaa

SEQ ID NO: 3209069 - DNA, 18 bp, Homo sapiens
atactgagccaagtataa

SEQ ID NO: 3209070 - DNA, 13 bp, Homo sapiens
atactgattatga

SEQ ID NO: 3209071 - DNA, 16 bp, Homo sapiens
atactgatttttaagt

SEQ ID NO: 3209072 - DNA, 16 bp, Homo sapiens
atactgcaagaaaatg

SEQ ID NO: 3209073 - DNA, 21 bp, Homo sapiens
atactgcatactttttaaatg

SEQ ID NO: 3209074 - DNA, 20 bp, Homo sapiens
atactgcgactttctgcctg

SEQ ID NO: 3209075 - DNA, 23 bp, Homo sapiens
atactgcggaccaagggactcca

SEQ ID NO: 3209076 - DNA, 15 bp, Homo sapiens
atactgctacagcaa

SEQ ID NO: 3209077 - DNA, 22 bp, Homo sapiens
atactgcttgaccgtactctca

SEQ ID NO: 3209078 - DNA, 22 bp, Homo sapiens
atactgcttgcttacaatcttt

SEQ ID NO: 3209079 - DNA, 13 bp, Homo sapiens
atactggaagttt

SEQ ID NO: 3209080 - DNA, 18 bp, Homo sapiens
atactggaagttttgcat

SEQ ID NO: 3209081 - DNA, 22 bp, Homo sapiens
atactgggtttcaagaaaatct

SEQ ID NO: 3209082 - DNA, 19 bp, Homo sapiens
atactgtatattcaggact

SEQ ID NO: 3209083 - DNA, 15 bp, Homo sapiens
atactgtatttctaa

SEQ ID NO: 3209084 - DNA, 23 bp, Homo sapiens
atactgtctgggattaagggcaa

SEQ ID NO: 3209085 - DNA, 22 bp, Homo sapiens
atactgtgcagaataatggaaa

SEQ ID NO: 3209086 - DNA, 22 bp, Homo sapiens
atactgtgtgcttgttttataa

SEQ ID NO: 3209087 - DNA, 14 bp, Homo sapiens
atactgtgtggaac

SEQ ID NO: 3209088 - DNA, 14 bp, Homo sapiens
atactgtgtgggat

SEQ ID NO: 3209089 - DNA, 20 bp, Homo sapiens
atacttagtggtatgtctct

SEQ ID NO: 3209090 - DNA, 15 bp, Homo sapiens
atacttatatttccc

SEQ ID NO: 3209091 - DNA, 15 bp, Homo sapiens
atacttattaagttc

SEQ ID NO: 3209092 - DNA, 14 bp, Homo sapiens
atacttattttcag

SEQ ID NO: 3209093 - DNA, 21 bp, Homo sapiens
atacttattttcagtgcatca

SEQ ID NO: 3209094 - DNA, 23 bp, Homo sapiens
atacttattttcagtgcatcatt

SEQ ID NO: 3209095 - DNA, 19 bp, Homo sapiens
atacttcaaaaataatgtg

SEQ ID NO: 3209096 - DNA, 17 bp, Homo sapiens
atacttgaagaaacaga

SEQ ID NO: 3209097 - DNA, 15 bp, Homo sapiens
atacttgactctaat

SEQ ID NO: 3209098 - DNA, 16 bp, Homo sapiens
atacttgactctaata

SEQ ID NO: 3209099 - DNA, 12 bp, Homo sapiens
atacttggattt

SEQ ID NO: 3209100 - DNA, 13 bp, Homo sapiens
atacttggattta

SEQ ID NO: 3209101 - DNA, 16 bp, Homo sapiens
atacttggatttagtt

SEQ ID NO: 3209102 - DNA, 12 bp, Homo sapiens
atacttgtttca

SEQ ID NO: 3209103 - DNA, 12 bp, Homo sapiens
atactttacagg

SEQ ID NO: 3209104 - DNA, 15 bp, Homo sapiens
atactttatatctgt

SEQ ID NO: 3209105 - DNA, 18 bp, Homo sapiens
atactttatatctgtaat

SEQ ID NO: 3209106 - DNA, 13 bp, Homo sapiens
atactttatttct

SEQ ID NO: 3209107 - DNA, 14 bp, Homo sapiens
atactttatttctg

SEQ ID NO: 3209108 - DNA, 22 bp, Homo sapiens
atactttgaaaggagatgtctt

SEQ ID NO: 3209109 - DNA, 23 bp, Homo sapiens
atactttgaaaggagatgtcttg

SEQ ID NO: 3209110 - DNA, 14 bp, Homo sapiens
atactttgtaaata

SEQ ID NO: 3209111 - DNA, 22 bp, Homo sapiens
atactttgtcctaagagattta

SEQ ID NO: 3209112 - DNA, 19 bp, Homo sapiens
atactttgtttattgtaaa

SEQ ID NO: 3209113 - DNA, 14 bp, Homo sapiens
atacttttaaatta

SEQ ID NO: 3209114 - DNA, 16 bp, Homo sapiens
atacttttactctgcc

SEQ ID NO: 3209115 - DNA, 20 bp, Homo sapiens
atacttttactctgcctaca

SEQ ID NO: 3209116 - DNA, 22 bp, Homo sapiens
atacttttcccctgttaaacag

SEQ ID NO: 3209117 - DNA, 19 bp, Homo sapiens
atactttttaaatgtaaag

SEQ ID NO: 3209118 - DNA, 14 bp, Homo sapiens
atagaaacatgaca

SEQ ID NO: 3209119 - DNA, 21 bp, Homo sapiens
atagaaactcaccatgtaaaa

SEQ ID NO: 3209120 - DNA, 20 bp, Homo sapiens
atagaaataaatagctatat

SEQ ID NO: 3209121 - DNA, 23 bp, Homo sapiens
atagaaatggaaattttgctatc

SEQ ID NO: 3209122 - DNA, 17 bp, Homo sapiens
atagaacatattttcct

SEQ ID NO: 3209123 - DNA, 15 bp, Homo sapiens
atagaactgggtaaa

SEQ ID NO: 3209124 - DNA, 23 bp, Homo sapiens
atagaagtttgtccatttgtaaa

SEQ ID NO: 3209125 - DNA, 13 bp, Homo sapiens
atagaagttttat

SEQ ID NO: 3209126 - DNA, 18 bp, Homo sapiens
atagaataaaggcagttt

SEQ ID NO: 3209127 - DNA, 20 bp, Homo sapiens
atagaataaaggcagttttc

SEQ ID NO: 3209128 - DNA, 15 bp, Homo sapiens
atagaattgtagact

SEQ ID NO: 3209129 - DNA, 17 bp, Homo sapiens
atagacaaatagaaaat

SEQ ID NO: 3209130 - DNA, 20 bp, Homo sapiens
atagacaatttgcacatctt

SEQ ID NO: 3209131 - DNA, 22 bp, Homo sapiens
atagactagtcctatggaaaaa

SEQ ID NO: 3209132 - DNA, 19 bp, Homo sapiens
atagactgaggtataaaga

SEQ ID NO: 3209133 - DNA, 20 bp, Homo sapiens
atagacttattcttttataa

SEQ ID NO: 3209134 - DNA, 14 bp, Homo sapiens
atagagaaaaactt

SEQ ID NO: 3209135 - DNA, 22 bp, Homo sapiens
atagagacaatctattttgtta

SEQ ID NO: 3209136 - DNA, 14 bp, Homo sapiens
atagagactgtaga

SEQ ID NO: 3209137 - DNA, 23 bp, Homo sapiens
atagagactgtagattgcttctg

SEQ ID NO: 3209138 - DNA, 17 bp, Homo sapiens
atagagagggggctctc

SEQ ID NO: 3209139 - DNA, 16 bp, Homo sapiens
atagagatgtttttaa

SEQ ID NO: 3209140 - DNA, 22 bp, Homo sapiens
atagagatttgtctaattgcat

SEQ ID NO: 3209141 - DNA, 13 bp, Homo sapiens
atagagccctggc

SEQ ID NO: 3209142 - DNA, 19 bp, Homo sapiens
atagagccctggccagccc

SEQ ID NO: 3209143 - DNA, 17 bp, Homo sapiens
atagagctgggtggcct

SEQ ID NO: 3209144 - DNA, 16 bp, Homo sapiens
atagagcttttaaaaa

SEQ ID NO: 3209145 - DNA, 19 bp, Homo sapiens
atagaggctagcttctgct

SEQ ID NO: 3209146 - DNA, 18 bp, Homo sapiens
atagaggcttctccgcca

SEQ ID NO: 3209147 - DNA, 14 bp, Homo sapiens
atagagggccaaga

SEQ ID NO: 3209148 - DNA, 16 bp, Homo sapiens
atagaggtaccagcaa

SEQ ID NO: 3209149 - DNA, 14 bp, Homo sapiens
atagagtatatgca

SEQ ID NO: 3209150 - DNA, 13 bp, Homo sapiens
atagagttcatcc

SEQ ID NO: 3209151 - DNA, 15 bp, Homo sapiens
atagataatattgtt

SEQ ID NO: 3209152 - DNA, 16 bp, Homo sapiens
atagataatattgttt

SEQ ID NO: 3209153 - DNA, 16 bp, Homo sapiens
atagatatctatattt

SEQ ID NO: 3209154 - DNA, 19 bp, Homo sapiens
atagatatctatattttta

SEQ ID NO: 3209155 - DNA, 19 bp, Homo sapiens
atagatcaaagtcaaaaat

SEQ ID NO: 3209156 - DNA, 12 bp, Homo sapiens
atagatcttctg

SEQ ID NO: 3209157 - DNA, 14 bp, Homo sapiens
atagatcttctgaa

SEQ ID NO: 3209158 - DNA, 18 bp, Homo sapiens
atagattaatggcactga

SEQ ID NO: 3209159 - DNA, 13 bp, Homo sapiens
atagattagaaaa

SEQ ID NO: 3209160 - DNA, 15 bp, Homo sapiens
atagattctaaagat

SEQ ID NO: 3209161 - DNA, 18 bp, Homo sapiens
atagattctaaagattct

SEQ ID NO: 3209162 - DNA, 19 bp, Homo sapiens
atagatttaggagcagaaa

SEQ ID NO: 3209163 - DNA, 20 bp, Homo sapiens
atagatttatttttcagttc

SEQ ID NO: 3209164 - DNA, 22 bp, Homo sapiens
atagatttatttttcagttcca

SEQ ID NO: 3209165 - DNA, 17 bp, Homo sapiens
atagatttttgtttttg

SEQ ID NO: 3209166 - DNA, 16 bp, Homo sapiens
atagcaaacttggaat

SEQ ID NO: 3209167 - DNA, 22 bp, Homo sapiens
atagcaagatattgatcaaata

SEQ ID NO: 3209168 - DNA, 14 bp, Homo sapiens
atagcactttgaaa

SEQ ID NO: 3209169 - DNA, 20 bp, Homo sapiens
atagcactttgaaatacctc

SEQ ID NO: 3209170 - DNA, 16 bp, Homo sapiens
atagcagacagtgttt

SEQ ID NO: 3209171 - DNA, 14 bp, Homo sapiens
atagcagaggggcc

SEQ ID NO: 3209172 - DNA, 20 bp, Homo sapiens
atagcagaggggccaggccc

SEQ ID NO: 3209173 - DNA, 19 bp, Homo sapiens
atagcagcctttctctctt

SEQ ID NO: 3209174 - DNA, 23 bp, Homo sapiens
atagcatctcaggagatttcatg

SEQ ID NO: 3209175 - DNA, 13 bp, Homo sapiens
atagcatgtaatg

SEQ ID NO: 3209176 - DNA, 18 bp, Homo sapiens
atagcattgataatcttc

SEQ ID NO: 3209177 - DNA, 21 bp, Homo sapiens
atagcatttttgatttatgca

SEQ ID NO: 3209178 - DNA, 11 bp, Homo sapiens
atagccagaga

SEQ ID NO: 3209179 - DNA, 13 bp, Homo sapiens
atagcccagaaca

SEQ ID NO: 3209180 - DNA, 16 bp, Homo sapiens
atagcccatccctgcc

SEQ ID NO: 3209181 - DNA, 17 bp, Homo sapiens
atagcccatccctgcct

SEQ ID NO: 3209182 - DNA, 19 bp, Homo sapiens
atagccctgcaaaaattca

SEQ ID NO: 3209183 - DNA, 17 bp, Homo sapiens
atagcctaggtgacaga

SEQ ID NO: 3209184 - DNA, 16 bp, Homo sapiens
atagcctatatttaca

SEQ ID NO: 3209185 - DNA, 11 bp, Homo sapiens
atagcctgcct

SEQ ID NO: 3209186 - DNA, 15 bp, Homo sapiens
atagcctgcctcagt

SEQ ID NO: 3209187 - DNA, 20 bp, Homo sapiens
atagcctgcctcagtggcag

SEQ ID NO: 3209188 - DNA, 22 bp, Homo sapiens
atagcctgcctcagtggcagca

SEQ ID NO: 3209189 - DNA, 22 bp, Homo sapiens
atagcgccgtgctgtaaataag

SEQ ID NO: 3209190 - DNA, 15 bp, Homo sapiens
atagctaactgtaaa

SEQ ID NO: 3209191 - DNA, 15 bp, Homo sapiens
atagctacaggaagc

SEQ ID NO: 3209192 - DNA, 19 bp, Homo sapiens
atagctacccaaaagagaa

SEQ ID NO: 3209193 - DNA, 21 bp, Homo sapiens
atagctacccaaaagagaaaa

SEQ ID NO: 3209194 - DNA, 19 bp, Homo sapiens
atagctatatccatgtact

SEQ ID NO: 3209195 - DNA, 22 bp, Homo sapiens
atagctatatccatgtactgta

SEQ ID NO: 3209196 - DNA, 14 bp, Homo sapiens
atagctcatcctta

SEQ ID NO: 3209197 - DNA, 20 bp, Homo sapiens
atagctccccgcttctgcct

SEQ ID NO: 3209198 - DNA, 17 bp, Homo sapiens
atagctctattttaaag

SEQ ID NO: 3209199 - DNA, 22 bp, Homo sapiens
atagctctggggtgggcagttt

SEQ ID NO: 3209200 - DNA, 17 bp, Homo sapiens
atagctgagattcctgg

SEQ ID NO: 3209201 - DNA, 17 bp, Homo sapiens
atagctgggactacagg

SEQ ID NO: 3209202 - DNA, 15 bp, Homo sapiens
atagctgtacttctt

SEQ ID NO: 3209203 - DNA, 19 bp, Homo sapiens
atagcttaactaatttgaa

SEQ ID NO: 3209204 - DNA, 23 bp, Homo sapiens
atagcttaactaatttgaatgtg

SEQ ID NO: 3209205 - DNA, 17 bp, Homo sapiens
atagcttgcagaactgt

SEQ ID NO: 3209206 - DNA, 14 bp, Homo sapiens
atagcttgtatagt

SEQ ID NO: 3209207 - DNA, 22 bp, Homo sapiens
atagctttattttttaagtatt

SEQ ID NO: 3209208 - DNA, 18 bp, Homo sapiens
atagcttttattgtataa

SEQ ID NO: 3209209 - DNA, 15 bp, Homo sapiens
ataggaacatatgaa

SEQ ID NO: 3209210 - DNA, 17 bp, Homo sapiens
ataggaagacgcagagc

SEQ ID NO: 3209211 - DNA, 19 bp, Homo sapiens
ataggaagcgtctggcaga

SEQ ID NO: 3209212 - DNA, 16 bp, Homo sapiens
ataggaatagaggaag

SEQ ID NO: 3209213 - DNA, 20 bp, Homo sapiens
ataggaatcattcagaaatg

SEQ ID NO: 3209214 - DNA, 18 bp, Homo sapiens
ataggacatactgcatgt

SEQ ID NO: 3209215 - DNA, 20 bp, Homo sapiens
ataggagagattgggagaaa

SEQ ID NO: 3209216 - DNA, 15 bp, Homo sapiens
ataggagaggagggt

SEQ ID NO: 3209217 - DNA, 19 bp, Homo sapiens
ataggagaggatgagagcc

SEQ ID NO: 3209218 - DNA, 21 bp, Homo sapiens
ataggagaggatgagagccca

SEQ ID NO: 3209219 - DNA, 23 bp, Homo sapiens
ataggagaggatgagagcccaga

SEQ ID NO: 3209220 - DNA, 24 bp, Homo sapiens
ataggagaggatgagagcccagag

SEQ ID NO: 3209221 - DNA, 14 bp, Homo sapiens
ataggcaaattaat

SEQ ID NO: 3209222 - DNA, 20 bp, Homo sapiens
ataggcaggaagcccaattg

SEQ ID NO: 3209223 - DNA, 22 bp, Homo sapiens
ataggcccaaggtcccctccac

SEQ ID NO: 3209224 - DNA, 12 bp, Homo sapiens
ataggctctgca

SEQ ID NO: 3209225 - DNA, 16 bp, Homo sapiens
ataacagctcctttat

SEQ ID NO: 3209226 - DNA, 16 bp, Homo sapiens
ataacagtaaatgtgc

SEQ ID NO: 3209227 - DNA, 18 bp, Homo sapiens
ataacagttatatttttg

SEQ ID NO: 3209228 - DNA, 14 bp, Homo sapiens
ataacatctttatt

SEQ ID NO: 3209229 - DNA, 21 bp, Homo sapiens
ataacatctttattgaaattc

SEQ ID NO: 3209230 - DNA, 13 bp, Homo sapiens
ataacatgtaaaa

SEQ ID NO: 3209231 - DNA, 14 bp, Homo sapiens
ataacattacctta

SEQ ID NO: 3209232 - DNA, 14 bp, Homo sapiens
ataacccagttact

SEQ ID NO: 3209233 - DNA, 14 bp, Homo sapiens
ataaccccagcctg

SEQ ID NO: 3209234 - DNA, 15 bp, Homo sapiens
ataaccccagcctga

SEQ ID NO: 3209235 - DNA, 14 bp, Homo sapiens
ataacctaattaat

SEQ ID NO: 3209236 - DNA, 17 bp, Homo sapiens
ataacctagttaaagaa

SEQ ID NO: 3209237 - DNA, 13 bp, Homo sapiens
ataacctatatga

SEQ ID NO: 3209238 - DNA, 12 bp, Homo sapiens
ataacctctggc

SEQ ID NO: 3209239 - DNA, 14 bp, Homo sapiens
ataacctctggccc

SEQ ID NO: 3209240 - DNA, 15 bp, Homo sapiens
ataacctctggccct

SEQ ID NO: 3209241 - DNA, 20 bp, Homo sapiens
ataacctctggcccttggaa

SEQ ID NO: 3209242 - DNA, 21 bp, Homo sapiens
ataacggaaaaataattgcca

SEQ ID NO: 3209243 - DNA, 16 bp, Homo sapiens
ataactaaaaggtatg

SEQ ID NO: 3209244 - DNA, 15 bp, Homo sapiens
ataactaaaatgtat

SEQ ID NO: 3209245 - DNA, 14 bp, Homo sapiens
ataactaaataaag

SEQ ID NO: 3209246 - DNA, 19 bp, Homo sapiens
ataactactgtgttcctgg

SEQ ID NO: 3209247 - DNA, 19 bp, Homo sapiens
ataactcatcataaaataa

SEQ ID NO: 3209248 - DNA, 12 bp, Homo sapiens
ataactccttct

SEQ ID NO: 3209249 - DNA, 20 bp, Homo sapiens
ataactccttcttgtagtag

SEQ ID NO: 3209250 - DNA, 11 bp, Homo sapiens
ataactctgca

SEQ ID NO: 3209251 - DNA, 13 bp, Homo sapiens
ataactctgtaaa

SEQ ID NO: 3209252 - DNA, 13 bp, Homo sapiens
ataactgaaaatg

SEQ ID NO: 3209253 - DNA, 13 bp, Homo sapiens
ataactgaaccaa

SEQ ID NO: 3209254 - DNA, 16 bp, Homo sapiens
ataactgagcttagag

SEQ ID NO: 3209255 - DNA, 16 bp, Homo sapiens
ataactgatttctatg

SEQ ID NO: 3209256 - DNA, 20 bp, Homo sapiens
ataactgtagctcaagttta

SEQ ID NO: 3209257 - DNA, 13 bp, Homo sapiens
ataactgtgaagt

SEQ ID NO: 3209258 - DNA, 19 bp, Homo sapiens
ataacttaaaaaaatgaca

SEQ ID NO: 3209259 - DNA, 19 bp, Homo sapiens
ataacttaaaaatgtaaat

SEQ ID NO: 3209260 - DNA, 20 bp, Homo sapiens
ataacttaaaaatgtaaata

SEQ ID NO: 3209261 - DNA, 23 bp, Homo sapiens
ataacttaaaataattaaataaa

SEQ ID NO: 3209262 - DNA, 16 bp, Homo sapiens
ataacttactgtatat

SEQ ID NO: 3209263 - DNA, 22 bp, Homo sapiens
ataacttactgtatatgtattc

SEQ ID NO: 3209264 - DNA, 16 bp, Homo sapiens
ataacttcaagcaaac

SEQ ID NO: 3209265 - DNA, 23 bp, Homo sapiens
ataacttctatattttaatagaa

SEQ ID NO: 3209266 - DNA, 16 bp, Homo sapiens
ataacttcttcctgct

SEQ ID NO: 3209267 - DNA, 19 bp, Homo sapiens
ataacttcttcctgctgga

SEQ ID NO: 3209268 - DNA, 20 bp, Homo sapiens
ataacttgatgcatgtggtt

SEQ ID NO: 3209269 - DNA, 18 bp, Homo sapiens
ataacttggggaggcaag

SEQ ID NO: 3209270 - DNA, 18 bp, Homo sapiens
ataacttttacacgacca

SEQ ID NO: 3209271 - DNA, 17 bp, Homo sapiens
ataacttttttgagtca

SEQ ID NO: 3209272 - DNA, 23 bp, Homo sapiens
ataacttttttgagtcattgact

SEQ ID NO: 3209273 - DNA, 15 bp, Homo sapiens
ataagaaagtttcac

SEQ ID NO: 3209274 - DNA, 15 bp, Homo sapiens
ataagaaatactaga

SEQ ID NO: 3209275 - DNA, 16 bp, Homo sapiens
ataagaatgctggttt

SEQ ID NO: 3209276 - DNA, 19 bp, Homo sapiens
ataagaatgctggttttcc

SEQ ID NO: 3209277 - DNA, 21 bp, Homo sapiens
ataagaatgctggttttccta

SEQ ID NO: 3209278 - DNA, 22 bp, Homo sapiens
ataagaatgctggttttcctaa

SEQ ID NO: 3209279 - DNA, 18 bp, Homo sapiens
ataagaatggttgcctta

SEQ ID NO: 3209280 - DNA, 22 bp, Homo sapiens
ataagacatatctctaattcca

SEQ ID NO: 3209281 - DNA, 20 bp, Homo sapiens
ataagaccgtgtcccaagga

SEQ ID NO: 3209282 - DNA, 14 bp, Homo sapiens
ataagactgtcatg

SEQ ID NO: 3209283 - DNA, 18 bp, Homo sapiens
ataagagaaagaaaatga

SEQ ID NO: 3209284 - DNA, 19 bp, Homo sapiens
ataagagaagtctcattcg

SEQ ID NO: 3209285 - DNA, 13 bp, Homo sapiens
ataagataaatgt

SEQ ID NO: 3209286 - DNA, 14 bp, Homo sapiens
ataagattcatatt

SEQ ID NO: 3209287 - DNA, 12 bp, Homo sapiens
ataagattctaa

SEQ ID NO: 3209288 - DNA, 13 bp, Homo sapiens
ataagattctaac

SEQ ID NO: 3209289 - DNA, 19 bp, Homo sapiens
ataagcaaatttcaaaaga

SEQ ID NO: 3209290 - DNA, 22 bp, Homo sapiens
ataagcaaatttcaaaagacat

SEQ ID NO: 3209291 - DNA, 15 bp, Homo sapiens
ataagcaagagagat

SEQ ID NO: 3209292 - DNA, 16 bp, Homo sapiens
ataagcaagagagatg

SEQ ID NO: 3209293 - DNA, 17 bp, Homo sapiens
ataagcaagagagatgt

SEQ ID NO: 3209294 - DNA, 13 bp, Homo sapiens
ataagcaggtgga

SEQ ID NO: 3209295 - DNA, 20 bp, Homo sapiens
ataagcattgacttgccgtc

SEQ ID NO: 3209296 - DNA, 13 bp, Homo sapiens
ataagcctgagcc

SEQ ID NO: 3209297 - DNA, 14 bp, Homo sapiens
ataagcctgagcct

SEQ ID NO: 3209298 - DNA, 21 bp, Homo sapiens
ataagctatcacctagcagcc

SEQ ID NO: 3209299 - DNA, 19 bp, Homo sapiens
ataagctttctctcagaaa

SEQ ID NO: 3209300 - DNA, 17 bp, Homo sapiens
ataaggaagagggctga

SEQ ID NO: 3209301 - DNA, 22 bp, Homo sapiens
ataaggaggaggagggagaaga

SEQ ID NO: 3209302 - DNA, 20 bp, Homo sapiens
ataaggatcagaacagcaga

SEQ ID NO: 3209303 - DNA, 13 bp, Homo sapiens
ataaggcaggcat

SEQ ID NO: 3209304 - DNA, 16 bp, Homo sapiens
ataagggaaaagataa

SEQ ID NO: 3209305 - DNA, 19 bp, Homo sapiens
ataagggagagctgagcca

SEQ ID NO: 3209306 - DNA, 18 bp, Homo sapiens
ataaggggtttgccattt

SEQ ID NO: 3209307 - DNA, 20 bp, Homo sapiens
ataaggggtttgccatttga

SEQ ID NO: 3209308 - DNA, 21 bp, Homo sapiens
ataaggggtttgccatttgat

SEQ ID NO: 3209309 - DNA, 17 bp, Homo sapiens
ataaggtcaagggaaaa

SEQ ID NO: 3209310 - DNA, 17 bp, Homo sapiens
ataaggtttaaaaagat

SEQ ID NO: 3209311 - DNA, 13 bp, Homo sapiens
ataagtaaaccta

SEQ ID NO: 3209312 - DNA, 15 bp, Homo sapiens
ataagtaaatgctag

SEQ ID NO: 3209313 - DNA, 18 bp, Homo sapiens
ataagtagttggtttgta

SEQ ID NO: 3209314 - DNA, 15 bp, Homo sapiens
ataagtatttataat

SEQ ID NO: 3209315 - DNA, 19 bp, Homo sapiens
ataagtatttataatagca

SEQ ID NO: 3209316 - DNA, 16 bp, Homo sapiens
ataagtcaagcacatg

SEQ ID NO: 3209317 - DNA, 14 bp, Homo sapiens
ataagtctaaataa

SEQ ID NO: 3209318 - DNA, 15 bp, Homo sapiens
ataagtgaagtgata

SEQ ID NO: 3209319 - DNA, 14 bp, Homo sapiens
ataagtggaaaaaa

SEQ ID NO: 3209320 - DNA, 21 bp, Homo sapiens
ataagtggaaaaaagagaaaa

SEQ ID NO: 3209321 - DNA, 18 bp, Homo sapiens
ataagtggaggcacttta

SEQ ID NO: 3209322 - DNA, 19 bp, Homo sapiens
ataagtgtacatatgtgct

SEQ ID NO: 3209323 - DNA, 17 bp, Homo sapiens
ataagttaacttccaat

SEQ ID NO: 3209324 - DNA, 19 bp, Homo sapiens
ataagttatttttgtacat

SEQ ID NO: 3209325 - DNA, 15 bp, Homo sapiens
ataagttcacaaaat

SEQ ID NO: 3209326 - DNA, 20 bp, Homo sapiens
ataagtttacacctttatct

SEQ ID NO: 3209327 - DNA, 16 bp, Homo sapiens
ataagtttctattctg

SEQ ID NO: 3209328 - DNA, 15 bp, Homo sapiens
ataagtttgaaggaa

SEQ ID NO: 3209329 - DNA, 19 bp, Homo sapiens
ataagtttgaaggaaacag

SEQ ID NO: 3209330 - DNA, 14 bp, Homo sapiens
ataataaagtgttt

SEQ ID NO: 3209331 - DNA, 18 bp, Homo sapiens
ataataaatcacacattc

SEQ ID NO: 3209332 - DNA, 15 bp, Homo sapiens
ataataaattgaaat

SEQ ID NO: 3209333 - DNA, 14 bp, Homo sapiens
ataataatttgcac

SEQ ID NO: 3209334 - DNA, 18 bp, Homo sapiens
ataatacagaatcttgtt

SEQ ID NO: 3209335 - DNA, 16 bp, Homo sapiens
ataatacctcaatgtt

SEQ ID NO: 3209336 - DNA, 12 bp, Homo sapiens
ataatagattct

SEQ ID NO: 3209337 - DNA, 21 bp, Homo sapiens
ataatagcaacttttgtgtaa

SEQ ID NO: 3209338 - DNA, 12 bp, Homo sapiens
ataatagggaaa

SEQ ID NO: 3209339 - DNA, 23 bp, Homo sapiens
ataatagtcaatttctacttctg

SEQ ID NO: 3209340 - DNA, 14 bp, Homo sapiens
ataatagtttacat

SEQ ID NO: 3209341 - DNA, 20 bp, Homo sapiens
ataatagtttacatgtagta

SEQ ID NO: 3209342 - DNA, 18 bp, Homo sapiens
ataatataccaatgcttt

SEQ ID NO: 3209343 - DNA, 18 bp, Homo sapiens
ataatatctttgtgataa

SEQ ID NO: 3209344 - DNA, 13 bp, Homo sapiens
ataatatgatttt

SEQ ID NO: 3209345 - DNA, 21 bp, Homo sapiens
ataatatgctgccaaattttg

SEQ ID NO: 3209346 - DNA, 22 bp, Homo sapiens
ataatatggctatgcttaaaag

SEQ ID NO: 3209347 - DNA, 21 bp, Homo sapiens
ataatattaatttatttaatt

SEQ ID NO: 3209348 - DNA, 13 bp, Homo sapiens
ataatattactgt

SEQ ID NO: 3209349 - DNA, 18 bp, Homo sapiens
ataatattagtgattctg

SEQ ID NO: 3209350 - DNA, 20 bp, Homo sapiens
ataatattagtgattctgat

SEQ ID NO: 3209351 - DNA, 15 bp, Homo sapiens
ataatattcattggt

SEQ ID NO: 3209352 - DNA, 22 bp, Homo sapiens
ataatattgttgtataatttcg

SEQ ID NO: 3209353 - DNA, 18 bp, Homo sapiens
ataatatttcaagtgcct

SEQ ID NO: 3209354 - DNA, 19 bp, Homo sapiens
ataatatttcaagtgccta

SEQ ID NO: 3209355 - DNA, 13 bp, Homo sapiens
ataggctctgcac

SEQ ID NO: 3209356 - DNA, 14 bp, Homo sapiens
ataggctctgcaca

SEQ ID NO: 3209357 - DNA, 15 bp, Homo sapiens
ataggctctgcacag

SEQ ID NO: 3209358 - DNA, 15 bp, Homo sapiens
ataggctttttaatc

SEQ ID NO: 3209359 - DNA, 17 bp, Homo sapiens
atagggaatatatctct

SEQ ID NO: 3209360 - DNA, 17 bp, Homo sapiens
ataggggatatttaagg

SEQ ID NO: 3209361 - DNA, 16 bp, Homo sapiens
atagggtctcttcagg

SEQ ID NO: 3209362 - DNA, 21 bp, Homo sapiens
atagggtctcttcaggttctt

SEQ ID NO: 3209363 - DNA, 14 bp, Homo sapiens
ataggtaatcaatg

SEQ ID NO: 3209364 - DNA, 16 bp, Homo sapiens
ataggtaatcaatgaa

SEQ ID NO: 3209365 - DNA, 15 bp, Homo sapiens
ataggtagtttggat

SEQ ID NO: 3209366 - DNA, 17 bp, Homo sapiens
ataggtagtttggatat

SEQ ID NO: 3209367 - DNA, 20 bp, Homo sapiens
ataggtagtttggatatttt

SEQ ID NO: 3209368 - DNA, 21 bp, Homo sapiens
ataggtcactggctctccaag

SEQ ID NO: 3209369 - DNA, 22 bp, Homo sapiens
ataggtcactggctctccaagt

SEQ ID NO: 3209370 - DNA, 13 bp, Homo sapiens
ataggtctcttct

SEQ ID NO: 3209371 - DNA, 15 bp, Homo sapiens
ataggtctttctctc

SEQ ID NO: 3209372 - DNA, 22 bp, Homo sapiens
ataggtgcttattctcaaagca

SEQ ID NO: 3209373 - DNA, 20 bp, Homo sapiens
ataggttgccaataatacac

SEQ ID NO: 3209374 - DNA, 17 bp, Homo sapiens
atagtaccaatcatttt

SEQ ID NO: 3209375 - DNA, 13 bp, Homo sapiens
atagtagaaaaat

SEQ ID NO: 3209376 - DNA, 15 bp, Homo sapiens
atagtagaaaaatca

SEQ ID NO: 3209377 - DNA, 16 bp, Homo sapiens
atagtagcatacattt

SEQ ID NO: 3209378 - DNA, 13 bp, Homo sapiens
atagtagtatgat

SEQ ID NO: 3209379 - DNA, 17 bp, Homo sapiens
atagtatatctggacaa

SEQ ID NO: 3209380 - DNA, 15 bp, Homo sapiens
atagtatctgtatat

SEQ ID NO: 3209381 - DNA, 16 bp, Homo sapiens
atagtatggtggctgg

SEQ ID NO: 3209382 - DNA, 17 bp, Homo sapiens
atagtatggtggctggg

SEQ ID NO: 3209383 - DNA, 18 bp, Homo sapiens
atagtatggtggctgggt

SEQ ID NO: 3209384 - DNA, 14 bp, Homo sapiens
atagtatgtgactt

SEQ ID NO: 3209385 - DNA, 20 bp, Homo sapiens
atagtatttgagagttctaa

SEQ ID NO: 3209386 - DNA, 23 bp, Homo sapiens
atagtatttgagagttctaaatt

SEQ ID NO: 3209387 - DNA, 15 bp, Homo sapiens
atagtcagcagcagc

SEQ ID NO: 3209388 - DNA, 19 bp, Homo sapiens
atagtcagcagcagctctg

SEQ ID NO: 3209389 - DNA, 18 bp, Homo sapiens
atagtcatttattttaaa

SEQ ID NO: 3209390 - DNA, 20 bp, Homo sapiens
atagtccagacacttaactc

SEQ ID NO: 3209391 - DNA, 21 bp, Homo sapiens
atagtctaagactatatatat

SEQ ID NO: 3209392 - DNA, 14 bp, Homo sapiens
atagtcttccacaa

SEQ ID NO: 3209393 - DNA, 17 bp, Homo sapiens
atagtcttttgcatgtc

SEQ ID NO: 3209394 - DNA, 15 bp, Homo sapiens
atagtgaatacttac

SEQ ID NO: 3209395 - DNA, 17 bp, Homo sapiens
atagtgcctaaaattgt

SEQ ID NO: 3209396 - DNA, 22 bp, Homo sapiens
atagtgcctaaaattgtatgaa

SEQ ID NO: 3209397 - DNA, 20 bp, Homo sapiens
atagtgctatatatataaat

SEQ ID NO: 3209398 - DNA, 12 bp, Homo sapiens
atagtggggcct

SEQ ID NO: 3209399 - DNA, 14 bp, Homo sapiens
atagtgtgaaatat

SEQ ID NO: 3209400 - DNA, 13 bp, Homo sapiens
atagtgtgaggga

SEQ ID NO: 3209401 - DNA, 14 bp, Homo sapiens
atagtgtgttctga

SEQ ID NO: 3209402 - DNA, 17 bp, Homo sapiens
atagtgtgttctgatta

SEQ ID NO: 3209403 - DNA, 19 bp, Homo sapiens
atagtgtgttctgattaga

SEQ ID NO: 3209404 - DNA, 22 bp, Homo sapiens
atagtgttctgcaaaaatattt

SEQ ID NO: 3209405 - DNA, 14 bp, Homo sapiens
atagttaaaatgct

SEQ ID NO: 3209406 - DNA, 13 bp, Homo sapiens
atagttactgtgt

SEQ ID NO: 3209407 - DNA, 21 bp, Homo sapiens
atagttcagaatttagtgtat

SEQ ID NO: 3209408 - DNA, 18 bp, Homo sapiens
atagttcagtagaattac

SEQ ID NO: 3209409 - DNA, 21 bp, Homo sapiens
atagttcctaagaagcttcta

SEQ ID NO: 3209410 - DNA, 12 bp, Homo sapiens
atagttctagac

SEQ ID NO: 3209411 - DNA, 15 bp, Homo sapiens
atagttgatgcatgt

SEQ ID NO: 3209412 - DNA, 13 bp, Homo sapiens
atagtttaaaaca

SEQ ID NO: 3209413 - DNA, 16 bp, Homo sapiens
atagtttaggagaaac

SEQ ID NO: 3209414 - DNA, 14 bp, Homo sapiens
atagtttcagatat

SEQ ID NO: 3209415 - DNA, 19 bp, Homo sapiens
atagtttctgaggctttat

SEQ ID NO: 3209416 - DNA, 13 bp, Homo sapiens
atagtttgtctat

SEQ ID NO: 3209417 - DNA, 17 bp, Homo sapiens
atagttttaaactcatt

SEQ ID NO: 3209418 - DNA, 22 bp, Homo sapiens
atagttttacttttaaactgtg

SEQ ID NO: 3209419 - DNA, 23 bp, Homo sapiens
atataaaaaccccaaactgttga

SEQ ID NO: 3209420 - DNA, 20 bp, Homo sapiens
atataaaaagaaaagataaa

SEQ ID NO: 3209421 - DNA, 22 bp, Homo sapiens
atataaaaagaaaagataaaga

SEQ ID NO: 3209422 - DNA, 15 bp, Homo sapiens
atataaaaatggctt

SEQ ID NO: 3209423 - DNA, 17 bp, Homo sapiens
atataaaacaaataaaa

SEQ ID NO: 3209424 - DNA, 23 bp, Homo sapiens
atataaaaggcaaatgtgtacat

SEQ ID NO: 3209425 - DNA, 12 bp, Homo sapiens
atataaaataac

SEQ ID NO: 3209426 - DNA, 14 bp, Homo sapiens
atataaaatgtatt

SEQ ID NO: 3209427 - DNA, 18 bp, Homo sapiens
atataaaatgtattcaag

SEQ ID NO: 3209428 - DNA, 15 bp, Homo sapiens
atataaacattttat

SEQ ID NO: 3209429 - DNA, 18 bp, Homo sapiens
atataaagaatatatata

SEQ ID NO: 3209430 - DNA, 15 bp, Homo sapiens
atataaagtattctt

SEQ ID NO: 3209431 - DNA, 16 bp, Homo sapiens
atataaatagctaatg

SEQ ID NO: 3209432 - DNA, 15 bp, Homo sapiens
atataaattctgtgg

SEQ ID NO: 3209433 - DNA, 12 bp, Homo sapiens
atataacacatt

SEQ ID NO: 3209434 - DNA, 15 bp, Homo sapiens
atataacagatacat

SEQ ID NO: 3209435 - DNA, 16 bp, Homo sapiens
atataacagatacatt

SEQ ID NO: 3209436 - DNA, 21 bp, Homo sapiens
atataactatgtggctgaaaa

SEQ ID NO: 3209437 - DNA, 13 bp, Homo sapiens
atataactgtaca

SEQ ID NO: 3209438 - DNA, 15 bp, Homo sapiens
atataagaaaatgct

SEQ ID NO: 3209439 - DNA, 18 bp, Homo sapiens
atataagagaagtctcat

SEQ ID NO: 3209440 - DNA, 16 bp, Homo sapiens
atataagccttttata

SEQ ID NO: 3209441 - DNA, 14 bp, Homo sapiens
atataagtgtacat

SEQ ID NO: 3209442 - DNA, 15 bp, Homo sapiens
atataagtgtacata

SEQ ID NO: 3209443 - DNA, 19 bp, Homo sapiens
atataagtttgaaggaaac

SEQ ID NO: 3209444 - DNA, 22 bp, Homo sapiens
atataataaaatgtgttgaaac

SEQ ID NO: 3209445 - DNA, 21 bp, Homo sapiens
atataataaagctactgattt

SEQ ID NO: 3209446 - DNA, 21 bp, Homo sapiens
atataatgttgttatttaaag

SEQ ID NO: 3209447 - DNA, 18 bp, Homo sapiens
atataattcactcaagca

SEQ ID NO: 3209448 - DNA, 12 bp, Homo sapiens
atataattctgt

SEQ ID NO: 3209449 - DNA, 13 bp, Homo sapiens
atataattctgta

SEQ ID NO: 3209450 - DNA, 14 bp, Homo sapiens
atataattctgtaa

SEQ ID NO: 3209451 - DNA, 17 bp, Homo sapiens
atataattctgtaaatg

SEQ ID NO: 3209452 - DNA, 14 bp, Homo sapiens
atataattctgtac

SEQ ID NO: 3209453 - DNA, 19 bp, Homo sapiens
atataattctgtacatagc

SEQ ID NO: 3209454 - DNA, 22 bp, Homo sapiens
atataattctgtacatagccta

SEQ ID NO: 3209455 - DNA, 23 bp, Homo sapiens
atataatttttttatgttttgtt

SEQ ID NO: 3209456 - DNA, 15 bp, Homo sapiens
atatacaaaacttta

SEQ ID NO: 3209457 - DNA, 16 bp, Homo sapiens
atatacacatatacct

SEQ ID NO: 3209458 - DNA, 13 bp, Homo sapiens
atatacagatgaa

SEQ ID NO: 3209459 - DNA, 15 bp, Homo sapiens
atatacagatgaaaa

SEQ ID NO: 3209460 - DNA, 16 bp, Homo sapiens
atatacagtaacttta

SEQ ID NO: 3209461 - DNA, 17 bp, Homo sapiens
atatacagtaactttat

SEQ ID NO: 3209462 - DNA, 22 bp, Homo sapiens
atatacagtaactttatgtgta

SEQ ID NO: 3209463 - DNA, 15 bp, Homo sapiens
atatacagttatttt

SEQ ID NO: 3209464 - DNA, 18 bp, Homo sapiens
atatacagttattttgga

SEQ ID NO: 3209465 - DNA, 17 bp, Homo sapiens
atatcttgcgaatccaa

SEQ ID NO: 3209466 - DNA, 23 bp, Homo sapiens
atatcttggcctaaacctcagtt

SEQ ID NO: 3209467 - DNA, 13 bp, Homo sapiens
atatctttattaa

SEQ ID NO: 3209468 - DNA, 21 bp, Homo sapiens
atatctttgtgataatttaag

SEQ ID NO: 3209469 - DNA, 22 bp, Homo sapiens
atatctttgtgataatttaaga

SEQ ID NO: 3209470 - DNA, 16 bp, Homo sapiens
atatcttttggttatt

SEQ ID NO: 3209471 - DNA, 13 bp, Homo sapiens
atatgaaaacaag

SEQ ID NO: 3209472 - DNA, 16 bp, Homo sapiens
atatgaaaatacaact

SEQ ID NO: 3209473 - DNA, 23 bp, Homo sapiens
atatgaaaatacaacttaaataa

SEQ ID NO: 3209474 - DNA, 17 bp, Homo sapiens
atatgaaagctgatttt

SEQ ID NO: 3209475 - DNA, 15 bp, Homo sapiens
atatgaacatattgt

SEQ ID NO: 3209476 - DNA, 18 bp, Homo sapiens
atatgaaccctttgtttc

SEQ ID NO: 3209477 - DNA, 19 bp, Homo sapiens
atatgaaccctttgtttct

SEQ ID NO: 3209478 - DNA, 14 bp, Homo sapiens
atatgaactgcagg

SEQ ID NO: 3209479 - DNA, 21 bp, Homo sapiens
atatgaatttaaatataattc

SEQ ID NO: 3209480 - DNA, 16 bp, Homo sapiens
atatgacatttaaatg

SEQ ID NO: 3209481 - DNA, 18 bp, Homo sapiens
atatgacggaagaacata

SEQ ID NO: 3209482 - DNA, 13 bp, Homo sapiens
atatgactcacat

SEQ ID NO: 3209483 - DNA, 15 bp, Homo sapiens
atatgagtatacaat

SEQ ID NO: 3209484 - DNA, 20 bp, Homo sapiens
atatgagtatacaatatata

SEQ ID NO: 3209485 - DNA, 17 bp, Homo sapiens
atatgagttactgaagg

SEQ ID NO: 3209486 - DNA, 14 bp, Homo sapiens
atatgatatgtaaa

SEQ ID NO: 3209487 - DNA, 16 bp, Homo sapiens
atatgatccagagcag

SEQ ID NO: 3209488 - DNA, 17 bp, Homo sapiens
atatgatgggggaaaaa

SEQ ID NO: 3209489 - DNA, 13 bp, Homo sapiens
atatgattataca

SEQ ID NO: 3209490 - DNA, 17 bp, Homo sapiens
atatgattattaatcag

SEQ ID NO: 3209491 - DNA, 23 bp, Homo sapiens
atatgatttcactagaaaagctg

SEQ ID NO: 3209492 - DNA, 22 bp, Homo sapiens
atatgattttatttgacaaaat

SEQ ID NO: 3209493 - DNA, 16 bp, Homo sapiens
atatgattttttaaaa

SEQ ID NO: 3209494 - DNA, 17 bp, Homo sapiens
atatgcaccttgtgtct

SEQ ID NO: 3209495 - DNA, 19 bp, Homo sapiens
atatgcaccttgtgtctgt

SEQ ID NO: 3209496 - DNA, 16 bp, Homo sapiens
atatgcagaatctctg

SEQ ID NO: 3209497 - DNA, 20 bp, Homo sapiens
atatgcagtgatatggcaga

SEQ ID NO: 3209498 - DNA, 23 bp, Homo sapiens
atatgccccttcttgggccccag

SEQ ID NO: 3209499 - DNA, 20 bp, Homo sapiens
atatgcctgaccccttgctc

SEQ ID NO: 3209500 - DNA, 14 bp, Homo sapiens
atatgccttgtata

SEQ ID NO: 3209501 - DNA, 14 bp, Homo sapiens
atatgctaatttgg

SEQ ID NO: 3209502 - DNA, 16 bp, Homo sapiens
atatgctctgctttta

SEQ ID NO: 3209503 - DNA, 18 bp, Homo sapiens
atatgctgccaaattttg

SEQ ID NO: 3209504 - DNA, 16 bp, Homo sapiens
atatgcttaaaataag

SEQ ID NO: 3209505 - DNA, 14 bp, Homo sapiens
atatgcttactgat

SEQ ID NO: 3209506 - DNA, 16 bp, Homo sapiens
atatgcttatacactt

SEQ ID NO: 3209507 - DNA, 14 bp, Homo sapiens
atatgctttattaa

SEQ ID NO: 3209508 - DNA, 19 bp, Homo sapiens
atatgctttattaatgttt

SEQ ID NO: 3209509 - DNA, 18 bp, Homo sapiens
atatggaacttctaatat

SEQ ID NO: 3209510 - DNA, 15 bp, Homo sapiens
atatggacacttaat

SEQ ID NO: 3209511 - DNA, 15 bp, Homo sapiens
atatggcaagaaagc

SEQ ID NO: 3209512 - DNA, 18 bp, Homo sapiens
atatggcaagaaagctgg

SEQ ID NO: 3209513 - DNA, 12 bp, Homo sapiens
atatggcagaag

SEQ ID NO: 3209514 - DNA, 15 bp, Homo sapiens
atatggcagaagaca

SEQ ID NO: 3209515 - DNA, 13 bp, Homo sapiens
atatggccacagt

SEQ ID NO: 3209516 - DNA, 16 bp, Homo sapiens
atatggcccagccttg

SEQ ID NO: 3209517 - DNA, 18 bp, Homo sapiens
atatggcgttttgtctgt

SEQ ID NO: 3209518 - DNA, 15 bp, Homo sapiens
atatggctgcccagg

SEQ ID NO: 3209519 - DNA, 14 bp, Homo sapiens
atatgggactgagc

SEQ ID NO: 3209520 - DNA, 16 bp, Homo sapiens
atatggggaatatatt

SEQ ID NO: 3209521 - DNA, 22 bp, Homo sapiens
atatgggttgcatttggtcaag

SEQ ID NO: 3209522 - DNA, 22 bp, Homo sapiens
atatggtctaccagtttgctga

SEQ ID NO: 3209523 - DNA, 22 bp, Homo sapiens
atatggtgcagagaagctggac

SEQ ID NO: 3209524 - DNA, 15 bp, Homo sapiens
atatggtttggtttt

SEQ ID NO: 3209525 - DNA, 15 bp, Homo sapiens
atatgtaagtacttc

SEQ ID NO: 3209526 - DNA, 15 bp, Homo sapiens
atatgtacagctctc

SEQ ID NO: 3209527 - DNA, 13 bp, Homo sapiens
atatgtacatttg

SEQ ID NO: 3209528 - DNA, 18 bp, Homo sapiens
atatgtagaaacatttag

SEQ ID NO: 3209529 - DNA, 13 bp, Homo sapiens
atatgtagactat

SEQ ID NO: 3209530 - DNA, 23 bp, Homo sapiens
atatgtagactatatacatgtgt

SEQ ID NO: 3209531 - DNA, 14 bp, Homo sapiens
atatgtagtattaa

SEQ ID NO: 3209532 - DNA, 15 bp, Homo sapiens
atatgtattcccttg

SEQ ID NO: 3209533 - DNA, 13 bp, Homo sapiens
atatgtattcttt

SEQ ID NO: 3209534 - DNA, 14 bp, Homo sapiens
atatgtattctttt

SEQ ID NO: 3209535 - DNA, 18 bp, Homo sapiens
atatgtattcttttctca

SEQ ID NO: 3209536 - DNA, 20 bp, Homo sapiens
atatgtattcttttctcagt

SEQ ID NO: 3209537 - DNA, 11 bp, Homo sapiens
atatgtcctgg

SEQ ID NO: 3209538 - DNA, 20 bp, Homo sapiens
atatgtccttgggttgctgg

SEQ ID NO: 3209539 - DNA, 20 bp, Homo sapiens
atatgtctcgctagtgatgt

SEQ ID NO: 3209540 - DNA, 21 bp, Homo sapiens
atatgtctcgctagtgatgtt

SEQ ID NO: 3209541 - DNA, 14 bp, Homo sapiens
atatgtgaaaaaaa

SEQ ID NO: 3209542 - DNA, 16 bp, Homo sapiens
atatgtgtatatatac

SEQ ID NO: 3209543 - DNA, 18 bp, Homo sapiens
atatgtgttacttcaagt

SEQ ID NO: 3209544 - DNA, 18 bp, Homo sapiens
atatgttgaatacttttt

SEQ ID NO: 3209545 - DNA, 17 bp, Homo sapiens
atatgttgagtgttcat

SEQ ID NO: 3209546 - DNA, 18 bp, Homo sapiens
atatgttgctataataaa

SEQ ID NO: 3209547 - DNA, 20 bp, Homo sapiens
atatgttgctataataaaga

SEQ ID NO: 3209548 - DNA, 16 bp, Homo sapiens
atatgttgtaatattt

SEQ ID NO: 3209549 - DNA, 18 bp, Homo sapiens
atatgttttaagaggcag

SEQ ID NO: 3209550 - DNA, 20 bp, Homo sapiens
atatgttttaagaggcaggg

SEQ ID NO: 3209551 - DNA, 18 bp, Homo sapiens
atattaaacaaagtttca

SEQ ID NO: 3209552 - DNA, 20 bp, Homo sapiens
atattaaacaaagtttcaga

SEQ ID NO: 3209553 - DNA, 22 bp, Homo sapiens
atattaaacaaagtttcagagt

SEQ ID NO: 3209554 - DNA, 12 bp, Homo sapiens
atattaaagatt

SEQ ID NO: 3209555 - DNA, 17 bp, Homo sapiens
atattaaatacagacac

SEQ ID NO: 3209556 - DNA, 20 bp, Homo sapiens
atattaaatacagacactaa

SEQ ID NO: 3209557 - DNA, 12 bp, Homo sapiens
atattaaatctg

SEQ ID NO: 3209558 - DNA, 13 bp, Homo sapiens
atattaaatctgc

SEQ ID NO: 3209559 - DNA, 15 bp, Homo sapiens
atattaagaaagact

SEQ ID NO: 3209560 - DNA, 24 bp, Homo sapiens
atattaagaaagactatctaaatg

SEQ ID NO: 3209561 - DNA, 12 bp, Homo sapiens
atattaagacag

SEQ ID NO: 3209562 - DNA, 14 bp, Homo sapiens
atattaagacagtg

SEQ ID NO: 3209563 - DNA, 17 bp, Homo sapiens
atattaagacagtgtac

SEQ ID NO: 3209564 - DNA, 19 bp, Homo sapiens
atattaagacagtgtacaa

SEQ ID NO: 3209565 - DNA, 14 bp, Homo sapiens
atattaatcaaaat

SEQ ID NO: 3209566 - DNA, 14 bp, Homo sapiens
atattaattttcca

SEQ ID NO: 3209567 - DNA, 22 bp, Homo sapiens
atattacacaggaggcttcgga

SEQ ID NO: 3209568 - DNA, 15 bp, Homo sapiens
atattacacatttgt

SEQ ID NO: 3209569 - DNA, 18 bp, Homo sapiens
atattaccaaaaaagtat

SEQ ID NO: 3209570 - DNA, 21 bp, Homo sapiens
atattaccttaagatttttct

SEQ ID NO: 3209571 - DNA, 18 bp, Homo sapiens
atattacggaggaacaga

SEQ ID NO: 3209572 - DNA, 22 bp, Homo sapiens
atattactcctatttttgtaaa

SEQ ID NO: 3209573 - DNA, 15 bp, Homo sapiens
atattactgacattt

SEQ ID NO: 3209574 - DNA, 17 bp, Homo sapiens
atattactgacatttct

SEQ ID NO: 3209575 - DNA, 18 bp, Homo sapiens
atattactgtttatttct

SEQ ID NO: 3209576 - DNA, 12 bp, Homo sapiens
atattactttat

SEQ ID NO: 3209577 - DNA, 18 bp, Homo sapiens
atattactttatcacttt

SEQ ID NO: 3209578 - DNA, 15 bp, Homo sapiens
atattagacatcaat

SEQ ID NO: 3209579 - DNA, 18 bp, Homo sapiens
atattagtgattctgatt

SEQ ID NO: 3209580 - DNA, 23 bp, Homo sapiens
atattagtgattctgatttcagt

SEQ ID NO: 3209581 - DNA, 20 bp, Homo sapiens
atattataactctgtataat

SEQ ID NO: 3209582 - DNA, 20 bp, Homo sapiens
atattatactaagaaaagat

SEQ ID NO: 3209583 - DNA, 21 bp, Homo sapiens
atattatgtatttatattttg

SEQ ID NO: 3209584 - DNA, 14 bp, Homo sapiens
atattatgtgaaga

SEQ ID NO: 3209585 - DNA, 13 bp, Homo sapiens
atattattagaaa

SEQ ID NO: 3209586 - DNA, 13 bp, Homo sapiens
atattattatata

SEQ ID NO: 3209587 - DNA, 18 bp, Homo sapiens
atattattgtaagttgta

SEQ ID NO: 3209588 - DNA, 12 bp, Homo sapiens
atattatttggc

SEQ ID NO: 3209589 - DNA, 16 bp, Homo sapiens
atattatttggcagtt

SEQ ID NO: 3209590 - DNA, 17 bp, Homo sapiens
atattatttgtgtttcc

SEQ ID NO: 3209591 - DNA, 13 bp, Homo sapiens
atattcaaagcag

SEQ ID NO: 3209592 - DNA, 19 bp, Homo sapiens
cagtccccagcccttctgc

SEQ ID NO: 3209593 - DNA, 16 bp, Homo sapiens
cagtcccccaacccca

SEQ ID NO: 3209594 - DNA, 17 bp, Homo sapiens
cagtccccctgccccag

SEQ ID NO: 3209595 - DNA, 20 bp, Homo sapiens
cagtccccgaggagctgggc

SEQ ID NO: 3209596 - DNA, 23 bp, Homo sapiens
cagtccccgtgaaggagagccct

SEQ ID NO: 3209597 - DNA, 18 bp, Homo sapiens
cagtccccgtgccccgcc

SEQ ID NO: 3209598 - DNA, 23 bp, Homo sapiens
cagtccccgtggccatccctgtg

SEQ ID NO: 3209599 - DNA, 12 bp, Homo sapiens
cagtcccctccc

SEQ ID NO: 3209600 - DNA, 15 bp, Homo sapiens
cagtcccctcccatc

SEQ ID NO: 3209601 - DNA, 20 bp, Homo sapiens
cagtcctccactcgacccag

SEQ ID NO: 3209602 - DNA, 19 bp, Homo sapiens
cagtcctcccctcacagcc

SEQ ID NO: 3209603 - DNA, 20 bp, Homo sapiens
cagtcctcccctcacagcct

SEQ ID NO: 3209604 - DNA, 23 bp, Homo sapiens
cagtcctcccctcacagcctctg

SEQ ID NO: 3209605 - DNA, 12 bp, Homo sapiens
cagtcctgcctg

SEQ ID NO: 3209606 - DNA, 15 bp, Homo sapiens
cagtcctgcctggcc

SEQ ID NO: 3209607 - DNA, 16 bp, Homo sapiens
cagtcctgctccagaa

SEQ ID NO: 3209608 - DNA, 21 bp, Homo sapiens
cagtcctgggagaacctcagg

SEQ ID NO: 3209609 - DNA, 23 bp, Homo sapiens
cagtcctgggagaacctcaggct

SEQ ID NO: 3209610 - DNA, 16 bp, Homo sapiens
cagtcctgggcaaagg

SEQ ID NO: 3209611 - DNA, 15 bp, Homo sapiens
cagtccttaaaaatc

SEQ ID NO: 3209612 - DNA, 16 bp, Homo sapiens
cagtcctttcccacca

SEQ ID NO: 3209613 - DNA, 21 bp, Homo sapiens
cagtcctttgtaaacagtgtt

SEQ ID NO: 3209614 - DNA, 14 bp, Homo sapiens
cagtcgcaggatcc

SEQ ID NO: 3209615 - DNA, 22 bp, Homo sapiens
cagtcgcaggatccgctgccac

SEQ ID NO: 3209616 - DNA, 13 bp, Homo sapiens
cagtcgggggctg

SEQ ID NO: 3209617 - DNA, 15 bp, Homo sapiens
cagtcgtgcctgtgt

SEQ ID NO: 3209618 - DNA, 17 bp, Homo sapiens
cagtcgtgcctgtgtcc

SEQ ID NO: 3209619 - DNA, 19 bp, Homo sapiens
cagtctagttgccaaatct

SEQ ID NO: 3209620 - DNA, 16 bp, Homo sapiens
cagtctatccacagag

SEQ ID NO: 3209621 - DNA, 17 bp, Homo sapiens
cagtctatccacagaga

SEQ ID NO: 3209622 - DNA, 23 bp, Homo sapiens
cagtctatccacagagagtccca

SEQ ID NO: 3209623 - DNA, 22 bp, Homo sapiens
cagtctcactgcagtcttattt

SEQ ID NO: 3209624 - DNA, 18 bp, Homo sapiens
cagtctcaggagcatggg

SEQ ID NO: 3209625 - DNA, 12 bp, Homo sapiens
cagtctcctcac

SEQ ID NO: 3209626 - DNA, 18 bp, Homo sapiens
cagtctccttcagcacgg

SEQ ID NO: 3209627 - DNA, 22 bp, Homo sapiens
cagtctctttaatcttcagttt

SEQ ID NO: 3209628 - DNA, 15 bp, Homo sapiens
cagtctctttcttcc

SEQ ID NO: 3209629 - DNA, 20 bp, Homo sapiens
cagtctctttcttcctttct

SEQ ID NO: 3209630 - DNA, 20 bp, Homo sapiens
cagtctgattcccaagctct

SEQ ID NO: 3209631 - DNA, 23 bp, Homo sapiens
cagtctgattcccaagctctgct

SEQ ID NO: 3209632 - DNA, 15 bp, Homo sapiens
cagtctggaatgcag

SEQ ID NO: 3209633 - DNA, 17 bp, Homo sapiens
cagtctgtctactgtgg

SEQ ID NO: 3209634 - DNA, 15 bp, Homo sapiens
cagtctgtggatcag

SEQ ID NO: 3209635 - DNA, 17 bp, Homo sapiens
cagtcttaatactttat

SEQ ID NO: 3209636 - DNA, 16 bp, Homo sapiens
cagtcttcctgacact

SEQ ID NO: 3209637 - DNA, 17 bp, Homo sapiens
cagtcttcctgacactt

SEQ ID NO: 3209638 - DNA, 17 bp, Homo sapiens
cagtcttccttgtctct

SEQ ID NO: 3209639 - DNA, 15 bp, Homo sapiens
cagtcttctgggctg

SEQ ID NO: 3209640 - DNA, 13 bp, Homo sapiens
cagtcttgcctag

SEQ ID NO: 3209641 - DNA, 19 bp, Homo sapiens
cagtctttaaaggcccagc

SEQ ID NO: 3209642 - DNA, 20 bp, Homo sapiens
cagtctttaaaggcccagcc

SEQ ID NO: 3209643 - DNA, 23 bp, Homo sapiens
cagtctttaaaggcccagcccct

SEQ ID NO: 3209644 - DNA, 17 bp, Homo sapiens
cagtctttgatcatcat

SEQ ID NO: 3209645 - DNA, 12 bp, Homo sapiens
cagtctttttct

SEQ ID NO: 3209646 - DNA, 20 bp, Homo sapiens
cagtctttttctgttgtaac

SEQ ID NO: 3209647 - DNA, 22 bp, Homo sapiens
cagtgaaaaatatgttgagtgt

SEQ ID NO: 3209648 - DNA, 12 bp, Homo sapiens
cagtgaaaatgt

SEQ ID NO: 3209649 - DNA, 14 bp, Homo sapiens
cagtgaaacacttg

SEQ ID NO: 3209650 - DNA, 15 bp, Homo sapiens
cagtgaaagaaactg

SEQ ID NO: 3209651 - DNA, 22 bp, Homo sapiens
cagtgaaattttggtgaatgtg

SEQ ID NO: 3209652 - DNA, 20 bp, Homo sapiens
cagtgaacttacacttggag

SEQ ID NO: 3209653 - DNA, 12 bp, Homo sapiens
cagtgaagcctc

SEQ ID NO: 3209654 - DNA, 24 bp, Homo sapiens
cagtgaaggtctttgttatgacag

SEQ ID NO: 3209655 - DNA, 22 bp, Homo sapiens
cagtgaaggtggggagaagctg

SEQ ID NO: 3209656 - DNA, 20 bp, Homo sapiens
cagtgacaaagactcctctg

SEQ ID NO: 3209657 - DNA, 17 bp, Homo sapiens
cagtgacacttcagaga

SEQ ID NO: 3209658 - DNA, 18 bp, Homo sapiens
cagtgacagacaggctct

SEQ ID NO: 3209659 - DNA, 18 bp, Homo sapiens
cagtgacagagttcacta

SEQ ID NO: 3209660 - DNA, 16 bp, Homo sapiens
cagtgaccttttcttc

SEQ ID NO: 3209661 - DNA, 16 bp, Homo sapiens
cagtgacgtgcacctg

SEQ ID NO: 3209662 - DNA, 16 bp, Homo sapiens
cagtgactttgtatag

SEQ ID NO: 3209663 - DNA, 20 bp, Homo sapiens
cagtgactttttctgagctt

SEQ ID NO: 3209664 - DNA, 17 bp, Homo sapiens
cagtgagacagtctgga

SEQ ID NO: 3209665 - DNA, 18 bp, Homo sapiens
cagtgagacagtctggaa

SEQ ID NO: 3209666 - DNA, 12 bp, Homo sapiens
cagtgagctcta

SEQ ID NO: 3209667 - DNA, 14 bp, Homo sapiens
cagtgtggagaggg

SEQ ID NO: 3209668 - DNA, 18 bp, Homo sapiens
cagtgtggtttgggaaag

SEQ ID NO: 3209669 - DNA, 21 bp, Homo sapiens
cagtgttccccatctgggtcc

SEQ ID NO: 3209670 - DNA, 14 bp, Homo sapiens
cagtgttcgcttgg

SEQ ID NO: 3209671 - DNA, 17 bp, Homo sapiens
cagtgttcgcttggctc

SEQ ID NO: 3209672 - DNA, 23 bp, Homo sapiens
cagtgttgttgctctaggaagac

SEQ ID NO: 3209673 - DNA, 16 bp, Homo sapiens
cagtgttgtttgtaaa

SEQ ID NO: 3209674 - DNA, 19 bp, Homo sapiens
cagtgttgtttgtaaataa

SEQ ID NO: 3209675 - DNA, 21 bp, Homo sapiens
cagtgttgtttgtaaataaga

SEQ ID NO: 3209676 - DNA, 22 bp, Homo sapiens
cagtgttgtttgtaaataagag

SEQ ID NO: 3209677 - DNA, 15 bp, Homo sapiens
cagtgtttcccataa

SEQ ID NO: 3209678 - DNA, 17 bp, Homo sapiens
cagtgtttcccataatt

SEQ ID NO: 3209679 - DNA, 15 bp, Homo sapiens
cagtgtttggacagg

SEQ ID NO: 3209680 - DNA, 13 bp, Homo sapiens
cagtgttttcaga

SEQ ID NO: 3209681 - DNA, 22 bp, Homo sapiens
cagtgttttctgggataagtaa

SEQ ID NO: 3209682 - DNA, 18 bp, Homo sapiens
cagtgtttttgaaaccca

SEQ ID NO: 3209683 - DNA, 22 bp, Homo sapiens
cagtgtttttgaaacccacagt

SEQ ID NO: 3209684 - DNA, 20 bp, Homo sapiens
cagttaactttcagaagaga

SEQ ID NO: 3209685 - DNA, 14 bp, Homo sapiens
cagttaagaagccc

SEQ ID NO: 3209686 - DNA, 17 bp, Homo sapiens
cagttaagaagccctgc

SEQ ID NO: 3209687 - DNA, 12 bp, Homo sapiens
cagttaattttt

SEQ ID NO: 3209688 - DNA, 19 bp, Homo sapiens
cagttaatttttccaacta

SEQ ID NO: 3209689 - DNA, 23 bp, Homo sapiens
cagttactccctacactgatgca

SEQ ID NO: 3209690 - DNA, 19 bp, Homo sapiens
cagttagggttgagttact

SEQ ID NO: 3209691 - DNA, 20 bp, Homo sapiens
cagttagggttttgcaataa

SEQ ID NO: 3209692 - DNA, 16 bp, Homo sapiens
cagttagttgtgaaag

SEQ ID NO: 3209693 - DNA, 19 bp, Homo sapiens
cagttataaaattaaaagt

SEQ ID NO: 3209694 - DNA, 21 bp, Homo sapiens
cagttataagtagcaggccaa

SEQ ID NO: 3209695 - DNA, 20 bp, Homo sapiens
cagttatacagttataaaat

SEQ ID NO: 3209696 - DNA, 15 bp, Homo sapiens
cagttatcctttgtg

SEQ ID NO: 3209697 - DNA, 15 bp, Homo sapiens
cagttatcttagctg

SEQ ID NO: 3209698 - DNA, 17 bp, Homo sapiens
cagttattttggatata

SEQ ID NO: 3209699 - DNA, 22 bp, Homo sapiens
cagttattttggatatattatt

SEQ ID NO: 3209700 - DNA, 16 bp, Homo sapiens
cagttcaaagtgtata

SEQ ID NO: 3209701 - DNA, 18 bp, Homo sapiens
cagttcaaagtgtatatt

SEQ ID NO: 3209702 - DNA, 16 bp, Homo sapiens
cagttcaactttcaga

SEQ ID NO: 3209703 - DNA, 16 bp, Homo sapiens
cagttcacaccctgca

SEQ ID NO: 3209704 - DNA, 17 bp, Homo sapiens
cagttcacaccctgcaa

SEQ ID NO: 3209705 - DNA, 20 bp, Homo sapiens
cagttcacaccctgcaaggc

SEQ ID NO: 3209706 - DNA, 16 bp, Homo sapiens
cagttcagcaccaccc

SEQ ID NO: 3209707 - DNA, 17 bp, Homo sapiens
cagttcagcaccaccct

SEQ ID NO: 3209708 - DNA, 18 bp, Homo sapiens
cagttcagtggcagggct

SEQ ID NO: 3209709 - DNA, 21 bp, Homo sapiens
cagttcagtggcagggctcag

SEQ ID NO: 3209710 - DNA, 22 bp, Homo sapiens
cagttcagtggcagggctcagg

SEQ ID NO: 3209711 - DNA, 16 bp, Homo sapiens
cagttcatcgattttc

SEQ ID NO: 3209712 - DNA, 19 bp, Homo sapiens
cagttcatcgattttctat

SEQ ID NO: 3209713 - DNA, 16 bp, Homo sapiens
cagttcatgtttgctt

SEQ ID NO: 3209714 - DNA, 18 bp, Homo sapiens
cagttcatgtttgcttca

SEQ ID NO: 3209715 - DNA, 18 bp, Homo sapiens
cagttcattgcactttga

SEQ ID NO: 3209716 - DNA, 19 bp, Homo sapiens
cagttcccccaacctcaga

SEQ ID NO: 3209717 - DNA, 15 bp, Homo sapiens
cagttcccccagtac

SEQ ID NO: 3209718 - DNA, 18 bp, Homo sapiens
cagttcccccagtacctc

SEQ ID NO: 3209719 - DNA, 21 bp, Homo sapiens
cagttcccggagcacagccct

SEQ ID NO: 3209720 - DNA, 23 bp, Homo sapiens
cagttcccggagcacagccctgg

SEQ ID NO: 3209721 - DNA, 20 bp, Homo sapiens
cagttccctttatttcacat

SEQ ID NO: 3209722 - DNA, 20 bp, Homo sapiens
cagttccggattggcttgtg

SEQ ID NO: 3209723 - DNA, 23 bp, Homo sapiens
cagttccgggagagcggctgccc

SEQ ID NO: 3209724 - DNA, 15 bp, Homo sapiens
cagttcctgggaaca

SEQ ID NO: 3209725 - DNA, 22 bp, Homo sapiens
cagttcctttgtgtgtactcac

SEQ ID NO: 3209726 - DNA, 22 bp, Homo sapiens
cagttcgggaacccccttcccc

SEQ ID NO: 3209727 - DNA, 16 bp, Homo sapiens
cagttctcactcctag

SEQ ID NO: 3209728 - DNA, 17 bp, Homo sapiens
cagttctgctcctctcc

SEQ ID NO: 3209729 - DNA, 22 bp, Homo sapiens
cagttctgctcctctccaggca

SEQ ID NO: 3209730 - DNA, 20 bp, Homo sapiens
cagttctgtggtttcatgtt

SEQ ID NO: 3209731 - DNA, 16 bp, Homo sapiens
cagttctgtgtacatt

SEQ ID NO: 3209732 - DNA, 17 bp, Homo sapiens
cagttcttggtgctctg

SEQ ID NO: 3209733 - DNA, 21 bp, Homo sapiens
cagttctttataacaaaacag

SEQ ID NO: 3209734 - DNA, 19 bp, Homo sapiens
cagttgacatccaaatcta

SEQ ID NO: 3209735 - DNA, 18 bp, Homo sapiens
cagttgagagagaatctc

SEQ ID NO: 3209736 - DNA, 16 bp, Homo sapiens
cagttgatcttcttca

SEQ ID NO: 3209737 - DNA, 14 bp, Homo sapiens
cagttgcaggagcg

SEQ ID NO: 3209738 - DNA, 19 bp, Homo sapiens
cagttgcaggagcgtgaag

SEQ ID NO: 3209739 - DNA, 15 bp, Homo sapiens
cagttgcagtgctgc

SEQ ID NO: 3209740 - DNA, 21 bp, Homo sapiens
cagttgccaaagttttgctgt

SEQ ID NO: 3209741 - DNA, 14 bp, Homo sapiens
cagttgcccagagc

SEQ ID NO: 3209742 - DNA, 21 bp, Homo sapiens
cagttgcccagagcactttag

SEQ ID NO: 3209743 - DNA, 22 bp, Homo sapiens
cagttgcccagagcactttagc

SEQ ID NO: 3209744 - DNA, 12 bp, Homo sapiens
cagttgccctag

SEQ ID NO: 3209745 - DNA, 17 bp, Homo sapiens
cagttgccctagcccag

SEQ ID NO: 3209746 - DNA, 22 bp, Homo sapiens
cagttgccctagcccagactct

SEQ ID NO: 3209747 - DNA, 18 bp, Homo sapiens
cagttgccgtctaggatt

SEQ ID NO: 3209748 - DNA, 19 bp, Homo sapiens
cagttgccgtctaggattg

SEQ ID NO: 3209749 - DNA, 13 bp, Homo sapiens
cagttgcctttta

SEQ ID NO: 3209750 - DNA, 17 bp, Homo sapiens
cagttgctcaaaaagaa

SEQ ID NO: 3209751 - DNA, 13 bp, Homo sapiens
cagttgcttgtct

SEQ ID NO: 3209752 - DNA, 14 bp, Homo sapiens
cagttgcttgtctt

SEQ ID NO: 3209753 - DNA, 22 bp, Homo sapiens
cagttggatctctggttgtcta

SEQ ID NO: 3209754 - DNA, 20 bp, Homo sapiens
cagttggcagagaaggcctc

SEQ ID NO: 3209755 - DNA, 22 bp, Homo sapiens
cagttggcagagaaggcctctt

SEQ ID NO: 3209756 - DNA, 16 bp, Homo sapiens
cagttggccttcagaa

SEQ ID NO: 3209757 - DNA, 22 bp, Homo sapiens
cagttgggacccaaaacacagg

SEQ ID NO: 3209758 - DNA, 15 bp, Homo sapiens
cagttgggactcagg

SEQ ID NO: 3209759 - DNA, 16 bp, Homo sapiens
cagttgggactcagga

SEQ ID NO: 3209760 - DNA, 22 bp, Homo sapiens
cagttggggaagccaggtgagc

SEQ ID NO: 3209761 - DNA, 23 bp, Homo sapiens
cagttgggtagatgggtgggggc

SEQ ID NO: 3209762 - DNA, 17 bp, Homo sapiens
cagttggtaacttttgt

SEQ ID NO: 3209763 - DNA, 13 bp, Homo sapiens
cagttggtggggc

SEQ ID NO: 3209764 - DNA, 14 bp, Homo sapiens
cagttgtatttaat

SEQ ID NO: 3209765 - DNA, 12 bp, Homo sapiens
cagttgtgttca

SEQ ID NO: 3209766 - DNA, 12 bp, Homo sapiens
cagttgttcttt

SEQ ID NO: 3209767 - DNA, 13 bp, Homo sapiens
cagttgttctttt

SEQ ID NO: 3209768 - DNA, 22 bp, Homo sapiens
cagtttaatgtctcctttgctc

SEQ ID NO: 3209769 - DNA, 18 bp, Homo sapiens
cagtttaccagttgcctt

SEQ ID NO: 3209770 - DNA, 19 bp, Homo sapiens
cagtttagatttcaagaaa

SEQ ID NO: 3209771 - DNA, 13 bp, Homo sapiens
cagtttagtgctt

SEQ ID NO: 3209772 - DNA, 16 bp, Homo sapiens
cagtttctccatcagc

SEQ ID NO: 3209773 - DNA, 17 bp, Homo sapiens
cagtttctccatcagct

SEQ ID NO: 3209774 - DNA, 13 bp, Homo sapiens
cagtttcttctta

SEQ ID NO: 3209775 - DNA, 22 bp, Homo sapiens
cagtttcttgcttggaagccag

SEQ ID NO: 3209776 - DNA, 15 bp, Homo sapiens
cagtttgagacagga

SEQ ID NO: 3209777 - DNA, 18 bp, Homo sapiens
cagtttgagacaggagac

SEQ ID NO: 3209778 - DNA, 12 bp, Homo sapiens
cagtttgctgta

SEQ ID NO: 3209779 - DNA, 20 bp, Homo sapiens
cagtttgggtaaaatacttt

SEQ ID NO: 3209780 - DNA, 15 bp, Homo sapiens
cagtttggtttatat

SEQ ID NO: 3209781 - DNA, 15 bp, Homo sapiens
cagtttgtgtgtctt

SEQ ID NO: 3209782 - DNA, 21 bp, Homo sapiens
cagtttgtgtgtcttaattat

SEQ ID NO: 3209783 - DNA, 16 bp, Homo sapiens
cagtttgttctccggg

SEQ ID NO: 3209784 - DNA, 14 bp, Homo sapiens
cagtttgttggaaa

SEQ ID NO: 3209785 - DNA, 13 bp, Homo sapiens
cagttttaactgt

SEQ ID NO: 3209786 - DNA, 15 bp, Homo sapiens
cagttttaactgtgg

SEQ ID NO: 3209787 - DNA, 15 bp, Homo sapiens
cagttttatcatttt

SEQ ID NO: 3209788 - DNA, 16 bp, Homo sapiens
cagttttatgctcttt

SEQ ID NO: 3209789 - DNA, 15 bp, Homo sapiens
cagttttatttttgc

SEQ ID NO: 3209790 - DNA, 22 bp, Homo sapiens
cagttttcaagtcaaattaata

SEQ ID NO: 3209791 - DNA, 23 bp, Homo sapiens
cagttttcaagtcaaattaataa

SEQ ID NO: 3209792 - DNA, 16 bp, Homo sapiens
caggtggagggcacag

SEQ ID NO: 3209793 - DNA, 18 bp, Homo sapiens
caggtggagggcacagcc

SEQ ID NO: 3209794 - DNA, 23 bp, Homo sapiens
caggtggagggcacagccctccg

SEQ ID NO: 3209795 - DNA, 16 bp, Homo sapiens
caggtggcagagtgaa

SEQ ID NO: 3209796 - DNA, 15 bp, Homo sapiens
caggtggccactcca

SEQ ID NO: 3209797 - DNA, 16 bp, Homo sapiens
caggtggccactccag

SEQ ID NO: 3209798 - DNA, 10 bp, Homo sapiens
caggtgggca

SEQ ID NO: 3209799 - DNA, 15 bp, Homo sapiens
caggtgggcagacag

SEQ ID NO: 3209800 - DNA, 21 bp, Homo sapiens
caggtgggcgtggtcactgct

SEQ ID NO: 3209801 - DNA, 13 bp, Homo sapiens
caggtggggcagc

SEQ ID NO: 3209802 - DNA, 21 bp, Homo sapiens
caggtggtgagaaatttctgt

SEQ ID NO: 3209803 - DNA, 21 bp, Homo sapiens
caggtggtggcactgagcccc

SEQ ID NO: 3209804 - DNA, 14 bp, Homo sapiens
caggtgtccctgca

SEQ ID NO: 3209805 - DNA, 18 bp, Homo sapiens
caggtgtccctgcacttg

SEQ ID NO: 3209806 - DNA, 22 bp, Homo sapiens
caggtgtcctttcccctctctg

SEQ ID NO: 3209807 - DNA, 20 bp, Homo sapiens
caggtgtgagtcaccaagcc

SEQ ID NO: 3209808 - DNA, 19 bp, Homo sapiens
caggtgttaacattccaag

SEQ ID NO: 3209809 - DNA, 12 bp, Homo sapiens
caggtgtttata

SEQ ID NO: 3209810 - DNA, 21 bp, Homo sapiens
caggtgttttttatgaagtgc

SEQ ID NO: 3209811 - DNA, 17 bp, Homo sapiens
caggttataacagtgtt

SEQ ID NO: 3209812 - DNA, 22 bp, Homo sapiens
caggttattgcaataaagtata

SEQ ID NO: 3209813 - DNA, 16 bp, Homo sapiens
caggttcaacccacag

SEQ ID NO: 3209814 - DNA, 16 bp, Homo sapiens
caggttcacactcaga

SEQ ID NO: 3209815 - DNA, 19 bp, Homo sapiens
caggttcacactcagaaag

SEQ ID NO: 3209816 - DNA, 23 bp, Homo sapiens
caggttcacactcagaaagaggt

SEQ ID NO: 3209817 - DNA, 14 bp, Homo sapiens
caggttccccaagg

SEQ ID NO: 3209818 - DNA, 21 bp, Homo sapiens
caggttccccaagggccctgg

SEQ ID NO: 3209819 - DNA, 16 bp, Homo sapiens
caggttcccccagcaa

SEQ ID NO: 3209820 - DNA, 16 bp, Homo sapiens
caggttccctcccaga

SEQ ID NO: 3209821 - DNA, 23 bp, Homo sapiens
caggttccctcccagaggagcca

SEQ ID NO: 3209822 - DNA, 23 bp, Homo sapiens
caggttctccgttagctcctgtg

SEQ ID NO: 3209823 - DNA, 21 bp, Homo sapiens
caggttgaggggctcctggaa

SEQ ID NO: 3209824 - DNA, 21 bp, Homo sapiens
caggttggaaggggccttgct

SEQ ID NO: 3209825 - DNA, 14 bp, Homo sapiens
caggttggacccca

SEQ ID NO: 3209826 - DNA, 21 bp, Homo sapiens
caggttggatgggagtgggca

SEQ ID NO: 3209827 - DNA, 12 bp, Homo sapiens
caggtttaacat

SEQ ID NO: 3209828 - DNA, 19 bp, Homo sapiens
cagtaaagagaaactttgt

SEQ ID NO: 3209829 - DNA, 23 bp, Homo sapiens
cagtaaagagaaactttgtgcta

SEQ ID NO: 3209830 - DNA, 15 bp, Homo sapiens
cagtaaagcacttgc

SEQ ID NO: 3209831 - DNA, 20 bp, Homo sapiens
cagtaacatttctgttctca

SEQ ID NO: 3209832 - DNA, 21 bp, Homo sapiens
cagtaactaattttgttgaaa

SEQ ID NO: 3209833 - DNA, 14 bp, Homo sapiens
cagtaactttatgt

SEQ ID NO: 3209834 - DNA, 21 bp, Homo sapiens
cagtaacttttttgtgtatgt

SEQ ID NO: 3209835 - DNA, 13 bp, Homo sapiens
cagtaaggcaggg

SEQ ID NO: 3209836 - DNA, 14 bp, Homo sapiens
cagtaataaaacat

SEQ ID NO: 3209837 - DNA, 15 bp, Homo sapiens
cagtacaatcagcag

SEQ ID NO: 3209838 - DNA, 14 bp, Homo sapiens
cagtacatgggaaa

SEQ ID NO: 3209839 - DNA, 16 bp, Homo sapiens
cagtacatttaaattt

SEQ ID NO: 3209840 - DNA, 20 bp, Homo sapiens
cagtacatttaaattttttg

SEQ ID NO: 3209841 - DNA, 15 bp, Homo sapiens
cagtaccctctcagc

SEQ ID NO: 3209842 - DNA, 24 bp, Homo sapiens
cagtaccctctcagctccaggtgg

SEQ ID NO: 3209843 - DNA, 20 bp, Homo sapiens
cagtacctataaagtaaagc

SEQ ID NO: 3209844 - DNA, 22 bp, Homo sapiens
cagtacctataaagtaaagcta

SEQ ID NO: 3209845 - DNA, 21 bp, Homo sapiens
cagtacctctgtatagaaatc

SEQ ID NO: 3209846 - DNA, 16 bp, Homo sapiens
cagtacctttgtcaca

SEQ ID NO: 3209847 - DNA, 15 bp, Homo sapiens
cagtactcaaattca

SEQ ID NO: 3209848 - DNA, 20 bp, Homo sapiens
cagtactttattgtacagac

SEQ ID NO: 3209849 - DNA, 17 bp, Homo sapiens
cagtacttttgttgtat

SEQ ID NO: 3209850 - DNA, 15 bp, Homo sapiens
cagtacttttttaaa

SEQ ID NO: 3209851 - DNA, 21 bp, Homo sapiens
cagtacttttttaaatatttt

SEQ ID NO: 3209852 - DNA, 13 bp, Homo sapiens
cagtagagccagc

SEQ ID NO: 3209853 - DNA, 21 bp, Homo sapiens
cagtagattcaagttgtgtct

SEQ ID NO: 3209854 - DNA, 18 bp, Homo sapiens
cagtagattgcagaaaat

SEQ ID NO: 3209855 - DNA, 15 bp, Homo sapiens
cagtagctccaacac

SEQ ID NO: 3209856 - DNA, 17 bp, Homo sapiens
cagtaggataagccact

SEQ ID NO: 3209857 - DNA, 19 bp, Homo sapiens
cagtaggcttttaccatta

SEQ ID NO: 3209858 - DNA, 18 bp, Homo sapiens
cagtaggtccaagggcca

SEQ ID NO: 3209859 - DNA, 19 bp, Homo sapiens
cagtaggtccaagggccat

SEQ ID NO: 3209860 - DNA, 16 bp, Homo sapiens
cagtagttgtattctt

SEQ ID NO: 3209861 - DNA, 19 bp, Homo sapiens
cagtataaacaaagttact

SEQ ID NO: 3209862 - DNA, 16 bp, Homo sapiens
cagtatacctcatttt

SEQ ID NO: 3209863 - DNA, 20 bp, Homo sapiens
cagtatacctcatttttcat

SEQ ID NO: 3209864 - DNA, 15 bp, Homo sapiens
cagtatactgtgtgg

SEQ ID NO: 3209865 - DNA, 14 bp, Homo sapiens
cagtatatttaaac

SEQ ID NO: 3209866 - DNA, 19 bp, Homo sapiens
cagtatctatatatgtgta

SEQ ID NO: 3209867 - DNA, 20 bp, Homo sapiens
cagtatctatatatgtgtat

SEQ ID NO: 3209868 - DNA, 20 bp, Homo sapiens
cagtatgagtcaatgtgcag

SEQ ID NO: 3209869 - DNA, 21 bp, Homo sapiens
cagtatgagtcaatgtgcagt

SEQ ID NO: 3209870 - DNA, 23 bp, Homo sapiens
cagtatgagtcaatgtgcagtgt

SEQ ID NO: 3209871 - DNA, 15 bp, Homo sapiens
cagtatgatttatcc

SEQ ID NO: 3209872 - DNA, 16 bp, Homo sapiens
cagtatgctgcccctg

SEQ ID NO: 3209873 - DNA, 21 bp, Homo sapiens
cagtatggtctaacactggca

SEQ ID NO: 3209874 - DNA, 19 bp, Homo sapiens
cagtatgtgggatattgaa

SEQ ID NO: 3209875 - DNA, 22 bp, Homo sapiens
cagtattaatactaaaatatgt

SEQ ID NO: 3209876 - DNA, 19 bp, Homo sapiens
cagtattacttctgctaca

SEQ ID NO: 3209877 - DNA, 22 bp, Homo sapiens
cagtattatgcatatataagtt

SEQ ID NO: 3209878 - DNA, 13 bp, Homo sapiens
cagtattcttgtc

SEQ ID NO: 3209879 - DNA, 18 bp, Homo sapiens
cagtattgaaaacttcaa

SEQ ID NO: 3209880 - DNA, 19 bp, Homo sapiens
cagtattgaaaacttcaaa

SEQ ID NO: 3209881 - DNA, 16 bp, Homo sapiens
cagtatttagaagcca

SEQ ID NO: 3209882 - DNA, 17 bp, Homo sapiens
cagtatttagaagccaa

SEQ ID NO: 3209883 - DNA, 14 bp, Homo sapiens
cagtatttcaactg

SEQ ID NO: 3209884 - DNA, 18 bp, Homo sapiens
cagtatttcaactgctgt

SEQ ID NO: 3209885 - DNA, 21 bp, Homo sapiens
cagtattttcccaatagcact

SEQ ID NO: 3209886 - DNA, 23 bp, Homo sapiens
cagtattttcccaatagcacttt

SEQ ID NO: 3209887 - DNA, 14 bp, Homo sapiens
cagtattttggaga

SEQ ID NO: 3209888 - DNA, 13 bp, Homo sapiens
cagtatttttaaa

SEQ ID NO: 3209889 - DNA, 15 bp, Homo sapiens
cagtatttttaaagg

SEQ ID NO: 3209890 - DNA, 18 bp, Homo sapiens
cagtatttttaaaggcat

SEQ ID NO: 3209891 - DNA, 19 bp, Homo sapiens
cagtatttttaaaggcatt

SEQ ID NO: 3209892 - DNA, 19 bp, Homo sapiens
cagtcaaaacagagatgtg

SEQ ID NO: 3209893 - DNA, 15 bp, Homo sapiens
cagtcaaaataattc

SEQ ID NO: 3209894 - DNA, 20 bp, Homo sapiens
cagtcaagaagaaaaaggtt

SEQ ID NO: 3209895 - DNA, 15 bp, Homo sapiens
cagtcaatattttta

SEQ ID NO: 3209896 - DNA, 21 bp, Homo sapiens
cagtcactccctctgccttca

SEQ ID NO: 3209897 - DNA, 14 bp, Homo sapiens
cagtcactggaggt

SEQ ID NO: 3209898 - DNA, 18 bp, Homo sapiens
cagtcactgggagaggtt

SEQ ID NO: 3209899 - DNA, 16 bp, Homo sapiens
cagtcagaaaacttta

SEQ ID NO: 3209900 - DNA, 13 bp, Homo sapiens
cagtcagcatgct

SEQ ID NO: 3209901 - DNA, 18 bp, Homo sapiens
cagtcagttcccggagca

SEQ ID NO: 3209902 - DNA, 20 bp, Homo sapiens
cagtcagttcccggagcaca

SEQ ID NO: 3209903 - DNA, 13 bp, Homo sapiens
cagtcatcatcag

SEQ ID NO: 3209904 - DNA, 18 bp, Homo sapiens
cagtcatcatcagggcct

SEQ ID NO: 3209905 - DNA, 22 bp, Homo sapiens
cagtcatcatcagggcctgggg

SEQ ID NO: 3209906 - DNA, 14 bp, Homo sapiens
cagtcatgcataaa

SEQ ID NO: 3209907 - DNA, 13 bp, Homo sapiens
cagtcattatgag

SEQ ID NO: 3209908 - DNA, 11 bp, Homo sapiens
cagtcatttaa

SEQ ID NO: 3209909 - DNA, 23 bp, Homo sapiens
cagtccaaatgtcctccagaagc

SEQ ID NO: 3209910 - DNA, 19 bp, Homo sapiens
cagtccagtgtcacctctc

SEQ ID NO: 3209911 - DNA, 16 bp, Homo sapiens
cagtccatagcagaga

SEQ ID NO: 3209912 - DNA, 22 bp, Homo sapiens
cagtcccagacaattccattca

SEQ ID NO: 3209913 - DNA, 17 bp, Homo sapiens
cagtcccagggaaggtg

SEQ ID NO: 3209914 - DNA, 22 bp, Homo sapiens
cagtcccagggaaggtggggcc

SEQ ID NO: 3209915 - DNA, 22 bp, Homo sapiens
cagtcccagtattctcagagca

SEQ ID NO: 3209916 - DNA, 15 bp, Homo sapiens
cagtccccacccctg

SEQ ID NO: 3209917 - DNA, 18 bp, Homo sapiens
cagtccccacccctgccc

SEQ ID NO: 3209918 - DNA, 21 bp, Homo sapiens
cagtccccacccctgccccca

SEQ ID NO: 3209919 - DNA, 17 bp, Homo sapiens
cagtccccagactcagc

SEQ ID NO: 3209920 - DNA, 15 bp, Homo sapiens
cactggccaccaggc

SEQ ID NO: 3209921 - DNA, 18 bp, Homo sapiens
cactggccaccaggctgg

SEQ ID NO: 3209922 - DNA, 20 bp, Homo sapiens
cactggccaccaggctggcg

SEQ ID NO: 3209923 - DNA, 11 bp, Homo sapiens
cactggccaga

SEQ ID NO: 3209924 - DNA, 15 bp, Homo sapiens
cactggccagagagg

SEQ ID NO: 3209925 - DNA, 18 bp, Homo sapiens
cactggccagagagggcc

SEQ ID NO: 3209926 - DNA, 14 bp, Homo sapiens
cactggccatccct

SEQ ID NO: 3209927 - DNA, 16 bp, Homo sapiens
cactggctaaagataa

SEQ ID NO: 3209928 - DNA, 15 bp, Homo sapiens
cactggctccatgat

SEQ ID NO: 3209929 - DNA, 22 bp, Homo sapiens
cactggctccatgattctctga

SEQ ID NO: 3209930 - DNA, 16 bp, Homo sapiens
cactggctctccaagt

SEQ ID NO: 3209931 - DNA, 18 bp, Homo sapiens
cactggctctccaagtgc

SEQ ID NO: 3209932 - DNA, 21 bp, Homo sapiens
cactggctctccaagtgccag

SEQ ID NO: 3209933 - DNA, 16 bp, Homo sapiens
cactggctctctccag

SEQ ID NO: 3209934 - DNA, 17 bp, Homo sapiens
cactggctctctccagg

SEQ ID NO: 3209935 - DNA, 17 bp, Homo sapiens
cactggctggcctgagc

SEQ ID NO: 3209936 - DNA, 18 bp, Homo sapiens
cactggctggcctgagca

SEQ ID NO: 3209937 - DNA, 13 bp, Homo sapiens
cactggctggctc

SEQ ID NO: 3209938 - DNA, 14 bp, Homo sapiens
cactggctggctcc

SEQ ID NO: 3209939 - DNA, 19 bp, Homo sapiens
cactggctggggcagaggg

SEQ ID NO: 3209940 - DNA, 22 bp, Homo sapiens
cactggctgtcagtatgacatt

SEQ ID NO: 3209941 - DNA, 18 bp, Homo sapiens
cactgggccacggaggag

SEQ ID NO: 3209942 - DNA, 20 bp, Homo sapiens
cactggggaatgctcccagc

SEQ ID NO: 3209943 - DNA, 19 bp, Homo sapiens
cactgggtggggtgaggac

SEQ ID NO: 3209944 - DNA, 23 bp, Homo sapiens
cactgggtggggtgaggaccact

SEQ ID NO: 3209945 - DNA, 17 bp, Homo sapiens
cactgggtggtggcctg

SEQ ID NO: 3209946 - DNA, 18 bp, Homo sapiens
cactgggtggtggcctgg

SEQ ID NO: 3209947 - DNA, 23 bp, Homo sapiens
cactgggtgttgatcttacaaga

SEQ ID NO: 3209948 - DNA, 20 bp, Homo sapiens
cactggtagaccaaaataaa

SEQ ID NO: 3209949 - DNA, 22 bp, Homo sapiens
cactggtaggttgggacaccag

SEQ ID NO: 3209950 - DNA, 14 bp, Homo sapiens
cactggtggcatcg

SEQ ID NO: 3209951 - DNA, 15 bp, Homo sapiens
cactggtgggcagct

SEQ ID NO: 3209952 - DNA, 18 bp, Homo sapiens
cactggtgggcagctgag

SEQ ID NO: 3209953 - DNA, 19 bp, Homo sapiens
cactggtgtgaactcaccc

SEQ ID NO: 3209954 - DNA, 20 bp, Homo sapiens
cactggtgtgaactcaccct

SEQ ID NO: 3209955 - DNA, 13 bp, Homo sapiens
cactgtaaaatga

SEQ ID NO: 3209956 - DNA, 16 bp, Homo sapiens
cactgtaaaatgaaat

SEQ ID NO: 3209957 - DNA, 18 bp, Homo sapiens
cactgtagaatgatttca

SEQ ID NO: 3209958 - DNA, 19 bp, Homo sapiens
cactgtataaataggagag

SEQ ID NO: 3209959 - DNA, 21 bp, Homo sapiens
cactgtataaataggagagga

SEQ ID NO: 3209960 - DNA, 23 bp, Homo sapiens
cactgtataaataggagaggatg

SEQ ID NO: 3209961 - DNA, 14 bp, Homo sapiens
cactgtatccaggt

SEQ ID NO: 3209962 - DNA, 15 bp, Homo sapiens
cactgtatgagtgga

SEQ ID NO: 3209963 - DNA, 16 bp, Homo sapiens
cactgtatgctggacg

SEQ ID NO: 3209964 - DNA, 18 bp, Homo sapiens
cactgtatgctggacggc

SEQ ID NO: 3209965 - DNA, 17 bp, Homo sapiens
cactgtatttgtatctc

SEQ ID NO: 3209966 - DNA, 19 bp, Homo sapiens
cactgtcactgtttctctg

SEQ ID NO: 3209967 - DNA, 22 bp, Homo sapiens
cactgtcactgtttctctgctg

SEQ ID NO: 3209968 - DNA, 13 bp, Homo sapiens
cactgtcactttg

SEQ ID NO: 3209969 - DNA, 18 bp, Homo sapiens
cactgtcaggcctctgag

SEQ ID NO: 3209970 - DNA, 14 bp, Homo sapiens
cactgtccccctac

SEQ ID NO: 3209971 - DNA, 22 bp, Homo sapiens
cactgtcctccacacaagggaa

SEQ ID NO: 3209972 - DNA, 18 bp, Homo sapiens
cactgtcgcccaggctgg

SEQ ID NO: 3209973 - DNA, 14 bp, Homo sapiens
cactgtctttttct

SEQ ID NO: 3209974 - DNA, 16 bp, Homo sapiens
cactgtgaccttgact

SEQ ID NO: 3209975 - DNA, 17 bp, Homo sapiens
cactgtgcactgccctg

SEQ ID NO: 3209976 - DNA, 21 bp, Homo sapiens
cactgtgctaataacagtgca

SEQ ID NO: 3209977 - DNA, 14 bp, Homo sapiens
cactgtgctataaa

SEQ ID NO: 3209978 - DNA, 19 bp, Homo sapiens
cactgtgcttattttgttt

SEQ ID NO: 3209979 - DNA, 19 bp, Homo sapiens
cactgtgcttcgagccaac

SEQ ID NO: 3209980 - DNA, 23 bp, Homo sapiens
cactgtggaactaataaatacat

SEQ ID NO: 3209981 - DNA, 21 bp, Homo sapiens
cactgtggccacagccccctt

SEQ ID NO: 3209982 - DNA, 15 bp, Homo sapiens
cactgtggccagagc

SEQ ID NO: 3209983 - DNA, 17 bp, Homo sapiens
cactgtggccagagctg

SEQ ID NO: 3209984 - DNA, 22 bp, Homo sapiens
cactgtggccagagctggaagg

SEQ ID NO: 3209985 - DNA, 20 bp, Homo sapiens
cactgtgggaaggccagctg

SEQ ID NO: 3209986 - DNA, 14 bp, Homo sapiens
cactgttagaacac

SEQ ID NO: 3209987 - DNA, 16 bp, Homo sapiens
cactgttagaacacta

SEQ ID NO: 3209988 - DNA, 17 bp, Homo sapiens
cactgttccctctgctc

SEQ ID NO: 3209989 - DNA, 17 bp, Homo sapiens
cactgttgcccaggctg

SEQ ID NO: 3209990 - DNA, 23 bp, Homo sapiens
cactgttgtgaatcaccaaagga

SEQ ID NO: 3209991 - DNA, 21 bp, Homo sapiens
cactgtttctcttgagctggc

SEQ ID NO: 3209992 - DNA, 15 bp, Homo sapiens
cactgtttgttttta

SEQ ID NO: 3209993 - DNA, 16 bp, Homo sapiens
cacttaaaaaatgtcc

SEQ ID NO: 3209994 - DNA, 15 bp, Homo sapiens
cacttaaaattgtaa

SEQ ID NO: 3209995 - DNA, 21 bp, Homo sapiens
cacttaaacgaagagttccct

SEQ ID NO: 3209996 - DNA, 13 bp, Homo sapiens
cacttaatagcaa

SEQ ID NO: 3209997 - DNA, 14 bp, Homo sapiens
cacttaattacagt

SEQ ID NO: 3209998 - DNA, 21 bp, Homo sapiens
cacttaattacagttaaagaa

SEQ ID NO: 3209999 - DNA, 17 bp, Homo sapiens
cacttaatttgtaaact

SEQ ID NO: 3210000 - DNA, 18 bp, Homo sapiens
cacttaatttgtaaactt

SEQ ID NO: 3210001 - DNA, 21 bp, Homo sapiens
cacttaatttgtaaacttctg

SEQ ID NO: 3210002 - DNA, 22 bp, Homo sapiens
cacttaatttgtaaacttctga

SEQ ID NO: 3210003 - DNA, 17 bp, Homo sapiens
cacttacaccagtttga

SEQ ID NO: 3210004 - DNA, 16 bp, Homo sapiens
cacttacactttatgc

SEQ ID NO: 3210005 - DNA, 15 bp, Homo sapiens
cacttactggtagga

SEQ ID NO: 3210006 - DNA, 18 bp, Homo sapiens
cacttactgtttctgtca

SEQ ID NO: 3210007 - DNA, 19 bp, Homo sapiens
cacttagaaattgcatttc

SEQ ID NO: 3210008 - DNA, 17 bp, Homo sapiens
cacttagccgcaccctg

SEQ ID NO: 3210009 - DNA, 12 bp, Homo sapiens
cacttagtcctt

SEQ ID NO: 3210010 - DNA, 21 bp, Homo sapiens
cacttagtgatcatttaaaaa

SEQ ID NO: 3210011 - DNA, 18 bp, Homo sapiens
cacttatcttctggatta

SEQ ID NO: 3210012 - DNA, 13 bp, Homo sapiens
cacttatgtactt

SEQ ID NO: 3210013 - DNA, 20 bp, Homo sapiens
cacttattccctcatccttt

SEQ ID NO: 3210014 - DNA, 20 bp, Homo sapiens
cacttatttatgaacctgcc

SEQ ID NO: 3210015 - DNA, 22 bp, Homo sapiens
cacttatttattgggatgtgag

SEQ ID NO: 3210016 - DNA, 21 bp, Homo sapiens
cacttatttcactatcttctt

SEQ ID NO: 3210017 - DNA, 18 bp, Homo sapiens
cacttcaaggtgacagaa

SEQ ID NO: 3210018 - DNA, 14 bp, Homo sapiens
cacttcacagctgg

SEQ ID NO: 3210019 - DNA, 19 bp, Homo sapiens
cacttcacgcccttggcca

SEQ ID NO: 3210020 - DNA, 15 bp, Homo sapiens
cacttcagagagctg

SEQ ID NO: 3210021 - DNA, 13 bp, Homo sapiens
cacttcagatctg

SEQ ID NO: 3210022 - DNA, 14 bp, Homo sapiens
cacttcaggctctt

SEQ ID NO: 3210023 - DNA, 20 bp, Homo sapiens
cacttcaggctcttctcctt

SEQ ID NO: 3210024 - DNA, 23 bp, Homo sapiens
cacttcaggctcttctcctttca

SEQ ID NO: 3210025 - DNA, 22 bp, Homo sapiens
cacttcattcttgaaagctgtg

SEQ ID NO: 3210026 - DNA, 22 bp, Homo sapiens
cacttcattgagagttttgtct

SEQ ID NO: 3210027 - DNA, 12 bp, Homo sapiens
cacttcattttc

SEQ ID NO: 3210028 - DNA, 20 bp, Homo sapiens
cacttccataatctggactc

SEQ ID NO: 3210029 - DNA, 21 bp, Homo sapiens
cacttccccctcttcttctga

SEQ ID NO: 3210030 - DNA, 16 bp, Homo sapiens
cacttccctacatgga

SEQ ID NO: 3210031 - DNA, 15 bp, Homo sapiens
cacttcctgctacag

SEQ ID NO: 3210032 - DNA, 16 bp, Homo sapiens
cacttcctgctacagg

SEQ ID NO: 3210033 - DNA, 17 bp, Homo sapiens
cacttcctttgtgttta

SEQ ID NO: 3210034 - DNA, 20 bp, Homo sapiens
cacttcctttgtgtttatat

SEQ ID NO: 3210035 - DNA, 23 bp, Homo sapiens
cacttcggccaggtcacacgacc

SEQ ID NO: 3210036 - DNA, 23 bp, Homo sapiens
cacttctaactccactggctcca

SEQ ID NO: 3210037 - DNA, 16 bp, Homo sapiens
cacttctcatcttaaa

SEQ ID NO: 3210038 - DNA, 22 bp, Homo sapiens
cacttctgccatattctgttgg

SEQ ID NO: 3210039 - DNA, 18 bp, Homo sapiens
cacttctgggcttcatct

SEQ ID NO: 3210040 - DNA, 20 bp, Homo sapiens
cacttctgggcttcatctgg

SEQ ID NO: 3210041 - DNA, 17 bp, Homo sapiens
cacttcttaaaggcctg

SEQ ID NO: 3210042 - DNA, 19 bp, Homo sapiens
cacttcttaaaggcctgga

SEQ ID NO: 3210043 - DNA, 21 bp, Homo sapiens
cacttgaaacctttttttatc

SEQ ID NO: 3210044 - DNA, 15 bp, Homo sapiens
cacttgaaagatttt

SEQ ID NO: 3210045 - DNA, 20 bp, Homo sapiens
cagaacttcagaaagacttg

SEQ ID NO: 3210046 - DNA, 14 bp, Homo sapiens
cagaacttccctga

SEQ ID NO: 3210047 - DNA, 15 bp, Homo sapiens
cagaacttccctgat

SEQ ID NO: 3210048 - DNA, 15 bp, Homo sapiens
cagaacttgaatgtg

SEQ ID NO: 3210049 - DNA, 14 bp, Homo sapiens
cagaagaaaattct

SEQ ID NO: 3210050 - DNA, 18 bp, Homo sapiens
cagaagacaaaaagacaa

SEQ ID NO: 3210051 - DNA, 14 bp, Homo sapiens
cagaagacaccaga

SEQ ID NO: 3210052 - DNA, 15 bp, Homo sapiens
cagaagacaccagag

SEQ ID NO: 3210053 - DNA, 16 bp, Homo sapiens
cagaagacaccagagc

SEQ ID NO: 3210054 - DNA, 21 bp, Homo sapiens
cagaagacaccagagcagatg

SEQ ID NO: 3210055 - DNA, 19 bp, Homo sapiens
cagaagacactgcaaaggc

SEQ ID NO: 3210056 - DNA, 15 bp, Homo sapiens
cagaagagaaggaag

SEQ ID NO: 3210057 - DNA, 21 bp, Homo sapiens
cagaagagatgggcttgtttt

SEQ ID NO: 3210058 - DNA, 22 bp, Homo sapiens
cagaagaggttgggcttccatg

SEQ ID NO: 3210059 - DNA, 15 bp, Homo sapiens
cagaagataacttga

SEQ ID NO: 3210060 - DNA, 20 bp, Homo sapiens
cagaagcagggtaccctttg

SEQ ID NO: 3210061 - DNA, 23 bp, Homo sapiens
cagaagcagttgagtcgtcatca

SEQ ID NO: 3210062 - DNA, 18 bp, Homo sapiens
cagaagcatattttgctg

SEQ ID NO: 3210063 - DNA, 15 bp, Homo sapiens
cagaagcatttgtat

SEQ ID NO: 3210064 - DNA, 17 bp, Homo sapiens
cagaagcatttgtattt

SEQ ID NO: 3210065 - DNA, 20 bp, Homo sapiens
cagaagcatttgtattttgt

SEQ ID NO: 3210066 - DNA, 23 bp, Homo sapiens
cagaagccctgatgtgtcctcag

SEQ ID NO: 3210067 - DNA, 21 bp, Homo sapiens
cagaagcctggactctgcccc

SEQ ID NO: 3210068 - DNA, 22 bp, Homo sapiens
cagaagcctggactctgcccca

SEQ ID NO: 3210069 - DNA, 14 bp, Homo sapiens
cagaagctattttt

SEQ ID NO: 3210070 - DNA, 14 bp, Homo sapiens
cagaagcttcagaa

SEQ ID NO: 3210071 - DNA, 18 bp, Homo sapiens
cagaaggagggcagagcc

SEQ ID NO: 3210072 - DNA, 21 bp, Homo sapiens
cagaaggagggcagagccatg

SEQ ID NO: 3210073 - DNA, 22 bp, Homo sapiens
cagaaggagggcagagccatgg

SEQ ID NO: 3210074 - DNA, 18 bp, Homo sapiens
cagaagggaattgctcag

SEQ ID NO: 3210075 - DNA, 13 bp, Homo sapiens
cagaagggctctt

SEQ ID NO: 3210076 - DNA, 20 bp, Homo sapiens
cagaaggggtttggtctggg

SEQ ID NO: 3210077 - DNA, 22 bp, Homo sapiens
cagaaggtgccactttacccac

SEQ ID NO: 3210078 - DNA, 21 bp, Homo sapiens
cagaagttttaacttccagtg

SEQ ID NO: 3210079 - DNA, 13 bp, Homo sapiens
cagaataaagcag

SEQ ID NO: 3210080 - DNA, 15 bp, Homo sapiens
cagaataaagcagcc

SEQ ID NO: 3210081 - DNA, 18 bp, Homo sapiens
cagaataaagcagcctga

SEQ ID NO: 3210082 - DNA, 22 bp, Homo sapiens
cagaataaagttctgagtgttt

SEQ ID NO: 3210083 - DNA, 11 bp, Homo sapiens
cagaataatgg

SEQ ID NO: 3210084 - DNA, 15 bp, Homo sapiens
cagaataatggaaac

SEQ ID NO: 3210085 - DNA, 16 bp, Homo sapiens
cagaataatggaaaca

SEQ ID NO: 3210086 - DNA, 19 bp, Homo sapiens
cagaataatggaaacatta

SEQ ID NO: 3210087 - DNA, 23 bp, Homo sapiens
cagaatacagtaagctgctctat

SEQ ID NO: 3210088 - DNA, 15 bp, Homo sapiens
cagaatagccacatt

SEQ ID NO: 3210089 - DNA, 22 bp, Homo sapiens
cagaatagccacatttggaata

SEQ ID NO: 3210090 - DNA, 21 bp, Homo sapiens
cagaatagcttccaataaagc

SEQ ID NO: 3210091 - DNA, 12 bp, Homo sapiens
cagaatatctgg

SEQ ID NO: 3210092 - DNA, 13 bp, Homo sapiens
cagaatattgctt

SEQ ID NO: 3210093 - DNA, 13 bp, Homo sapiens
cagaatatttcta

SEQ ID NO: 3210094 - DNA, 19 bp, Homo sapiens
cagaatatttctattgaat

SEQ ID NO: 3210095 - DNA, 18 bp, Homo sapiens
cagaatcccagccggcca

SEQ ID NO: 3210096 - DNA, 23 bp, Homo sapiens
cagaatcctcagttggaatcatt

SEQ ID NO: 3210097 - DNA, 16 bp, Homo sapiens
cagaatctaaacgtgg

SEQ ID NO: 3210098 - DNA, 17 bp, Homo sapiens
cagaatctaaacgtggt

SEQ ID NO: 3210099 - DNA, 17 bp, Homo sapiens
cagaatctgctgttgcc

SEQ ID NO: 3210100 - DNA, 21 bp, Homo sapiens
cagaatctgctgttgccatag

SEQ ID NO: 3210101 - DNA, 18 bp, Homo sapiens
cagatgcagagagccatt

SEQ ID NO: 3210102 - DNA, 16 bp, Homo sapiens
cagatgcaggacagga

SEQ ID NO: 3210103 - DNA, 19 bp, Homo sapiens
cagatgcaggacaggaggc

SEQ ID NO: 3210104 - DNA, 22 bp, Homo sapiens
cagatgcaggacaggaggcggc

SEQ ID NO: 3210105 - DNA, 15 bp, Homo sapiens
cagatgcccagaggg

SEQ ID NO: 3210106 - DNA, 19 bp, Homo sapiens
cagatgcccagagggccca

SEQ ID NO: 3210107 - DNA, 15 bp, Homo sapiens
cagatgccccagagc

SEQ ID NO: 3210108 - DNA, 11 bp, Homo sapiens
cagatgccctt

SEQ ID NO: 3210109 - DNA, 16 bp, Homo sapiens
cagatgcgtgcccagc

SEQ ID NO: 3210110 - DNA, 14 bp, Homo sapiens
cagatgctccaaga

SEQ ID NO: 3210111 - DNA, 22 bp, Homo sapiens
cagatgctccaagattctagat

SEQ ID NO: 3210112 - DNA, 22 bp, Homo sapiens
cagatgcttgcggcaaaaggaa

SEQ ID NO: 3210113 - DNA, 13 bp, Homo sapiens
cagatggaaaaat

SEQ ID NO: 3210114 - DNA, 19 bp, Homo sapiens
cagatggacagcgatgagg

SEQ ID NO: 3210115 - DNA, 22 bp, Homo sapiens
cagatggaggttctcagagcca

SEQ ID NO: 3210116 - DNA, 15 bp, Homo sapiens
cagatggatttgcct

SEQ ID NO: 3210117 - DNA, 16 bp, Homo sapiens
cagatggcccctccac

SEQ ID NO: 3210118 - DNA, 23 bp, Homo sapiens
cagatgggaggaaagagagcagg

SEQ ID NO: 3210119 - DNA, 20 bp, Homo sapiens
cagatgggtctgatattaat

SEQ ID NO: 3210120 - DNA, 21 bp, Homo sapiens
cagatgggtctgatattaatc

SEQ ID NO: 3210121 - DNA, 22 bp, Homo sapiens
cagatggtttccacatttagat

SEQ ID NO: 3210122 - DNA, 12 bp, Homo sapiens
cagatgtattga

SEQ ID NO: 3210123 - DNA, 16 bp, Homo sapiens
cagatgtcagcttccc

SEQ ID NO: 3210124 - DNA, 16 bp, Homo sapiens
cagatgtctctggggc

SEQ ID NO: 3210125 - DNA, 11 bp, Homo sapiens
cagatgtgaaa

SEQ ID NO: 3210126 - DNA, 11 bp, Homo sapiens
cagatgtgcat

SEQ ID NO: 3210127 - DNA, 15 bp, Homo sapiens
cagatgttaaaataa

SEQ ID NO: 3210128 - DNA, 16 bp, Homo sapiens
cagatgttaaaataaa

SEQ ID NO: 3210129 - DNA, 21 bp, Homo sapiens
cagatgttaaaataaatggtt

SEQ ID NO: 3210130 - DNA, 23 bp, Homo sapiens
cagatgtttccagacttccttga

SEQ ID NO: 3210131 - DNA, 18 bp, Homo sapiens
cagattaaattacagctt

SEQ ID NO: 3210132 - DNA, 20 bp, Homo sapiens
cagattaaattacagctttt

SEQ ID NO: 3210133 - DNA, 20 bp, Homo sapiens
cagattacaggaatgaagaa

SEQ ID NO: 3210134 - DNA, 21 bp, Homo sapiens
cagattacaggaatgaagaac

SEQ ID NO: 3210135 - DNA, 16 bp, Homo sapiens
cagattcaggccagcc

SEQ ID NO: 3210136 - DNA, 17 bp, Homo sapiens
cagattcaggccagccc

SEQ ID NO: 3210137 - DNA, 16 bp, Homo sapiens
cagattccaacatttc

SEQ ID NO: 3210138 - DNA, 17 bp, Homo sapiens
cagattcccagagcaaa

SEQ ID NO: 3210139 - DNA, 21 bp, Homo sapiens
cagattctgacatttatattt

SEQ ID NO: 3210140 - DNA, 18 bp, Homo sapiens
cagattgcaacaggctgg

SEQ ID NO: 3210141 - DNA, 21 bp, Homo sapiens
cagattgcaacaggctgggct

SEQ ID NO: 3210142 - DNA, 16 bp, Homo sapiens
cagattgtttctatac

SEQ ID NO: 3210143 - DNA, 17 bp, Homo sapiens
cagattgtttctataca

SEQ ID NO: 3210144 - DNA, 20 bp, Homo sapiens
cagattgtttctatacaaat

SEQ ID NO: 3210145 - DNA, 19 bp, Homo sapiens
cagatttatttttgaaaca

SEQ ID NO: 3210146 - DNA, 19 bp, Homo sapiens
cagatttgaactcttcaat

SEQ ID NO: 3210147 - DNA, 18 bp, Homo sapiens
cagatttggcttgacaaa

SEQ ID NO: 3210148 - DNA, 24 bp, Homo sapiens
cagatttgtctttttgttgtaaaa

SEQ ID NO: 3210149 - DNA, 14 bp, Homo sapiens
cagatttgtgttat

SEQ ID NO: 3210150 - DNA, 22 bp, Homo sapiens
cagattttaaaaagtcttcact

SEQ ID NO: 3210151 - DNA, 22 bp, Homo sapiens
cagattttaagggggaaaactg

SEQ ID NO: 3210152 - DNA, 16 bp, Homo sapiens
cagattttaattgtca

SEQ ID NO: 3210153 - DNA, 15 bp, Homo sapiens
cagattttaattttg

SEQ ID NO: 3210154 - DNA, 23 bp, Homo sapiens
cagattttaattttgaataaata

SEQ ID NO: 3210155 - DNA, 21 bp, Homo sapiens
cagattttatttatatcttta

SEQ ID NO: 3210156 - DNA, 23 bp, Homo sapiens
cagattttgctgtatatttgtga

SEQ ID NO: 3210157 - DNA, 23 bp, Homo sapiens
cagattttgttggcatagctctg

SEQ ID NO: 3210158 - DNA, 15 bp, Homo sapiens
cagatttttaaagtt

SEQ ID NO: 3210159 - DNA, 14 bp, Homo sapiens
cagcaaaaatataa

SEQ ID NO: 3210160 - DNA, 13 bp, Homo sapiens
cagcaaaatgttg

SEQ ID NO: 3210161 - DNA, 21 bp, Homo sapiens
cagcaaacactccaccctcca

SEQ ID NO: 3210162 - DNA, 14 bp, Homo sapiens
cagcaaattttcag

SEQ ID NO: 3210163 - DNA, 14 bp, Homo sapiens
cagcaagcgggagc

SEQ ID NO: 3210164 - DNA, 20 bp, Homo sapiens
cagcaagcgggagcccgtgg

SEQ ID NO: 3210165 - DNA, 13 bp, Homo sapiens
cagcaaggcaggt

SEQ ID NO: 3210166 - DNA, 20 bp, Homo sapiens
cagcaaggcaggttggatgg

SEQ ID NO: 3210167 - DNA, 18 bp, Homo sapiens
cagcaaggccctgctgcc

SEQ ID NO: 3210168 - DNA, 19 bp, Homo sapiens
cagcaaggccctgctgccc

SEQ ID NO: 3210169 - DNA, 14 bp, Homo sapiens
cagcaaggggctct

SEQ ID NO: 3210170 - DNA, 16 bp, Homo sapiens
cagcaaggggctctgc

SEQ ID NO: 3210171 - DNA, 14 bp, Homo sapiens
cagcaagtgagagc

SEQ ID NO: 3210172 - DNA, 21 bp, Homo sapiens
cagcaagtgagagctgggtgt

SEQ ID NO: 3210173 - DNA, 23 bp, Homo sapiens
cagcaagttagaactagccaaac

SEQ ID NO: 3210174 - DNA, 17 bp, Homo sapiens
cagcaagttcacatgga

SEQ ID NO: 3210175 - DNA, 20 bp, Homo sapiens
cagcaatactcatcagagca

SEQ ID NO: 3210176 - DNA, 19 bp, Homo sapiens
cagcaatatattaccagca

SEQ ID NO: 3210177 - DNA, 12 bp, Homo sapiens
cagcaatctgca

SEQ ID NO: 3210178 - DNA, 21 bp, Homo sapiens
cagcaatctgcattttaacaa

SEQ ID NO: 3210179 - DNA, 19 bp, Homo sapiens
cagcaatgacatctcaggg

SEQ ID NO: 3210180 - DNA, 21 bp, Homo sapiens
cagacattatgtaaaagaaag

SEQ ID NO: 3210181 - DNA, 13 bp, Homo sapiens
cagaccaccccgc

SEQ ID NO: 3210182 - DNA, 22 bp, Homo sapiens
cagaccaccccgcctgccctca

SEQ ID NO: 3210183 - DNA, 23 bp, Homo sapiens
cagaccacgcccgtcctgcctgt

SEQ ID NO: 3210184 - DNA, 13 bp, Homo sapiens
cagaccacttgcc

SEQ ID NO: 3210185 - DNA, 16 bp, Homo sapiens
cagaccacttgccacg

SEQ ID NO: 3210186 - DNA, 19 bp, Homo sapiens
cagaccacttgccacgctg

SEQ ID NO: 3210187 - DNA, 18 bp, Homo sapiens
cagaccagagctgtctga

SEQ ID NO: 3210188 - DNA, 20 bp, Homo sapiens
cagaccagtgaccccagaaa

SEQ ID NO: 3210189 - DNA, 22 bp, Homo sapiens
cagaccatgaagtaaattatgt

SEQ ID NO: 3210190 - DNA, 22 bp, Homo sapiens
cagacccaactcgcctgtggac

SEQ ID NO: 3210191 - DNA, 17 bp, Homo sapiens
cagacccaggtcttcca

SEQ ID NO: 3210192 - DNA, 22 bp, Homo sapiens
cagacccaggtcttccagacct

SEQ ID NO: 3210193 - DNA, 14 bp, Homo sapiens
cagaccccagggca

SEQ ID NO: 3210194 - DNA, 13 bp, Homo sapiens
cagacccctctgg

SEQ ID NO: 3210195 - DNA, 17 bp, Homo sapiens
cagacccctctggccag

SEQ ID NO: 3210196 - DNA, 18 bp, Homo sapiens
cagacccctctggccagg

SEQ ID NO: 3210197 - DNA, 11 bp, Homo sapiens
cagacccctgc

SEQ ID NO: 3210198 - DNA, 12 bp, Homo sapiens
cagacccctgcc

SEQ ID NO: 3210199 - DNA, 16 bp, Homo sapiens
cagacccctggctttt

SEQ ID NO: 3210200 - DNA, 21 bp, Homo sapiens
cagacccctggcttttcactg

SEQ ID NO: 3210201 - DNA, 13 bp, Homo sapiens
cagacccctggga

SEQ ID NO: 3210202 - DNA, 14 bp, Homo sapiens
cagacccggctgcg

SEQ ID NO: 3210203 - DNA, 15 bp, Homo sapiens
cagacctccccagcc

SEQ ID NO: 3210204 - DNA, 16 bp, Homo sapiens
cagacctccccagccc

SEQ ID NO: 3210205 - DNA, 21 bp, Homo sapiens
cagacctgcttcctgaaataa

SEQ ID NO: 3210206 - DNA, 23 bp, Homo sapiens
cagacctgctttttgaaatgaaa

SEQ ID NO: 3210207 - DNA, 13 bp, Homo sapiens
cagacctggagcc

SEQ ID NO: 3210208 - DNA, 22 bp, Homo sapiens
cagacctggagcccctgggtgg

SEQ ID NO: 3210209 - DNA, 13 bp, Homo sapiens
cagacctgtcttc

SEQ ID NO: 3210210 - DNA, 20 bp, Homo sapiens
cagacgcatagactgaggta

SEQ ID NO: 3210211 - DNA, 14 bp, Homo sapiens
cagacggcggccag

SEQ ID NO: 3210212 - DNA, 17 bp, Homo sapiens
cagacggcggccaggca

SEQ ID NO: 3210213 - DNA, 13 bp, Homo sapiens
cagacgggcacag

SEQ ID NO: 3210214 - DNA, 15 bp, Homo sapiens
cagacgggcacagac

SEQ ID NO: 3210215 - DNA, 13 bp, Homo sapiens
cagacggtgacgc

SEQ ID NO: 3210216 - DNA, 15 bp, Homo sapiens
cagactagatgtagt

SEQ ID NO: 3210217 - DNA, 19 bp, Homo sapiens
cagactagatgtagtattt

SEQ ID NO: 3210218 - DNA, 16 bp, Homo sapiens
cagactcagtttgtca

SEQ ID NO: 3210219 - DNA, 17 bp, Homo sapiens
cagactcagtttgtcag

SEQ ID NO: 3210220 - DNA, 16 bp, Homo sapiens
cagactccggcctgta

SEQ ID NO: 3210221 - DNA, 20 bp, Homo sapiens
cagactccggcctgtaatca

SEQ ID NO: 3210222 - DNA, 18 bp, Homo sapiens
cagactctacagaggcca

SEQ ID NO: 3210223 - DNA, 19 bp, Homo sapiens
cagactctaggttatacaa

SEQ ID NO: 3210224 - DNA, 19 bp, Homo sapiens
cagactctcagcccagaag

SEQ ID NO: 3210225 - DNA, 18 bp, Homo sapiens
cagactctttaataaatt

SEQ ID NO: 3210226 - DNA, 19 bp, Homo sapiens
cagactctttaataaattg

SEQ ID NO: 3210227 - DNA, 12 bp, Homo sapiens
cagactgcaggt

SEQ ID NO: 3210228 - DNA, 15 bp, Homo sapiens
cagactgcaggttgg

SEQ ID NO: 3210229 - DNA, 19 bp, Homo sapiens
cagactgctagtgttctgt

SEQ ID NO: 3210230 - DNA, 20 bp, Homo sapiens
cagactgctgggactggcca

SEQ ID NO: 3210231 - DNA, 17 bp, Homo sapiens
cagactggaagcacagc

SEQ ID NO: 3210232 - DNA, 20 bp, Homo sapiens
cagactggaagcacagcttc

SEQ ID NO: 3210233 - DNA, 14 bp, Homo sapiens
cagactggcaataa

SEQ ID NO: 3210234 - DNA, 15 bp, Homo sapiens
cagactggcaataaa

SEQ ID NO: 3210235 - DNA, 19 bp, Homo sapiens
cagactggcaataaactcc

SEQ ID NO: 3210236 - DNA, 18 bp, Homo sapiens
cagactggcggagaagga

SEQ ID NO: 3210237 - DNA, 23 bp, Homo sapiens
cagactggcggagaaggagagga

SEQ ID NO: 3210238 - DNA, 16 bp, Homo sapiens
cagactggctggctgc

SEQ ID NO: 3210239 - DNA, 14 bp, Homo sapiens
cagactggggcatc

SEQ ID NO: 3210240 - DNA, 16 bp, Homo sapiens
cagactgtaagatgtt

SEQ ID NO: 3210241 - DNA, 17 bp, Homo sapiens
cagactgtaagatgttg

SEQ ID NO: 3210242 - DNA, 22 bp, Homo sapiens
cagactgtaagatgttgtttta

SEQ ID NO: 3210243 - DNA, 17 bp, Homo sapiens
cagactgtgaacttgac

SEQ ID NO: 3210244 - DNA, 17 bp, Homo sapiens
cagacttcaaaaggaat

SEQ ID NO: 3210245 - DNA, 21 bp, Homo sapiens
cagacttcaaaaggaatgaac

SEQ ID NO: 3210246 - DNA, 13 bp, Homo sapiens
cagacttctccag

SEQ ID NO: 3210247 - DNA, 22 bp, Homo sapiens
cagacttctggaaggctggctg

SEQ ID NO: 3210248 - DNA, 23 bp, Homo sapiens
cagacttctggaaggctggctga

SEQ ID NO: 3210249 - DNA, 17 bp, Homo sapiens
cagactttagtgccctg

SEQ ID NO: 3210250 - DNA, 22 bp, Homo sapiens
cagactttagtgccctgccccc

SEQ ID NO: 3210251 - DNA, 12 bp, Homo sapiens
cagactttctgt

SEQ ID NO: 3210252 - DNA, 19 bp, Homo sapiens
cagagaaagtacttctcca

SEQ ID NO: 3210253 - DNA, 20 bp, Homo sapiens
cagagaaatctaagctgtgt

SEQ ID NO: 3210254 - DNA, 24 bp, Homo sapiens
cagagaacagcgaagtagcttgct

SEQ ID NO: 3210255 - DNA, 13 bp, Homo sapiens
cagagaagcagac

SEQ ID NO: 3210256 - DNA, 19 bp, Homo sapiens
cagagaagcatcctccaca

SEQ ID NO: 3210257 - DNA, 16 bp, Homo sapiens
cagagaagctggactt

SEQ ID NO: 3210258 - DNA, 15 bp, Homo sapiens
cagagaaggaaaaga

SEQ ID NO: 3210259 - DNA, 22 bp, Homo sapiens
cagagaaggaaaagactgaatc

SEQ ID NO: 3210260 - DNA, 16 bp, Homo sapiens
cagagaaggcagcagg

SEQ ID NO: 3210261 - DNA, 18 bp, Homo sapiens
cagagaaggcctcttgtg

SEQ ID NO: 3210262 - DNA, 22 bp, Homo sapiens
cagagaagggaagaaggggcca

SEQ ID NO: 3210263 - DNA, 18 bp, Homo sapiens
cagagaagggcataaaac

SEQ ID NO: 3210264 - DNA, 20 bp, Homo sapiens
cagagaagggctcctgcagg

SEQ ID NO: 3210265 - DNA, 21 bp, Homo sapiens
cagagaagggctcctgcaggc

SEQ ID NO: 3210266 - DNA, 17 bp, Homo sapiens
cagagaagtttgtagcc

SEQ ID NO: 3210267 - DNA, 20 bp, Homo sapiens
cagagaatagatcagtattt

SEQ ID NO: 3210268 - DNA, 22 bp, Homo sapiens
cagagacaacaggtaaaacagg

SEQ ID NO: 3210269 - DNA, 23 bp, Homo sapiens
cagagacaacaggtaaaacaggg

SEQ ID NO: 3210270 - DNA, 14 bp, Homo sapiens
cagagacagctgat

SEQ ID NO: 3210271 - DNA, 23 bp, Homo sapiens
cagagacaggcccaagagatgaa

SEQ ID NO: 3210272 - DNA, 13 bp, Homo sapiens
cagagacattcct

SEQ ID NO: 3210273 - DNA, 15 bp, Homo sapiens
cagagaccaggctgt

SEQ ID NO: 3210274 - DNA, 16 bp, Homo sapiens
cagagaccaggctgtg

SEQ ID NO: 3210275 - DNA, 15 bp, Homo sapiens
cagagaccctctgcc

SEQ ID NO: 3210276 - DNA, 13 bp, Homo sapiens
cagagaccgtcct

SEQ ID NO: 3210277 - DNA, 13 bp, Homo sapiens
cagagacctccaa

SEQ ID NO: 3210278 - DNA, 15 bp, Homo sapiens
cagagacctgaagtg

SEQ ID NO: 3210279 - DNA, 15 bp, Homo sapiens
cagagacgcaggaat

SEQ ID NO: 3210280 - DNA, 17 bp, Homo sapiens
cagagacgcaggaatgg

SEQ ID NO: 3210281 - DNA, 14 bp, Homo sapiens
cagagacggcagaa

SEQ ID NO: 3210282 - DNA, 17 bp, Homo sapiens
cagagactcagcgctcc

SEQ ID NO: 3210283 - DNA, 23 bp, Homo sapiens
cagagactcagcgctcctcctgt

SEQ ID NO: 3210284 - DNA, 14 bp, Homo sapiens
cagagactttgtag

SEQ ID NO: 3210285 - DNA, 13 bp, Homo sapiens
cagagagaaaaag

SEQ ID NO: 3210286 - DNA, 18 bp, Homo sapiens
cagagagacagacttgag

SEQ ID NO: 3210287 - DNA, 22 bp, Homo sapiens
cagagagaggggagaagcctgg

SEQ ID NO: 3210288 - DNA, 19 bp, Homo sapiens
cagagagccattttgtgaa

SEQ ID NO: 3210289 - DNA, 18 bp, Homo sapiens
cagagagcggtctcaggc

SEQ ID NO: 3210290 - DNA, 21 bp, Homo sapiens
cagagagcggtctcaggctgg

SEQ ID NO: 3210291 - DNA, 22 bp, Homo sapiens
cagagagcggtctcaggctggt

SEQ ID NO: 3210292 - DNA, 12 bp, Homo sapiens
cagagagctggt

SEQ ID NO: 3210293 - DNA, 13 bp, Homo sapiens
cagagaggagaaa

SEQ ID NO: 3210294 - DNA, 15 bp, Homo sapiens
cagagaggagcacct

SEQ ID NO: 3210295 - DNA, 17 bp, Homo sapiens
cagagaggagcacctga

SEQ ID NO: 3210296 - DNA, 21 bp, Homo sapiens
cagagagggagagcagagaaa

SEQ ID NO: 3210297 - DNA, 13 bp, Homo sapiens
cagagagggccca

SEQ ID NO: 3210298 - DNA, 17 bp, Homo sapiens
cagagagggtggtgacc

SEQ ID NO: 3210299 - DNA, 20 bp, Homo sapiens
cagagagggtggtgacctct

SEQ ID NO: 3210300 - DNA, 22 bp, Homo sapiens
cagagagggtggtgacctctgc

SEQ ID NO: 3210301 - DNA, 21 bp, Homo sapiens
cagagaggtctcaggttcttt

SEQ ID NO: 3210302 - DNA, 16 bp, Homo sapiens
cagagagtccaattta

SEQ ID NO: 3210303 - DNA, 17 bp, Homo sapiens
cagagagtccaatttat

SEQ ID NO: 3210304 - DNA, 15 bp, Homo sapiens
cagagataggcctgt

SEQ ID NO: 3210305 - DNA, 21 bp, Homo sapiens
cagagatgcgaaccacccaaa

SEQ ID NO: 3210306 - DNA, 22 bp, Homo sapiens
cagcctgggcctgggtggaaat

SEQ ID NO: 3210307 - DNA, 15 bp, Homo sapiens
cagcctgggcgacag

SEQ ID NO: 3210308 - DNA, 15 bp, Homo sapiens
cagcctggggcctgg

SEQ ID NO: 3210309 - DNA, 18 bp, Homo sapiens
cagcctggggcctggcag

SEQ ID NO: 3210310 - DNA, 22 bp, Homo sapiens
cagcctggggcctggcagggag

SEQ ID NO: 3210311 - DNA, 12 bp, Homo sapiens
cagcctggggct

SEQ ID NO: 3210312 - DNA, 20 bp, Homo sapiens
cagcctggggctccctctct

SEQ ID NO: 3210313 - DNA, 19 bp, Homo sapiens
cagcctgggtgacagagca

SEQ ID NO: 3210314 - DNA, 15 bp, Homo sapiens
cagcctggtgcccat

SEQ ID NO: 3210315 - DNA, 20 bp, Homo sapiens
cagcctgtgctgtggcatag

SEQ ID NO: 3210316 - DNA, 19 bp, Homo sapiens
cagcctgtggcatctttgc

SEQ ID NO: 3210317 - DNA, 14 bp, Homo sapiens
cagccttaatattt

SEQ ID NO: 3210318 - DNA, 21 bp, Homo sapiens
cagccttccccctcccagggc

SEQ ID NO: 3210319 - DNA, 13 bp, Homo sapiens
cagccttcggagc

SEQ ID NO: 3210320 - DNA, 16 bp, Homo sapiens
cagccttcttccatcc

SEQ ID NO: 3210321 - DNA, 16 bp, Homo sapiens
cagccttgagccctgg

SEQ ID NO: 3210322 - DNA, 18 bp, Homo sapiens
cagccttgagccctggct

SEQ ID NO: 3210323 - DNA, 13 bp, Homo sapiens
cagccttggctcc

SEQ ID NO: 3210324 - DNA, 20 bp, Homo sapiens
cagcctttttgtttcaatga

SEQ ID NO: 3210325 - DNA, 19 bp, Homo sapiens
cagcgaagtagcttgctcc

SEQ ID NO: 3210326 - DNA, 20 bp, Homo sapiens
cagcgaagtctcatgggaag

SEQ ID NO: 3210327 - DNA, 19 bp, Homo sapiens
cagcgacatagcccatccc

SEQ ID NO: 3210328 - DNA, 18 bp, Homo sapiens
cagcgaccttcctcatcc

SEQ ID NO: 3210329 - DNA, 13 bp, Homo sapiens
cagcgagccctgg

SEQ ID NO: 3210330 - DNA, 15 bp, Homo sapiens
cagcgagggcagctg

SEQ ID NO: 3210331 - DNA, 16 bp, Homo sapiens
cagcgagggcagctgc

SEQ ID NO: 3210332 - DNA, 18 bp, Homo sapiens
cagcgagggcagctgcta

SEQ ID NO: 3210333 - DNA, 18 bp, Homo sapiens
cagcactggctctctcca

SEQ ID NO: 3210334 - DNA, 19 bp, Homo sapiens
cagcactggctctctccag

SEQ ID NO: 3210335 - DNA, 21 bp, Homo sapiens
cagcactggctctctccagga

SEQ ID NO: 3210336 - DNA, 14 bp, Homo sapiens
cagcactgtctcag

SEQ ID NO: 3210337 - DNA, 13 bp, Homo sapiens
cagcacttccatg

SEQ ID NO: 3210338 - DNA, 16 bp, Homo sapiens
cagcacttgttttcag

SEQ ID NO: 3210339 - DNA, 17 bp, Homo sapiens
cagcactttgggaggct

SEQ ID NO: 3210340 - DNA, 15 bp, Homo sapiens
cagcagaagacaaaa

SEQ ID NO: 3210341 - DNA, 23 bp, Homo sapiens
cagcagaggacagtctggagaag

SEQ ID NO: 3210342 - DNA, 20 bp, Homo sapiens
cagcagagttattgaatctt

SEQ ID NO: 3210343 - DNA, 15 bp, Homo sapiens
cagcagcaaattttc

SEQ ID NO: 3210344 - DNA, 15 bp, Homo sapiens
cagcagcagcaggtg

SEQ ID NO: 3210345 - DNA, 16 bp, Homo sapiens
cagcagcagcaggtga

SEQ ID NO: 3210346 - DNA, 19 bp, Homo sapiens
cagcagcccagcttcctgg

SEQ ID NO: 3210347 - DNA, 21 bp, Homo sapiens
cagcagcccagcttcctggtg

SEQ ID NO: 3210348 - DNA, 23 bp, Homo sapiens
cagcagcccatggcctctggcca

SEQ ID NO: 3210349 - DNA, 17 bp, Homo sapiens
cagcagccccccagcac

SEQ ID NO: 3210350 - DNA, 18 bp, Homo sapiens
cagcagccccccagcact

SEQ ID NO: 3210351 - DNA, 21 bp, Homo sapiens
cagcagccccccagcactaag

SEQ ID NO: 3210352 - DNA, 13 bp, Homo sapiens
cagcagcccctgc

SEQ ID NO: 3210353 - DNA, 16 bp, Homo sapiens
cagcagcccctgcaca

SEQ ID NO: 3210354 - DNA, 16 bp, Homo sapiens
cagcagccctcaacag

SEQ ID NO: 3210355 - DNA, 17 bp, Homo sapiens
cagcagccctcaacagg

SEQ ID NO: 3210356 - DNA, 22 bp, Homo sapiens
cagcagccctcaacaggcccag

SEQ ID NO: 3210357 - DNA, 17 bp, Homo sapiens
cagcagctaggactgag

SEQ ID NO: 3210358 - DNA, 15 bp, Homo sapiens
cagcagctctgagcc

SEQ ID NO: 3210359 - DNA, 17 bp, Homo sapiens
cagcagctctgagccag

SEQ ID NO: 3210360 - DNA, 20 bp, Homo sapiens
cagcagctctgagccagatt

SEQ ID NO: 3210361 - DNA, 19 bp, Homo sapiens
cagcaggagagactgagca

SEQ ID NO: 3210362 - DNA, 20 bp, Homo sapiens
cagcaggagagactgagcag

SEQ ID NO: 3210363 - DNA, 15 bp, Homo sapiens
cagcaggcagcgcca

SEQ ID NO: 3210364 - DNA, 23 bp, Homo sapiens
cagcaggcggcctttgttgctca

SEQ ID NO: 3210365 - DNA, 14 bp, Homo sapiens
cagcaggctggcct

SEQ ID NO: 3210366 - DNA, 19 bp, Homo sapiens
cagcagggacaagatacat

SEQ ID NO: 3210367 - DNA, 14 bp, Homo sapiens
cagcagggcctcaa

SEQ ID NO: 3210368 - DNA, 14 bp, Homo sapiens
cagcaggggtgtga

SEQ ID NO: 3210369 - DNA, 22 bp, Homo sapiens
cagcaggtcctccatcccaaca

SEQ ID NO: 3210370 - DNA, 20 bp, Homo sapiens
cagcaggtctagaagaacaa

SEQ ID NO: 3210371 - DNA, 20 bp, Homo sapiens
cagcaggtgattggaccagg

SEQ ID NO: 3210372 - DNA, 17 bp, Homo sapiens
cagcaggtgtggtggct

SEQ ID NO: 3210373 - DNA, 21 bp, Homo sapiens
cagcaggtgtggtggctcatg

SEQ ID NO: 3210374 - DNA, 13 bp, Homo sapiens
cagcagtagcttt

SEQ ID NO: 3210375 - DNA, 22 bp, Homo sapiens
cagcagtctccttcagcacggc

SEQ ID NO: 3210376 - DNA, 19 bp, Homo sapiens
cagcagtgaccacaccaac

SEQ ID NO: 3210377 - DNA, 16 bp, Homo sapiens
cagcagtgtcatcaga

SEQ ID NO: 3210378 - DNA, 21 bp, Homo sapiens
cagcagtgttccccatctggg

SEQ ID NO: 3210379 - DNA, 23 bp, Homo sapiens
cagcagtgttccccatctgggtc

SEQ ID NO: 3210380 - DNA, 13 bp, Homo sapiens
cagcagttctgtt

SEQ ID NO: 3210381 - DNA, 18 bp, Homo sapiens
cagcatatttatagcaat

SEQ ID NO: 3210382 - DNA, 20 bp, Homo sapiens
cagcatcactccccaaggaa

SEQ ID NO: 3210383 - DNA, 20 bp, Homo sapiens
cagcatcatggaggtttgaa

SEQ ID NO: 3210384 - DNA, 13 bp, Homo sapiens
cagcatccctgga

SEQ ID NO: 3210385 - DNA, 15 bp, Homo sapiens
cagcatccctggagc

SEQ ID NO: 3210386 - DNA, 16 bp, Homo sapiens
cagcatccctggagca

SEQ ID NO: 3210387 - DNA, 23 bp, Homo sapiens
cagcatccgcaggtgctggtccc

SEQ ID NO: 3210388 - DNA, 17 bp, Homo sapiens
cagcatcctccaaaact

SEQ ID NO: 3210389 - DNA, 21 bp, Homo sapiens
cagcatcctggcacccggccc

SEQ ID NO: 3210390 - DNA, 18 bp, Homo sapiens
cagcatcgggagcaccca

SEQ ID NO: 3210391 - DNA, 19 bp, Homo sapiens
cagcatcgggagcacccag

SEQ ID NO: 3210392 - DNA, 24 bp, Homo sapiens
cagcatcgggagcacccagagcac

SEQ ID NO: 3210393 - DNA, 17 bp, Homo sapiens
cagcatctcagcgccag

SEQ ID NO: 3210394 - DNA, 23 bp, Homo sapiens
cagcatctcccagcaagacctca

SEQ ID NO: 3210395 - DNA, 15 bp, Homo sapiens
cagcatcttctggtt

SEQ ID NO: 3210396 - DNA, 18 bp, Homo sapiens
cagcatgaataaaacact

SEQ ID NO: 3210397 - DNA, 22 bp, Homo sapiens
cagcatgactatgtatttttct

SEQ ID NO: 3210398 - DNA, 15 bp, Homo sapiens
cagcatgaggacaga

SEQ ID NO: 3210399 - DNA, 23 bp, Homo sapiens
cagcatgccccttggctggatca

SEQ ID NO: 3210400 - DNA, 16 bp, Homo sapiens
cagcatgcttcccaga

SEQ ID NO: 3210401 - DNA, 17 bp, Homo sapiens
cagcatgcttcccagag

SEQ ID NO: 3210402 - DNA, 20 bp, Homo sapiens
cagcatgcttcccagaggga

SEQ ID NO: 3210403 - DNA, 15 bp, Homo sapiens
cagcatgcttgggct

SEQ ID NO: 3210404 - DNA, 17 bp, Homo sapiens
cagcatggtccctgcct

SEQ ID NO: 3210405 - DNA, 20 bp, Homo sapiens
cagcatggtccctgccttag

SEQ ID NO: 3210406 - DNA, 23 bp, Homo sapiens
cagcatggtccctgccttaggcc

SEQ ID NO: 3210407 - DNA, 22 bp, Homo sapiens
cagcatgtacggattttcagtt

SEQ ID NO: 3210408 - DNA, 12 bp, Homo sapiens
cagcatgtgcca

SEQ ID NO: 3210409 - DNA, 19 bp, Homo sapiens
cagcatgtgccaagattct

SEQ ID NO: 3210410 - DNA, 22 bp, Homo sapiens
cagcatgtgtatttccagtgca

SEQ ID NO: 3210411 - DNA, 15 bp, Homo sapiens
cagcattaggctttt

SEQ ID NO: 3210412 - DNA, 14 bp, Homo sapiens
cagcattccagact

SEQ ID NO: 3210413 - DNA, 20 bp, Homo sapiens
cagcattccagcccctctgg

SEQ ID NO: 3210414 - DNA, 14 bp, Homo sapiens
cagcattctcactc

SEQ ID NO: 3210415 - DNA, 14 bp, Homo sapiens
cagcattgctttct

SEQ ID NO: 3210416 - DNA, 16 bp, Homo sapiens
cagcattgctttctga

SEQ ID NO: 3210417 - DNA, 14 bp, Homo sapiens
cagcattgtctttg

SEQ ID NO: 3210418 - DNA, 18 bp, Homo sapiens
cagcattgtctttgctgt

SEQ ID NO: 3210419 - DNA, 17 bp, Homo sapiens
cagccaaaccctgtctg

SEQ ID NO: 3210420 - DNA, 17 bp, Homo sapiens
cagccaaatgcagggag

SEQ ID NO: 3210421 - DNA, 16 bp, Homo sapiens
cagccaactagcccct

SEQ ID NO: 3210422 - DNA, 19 bp, Homo sapiens
cagccaactagcccctggg

SEQ ID NO: 3210423 - DNA, 13 bp, Homo sapiens
cagccaactcatt

SEQ ID NO: 3210424 - DNA, 16 bp, Homo sapiens
cagccaagattttcct

SEQ ID NO: 3210425 - DNA, 23 bp, Homo sapiens
cagccaagattttcctcttgtga

SEQ ID NO: 3210426 - DNA, 13 bp, Homo sapiens
cagccaagggtcc

SEQ ID NO: 3210427 - DNA, 16 bp, Homo sapiens
cagccaagggtcctca

SEQ ID NO: 3210428 - DNA, 17 bp, Homo sapiens
cagccaagggtcctcac

SEQ ID NO: 3210429 - DNA, 22 bp, Homo sapiens
cagccaagggtcctcacccctc

SEQ ID NO: 3210430 - DNA, 23 bp, Homo sapiens
cagccaaggttttataaggctga

SEQ ID NO: 3210431 - DNA, 19 bp, Homo sapiens
cagccacacccaggcactt

SEQ ID NO: 3210432 - DNA, 13 bp, Homo sapiens
cagccacagaccc

SEQ ID NO: 3210433 - DNA, 20 bp, Homo sapiens
cagccacagacccctgggag

SEQ ID NO: 3210434 - DNA, 11 bp, Homo sapiens
cagccaccccg

SEQ ID NO: 3210435 - DNA, 17 bp, Homo sapiens
cagccaccccgggctct

SEQ ID NO: 3210436 - DNA, 20 bp, Homo sapiens
cagccaccccgggctctctg

SEQ ID NO: 3210437 - DNA, 21 bp, Homo sapiens
cagccaccccgggctctctgc

SEQ ID NO: 3210438 - DNA, 21 bp, Homo sapiens
cagccacccgtggggtgctgc

SEQ ID NO: 3210439 - DNA, 14 bp, Homo sapiens
cagccacgaccagc

SEQ ID NO: 3210440 - DNA, 17 bp, Homo sapiens
cagccacgaccagcccc

SEQ ID NO: 3210441 - DNA, 15 bp, Homo sapiens
cagccacggccaggc

SEQ ID NO: 3210442 - DNA, 23 bp, Homo sapiens
cagccacggccaggccagaggga

SEQ ID NO: 3210443 - DNA, 13 bp, Homo sapiens
cagccacttggtt

SEQ ID NO: 3210444 - DNA, 22 bp, Homo sapiens
cagccacttggtttttggctct

SEQ ID NO: 3210445 - DNA, 20 bp, Homo sapiens
cagccagagttcctgcggag

SEQ ID NO: 3210446 - DNA, 22 bp, Homo sapiens
cagccagatggactccagcctg

SEQ ID NO: 3210447 - DNA, 22 bp, Homo sapiens
cagccagcaatgatgtccagaa

SEQ ID NO: 3210448 - DNA, 23 bp, Homo sapiens
cagccagcaatgatgtccagaag

SEQ ID NO: 3210449 - DNA, 12 bp, Homo sapiens
cagccagcacct

SEQ ID NO: 3210450 - DNA, 13 bp, Homo sapiens
cagccagcacctg

SEQ ID NO: 3210451 - DNA, 14 bp, Homo sapiens
cagccagcacctgg

SEQ ID NO: 3210452 - DNA, 16 bp, Homo sapiens
cagccagcacctggca

SEQ ID NO: 3210453 - DNA, 14 bp, Homo sapiens
cagccagcagaggg

SEQ ID NO: 3210454 - DNA, 13 bp, Homo sapiens
cagccagccagtc

SEQ ID NO: 3210455 - DNA, 14 bp, Homo sapiens
cagccagccgccct

SEQ ID NO: 3210456 - DNA, 16 bp, Homo sapiens
cagccagccgccctgg

SEQ ID NO: 3210457 - DNA, 17 bp, Homo sapiens
cagccagccgccctggg

SEQ ID NO: 3210458 - DNA, 22 bp, Homo sapiens
cagctcttgctaatcagtgtct

SEQ ID NO: 3210459 - DNA, 23 bp, Homo sapiens
cagctcttgctaatcagtgtctc

SEQ ID NO: 3210460 - DNA, 20 bp, Homo sapiens
cagctgaatgcctcctgtgg

SEQ ID NO: 3210461 - DNA, 21 bp, Homo sapiens
cagctgaatgcctcctgtggg

SEQ ID NO: 3210462 - DNA, 13 bp, Homo sapiens
cagctgactaaac

SEQ ID NO: 3210463 - DNA, 15 bp, Homo sapiens
cagctgactgtggcc

SEQ ID NO: 3210464 - DNA, 16 bp, Homo sapiens
cagctgactgtggccc

SEQ ID NO: 3210465 - DNA, 20 bp, Homo sapiens
cagctgactgtggccccctc

SEQ ID NO: 3210466 - DNA, 21 bp, Homo sapiens
cagctgagagacttttaatca

SEQ ID NO: 3210467 - DNA, 21 bp, Homo sapiens
cagctgagagccctgctgtgg

SEQ ID NO: 3210468 - DNA, 16 bp, Homo sapiens
cagctgagccctgggg

SEQ ID NO: 3210469 - DNA, 17 bp, Homo sapiens
cagctgaggcaggggga

SEQ ID NO: 3210470 - DNA, 20 bp, Homo sapiens
cagctgaggtctcttgaggg

SEQ ID NO: 3210471 - DNA, 16 bp, Homo sapiens
cagctgatacttcatt

SEQ ID NO: 3210472 - DNA, 14 bp, Homo sapiens
caggataaggagac

SEQ ID NO: 3210473 - DNA, 18 bp, Homo sapiens
caggataataaagtgttt

SEQ ID NO: 3210474 - DNA, 20 bp, Homo sapiens
caggataatatatttgcaga

SEQ ID NO: 3210475 - DNA, 14 bp, Homo sapiens
caggatacatgtgc

SEQ ID NO: 3210476 - DNA, 18 bp, Homo sapiens
caggatactctgtcagat

SEQ ID NO: 3210477 - DNA, 20 bp, Homo sapiens
caggatactctgtcagatgg

SEQ ID NO: 3210478 - DNA, 18 bp, Homo sapiens
caggatactggcacagag

SEQ ID NO: 3210479 - DNA, 16 bp, Homo sapiens
caggatattagttaat

SEQ ID NO: 3210480 - DNA, 17 bp, Homo sapiens
caggatcagccccgctc

SEQ ID NO: 3210481 - DNA, 13 bp, Homo sapiens
caggatcagtctg

SEQ ID NO: 3210482 - DNA, 19 bp, Homo sapiens
caggatcatggtgtaataa

SEQ ID NO: 3210483 - DNA, 22 bp, Homo sapiens
caggatcatggtgtaataagac

SEQ ID NO: 3210484 - DNA, 17 bp, Homo sapiens
caggatccgctgccacc

SEQ ID NO: 3210485 - DNA, 18 bp, Homo sapiens
caggatccgctgccacca

SEQ ID NO: 3210486 - DNA, 19 bp, Homo sapiens
caggatccgctgccaccac

SEQ ID NO: 3210487 - DNA, 15 bp, Homo sapiens
caggatctttgactg

SEQ ID NO: 3210488 - DNA, 15 bp, Homo sapiens
caggatgaaagttcc

SEQ ID NO: 3210489 - DNA, 21 bp, Homo sapiens
caggatgacacctccatttct

SEQ ID NO: 3210490 - DNA, 19 bp, Homo sapiens
caggatgcacatttctgga

SEQ ID NO: 3210491 - DNA, 14 bp, Homo sapiens
caggatgccagccc

SEQ ID NO: 3210492 - DNA, 16 bp, Homo sapiens
caggatgccagcccct

SEQ ID NO: 3210493 - DNA, 19 bp, Homo sapiens
caggatgccagcccctgcc

SEQ ID NO: 3210494 - DNA, 22 bp, Homo sapiens
caggatgccagcccctgcctgg

SEQ ID NO: 3210495 - DNA, 21 bp, Homo sapiens
caggatgcccagatgaactga

SEQ ID NO: 3210496 - DNA, 16 bp, Homo sapiens
caggatgctgggtggc

SEQ ID NO: 3210497 - DNA, 23 bp, Homo sapiens
caggatggactcttctcggctca

SEQ ID NO: 3210498 - DNA, 19 bp, Homo sapiens
caggatgggggctggcctc

SEQ ID NO: 3210499 - DNA, 23 bp, Homo sapiens
caggatggtctcgatctcctgac

SEQ ID NO: 3210500 - DNA, 18 bp, Homo sapiens
caggatgtaggggttaac

SEQ ID NO: 3210501 - DNA, 17 bp, Homo sapiens
caggattcccccagcca

SEQ ID NO: 3210502 - DNA, 22 bp, Homo sapiens
caggatttcaccagaagttaca

SEQ ID NO: 3210503 - DNA, 19 bp, Homo sapiens
caggcaaaaaagggacagc

SEQ ID NO: 3210504 - DNA, 20 bp, Homo sapiens
caggcaaaacacgcaagggc

SEQ ID NO: 3210505 - DNA, 21 bp, Homo sapiens
caggcaaaacacgcaagggca

SEQ ID NO: 3210506 - DNA, 15 bp, Homo sapiens
caggcaagcacctcc

SEQ ID NO: 3210507 - DNA, 20 bp, Homo sapiens
caggcaagcccctcagccct

SEQ ID NO: 3210508 - DNA, 23 bp, Homo sapiens
caggcaagcccctcagcccttgc

SEQ ID NO: 3210509 - DNA, 20 bp, Homo sapiens
caggcaatgctggctgttgg

SEQ ID NO: 3210510 - DNA, 12 bp, Homo sapiens
caggcacacagc

SEQ ID NO: 3210511 - DNA, 16 bp, Homo sapiens
caggcacacagcagcc

SEQ ID NO: 3210512 - DNA, 18 bp, Homo sapiens
caggcacacagcagcccc

SEQ ID NO: 3210513 - DNA, 21 bp, Homo sapiens
caggcacacagcagcccccca

SEQ ID NO: 3210514 - DNA, 16 bp, Homo sapiens
caggcacacagggccc

SEQ ID NO: 3210515 - DNA, 13 bp, Homo sapiens
caggcaccagcat

SEQ ID NO: 3210516 - DNA, 17 bp, Homo sapiens
caggcaccagcatccac

SEQ ID NO: 3210517 - DNA, 16 bp, Homo sapiens
caggcacccttctttc

SEQ ID NO: 3210518 - DNA, 16 bp, Homo sapiens
caggcaccgagaatgt

SEQ ID NO: 3210519 - DNA, 20 bp, Homo sapiens
caggcaccgccacgtcccag

SEQ ID NO: 3210520 - DNA, 21 bp, Homo sapiens
caggcaccgccacgtcccagc

SEQ ID NO: 3210521 - DNA, 12 bp, Homo sapiens
caggcacctggc

SEQ ID NO: 3210522 - DNA, 15 bp, Homo sapiens
caggcacctggcctg

SEQ ID NO: 3210523 - DNA, 21 bp, Homo sapiens
caggcacctggcctgctggga

SEQ ID NO: 3210524 - DNA, 19 bp, Homo sapiens
caggcaccttcttggcgct

SEQ ID NO: 3210525 - DNA, 20 bp, Homo sapiens
caggcacgggtggtccccgt

SEQ ID NO: 3210526 - DNA, 23 bp, Homo sapiens
caggcacgggtggtccccgttcc

SEQ ID NO: 3210527 - DNA, 16 bp, Homo sapiens
caggcactagcctttg

SEQ ID NO: 3210528 - DNA, 23 bp, Homo sapiens
caggcactagcctttggctctgg

SEQ ID NO: 3210529 - DNA, 12 bp, Homo sapiens
caggcactccaa

SEQ ID NO: 3210530 - DNA, 16 bp, Homo sapiens
caggcactgccttctc

SEQ ID NO: 3210531 - DNA, 23 bp, Homo sapiens
caggcactgctgcccagcctcca

SEQ ID NO: 3210532 - DNA, 14 bp, Homo sapiens
caggcactggtggc

SEQ ID NO: 3210533 - DNA, 21 bp, Homo sapiens
caggcagactacacaggatga

SEQ ID NO: 3210534 - DNA, 13 bp, Homo sapiens
caggcagagctga

SEQ ID NO: 3210535 - DNA, 18 bp, Homo sapiens
caggcagatctgtgcccc

SEQ ID NO: 3210536 - DNA, 16 bp, Homo sapiens
caggcagcacagtgtg

SEQ ID NO: 3210537 - DNA, 12 bp, Homo sapiens
caggcagcgatg

SEQ ID NO: 3210538 - DNA, 21 bp, Homo sapiens
caggcagcgatggtctcagaa

SEQ ID NO: 3210539 - DNA, 10 bp, Homo sapiens
caggcagctc

SEQ ID NO: 3210540 - DNA, 14 bp, Homo sapiens
caggcagctcgagg

SEQ ID NO: 3210541 - DNA, 15 bp, Homo sapiens
caggcagctggatga

SEQ ID NO: 3210542 - DNA, 20 bp, Homo sapiens
caggcaggaacaaacagggc

SEQ ID NO: 3210543 - DNA, 16 bp, Homo sapiens
caggcaggccagatgg

SEQ ID NO: 3210544 - DNA, 20 bp, Homo sapiens
caggcaggccagatggcccc

SEQ ID NO: 3210545 - DNA, 17 bp, Homo sapiens
caggcaggggtgggggt

SEQ ID NO: 3210546 - DNA, 15 bp, Homo sapiens
caggcaggtccaggg

SEQ ID NO: 3210547 - DNA, 22 bp, Homo sapiens
caggcaggtcttgaactcctgg

SEQ ID NO: 3210548 - DNA, 21 bp, Homo sapiens
caggcagtcgggggctggcct

SEQ ID NO: 3210549 - DNA, 23 bp, Homo sapiens
caggcagtgcatgtgaagcatgc

SEQ ID NO: 3210550 - DNA, 14 bp, Homo sapiens
caggcatagaggct

SEQ ID NO: 3210551 - DNA, 19 bp, Homo sapiens
caggcatagaggcttctcc

SEQ ID NO: 3210552 - DNA, 21 bp, Homo sapiens
caggcatagaggcttctccgc

SEQ ID NO: 3210553 - DNA, 12 bp, Homo sapiens
caggcatcctcc

SEQ ID NO: 3210554 - DNA, 18 bp, Homo sapiens
caggcatctccttgggct

SEQ ID NO: 3210555 - DNA, 13 bp, Homo sapiens
caggcatgcttct

SEQ ID NO: 3210556 - DNA, 15 bp, Homo sapiens
caggcatggctcaga

SEQ ID NO: 3210557 - DNA, 23 bp, Homo sapiens
caggcatgggtgcaaggaaaatt

SEQ ID NO: 3210558 - DNA, 20 bp, Homo sapiens
caggcatgttctctgaggac

SEQ ID NO: 3210559 - DNA, 20 bp, Homo sapiens
caggcattgaggaagagtct

SEQ ID NO: 3210560 - DNA, 15 bp, Homo sapiens
caggcattggatatt

SEQ ID NO: 3210561 - DNA, 19 bp, Homo sapiens
caggcattggctcagcccg

SEQ ID NO: 3210562 - DNA, 16 bp, Homo sapiens
caggccaacagcacct

SEQ ID NO: 3210563 - DNA, 17 bp, Homo sapiens
caggccaagaaacgtct

SEQ ID NO: 3210564 - DNA, 11 bp, Homo sapiens
caggccacagc

SEQ ID NO: 3210565 - DNA, 12 bp, Homo sapiens
caggccacagcc

SEQ ID NO: 3210566 - DNA, 16 bp, Homo sapiens
caggccacagccgcct

SEQ ID NO: 3210567 - DNA, 22 bp, Homo sapiens
caggccacagccgcctttgggt

SEQ ID NO: 3210568 - DNA, 23 bp, Homo sapiens
caggccaccatattcagtgctgt

SEQ ID NO: 3210569 - DNA, 15 bp, Homo sapiens
caggccacctcccca

SEQ ID NO: 3210570 - DNA, 12 bp, Homo sapiens
caggccactgtg

SEQ ID NO: 3210571 - DNA, 14 bp, Homo sapiens
caggccactgtggc

SEQ ID NO: 3210572 - DNA, 16 bp, Homo sapiens
caggccagagggagtg

SEQ ID NO: 3210573 - DNA, 21 bp, Homo sapiens
caggccagagggagtgacaga

SEQ ID NO: 3210574 - DNA, 16 bp, Homo sapiens
caggccagatggcccc

SEQ ID NO: 3210575 - DNA, 23 bp, Homo sapiens
caggccagatggcccctccactg

SEQ ID NO: 3210576 - DNA, 14 bp, Homo sapiens
caggccagcccagc

SEQ ID NO: 3210577 - DNA, 19 bp, Homo sapiens
caggccagcccagccaggc

SEQ ID NO: 3210578 - DNA, 20 bp, Homo sapiens
caggccagcccagccaggcc

SEQ ID NO: 3210579 - DNA, 16 bp, Homo sapiens
caggccagcctccgag

SEQ ID NO: 3210580 - DNA, 23 bp, Homo sapiens
caggccagcctccgagagggaga

SEQ ID NO: 3210581 - DNA, 14 bp, Homo sapiens
caggccaggaccac

SEQ ID NO: 3210582 - DNA, 19 bp, Homo sapiens
caggccagtgtctgggttt

SEQ ID NO: 3210583 - DNA, 12 bp, Homo sapiens
caggcccagcat

SEQ ID NO: 3210584 - DNA, 14 bp, Homo sapiens
caggcccagccagt

SEQ ID NO: 3210585 - DNA, 14 bp, Homo sapiens
caggcccagcgcgg

SEQ ID NO: 3210586 - DNA, 17 bp, Homo sapiens
caggcccagcgcggcca

SEQ ID NO: 3210587 - DNA, 19 bp, Homo sapiens
caggcccagcgcggccagc

SEQ ID NO: 3210588 - DNA, 14 bp, Homo sapiens
caggcccagggagg

SEQ ID NO: 3210589 - DNA, 15 bp, Homo sapiens
caggcccagggaggg

SEQ ID NO: 3210590 - DNA, 16 bp, Homo sapiens
caggcccagggaggga

SEQ ID NO: 3210591 - DNA, 14 bp, Homo sapiens
caggcccagtgaca

SEQ ID NO: 3210592 - DNA, 20 bp, Homo sapiens
caggcccatctcaggtgcca

SEQ ID NO: 3210593 - DNA, 22 bp, Homo sapiens
caggcccatctcaggtgccact

SEQ ID NO: 3210594 - DNA, 15 bp, Homo sapiens
caggccccaggaaag

SEQ ID NO: 3210595 - DNA, 15 bp, Homo sapiens
caggcccctgccacc

SEQ ID NO: 3210596 - DNA, 20 bp, Homo sapiens
caggcccgagatgtgaccca

SEQ ID NO: 3210597 - DNA, 15 bp, Homo sapiens
cacaacatttgcaga

SEQ ID NO: 3210598 - DNA, 17 bp, Homo sapiens
cacaaccctgttttata

SEQ ID NO: 3210599 - DNA, 17 bp, Homo sapiens
cacaacctagggcaagt

SEQ ID NO: 3210600 - DNA, 23 bp, Homo sapiens
cacaaccttctgtggctcacaga

SEQ ID NO: 3210601 - DNA, 19 bp, Homo sapiens
cacaactatttttccaaaa

SEQ ID NO: 3210602 - DNA, 12 bp, Homo sapiens
cacaactccctt

SEQ ID NO: 3210603 - DNA, 15 bp, Homo sapiens
caataggcaaattaa

SEQ ID NO: 3210604 - DNA, 17 bp, Homo sapiens
caataggtctttctctc

SEQ ID NO: 3210605 - DNA, 19 bp, Homo sapiens
caataggtctttctctcag

SEQ ID NO: 3210606 - DNA, 15 bp, Homo sapiens
caatagtatttctcc

SEQ ID NO: 3210607 - DNA, 23 bp, Homo sapiens
caaagtgaaggacatagaggtat

SEQ ID NO: 3210608 - DNA, 21 bp, Homo sapiens
caaagtgagaaaatgcctcaa

SEQ ID NO: 3210609 - DNA, 15 bp, Homo sapiens
caaagtgctggattg

SEQ ID NO: 3210610 - DNA, 19 bp, Homo sapiens
caaagtgctgggattacaa

SEQ ID NO: 3210611 - DNA, 21 bp, Homo sapiens
caaagtgctgtacccttccac

SEQ ID NO: 3210612 - DNA, 19 bp, Homo sapiens
caaagtgctttgacttctt

SEQ ID NO: 3210613 - DNA, 11 bp, Homo sapiens
caaagtggaac

SEQ ID NO: 3210614 - DNA, 17 bp, Homo sapiens
caaagtggggagggaca

SEQ ID NO: 3210615 - DNA, 20 bp, Homo sapiens
caaagtggggagggacaagg

SEQ ID NO: 3210616 - DNA, 12 bp, Homo sapiens
caaagtgtatat

SEQ ID NO: 3210617 - DNA, 20 bp, Homo sapiens
caaagtgtatatttattcat

SEQ ID NO: 3210618 - DNA, 11 bp, Homo sapiens
caaagtgttaa

SEQ ID NO: 3210619 - DNA, 21 bp, Homo sapiens
caaagtgttttctcagaacag

SEQ ID NO: 3210620 - DNA, 17 bp, Homo sapiens
caaagttaaaagtaaaa

SEQ ID NO: 3210621 - DNA, 16 bp, Homo sapiens
caaagttactaggtaa

SEQ ID NO: 3210622 - DNA, 19 bp, Homo sapiens
caaagttatattcacagtt

SEQ ID NO: 3210623 - DNA, 20 bp, Homo sapiens
caaagttccctacttcctgt

SEQ ID NO: 3210624 - DNA, 20 bp, Homo sapiens
caaagttctaataatttcta

SEQ ID NO: 3210625 - DNA, 16 bp, Homo sapiens
caaagtttcagagtat

SEQ ID NO: 3210626 - DNA, 18 bp, Homo sapiens
caaagtttcagagtatat

SEQ ID NO: 3210627 - DNA, 22 bp, Homo sapiens
caaagtttcctaatcagaaatt

SEQ ID NO: 3210628 - DNA, 13 bp, Homo sapiens
caaagttttcctt

SEQ ID NO: 3210629 - DNA, 21 bp, Homo sapiens
caaagttttgaaaagctatta

SEQ ID NO: 3210630 - DNA, 18 bp, Homo sapiens
caaataaaaatattgtgt

SEQ ID NO: 3210631 - DNA, 18 bp, Homo sapiens
caaataaaattggcacca

SEQ ID NO: 3210632 - DNA, 13 bp, Homo sapiens
caaataaacagct

SEQ ID NO: 3210633 - DNA, 21 bp, Homo sapiens
caaataaacagctatttaagg

SEQ ID NO: 3210634 - DNA, 17 bp, Homo sapiens
caaataaactctaaaca

SEQ ID NO: 3210635 - DNA, 16 bp, Homo sapiens
caaataaagcctttta

SEQ ID NO: 3210636 - DNA, 22 bp, Homo sapiens
caaataaagccttttaaatcat

SEQ ID NO: 3210637 - DNA, 16 bp, Homo sapiens
caaataagtatttata

SEQ ID NO: 3210638 - DNA, 12 bp, Homo sapiens
caaataatttca

SEQ ID NO: 3210639 - DNA, 14 bp, Homo sapiens
caaataatttcata

SEQ ID NO: 3210640 - DNA, 17 bp, Homo sapiens
caaatacaaagtaaata

SEQ ID NO: 3210641 - DNA, 20 bp, Homo sapiens
caaatacaaagtaaatacaa

SEQ ID NO: 3210642 - DNA, 14 bp, Homo sapiens
caaatacacatttc

SEQ ID NO: 3210643 - DNA, 16 bp, Homo sapiens
caaatacacatttgct

SEQ ID NO: 3210644 - DNA, 19 bp, Homo sapiens
caaatacctccattaaatg

SEQ ID NO: 3210645 - DNA, 16 bp, Homo sapiens
caaatagaaaatggtc

SEQ ID NO: 3210646 - DNA, 20 bp, Homo sapiens
caaataggctattaaaaaag

SEQ ID NO: 3210647 - DNA, 21 bp, Homo sapiens
caaatagtgtgaaatatatta

SEQ ID NO: 3210648 - DNA, 16 bp, Homo sapiens
caaatataacaagtat

SEQ ID NO: 3210649 - DNA, 16 bp, Homo sapiens
caaatatagaaagttg

SEQ ID NO: 3210650 - DNA, 23 bp, Homo sapiens
caaatatagaaagttgatattca

SEQ ID NO: 3210651 - DNA, 19 bp, Homo sapiens
caaatatagcgttcccaac

SEQ ID NO: 3210652 - DNA, 15 bp, Homo sapiens
caaatatcttgtgtt

SEQ ID NO: 3210653 - DNA, 22 bp, Homo sapiens
caaatatcttgtgttgtccttt

SEQ ID NO: 3210654 - DNA, 16 bp, Homo sapiens
caaatatgttaaagtt

SEQ ID NO: 3210655 - DNA, 18 bp, Homo sapiens
caaatatgttaaagttta

SEQ ID NO: 3210656 - DNA, 15 bp, Homo sapiens
caaatattaccaaaa

SEQ ID NO: 3210657 - DNA, 23 bp, Homo sapiens
caaatattaccaaaaaagtattt

SEQ ID NO: 3210658 - DNA, 15 bp, Homo sapiens
caaatattttcatgt

SEQ ID NO: 3210659 - DNA, 17 bp, Homo sapiens
caaatcaacagaagcat

SEQ ID NO: 3210660 - DNA, 17 bp, Homo sapiens
caaatcaataagaaggt

SEQ ID NO: 3210661 - DNA, 16 bp, Homo sapiens
caaatcaattactggt

SEQ ID NO: 3210662 - DNA, 22 bp, Homo sapiens
caaatcagaagtcatcttgcta

SEQ ID NO: 3210663 - DNA, 17 bp, Homo sapiens
caaatcagtgatctatg

SEQ ID NO: 3210664 - DNA, 22 bp, Homo sapiens
caaatcagtgatctatgtttgt

SEQ ID NO: 3210665 - DNA, 16 bp, Homo sapiens
caaatcagttagtttt

SEQ ID NO: 3210666 - DNA, 20 bp, Homo sapiens
caaatcatctgcattcctga

SEQ ID NO: 3210667 - DNA, 21 bp, Homo sapiens
caaatcgtccagcgaccttcc

SEQ ID NO: 3210668 - DNA, 22 bp, Homo sapiens
caaatctaatctcttattctaa

SEQ ID NO: 3210669 - DNA, 22 bp, Homo sapiens
caaatctacagatcctttttcc

SEQ ID NO: 3210670 - DNA, 18 bp, Homo sapiens
caaatctaccactgtatg

SEQ ID NO: 3210671 - DNA, 14 bp, Homo sapiens
caaatctattcaga

SEQ ID NO: 3210672 - DNA, 16 bp, Homo sapiens
caaatctattcagaca

SEQ ID NO: 3210673 - DNA, 21 bp, Homo sapiens
caaatctcaatgaagccagct

SEQ ID NO: 3210674 - DNA, 18 bp, Homo sapiens
caaatctcccacaagtat

SEQ ID NO: 3210675 - DNA, 16 bp, Homo sapiens
caaatctgacatatta

SEQ ID NO: 3210676 - DNA, 21 bp, Homo sapiens
caaatctgacatattatgcct

SEQ ID NO: 3210677 - DNA, 21 bp, Homo sapiens
caaatctgctttttaaagaat

SEQ ID NO: 3210678 - DNA, 15 bp, Homo sapiens
caaatctgtatatgt

SEQ ID NO: 3210679 - DNA, 19 bp, Homo sapiens
caaatctgtatatgttgta

SEQ ID NO: 3210680 - DNA, 23 bp, Homo sapiens
caaatctgtatatgttgtaataa

SEQ ID NO: 3210681 - DNA, 13 bp, Homo sapiens
caaatcttgaaat

SEQ ID NO: 3210682 - DNA, 19 bp, Homo sapiens
caaatcttgaaattaagaa

SEQ ID NO: 3210683 - DNA, 16 bp, Homo sapiens
caaatcttgaatttct

SEQ ID NO: 3210684 - DNA, 13 bp, Homo sapiens
caaatgaaatgta

SEQ ID NO: 3210685 - DNA, 18 bp, Homo sapiens
caaatgaaatgtatgcat

SEQ ID NO: 3210686 - DNA, 19 bp, Homo sapiens
caaatgaattctttaagga

SEQ ID NO: 3210687 - DNA, 12 bp, Homo sapiens
caaatgacagat

SEQ ID NO: 3210688 - DNA, 20 bp, Homo sapiens
caaatgaccgcacgttctct

SEQ ID NO: 3210689 - DNA, 16 bp, Homo sapiens
caaatgagctctgaaa

SEQ ID NO: 3210690 - DNA, 21 bp, Homo sapiens
caaatgagctctgaaatcttc

SEQ ID NO: 3210691 - DNA, 15 bp, Homo sapiens
caaatgcagggaggg

SEQ ID NO: 3210692 - DNA, 23 bp, Homo sapiens
caaatgccttgaactgttgtctg

SEQ ID NO: 3210693 - DNA, 14 bp, Homo sapiens
caaatggaggaata

SEQ ID NO: 3210694 - DNA, 19 bp, Homo sapiens
caaatggaggcttttcact

SEQ ID NO: 3210695 - DNA, 19 bp, Homo sapiens
caaatggcgtctggaagtc

SEQ ID NO: 3210696 - DNA, 15 bp, Homo sapiens
caaatggtaggcatt

SEQ ID NO: 3210697 - DNA, 13 bp, Homo sapiens
caaatggttctta

SEQ ID NO: 3210698 - DNA, 19 bp, Homo sapiens
caaatggttcttacttttc

SEQ ID NO: 3210699 - DNA, 22 bp, Homo sapiens
caaatggttcttacttttcctg

SEQ ID NO: 3210700 - DNA, 23 bp, Homo sapiens
caaatggttcttacttttcctgg

SEQ ID NO: 3210701 - DNA, 16 bp, Homo sapiens
caaatggtttttgcaa

SEQ ID NO: 3210702 - DNA, 21 bp, Homo sapiens
caaatggtttttgcaagattt

SEQ ID NO: 3210703 - DNA, 18 bp, Homo sapiens
caaatgtaattgaataaa

SEQ ID NO: 3210704 - DNA, 24 bp, Homo sapiens
caaatgtcttttagaagatagatg

SEQ ID NO: 3210705 - DNA, 18 bp, Homo sapiens
caaatgtgatttttgtaa

SEQ ID NO: 3210706 - DNA, 19 bp, Homo sapiens
caaatgtgatttttgtaat

SEQ ID NO: 3210707 - DNA, 14 bp, Homo sapiens
caaatgtggctcct

SEQ ID NO: 3210708 - DNA, 17 bp, Homo sapiens
caaatgtgtataatttt

SEQ ID NO: 3210709 - DNA, 12 bp, Homo sapiens
caaatgttctaa

SEQ ID NO: 3210710 - DNA, 14 bp, Homo sapiens
caaatgttctaagt

SEQ ID NO: 3210711 - DNA, 19 bp, Homo sapiens
caaatgttctaagtttcta

SEQ ID NO: 3210712 - DNA, 18 bp, Homo sapiens
caaatgtttacagggagc

SEQ ID NO: 3210713 - DNA, 21 bp, Homo sapiens
caaattaaaaaaaaattgtat

SEQ ID NO: 3210714 - DNA, 21 bp, Homo sapiens
caaattaaaaagattcttttt

SEQ ID NO: 3210715 - DNA, 22 bp, Homo sapiens
caaattaaaaagattctttttc

SEQ ID NO: 3210716 - DNA, 23 bp, Homo sapiens
caaattaaaacatatttcatttt

SEQ ID NO: 3210717 - DNA, 15 bp, Homo sapiens
caaattaataatctt

SEQ ID NO: 3210718 - DNA, 18 bp, Homo sapiens
caaattagaaaatgttat

SEQ ID NO: 3210719 - DNA, 14 bp, Homo sapiens
caaattagggcaat

SEQ ID NO: 3210720 - DNA, 13 bp, Homo sapiens
caaattataaaaa

SEQ ID NO: 3210721 - DNA, 19 bp, Homo sapiens
caaattataaaaagccact

SEQ ID NO: 3210722 - DNA, 14 bp, Homo sapiens
caaattcaaggcct

SEQ ID NO: 3210723 - DNA, 14 bp, Homo sapiens
caaattcagcctac

SEQ ID NO: 3210724 - DNA, 19 bp, Homo sapiens
caaattctcttctttttct

SEQ ID NO: 3210725 - DNA, 17 bp, Homo sapiens
caaattgcactgaagtt

SEQ ID NO: 3210726 - DNA, 18 bp, Homo sapiens
caaattgcactgaagttt

SEQ ID NO: 3210727 - DNA, 22 bp, Homo sapiens
caaattgggacaacagtgcttt

SEQ ID NO: 3210728 - DNA, 14 bp, Homo sapiens
caaattgtatctta

SEQ ID NO: 3210729 - DNA, 15 bp, Homo sapiens
caaattgtatcttat

SEQ ID NO: 3210730 - DNA, 18 bp, Homo sapiens
caaattgtcgtttttatt

SEQ ID NO: 3210731 - DNA, 18 bp, Homo sapiens
caaattgtgcagtacttt

SEQ ID NO: 3210732 - DNA, 22 bp, Homo sapiens
caaattgtgcttctccccagaa

SEQ ID NO: 3210733 - DNA, 23 bp, Homo sapiens
caaattgtgcttctccccagaat

SEQ ID NO: 3210734 - DNA, 15 bp, Homo sapiens
caaatttacatttat

SEQ ID NO: 3210735 - DNA, 19 bp, Homo sapiens
caaactggggcctccagaa

SEQ ID NO: 3210736 - DNA, 21 bp, Homo sapiens
caaactggggcctccagaact

SEQ ID NO: 3210737 - DNA, 19 bp, Homo sapiens
caaactggtattctgttct

SEQ ID NO: 3210738 - DNA, 14 bp, Homo sapiens
caaactgtaaataa

SEQ ID NO: 3210739 - DNA, 16 bp, Homo sapiens
caaactgttcaagaaa

SEQ ID NO: 3210740 - DNA, 20 bp, Homo sapiens
caaactgttcaagaaataat

SEQ ID NO: 3210741 - DNA, 13 bp, Homo sapiens
caaactgttgatt

SEQ ID NO: 3210742 - DNA, 13 bp, Homo sapiens
caaacttactatt

SEQ ID NO: 3210743 - DNA, 18 bp, Homo sapiens
caaacttactattttgac

SEQ ID NO: 3210744 - DNA, 15 bp, Homo sapiens
caaacttagaaaggg

SEQ ID NO: 3210745 - DNA, 13 bp, Homo sapiens
caaacttcagaaa

SEQ ID NO: 3210746 - DNA, 13 bp, Homo sapiens
caaacttgcttta

SEQ ID NO: 3210747 - DNA, 22 bp, Homo sapiens
caaacttggaatttgtaacctc

SEQ ID NO: 3210748 - DNA, 18 bp, Homo sapiens
caaacttttatactcttt

SEQ ID NO: 3210749 - DNA, 19 bp, Homo sapiens
caaagaaacaagctgtgca

SEQ ID NO: 3210750 - DNA, 16 bp, Homo sapiens
caaagaaagtgtattg

SEQ ID NO: 3210751 - DNA, 16 bp, Homo sapiens
caaagaaatgaacatt

SEQ ID NO: 3210752 - DNA, 19 bp, Homo sapiens
caaagaactccagagtcag

SEQ ID NO: 3210753 - DNA, 20 bp, Homo sapiens
caaagaacttgatttgcatg

SEQ ID NO: 3210754 - DNA, 14 bp, Homo sapiens
caaagacaaaagtc

SEQ ID NO: 3210755 - DNA, 18 bp, Homo sapiens
caaagacaatcactgaaa

SEQ ID NO: 3210756 - DNA, 20 bp, Homo sapiens
caaagactcctctgggcctg

SEQ ID NO: 3210757 - DNA, 22 bp, Homo sapiens
caaagactcctctgggcctggg

SEQ ID NO: 3210758 - DNA, 14 bp, Homo sapiens
caaagactgtactg

SEQ ID NO: 3210759 - DNA, 19 bp, Homo sapiens
caaagacttagtatatttt

SEQ ID NO: 3210760 - DNA, 20 bp, Homo sapiens
caaagacttagtatattttc

SEQ ID NO: 3210761 - DNA, 20 bp, Homo sapiens
caaagagaaatcacaggggc

SEQ ID NO: 3210762 - DNA, 21 bp, Homo sapiens
caaagagaaatcacaggggcg

SEQ ID NO: 3210763 - DNA, 16 bp, Homo sapiens
caaagagaatgccatt

SEQ ID NO: 3210764 - DNA, 11 bp, Homo sapiens
caaagagatgg

SEQ ID NO: 3210765 - DNA, 23 bp, Homo sapiens
caaagagatgggccttttcttga

SEQ ID NO: 3210766 - DNA, 23 bp, Homo sapiens
caaagagccttcagaatgctcct

SEQ ID NO: 3210767 - DNA, 22 bp, Homo sapiens
caaagagcgagtcccctgcccg

SEQ ID NO: 3210768 - DNA, 21 bp, Homo sapiens
caaagaggactcgcttgtaaa

SEQ ID NO: 3210769 - DNA, 23 bp, Homo sapiens
caaagaggactcgcttgtaaata

SEQ ID NO: 3210770 - DNA, 13 bp, Homo sapiens
caaagaggctgcc

SEQ ID NO: 3210771 - DNA, 15 bp, Homo sapiens
caaagaggctgcccc

SEQ ID NO: 3210772 - DNA, 16 bp, Homo sapiens
caaagaggctgcccct

SEQ ID NO: 3210773 - DNA, 21 bp, Homo sapiens
caaagaggctgcccctctcac

SEQ ID NO: 3210774 - DNA, 23 bp, Homo sapiens
caaagaggctgcccctctcacca

SEQ ID NO: 3210775 - DNA, 13 bp, Homo sapiens
caaagaggtattt

SEQ ID NO: 3210776 - DNA, 14 bp, Homo sapiens
caaagataaggact

SEQ ID NO: 3210777 - DNA, 18 bp, Homo sapiens
caaagatcaaaataaaaa

SEQ ID NO: 3210778 - DNA, 23 bp, Homo sapiens
caaagatctgaattaaataaata

SEQ ID NO: 3210779 - DNA, 11 bp, Homo sapiens
caaagatgctg

SEQ ID NO: 3210780 - DNA, 16 bp, Homo sapiens
caaagatgtttgtcag

SEQ ID NO: 3210781 - DNA, 16 bp, Homo sapiens
caaagattaaatgtgt

SEQ ID NO: 3210782 - DNA, 22 bp, Homo sapiens
attttttaagtatttatatatt

SEQ ID NO: 3210783 - DNA, 18 bp, Homo sapiens
attttttatatatacagt

SEQ ID NO: 3210784 - DNA, 16 bp, Homo sapiens
attttttatcatgcat

SEQ ID NO: 3210785 - DNA, 21 bp, Homo sapiens
attttttatcatgcatgtcct

SEQ ID NO: 3210786 - DNA, 13 bp, Homo sapiens
attttttattgtt

SEQ ID NO: 3210787 - DNA, 17 bp, Homo sapiens
attttttatttacattt

SEQ ID NO: 3210788 - DNA, 13 bp, Homo sapiens
attttttccaaaa

SEQ ID NO: 3210789 - DNA, 15 bp, Homo sapiens
attttttccctcctg

SEQ ID NO: 3210790 - DNA, 19 bp, Homo sapiens
attttttccctcctgacaa

SEQ ID NO: 3210791 - DNA, 20 bp, Homo sapiens
attttttccctcctgacaaa

SEQ ID NO: 3210792 - DNA, 13 bp, Homo sapiens
attttttgaaagt

SEQ ID NO: 3210793 - DNA, 16 bp, Homo sapiens
attttttggcacttgc

SEQ ID NO: 3210794 - DNA, 15 bp, Homo sapiens
atttttttaaaatca

SEQ ID NO: 3210795 - DNA, 18 bp, Homo sapiens
atttttttaaaatcacta

SEQ ID NO: 3210796 - DNA, 19 bp, Homo sapiens
atttttttaactgaaaatg

SEQ ID NO: 3210797 - DNA, 21 bp, Homo sapiens
atttttttaagctatcagcaa

SEQ ID NO: 3210798 - DNA, 15 bp, Homo sapiens
atttttttagattga

SEQ ID NO: 3210799 - DNA, 15 bp, Homo sapiens
atttttttcaatatt

SEQ ID NO: 3210800 - DNA, 12 bp, Homo sapiens
atttttttctac

SEQ ID NO: 3210801 - DNA, 19 bp, Homo sapiens
attttttttaacaaatcta

SEQ ID NO: 3210802 - DNA, 15 bp, Homo sapiens
attttttttaatgta

SEQ ID NO: 3210803 - DNA, 14 bp, Homo sapiens
attttttttatatt

SEQ ID NO: 3210804 - DNA, 22 bp, Homo sapiens
attttttttatattgccttatt

SEQ ID NO: 3210805 - DNA, 19 bp, Homo sapiens
attttttttcaaaaatgct

SEQ ID NO: 3210806 - DNA, 24 bp, Homo sapiens
attttttttgttttttgtaactac

SEQ ID NO: 3210807 - DNA, 22 bp, Homo sapiens
atttttttttaattttgatata

SEQ ID NO: 3210808 - DNA, 22 bp, Homo sapiens
caaaaaaaaagttttatttttc

SEQ ID NO: 3210809 - DNA, 19 bp, Homo sapiens
caaaaaaaatttagccggg

SEQ ID NO: 3210810 - DNA, 21 bp, Homo sapiens
caaaaaaaatttagccgggcg

SEQ ID NO: 3210811 - DNA, 16 bp, Homo sapiens
caaaaaaacactagtt

SEQ ID NO: 3210812 - DNA, 18 bp, Homo sapiens
caaaaaaaccacaaaggc

SEQ ID NO: 3210813 - DNA, 22 bp, Homo sapiens
caaaaaaaccacaaaggccaaa

SEQ ID NO: 3210814 - DNA, 14 bp, Homo sapiens
caaaaaaagcctcc

SEQ ID NO: 3210815 - DNA, 15 bp, Homo sapiens
caaaaaaagcctcca

SEQ ID NO: 3210816 - DNA, 20 bp, Homo sapiens
caaaaaaagttgaaggcctt

SEQ ID NO: 3210817 - DNA, 21 bp, Homo sapiens
caaaaaaatatcagacaagca

SEQ ID NO: 3210818 - DNA, 15 bp, Homo sapiens
caaaaaaatttaaaa

SEQ ID NO: 3210819 - DNA, 16 bp, Homo sapiens
caaaaaaatttaaaat

SEQ ID NO: 3210820 - DNA, 11 bp, Homo sapiens
caaaaaacaga

SEQ ID NO: 3210821 - DNA, 12 bp, Homo sapiens
caaaaaacagat

SEQ ID NO: 3210822 - DNA, 15 bp, Homo sapiens
caaaaaagggacagc

SEQ ID NO: 3210823 - DNA, 19 bp, Homo sapiens
caaaaaagtatttttttaa

SEQ ID NO: 3210824 - DNA, 13 bp, Homo sapiens
caaaaacaaaaaa

SEQ ID NO: 3210825 - DNA, 15 bp, Homo sapiens
caaaaacaaaaacaa

SEQ ID NO: 3210826 - DNA, 22 bp, Homo sapiens
caaaaacatgtatgtgcatttc

SEQ ID NO: 3210827 - DNA, 23 bp, Homo sapiens
caaaaacatgtatgtgcatttca

SEQ ID NO: 3210828 - DNA, 14 bp, Homo sapiens
caaaaactatttgg

SEQ ID NO: 3210829 - DNA, 23 bp, Homo sapiens
caaaaactttggagtcccctcac

SEQ ID NO: 3210830 - DNA, 19 bp, Homo sapiens
caaaaagaatctgcattta

SEQ ID NO: 3210831 - DNA, 14 bp, Homo sapiens
caaaaagacaaaca

SEQ ID NO: 3210832 - DNA, 23 bp, Homo sapiens
caaaaagcagagtggactgcatt

SEQ ID NO: 3210833 - DNA, 11 bp, Homo sapiens
caaaaagtgtt

SEQ ID NO: 3210834 - DNA, 12 bp, Homo sapiens
caaaaagtgttt

SEQ ID NO: 3210835 - DNA, 21 bp, Homo sapiens
caaaaataaaaaatctgaaga

SEQ ID NO: 3210836 - DNA, 16 bp, Homo sapiens
caaaaataatcatgaa

SEQ ID NO: 3210837 - DNA, 15 bp, Homo sapiens
caaaaatagccctgc

SEQ ID NO: 3210838 - DNA, 14 bp, Homo sapiens
caaaaatagttaaa

SEQ ID NO: 3210839 - DNA, 16 bp, Homo sapiens
caaaaatagttaaaat

SEQ ID NO: 3210840 - DNA, 18 bp, Homo sapiens
caaaaatagttaaaatgc

SEQ ID NO: 3210841 - DNA, 11 bp, Homo sapiens
caaaaatataa

SEQ ID NO: 3210842 - DNA, 17 bp, Homo sapiens
caaaaatgaactgaagt

SEQ ID NO: 3210843 - DNA, 21 bp, Homo sapiens
caaaaatgacaacagaaaaac

SEQ ID NO: 3210844 - DNA, 11 bp, Homo sapiens
caaaaatggga

SEQ ID NO: 3210845 - DNA, 15 bp, Homo sapiens
caaaaatgggaaaaa

SEQ ID NO: 3210846 - DNA, 11 bp, Homo sapiens
caaaaattagg

SEQ ID NO: 3210847 - DNA, 16 bp, Homo sapiens
caaaaattaggtattt

SEQ ID NO: 3210848 - DNA, 17 bp, Homo sapiens
caaaacaaaaattaggt

SEQ ID NO: 3210849 - DNA, 19 bp, Homo sapiens
caaaacagaagcagcttct

SEQ ID NO: 3210850 - DNA, 23 bp, Homo sapiens
caaaacatagctggttaaccttg

SEQ ID NO: 3210851 - DNA, 18 bp, Homo sapiens
caaaacatattcaaagca

SEQ ID NO: 3210852 - DNA, 12 bp, Homo sapiens
caaaacattcca

SEQ ID NO: 3210853 - DNA, 13 bp, Homo sapiens
attggggtagttg

SEQ ID NO: 3210854 - DNA, 18 bp, Homo sapiens
attgggtgggtaaattca

SEQ ID NO: 3210855 - DNA, 13 bp, Homo sapiens
attgggtttttat

SEQ ID NO: 3210856 - DNA, 18 bp, Homo sapiens
attggtctaatttattca

SEQ ID NO: 3210857 - DNA, 15 bp, Homo sapiens
attggtgactcactt

SEQ ID NO: 3210858 - DNA, 14 bp, Homo sapiens
attggtttgcacaa

SEQ ID NO: 3210859 - DNA, 21 bp, Homo sapiens
attggtttggcaagaacttgt

SEQ ID NO: 3210860 - DNA, 22 bp, Homo sapiens
attggtttggcaagaacttgtt

SEQ ID NO: 3210861 - DNA, 17 bp, Homo sapiens
attgtaaaaaaaaatgc

SEQ ID NO: 3210862 - DNA, 19 bp, Homo sapiens
attgtaaaatagcttgtat

SEQ ID NO: 3210863 - DNA, 21 bp, Homo sapiens
attgtaaaatagcttgtatag

SEQ ID NO: 3210864 - DNA, 13 bp, Homo sapiens
attgtaaactgta

SEQ ID NO: 3210865 - DNA, 13 bp, Homo sapiens
attgtaactatta

SEQ ID NO: 3210866 - DNA, 20 bp, Homo sapiens
attgtaagtgaagtaaaact

SEQ ID NO: 3210867 - DNA, 18 bp, Homo sapiens
attgtaagttgtacaaat

SEQ ID NO: 3210868 - DNA, 19 bp, Homo sapiens
attgtaagttgtacaaatg

SEQ ID NO: 3210869 - DNA, 22 bp, Homo sapiens
attgtacaaaattaagcaaatg

SEQ ID NO: 3210870 - DNA, 15 bp, Homo sapiens
attgtacactatcta

SEQ ID NO: 3210871 - DNA, 17 bp, Homo sapiens
attgtacagactgtttt

SEQ ID NO: 3210872 - DNA, 22 bp, Homo sapiens
attgtacagactgttttactgt

SEQ ID NO: 3210873 - DNA, 15 bp, Homo sapiens
attgtagaattgtat

SEQ ID NO: 3210874 - DNA, 18 bp, Homo sapiens
attgtagcatttcttgat

SEQ ID NO: 3210875 - DNA, 22 bp, Homo sapiens
attgtagttctgtgtacttttt

SEQ ID NO: 3210876 - DNA, 13 bp, Homo sapiens
attgtataaacta

SEQ ID NO: 3210877 - DNA, 22 bp, Homo sapiens
attgtataaactatcagtttgt

SEQ ID NO: 3210878 - DNA, 14 bp, Homo sapiens
attgtataagtcaa

SEQ ID NO: 3210879 - DNA, 15 bp, Homo sapiens
attgtatcagaggcc

SEQ ID NO: 3210880 - DNA, 19 bp, Homo sapiens
attgtatcagaggcctata

SEQ ID NO: 3210881 - DNA, 21 bp, Homo sapiens
attgtatcagaggcctataat

SEQ ID NO: 3210882 - DNA, 16 bp, Homo sapiens
attgtatctagtgcag

SEQ ID NO: 3210883 - DNA, 19 bp, Homo sapiens
attgtatctagtgcagctg

SEQ ID NO: 3210884 - DNA, 14 bp, Homo sapiens
attgtatctcttaa

SEQ ID NO: 3210885 - DNA, 16 bp, Homo sapiens
attgtatctcttaaag

SEQ ID NO: 3210886 - DNA, 14 bp, Homo sapiens
attgtatgatgtgt

SEQ ID NO: 3210887 - DNA, 16 bp, Homo sapiens
attgtattcagataat

SEQ ID NO: 3210888 - DNA, 18 bp, Homo sapiens
attgtatttattccatat

SEQ ID NO: 3210889 - DNA, 21 bp, Homo sapiens
attgtcacctctgttaaggtt

SEQ ID NO: 3210890 - DNA, 23 bp, Homo sapiens
attgtcacctctgttaaggttga

SEQ ID NO: 3210891 - DNA, 23 bp, Homo sapiens
attgtcagatattttttcagaaa

SEQ ID NO: 3210892 - DNA, 21 bp, Homo sapiens
attgtcagccatcgtcctggg

SEQ ID NO: 3210893 - DNA, 16 bp, Homo sapiens
attgtcataagtaaac

SEQ ID NO: 3210894 - DNA, 13 bp, Homo sapiens
attgtcatttata

SEQ ID NO: 3210895 - DNA, 14 bp, Homo sapiens
attgtccttcagag

SEQ ID NO: 3210896 - DNA, 15 bp, Homo sapiens
attgtccttcagagc

SEQ ID NO: 3210897 - DNA, 21 bp, Homo sapiens
attgtccttggaggaaactta

SEQ ID NO: 3210898 - DNA, 18 bp, Homo sapiens
attgtctacatagtgaca

SEQ ID NO: 3210899 - DNA, 14 bp, Homo sapiens
attgtctgtctaca

SEQ ID NO: 3210900 - DNA, 21 bp, Homo sapiens
attgtctgtctacatttctgc

SEQ ID NO: 3210901 - DNA, 19 bp, Homo sapiens
attgtcttgttctgtccct

SEQ ID NO: 3210902 - DNA, 23 bp, Homo sapiens
attgtcttgttctgtcccttcca

SEQ ID NO: 3210903 - DNA, 20 bp, Homo sapiens
attgtctttatatgaacata

SEQ ID NO: 3210904 - DNA, 23 bp, Homo sapiens
attgtctttatgagctaaaaata

SEQ ID NO: 3210905 - DNA, 23 bp, Homo sapiens
attgtcttttagacaactagatt

SEQ ID NO: 3210906 - DNA, 16 bp, Homo sapiens
attgtgaccaagttat

SEQ ID NO: 3210907 - DNA, 17 bp, Homo sapiens
attgtgaccaagttata

SEQ ID NO: 3210908 - DNA, 21 bp, Homo sapiens
attgtgaccacaggctggtgt

SEQ ID NO: 3210909 - DNA, 22 bp, Homo sapiens
attgtgcataatgctttggaaa

SEQ ID NO: 3210910 - DNA, 19 bp, Homo sapiens
attgtgccaatatgtattg

SEQ ID NO: 3210911 - DNA, 20 bp, Homo sapiens
attgtgcttcacagtagagc

SEQ ID NO: 3210912 - DNA, 18 bp, Homo sapiens
attgtgcttctccccaga

SEQ ID NO: 3210913 - DNA, 17 bp, Homo sapiens
attgtggaaaaccagga

SEQ ID NO: 3210914 - DNA, 18 bp, Homo sapiens
attgtgggggaaaaataa

SEQ ID NO: 3210915 - DNA, 21 bp, Homo sapiens
attgtggtaggccttttaaca

SEQ ID NO: 3210916 - DNA, 22 bp, Homo sapiens
attgtggtaggccttttaacat

SEQ ID NO: 3210917 - DNA, 15 bp, Homo sapiens
attgtgtaaaaaatg

SEQ ID NO: 3210918 - DNA, 15 bp, Homo sapiens
attgtgtatattcat

SEQ ID NO: 3210919 - DNA, 18 bp, Homo sapiens
attgtgtcagaaacatga

SEQ ID NO: 3210920 - DNA, 18 bp, Homo sapiens
attgtgttgactttataa

SEQ ID NO: 3210921 - DNA, 17 bp, Homo sapiens
attgtgttgtgaatgtt

SEQ ID NO: 3210922 - DNA, 17 bp, Homo sapiens
attgttaactcttgtct

SEQ ID NO: 3210923 - DNA, 23 bp, Homo sapiens
attgttaagtctaaatatttcct

SEQ ID NO: 3210924 - DNA, 18 bp, Homo sapiens
attgttaatctctgttat

SEQ ID NO: 3210925 - DNA, 17 bp, Homo sapiens
attgttagggtcagcca

SEQ ID NO: 3210926 - DNA, 20 bp, Homo sapiens
attgttatgtaaaactcgct

SEQ ID NO: 3210927 - DNA, 16 bp, Homo sapiens
attgttatttctgtag

SEQ ID NO: 3210928 - DNA, 19 bp, Homo sapiens
attgttcaaacaatatcat

SEQ ID NO: 3210929 - DNA, 18 bp, Homo sapiens
attgttccaaatgaatgt

SEQ ID NO: 3210930 - DNA, 12 bp, Homo sapiens
attgttccaaga

SEQ ID NO: 3210931 - DNA, 20 bp, Homo sapiens
attgttccaagacattgtca

SEQ ID NO: 3210932 - DNA, 21 bp, Homo sapiens
attgttcccagtgacacttca

SEQ ID NO: 3210933 - DNA, 19 bp, Homo sapiens
attgttcttagtttgcagt

SEQ ID NO: 3210934 - DNA, 15 bp, Homo sapiens
attgttgaaattttg

SEQ ID NO: 3210935 - DNA, 17 bp, Homo sapiens
attgttgacagttctga

SEQ ID NO: 3210936 - DNA, 22 bp, Homo sapiens
attgttgacagttctgaagaat

SEQ ID NO: 3210937 - DNA, 16 bp, Homo sapiens
attgttgagctattgc

SEQ ID NO: 3210938 - DNA, 20 bp, Homo sapiens
attgttgaggtggtctgaat

SEQ ID NO: 3210939 - DNA, 18 bp, Homo sapiens
attgttgataggaactgt

SEQ ID NO: 3210940 - DNA, 21 bp, Homo sapiens
attgttgatgggcacttgaga

SEQ ID NO: 3210941 - DNA, 23 bp, Homo sapiens
attgttgcatccctcaattgaat

SEQ ID NO: 3210942 - DNA, 14 bp, Homo sapiens
attgttgctccctg

SEQ ID NO: 3210943 - DNA, 14 bp, Homo sapiens
attgttggctattt

SEQ ID NO: 3210944 - DNA, 22 bp, Homo sapiens
attgttgtgggctttctccggg

SEQ ID NO: 3210945 - DNA, 20 bp, Homo sapiens
attgttgtttctttctagtg

SEQ ID NO: 3210946 - DNA, 22 bp, Homo sapiens
attgttgtttgccatactttgt

SEQ ID NO: 3210947 - DNA, 14 bp, Homo sapiens
attgtttaaaatgt

SEQ ID NO: 3210948 - DNA, 17 bp, Homo sapiens
attgtttaaaatgtaat

SEQ ID NO: 3210949 - DNA, 13 bp, Homo sapiens
attgtttaaaatt

SEQ ID NO: 3210950 - DNA, 14 bp, Homo sapiens
attgtttaaaattc

SEQ ID NO: 3210951 - DNA, 18 bp, Homo sapiens
attgtttaaaattcagtt

SEQ ID NO: 3210952 - DNA, 12 bp, Homo sapiens
attgtttaaaga

SEQ ID NO: 3210953 - DNA, 14 bp, Homo sapiens
attgtttattcttt

SEQ ID NO: 3210954 - DNA, 18 bp, Homo sapiens
attgtttatttatcagtg

SEQ ID NO: 3210955 - DNA, 21 bp, Homo sapiens
attgtttatttatcagtgaca

SEQ ID NO: 3210956 - DNA, 21 bp, Homo sapiens
attgtttccaacttgtctggg

SEQ ID NO: 3210957 - DNA, 15 bp, Homo sapiens
attgtttctatacaa

SEQ ID NO: 3210958 - DNA, 12 bp, Homo sapiens
attgtttgctgc

SEQ ID NO: 3210959 - DNA, 19 bp, Homo sapiens
attgtttgcttattgttcc

SEQ ID NO: 3210960 - DNA, 22 bp, Homo sapiens
attgtttgcttattgttccaag

SEQ ID NO: 3210961 - DNA, 23 bp, Homo sapiens
attgtttgcttattgttccaaga

SEQ ID NO: 3210962 - DNA, 21 bp, Homo sapiens
attgtttggggatgagaaagg

SEQ ID NO: 3210963 - DNA, 13 bp, Homo sapiens
attgttttaatct

SEQ ID NO: 3210964 - DNA, 18 bp, Homo sapiens
attgttttaatctgaaat

SEQ ID NO: 3210965 - DNA, 15 bp, Homo sapiens
attgttttagagact

SEQ ID NO: 3210966 - DNA, 13 bp, Homo sapiens
attgttttatcat

SEQ ID NO: 3210967 - DNA, 20 bp, Homo sapiens
attgttttatggtgtgttcc

SEQ ID NO: 3210968 - DNA, 19 bp, Homo sapiens
attgttttcagtgtacatg

SEQ ID NO: 3210969 - DNA, 19 bp, Homo sapiens
attgttttctttaaagatg

SEQ ID NO: 3210970 - DNA, 17 bp, Homo sapiens
attgttttgaatattac

SEQ ID NO: 3210971 - DNA, 22 bp, Homo sapiens
attgttttgaatattactccta

SEQ ID NO: 3210972 - DNA, 11 bp, Homo sapiens
attgtttttct

SEQ ID NO: 3210973 - DNA, 14 bp, Homo sapiens
attgtttttctttc

SEQ ID NO: 3210974 - DNA, 15 bp, Homo sapiens
attgtttttctttct

SEQ ID NO: 3210975 - DNA, 16 bp, Homo sapiens
attgtttttgtattta

SEQ ID NO: 3210976 - DNA, 17 bp, Homo sapiens
attgtttttgtatttat

SEQ ID NO: 3210977 - DNA, 14 bp, Homo sapiens
attgttttttaaag

SEQ ID NO: 3210978 - DNA, 16 bp, Homo sapiens
atttaaaaaaatcaca

SEQ ID NO: 3210979 - DNA, 13 bp, Homo sapiens
atttaaaaaataa

SEQ ID NO: 3210980 - DNA, 22 bp, Homo sapiens
atttaaaaaataaataaaaact

SEQ ID NO: 3210981 - DNA, 17 bp, Homo sapiens
attttcatttgtacaag

SEQ ID NO: 3210982 - DNA, 14 bp, Homo sapiens
attttccaaagagt

SEQ ID NO: 3210983 - DNA, 14 bp, Homo sapiens
attttccaaatgta

SEQ ID NO: 3210984 - DNA, 14 bp, Homo sapiens
attttccaaccttt

SEQ ID NO: 3210985 - DNA, 21 bp, Homo sapiens
attttccatttttatttcaaa

SEQ ID NO: 3210986 - DNA, 20 bp, Homo sapiens
attttcccaatagcactttc

SEQ ID NO: 3210987 - DNA, 22 bp, Homo sapiens
attttcccaatagcactttcat

SEQ ID NO: 3210988 - DNA, 20 bp, Homo sapiens
attttcccccactactgcag

SEQ ID NO: 3210989 - DNA, 14 bp, Homo sapiens
attttccccccact

SEQ ID NO: 3210990 - DNA, 20 bp, Homo sapiens
attttccccccactctcccc

SEQ ID NO: 3210991 - DNA, 21 bp, Homo sapiens
attttccccccactctcccca

SEQ ID NO: 3210992 - DNA, 16 bp, Homo sapiens
attttccccttcctca

SEQ ID NO: 3210993 - DNA, 21 bp, Homo sapiens
attttcctcaatcacactaca

SEQ ID NO: 3210994 - DNA, 15 bp, Homo sapiens
attttcctcattttg

SEQ ID NO: 3210995 - DNA, 17 bp, Homo sapiens
attttcctcattttgaa

SEQ ID NO: 3210996 - DNA, 11 bp, Homo sapiens
attttcctgga

SEQ ID NO: 3210997 - DNA, 16 bp, Homo sapiens
attttcctggatttat

SEQ ID NO: 3210998 - DNA, 22 bp, Homo sapiens
attttcctggtgccaatttcaa

SEQ ID NO: 3210999 - DNA, 23 bp, Homo sapiens
attttcctggtgccaatttcaag

SEQ ID NO: 3211000 - DNA, 14 bp, Homo sapiens
attttccttttcaa

SEQ ID NO: 3211001 - DNA, 15 bp, Homo sapiens
attttcgtatgaaaa

SEQ ID NO: 3211002 - DNA, 17 bp, Homo sapiens
attttcgtatgaaaatg

SEQ ID NO: 3211003 - DNA, 18 bp, Homo sapiens
attttctaagcaatttct

SEQ ID NO: 3211004 - DNA, 15 bp, Homo sapiens
attttctacaattaa

SEQ ID NO: 3211005 - DNA, 18 bp, Homo sapiens
attttctagaaatgttta

SEQ ID NO: 3211006 - DNA, 16 bp, Homo sapiens
attttctagactttct

SEQ ID NO: 3211007 - DNA, 17 bp, Homo sapiens
attttctataacagata

SEQ ID NO: 3211008 - DNA, 19 bp, Homo sapiens
attttctcaaaagcattta

SEQ ID NO: 3211009 - DNA, 22 bp, Homo sapiens
attttctcaaaagcatttatca

SEQ ID NO: 3211010 - DNA, 20 bp, Homo sapiens
attttctccaaataaaaatt

SEQ ID NO: 3211011 - DNA, 14 bp, Homo sapiens
attttctctgtact

SEQ ID NO: 3211012 - DNA, 12 bp, Homo sapiens
attttctgaaag

SEQ ID NO: 3211013 - DNA, 18 bp, Homo sapiens
attttctgaaagttaccc

SEQ ID NO: 3211014 - DNA, 12 bp, Homo sapiens
attttctgaatt

SEQ ID NO: 3211015 - DNA, 18 bp, Homo sapiens
attttctggaatacatga

SEQ ID NO: 3211016 - DNA, 19 bp, Homo sapiens
attttctggaatacatgaa

SEQ ID NO: 3211017 - DNA, 22 bp, Homo sapiens
attttctggggctcctcacata

SEQ ID NO: 3211018 - DNA, 19 bp, Homo sapiens
attttctggttctaacatt

SEQ ID NO: 3211019 - DNA, 21 bp, Homo sapiens
attttcttattgcgctgctac

SEQ ID NO: 3211020 - DNA, 18 bp, Homo sapiens
attttcttgtatgatagt

SEQ ID NO: 3211021 - DNA, 15 bp, Homo sapiens
attttctttaatgct

SEQ ID NO: 3211022 - DNA, 16 bp, Homo sapiens
attttctttctgtaac

SEQ ID NO: 3211023 - DNA, 13 bp, Homo sapiens
attttgaaaagct

SEQ ID NO: 3211024 - DNA, 18 bp, Homo sapiens
attttgaaaagcttctta

SEQ ID NO: 3211025 - DNA, 19 bp, Homo sapiens
attttgaaaagcttcttaa

SEQ ID NO: 3211026 - DNA, 20 bp, Homo sapiens
attttgaaaagcttcttaat

SEQ ID NO: 3211027 - DNA, 13 bp, Homo sapiens
attttgaagaata

SEQ ID NO: 3211028 - DNA, 17 bp, Homo sapiens
attttgacctactctca

SEQ ID NO: 3211029 - DNA, 19 bp, Homo sapiens
attttgacttaatgtgatt

SEQ ID NO: 3211030 - DNA, 20 bp, Homo sapiens
attttgacttagtaactttt

SEQ ID NO: 3211031 - DNA, 22 bp, Homo sapiens
attttgagaatgctgacacttt

SEQ ID NO: 3211032 - DNA, 17 bp, Homo sapiens
attttgataataaattg

SEQ ID NO: 3211033 - DNA, 21 bp, Homo sapiens
attttgataataatattgttt

SEQ ID NO: 3211034 - DNA, 17 bp, Homo sapiens
attttgataccagaagg

SEQ ID NO: 3211035 - DNA, 19 bp, Homo sapiens
attttgataccagaaggga

SEQ ID NO: 3211036 - DNA, 16 bp, Homo sapiens
attttgatatacattg

SEQ ID NO: 3211037 - DNA, 18 bp, Homo sapiens
attttgatgtgacaataa

SEQ ID NO: 3211038 - DNA, 14 bp, Homo sapiens
attttgattattgt

SEQ ID NO: 3211039 - DNA, 20 bp, Homo sapiens
attttgattttttttttaaa

SEQ ID NO: 3211040 - DNA, 14 bp, Homo sapiens
attttgcaaaattt

SEQ ID NO: 3211041 - DNA, 18 bp, Homo sapiens
attttgcaaaatttccag

SEQ ID NO: 3211042 - DNA, 19 bp, Homo sapiens
attttgcaaaatttccagt

SEQ ID NO: 3211043 - DNA, 14 bp, Homo sapiens
attttgcaaatata

SEQ ID NO: 3211044 - DNA, 19 bp, Homo sapiens
attttgcaaatataaacat

SEQ ID NO: 3211045 - DNA, 12 bp, Homo sapiens
attttgcactgt

SEQ ID NO: 3211046 - DNA, 15 bp, Homo sapiens
attttgcagcagtga

SEQ ID NO: 3211047 - DNA, 18 bp, Homo sapiens
attttgcatactgaaaat

SEQ ID NO: 3211048 - DNA, 21 bp, Homo sapiens
attttgcctcttttctctgtg

SEQ ID NO: 3211049 - DNA, 13 bp, Homo sapiens
attttgcctttaa

SEQ ID NO: 3211050 - DNA, 21 bp, Homo sapiens
attttgctgactttaaaagga

SEQ ID NO: 3211051 - DNA, 15 bp, Homo sapiens
attttgctgagttgt

SEQ ID NO: 3211052 - DNA, 14 bp, Homo sapiens
attttgctgtatat

SEQ ID NO: 3211053 - DNA, 13 bp, Homo sapiens
attttgctttggt

SEQ ID NO: 3211054 - DNA, 14 bp, Homo sapiens
attttgctttggtt

SEQ ID NO: 3211055 - DNA, 19 bp, Homo sapiens
attttggaaaataaattat

SEQ ID NO: 3211056 - DNA, 12 bp, Homo sapiens
attttggaattt

SEQ ID NO: 3211057 - DNA, 22 bp, Homo sapiens
attttggataaatcatttcagt

SEQ ID NO: 3211058 - DNA, 18 bp, Homo sapiens
attttggataatattcat

SEQ ID NO: 3211059 - DNA, 17 bp, Homo sapiens
attttggattttgcaag

SEQ ID NO: 3211060 - DNA, 20 bp, Homo sapiens
attttggcgctattacaaat

SEQ ID NO: 3211061 - DNA, 23 bp, Homo sapiens
attttggggaagggtttgaattg

SEQ ID NO: 3211062 - DNA, 22 bp, Homo sapiens
attttgggggtttttaatcttt

SEQ ID NO: 3211063 - DNA, 23 bp, Homo sapiens
attttggggtacccactgctctg

SEQ ID NO: 3211064 - DNA, 14 bp, Homo sapiens
attttggggtctct

SEQ ID NO: 3211065 - DNA, 15 bp, Homo sapiens
attttggtactttta

SEQ ID NO: 3211066 - DNA, 20 bp, Homo sapiens
attttggtattacactgtat

SEQ ID NO: 3211067 - DNA, 14 bp, Homo sapiens
attttggtgagaaa

SEQ ID NO: 3211068 - DNA, 21 bp, Homo sapiens
attttggtgagaaatgggact

SEQ ID NO: 3211069 - DNA, 13 bp, Homo sapiens
attttgtaaacta

SEQ ID NO: 3211070 - DNA, 18 bp, Homo sapiens
attttgtaacgaagacac

SEQ ID NO: 3211071 - DNA, 19 bp, Homo sapiens
attttgtaacgaagacaca

SEQ ID NO: 3211072 - DNA, 14 bp, Homo sapiens
attttgtactttgt

SEQ ID NO: 3211073 - DNA, 14 bp, Homo sapiens
attttgtatatatc

SEQ ID NO: 3211074 - DNA, 19 bp, Homo sapiens
attttgtattacatctaat

SEQ ID NO: 3211075 - DNA, 24 bp, Homo sapiens
attttgtattacatctaatgcttc

SEQ ID NO: 3211076 - DNA, 15 bp, Homo sapiens
attttgtattgtggt

SEQ ID NO: 3211077 - DNA, 17 bp, Homo sapiens
attttgtattgtggtat

SEQ ID NO: 3211078 - DNA, 19 bp, Homo sapiens
attttgtcacattatttat

SEQ ID NO: 3211079 - DNA, 12 bp, Homo sapiens
attttgtctacc

SEQ ID NO: 3211080 - DNA, 18 bp, Homo sapiens
attttgtcttattcttaa

SEQ ID NO: 3211081 - DNA, 19 bp, Homo sapiens
attttgtcttattcttaag

SEQ ID NO: 3211082 - DNA, 22 bp, Homo sapiens
attttgtctttttgtttgggat

SEQ ID NO: 3211083 - DNA, 12 bp, Homo sapiens
attttgtgaatg

SEQ ID NO: 3211084 - DNA, 15 bp, Homo sapiens
attttgtgaatggat

SEQ ID NO: 3211085 - DNA, 19 bp, Homo sapiens
attttgtgatgaataaaat

SEQ ID NO: 3211086 - DNA, 22 bp, Homo sapiens
attttgtgatgaataaaataat

SEQ ID NO: 3211087 - DNA, 15 bp, Homo sapiens
attttgtgcattctt

SEQ ID NO: 3211088 - DNA, 16 bp, Homo sapiens
attttgtgctcattta

SEQ ID NO: 3211089 - DNA, 17 bp, Homo sapiens
attttgtgtgaccaact

SEQ ID NO: 3211090 - DNA, 18 bp, Homo sapiens
attttgtgttgtacaatt

SEQ ID NO: 3211091 - DNA, 21 bp, Homo sapiens
attttgtgttgtacaattaag

SEQ ID NO: 3211092 - DNA, 14 bp, Homo sapiens
attttgttcttatt

SEQ ID NO: 3211093 - DNA, 14 bp, Homo sapiens
attttgttgaaatt

SEQ ID NO: 3211094 - DNA, 20 bp, Homo sapiens
attttgttgcttttgtgaac

SEQ ID NO: 3211095 - DNA, 15 bp, Homo sapiens
attttgttggcatag

SEQ ID NO: 3211096 - DNA, 17 bp, Homo sapiens
attttgttgtaaaaaga

SEQ ID NO: 3211097 - DNA, 11 bp, Homo sapiens
attttgtttac

SEQ ID NO: 3211098 - DNA, 12 bp, Homo sapiens
attttgtttaca

SEQ ID NO: 3211099 - DNA, 14 bp, Homo sapiens
attttgtttcaatc

SEQ ID NO: 3211100 - DNA, 19 bp, Homo sapiens
attttgtttcaatctctga

SEQ ID NO: 3211101 - DNA, 14 bp, Homo sapiens
atttttaaaaaata

SEQ ID NO: 3211102 - DNA, 18 bp, Homo sapiens
atttttaaaaaatatttt

SEQ ID NO: 3211103 - DNA, 19 bp, Homo sapiens
atttttaaaaaatattttc

SEQ ID NO: 3211104 - DNA, 23 bp, Homo sapiens
atttttaaaaaatattttctctg

SEQ ID NO: 3211105 - DNA, 13 bp, Homo sapiens
atttttaaaaaga

SEQ ID NO: 3211106 - DNA, 17 bp, Homo sapiens
atttttaaaaagaaatc

SEQ ID NO: 3211107 - DNA, 17 bp, Homo sapiens
atttttaaaatatttat

SEQ ID NO: 3211108 - DNA, 15 bp, Homo sapiens
atttttaaagtactt

SEQ ID NO: 3211109 - DNA, 20 bp, Homo sapiens
atttttaaagtactttctta

SEQ ID NO: 3211110 - DNA, 19 bp, Homo sapiens
atttgtgtattttcctgga

SEQ ID NO: 3211111 - DNA, 14 bp, Homo sapiens
atttgttataatga

SEQ ID NO: 3211112 - DNA, 13 bp, Homo sapiens
atttgttcatgtt

SEQ ID NO: 3211113 - DNA, 14 bp, Homo sapiens
atttgttcatgttt

SEQ ID NO: 3211114 - DNA, 18 bp, Homo sapiens
atttgttcctgccccacc

SEQ ID NO: 3211115 - DNA, 20 bp, Homo sapiens
atttgttgaaattatgtatg

SEQ ID NO: 3211116 - DNA, 19 bp, Homo sapiens
atttgttgacagcaaaatg

SEQ ID NO: 3211117 - DNA, 20 bp, Homo sapiens
atttgttgacagcaaaatgt

SEQ ID NO: 3211118 - DNA, 13 bp, Homo sapiens
atttgttggaatg

SEQ ID NO: 3211119 - DNA, 23 bp, Homo sapiens
atttgttggtaactaatgttatt

SEQ ID NO: 3211120 - DNA, 21 bp, Homo sapiens
atttgtttacttgtaaattga

SEQ ID NO: 3211121 - DNA, 14 bp, Homo sapiens
atttgttttcatgg

SEQ ID NO: 3211122 - DNA, 18 bp, Homo sapiens
atttgttttgacggatga

SEQ ID NO: 3211123 - DNA, 21 bp, Homo sapiens
atttgttttgacggatgattg

SEQ ID NO: 3211124 - DNA, 16 bp, Homo sapiens
atttgtttttcattca

SEQ ID NO: 3211125 - DNA, 17 bp, Homo sapiens
attttaaaaactttatt

SEQ ID NO: 3211126 - DNA, 23 bp, Homo sapiens
attttaaaaagtccataccttat

SEQ ID NO: 3211127 - DNA, 18 bp, Homo sapiens
attttaaaaagtcttcac

SEQ ID NO: 3211128 - DNA, 18 bp, Homo sapiens
attttaaaaatacatatc

SEQ ID NO: 3211129 - DNA, 22 bp, Homo sapiens
attttaaaaattggaaactgac

SEQ ID NO: 3211130 - DNA, 19 bp, Homo sapiens
attttaaaagccacataga

SEQ ID NO: 3211131 - DNA, 18 bp, Homo sapiens
attttaaaagtctatttt

SEQ ID NO: 3211132 - DNA, 19 bp, Homo sapiens
attttaaaagtctatttta

SEQ ID NO: 3211133 - DNA, 20 bp, Homo sapiens
attttaaaagttttgttctt

SEQ ID NO: 3211134 - DNA, 19 bp, Homo sapiens
attttaaaataaattagtt

SEQ ID NO: 3211135 - DNA, 13 bp, Homo sapiens
attttaaacaaag

SEQ ID NO: 3211136 - DNA, 17 bp, Homo sapiens
attttaaagtatgcatt

SEQ ID NO: 3211137 - DNA, 16 bp, Homo sapiens
attttaaataaaagaa

SEQ ID NO: 3211138 - DNA, 20 bp, Homo sapiens
attttaaataaaagtgatca

SEQ ID NO: 3211139 - DNA, 15 bp, Homo sapiens
attttaaataacctc

SEQ ID NO: 3211140 - DNA, 19 bp, Homo sapiens
attttaaataacctctggc

SEQ ID NO: 3211141 - DNA, 22 bp, Homo sapiens
attttaaataacctctggccct

SEQ ID NO: 3211142 - DNA, 23 bp, Homo sapiens
attttaaataacctctggccctt

SEQ ID NO: 3211143 - DNA, 19 bp, Homo sapiens
attttaaatataaatagct

SEQ ID NO: 3211144 - DNA, 19 bp, Homo sapiens
attttaaatctaaatctat

SEQ ID NO: 3211145 - DNA, 16 bp, Homo sapiens
attttaaattcacaat

SEQ ID NO: 3211146 - DNA, 15 bp, Homo sapiens
attttaacaataact

SEQ ID NO: 3211147 - DNA, 22 bp, Homo sapiens
attttaacaataactactgtgt

SEQ ID NO: 3211148 - DNA, 17 bp, Homo sapiens
attttaacactttgtat

SEQ ID NO: 3211149 - DNA, 18 bp, Homo sapiens
attttaacactttgtatt

SEQ ID NO: 3211150 - DNA, 17 bp, Homo sapiens
attttaacctagatgtt

SEQ ID NO: 3211151 - DNA, 19 bp, Homo sapiens
attttaactttatcacatt

SEQ ID NO: 3211152 - DNA, 21 bp, Homo sapiens
attttaagcactcttaaagca

SEQ ID NO: 3211153 - DNA, 22 bp, Homo sapiens
attttaagcactcttaaagcaa

SEQ ID NO: 3211154 - DNA, 18 bp, Homo sapiens
attttaagggggaaaact

SEQ ID NO: 3211155 - DNA, 12 bp, Homo sapiens
attttaagtgct

SEQ ID NO: 3211156 - DNA, 14 bp, Homo sapiens
attttaagtgcttt

SEQ ID NO: 3211157 - DNA, 18 bp, Homo sapiens
attttaagtgctttgtaa

SEQ ID NO: 3211158 - DNA, 13 bp, Homo sapiens
attttaatattga

SEQ ID NO: 3211159 - DNA, 21 bp, Homo sapiens
attttaatcctgtaccaaatc

SEQ ID NO: 3211160 - DNA, 15 bp, Homo sapiens
attttaatgaatatt

SEQ ID NO: 3211161 - DNA, 19 bp, Homo sapiens
attttaatgaatattgatg

SEQ ID NO: 3211162 - DNA, 15 bp, Homo sapiens
attttaatgggtttc

SEQ ID NO: 3211163 - DNA, 12 bp, Homo sapiens
attttaatgtga

SEQ ID NO: 3211164 - DNA, 13 bp, Homo sapiens
attttaatgtgaa

SEQ ID NO: 3211165 - DNA, 22 bp, Homo sapiens
attttaatgtgatgatgtaatt

SEQ ID NO: 3211166 - DNA, 12 bp, Homo sapiens
attttaattcat

SEQ ID NO: 3211167 - DNA, 15 bp, Homo sapiens
attttaattgtcatg

SEQ ID NO: 3211168 - DNA, 16 bp, Homo sapiens
attttacaaaagatgt

SEQ ID NO: 3211169 - DNA, 15 bp, Homo sapiens
attttacacaaatgt

SEQ ID NO: 3211170 - DNA, 19 bp, Homo sapiens
attttacacattagatttt

SEQ ID NO: 3211171 - DNA, 20 bp, Homo sapiens
attttacagaaacgtgttaa

SEQ ID NO: 3211172 - DNA, 15 bp, Homo sapiens
attttaccaaagcat

SEQ ID NO: 3211173 - DNA, 16 bp, Homo sapiens
attttaccaaagcatc

SEQ ID NO: 3211174 - DNA, 20 bp, Homo sapiens
attttaccaagagtaacttt

SEQ ID NO: 3211175 - DNA, 16 bp, Homo sapiens
attttaccagcagaag

SEQ ID NO: 3211176 - DNA, 13 bp, Homo sapiens
attttacttccat

SEQ ID NO: 3211177 - DNA, 14 bp, Homo sapiens
attttactttgtac

SEQ ID NO: 3211178 - DNA, 21 bp, Homo sapiens
attttagaaacccctctgtag

SEQ ID NO: 3211179 - DNA, 15 bp, Homo sapiens
attttagaaatattc

SEQ ID NO: 3211180 - DNA, 17 bp, Homo sapiens
attttagaaattataat

SEQ ID NO: 3211181 - DNA, 17 bp, Homo sapiens
attttaggaacttcaga

SEQ ID NO: 3211182 - DNA, 21 bp, Homo sapiens
attttaggagctaaggctcta

SEQ ID NO: 3211183 - DNA, 22 bp, Homo sapiens
attttaggagctaaggctctat

SEQ ID NO: 3211184 - DNA, 22 bp, Homo sapiens
attttaggcactgttcaatact

SEQ ID NO: 3211185 - DNA, 21 bp, Homo sapiens
attttaggtgttgattttctg

SEQ ID NO: 3211186 - DNA, 14 bp, Homo sapiens
attttagtacattt

SEQ ID NO: 3211187 - DNA, 16 bp, Homo sapiens
attttagtccaaataa

SEQ ID NO: 3211188 - DNA, 15 bp, Homo sapiens
attttagtgactgta

SEQ ID NO: 3211189 - DNA, 18 bp, Homo sapiens
attttagtgactgtaatt

SEQ ID NO: 3211190 - DNA, 12 bp, Homo sapiens
attttataattt

SEQ ID NO: 3211191 - DNA, 20 bp, Homo sapiens
attttataggactgttcttt

SEQ ID NO: 3211192 - DNA, 17 bp, Homo sapiens
attttatataaaatcca

SEQ ID NO: 3211193 - DNA, 18 bp, Homo sapiens
attttatataaaatccat

SEQ ID NO: 3211194 - DNA, 13 bp, Homo sapiens
attttatatgatg

SEQ ID NO: 3211195 - DNA, 18 bp, Homo sapiens
attttatattaaaataag

SEQ ID NO: 3211196 - DNA, 22 bp, Homo sapiens
attttatattactgacatttct

SEQ ID NO: 3211197 - DNA, 15 bp, Homo sapiens
attttatatttttgt

SEQ ID NO: 3211198 - DNA, 18 bp, Homo sapiens
attttatatttttgtaca

SEQ ID NO: 3211199 - DNA, 19 bp, Homo sapiens
attttatatttttgtacat

SEQ ID NO: 3211200 - DNA, 13 bp, Homo sapiens
attttatctgtga

SEQ ID NO: 3211201 - DNA, 15 bp, Homo sapiens
attttatctgtgaat

SEQ ID NO: 3211202 - DNA, 16 bp, Homo sapiens
attttatgaatgtctt

SEQ ID NO: 3211203 - DNA, 18 bp, Homo sapiens
attttatgatcagtgttg

SEQ ID NO: 3211204 - DNA, 15 bp, Homo sapiens
attttattaaatgca

SEQ ID NO: 3211205 - DNA, 15 bp, Homo sapiens
attttattgtataaa

SEQ ID NO: 3211206 - DNA, 22 bp, Homo sapiens
attttatttacccctcccctat

SEQ ID NO: 3211207 - DNA, 17 bp, Homo sapiens
attttatttagacaaga

SEQ ID NO: 3211208 - DNA, 16 bp, Homo sapiens
attttatttccatcat

SEQ ID NO: 3211209 - DNA, 17 bp, Homo sapiens
attttatttgtttttca

SEQ ID NO: 3211210 - DNA, 21 bp, Homo sapiens
attttattttggcttcatttc

SEQ ID NO: 3211211 - DNA, 21 bp, Homo sapiens
attttattttgtgctcattta

SEQ ID NO: 3211212 - DNA, 22 bp, Homo sapiens
attttattttgtgctcatttaa

SEQ ID NO: 3211213 - DNA, 19 bp, Homo sapiens
attttatttttaaaatatt

SEQ ID NO: 3211214 - DNA, 19 bp, Homo sapiens
attttattttttccctcct

SEQ ID NO: 3211215 - DNA, 17 bp, Homo sapiens
attttatttttttctac

SEQ ID NO: 3211216 - DNA, 18 bp, Homo sapiens
attttcaaattgtatcta

SEQ ID NO: 3211217 - DNA, 14 bp, Homo sapiens
attttcaactgctt

SEQ ID NO: 3211218 - DNA, 13 bp, Homo sapiens
attttcaagaaac

SEQ ID NO: 3211219 - DNA, 23 bp, Homo sapiens
attttcaagaaactgaggaattt

SEQ ID NO: 3211220 - DNA, 24 bp, Homo sapiens
attttcaagaataatcacgctttc

SEQ ID NO: 3211221 - DNA, 16 bp, Homo sapiens
attttcaagtttacac

SEQ ID NO: 3211222 - DNA, 20 bp, Homo sapiens
attttcacattcttggctta

SEQ ID NO: 3211223 - DNA, 17 bp, Homo sapiens
attttcagaatctgaat

SEQ ID NO: 3211224 - DNA, 20 bp, Homo sapiens
attttcagaatctgaatgta

SEQ ID NO: 3211225 - DNA, 21 bp, Homo sapiens
attttcagaatctgaatgtaa

SEQ ID NO: 3211226 - DNA, 18 bp, Homo sapiens
attttcagcaaactcttt

SEQ ID NO: 3211227 - DNA, 12 bp, Homo sapiens
attttcagcatt

SEQ ID NO: 3211228 - DNA, 19 bp, Homo sapiens
attttcagcattaagctgt

SEQ ID NO: 3211229 - DNA, 11 bp, Homo sapiens
attttcagtac

SEQ ID NO: 3211230 - DNA, 21 bp, Homo sapiens
attttcagtagggctacaaaa

SEQ ID NO: 3211231 - DNA, 11 bp, Homo sapiens
attttcagtat

SEQ ID NO: 3211232 - DNA, 23 bp, Homo sapiens
attttcagtatactgtgtgggat

SEQ ID NO: 3211233 - DNA, 15 bp, Homo sapiens
attttcagtgcatca

SEQ ID NO: 3211234 - DNA, 16 bp, Homo sapiens
attttcatgcacagta

SEQ ID NO: 3211235 - DNA, 24 bp, Homo sapiens
attttcatgcacagtagattcaag

SEQ ID NO: 3211236 - DNA, 11 bp, Homo sapiens
attttcatgtg

SEQ ID NO: 3211237 - DNA, 18 bp, Homo sapiens
attttcattaaacttgaa

SEQ ID NO: 3211238 - DNA, 15 bp, Homo sapiens
attttcatttgtaca

SEQ ID NO: 3211239 - DNA, 22 bp, Homo sapiens
atttgaaatactaaaagcaaat

SEQ ID NO: 3211240 - DNA, 16 bp, Homo sapiens
atttgaaatcgttgga

SEQ ID NO: 3211241 - DNA, 15 bp, Homo sapiens
atttgaaatttagct

SEQ ID NO: 3211242 - DNA, 22 bp, Homo sapiens
atttgaagtgtacctgtgtaca

SEQ ID NO: 3211243 - DNA, 13 bp, Homo sapiens
atttgaatgaaaa

SEQ ID NO: 3211244 - DNA, 14 bp, Homo sapiens
atttgaatgaaaaa

SEQ ID NO: 3211245 - DNA, 17 bp, Homo sapiens
atttgaatgggtccatt

SEQ ID NO: 3211246 - DNA, 13 bp, Homo sapiens
atttgaatgttaa

SEQ ID NO: 3211247 - DNA, 18 bp, Homo sapiens
atttgaatgttaagcaga

SEQ ID NO: 3211248 - DNA, 23 bp, Homo sapiens
atttgaattatcagcaaagaaaa

SEQ ID NO: 3211249 - DNA, 18 bp, Homo sapiens
atttgaattttaaatcta

SEQ ID NO: 3211250 - DNA, 17 bp, Homo sapiens
atttgactaattttaca

SEQ ID NO: 3211251 - DNA, 17 bp, Homo sapiens
atttgactattctgtat

SEQ ID NO: 3211252 - DNA, 17 bp, Homo sapiens
atttgagagaaatatga

SEQ ID NO: 3211253 - DNA, 16 bp, Homo sapiens
atttgagcagggctca

SEQ ID NO: 3211254 - DNA, 16 bp, Homo sapiens
atttgagcatatcagt

SEQ ID NO: 3211255 - DNA, 16 bp, Homo sapiens
atttgaggagtgttaa

SEQ ID NO: 3211256 - DNA, 20 bp, Homo sapiens
atttgaggagtgttaagatt

SEQ ID NO: 3211257 - DNA, 17 bp, Homo sapiens
atttgagggcccagcca

SEQ ID NO: 3211258 - DNA, 18 bp, Homo sapiens
atttgagggcccagccag

SEQ ID NO: 3211259 - DNA, 22 bp, Homo sapiens
atttgaggggaaaacaccataa

SEQ ID NO: 3211260 - DNA, 13 bp, Homo sapiens
atttgaggtcaag

SEQ ID NO: 3211261 - DNA, 19 bp, Homo sapiens
atttgagtgttttaagata

SEQ ID NO: 3211262 - DNA, 16 bp, Homo sapiens
atttgatacccctggg

SEQ ID NO: 3211263 - DNA, 22 bp, Homo sapiens
atttgatacttatattttcgta

SEQ ID NO: 3211264 - DNA, 16 bp, Homo sapiens
atttgatattatctac

SEQ ID NO: 3211265 - DNA, 19 bp, Homo sapiens
atttgatatttgcattgag

SEQ ID NO: 3211266 - DNA, 15 bp, Homo sapiens
atttgatatttggtt

SEQ ID NO: 3211267 - DNA, 16 bp, Homo sapiens
atttgatatttttcca

SEQ ID NO: 3211268 - DNA, 22 bp, Homo sapiens
atttgatatttttccatttatt

SEQ ID NO: 3211269 - DNA, 11 bp, Homo sapiens
atttgatgaaa

SEQ ID NO: 3211270 - DNA, 21 bp, Homo sapiens
atttgatgaaagctgattact

SEQ ID NO: 3211271 - DNA, 15 bp, Homo sapiens
atttgatgccaggac

SEQ ID NO: 3211272 - DNA, 19 bp, Homo sapiens
atttgatgctggagaggtt

SEQ ID NO: 3211273 - DNA, 16 bp, Homo sapiens
atttgatgctgtttga

SEQ ID NO: 3211274 - DNA, 22 bp, Homo sapiens
atttgatggtatttctttctcg

SEQ ID NO: 3211275 - DNA, 17 bp, Homo sapiens
atttgattaacaaatat

SEQ ID NO: 3211276 - DNA, 20 bp, Homo sapiens
atttgattcgccctcctccc

SEQ ID NO: 3211277 - DNA, 14 bp, Homo sapiens
atttgatttccatc

SEQ ID NO: 3211278 - DNA, 17 bp, Homo sapiens
atttgatttccatctta

SEQ ID NO: 3211279 - DNA, 13 bp, Homo sapiens
atttgatttctat

SEQ ID NO: 3211280 - DNA, 22 bp, Homo sapiens
atttgcaacaggggaggaaaaa

SEQ ID NO: 3211281 - DNA, 9 bp, Homo sapiens
atttgcata

SEQ ID NO: 3211282 - DNA, 19 bp, Homo sapiens
atttgcatattctattgta

SEQ ID NO: 3211283 - DNA, 16 bp, Homo sapiens
atttgccaataaagct

SEQ ID NO: 3211284 - DNA, 20 bp, Homo sapiens
atttgccaataaagcttttg

SEQ ID NO: 3211285 - DNA, 11 bp, Homo sapiens
atttgccagca

SEQ ID NO: 3211286 - DNA, 14 bp, Homo sapiens
atttgccagcacag

SEQ ID NO: 3211287 - DNA, 16 bp, Homo sapiens
atttgccagcacaggg

SEQ ID NO: 3211288 - DNA, 20 bp, Homo sapiens
atttgccaggggcatccaag

SEQ ID NO: 3211289 - DNA, 19 bp, Homo sapiens
atttgcccatttacacttt

SEQ ID NO: 3211290 - DNA, 15 bp, Homo sapiens
atttgccttgcagaa

SEQ ID NO: 3211291 - DNA, 23 bp, Homo sapiens
atttgccttgcagaactgccatt

SEQ ID NO: 3211292 - DNA, 23 bp, Homo sapiens
atttgcggcgtcagtctttttct

SEQ ID NO: 3211293 - DNA, 15 bp, Homo sapiens
atttgctactgtaca

SEQ ID NO: 3211294 - DNA, 16 bp, Homo sapiens
atttgctactgtacat

SEQ ID NO: 3211295 - DNA, 17 bp, Homo sapiens
atttgctactgttgtaa

SEQ ID NO: 3211296 - DNA, 22 bp, Homo sapiens
atttgctgacaaccattaaagt

SEQ ID NO: 3211297 - DNA, 13 bp, Homo sapiens
atttgctgccatt

SEQ ID NO: 3211298 - DNA, 11 bp, Homo sapiens
atttgcttttt

SEQ ID NO: 3211299 - DNA, 16 bp, Homo sapiens
atttggaaagagacca

SEQ ID NO: 3211300 - DNA, 22 bp, Homo sapiens
atttggaaataaagtcagatgg

SEQ ID NO: 3211301 - DNA, 12 bp, Homo sapiens
atttggaaatcc

SEQ ID NO: 3211302 - DNA, 14 bp, Homo sapiens
atttggaaatccta

SEQ ID NO: 3211303 - DNA, 13 bp, Homo sapiens
atttggaatactt

SEQ ID NO: 3211304 - DNA, 14 bp, Homo sapiens
atttggaatacttt

SEQ ID NO: 3211305 - DNA, 15 bp, Homo sapiens
atttggaatactttt

SEQ ID NO: 3211306 - DNA, 11 bp, Homo sapiens
atttggaatag

SEQ ID NO: 3211307 - DNA, 20 bp, Homo sapiens
atttggaatatttgaataat

SEQ ID NO: 3211308 - DNA, 23 bp, Homo sapiens
atttggaggctggagtaatcaga

SEQ ID NO: 3211309 - DNA, 18 bp, Homo sapiens
atttggattagaaattta

SEQ ID NO: 3211310 - DNA, 23 bp, Homo sapiens
atttggatttaaaagcctgctca

SEQ ID NO: 3211311 - DNA, 16 bp, Homo sapiens
atttggcatctcctgt

SEQ ID NO: 3211312 - DNA, 17 bp, Homo sapiens
atttggcatctcctgtc

SEQ ID NO: 3211313 - DNA, 15 bp, Homo sapiens
atttggcttaaatat

SEQ ID NO: 3211314 - DNA, 17 bp, Homo sapiens
atttggcttaaatatag

SEQ ID NO: 3211315 - DNA, 19 bp, Homo sapiens
atttggcttgacaaaggca

SEQ ID NO: 3211316 - DNA, 14 bp, Homo sapiens
atttgggaagtgaa

SEQ ID NO: 3211317 - DNA, 17 bp, Homo sapiens
atttgggagacatgtga

SEQ ID NO: 3211318 - DNA, 16 bp, Homo sapiens
atttgggagctgaacc

SEQ ID NO: 3211319 - DNA, 23 bp, Homo sapiens
atttggggaaacctagagaagat

SEQ ID NO: 3211320 - DNA, 14 bp, Homo sapiens
atttggtattacac

SEQ ID NO: 3211321 - DNA, 23 bp, Homo sapiens
atttggtcaagattttgaatgct

SEQ ID NO: 3211322 - DNA, 19 bp, Homo sapiens
atttggtccaaaaaaagga

SEQ ID NO: 3211323 - DNA, 21 bp, Homo sapiens
atttggtccaaaaaaaggaaa

SEQ ID NO: 3211324 - DNA, 14 bp, Homo sapiens
atttggtctctatt

SEQ ID NO: 3211325 - DNA, 20 bp, Homo sapiens
atttggtgttcctggaagca

SEQ ID NO: 3211326 - DNA, 16 bp, Homo sapiens
atttggttcattaatt

SEQ ID NO: 3211327 - DNA, 15 bp, Homo sapiens
atttggttctaatag

SEQ ID NO: 3211328 - DNA, 20 bp, Homo sapiens
atttggtttctagatcactg

SEQ ID NO: 3211329 - DNA, 23 bp, Homo sapiens
atttgtaaaaacagcattgcttt

SEQ ID NO: 3211330 - DNA, 18 bp, Homo sapiens
atttgtaaaccattgtaa

SEQ ID NO: 3211331 - DNA, 12 bp, Homo sapiens
atttgtaaatct

SEQ ID NO: 3211332 - DNA, 16 bp, Homo sapiens
atttgtaaatctgcca

SEQ ID NO: 3211333 - DNA, 15 bp, Homo sapiens
atttgtaagtttcag

SEQ ID NO: 3211334 - DNA, 18 bp, Homo sapiens
atttgtaagtttcaggtg

SEQ ID NO: 3211335 - DNA, 21 bp, Homo sapiens
atttgtaagtttcaggtgaca

SEQ ID NO: 3211336 - DNA, 14 bp, Homo sapiens
atttgtaattacag

SEQ ID NO: 3211337 - DNA, 23 bp, Homo sapiens
atttgtaattacaggagggaaca

SEQ ID NO: 3211338 - DNA, 17 bp, Homo sapiens
atttgtaattttaaaag

SEQ ID NO: 3211339 - DNA, 18 bp, Homo sapiens
atttgtacaggactgtaa

SEQ ID NO: 3211340 - DNA, 11 bp, Homo sapiens
atttgtacttc

SEQ ID NO: 3211341 - DNA, 13 bp, Homo sapiens
atttgtacttctt

SEQ ID NO: 3211342 - DNA, 15 bp, Homo sapiens
atttgtacttcttat

SEQ ID NO: 3211343 - DNA, 13 bp, Homo sapiens
atttgtagattag

SEQ ID NO: 3211344 - DNA, 22 bp, Homo sapiens
atttgtagattaggattaaaat

SEQ ID NO: 3211345 - DNA, 18 bp, Homo sapiens
atttgtagcactgagggt

SEQ ID NO: 3211346 - DNA, 22 bp, Homo sapiens
atttgtagcataactgtagctc

SEQ ID NO: 3211347 - DNA, 23 bp, Homo sapiens
atttgtaggaaggtctcattctt

SEQ ID NO: 3211348 - DNA, 20 bp, Homo sapiens
atttgtatctctgaagcatg

SEQ ID NO: 3211349 - DNA, 23 bp, Homo sapiens
atttgtatctctgaagcatgttt

SEQ ID NO: 3211350 - DNA, 14 bp, Homo sapiens
atttgtattaaaat

SEQ ID NO: 3211351 - DNA, 21 bp, Homo sapiens
atttgtattaaaattgtaagc

SEQ ID NO: 3211352 - DNA, 12 bp, Homo sapiens
atttgtattaat

SEQ ID NO: 3211353 - DNA, 20 bp, Homo sapiens
atttgtattaataaagcatt

SEQ ID NO: 3211354 - DNA, 19 bp, Homo sapiens
atttgtattactttctctg

SEQ ID NO: 3211355 - DNA, 21 bp, Homo sapiens
atttgtattactttctctgta

SEQ ID NO: 3211356 - DNA, 21 bp, Homo sapiens
atttgtattgtacataaaatt

SEQ ID NO: 3211357 - DNA, 14 bp, Homo sapiens
atttgtcaatgaca

SEQ ID NO: 3211358 - DNA, 20 bp, Homo sapiens
atttgtcccagcctggggct

SEQ ID NO: 3211359 - DNA, 15 bp, Homo sapiens
atttgtctttaaaca

SEQ ID NO: 3211360 - DNA, 15 bp, Homo sapiens
atttgtgatagcact

SEQ ID NO: 3211361 - DNA, 18 bp, Homo sapiens
atttgtgatagcactttc

SEQ ID NO: 3211362 - DNA, 20 bp, Homo sapiens
atttgtgctagaaattttca

SEQ ID NO: 3211363 - DNA, 14 bp, Homo sapiens
atttgtgctgggtt

SEQ ID NO: 3211364 - DNA, 22 bp, Homo sapiens
atttgtgctgggttattcagaa

SEQ ID NO: 3211365 - DNA, 13 bp, Homo sapiens
atttgtggtcaca

SEQ ID NO: 3211366 - DNA, 17 bp, Homo sapiens
atttgtgtaataaagtg

SEQ ID NO: 3211367 - DNA, 18 bp, Homo sapiens
atttgtgtaataaagtgt

SEQ ID NO: 3211368 - DNA, 18 bp, Homo sapiens
atttcaggaatttaaaat

SEQ ID NO: 3211369 - DNA, 19 bp, Homo sapiens
atttcaggcattggatatt

SEQ ID NO: 3211370 - DNA, 15 bp, Homo sapiens
atttcagggagaaac

SEQ ID NO: 3211371 - DNA, 18 bp, Homo sapiens
atttcagtaagtctcata

SEQ ID NO: 3211372 - DNA, 18 bp, Homo sapiens
atttcagtatcatctcca

SEQ ID NO: 3211373 - DNA, 14 bp, Homo sapiens
atttcagtggcttc

SEQ ID NO: 3211374 - DNA, 20 bp, Homo sapiens
atttcagtttttcatttgtt

SEQ ID NO: 3211375 - DNA, 21 bp, Homo sapiens
atttcatacctcagaatgtaa

SEQ ID NO: 3211376 - DNA, 19 bp, Homo sapiens
atttcatactgaaattatt

SEQ ID NO: 3211377 - DNA, 12 bp, Homo sapiens
atttcatattga

SEQ ID NO: 3211378 - DNA, 19 bp, Homo sapiens
atttcatccagtttgttct

SEQ ID NO: 3211379 - DNA, 13 bp, Homo sapiens
atttcatctattt

SEQ ID NO: 3211380 - DNA, 15 bp, Homo sapiens
atttcatcttctgga

SEQ ID NO: 3211381 - DNA, 17 bp, Homo sapiens
atttcatcttctggaat

SEQ ID NO: 3211382 - DNA, 16 bp, Homo sapiens
atttcattcaaatcag

SEQ ID NO: 3211383 - DNA, 18 bp, Homo sapiens
atttcattgcctgtgtat

SEQ ID NO: 3211384 - DNA, 17 bp, Homo sapiens
atttcattgtatgatgt

SEQ ID NO: 3211385 - DNA, 21 bp, Homo sapiens
atttcatttccaactcaggtt

SEQ ID NO: 3211386 - DNA, 19 bp, Homo sapiens
atttcattttaacatgatt

SEQ ID NO: 3211387 - DNA, 21 bp, Homo sapiens
atttccaaacctggttcatat

SEQ ID NO: 3211388 - DNA, 20 bp, Homo sapiens
atttccaacaccacagacac

SEQ ID NO: 3211389 - DNA, 21 bp, Homo sapiens
atttccaacaccacagacaca

SEQ ID NO: 3211390 - DNA, 16 bp, Homo sapiens
atttccaactcaggtt

SEQ ID NO: 3211391 - DNA, 20 bp, Homo sapiens
atttccaactggcactctgt

SEQ ID NO: 3211392 - DNA, 22 bp, Homo sapiens
atttccacttgccctgttctct

SEQ ID NO: 3211393 - DNA, 14 bp, Homo sapiens
atttccaggcccct

SEQ ID NO: 3211394 - DNA, 18 bp, Homo sapiens
atttccaggcccctgagg

SEQ ID NO: 3211395 - DNA, 15 bp, Homo sapiens
atttccagtgagtgt

SEQ ID NO: 3211396 - DNA, 17 bp, Homo sapiens
atttccagtgagtgtaa

SEQ ID NO: 3211397 - DNA, 21 bp, Homo sapiens
atttccagtgagtgtaaataa

SEQ ID NO: 3211398 - DNA, 12 bp, Homo sapiens
atttccatctta

SEQ ID NO: 3211399 - DNA, 18 bp, Homo sapiens
atttccatcttaatgtta

SEQ ID NO: 3211400 - DNA, 13 bp, Homo sapiens
atttccatttctg

SEQ ID NO: 3211401 - DNA, 17 bp, Homo sapiens
atttcccaattaggaag

SEQ ID NO: 3211402 - DNA, 18 bp, Homo sapiens
atttcccaattaggaagt

SEQ ID NO: 3211403 - DNA, 15 bp, Homo sapiens
atttcccagggttaa

SEQ ID NO: 3211404 - DNA, 13 bp, Homo sapiens
atttcccatctgc

SEQ ID NO: 3211405 - DNA, 20 bp, Homo sapiens
atttccccaggggaaaatga

SEQ ID NO: 3211406 - DNA, 16 bp, Homo sapiens
atttccccctcctcag

SEQ ID NO: 3211407 - DNA, 15 bp, Homo sapiens
atttcccctccttcc

SEQ ID NO: 3211408 - DNA, 20 bp, Homo sapiens
atttccctaaaatacattta

SEQ ID NO: 3211409 - DNA, 22 bp, Homo sapiens
atttccgcacttcagaattcca

SEQ ID NO: 3211410 - DNA, 15 bp, Homo sapiens
atttccgttttgcct

SEQ ID NO: 3211411 - DNA, 14 bp, Homo sapiens
atttcctaaacata

SEQ ID NO: 3211412 - DNA, 19 bp, Homo sapiens
atttcctcagcttatctct

SEQ ID NO: 3211413 - DNA, 21 bp, Homo sapiens
atttcctcagcttatctcttt

SEQ ID NO: 3211414 - DNA, 11 bp, Homo sapiens
atttcctctat

SEQ ID NO: 3211415 - DNA, 22 bp, Homo sapiens
atttcctctattgatgtacagt

SEQ ID NO: 3211416 - DNA, 15 bp, Homo sapiens
atttcctgacttgag

SEQ ID NO: 3211417 - DNA, 16 bp, Homo sapiens
atttcctgacttgagt

SEQ ID NO: 3211418 - DNA, 23 bp, Homo sapiens
atttcctgtacaatcatgaacag

SEQ ID NO: 3211419 - DNA, 13 bp, Homo sapiens
atttccttaaaat

SEQ ID NO: 3211420 - DNA, 18 bp, Homo sapiens
atttccttaaactgtgtg

SEQ ID NO: 3211421 - DNA, 18 bp, Homo sapiens
atttcctttggagctttt

SEQ ID NO: 3211422 - DNA, 20 bp, Homo sapiens
atttcgtgggtctgttttcc

SEQ ID NO: 3211423 - DNA, 22 bp, Homo sapiens
atttctaagaagttgtttgagg

SEQ ID NO: 3211424 - DNA, 17 bp, Homo sapiens
atttctaccatttcaga

SEQ ID NO: 3211425 - DNA, 12 bp, Homo sapiens
atttctacctca

SEQ ID NO: 3211426 - DNA, 13 bp, Homo sapiens
atttctacctcag

SEQ ID NO: 3211427 - DNA, 14 bp, Homo sapiens
atttctacctcagc

SEQ ID NO: 3211428 - DNA, 14 bp, Homo sapiens
atttctagaaacaa

SEQ ID NO: 3211429 - DNA, 18 bp, Homo sapiens
atttctaggcacaaggtt

SEQ ID NO: 3211430 - DNA, 14 bp, Homo sapiens
atttctatatttat

SEQ ID NO: 3211431 - DNA, 20 bp, Homo sapiens
atttctatgatccttttttg

SEQ ID NO: 3211432 - DNA, 14 bp, Homo sapiens
atttctatggcttt

SEQ ID NO: 3211433 - DNA, 14 bp, Homo sapiens
atttctattattaa

SEQ ID NO: 3211434 - DNA, 16 bp, Homo sapiens
atttctatttatttac

SEQ ID NO: 3211435 - DNA, 20 bp, Homo sapiens
atttctcaaagatctgaatt

SEQ ID NO: 3211436 - DNA, 21 bp, Homo sapiens
atttctcagcctggttcagaa

SEQ ID NO: 3211437 - DNA, 20 bp, Homo sapiens
atttctcataatgtgaaata

SEQ ID NO: 3211438 - DNA, 15 bp, Homo sapiens
atttctcattgactt

SEQ ID NO: 3211439 - DNA, 18 bp, Homo sapiens
atttctccagttgggact

SEQ ID NO: 3211440 - DNA, 14 bp, Homo sapiens
atttctcctttgca

SEQ ID NO: 3211441 - DNA, 20 bp, Homo sapiens
atttctcctttgcaatagca

SEQ ID NO: 3211442 - DNA, 18 bp, Homo sapiens
atttctcgggtgcatttg

SEQ ID NO: 3211443 - DNA, 20 bp, Homo sapiens
atttctctaactcctgccat

SEQ ID NO: 3211444 - DNA, 23 bp, Homo sapiens
atttctctagtgtattatcactg

SEQ ID NO: 3211445 - DNA, 13 bp, Homo sapiens
atttctctgagca

SEQ ID NO: 3211446 - DNA, 18 bp, Homo sapiens
atttctctgagcagtcag

SEQ ID NO: 3211447 - DNA, 12 bp, Homo sapiens
atttctcttctc

SEQ ID NO: 3211448 - DNA, 19 bp, Homo sapiens
atttctcttctcagctctt

SEQ ID NO: 3211449 - DNA, 13 bp, Homo sapiens
atttctgaactgt

SEQ ID NO: 3211450 - DNA, 17 bp, Homo sapiens
atttctgaactgttaca

SEQ ID NO: 3211451 - DNA, 18 bp, Homo sapiens
atttctgaattcaaagct

SEQ ID NO: 3211452 - DNA, 23 bp, Homo sapiens
atttctgagagtgaaaccatgac

SEQ ID NO: 3211453 - DNA, 15 bp, Homo sapiens
atttctgatcagagg

SEQ ID NO: 3211454 - DNA, 16 bp, Homo sapiens
atttctgatcagaggt

SEQ ID NO: 3211455 - DNA, 19 bp, Homo sapiens
atttctgatcagaggtgta

SEQ ID NO: 3211456 - DNA, 19 bp, Homo sapiens
atttctgatgtctccagat

SEQ ID NO: 3211457 - DNA, 22 bp, Homo sapiens
atttctgcatatgttgaatact

SEQ ID NO: 3211458 - DNA, 14 bp, Homo sapiens
atttctgctctgga

SEQ ID NO: 3211459 - DNA, 15 bp, Homo sapiens
atttctgctctggaa

SEQ ID NO: 3211460 - DNA, 16 bp, Homo sapiens
atttctggttctgatg

SEQ ID NO: 3211461 - DNA, 17 bp, Homo sapiens
atttctggttctgatgc

SEQ ID NO: 3211462 - DNA, 19 bp, Homo sapiens
atttctgtcacagtaaaaa

SEQ ID NO: 3211463 - DNA, 15 bp, Homo sapiens
atttctgtcagaatg

SEQ ID NO: 3211464 - DNA, 21 bp, Homo sapiens
atttctgtcattcaaatgggt

SEQ ID NO: 3211465 - DNA, 16 bp, Homo sapiens
atttctgtctttaaga

SEQ ID NO: 3211466 - DNA, 11 bp, Homo sapiens
atttctgtgtt

SEQ ID NO: 3211467 - DNA, 14 bp, Homo sapiens
atttctgttctcat

SEQ ID NO: 3211468 - DNA, 15 bp, Homo sapiens
atttctgtttctcat

SEQ ID NO: 3211469 - DNA, 15 bp, Homo sapiens
atttcttaaatcttt

SEQ ID NO: 3211470 - DNA, 22 bp, Homo sapiens
atttcttaaatctttcttcaaa

SEQ ID NO: 3211471 - DNA, 13 bp, Homo sapiens
atttcttaaattt

SEQ ID NO: 3211472 - DNA, 15 bp, Homo sapiens
atttcttaaattttt

SEQ ID NO: 3211473 - DNA, 19 bp, Homo sapiens
atttcttaacttcttgctt

SEQ ID NO: 3211474 - DNA, 15 bp, Homo sapiens
atttcttcaaaatgt

SEQ ID NO: 3211475 - DNA, 17 bp, Homo sapiens
atttcttcaaaatgtat

SEQ ID NO: 3211476 - DNA, 20 bp, Homo sapiens
atttcttcaaaatgtatata

SEQ ID NO: 3211477 - DNA, 18 bp, Homo sapiens
atttcttcagtcagaaaa

SEQ ID NO: 3211478 - DNA, 21 bp, Homo sapiens
atttcttcagtcagaaaactt

SEQ ID NO: 3211479 - DNA, 11 bp, Homo sapiens
atttcttcctt

SEQ ID NO: 3211480 - DNA, 16 bp, Homo sapiens
atttcttctagaagat

SEQ ID NO: 3211481 - DNA, 23 bp, Homo sapiens
atttcttctagaagataacattt

SEQ ID NO: 3211482 - DNA, 12 bp, Homo sapiens
atttcttgcttt

SEQ ID NO: 3211483 - DNA, 18 bp, Homo sapiens
atttctttaaaagaatga

SEQ ID NO: 3211484 - DNA, 20 bp, Homo sapiens
atttctttaaaagaatgact

SEQ ID NO: 3211485 - DNA, 20 bp, Homo sapiens
atttctttgatctggacaga

SEQ ID NO: 3211486 - DNA, 21 bp, Homo sapiens
atttctttgatctggacagaa

SEQ ID NO: 3211487 - DNA, 21 bp, Homo sapiens
atttctttgttatcaaacttc

SEQ ID NO: 3211488 - DNA, 22 bp, Homo sapiens
atttcttttccttcattcatag

SEQ ID NO: 3211489 - DNA, 24 bp, Homo sapiens
atttcttttccttcattcataggg

SEQ ID NO: 3211490 - DNA, 16 bp, Homo sapiens
atttcttttcttcctg

SEQ ID NO: 3211491 - DNA, 16 bp, Homo sapiens
atttctttttttcctt

SEQ ID NO: 3211492 - DNA, 22 bp, Homo sapiens
atttgaaaaagttccatagaaa

SEQ ID NO: 3211493 - DNA, 22 bp, Homo sapiens
atttgaaaacataatctgcaaa

SEQ ID NO: 3211494 - DNA, 23 bp, Homo sapiens
atttgaaaaccatattttattgt

SEQ ID NO: 3211495 - DNA, 17 bp, Homo sapiens
atttgaaaccaggacat

SEQ ID NO: 3211496 - DNA, 13 bp, Homo sapiens
atttgaaatacta

SEQ ID NO: 3211497 - DNA, 13 bp, Homo sapiens
attgagaatttta

SEQ ID NO: 3211498 - DNA, 15 bp, Homo sapiens
attgagctgatataa

SEQ ID NO: 3211499 - DNA, 14 bp, Homo sapiens
attgaggagctgca

SEQ ID NO: 3211500 - DNA, 20 bp, Homo sapiens
attgagggtcattctttatt

SEQ ID NO: 3211501 - DNA, 17 bp, Homo sapiens
attgaggtttggaagag

SEQ ID NO: 3211502 - DNA, 13 bp, Homo sapiens
attgagtattgtt

SEQ ID NO: 3211503 - DNA, 14 bp, Homo sapiens
attgagtattgttt

SEQ ID NO: 3211504 - DNA, 15 bp, Homo sapiens
attgagtattgttta

SEQ ID NO: 3211505 - DNA, 23 bp, Homo sapiens
attgagtattgtttaaaatgtaa

SEQ ID NO: 3211506 - DNA, 14 bp, Homo sapiens
attgagtttgtagg

SEQ ID NO: 3211507 - DNA, 19 bp, Homo sapiens
attgataaccttgaaaaaa

SEQ ID NO: 3211508 - DNA, 15 bp, Homo sapiens
attgataatcttcag

SEQ ID NO: 3211509 - DNA, 16 bp, Homo sapiens
attgataatcttcagg

SEQ ID NO: 3211510 - DNA, 21 bp, Homo sapiens
attgatcctttgatcccagaa

SEQ ID NO: 3211511 - DNA, 22 bp, Homo sapiens
attgatcctttgatcccagaaa

SEQ ID NO: 3211512 - DNA, 14 bp, Homo sapiens
attgatctttttat

SEQ ID NO: 3211513 - DNA, 19 bp, Homo sapiens
attgatctttttatcatga

SEQ ID NO: 3211514 - DNA, 17 bp, Homo sapiens
attgatgaaaagattta

SEQ ID NO: 3211515 - DNA, 21 bp, Homo sapiens
attgatgaaaagatttaagca

SEQ ID NO: 3211516 - DNA, 23 bp, Homo sapiens
attgatgataacacttaaaattg

SEQ ID NO: 3211517 - DNA, 15 bp, Homo sapiens
attgatggatgtctt

SEQ ID NO: 3211518 - DNA, 22 bp, Homo sapiens
attgatgtacagtctgtcatga

SEQ ID NO: 3211519 - DNA, 18 bp, Homo sapiens
attgattgggaaaacatt

SEQ ID NO: 3211520 - DNA, 21 bp, Homo sapiens
attgattgggaaaacatttgc

SEQ ID NO: 3211521 - DNA, 22 bp, Homo sapiens
attgattgggaaaacatttgct

SEQ ID NO: 3211522 - DNA, 23 bp, Homo sapiens
attgattgggaaaacatttgctg

SEQ ID NO: 3211523 - DNA, 13 bp, Homo sapiens
attgatttcaaga

SEQ ID NO: 3211524 - DNA, 16 bp, Homo sapiens
attgatttcaagacct

SEQ ID NO: 3211525 - DNA, 12 bp, Homo sapiens
attgatttcttt

SEQ ID NO: 3211526 - DNA, 15 bp, Homo sapiens
attgatttcttttct

SEQ ID NO: 3211527 - DNA, 14 bp, Homo sapiens
attgatttgaagaa

SEQ ID NO: 3211528 - DNA, 16 bp, Homo sapiens
attgatttgaagaaca

SEQ ID NO: 3211529 - DNA, 12 bp, Homo sapiens
attgatttgcat

SEQ ID NO: 3211530 - DNA, 16 bp, Homo sapiens
attgatttgcattgaa

SEQ ID NO: 3211531 - DNA, 23 bp, Homo sapiens
attgcaaaggttccaactgtata

SEQ ID NO: 3211532 - DNA, 12 bp, Homo sapiens
attgcaaatctt

SEQ ID NO: 3211533 - DNA, 18 bp, Homo sapiens
attgcaacaggctgggct

SEQ ID NO: 3211534 - DNA, 16 bp, Homo sapiens
attgcaataaagtata

SEQ ID NO: 3211535 - DNA, 16 bp, Homo sapiens
attgcaatatctgaag

SEQ ID NO: 3211536 - DNA, 13 bp, Homo sapiens
attgcaattaaac

SEQ ID NO: 3211537 - DNA, 15 bp, Homo sapiens
attgcacagaatttg

SEQ ID NO: 3211538 - DNA, 15 bp, Homo sapiens
attgcacattgtaaa

SEQ ID NO: 3211539 - DNA, 17 bp, Homo sapiens
attgcacctggatgtac

SEQ ID NO: 3211540 - DNA, 17 bp, Homo sapiens
attgcacgtggcctctt

SEQ ID NO: 3211541 - DNA, 14 bp, Homo sapiens
attgcactgaagtt

SEQ ID NO: 3211542 - DNA, 23 bp, Homo sapiens
attgcactgaagtttttgaaata

SEQ ID NO: 3211543 - DNA, 13 bp, Homo sapiens
attgcacttttaa

SEQ ID NO: 3211544 - DNA, 17 bp, Homo sapiens
attgcagaaaattctgt

SEQ ID NO: 3211545 - DNA, 16 bp, Homo sapiens
attgcagcagataact

SEQ ID NO: 3211546 - DNA, 19 bp, Homo sapiens
attgcagcagataactttt

SEQ ID NO: 3211547 - DNA, 17 bp, Homo sapiens
attgcaggatggtgtct

SEQ ID NO: 3211548 - DNA, 14 bp, Homo sapiens
attgcatcactgta

SEQ ID NO: 3211549 - DNA, 16 bp, Homo sapiens
attgcatcactgtatc

SEQ ID NO: 3211550 - DNA, 19 bp, Homo sapiens
attgcatcactgtatcatt

SEQ ID NO: 3211551 - DNA, 11 bp, Homo sapiens
attgcattgac

SEQ ID NO: 3211552 - DNA, 14 bp, Homo sapiens
attgcattgctggt

SEQ ID NO: 3211553 - DNA, 14 bp, Homo sapiens
attgccagtgtctt

SEQ ID NO: 3211554 - DNA, 18 bp, Homo sapiens
attgccattccctgcctg

SEQ ID NO: 3211555 - DNA, 21 bp, Homo sapiens
attgcccacgctggagtgcag

SEQ ID NO: 3211556 - DNA, 16 bp, Homo sapiens
attgcccccacctctg

SEQ ID NO: 3211557 - DNA, 11 bp, Homo sapiens
attgcctctga

SEQ ID NO: 3211558 - DNA, 13 bp, Homo sapiens
attgcctctgaaa

SEQ ID NO: 3211559 - DNA, 12 bp, Homo sapiens
attgcctttaaa

SEQ ID NO: 3211560 - DNA, 14 bp, Homo sapiens
attgcggccccagg

SEQ ID NO: 3211561 - DNA, 17 bp, Homo sapiens
attgcggccccaggagg

SEQ ID NO: 3211562 - DNA, 17 bp, Homo sapiens
attgctaccgagaaggt

SEQ ID NO: 3211563 - DNA, 20 bp, Homo sapiens
attgctactataatcaaatg

SEQ ID NO: 3211564 - DNA, 15 bp, Homo sapiens
attgctactgtccta

SEQ ID NO: 3211565 - DNA, 20 bp, Homo sapiens
attgctactgtcctacccac

SEQ ID NO: 3211566 - DNA, 15 bp, Homo sapiens
attgctatgttacta

SEQ ID NO: 3211567 - DNA, 18 bp, Homo sapiens
attgctcatgttggccaa

SEQ ID NO: 3211568 - DNA, 16 bp, Homo sapiens
attgctccctaagact

SEQ ID NO: 3211569 - DNA, 18 bp, Homo sapiens
attgctccctaagactgt

SEQ ID NO: 3211570 - DNA, 19 bp, Homo sapiens
attgctccctaagactgtg

SEQ ID NO: 3211571 - DNA, 12 bp, Homo sapiens
attgctccttga

SEQ ID NO: 3211572 - DNA, 21 bp, Homo sapiens
attgctgaagggcattctttc

SEQ ID NO: 3211573 - DNA, 22 bp, Homo sapiens
attgctgaagggcattctttcc

SEQ ID NO: 3211574 - DNA, 22 bp, Homo sapiens
attgctgagcctctgctcccca

SEQ ID NO: 3211575 - DNA, 22 bp, Homo sapiens
attgctgccataattctaagtt

SEQ ID NO: 3211576 - DNA, 13 bp, Homo sapiens
attgctgcttgga

SEQ ID NO: 3211577 - DNA, 14 bp, Homo sapiens
attgctgcttggat

SEQ ID NO: 3211578 - DNA, 21 bp, Homo sapiens
attgctggttctatttaatgg

SEQ ID NO: 3211579 - DNA, 22 bp, Homo sapiens
attgctggttctatttaatgga

SEQ ID NO: 3211580 - DNA, 20 bp, Homo sapiens
attgcttaaaagacattttt

SEQ ID NO: 3211581 - DNA, 13 bp, Homo sapiens
attgcttacattt

SEQ ID NO: 3211582 - DNA, 13 bp, Homo sapiens
attgcttactgat

SEQ ID NO: 3211583 - DNA, 14 bp, Homo sapiens
attgcttactgata

SEQ ID NO: 3211584 - DNA, 16 bp, Homo sapiens
attgcttactgatatt

SEQ ID NO: 3211585 - DNA, 19 bp, Homo sapiens
attgcttattatgtaggta

SEQ ID NO: 3211586 - DNA, 19 bp, Homo sapiens
attgcttcctcctccccaa

SEQ ID NO: 3211587 - DNA, 13 bp, Homo sapiens
attgcttctgtag

SEQ ID NO: 3211588 - DNA, 15 bp, Homo sapiens
attgcttctgtagta

SEQ ID NO: 3211589 - DNA, 14 bp, Homo sapiens
attgctttccactg

SEQ ID NO: 3211590 - DNA, 11 bp, Homo sapiens
attgctttctg

SEQ ID NO: 3211591 - DNA, 13 bp, Homo sapiens
attgctttctgaa

SEQ ID NO: 3211592 - DNA, 21 bp, Homo sapiens
attgctttgaagcagttgtgt

SEQ ID NO: 3211593 - DNA, 12 bp, Homo sapiens
attgctttgcca

SEQ ID NO: 3211594 - DNA, 23 bp, Homo sapiens
attgctttgccaaaataccagag

SEQ ID NO: 3211595 - DNA, 16 bp, Homo sapiens
attgcttttattttga

SEQ ID NO: 3211596 - DNA, 15 bp, Homo sapiens
attgcttttttgtat

SEQ ID NO: 3211597 - DNA, 12 bp, Homo sapiens
attggaaatgga

SEQ ID NO: 3211598 - DNA, 12 bp, Homo sapiens
attggaaatgta

SEQ ID NO: 3211599 - DNA, 22 bp, Homo sapiens
attggaaatgtcatctaaccat

SEQ ID NO: 3211600 - DNA, 23 bp, Homo sapiens
attggaaggtatttttttaaatt

SEQ ID NO: 3211601 - DNA, 18 bp, Homo sapiens
attggaatctgatatact

SEQ ID NO: 3211602 - DNA, 19 bp, Homo sapiens
attggaatggaactactgt

SEQ ID NO: 3211603 - DNA, 18 bp, Homo sapiens
attggaatgttctcagat

SEQ ID NO: 3211604 - DNA, 12 bp, Homo sapiens
attggaattaac

SEQ ID NO: 3211605 - DNA, 21 bp, Homo sapiens
attggagagggctctgtgctg

SEQ ID NO: 3211606 - DNA, 18 bp, Homo sapiens
attggagagtaaaaactg

SEQ ID NO: 3211607 - DNA, 21 bp, Homo sapiens
attggagcggtgggcactgtt

SEQ ID NO: 3211608 - DNA, 21 bp, Homo sapiens
atattgagaatcccttaaaat

SEQ ID NO: 3211609 - DNA, 17 bp, Homo sapiens
atattgagtcaaatggt

SEQ ID NO: 3211610 - DNA, 15 bp, Homo sapiens
atattgatatgctta

SEQ ID NO: 3211611 - DNA, 18 bp, Homo sapiens
atattgatattgaaggaa

SEQ ID NO: 3211612 - DNA, 17 bp, Homo sapiens
atattgatctttttatc

SEQ ID NO: 3211613 - DNA, 13 bp, Homo sapiens
atattgatgaaaa

SEQ ID NO: 3211614 - DNA, 15 bp, Homo sapiens
atattgatgataaca

SEQ ID NO: 3211615 - DNA, 15 bp, Homo sapiens
atattgatgtcagta

SEQ ID NO: 3211616 - DNA, 20 bp, Homo sapiens
atattgatgtcagtatttca

SEQ ID NO: 3211617 - DNA, 15 bp, Homo sapiens
atattgattgggaaa

SEQ ID NO: 3211618 - DNA, 21 bp, Homo sapiens
atattgattgggaaaacattt

SEQ ID NO: 3211619 - DNA, 16 bp, Homo sapiens
atattgattgtccttt

SEQ ID NO: 3211620 - DNA, 17 bp, Homo sapiens
atattgcaggagacatt

SEQ ID NO: 3211621 - DNA, 19 bp, Homo sapiens
atattgcaggagacatttt

SEQ ID NO: 3211622 - DNA, 15 bp, Homo sapiens
atattgctactataa

SEQ ID NO: 3211623 - DNA, 21 bp, Homo sapiens
atattgcttcttgtgttttac

SEQ ID NO: 3211624 - DNA, 20 bp, Homo sapiens
atattggtgcgtttttacag

SEQ ID NO: 3211625 - DNA, 21 bp, Homo sapiens
atattggtgcgtttttacagt

SEQ ID NO: 3211626 - DNA, 21 bp, Homo sapiens
atattgtacaaatgtaagcaa

SEQ ID NO: 3211627 - DNA, 22 bp, Homo sapiens
atattgtcagagttctgctcta

SEQ ID NO: 3211628 - DNA, 12 bp, Homo sapiens
atattgtcagat

SEQ ID NO: 3211629 - DNA, 17 bp, Homo sapiens
atattgtgattctgcct

SEQ ID NO: 3211630 - DNA, 17 bp, Homo sapiens
atattgtgtttgtgtat

SEQ ID NO: 3211631 - DNA, 18 bp, Homo sapiens
atattgttgtataatttc

SEQ ID NO: 3211632 - DNA, 14 bp, Homo sapiens
atattgtttaaaat

SEQ ID NO: 3211633 - DNA, 16 bp, Homo sapiens
atattgtttaaaattc

SEQ ID NO: 3211634 - DNA, 17 bp, Homo sapiens
atattgtttaaaattca

SEQ ID NO: 3211635 - DNA, 19 bp, Homo sapiens
atattgtttctgcattcat

SEQ ID NO: 3211636 - DNA, 14 bp, Homo sapiens
atattgtttggtaa

SEQ ID NO: 3211637 - DNA, 21 bp, Homo sapiens
atattgtttggtaaatgtttc

SEQ ID NO: 3211638 - DNA, 13 bp, Homo sapiens
atattgttttcag

SEQ ID NO: 3211639 - DNA, 20 bp, Homo sapiens
atatttaaaaattgtttctt

SEQ ID NO: 3211640 - DNA, 14 bp, Homo sapiens
atatttaaacagca

SEQ ID NO: 3211641 - DNA, 18 bp, Homo sapiens
atatttaaacagcagtgt

SEQ ID NO: 3211642 - DNA, 23 bp, Homo sapiens
atatttaacaatttattctgata

SEQ ID NO: 3211643 - DNA, 22 bp, Homo sapiens
atatttaacattatttatatgg

SEQ ID NO: 3211644 - DNA, 17 bp, Homo sapiens
atatttaagaaaagcac

SEQ ID NO: 3211645 - DNA, 19 bp, Homo sapiens
atatttaagaaaagcactt

SEQ ID NO: 3211646 - DNA, 22 bp, Homo sapiens
atatttaagaaaagcacttttg

SEQ ID NO: 3211647 - DNA, 23 bp, Homo sapiens
atatttaagaaaagcacttttgt

SEQ ID NO: 3211648 - DNA, 16 bp, Homo sapiens
atatttaagaaaatac

SEQ ID NO: 3211649 - DNA, 14 bp, Homo sapiens
atatttaagcctta

SEQ ID NO: 3211650 - DNA, 17 bp, Homo sapiens
atatttaatatattgaa

SEQ ID NO: 3211651 - DNA, 19 bp, Homo sapiens
atatttaatatattgaata

SEQ ID NO: 3211652 - DNA, 21 bp, Homo sapiens
atatttaatgcattaaacctg

SEQ ID NO: 3211653 - DNA, 14 bp, Homo sapiens
atatttaattatta

SEQ ID NO: 3211654 - DNA, 15 bp, Homo sapiens
atatttaattattaa

SEQ ID NO: 3211655 - DNA, 18 bp, Homo sapiens
atatttactctttgcaaa

SEQ ID NO: 3211656 - DNA, 19 bp, Homo sapiens
atatttactctttgcaaac

SEQ ID NO: 3211657 - DNA, 13 bp, Homo sapiens
atatttataactc

SEQ ID NO: 3211658 - DNA, 23 bp, Homo sapiens
atatttataactcatcataaaat

SEQ ID NO: 3211659 - DNA, 15 bp, Homo sapiens
atatttatagtcaca

SEQ ID NO: 3211660 - DNA, 15 bp, Homo sapiens
atatttatatatatt

SEQ ID NO: 3211661 - DNA, 15 bp, Homo sapiens
atatttatccaaaat

SEQ ID NO: 3211662 - DNA, 14 bp, Homo sapiens
atatttatgtagat

SEQ ID NO: 3211663 - DNA, 21 bp, Homo sapiens
atatttatgtctatttaagcc

SEQ ID NO: 3211664 - DNA, 18 bp, Homo sapiens
atatttattaaataaaat

SEQ ID NO: 3211665 - DNA, 20 bp, Homo sapiens
atatttattaaataaaatca

SEQ ID NO: 3211666 - DNA, 22 bp, Homo sapiens
atatttattaaataaaatcaat

SEQ ID NO: 3211667 - DNA, 14 bp, Homo sapiens
atatttattacctc

SEQ ID NO: 3211668 - DNA, 23 bp, Homo sapiens
atatttattattttcacctgttt

SEQ ID NO: 3211669 - DNA, 14 bp, Homo sapiens
atatttattgtgct

SEQ ID NO: 3211670 - DNA, 13 bp, Homo sapiens
atatttatttaaa

SEQ ID NO: 3211671 - DNA, 19 bp, Homo sapiens
atatttattttattctatg

SEQ ID NO: 3211672 - DNA, 22 bp, Homo sapiens
atatttattttcagtatactgt

SEQ ID NO: 3211673 - DNA, 23 bp, Homo sapiens
atatttcagatatcaaaattcta

SEQ ID NO: 3211674 - DNA, 13 bp, Homo sapiens
atatttcatttta

SEQ ID NO: 3211675 - DNA, 15 bp, Homo sapiens
atatttcattttaac

SEQ ID NO: 3211676 - DNA, 19 bp, Homo sapiens
atatttccctaaaatacat

SEQ ID NO: 3211677 - DNA, 21 bp, Homo sapiens
atatttccttaaactgtgtgg

SEQ ID NO: 3211678 - DNA, 14 bp, Homo sapiens
atatttctattgaa

SEQ ID NO: 3211679 - DNA, 16 bp, Homo sapiens
atatttctattgaatt

SEQ ID NO: 3211680 - DNA, 20 bp, Homo sapiens
atatttctgctttctttgat

SEQ ID NO: 3211681 - DNA, 13 bp, Homo sapiens
atatttcttgctt

SEQ ID NO: 3211682 - DNA, 13 bp, Homo sapiens
atatttgaatttt

SEQ ID NO: 3211683 - DNA, 15 bp, Homo sapiens
atatttgactattct

SEQ ID NO: 3211684 - DNA, 19 bp, Homo sapiens
atatttgagtcacttgtgt

SEQ ID NO: 3211685 - DNA, 17 bp, Homo sapiens
atatttgatatttggtt

SEQ ID NO: 3211686 - DNA, 19 bp, Homo sapiens
atatttgcagtttttcatt

SEQ ID NO: 3211687 - DNA, 15 bp, Homo sapiens
atatttggattgtca

SEQ ID NO: 3211688 - DNA, 21 bp, Homo sapiens
atatttggtttctagatcact

SEQ ID NO: 3211689 - DNA, 14 bp, Homo sapiens
atatttgtacaaaa

SEQ ID NO: 3211690 - DNA, 12 bp, Homo sapiens
atatttgtatcg

SEQ ID NO: 3211691 - DNA, 21 bp, Homo sapiens
atatttgtgatagcactttct

SEQ ID NO: 3211692 - DNA, 14 bp, Homo sapiens
atatttgtggaata

SEQ ID NO: 3211693 - DNA, 12 bp, Homo sapiens
atatttgtgtat

SEQ ID NO: 3211694 - DNA, 13 bp, Homo sapiens
atattttaataga

SEQ ID NO: 3211695 - DNA, 23 bp, Homo sapiens
atattttacattcttggaaagtc

SEQ ID NO: 3211696 - DNA, 14 bp, Homo sapiens
atattttataattt

SEQ ID NO: 3211697 - DNA, 15 bp, Homo sapiens
atattttatataaag

SEQ ID NO: 3211698 - DNA, 15 bp, Homo sapiens
atattttcaaagaga

SEQ ID NO: 3211699 - DNA, 17 bp, Homo sapiens
atattttcaaattgtat

SEQ ID NO: 3211700 - DNA, 20 bp, Homo sapiens
atattttcaacgcagccctg

SEQ ID NO: 3211701 - DNA, 13 bp, Homo sapiens
atattttcatgta

SEQ ID NO: 3211702 - DNA, 19 bp, Homo sapiens
atattttcgtatgaaaatg

SEQ ID NO: 3211703 - DNA, 14 bp, Homo sapiens
atattttctatttt

SEQ ID NO: 3211704 - DNA, 13 bp, Homo sapiens
atattttgattat

SEQ ID NO: 3211705 - DNA, 16 bp, Homo sapiens
ataaacatcacacaca

SEQ ID NO: 3211706 - DNA, 17 bp, Homo sapiens
ataaacatcacacacac

SEQ ID NO: 3211707 - DNA, 16 bp, Homo sapiens
ataaacatcagtttct

SEQ ID NO: 3211708 - DNA, 21 bp, Homo sapiens
ataaacattaaatgtcttata

SEQ ID NO: 3211709 - DNA, 16 bp, Homo sapiens
ataaaccaaaggacat

SEQ ID NO: 3211710 - DNA, 15 bp, Homo sapiens
ataaaccaataaatc

SEQ ID NO: 3211711 - DNA, 12 bp, Homo sapiens
ataaaccaatct

SEQ ID NO: 3211712 - DNA, 21 bp, Homo sapiens
ataaaccaggtttagacagta

SEQ ID NO: 3211713 - DNA, 19 bp, Homo sapiens
ataaaccatttttgttact

SEQ ID NO: 3211714 - DNA, 17 bp, Homo sapiens
ataaacctccgccaatg

SEQ ID NO: 3211715 - DNA, 13 bp, Homo sapiens
ataaacctggaga

SEQ ID NO: 3211716 - DNA, 16 bp, Homo sapiens
ataaacctggagatat

SEQ ID NO: 3211717 - DNA, 14 bp, Homo sapiens
ataaaccttcagaa

SEQ ID NO: 3211718 - DNA, 20 bp, Homo sapiens
ataaacgcgggaaaaaagat

SEQ ID NO: 3211719 - DNA, 14 bp, Homo sapiens
ataaactaggtaaa

SEQ ID NO: 3211720 - DNA, 21 bp, Homo sapiens
ataaactcctactaaatccct

SEQ ID NO: 3211721 - DNA, 20 bp, Homo sapiens
ataaactccttaacttcagg

SEQ ID NO: 3211722 - DNA, 21 bp, Homo sapiens
ataaactgaatattttggaaa

SEQ ID NO: 3211723 - DNA, 18 bp, Homo sapiens
ataaactgactttatcct

SEQ ID NO: 3211724 - DNA, 14 bp, Homo sapiens
ataaactgagcctc

SEQ ID NO: 3211725 - DNA, 14 bp, Homo sapiens
ataaactgtattaa

SEQ ID NO: 3211726 - DNA, 18 bp, Homo sapiens
ataaactgtcaaattttc

SEQ ID NO: 3211727 - DNA, 16 bp, Homo sapiens
ataaactgtgtttact

SEQ ID NO: 3211728 - DNA, 13 bp, Homo sapiens
ataaactgtttat

SEQ ID NO: 3211729 - DNA, 21 bp, Homo sapiens
ataaactgtttcagatttttt

SEQ ID NO: 3211730 - DNA, 16 bp, Homo sapiens
ataaacttagaggaaa

SEQ ID NO: 3211731 - DNA, 20 bp, Homo sapiens
ataaacttagaggaaaatga

SEQ ID NO: 3211732 - DNA, 13 bp, Homo sapiens
ataaacttcagag

SEQ ID NO: 3211733 - DNA, 22 bp, Homo sapiens
ataaactttaatataaagtagt

SEQ ID NO: 3211734 - DNA, 18 bp, Homo sapiens
ataaactttttttcaatg

SEQ ID NO: 3211735 - DNA, 23 bp, Homo sapiens
ataaagaactccttattttgtat

SEQ ID NO: 3211736 - DNA, 12 bp, Homo sapiens
ataaagaatata

SEQ ID NO: 3211737 - DNA, 14 bp, Homo sapiens
ataaagaatttaaa

SEQ ID NO: 3211738 - DNA, 13 bp, Homo sapiens
ataaagatgagtt

SEQ ID NO: 3211739 - DNA, 14 bp, Homo sapiens
ataaagatgagttg

SEQ ID NO: 3211740 - DNA, 14 bp, Homo sapiens
ataaagatgatcta

SEQ ID NO: 3211741 - DNA, 13 bp, Homo sapiens
ataaagattgtac

SEQ ID NO: 3211742 - DNA, 15 bp, Homo sapiens
ataaagattgtactt

SEQ ID NO: 3211743 - DNA, 23 bp, Homo sapiens
ataaagcagcctcattctgaggc

SEQ ID NO: 3211744 - DNA, 22 bp, Homo sapiens
ataaagcctcaaggttttaggt

SEQ ID NO: 3211745 - DNA, 21 bp, Homo sapiens
ataaagcgatatacagatgaa

SEQ ID NO: 3211746 - DNA, 15 bp, Homo sapiens
ataaaggcagctgcc

SEQ ID NO: 3211747 - DNA, 16 bp, Homo sapiens
ataaaggcagctgcct

SEQ ID NO: 3211748 - DNA, 17 bp, Homo sapiens
ataaaggcagctgcctc

SEQ ID NO: 3211749 - DNA, 23 bp, Homo sapiens
ataaaggcagctgcctctgctcc

SEQ ID NO: 3211750 - DNA, 17 bp, Homo sapiens
ataaaggcagttttcta

SEQ ID NO: 3211751 - DNA, 16 bp, Homo sapiens
ataaagggttgaaaat

SEQ ID NO: 3211752 - DNA, 16 bp, Homo sapiens
ataaaggttgacaata

SEQ ID NO: 3211753 - DNA, 22 bp, Homo sapiens
ataaaggttgacaataaatgtg

SEQ ID NO: 3211754 - DNA, 17 bp, Homo sapiens
ataaagtagtcctgtga

SEQ ID NO: 3211755 - DNA, 20 bp, Homo sapiens
ataaagtattcaacaatttc

SEQ ID NO: 3211756 - DNA, 15 bp, Homo sapiens
ataaagtattctttt

SEQ ID NO: 3211757 - DNA, 13 bp, Homo sapiens
ataaagtgttttc

SEQ ID NO: 3211758 - DNA, 15 bp, Homo sapiens
ataaagtgttttcag

SEQ ID NO: 3211759 - DNA, 18 bp, Homo sapiens
ataaagtgttttcagagc

SEQ ID NO: 3211760 - DNA, 13 bp, Homo sapiens
ataaataaaactg

SEQ ID NO: 3211761 - DNA, 12 bp, Homo sapiens
ataaataaatgt

SEQ ID NO: 3211762 - DNA, 18 bp, Homo sapiens
ataaataattgaaacaat

SEQ ID NO: 3211763 - DNA, 22 bp, Homo sapiens
ataaatacatacggtcaggttt

SEQ ID NO: 3211764 - DNA, 21 bp, Homo sapiens
ataaatacgtattacaaacaa

SEQ ID NO: 3211765 - DNA, 11 bp, Homo sapiens
ataaatagcta

SEQ ID NO: 3211766 - DNA, 16 bp, Homo sapiens
ataaatataagccttt

SEQ ID NO: 3211767 - DNA, 17 bp, Homo sapiens
ataaatatatataaaga

SEQ ID NO: 3211768 - DNA, 13 bp, Homo sapiens
ataaatatgcagt

SEQ ID NO: 3211769 - DNA, 20 bp, Homo sapiens
ataaatatttgacttgcatg

SEQ ID NO: 3211770 - DNA, 15 bp, Homo sapiens
ataaatcatttcagt

SEQ ID NO: 3211771 - DNA, 14 bp, Homo sapiens
ataaatctcttctt

SEQ ID NO: 3211772 - DNA, 17 bp, Homo sapiens
ataaatctgccatttca

SEQ ID NO: 3211773 - DNA, 22 bp, Homo sapiens
ataaatctgttctgggctcttt

SEQ ID NO: 3211774 - DNA, 14 bp, Homo sapiens
ataaatctgttgcc

SEQ ID NO: 3211775 - DNA, 18 bp, Homo sapiens
ataaatctttttactttg

SEQ ID NO: 3211776 - DNA, 11 bp, Homo sapiens
ataaatgaagc

SEQ ID NO: 3211777 - DNA, 17 bp, Homo sapiens
ataaatgaagcagcttt

SEQ ID NO: 3211778 - DNA, 17 bp, Homo sapiens
ataaatgaataaatcca

SEQ ID NO: 3211779 - DNA, 13 bp, Homo sapiens
ataaatgccttta

SEQ ID NO: 3211780 - DNA, 13 bp, Homo sapiens
ataaatggaaatc

SEQ ID NO: 3211781 - DNA, 19 bp, Homo sapiens
ataaatgtaaaaataataa

SEQ ID NO: 3211782 - DNA, 18 bp, Homo sapiens
ataaatgtaccagagaga

SEQ ID NO: 3211783 - DNA, 19 bp, Homo sapiens
ataaatgtataaatataca

SEQ ID NO: 3211784 - DNA, 18 bp, Homo sapiens
ataaatgtatatacacat

SEQ ID NO: 3211785 - DNA, 19 bp, Homo sapiens
ataaatgtatatacacata

SEQ ID NO: 3211786 - DNA, 21 bp, Homo sapiens
ataaatgtatatacacatata

SEQ ID NO: 3211787 - DNA, 13 bp, Homo sapiens
ataaatgtatcat

SEQ ID NO: 3211788 - DNA, 13 bp, Homo sapiens
ataaatgtcctaa

SEQ ID NO: 3211789 - DNA, 15 bp, Homo sapiens
ataaatgtctgttga

SEQ ID NO: 3211790 - DNA, 16 bp, Homo sapiens
ataaatgttattgtcc

SEQ ID NO: 3211791 - DNA, 20 bp, Homo sapiens
ataaatgtttaaatataaat

SEQ ID NO: 3211792 - DNA, 14 bp, Homo sapiens
ataaatgtttgtct

SEQ ID NO: 3211793 - DNA, 14 bp, Homo sapiens
ataaattagttgtt

SEQ ID NO: 3211794 - DNA, 13 bp, Homo sapiens
ataaattataagt

SEQ ID NO: 3211795 - DNA, 16 bp, Homo sapiens
ataaattatgagattt

SEQ ID NO: 3211796 - DNA, 17 bp, Homo sapiens
ataaattatgagatttt

SEQ ID NO: 3211797 - DNA, 15 bp, Homo sapiens
ataaattatgataat

SEQ ID NO: 3211798 - DNA, 20 bp, Homo sapiens
ataaattcaactttgtaaaa

SEQ ID NO: 3211799 - DNA, 12 bp, Homo sapiens
ataaattcagat

SEQ ID NO: 3211800 - DNA, 13 bp, Homo sapiens
ataaattcagata

SEQ ID NO: 3211801 - DNA, 16 bp, Homo sapiens
ataaattcagatatat

SEQ ID NO: 3211802 - DNA, 15 bp, Homo sapiens
ataaattccactgga

SEQ ID NO: 3211803 - DNA, 15 bp, Homo sapiens
ataaattctactaag

SEQ ID NO: 3211804 - DNA, 16 bp, Homo sapiens
ataaattctactaagt

SEQ ID NO: 3211805 - DNA, 17 bp, Homo sapiens
ataaattctactaagtt

SEQ ID NO: 3211806 - DNA, 18 bp, Homo sapiens
ataaattgctccttgaca

SEQ ID NO: 3211807 - DNA, 17 bp, Homo sapiens
ataaattgcttactgat

SEQ ID NO: 3211808 - DNA, 17 bp, Homo sapiens
ataaatttatatacttt

SEQ ID NO: 3211809 - DNA, 14 bp, Homo sapiens
ataacaacttcata

SEQ ID NO: 3211810 - DNA, 21 bp, Homo sapiens
ataacaaggagctcaccctgc

SEQ ID NO: 3211811 - DNA, 21 bp, Homo sapiens
ataacaaggttcttctaaaat

SEQ ID NO: 3211812 - DNA, 22 bp, Homo sapiens
ataacaaggttcttctaaaatt

SEQ ID NO: 3211813 - DNA, 16 bp, Homo sapiens
ataacaatatatagaa

SEQ ID NO: 3211814 - DNA, 14 bp, Homo sapiens
ataacaatgtatgt

SEQ ID NO: 3211815 - DNA, 17 bp, Homo sapiens
ataacaatgtatgtgaa

SEQ ID NO: 3211816 - DNA, 18 bp, Homo sapiens
ataacaatgttaaggaaa

SEQ ID NO: 3211817 - DNA, 17 bp, Homo sapiens
ataacacccttccttct

SEQ ID NO: 3211818 - DNA, 15 bp, Homo sapiens
ataacactaaaattt

SEQ ID NO: 3211819 - DNA, 21 bp, Homo sapiens
ataacactctaggatgtatat

SEQ ID NO: 3211820 - DNA, 22 bp, Homo sapiens
ataacacttaaaattgtaacct

SEQ ID NO: 3211821 - DNA, 23 bp, Homo sapiens
ataacagaaagcctgggtgacat

SEQ ID NO: 3211822 - DNA, 16 bp, Homo sapiens
ataacagatacatttc

SEQ ID NO: 3211823 - DNA, 18 bp, Homo sapiens
ataacagatgtgaaaata

SEQ ID NO: 3211824 - DNA, 22 bp, Homo sapiens
ataacagatgtgaaaatatact

SEQ ID NO: 3211825 - DNA, 15 bp, Homo sapiens
ataacagctccttta

SEQ ID NO: 3211826 - DNA, 13 bp, Homo sapiens
ctgctcccagcct

SEQ ID NO: 3211827 - DNA, 15 bp, Homo sapiens
ctgctcccagcctgc

SEQ ID NO: 3211828 - DNA, 16 bp, Homo sapiens
ctgctcccagcctgct

SEQ ID NO: 3211829 - DNA, 20 bp, Homo sapiens
ctgctcccagcctgctgaga

SEQ ID NO: 3211830 - DNA, 17 bp, Homo sapiens
ctgctcccattcctccc

SEQ ID NO: 3211831 - DNA, 16 bp, Homo sapiens
ctgctccccagccctg

SEQ ID NO: 3211832 - DNA, 19 bp, Homo sapiens
ctgctccccagccctggct

SEQ ID NO: 3211833 - DNA, 14 bp, Homo sapiens
ctgctccctgaagc

SEQ ID NO: 3211834 - DNA, 18 bp, Homo sapiens
ctgctccctgctttggct

SEQ ID NO: 3211835 - DNA, 15 bp, Homo sapiens
ctgctccgcccgctc

SEQ ID NO: 3211836 - DNA, 16 bp, Homo sapiens
ctgctccgctgctcct

SEQ ID NO: 3211837 - DNA, 18 bp, Homo sapiens
ctgctccgctgctccttg

SEQ ID NO: 3211838 - DNA, 14 bp, Homo sapiens
ctgctcctcactgg

SEQ ID NO: 3211839 - DNA, 12 bp, Homo sapiens
ctgctcctccct

SEQ ID NO: 3211840 - DNA, 19 bp, Homo sapiens
ctgctcctccctgcccccc

SEQ ID NO: 3211841 - DNA, 16 bp, Homo sapiens
ctgctcctccctggct

SEQ ID NO: 3211842 - DNA, 19 bp, Homo sapiens
ctgctcctccctggctgcc

SEQ ID NO: 3211843 - DNA, 13 bp, Homo sapiens
ctgctcctctcca

SEQ ID NO: 3211844 - DNA, 14 bp, Homo sapiens
ctgctcctctccag

SEQ ID NO: 3211845 - DNA, 15 bp, Homo sapiens
ctgctcctctccagg

SEQ ID NO: 3211846 - DNA, 17 bp, Homo sapiens
ctgctcctctccccagc

SEQ ID NO: 3211847 - DNA, 19 bp, Homo sapiens
ctgctcctctccccagcaa

SEQ ID NO: 3211848 - DNA, 19 bp, Homo sapiens
ctgctcctggagcctttga

SEQ ID NO: 3211849 - DNA, 15 bp, Homo sapiens
ctgctccttcactgt

SEQ ID NO: 3211850 - DNA, 21 bp, Homo sapiens
ctgctccttcactgttccctc

SEQ ID NO: 3211851 - DNA, 13 bp, Homo sapiens
ctgctccttggct

SEQ ID NO: 3211852 - DNA, 16 bp, Homo sapiens
ctgctcgcccaggaag

SEQ ID NO: 3211853 - DNA, 18 bp, Homo sapiens
ctgctcgccctcctttct

SEQ ID NO: 3211854 - DNA, 23 bp, Homo sapiens
ctgctcgccctcctttctgtgcc

SEQ ID NO: 3211855 - DNA, 20 bp, Homo sapiens
ctgctctacccatgagcctg

SEQ ID NO: 3211856 - DNA, 22 bp, Homo sapiens
ctgctctacccatgagcctgcc

SEQ ID NO: 3211857 - DNA, 14 bp, Homo sapiens
ctgctctagccagg

SEQ ID NO: 3211858 - DNA, 16 bp, Homo sapiens
ctgctctagccaggag

SEQ ID NO: 3211859 - DNA, 22 bp, Homo sapiens
ctgctctagctggcaggacaca

SEQ ID NO: 3211860 - DNA, 23 bp, Homo sapiens
ctgctctagtgggacagcccaga

SEQ ID NO: 3211861 - DNA, 21 bp, Homo sapiens
ctgctctattccaaaaaggtt

SEQ ID NO: 3211862 - DNA, 15 bp, Homo sapiens
ctgctctccgaccag

SEQ ID NO: 3211863 - DNA, 20 bp, Homo sapiens
ctgctctcctcttgccactg

SEQ ID NO: 3211864 - DNA, 17 bp, Homo sapiens
ctgctctggttgtttct

SEQ ID NO: 3211865 - DNA, 22 bp, Homo sapiens
ctgctctggttgtttctgttcc

SEQ ID NO: 3211866 - DNA, 18 bp, Homo sapiens
ctgctcttagtgcccgcc

SEQ ID NO: 3211867 - DNA, 13 bp, Homo sapiens
ctgctcttgaaca

SEQ ID NO: 3211868 - DNA, 15 bp, Homo sapiens
ctgctcttgaacatt

SEQ ID NO: 3211869 - DNA, 14 bp, Homo sapiens
ctgctcttgtttct

SEQ ID NO: 3211870 - DNA, 15 bp, Homo sapiens
ctgctctttctctgc

SEQ ID NO: 3211871 - DNA, 16 bp, Homo sapiens
ctgctctttctctgcc

SEQ ID NO: 3211872 - DNA, 17 bp, Homo sapiens
ctgctctttctctgcca

SEQ ID NO: 3211873 - DNA, 22 bp, Homo sapiens
ctgctctttctctgccagtgac

SEQ ID NO: 3211874 - DNA, 17 bp, Homo sapiens
ctgctgaaggaataaat

SEQ ID NO: 3211875 - DNA, 15 bp, Homo sapiens
ctgctgaatgtaaaa

SEQ ID NO: 3211876 - DNA, 15 bp, Homo sapiens
ctgctgacagacaca

SEQ ID NO: 3211877 - DNA, 21 bp, Homo sapiens
ctgctgacagacacaggcccg

SEQ ID NO: 3211878 - DNA, 23 bp, Homo sapiens
ctgctgacagacacaggcccggc

SEQ ID NO: 3211879 - DNA, 12 bp, Homo sapiens
ctgctgagccac

SEQ ID NO: 3211880 - DNA, 22 bp, Homo sapiens
ctgctgagccactcgcagtcgc

SEQ ID NO: 3211881 - DNA, 16 bp, Homo sapiens
ctgctgcaccagagtg

SEQ ID NO: 3211882 - DNA, 11 bp, Homo sapiens
ctgctgcaggg

SEQ ID NO: 3211883 - DNA, 12 bp, Homo sapiens
ctgctgcagggg

SEQ ID NO: 3211884 - DNA, 19 bp, Homo sapiens
ctgctgcaggggctctgga

SEQ ID NO: 3211885 - DNA, 16 bp, Homo sapiens
ctgctgcatggggtgg

SEQ ID NO: 3211886 - DNA, 15 bp, Homo sapiens
ctgctgccagggctt

SEQ ID NO: 3211887 - DNA, 13 bp, Homo sapiens
ctgctgccagtgc

SEQ ID NO: 3211888 - DNA, 12 bp, Homo sapiens
ctgctgcccagc

SEQ ID NO: 3211889 - DNA, 16 bp, Homo sapiens
ctgctgcccaggccac

SEQ ID NO: 3211890 - DNA, 14 bp, Homo sapiens
ctgctgcccccacc

SEQ ID NO: 3211891 - DNA, 15 bp, Homo sapiens
ctgctgcccccaccc

SEQ ID NO: 3211892 - DNA, 22 bp, Homo sapiens
ctgctgcccccaccccggggac

SEQ ID NO: 3211893 - DNA, 17 bp, Homo sapiens
ctgctgccgcctcccag

SEQ ID NO: 3211894 - DNA, 19 bp, Homo sapiens
ctgctgccgcctcccagcc

SEQ ID NO: 3211895 - DNA, 20 bp, Homo sapiens
ctgctgccgcctcccagcct

SEQ ID NO: 3211896 - DNA, 20 bp, Homo sapiens
ctgctgcctctttccctagg

SEQ ID NO: 3211897 - DNA, 17 bp, Homo sapiens
ctgctgcgtccccactc

SEQ ID NO: 3211898 - DNA, 13 bp, Homo sapiens
ctgctgctaccag

SEQ ID NO: 3211899 - DNA, 21 bp, Homo sapiens
ctgctgctctcccctcccagt

SEQ ID NO: 3211900 - DNA, 14 bp, Homo sapiens
ctgctgctgctgtg

SEQ ID NO: 3211901 - DNA, 23 bp, Homo sapiens
ctgctgctgtaactgctgagcca

SEQ ID NO: 3211902 - DNA, 16 bp, Homo sapiens
ctgctgctgtgcagca

SEQ ID NO: 3211903 - DNA, 19 bp, Homo sapiens
ctgctggagtctggcttta

SEQ ID NO: 3211904 - DNA, 16 bp, Homo sapiens
ctgctggcacccaccg

SEQ ID NO: 3211905 - DNA, 16 bp, Homo sapiens
ctgctggcctggatct

SEQ ID NO: 3211906 - DNA, 13 bp, Homo sapiens
ctgctggcctggc

SEQ ID NO: 3211907 - DNA, 20 bp, Homo sapiens
ctgctggcctggccggcaac

SEQ ID NO: 3211908 - DNA, 15 bp, Homo sapiens
ctgctggctgcctta

SEQ ID NO: 3211909 - DNA, 15 bp, Homo sapiens
ctgctggctgcggcc

SEQ ID NO: 3211910 - DNA, 22 bp, Homo sapiens
ctgctggcttccagcttcaggc

SEQ ID NO: 3211911 - DNA, 14 bp, Homo sapiens
ctgctggcttgcag

SEQ ID NO: 3211912 - DNA, 16 bp, Homo sapiens
ctgctggcttgcagtg

SEQ ID NO: 3211913 - DNA, 11 bp, Homo sapiens
ctgctgggaac

SEQ ID NO: 3211914 - DNA, 17 bp, Homo sapiens
ctgctgggaaccccgca

SEQ ID NO: 3211915 - DNA, 21 bp, Homo sapiens
ctgctgggaaccccgcagccc

SEQ ID NO: 3211916 - DNA, 17 bp, Homo sapiens
ctgctgggactggccag

SEQ ID NO: 3211917 - DNA, 19 bp, Homo sapiens
ctgctgggactggccaggt

SEQ ID NO: 3211918 - DNA, 14 bp, Homo sapiens
ctgctggggatccc

SEQ ID NO: 3211919 - DNA, 21 bp, Homo sapiens
ctgctggggatccccgcctgg

SEQ ID NO: 3211920 - DNA, 22 bp, Homo sapiens
ctgctggggatccccgcctggc

SEQ ID NO: 3211921 - DNA, 15 bp, Homo sapiens
ctgctggggcatgtg

SEQ ID NO: 3211922 - DNA, 18 bp, Homo sapiens
ctgctggggcatgtgtgc

SEQ ID NO: 3211923 - DNA, 17 bp, Homo sapiens
ctgctggggcctcagac

SEQ ID NO: 3211924 - DNA, 16 bp, Homo sapiens
ctgctggtaacagtgg

SEQ ID NO: 3211925 - DNA, 15 bp, Homo sapiens
ctgctggtacctgcc

SEQ ID NO: 3211926 - DNA, 17 bp, Homo sapiens
ctgctggtccgtgggac

SEQ ID NO: 3211927 - DNA, 13 bp, Homo sapiens
ctgctggttcagg

SEQ ID NO: 3211928 - DNA, 20 bp, Homo sapiens
ctgctggttcctgactggca

SEQ ID NO: 3211929 - DNA, 21 bp, Homo sapiens
ctgctgtaaaattataaactt

SEQ ID NO: 3211930 - DNA, 20 bp, Homo sapiens
ctgctgtaaatacaggaaga

SEQ ID NO: 3211931 - DNA, 15 bp, Homo sapiens
ctgctgtaactgctg

SEQ ID NO: 3211932 - DNA, 14 bp, Homo sapiens
ctgctgtacccaga

SEQ ID NO: 3211933 - DNA, 16 bp, Homo sapiens
ctgctgtacccagatg

SEQ ID NO: 3211934 - DNA, 18 bp, Homo sapiens
ctgctgtagtcctttctg

SEQ ID NO: 3211935 - DNA, 21 bp, Homo sapiens
ctgctgtagtcctttctgcct

SEQ ID NO: 3211936 - DNA, 21 bp, Homo sapiens
ctgctgtgatacgatgcttca

SEQ ID NO: 3211937 - DNA, 16 bp, Homo sapiens
ctgctgtgctgctcaa

SEQ ID NO: 3211938 - DNA, 14 bp, Homo sapiens
ctgctgtgtgtgag

SEQ ID NO: 3211939 - DNA, 16 bp, Homo sapiens
ctgctgttgccatagc

SEQ ID NO: 3211940 - DNA, 21 bp, Homo sapiens
ctgctgtttgacacctctttt

SEQ ID NO: 3211941 - DNA, 21 bp, Homo sapiens
ctgcttacctactttcttcag

SEQ ID NO: 3211942 - DNA, 23 bp, Homo sapiens
ctgcttatcaataaacctgtttg

SEQ ID NO: 3211943 - DNA, 16 bp, Homo sapiens
ctgcttcagcctcccg

SEQ ID NO: 3211944 - DNA, 12 bp, Homo sapiens
ctgcttcagtgg

SEQ ID NO: 3211945 - DNA, 19 bp, Homo sapiens
ctgcttcagtgtatggaaa

SEQ ID NO: 3211946 - DNA, 16 bp, Homo sapiens
ctgcttcatgtgaaca

SEQ ID NO: 3211947 - DNA, 12 bp, Homo sapiens
ctgcttccagga

SEQ ID NO: 3211948 - DNA, 13 bp, Homo sapiens
ctgcttcccatcc

SEQ ID NO: 3211949 - DNA, 22 bp, Homo sapiens
cttgggggaacgatgtgtctgt

SEQ ID NO: 3211950 - DNA, 22 bp, Homo sapiens
cttgggggggtggccgctgagt

SEQ ID NO: 3211951 - DNA, 14 bp, Homo sapiens
cttggggtactctt

SEQ ID NO: 3211952 - DNA, 21 bp, Homo sapiens
cttggggtactcttgatgtga

SEQ ID NO: 3211953 - DNA, 22 bp, Homo sapiens
cttggggtactcttgatgtgaa

SEQ ID NO: 3211954 - DNA, 23 bp, Homo sapiens
cttggggtcaggaacagtggctg

SEQ ID NO: 3211955 - DNA, 20 bp, Homo sapiens
cttgggtaagtcccccaggg

SEQ ID NO: 3211956 - DNA, 19 bp, Homo sapiens
cttgggttccaaccaggca

SEQ ID NO: 3211957 - DNA, 19 bp, Homo sapiens
cttggtacagttgcaggag

SEQ ID NO: 3211958 - DNA, 23 bp, Homo sapiens
cttggtatttttcagagatttat

SEQ ID NO: 3211959 - DNA, 15 bp, Homo sapiens
cttggtcagagccac

SEQ ID NO: 3211960 - DNA, 17 bp, Homo sapiens
cttggtccctggtccct

SEQ ID NO: 3211961 - DNA, 20 bp, Homo sapiens
cttggtctgatttcaggata

SEQ ID NO: 3211962 - DNA, 18 bp, Homo sapiens
cttggtctttctgtgctt

SEQ ID NO: 3211963 - DNA, 16 bp, Homo sapiens
cttggtctttgtatct

SEQ ID NO: 3211964 - DNA, 20 bp, Homo sapiens
cttggtgaatttttttttcc

SEQ ID NO: 3211965 - DNA, 22 bp, Homo sapiens
cttggtgaatttttttttccta

SEQ ID NO: 3211966 - DNA, 19 bp, Homo sapiens
cttggtgccttttgtgtga

SEQ ID NO: 3211967 - DNA, 16 bp, Homo sapiens
cttggtgctctgtgtt

SEQ ID NO: 3211968 - DNA, 21 bp, Homo sapiens
cttggtggggctcgtggcctt

SEQ ID NO: 3211969 - DNA, 17 bp, Homo sapiens
cttggtgttttgggact

SEQ ID NO: 3211970 - DNA, 17 bp, Homo sapiens
cttggttcatcagtgtt

SEQ ID NO: 3211971 - DNA, 17 bp, Homo sapiens
cttggttcccttgtgtg

SEQ ID NO: 3211972 - DNA, 13 bp, Homo sapiens
cttggttggctgg

SEQ ID NO: 3211973 - DNA, 23 bp, Homo sapiens
cttggtttctctctacagtgcca

SEQ ID NO: 3211974 - DNA, 23 bp, Homo sapiens
cttggtttttttttttcttaaat

SEQ ID NO: 3211975 - DNA, 19 bp, Homo sapiens
cttgtaaaaaaagcaaaaa

SEQ ID NO: 3211976 - DNA, 12 bp, Homo sapiens
cttgtaaagact

SEQ ID NO: 3211977 - DNA, 21 bp, Homo sapiens
cttgtaaataaccacaaggtc

SEQ ID NO: 3211978 - DNA, 14 bp, Homo sapiens
cttgtaaataccag

SEQ ID NO: 3211979 - DNA, 19 bp, Homo sapiens
cttgtaaataccaggattt

SEQ ID NO: 3211980 - DNA, 16 bp, Homo sapiens
cttgtaaatagctcag

SEQ ID NO: 3211981 - DNA, 17 bp, Homo sapiens
cttgtaactcaccgtgc

SEQ ID NO: 3211982 - DNA, 23 bp, Homo sapiens
cttgtaactcaccgtgctgtctt

SEQ ID NO: 3211983 - DNA, 14 bp, Homo sapiens
cttgtaagaccctt

SEQ ID NO: 3211984 - DNA, 18 bp, Homo sapiens
cttgtaagctatctgtgc

SEQ ID NO: 3211985 - DNA, 13 bp, Homo sapiens
cttgtaataaata

SEQ ID NO: 3211986 - DNA, 17 bp, Homo sapiens
cttgtaataaatactgc

SEQ ID NO: 3211987 - DNA, 13 bp, Homo sapiens
cttgtaattctaa

SEQ ID NO: 3211988 - DNA, 16 bp, Homo sapiens
cttgtaatttttattt

SEQ ID NO: 3211989 - DNA, 14 bp, Homo sapiens
cttgtacatgtgta

SEQ ID NO: 3211990 - DNA, 16 bp, Homo sapiens
cttgtactcttaggat

SEQ ID NO: 3211991 - DNA, 14 bp, Homo sapiens
cttgtactgggaca

SEQ ID NO: 3211992 - DNA, 15 bp, Homo sapiens
cttgtacttctgtgt

SEQ ID NO: 3211993 - DNA, 17 bp, Homo sapiens
cttgtacttctgtgttc

SEQ ID NO: 3211994 - DNA, 19 bp, Homo sapiens
cttgtagaactcactctgg

SEQ ID NO: 3211995 - DNA, 21 bp, Homo sapiens
cttgtagaactcactctgggc

SEQ ID NO: 3211996 - DNA, 15 bp, Homo sapiens
cttgtagaattgtta

SEQ ID NO: 3211997 - DNA, 16 bp, Homo sapiens
cttgtagacacttact

SEQ ID NO: 3211998 - DNA, 22 bp, Homo sapiens
cttgtagctgtaaaacgctgtc

SEQ ID NO: 3211999 - DNA, 14 bp, Homo sapiens
cttgtataaatgta

SEQ ID NO: 3212000 - DNA, 15 bp, Homo sapiens
cttgtataaatgtat

SEQ ID NO: 3212001 - DNA, 23 bp, Homo sapiens
cttgtataaatgtatatacacat

SEQ ID NO: 3212002 - DNA, 19 bp, Homo sapiens
cttgtataagatcctagat

SEQ ID NO: 3212003 - DNA, 20 bp, Homo sapiens
cttgtatatacgcatctata

SEQ ID NO: 3212004 - DNA, 20 bp, Homo sapiens
cttgtatcaacactgttact

SEQ ID NO: 3212005 - DNA, 13 bp, Homo sapiens
cttgtattaaact

SEQ ID NO: 3212006 - DNA, 14 bp, Homo sapiens
cttgtattgacttt

SEQ ID NO: 3212007 - DNA, 19 bp, Homo sapiens
cttgtattgactttatgtt

SEQ ID NO: 3212008 - DNA, 13 bp, Homo sapiens
cttgtatttccaa

SEQ ID NO: 3212009 - DNA, 22 bp, Homo sapiens
cttgtcaccagttaaaagcatt

SEQ ID NO: 3212010 - DNA, 17 bp, Homo sapiens
cttgtcactgacacaaa

SEQ ID NO: 3212011 - DNA, 16 bp, Homo sapiens
cttgtcagacataaag

SEQ ID NO: 3212012 - DNA, 18 bp, Homo sapiens
cttgtcaggcatggctca

SEQ ID NO: 3212013 - DNA, 19 bp, Homo sapiens
cttgtcccatgtggcttgt

SEQ ID NO: 3212014 - DNA, 23 bp, Homo sapiens
cttgtcccccgtgatctcccctc

SEQ ID NO: 3212015 - DNA, 21 bp, Homo sapiens
cttgtccctttccctaccttt

SEQ ID NO: 3212016 - DNA, 13 bp, Homo sapiens
cttgtcctgccag

SEQ ID NO: 3212017 - DNA, 14 bp, Homo sapiens
cttgtcctgccagc

SEQ ID NO: 3212018 - DNA, 20 bp, Homo sapiens
cttgtcctgccagctgcctt

SEQ ID NO: 3212019 - DNA, 17 bp, Homo sapiens
cttgtcctgggcctgcc

SEQ ID NO: 3212020 - DNA, 14 bp, Homo sapiens
cttgtcctttccct

SEQ ID NO: 3212021 - DNA, 18 bp, Homo sapiens
cttgtctagtttcccaca

SEQ ID NO: 3212022 - DNA, 19 bp, Homo sapiens
cttgtctcctactcctgac

SEQ ID NO: 3212023 - DNA, 16 bp, Homo sapiens
cttgtctgaggcctca

SEQ ID NO: 3212024 - DNA, 20 bp, Homo sapiens
cttgtctgaggcctcatccc

SEQ ID NO: 3212025 - DNA, 21 bp, Homo sapiens
cttgtcttctggtactttctg

SEQ ID NO: 3212026 - DNA, 15 bp, Homo sapiens
cttgtctttcctcct

SEQ ID NO: 3212027 - DNA, 21 bp, Homo sapiens
cttgtctttcctcctaccttt

SEQ ID NO: 3212028 - DNA, 14 bp, Homo sapiens
cttgtgaaacacag

SEQ ID NO: 3212029 - DNA, 20 bp, Homo sapiens
cttgtgaaacacagctgttc

SEQ ID NO: 3212030 - DNA, 19 bp, Homo sapiens
cttgtgaatgcttctcact

SEQ ID NO: 3212031 - DNA, 19 bp, Homo sapiens
cttgtgaattattctgatt

SEQ ID NO: 3212032 - DNA, 19 bp, Homo sapiens
cttgtgagagcccattccc

SEQ ID NO: 3212033 - DNA, 23 bp, Homo sapiens
cttgtgagagcccattcccacca

SEQ ID NO: 3212034 - DNA, 18 bp, Homo sapiens
cttgtgagatccttcaca

SEQ ID NO: 3212035 - DNA, 17 bp, Homo sapiens
cttgtgattgctgccat

SEQ ID NO: 3212036 - DNA, 14 bp, Homo sapiens
cttgtgatttccat

SEQ ID NO: 3212037 - DNA, 21 bp, Homo sapiens
cttgtgatttctttaaaagaa

SEQ ID NO: 3212038 - DNA, 22 bp, Homo sapiens
cttgtgatttctttaaaagaat

SEQ ID NO: 3212039 - DNA, 23 bp, Homo sapiens
cttgtgatttctttaaaagaatg

SEQ ID NO: 3212040 - DNA, 19 bp, Homo sapiens
cttgtgccatagtcacatg

SEQ ID NO: 3212041 - DNA, 23 bp, Homo sapiens
cttgtgccctgcccccatctccc

SEQ ID NO: 3212042 - DNA, 18 bp, Homo sapiens
cttgtgcttggtggggct

SEQ ID NO: 3212043 - DNA, 23 bp, Homo sapiens
cttgtgctttgctcttgtcccac

SEQ ID NO: 3212044 - DNA, 16 bp, Homo sapiens
cttgtggccaatggaa

SEQ ID NO: 3212045 - DNA, 21 bp, Homo sapiens
cttgtggccccttttactttt

SEQ ID NO: 3212046 - DNA, 14 bp, Homo sapiens
cttgtgggctggtg

SEQ ID NO: 3212047 - DNA, 15 bp, Homo sapiens
cttgtgggctggtgc

SEQ ID NO: 3212048 - DNA, 17 bp, Homo sapiens
cttgtggggacccaggc

SEQ ID NO: 3212049 - DNA, 24 bp, Homo sapiens
cttgtgggtccatgctaacaaaga

SEQ ID NO: 3212050 - DNA, 19 bp, Homo sapiens
cttgtggtgtaaagctggc

SEQ ID NO: 3212051 - DNA, 21 bp, Homo sapiens
cttgtggtgtaaagctggccc

SEQ ID NO: 3212052 - DNA, 22 bp, Homo sapiens
cttgtggtgtaaagctggccct

SEQ ID NO: 3212053 - DNA, 20 bp, Homo sapiens
cttgtggttttcaaattgga

SEQ ID NO: 3212054 - DNA, 23 bp, Homo sapiens
cttgtgtatattttaatgaatat

SEQ ID NO: 3212055 - DNA, 19 bp, Homo sapiens
cttgtgtcaaccactaaag

SEQ ID NO: 3212056 - DNA, 21 bp, Homo sapiens
cttgtgtcaaccactaaagta

SEQ ID NO: 3212057 - DNA, 14 bp, Homo sapiens
cttgtgtcccatga

SEQ ID NO: 3212058 - DNA, 17 bp, Homo sapiens
cttgtgtctctgtgctt

SEQ ID NO: 3212059 - DNA, 18 bp, Homo sapiens
cttgtgtctctgtgcttt

SEQ ID NO: 3212060 - DNA, 10 bp, Homo sapiens
cttgtgtctg

SEQ ID NO: 3212061 - DNA, 14 bp, Homo sapiens
cttgtgtctgtaca

SEQ ID NO: 3212062 - DNA, 11 bp, Homo sapiens
cttcttttgaa

SEQ ID NO: 3212063 - DNA, 14 bp, Homo sapiens
cttcttttgctctt

SEQ ID NO: 3212064 - DNA, 22 bp, Homo sapiens
cttcttttgtggtgtcttccat

SEQ ID NO: 3212065 - DNA, 16 bp, Homo sapiens
cttctttttgctgttg

SEQ ID NO: 3212066 - DNA, 16 bp, Homo sapiens
cttcttttttttcatt

SEQ ID NO: 3212067 - DNA, 20 bp, Homo sapiens
cttgaaaagattctgaaacc

SEQ ID NO: 3212068 - DNA, 22 bp, Homo sapiens
cttgaaaataagaatagaaata

SEQ ID NO: 3212069 - DNA, 23 bp, Homo sapiens
cttgaaaatattttttatatata

SEQ ID NO: 3212070 - DNA, 20 bp, Homo sapiens
cttgaaaattttattaaaaa

SEQ ID NO: 3212071 - DNA, 23 bp, Homo sapiens
cttgaaacagattcaggccagcc

SEQ ID NO: 3212072 - DNA, 22 bp, Homo sapiens
cttgaaaccaattaagcagctt

SEQ ID NO: 3212073 - DNA, 17 bp, Homo sapiens
cttgaaagcatccatgt

SEQ ID NO: 3212074 - DNA, 13 bp, Homo sapiens
cttgaaagctgtg

SEQ ID NO: 3212075 - DNA, 15 bp, Homo sapiens
cttgaaattactgtg

SEQ ID NO: 3212076 - DNA, 22 bp, Homo sapiens
cttgaaattactgtgtaaatat

SEQ ID NO: 3212077 - DNA, 13 bp, Homo sapiens
cttgaaattttaa

SEQ ID NO: 3212078 - DNA, 15 bp, Homo sapiens
cttgaacccaggaga

SEQ ID NO: 3212079 - DNA, 16 bp, Homo sapiens
cttgaactgggtactt

SEQ ID NO: 3212080 - DNA, 18 bp, Homo sapiens
cttgaactgggtacttgt

SEQ ID NO: 3212081 - DNA, 23 bp, Homo sapiens
cttgaagaaacagagtggcctcc

SEQ ID NO: 3212082 - DNA, 22 bp, Homo sapiens
cttgaagaactgcaggccctgg

SEQ ID NO: 3212083 - DNA, 16 bp, Homo sapiens
cttgaagaaggaaaga

SEQ ID NO: 3212084 - DNA, 13 bp, Homo sapiens
cttgaagatcgtt

SEQ ID NO: 3212085 - DNA, 12 bp, Homo sapiens
cttgaagccaaa

SEQ ID NO: 3212086 - DNA, 13 bp, Homo sapiens
cttgaagccactg

SEQ ID NO: 3212087 - DNA, 16 bp, Homo sapiens
cttgaagccactgaag

SEQ ID NO: 3212088 - DNA, 14 bp, Homo sapiens
cttgaagggcccag

SEQ ID NO: 3212089 - DNA, 16 bp, Homo sapiens
cttgaagggcccagga

SEQ ID NO: 3212090 - DNA, 20 bp, Homo sapiens
cttgaagtctaaaagcagaa

SEQ ID NO: 3212091 - DNA, 16 bp, Homo sapiens
cttgaatgtagcagcc

SEQ ID NO: 3212092 - DNA, 13 bp, Homo sapiens
cttgaatgtcttt

SEQ ID NO: 3212093 - DNA, 22 bp, Homo sapiens
cttgaatgtggcttgagaaata

SEQ ID NO: 3212094 - DNA, 17 bp, Homo sapiens
cttgaatgtggtctcag

SEQ ID NO: 3212095 - DNA, 19 bp, Homo sapiens
cttgaatgtggtctcagga

SEQ ID NO: 3212096 - DNA, 21 bp, Homo sapiens
cttgaatgtggtctcaggata

SEQ ID NO: 3212097 - DNA, 12 bp, Homo sapiens
cttgaatttctg

SEQ ID NO: 3212098 - DNA, 23 bp, Homo sapiens
cttgacaagctgacttggcactt

SEQ ID NO: 3212099 - DNA, 22 bp, Homo sapiens
cttgacaagttgcgacggagag

SEQ ID NO: 3212100 - DNA, 16 bp, Homo sapiens
cttgacacagtcagca

SEQ ID NO: 3212101 - DNA, 14 bp, Homo sapiens
cttgacaccaacca

SEQ ID NO: 3212102 - DNA, 20 bp, Homo sapiens
cttgacaccaaccagacagc

SEQ ID NO: 3212103 - DNA, 20 bp, Homo sapiens
cttgacagggcacaccgggc

SEQ ID NO: 3212104 - DNA, 20 bp, Homo sapiens
cttgacatttatcacctctg

SEQ ID NO: 3212105 - DNA, 17 bp, Homo sapiens
cttgaccaggcttggcc

SEQ ID NO: 3212106 - DNA, 20 bp, Homo sapiens
cttgacctgaggctgtggtc

SEQ ID NO: 3212107 - DNA, 13 bp, Homo sapiens
cttgaccttcctc

SEQ ID NO: 3212108 - DNA, 18 bp, Homo sapiens
cttgaccttcctctgggg

SEQ ID NO: 3212109 - DNA, 18 bp, Homo sapiens
cttgaccttttcgacgct

SEQ ID NO: 3212110 - DNA, 19 bp, Homo sapiens
cttgactgggtgagaccca

SEQ ID NO: 3212111 - DNA, 11 bp, Homo sapiens
cttgagaaacc

SEQ ID NO: 3212112 - DNA, 13 bp, Homo sapiens
cttgagaaacctt

SEQ ID NO: 3212113 - DNA, 20 bp, Homo sapiens
cttgagaaccagtctcctca

SEQ ID NO: 3212114 - DNA, 11 bp, Homo sapiens
cttgagaactt

SEQ ID NO: 3212115 - DNA, 22 bp, Homo sapiens
cttgagacacggagcccagccc

SEQ ID NO: 3212116 - DNA, 11 bp, Homo sapiens
cttgagactgg

SEQ ID NO: 3212117 - DNA, 21 bp, Homo sapiens
cttgagagaaaaagtgcccct

SEQ ID NO: 3212118 - DNA, 20 bp, Homo sapiens
cttgagagtagatggtttga

SEQ ID NO: 3212119 - DNA, 15 bp, Homo sapiens
cttgagatgtcttct

SEQ ID NO: 3212120 - DNA, 18 bp, Homo sapiens
cttgagccagtaatcttt

SEQ ID NO: 3212121 - DNA, 14 bp, Homo sapiens
cttgagcccaggag

SEQ ID NO: 3212122 - DNA, 13 bp, Homo sapiens
cttgagcctcccc

SEQ ID NO: 3212123 - DNA, 15 bp, Homo sapiens
cttgagcctccccca

SEQ ID NO: 3212124 - DNA, 13 bp, Homo sapiens
cttgagctggcct

SEQ ID NO: 3212125 - DNA, 21 bp, Homo sapiens
cttgagcttggcagctgaact

SEQ ID NO: 3212126 - DNA, 21 bp, Homo sapiens
cttgaggaataaatgccttta

SEQ ID NO: 3212127 - DNA, 22 bp, Homo sapiens
cttgaggagtgtgagaatcaaa

SEQ ID NO: 3212128 - DNA, 19 bp, Homo sapiens
cttgagggcccagagcagg

SEQ ID NO: 3212129 - DNA, 22 bp, Homo sapiens
cttgaggtcttttgacatgtgg

SEQ ID NO: 3212130 - DNA, 17 bp, Homo sapiens
cttgagtcagaaaacag

SEQ ID NO: 3212131 - DNA, 19 bp, Homo sapiens
cttgagtcagaaaacagag

SEQ ID NO: 3212132 - DNA, 22 bp, Homo sapiens
cttgagtgcttgttagagagaa

SEQ ID NO: 3212133 - DNA, 21 bp, Homo sapiens
cttgagtggggttatctctgt

SEQ ID NO: 3212134 - DNA, 21 bp, Homo sapiens
cttgagtgttcctttttaaat

SEQ ID NO: 3212135 - DNA, 23 bp, Homo sapiens
cttgagtgttcctttttaaatgt

SEQ ID NO: 3212136 - DNA, 18 bp, Homo sapiens
cttgagttcaccatctct

SEQ ID NO: 3212137 - DNA, 21 bp, Homo sapiens
cttgagttcaccatctcttca

SEQ ID NO: 3212138 - DNA, 17 bp, Homo sapiens
cttgagttcccagatgg

SEQ ID NO: 3212139 - DNA, 12 bp, Homo sapiens
cttgagtttgtc

SEQ ID NO: 3212140 - DNA, 13 bp, Homo sapiens
cttgataaatata

SEQ ID NO: 3212141 - DNA, 17 bp, Homo sapiens
cttgataatattagtga

SEQ ID NO: 3212142 - DNA, 18 bp, Homo sapiens
cttgataatattagtgat

SEQ ID NO: 3212143 - DNA, 18 bp, Homo sapiens
cttgatacccccctctgt

SEQ ID NO: 3212144 - DNA, 20 bp, Homo sapiens
cttgatacccccctctgtct

SEQ ID NO: 3212145 - DNA, 22 bp, Homo sapiens
cttgatacgatagttacataat

SEQ ID NO: 3212146 - DNA, 14 bp, Homo sapiens
cttgatactgaatg

SEQ ID NO: 3212147 - DNA, 15 bp, Homo sapiens
cttgatcttaaagat

SEQ ID NO: 3212148 - DNA, 13 bp, Homo sapiens
cttgatgaagcaa

SEQ ID NO: 3212149 - DNA, 14 bp, Homo sapiens
cttgatgaagcaag

SEQ ID NO: 3212150 - DNA, 16 bp, Homo sapiens
cttgatgactgctgat

SEQ ID NO: 3212151 - DNA, 22 bp, Homo sapiens
cttgatgtgaagataatttgca

SEQ ID NO: 3212152 - DNA, 23 bp, Homo sapiens
cttgatgtgaagataatttgcat

SEQ ID NO: 3212153 - DNA, 18 bp, Homo sapiens
cttgatgtgttatctctt

SEQ ID NO: 3212154 - DNA, 23 bp, Homo sapiens
cttgatgttgcttagtcacttat

SEQ ID NO: 3212155 - DNA, 15 bp, Homo sapiens
cttgattaaatcaac

SEQ ID NO: 3212156 - DNA, 21 bp, Homo sapiens
cttgattaagattttacaaaa

SEQ ID NO: 3212157 - DNA, 13 bp, Homo sapiens
cttgattctgcag

SEQ ID NO: 3212158 - DNA, 20 bp, Homo sapiens
cttgattctgcagtaaatct

SEQ ID NO: 3212159 - DNA, 19 bp, Homo sapiens
cttgatttgatgtgacttt

SEQ ID NO: 3212160 - DNA, 14 bp, Homo sapiens
cttgcaatggcagc

SEQ ID NO: 3212161 - DNA, 19 bp, Homo sapiens
cttgcaattagcattctgt

SEQ ID NO: 3212162 - DNA, 18 bp, Homo sapiens
cttgcacccgcctctccc

SEQ ID NO: 3212163 - DNA, 15 bp, Homo sapiens
cttgcactccttccc

SEQ ID NO: 3212164 - DNA, 14 bp, Homo sapiens
cttgcagaactgta

SEQ ID NO: 3212165 - DNA, 21 bp, Homo sapiens
cttgcagactctacagaggcc

SEQ ID NO: 3212166 - DNA, 19 bp, Homo sapiens
cttgcaggggtcccccctc

SEQ ID NO: 3212167 - DNA, 18 bp, Homo sapiens
cttgcaggggtccctgct

SEQ ID NO: 3212168 - DNA, 12 bp, Homo sapiens
cttgcagtacat

SEQ ID NO: 3212169 - DNA, 21 bp, Homo sapiens
cttgcataataagctaaagag

SEQ ID NO: 3212170 - DNA, 15 bp, Homo sapiens
cttgcatccaactcc

SEQ ID NO: 3212171 - DNA, 18 bp, Homo sapiens
cttgcatccattgttgtg

SEQ ID NO: 3212172 - DNA, 16 bp, Homo sapiens
cttgcatccttcctat

SEQ ID NO: 3212173 - DNA, 18 bp, Homo sapiens
cttgcattgaatatatta

SEQ ID NO: 3212174 - DNA, 23 bp, Homo sapiens
cttgccaatgaggtctgaaatgg

SEQ ID NO: 3212175 - DNA, 16 bp, Homo sapiens
cttgccacatttctga

SEQ ID NO: 3212176 - DNA, 14 bp, Homo sapiens
cttgccactgcctc

SEQ ID NO: 3212177 - DNA, 16 bp, Homo sapiens
cttgccaggctccctt

SEQ ID NO: 3212178 - DNA, 19 bp, Homo sapiens
cttgcccagactacagggc

SEQ ID NO: 3212179 - DNA, 20 bp, Homo sapiens
cttgccccacagttgtgttc

SEQ ID NO: 3212180 - DNA, 14 bp, Homo sapiens
cttgcccccatccc

SEQ ID NO: 3212181 - DNA, 16 bp, Homo sapiens
cttgcccccatccctc

SEQ ID NO: 3212182 - DNA, 18 bp, Homo sapiens
cttgcccccatccctcgg

SEQ ID NO: 3212183 - DNA, 22 bp, Homo sapiens
cttgcccccatccctcggaccc

SEQ ID NO: 3212184 - DNA, 18 bp, Homo sapiens
cttgccccggccccggcc

SEQ ID NO: 3212185 - DNA, 15 bp, Homo sapiens
cttgccctagatgag

SEQ ID NO: 3212186 - DNA, 15 bp, Homo sapiens
cttgccctgacctcc

SEQ ID NO: 3212187 - DNA, 23 bp, Homo sapiens
cttgccctgccgccgcctcccgg

SEQ ID NO: 3212188 - DNA, 15 bp, Homo sapiens
cttgcccttccctgt

SEQ ID NO: 3212189 - DNA, 15 bp, Homo sapiens
cttgccgaggagcca

SEQ ID NO: 3212190 - DNA, 18 bp, Homo sapiens
cttgcctaggccaaatgc

SEQ ID NO: 3212191 - DNA, 18 bp, Homo sapiens
cttgttattgtgaatgat

SEQ ID NO: 3212192 - DNA, 19 bp, Homo sapiens
cttgttcaggaaaaggttg

SEQ ID NO: 3212193 - DNA, 19 bp, Homo sapiens
cttgttctatttttcaatc

SEQ ID NO: 3212194 - DNA, 20 bp, Homo sapiens
cttgttctatttttcaatca

SEQ ID NO: 3212195 - DNA, 21 bp, Homo sapiens
cttgttctgtgatgaggggag

SEQ ID NO: 3212196 - DNA, 18 bp, Homo sapiens
cttgttgggattcctgac

SEQ ID NO: 3212197 - DNA, 15 bp, Homo sapiens
cttgttgtgacacat

SEQ ID NO: 3212198 - DNA, 22 bp, Homo sapiens
cttgtttacctttctctctcta

SEQ ID NO: 3212199 - DNA, 14 bp, Homo sapiens
cttgtttcttttca

SEQ ID NO: 3212200 - DNA, 13 bp, Homo sapiens
cttgtttgatttc

SEQ ID NO: 3212201 - DNA, 16 bp, Homo sapiens
cttgtttgatttcaac

SEQ ID NO: 3212202 - DNA, 18 bp, Homo sapiens
cttgtttgatttcaacat

SEQ ID NO: 3212203 - DNA, 13 bp, Homo sapiens
cttgttttataaa

SEQ ID NO: 3212204 - DNA, 22 bp, Homo sapiens
cttgttttctttctttaaatgt

SEQ ID NO: 3212205 - DNA, 23 bp, Homo sapiens
cttgttttctttctttaaatgtt

SEQ ID NO: 3212206 - DNA, 18 bp, Homo sapiens
cttgttttgtttgtctct

SEQ ID NO: 3212207 - DNA, 23 bp, Homo sapiens
cttgttttttgtttgtttgttgc

SEQ ID NO: 3212208 - DNA, 19 bp, Homo sapiens
cttgttttttttttccact

SEQ ID NO: 3212209 - DNA, 18 bp, Homo sapiens
ctttaaaaaaatttaagt

SEQ ID NO: 3212210 - DNA, 14 bp, Homo sapiens
ctttaaaaaggaaa

SEQ ID NO: 3212211 - DNA, 19 bp, Homo sapiens
ctttaaaactcgaaaataa

SEQ ID NO: 3212212 - DNA, 15 bp, Homo sapiens
ctttaaaagaaaata

SEQ ID NO: 3212213 - DNA, 12 bp, Homo sapiens
ctttaaaagaat

SEQ ID NO: 3212214 - DNA, 13 bp, Homo sapiens
ctttaaaagagag

SEQ ID NO: 3212215 - DNA, 12 bp, Homo sapiens
ctttaaaaggat

SEQ ID NO: 3212216 - DNA, 18 bp, Homo sapiens
ctttaaaaggattaatct

SEQ ID NO: 3212217 - DNA, 17 bp, Homo sapiens
ctttaaacagtatttca

SEQ ID NO: 3212218 - DNA, 22 bp, Homo sapiens
ctttaaacctgtttttttttca

SEQ ID NO: 3212219 - DNA, 23 bp, Homo sapiens
ctttaaacctgtttttttttcat

SEQ ID NO: 3212220 - DNA, 16 bp, Homo sapiens
ctttaaactcagggac

SEQ ID NO: 3212221 - DNA, 21 bp, Homo sapiens
ctttaaaggcatctacacaat

SEQ ID NO: 3212222 - DNA, 14 bp, Homo sapiens
ctttaaaggcccag

SEQ ID NO: 3212223 - DNA, 16 bp, Homo sapiens
ctttaaaggcccagcc

SEQ ID NO: 3212224 - DNA, 15 bp, Homo sapiens
ctttaaatctgtgat

SEQ ID NO: 3212225 - DNA, 22 bp, Homo sapiens
ctttaaatgttttataagttca

SEQ ID NO: 3212226 - DNA, 21 bp, Homo sapiens
ctttaactgccgtaatttaac

SEQ ID NO: 3212227 - DNA, 20 bp, Homo sapiens
ctttaagaaccttaatgaca

SEQ ID NO: 3212228 - DNA, 14 bp, Homo sapiens
ctttaagacatact

SEQ ID NO: 3212229 - DNA, 23 bp, Homo sapiens
ctttaagagactcactggtttta

SEQ ID NO: 3212230 - DNA, 15 bp, Homo sapiens
ctttaagagagaaat

SEQ ID NO: 3212231 - DNA, 15 bp, Homo sapiens
ctttaagcagagaag

SEQ ID NO: 3212232 - DNA, 14 bp, Homo sapiens
ctttaagcagctct

SEQ ID NO: 3212233 - DNA, 17 bp, Homo sapiens
ctttaagcagctcttgc

SEQ ID NO: 3212234 - DNA, 15 bp, Homo sapiens
ctttaagccaaagaa

SEQ ID NO: 3212235 - DNA, 16 bp, Homo sapiens
ctttaagccaaagaaa

SEQ ID NO: 3212236 - DNA, 18 bp, Homo sapiens
ctttaagccaaagaaaca

SEQ ID NO: 3212237 - DNA, 17 bp, Homo sapiens
ctttaaggagatggact

SEQ ID NO: 3212238 - DNA, 18 bp, Homo sapiens
ctttaataacaatatata

SEQ ID NO: 3212239 - DNA, 22 bp, Homo sapiens
ctttaatcttcagttttatctt

SEQ ID NO: 3212240 - DNA, 14 bp, Homo sapiens
ctttaatgcatcta

SEQ ID NO: 3212241 - DNA, 19 bp, Homo sapiens
ctttaatggacttatttct

SEQ ID NO: 3212242 - DNA, 22 bp, Homo sapiens
ctttaatggacttatttcttca

SEQ ID NO: 3212243 - DNA, 13 bp, Homo sapiens
ctttaatgttttt

SEQ ID NO: 3212244 - DNA, 23 bp, Homo sapiens
ctttaatgttttttgccacagct

SEQ ID NO: 3212245 - DNA, 14 bp, Homo sapiens
ctttaattatatat

SEQ ID NO: 3212246 - DNA, 18 bp, Homo sapiens
ctttaattctgtatctgt

SEQ ID NO: 3212247 - DNA, 16 bp, Homo sapiens
ctttaattgtataagt

SEQ ID NO: 3212248 - DNA, 21 bp, Homo sapiens
ctttaatttctgtcagaatgc

SEQ ID NO: 3212249 - DNA, 19 bp, Homo sapiens
ctttacaggaaaaaaaatt

SEQ ID NO: 3212250 - DNA, 21 bp, Homo sapiens
ctttacaggtatttataatat

SEQ ID NO: 3212251 - DNA, 20 bp, Homo sapiens
ctttacatgctgtgctcttt

SEQ ID NO: 3212252 - DNA, 17 bp, Homo sapiens
ctttacccacctagaac

SEQ ID NO: 3212253 - DNA, 19 bp, Homo sapiens
ctttacccacctagaacac

SEQ ID NO: 3212254 - DNA, 16 bp, Homo sapiens
ctttacctgagaccag

SEQ ID NO: 3212255 - DNA, 22 bp, Homo sapiens
ctttacctttttgtatgtgaac

SEQ ID NO: 3212256 - DNA, 15 bp, Homo sapiens
ctttactattaaaat

SEQ ID NO: 3212257 - DNA, 14 bp, Homo sapiens
ctttactccatcat

SEQ ID NO: 3212258 - DNA, 22 bp, Homo sapiens
ctttactcccaagacttcattg

SEQ ID NO: 3212259 - DNA, 12 bp, Homo sapiens
ctttactccctt

SEQ ID NO: 3212260 - DNA, 16 bp, Homo sapiens
ctttactcccttcctg

SEQ ID NO: 3212261 - DNA, 17 bp, Homo sapiens
ctttactctgtgtttaa

SEQ ID NO: 3212262 - DNA, 18 bp, Homo sapiens
ctttactctgtgtttaaa

SEQ ID NO: 3212263 - DNA, 23 bp, Homo sapiens
ctttactggacctgaaatttaaa

SEQ ID NO: 3212264 - DNA, 21 bp, Homo sapiens
ctttactgtaatataaagtat

SEQ ID NO: 3212265 - DNA, 23 bp, Homo sapiens
ctttacttgtggtgtgaccatgt

SEQ ID NO: 3212266 - DNA, 17 bp, Homo sapiens
ctttagaagtgcatttc

SEQ ID NO: 3212267 - DNA, 20 bp, Homo sapiens
ctttagaattctaattgtca

SEQ ID NO: 3212268 - DNA, 15 bp, Homo sapiens
ctttagagcagcttt

SEQ ID NO: 3212269 - DNA, 17 bp, Homo sapiens
ctttagagcattgccat

SEQ ID NO: 3212270 - DNA, 19 bp, Homo sapiens
ctttagagcattgccattc

SEQ ID NO: 3212271 - DNA, 13 bp, Homo sapiens
ctttagatgctga

SEQ ID NO: 3212272 - DNA, 14 bp, Homo sapiens
ctttagatgctgat

SEQ ID NO: 3212273 - DNA, 23 bp, Homo sapiens
ctttagcacgtttaaagttctgt

SEQ ID NO: 3212274 - DNA, 14 bp, Homo sapiens
ctttagcgcccagt

SEQ ID NO: 3212275 - DNA, 15 bp, Homo sapiens
ctttagcgcccagtt

SEQ ID NO: 3212276 - DNA, 18 bp, Homo sapiens
ctttaggcagcagctttt

SEQ ID NO: 3212277 - DNA, 14 bp, Homo sapiens
ctttagggcagctt

SEQ ID NO: 3212278 - DNA, 20 bp, Homo sapiens
ctttaggtttttttaatgat

SEQ ID NO: 3212279 - DNA, 22 bp, Homo sapiens
ctttaggtttttttaatgatat

SEQ ID NO: 3212280 - DNA, 17 bp, Homo sapiens
ctttagtacctgaaaag

SEQ ID NO: 3212281 - DNA, 19 bp, Homo sapiens
ctttagtacctgaaaagta

SEQ ID NO: 3212282 - DNA, 17 bp, Homo sapiens
ctttagtatcagtgttt

SEQ ID NO: 3212283 - DNA, 22 bp, Homo sapiens
ctttagtatgacgctgatacat

SEQ ID NO: 3212284 - DNA, 18 bp, Homo sapiens
ctttagtgccctgccccc

SEQ ID NO: 3212285 - DNA, 21 bp, Homo sapiens
ctttagtgccctgccccctgg

SEQ ID NO: 3212286 - DNA, 12 bp, Homo sapiens
ctttataaactt

SEQ ID NO: 3212287 - DNA, 13 bp, Homo sapiens
ctttataaatgta

SEQ ID NO: 3212288 - DNA, 19 bp, Homo sapiens
ctttataattctactttga

SEQ ID NO: 3212289 - DNA, 15 bp, Homo sapiens
ctttatacagatttt

SEQ ID NO: 3212290 - DNA, 20 bp, Homo sapiens
ctttatagaaggaatttgta

SEQ ID NO: 3212291 - DNA, 23 bp, Homo sapiens
ctttatagaaggaatttgtactt

SEQ ID NO: 3212292 - DNA, 20 bp, Homo sapiens
ctttatagctgcaagtgtat

SEQ ID NO: 3212293 - DNA, 18 bp, Homo sapiens
ctttatatctgtaatgat

SEQ ID NO: 3212294 - DNA, 22 bp, Homo sapiens
ctttatatgaagaaaatcactt

SEQ ID NO: 3212295 - DNA, 21 bp, Homo sapiens
ctttatatttcacaggctgta

SEQ ID NO: 3212296 - DNA, 21 bp, Homo sapiens
ctttatcaaaaaaagactcag

SEQ ID NO: 3212297 - DNA, 14 bp, Homo sapiens
ctttatcaatgtgt

SEQ ID NO: 3212298 - DNA, 22 bp, Homo sapiens
ctttatcactttttgaactaag

SEQ ID NO: 3212299 - DNA, 21 bp, Homo sapiens
ctttatctaatacctctgtgt

SEQ ID NO: 3212300 - DNA, 22 bp, Homo sapiens
ctttatctaatacctctgtgtg

SEQ ID NO: 3212301 - DNA, 18 bp, Homo sapiens
ctttatctttcacctttc

SEQ ID NO: 3212302 - DNA, 13 bp, Homo sapiens
ctttatcttttca

SEQ ID NO: 3212303 - DNA, 20 bp, Homo sapiens
ctttatgataatagattctc

SEQ ID NO: 3212304 - DNA, 19 bp, Homo sapiens
ctttatgctgtattttaac

SEQ ID NO: 3212305 - DNA, 13 bp, Homo sapiens
ctttatggtttct

SEQ ID NO: 3212306 - DNA, 19 bp, Homo sapiens
ctttatgtagtttttatat

SEQ ID NO: 3212307 - DNA, 18 bp, Homo sapiens
ctttatgtggaaaacaga

SEQ ID NO: 3212308 - DNA, 16 bp, Homo sapiens
ctttggaaatcctcta

SEQ ID NO: 3212309 - DNA, 23 bp, Homo sapiens
ctttggaatgactataaacatta

SEQ ID NO: 3212310 - DNA, 20 bp, Homo sapiens
ctttggacctaaatggcctc

SEQ ID NO: 3212311 - DNA, 21 bp, Homo sapiens
ctttggacctaaatggcctca

SEQ ID NO: 3212312 - DNA, 18 bp, Homo sapiens
ctttggagatgctgaggg

SEQ ID NO: 3212313 - DNA, 18 bp, Homo sapiens
ctttggagtcccctcacc

SEQ ID NO: 3212314 - DNA, 17 bp, Homo sapiens
ctttggagttaaaatgc

SEQ ID NO: 3212315 - DNA, 20 bp, Homo sapiens
ctttggattctaaatacatg

SEQ ID NO: 3212316 - DNA, 13 bp, Homo sapiens
ctttggatttgac

SEQ ID NO: 3212317 - DNA, 16 bp, Homo sapiens
ctttggatttgacatt

SEQ ID NO: 3212318 - DNA, 17 bp, Homo sapiens
ctttggatttgacattg

SEQ ID NO: 3212319 - DNA, 13 bp, Homo sapiens
ctttggctcccct

SEQ ID NO: 3212320 - DNA, 13 bp, Homo sapiens
ctttggctctgga

SEQ ID NO: 3212321 - DNA, 13 bp, Homo sapiens
ctttggctgaggg

SEQ ID NO: 3212322 - DNA, 20 bp, Homo sapiens
ctttggctgaggggcttggg

SEQ ID NO: 3212323 - DNA, 23 bp, Homo sapiens
ctttgggaaagcccagactttag

SEQ ID NO: 3212324 - DNA, 20 bp, Homo sapiens
ctttgggacttgggagctgg

SEQ ID NO: 3212325 - DNA, 19 bp, Homo sapiens
ctttgggaggccaaggcag

SEQ ID NO: 3212326 - DNA, 20 bp, Homo sapiens
ctttgggaggccgaggcggg

SEQ ID NO: 3212327 - DNA, 17 bp, Homo sapiens
ctttgggaggctgaggc

SEQ ID NO: 3212328 - DNA, 18 bp, Homo sapiens
ctttgggatatggtcttg

SEQ ID NO: 3212329 - DNA, 18 bp, Homo sapiens
ctttgggatcccaccctg

SEQ ID NO: 3212330 - DNA, 20 bp, Homo sapiens
ctttgggatcccaccctggg

SEQ ID NO: 3212331 - DNA, 21 bp, Homo sapiens
ctttgggatcccaccctgggg

SEQ ID NO: 3212332 - DNA, 19 bp, Homo sapiens
ctttgggatttaatttcca

SEQ ID NO: 3212333 - DNA, 22 bp, Homo sapiens
ctttgggccgaatcccccaggg

SEQ ID NO: 3212334 - DNA, 21 bp, Homo sapiens
ctttgggctgccctggtgctg

SEQ ID NO: 3212335 - DNA, 17 bp, Homo sapiens
ctttgggctttgcaggc

SEQ ID NO: 3212336 - DNA, 18 bp, Homo sapiens
ctttgggttccatcttgc

SEQ ID NO: 3212337 - DNA, 23 bp, Homo sapiens
ctttggtactgctgtcttccaag

SEQ ID NO: 3212338 - DNA, 14 bp, Homo sapiens
ctttggtccttcaa

SEQ ID NO: 3212339 - DNA, 16 bp, Homo sapiens
ctttggtgcctcactg

SEQ ID NO: 3212340 - DNA, 13 bp, Homo sapiens
ctttggtgccttt

SEQ ID NO: 3212341 - DNA, 16 bp, Homo sapiens
ctttggtgcctttcct

SEQ ID NO: 3212342 - DNA, 19 bp, Homo sapiens
ctttggtgcctttcctgtt

SEQ ID NO: 3212343 - DNA, 21 bp, Homo sapiens
ctttggtgcgggcacaataaa

SEQ ID NO: 3212344 - DNA, 14 bp, Homo sapiens
ctttggttaaaaat

SEQ ID NO: 3212345 - DNA, 20 bp, Homo sapiens
ctttggttaaaaatggctca

SEQ ID NO: 3212346 - DNA, 13 bp, Homo sapiens
ctttgtaaaaatc

SEQ ID NO: 3212347 - DNA, 12 bp, Homo sapiens
ctttgtaaatag

SEQ ID NO: 3212348 - DNA, 16 bp, Homo sapiens
ctttgtaagacatttg

SEQ ID NO: 3212349 - DNA, 17 bp, Homo sapiens
ctttgtaagacatttgt

SEQ ID NO: 3212350 - DNA, 21 bp, Homo sapiens
ctttgtaagacatttgtatat

SEQ ID NO: 3212351 - DNA, 21 bp, Homo sapiens
ctttgtaagagtgtagaagca

SEQ ID NO: 3212352 - DNA, 12 bp, Homo sapiens
ctttgtacttgt

SEQ ID NO: 3212353 - DNA, 15 bp, Homo sapiens
ctttgtaggacaaaa

SEQ ID NO: 3212354 - DNA, 23 bp, Homo sapiens
ctttgtataatcccacccacctc

SEQ ID NO: 3212355 - DNA, 13 bp, Homo sapiens
ctttgtattactt

SEQ ID NO: 3212356 - DNA, 23 bp, Homo sapiens
ctttgtcgtggttcttaaatgtt

SEQ ID NO: 3212357 - DNA, 14 bp, Homo sapiens
ctttgtctgccttc

SEQ ID NO: 3212358 - DNA, 18 bp, Homo sapiens
ctttgtcttgtacttctg

SEQ ID NO: 3212359 - DNA, 23 bp, Homo sapiens
ctttgtgacaggaaagccctccc

SEQ ID NO: 3212360 - DNA, 15 bp, Homo sapiens
ctttgtgataattta

SEQ ID NO: 3212361 - DNA, 16 bp, Homo sapiens
ctttgtgataatttaa

SEQ ID NO: 3212362 - DNA, 17 bp, Homo sapiens
ctttgtgataatttaag

SEQ ID NO: 3212363 - DNA, 23 bp, Homo sapiens
ctttgtgattcaatctgtaaact

SEQ ID NO: 3212364 - DNA, 13 bp, Homo sapiens
ctttgtgcattct

SEQ ID NO: 3212365 - DNA, 14 bp, Homo sapiens
ctttgtgcattctg

SEQ ID NO: 3212366 - DNA, 17 bp, Homo sapiens
ctttgtgcttggggcta

SEQ ID NO: 3212367 - DNA, 19 bp, Homo sapiens
ctttgtggaccaattattg

SEQ ID NO: 3212368 - DNA, 13 bp, Homo sapiens
ctttgtggccttc

SEQ ID NO: 3212369 - DNA, 23 bp, Homo sapiens
ctttgtgggaaacagagtccaat

SEQ ID NO: 3212370 - DNA, 16 bp, Homo sapiens
ctttgtggggaagagg

SEQ ID NO: 3212371 - DNA, 19 bp, Homo sapiens
ctttgtggggaagaggggc

SEQ ID NO: 3212372 - DNA, 16 bp, Homo sapiens
ctttgtggttttatgg

SEQ ID NO: 3212373 - DNA, 23 bp, Homo sapiens
ctttgtgtttctattgacttcaa

SEQ ID NO: 3212374 - DNA, 14 bp, Homo sapiens
ctttgttataccat

SEQ ID NO: 3212375 - DNA, 22 bp, Homo sapiens
ctttgttatttttgtttcttcc

SEQ ID NO: 3212376 - DNA, 21 bp, Homo sapiens
ctttgttcccaaggacttcca

SEQ ID NO: 3212377 - DNA, 14 bp, Homo sapiens
ctttgttctcagct

SEQ ID NO: 3212378 - DNA, 20 bp, Homo sapiens
ctttgttgaagtttgaacca

SEQ ID NO: 3212379 - DNA, 16 bp, Homo sapiens
ctttgttgcccaggct

SEQ ID NO: 3212380 - DNA, 20 bp, Homo sapiens
ctttgttgctcagcaagggg

SEQ ID NO: 3212381 - DNA, 15 bp, Homo sapiens
ctttgttgtacgcag

SEQ ID NO: 3212382 - DNA, 22 bp, Homo sapiens
ctttgttgtttggattcctcac

SEQ ID NO: 3212383 - DNA, 19 bp, Homo sapiens
ctttgtttctttttacagc

SEQ ID NO: 3212384 - DNA, 17 bp, Homo sapiens
ctttgttttctgactaa

SEQ ID NO: 3212385 - DNA, 23 bp, Homo sapiens
ctttgttttgatgtttgtggcct

SEQ ID NO: 3212386 - DNA, 13 bp, Homo sapiens
cttttaaaatgca

SEQ ID NO: 3212387 - DNA, 19 bp, Homo sapiens
cttttaaaatgcaatgtaa

SEQ ID NO: 3212388 - DNA, 12 bp, Homo sapiens
cttttaaactgt

SEQ ID NO: 3212389 - DNA, 15 bp, Homo sapiens
cttttaaactgtgta

SEQ ID NO: 3212390 - DNA, 16 bp, Homo sapiens
cttttaaattagaaaa

SEQ ID NO: 3212391 - DNA, 19 bp, Homo sapiens
cttttaaattagaaaatat

SEQ ID NO: 3212392 - DNA, 13 bp, Homo sapiens
cttttaaattatg

SEQ ID NO: 3212393 - DNA, 10 bp, Homo sapiens
cttttaacat

SEQ ID NO: 3212394 - DNA, 12 bp, Homo sapiens
cttttaacattt

SEQ ID NO: 3212395 - DNA, 16 bp, Homo sapiens
cttttaaccaaacaat

SEQ ID NO: 3212396 - DNA, 15 bp, Homo sapiens
cttttaagacatttt

SEQ ID NO: 3212397 - DNA, 19 bp, Homo sapiens
cttttaatataaaagatat

SEQ ID NO: 3212398 - DNA, 14 bp, Homo sapiens
cttttaatcagaca

SEQ ID NO: 3212399 - DNA, 16 bp, Homo sapiens
cttttaattactgttt

SEQ ID NO: 3212400 - DNA, 13 bp, Homo sapiens
cttttaattcatt

SEQ ID NO: 3212401 - DNA, 19 bp, Homo sapiens
cttttaccactatttaagt

SEQ ID NO: 3212402 - DNA, 16 bp, Homo sapiens
cttttaccattagcat

SEQ ID NO: 3212403 - DNA, 20 bp, Homo sapiens
cttttaccttttttttttct

SEQ ID NO: 3212404 - DNA, 21 bp, Homo sapiens
cttttaccttttttttttctt

SEQ ID NO: 3212405 - DNA, 22 bp, Homo sapiens
cttttacgtagtaaaagtcata

SEQ ID NO: 3212406 - DNA, 14 bp, Homo sapiens
cttttactctgcct

SEQ ID NO: 3212407 - DNA, 18 bp, Homo sapiens
cttttacttttttatagc

SEQ ID NO: 3212408 - DNA, 23 bp, Homo sapiens
cttttagaaaagggagtttaaaa

SEQ ID NO: 3212409 - DNA, 23 bp, Homo sapiens
cttttagaaacctcattggccag

SEQ ID NO: 3212410 - DNA, 21 bp, Homo sapiens
cttttagaaatactgcaagaa

SEQ ID NO: 3212411 - DNA, 13 bp, Homo sapiens
cttttagacaact

SEQ ID NO: 3212412 - DNA, 17 bp, Homo sapiens
cttttagacaactagat

SEQ ID NO: 3212413 - DNA, 19 bp, Homo sapiens
cttttagacaactagattt

SEQ ID NO: 3212414 - DNA, 21 bp, Homo sapiens
cttttagacaactagatttgt

SEQ ID NO: 3212415 - DNA, 20 bp, Homo sapiens
cttttaggagaaagtgtatt

SEQ ID NO: 3212416 - DNA, 20 bp, Homo sapiens
cttttaggagaattcacaga

SEQ ID NO: 3212417 - DNA, 21 bp, Homo sapiens
cttttagttttagttgcagaa

SEQ ID NO: 3212418 - DNA, 15 bp, Homo sapiens
cttttagtttttccc

SEQ ID NO: 3212419 - DNA, 19 bp, Homo sapiens
cttttatagagcatatttg

SEQ ID NO: 3212420 - DNA, 18 bp, Homo sapiens
cttttatagctattactg

SEQ ID NO: 3212421 - DNA, 22 bp, Homo sapiens
cttttataggtgagaaaaaaac

SEQ ID NO: 3212422 - DNA, 21 bp, Homo sapiens
cttttatatggcccagccttg

SEQ ID NO: 3212423 - DNA, 13 bp, Homo sapiens
cttttatctattt

SEQ ID NO: 3212424 - DNA, 15 bp, Homo sapiens
cttttatctgcagaa

SEQ ID NO: 3212425 - DNA, 17 bp, Homo sapiens
cttttatctggtgcctc

SEQ ID NO: 3212426 - DNA, 19 bp, Homo sapiens
cttttatctggtgcctcct

SEQ ID NO: 3212427 - DNA, 16 bp, Homo sapiens
cttttatgagcagaag

SEQ ID NO: 3212428 - DNA, 17 bp, Homo sapiens
cttttatgatgtatatt

SEQ ID NO: 3212429 - DNA, 18 bp, Homo sapiens
cttttatgatgtatattt

SEQ ID NO: 3212430 - DNA, 18 bp, Homo sapiens
cttttatgtagtaattga

SEQ ID NO: 3212431 - DNA, 22 bp, Homo sapiens
cttttatgtagtaattgacatg

SEQ ID NO: 3212432 - DNA, 23 bp, Homo sapiens
cttttatgtagtaattgacatgt

SEQ ID NO: 3212433 - DNA, 18 bp, Homo sapiens
ctttttgaaatgaaattt

SEQ ID NO: 3212434 - DNA, 23 bp, Homo sapiens
ctttttgaaatgaaatttaaaca

SEQ ID NO: 3212435 - DNA, 11 bp, Homo sapiens
ctttttgaatg

SEQ ID NO: 3212436 - DNA, 19 bp, Homo sapiens
ctttttgaatgttatttgt

SEQ ID NO: 3212437 - DNA, 20 bp, Homo sapiens
ctttttgcatgatatcttca

SEQ ID NO: 3212438 - DNA, 15 bp, Homo sapiens
ctttttggaggtgct

SEQ ID NO: 3212439 - DNA, 21 bp, Homo sapiens
ctttttggctgacttcatctg

SEQ ID NO: 3212440 - DNA, 23 bp, Homo sapiens
ctttttggtcgaggagtaacaat

SEQ ID NO: 3212441 - DNA, 12 bp, Homo sapiens
ctttttgtaaat

SEQ ID NO: 3212442 - DNA, 18 bp, Homo sapiens
ctttttgtacttggaagt

SEQ ID NO: 3212443 - DNA, 13 bp, Homo sapiens
ctttttgtataaa

SEQ ID NO: 3212444 - DNA, 17 bp, Homo sapiens
ctttttgtatgtgaaca

SEQ ID NO: 3212445 - DNA, 13 bp, Homo sapiens
cttttttaaatga

SEQ ID NO: 3212446 - DNA, 14 bp, Homo sapiens
cttttttaaattaa

SEQ ID NO: 3212447 - DNA, 19 bp, Homo sapiens
cttttttacacacctacta

SEQ ID NO: 3212448 - DNA, 19 bp, Homo sapiens
cttttttactcattgaaat

SEQ ID NO: 3212449 - DNA, 21 bp, Homo sapiens
cttttttactcattgaaatgt

SEQ ID NO: 3212450 - DNA, 23 bp, Homo sapiens
cttttttactcattgaaatgtca

SEQ ID NO: 3212451 - DNA, 15 bp, Homo sapiens
cttttttatgaagaa

SEQ ID NO: 3212452 - DNA, 23 bp, Homo sapiens
cttttttatgtgccgtgttattg

SEQ ID NO: 3212453 - DNA, 15 bp, Homo sapiens
cttttttattaccag

SEQ ID NO: 3212454 - DNA, 16 bp, Homo sapiens
cttttttcaatatgca

SEQ ID NO: 3212455 - DNA, 17 bp, Homo sapiens
cttttttcaatatgcaa

SEQ ID NO: 3212456 - DNA, 15 bp, Homo sapiens
cttttttcttgagta

SEQ ID NO: 3212457 - DNA, 12 bp, Homo sapiens
cttttttgtgta

SEQ ID NO: 3212458 - DNA, 14 bp, Homo sapiens
cttttttgtgtatg

SEQ ID NO: 3212459 - DNA, 17 bp, Homo sapiens
cttttttgtgtatgtac

SEQ ID NO: 3212460 - DNA, 15 bp, Homo sapiens
ctttttttaaataga

SEQ ID NO: 3212461 - DNA, 11 bp, Homo sapiens
ctttttttccc

SEQ ID NO: 3212462 - DNA, 20 bp, Homo sapiens
ctttttttctgtaccagtta

SEQ ID NO: 3212463 - DNA, 15 bp, Homo sapiens
ctttttttcttgcta

SEQ ID NO: 3212464 - DNA, 16 bp, Homo sapiens
ctttttttcttgctag

SEQ ID NO: 3212465 - DNA, 21 bp, Homo sapiens
ctttttttggtgattcaaatg

SEQ ID NO: 3212466 - DNA, 15 bp, Homo sapiens
cttttttttatgaaa

SEQ ID NO: 3212467 - DNA, 14 bp, Homo sapiens
cttttttttcttta

SEQ ID NO: 3212468 - DNA, 15 bp, Homo sapiens
cttttttttctttaa

SEQ ID NO: 3212469 - DNA, 18 bp, Homo sapiens
ctttttttttctctttct

SEQ ID NO: 3212470 - DNA, 15 bp, Homo sapiens
ctttttttttgaaac

SEQ ID NO: 3212471 - DNA, 20 bp, Homo sapiens
ctttttttttgaaacagcag

SEQ ID NO: 3212472 - DNA, 18 bp, Homo sapiens
ctttttttttttgtttga

SEQ ID NO: 3212473 - DNA, 17 bp, Homo sapiens
ctttttttttttttccc

SEQ ID NO: 3212474 - DNA, 18 bp, Homo sapiens
ctttttttttttttttga

SEQ ID NO: 3212475 - DNA, 20 bp, Homo sapiens
ctttttttttttttttgaaa

SEQ ID NO: 3212476 - DNA, 21 bp, Homo sapiens
ctttttttttttttttgaaag

SEQ ID NO: 3212477 - DNA, 19 bp, Homo sapiens
gaaaaaaaaaaagaagaag

SEQ ID NO: 3212478 - DNA, 20 bp, Homo sapiens
gaaaaaaaaaatgttgagaa

SEQ ID NO: 3212479 - DNA, 19 bp, Homo sapiens
gaaaaaaaaccttgtaaaa

SEQ ID NO: 3212480 - DNA, 20 bp, Homo sapiens
gaaaaaaaataacacagaga

SEQ ID NO: 3212481 - DNA, 16 bp, Homo sapiens
gaaaaaaactgggata

SEQ ID NO: 3212482 - DNA, 19 bp, Homo sapiens
gaaaaaaactgggataact

SEQ ID NO: 3212483 - DNA, 22 bp, Homo sapiens
gaaaaaaactgggataactgat

SEQ ID NO: 3212484 - DNA, 22 bp, Homo sapiens
gaaaaaaatcttctccagattt

SEQ ID NO: 3212485 - DNA, 20 bp, Homo sapiens
gaaaaaaatgtacatttatt

SEQ ID NO: 3212486 - DNA, 20 bp, Homo sapiens
gaaaaaaccgttcaaattct

SEQ ID NO: 3212487 - DNA, 19 bp, Homo sapiens
gaaaaaagaaaatggctaa

SEQ ID NO: 3212488 - DNA, 11 bp, Homo sapiens
gaaaaaagcac

SEQ ID NO: 3212489 - DNA, 20 bp, Homo sapiens
gaaaaaagcacatacattaa

SEQ ID NO: 3212490 - DNA, 14 bp, Homo sapiens
gaaaaaatcagaac

SEQ ID NO: 3212491 - DNA, 20 bp, Homo sapiens
gaaaaacaacaacacaataa

SEQ ID NO: 3212492 - DNA, 15 bp, Homo sapiens
gaaaaacaatcttat

SEQ ID NO: 3212493 - DNA, 15 bp, Homo sapiens
gaaaaaccaatgatt

SEQ ID NO: 3212494 - DNA, 18 bp, Homo sapiens
gaaaaaccaatgattcat

SEQ ID NO: 3212495 - DNA, 18 bp, Homo sapiens
gaaaaactgctgtaaaca

SEQ ID NO: 3212496 - DNA, 14 bp, Homo sapiens
gaaaaagaaacaca

SEQ ID NO: 3212497 - DNA, 20 bp, Homo sapiens
gaaaaagcatgatgggaaaa

SEQ ID NO: 3212498 - DNA, 19 bp, Homo sapiens
gaaaaagttaaacattgaa

SEQ ID NO: 3212499 - DNA, 13 bp, Homo sapiens
gaaaaataaaaga

SEQ ID NO: 3212500 - DNA, 21 bp, Homo sapiens
gaaaaatatgttgagtgttca

SEQ ID NO: 3212501 - DNA, 20 bp, Homo sapiens
gaaaaatgggagacagcctc

SEQ ID NO: 3212502 - DNA, 23 bp, Homo sapiens
gaaaaatggttgatggaaaataa

SEQ ID NO: 3212503 - DNA, 18 bp, Homo sapiens
gaaaaatgtgaaaaaaat

SEQ ID NO: 3212504 - DNA, 15 bp, Homo sapiens
gaaaaatgttcttta

SEQ ID NO: 3212505 - DNA, 20 bp, Homo sapiens
gaaaaattcagcaaaccatt

SEQ ID NO: 3212506 - DNA, 18 bp, Homo sapiens
gaaaaatttaagcattgt

SEQ ID NO: 3212507 - DNA, 19 bp, Homo sapiens
gaaaacaaaattttatttt

SEQ ID NO: 3212508 - DNA, 21 bp, Homo sapiens
gaaaacaacttggcatttcta

SEQ ID NO: 3212509 - DNA, 17 bp, Homo sapiens
gaaaacaagttccaaat

SEQ ID NO: 3212510 - DNA, 15 bp, Homo sapiens
gaaaacacactcaaa

SEQ ID NO: 3212511 - DNA, 18 bp, Homo sapiens
gaaaacagagcctgccta

SEQ ID NO: 3212512 - DNA, 16 bp, Homo sapiens
gaaaacagatgaccat

SEQ ID NO: 3212513 - DNA, 14 bp, Homo sapiens
gaaaacatgttaat

SEQ ID NO: 3212514 - DNA, 21 bp, Homo sapiens
gaaaaccaagccgtggcttcc

SEQ ID NO: 3212515 - DNA, 16 bp, Homo sapiens
gaaaaccatctggcct

SEQ ID NO: 3212516 - DNA, 21 bp, Homo sapiens
gaaaacctaagtcctttatgt

SEQ ID NO: 3212517 - DNA, 13 bp, Homo sapiens
gaaaacggagctg

SEQ ID NO: 3212518 - DNA, 16 bp, Homo sapiens
gaaaacgttttattgt

SEQ ID NO: 3212519 - DNA, 18 bp, Homo sapiens
gaaaacgttttattgtgt

SEQ ID NO: 3212520 - DNA, 20 bp, Homo sapiens
gaaaactgaaaatctaatat

SEQ ID NO: 3212521 - DNA, 13 bp, Homo sapiens
gaaaactgtgttg

SEQ ID NO: 3212522 - DNA, 23 bp, Homo sapiens
gaaaactgttacctaaagtattt

SEQ ID NO: 3212523 - DNA, 14 bp, Homo sapiens
gaaaacttagccag

SEQ ID NO: 3212524 - DNA, 16 bp, Homo sapiens
gaaaagaacaaacaaa

SEQ ID NO: 3212525 - DNA, 16 bp, Homo sapiens
gaaaagaatacagaaa

SEQ ID NO: 3212526 - DNA, 18 bp, Homo sapiens
gaaaagaatacagaaaga

SEQ ID NO: 3212527 - DNA, 22 bp, Homo sapiens
gaaaagataaagaccagaaatt

SEQ ID NO: 3212528 - DNA, 19 bp, Homo sapiens
gaaaagatacgactttatt

SEQ ID NO: 3212529 - DNA, 20 bp, Homo sapiens
gaaaagatacgactttattt

SEQ ID NO: 3212530 - DNA, 12 bp, Homo sapiens
gaaaagcacttt

SEQ ID NO: 3212531 - DNA, 21 bp, Homo sapiens
gaaaagcacttttgttattcc

SEQ ID NO: 3212532 - DNA, 20 bp, Homo sapiens
gaaaagcgtctttaagagac

SEQ ID NO: 3212533 - DNA, 20 bp, Homo sapiens
gaaaagctattagccaggat

SEQ ID NO: 3212534 - DNA, 22 bp, Homo sapiens
gaaaagctattagccaggatca

SEQ ID NO: 3212535 - DNA, 18 bp, Homo sapiens
gaaaagctgcatttaaat

SEQ ID NO: 3212536 - DNA, 22 bp, Homo sapiens
gaaaagctgccatttcccttct

SEQ ID NO: 3212537 - DNA, 13 bp, Homo sapiens
gaaaagctgctga

SEQ ID NO: 3212538 - DNA, 20 bp, Homo sapiens
gaaaaggaagactagaggct

SEQ ID NO: 3212539 - DNA, 19 bp, Homo sapiens
gaaaagggaagttgtgcct

SEQ ID NO: 3212540 - DNA, 17 bp, Homo sapiens
gaaaagggagaaaaaga

SEQ ID NO: 3212541 - DNA, 23 bp, Homo sapiens
gaaaaggttcttcatccctttcc

SEQ ID NO: 3212542 - DNA, 19 bp, Homo sapiens
gaaaaggttgaataatata

SEQ ID NO: 3212543 - DNA, 23 bp, Homo sapiens
gaaaagtagacaatcattgtttt

SEQ ID NO: 3212544 - DNA, 20 bp, Homo sapiens
gaaaagtatattgataacct

SEQ ID NO: 3212545 - DNA, 17 bp, Homo sapiens
gaaaagttaaactaaaa

SEQ ID NO: 3212546 - DNA, 19 bp, Homo sapiens
gaaaagttaaactaaaaaa

SEQ ID NO: 3212547 - DNA, 20 bp, Homo sapiens
gaaaagttaaactaaaaaaa

SEQ ID NO: 3212548 - DNA, 14 bp, Homo sapiens
gaaaagttatttat

SEQ ID NO: 3212549 - DNA, 20 bp, Homo sapiens
gaaaagttgcagatgtattg

SEQ ID NO: 3212550 - DNA, 20 bp, Homo sapiens
gaaaataaacatcagtttct

SEQ ID NO: 3212551 - DNA, 14 bp, Homo sapiens
gaaaataactgaac

SEQ ID NO: 3212552 - DNA, 13 bp, Homo sapiens
gaaactgatttct

SEQ ID NO: 3212553 - DNA, 14 bp, Homo sapiens
gaaacttaagatga

SEQ ID NO: 3212554 - DNA, 17 bp, Homo sapiens
gaaactttgggaaaaca

SEQ ID NO: 3212555 - DNA, 21 bp, Homo sapiens
gaaactttgggaaaacatgtt

SEQ ID NO: 3212556 - DNA, 16 bp, Homo sapiens
gaaagaaaagaccctg

SEQ ID NO: 3212557 - DNA, 19 bp, Homo sapiens
gaaagaacatggacttgta

SEQ ID NO: 3212558 - DNA, 20 bp, Homo sapiens
gaaagaacatggacttgtat

SEQ ID NO: 3212559 - DNA, 13 bp, Homo sapiens
gaaagaagcaaga

SEQ ID NO: 3212560 - DNA, 15 bp, Homo sapiens
gaaagaagcaagaca

SEQ ID NO: 3212561 - DNA, 19 bp, Homo sapiens
gaaagaagggggccctgct

SEQ ID NO: 3212562 - DNA, 23 bp, Homo sapiens
gaaagaagggggccctgctacct

SEQ ID NO: 3212563 - DNA, 13 bp, Homo sapiens
gaaagaatagaac

SEQ ID NO: 3212564 - DNA, 16 bp, Homo sapiens
gaaagaatatatttat

SEQ ID NO: 3212565 - DNA, 21 bp, Homo sapiens
gaaagacctacattccctctc

SEQ ID NO: 3212566 - DNA, 17 bp, Homo sapiens
gaaagactgtacaaagt

SEQ ID NO: 3212567 - DNA, 23 bp, Homo sapiens
gaaagagataccaagatgccatc

SEQ ID NO: 3212568 - DNA, 17 bp, Homo sapiens
gaaagagctgcctggat

SEQ ID NO: 3212569 - DNA, 20 bp, Homo sapiens
gaaagaggctgaggcctgga

SEQ ID NO: 3212570 - DNA, 16 bp, Homo sapiens
gaaagaggtctcccca

SEQ ID NO: 3212571 - DNA, 18 bp, Homo sapiens
gaaagaggtgaaaatgaa

SEQ ID NO: 3212572 - DNA, 14 bp, Homo sapiens
gaaagatggataaa

SEQ ID NO: 3212573 - DNA, 23 bp, Homo sapiens
gaaagatggctgtgcctctgcct

SEQ ID NO: 3212574 - DNA, 16 bp, Homo sapiens
gaaagcacaggagaca

SEQ ID NO: 3212575 - DNA, 17 bp, Homo sapiens
gaaagcatcacctcagg

SEQ ID NO: 3212576 - DNA, 18 bp, Homo sapiens
gaaagcatcacctcaggc

SEQ ID NO: 3212577 - DNA, 15 bp, Homo sapiens
gaaagcatccatgtg

SEQ ID NO: 3212578 - DNA, 21 bp, Homo sapiens
gaaagcatgtggcatgttcat

SEQ ID NO: 3212579 - DNA, 22 bp, Homo sapiens
gaaagcatgtggcatgttcatc

SEQ ID NO: 3212580 - DNA, 18 bp, Homo sapiens
gaaagccacctctccctc

SEQ ID NO: 3212581 - DNA, 19 bp, Homo sapiens
gaaagccacctctccctca

SEQ ID NO: 3212582 - DNA, 14 bp, Homo sapiens
gaaagccaggcagg

SEQ ID NO: 3212583 - DNA, 19 bp, Homo sapiens
gaaagccattgaccaccca

SEQ ID NO: 3212584 - DNA, 12 bp, Homo sapiens
gaaagcccagac

SEQ ID NO: 3212585 - DNA, 13 bp, Homo sapiens
gaaagcccagact

SEQ ID NO: 3212586 - DNA, 14 bp, Homo sapiens
gaaagcccagactt

SEQ ID NO: 3212587 - DNA, 21 bp, Homo sapiens
gaaagccctcccccttcccct

SEQ ID NO: 3212588 - DNA, 20 bp, Homo sapiens
gaaagcctgttcccctcact

SEQ ID NO: 3212589 - DNA, 24 bp, Homo sapiens
gaaagcctgttcccctcactggat

SEQ ID NO: 3212590 - DNA, 16 bp, Homo sapiens
gaaagccttagggaag

SEQ ID NO: 3212591 - DNA, 16 bp, Homo sapiens
gaaagcgattcactgt

SEQ ID NO: 3212592 - DNA, 13 bp, Homo sapiens
gaaagctctagaa

SEQ ID NO: 3212593 - DNA, 18 bp, Homo sapiens
gaaagctctgttgcaatt

SEQ ID NO: 3212594 - DNA, 19 bp, Homo sapiens
gaaagctgagaactcctga

SEQ ID NO: 3212595 - DNA, 13 bp, Homo sapiens
gaaagctgagaag

SEQ ID NO: 3212596 - DNA, 22 bp, Homo sapiens
gaaagctgattactgtcaataa

SEQ ID NO: 3212597 - DNA, 20 bp, Homo sapiens
gaaagctgtgtttatatgga

SEQ ID NO: 3212598 - DNA, 20 bp, Homo sapiens
gaaaggaaaacctgaagact

SEQ ID NO: 3212599 - DNA, 14 bp, Homo sapiens
gaaaggaaaagagg

SEQ ID NO: 3212600 - DNA, 17 bp, Homo sapiens
gaaaggaaaagaggccc

SEQ ID NO: 3212601 - DNA, 16 bp, Homo sapiens
gaaaggaacctgggat

SEQ ID NO: 3212602 - DNA, 18 bp, Homo sapiens
gaaaggaggcatgcctct

SEQ ID NO: 3212603 - DNA, 19 bp, Homo sapiens
gaaaggaggcatgcctctg

SEQ ID NO: 3212604 - DNA, 20 bp, Homo sapiens
gaaaggatatttaagaaaat

SEQ ID NO: 3212605 - DNA, 15 bp, Homo sapiens
gaaaggatgtggaag

SEQ ID NO: 3212606 - DNA, 12 bp, Homo sapiens
gaaaggatttta

SEQ ID NO: 3212607 - DNA, 17 bp, Homo sapiens
gaaaggattttaccaaa

SEQ ID NO: 3212608 - DNA, 19 bp, Homo sapiens
gaaaggattttaccaaagc

SEQ ID NO: 3212609 - DNA, 13 bp, Homo sapiens
gaaaggcctgcac

SEQ ID NO: 3212610 - DNA, 16 bp, Homo sapiens
gaaaggcctgcacaca

SEQ ID NO: 3212611 - DNA, 15 bp, Homo sapiens
gaaaggctctgaaag

SEQ ID NO: 3212612 - DNA, 19 bp, Homo sapiens
gaaaggctctgaaagccag

SEQ ID NO: 3212613 - DNA, 20 bp, Homo sapiens
gaaaggctgccgaggaccct

SEQ ID NO: 3212614 - DNA, 12 bp, Homo sapiens
gaaagggcactt

SEQ ID NO: 3212615 - DNA, 20 bp, Homo sapiens
gaaagggccttgacatcagt

SEQ ID NO: 3212616 - DNA, 18 bp, Homo sapiens
gaaagggctatggcaagg

SEQ ID NO: 3212617 - DNA, 15 bp, Homo sapiens
gaaaggggagagcct

SEQ ID NO: 3212618 - DNA, 17 bp, Homo sapiens
gaaagggggtcccagtg

SEQ ID NO: 3212619 - DNA, 23 bp, Homo sapiens
gaaagggggtcccagtgggaggg

SEQ ID NO: 3212620 - DNA, 14 bp, Homo sapiens
gaaaggggttgggg

SEQ ID NO: 3212621 - DNA, 16 bp, Homo sapiens
gaaaggggttggggtg

SEQ ID NO: 3212622 - DNA, 21 bp, Homo sapiens
gaaagggtaatttcctttgct

SEQ ID NO: 3212623 - DNA, 23 bp, Homo sapiens
gaaaggtgagtttgagctgcctt

SEQ ID NO: 3212624 - DNA, 14 bp, Homo sapiens
gaaaggtttacatt

SEQ ID NO: 3212625 - DNA, 16 bp, Homo sapiens
gaaaggtttacattgt

SEQ ID NO: 3212626 - DNA, 18 bp, Homo sapiens
gaaagtacactctgctgt

SEQ ID NO: 3212627 - DNA, 22 bp, Homo sapiens
gaaagtacttctccaccctgct

SEQ ID NO: 3212628 - DNA, 21 bp, Homo sapiens
gaaagtagggggctttctggg

SEQ ID NO: 3212629 - DNA, 15 bp, Homo sapiens
gaaagtatatactga

SEQ ID NO: 3212630 - DNA, 16 bp, Homo sapiens
gaaagtcaagaagaat

SEQ ID NO: 3212631 - DNA, 17 bp, Homo sapiens
gaaagtcagatgcccag

SEQ ID NO: 3212632 - DNA, 22 bp, Homo sapiens
gaaagtcgaattaatagctttt

SEQ ID NO: 3212633 - DNA, 13 bp, Homo sapiens
gaaagtgaatttg

SEQ ID NO: 3212634 - DNA, 19 bp, Homo sapiens
gaaagtgaatttgaatgaa

SEQ ID NO: 3212635 - DNA, 15 bp, Homo sapiens
gaaagtgactttaaa

SEQ ID NO: 3212636 - DNA, 18 bp, Homo sapiens
gaaagtgactttaaaaga

SEQ ID NO: 3212637 - DNA, 21 bp, Homo sapiens
gaaagtgatatcccccagcct

SEQ ID NO: 3212638 - DNA, 14 bp, Homo sapiens
gaaagtgccagcat

SEQ ID NO: 3212639 - DNA, 22 bp, Homo sapiens
gaaagtgccagcattccagact

SEQ ID NO: 3212640 - DNA, 21 bp, Homo sapiens
gaaagtggccatgccaccctg

SEQ ID NO: 3212641 - DNA, 23 bp, Homo sapiens
gaaagtgggtgagatgctggaga

SEQ ID NO: 3212642 - DNA, 11 bp, Homo sapiens
gaaagtgtatt

SEQ ID NO: 3212643 - DNA, 17 bp, Homo sapiens
gaaagttaacattaatg

SEQ ID NO: 3212644 - DNA, 11 bp, Homo sapiens
gaaagtttttt

SEQ ID NO: 3212645 - DNA, 16 bp, Homo sapiens
gaaataaaaaagtctc

SEQ ID NO: 3212646 - DNA, 17 bp, Homo sapiens
gaaataaaaaagtctct

SEQ ID NO: 3212647 - DNA, 20 bp, Homo sapiens
gaaataaaaaagtctctatt

SEQ ID NO: 3212648 - DNA, 22 bp, Homo sapiens
gaaataaaaaagtctctattta

SEQ ID NO: 3212649 - DNA, 15 bp, Homo sapiens
gaaataaaacctttc

SEQ ID NO: 3212650 - DNA, 16 bp, Homo sapiens
gaaataaaacctttca

SEQ ID NO: 3212651 - DNA, 19 bp, Homo sapiens
gaaataaaagtgaatgaaa

SEQ ID NO: 3212652 - DNA, 23 bp, Homo sapiens
gaaataaaagtgaatgaaagatt

SEQ ID NO: 3212653 - DNA, 23 bp, Homo sapiens
gaaataaaatgccatagtttgtg

SEQ ID NO: 3212654 - DNA, 13 bp, Homo sapiens
gaaataaacactg

SEQ ID NO: 3212655 - DNA, 19 bp, Homo sapiens
gaaataaacactggtgcca

SEQ ID NO: 3212656 - DNA, 21 bp, Homo sapiens
gaaataaacactggtgccaac

SEQ ID NO: 3212657 - DNA, 17 bp, Homo sapiens
gaaataaacttcactga

SEQ ID NO: 3212658 - DNA, 19 bp, Homo sapiens
gaaataaagtcagatggaa

SEQ ID NO: 3212659 - DNA, 14 bp, Homo sapiens
gaaataaatagcta

SEQ ID NO: 3212660 - DNA, 23 bp, Homo sapiens
gaaataaatcagagagcaaggca

SEQ ID NO: 3212661 - DNA, 15 bp, Homo sapiens
gaaataaattcctaa

SEQ ID NO: 3212662 - DNA, 18 bp, Homo sapiens
gaaataacaatgttaagg

SEQ ID NO: 3212663 - DNA, 16 bp, Homo sapiens
gaaataatagggaaaa

SEQ ID NO: 3212664 - DNA, 17 bp, Homo sapiens
gaaataatcagtgactg

SEQ ID NO: 3212665 - DNA, 14 bp, Homo sapiens
gaaataatgctaca

SEQ ID NO: 3212666 - DNA, 19 bp, Homo sapiens
gaaataatgtacatctggc

SEQ ID NO: 3212667 - DNA, 14 bp, Homo sapiens
gaaataatttttct

SEQ ID NO: 3212668 - DNA, 18 bp, Homo sapiens
gaaatacacaagtaaaca

SEQ ID NO: 3212669 - DNA, 14 bp, Homo sapiens
gaaatacacttttt

SEQ ID NO: 3212670 - DNA, 21 bp, Homo sapiens
gaaatacacttttttccaaag

SEQ ID NO: 3212671 - DNA, 19 bp, Homo sapiens
gaaatacagttctgctctg

SEQ ID NO: 3212672 - DNA, 22 bp, Homo sapiens
gaaataccacaagcctgagaac

SEQ ID NO: 3212673 - DNA, 14 bp, Homo sapiens
gaaatacccttctt

SEQ ID NO: 3212674 - DNA, 11 bp, Homo sapiens
gaaatacctca

SEQ ID NO: 3212675 - DNA, 12 bp, Homo sapiens
gaaatacctcat

SEQ ID NO: 3212676 - DNA, 23 bp, Homo sapiens
gaaatacctcatgtttatgaaaa

SEQ ID NO: 3212677 - DNA, 13 bp, Homo sapiens
gaaatactaaaag

SEQ ID NO: 3212678 - DNA, 21 bp, Homo sapiens
gaaatactttcgaaatttcat

SEQ ID NO: 3212679 - DNA, 13 bp, Homo sapiens
gaaatagacaaaa

SEQ ID NO: 3212680 - DNA, 19 bp, Homo sapiens
gaaatagtaccttcaatac

SEQ ID NO: 3212681 - DNA, 18 bp, Homo sapiens
gaaatagttcaaactgca

SEQ ID NO: 3212682 - DNA, 15 bp, Homo sapiens
gaaatataataaaat

SEQ ID NO: 3212683 - DNA, 16 bp, Homo sapiens
gaaatatagttctgat

SEQ ID NO: 3212684 - DNA, 17 bp, Homo sapiens
gaaatatatatgtgtgt

SEQ ID NO: 3212685 - DNA, 23 bp, Homo sapiens
gaaatatatatgtgtgtgtatgt

SEQ ID NO: 3212686 - DNA, 18 bp, Homo sapiens
gaaatatctgaaaatgta

SEQ ID NO: 3212687 - DNA, 20 bp, Homo sapiens
gaaatatctgaaaatgtatg

SEQ ID NO: 3212688 - DNA, 21 bp, Homo sapiens
gaaatatctgaaaatgtatgt

SEQ ID NO: 3212689 - DNA, 19 bp, Homo sapiens
gaaatattaaaccctggat

SEQ ID NO: 3212690 - DNA, 19 bp, Homo sapiens
gaaatatttatttttttaa

SEQ ID NO: 3212691 - DNA, 22 bp, Homo sapiens
gaaatattttgataataaattg

SEQ ID NO: 3212692 - DNA, 23 bp, Homo sapiens
gaaatattttgataataaattga

SEQ ID NO: 3212693 - DNA, 19 bp, Homo sapiens
gaaatcaaagagagaaaat

SEQ ID NO: 3212694 - DNA, 15 bp, Homo sapiens
gaaatcacaggggcg

SEQ ID NO: 3212695 - DNA, 13 bp, Homo sapiens
gaccaagggactc

SEQ ID NO: 3212696 - DNA, 18 bp, Homo sapiens
gaccaaggggtgggccac

SEQ ID NO: 3212697 - DNA, 17 bp, Homo sapiens
gaccaaggtgaagcaaa

SEQ ID NO: 3212698 - DNA, 21 bp, Homo sapiens
gaccaataaaatttctaagag

SEQ ID NO: 3212699 - DNA, 19 bp, Homo sapiens
gaccaatttatgggagaat

SEQ ID NO: 3212700 - DNA, 20 bp, Homo sapiens
gaccacacagtccccagact

SEQ ID NO: 3212701 - DNA, 21 bp, Homo sapiens
gaccacacagtccccagactc

SEQ ID NO: 3212702 - DNA, 12 bp, Homo sapiens
gaccacacctcc

SEQ ID NO: 3212703 - DNA, 17 bp, Homo sapiens
gaccacatctttatctg

SEQ ID NO: 3212704 - DNA, 18 bp, Homo sapiens
gaccacattttatattta

SEQ ID NO: 3212705 - DNA, 22 bp, Homo sapiens
gaccaccaccccaacaaaccat

SEQ ID NO: 3212706 - DNA, 20 bp, Homo sapiens
gaccaccagccgccccagcc

SEQ ID NO: 3212707 - DNA, 21 bp, Homo sapiens
gaccaccagccgccccagccc

SEQ ID NO: 3212708 - DNA, 18 bp, Homo sapiens
gaccaccccgcctgccct

SEQ ID NO: 3212709 - DNA, 19 bp, Homo sapiens
gaccaccccgcctgccctc

SEQ ID NO: 3212710 - DNA, 16 bp, Homo sapiens
gaccaccctcccctct

SEQ ID NO: 3212711 - DNA, 16 bp, Homo sapiens
gaccaccttctgtccc

SEQ ID NO: 3212712 - DNA, 20 bp, Homo sapiens
gaccaccttctgtccccagc

SEQ ID NO: 3212713 - DNA, 22 bp, Homo sapiens
gaccaccttctgtccccagccc

SEQ ID NO: 3212714 - DNA, 21 bp, Homo sapiens
gaccacgcccgtcctgcctgt

SEQ ID NO: 3212715 - DNA, 19 bp, Homo sapiens
gaccactcagcccctagga

SEQ ID NO: 3212716 - DNA, 18 bp, Homo sapiens
gaccactcgaggcctgca

SEQ ID NO: 3212717 - DNA, 21 bp, Homo sapiens
gaccactgagtaccaggggct

SEQ ID NO: 3212718 - DNA, 21 bp, Homo sapiens
gaccactgcatgagcttttat

SEQ ID NO: 3212719 - DNA, 23 bp, Homo sapiens
gaccacttccaggggaacctgcc

SEQ ID NO: 3212720 - DNA, 21 bp, Homo sapiens
gaccactttggagactggggt

SEQ ID NO: 3212721 - DNA, 16 bp, Homo sapiens
gaccacttttatttat

SEQ ID NO: 3212722 - DNA, 17 bp, Homo sapiens
gaccacttttatttatt

SEQ ID NO: 3212723 - DNA, 21 bp, Homo sapiens
gaccagaaatcaaaaagggaa

SEQ ID NO: 3212724 - DNA, 16 bp, Homo sapiens
gaccagaagccaaaga

SEQ ID NO: 3212725 - DNA, 15 bp, Homo sapiens
gaccagagctgtctg

SEQ ID NO: 3212726 - DNA, 17 bp, Homo sapiens
gaccagcaggctggcct

SEQ ID NO: 3212727 - DNA, 16 bp, Homo sapiens
gaccagccccttcctg

SEQ ID NO: 3212728 - DNA, 20 bp, Homo sapiens
gaccagcctccatgctgcct

SEQ ID NO: 3212729 - DNA, 21 bp, Homo sapiens
gaccagcctccatgctgcctc

SEQ ID NO: 3212730 - DNA, 11 bp, Homo sapiens
gaccagctggg

SEQ ID NO: 3212731 - DNA, 19 bp, Homo sapiens
gaccaggactccctcctca

SEQ ID NO: 3212732 - DNA, 21 bp, Homo sapiens
gaccaggactccctcctcacc

SEQ ID NO: 3212733 - DNA, 12 bp, Homo sapiens
gaccaggatcag

SEQ ID NO: 3212734 - DNA, 15 bp, Homo sapiens
gaccaggctgtagga

SEQ ID NO: 3212735 - DNA, 14 bp, Homo sapiens
gaccaggctgtgtc

SEQ ID NO: 3212736 - DNA, 15 bp, Homo sapiens
gaccaggctgtgtcc

SEQ ID NO: 3212737 - DNA, 14 bp, Homo sapiens
gaccagggagcctt

SEQ ID NO: 3212738 - DNA, 13 bp, Homo sapiens
gaccagggatgct

SEQ ID NO: 3212739 - DNA, 16 bp, Homo sapiens
gaccagggatgctggg

SEQ ID NO: 3212740 - DNA, 20 bp, Homo sapiens
gaccagggatgctgggctgg

SEQ ID NO: 3212741 - DNA, 22 bp, Homo sapiens
gaccagggatgctgggctgggc

SEQ ID NO: 3212742 - DNA, 13 bp, Homo sapiens
gaccagggccgag

SEQ ID NO: 3212743 - DNA, 15 bp, Homo sapiens
gaccagggccgagga

SEQ ID NO: 3212744 - DNA, 18 bp, Homo sapiens
gaccagtgaccccagaaa

SEQ ID NO: 3212745 - DNA, 22 bp, Homo sapiens
gaccagtggtgccttggaggga

SEQ ID NO: 3212746 - DNA, 22 bp, Homo sapiens
gaccagtgtatcaggtcaggga

SEQ ID NO: 3212747 - DNA, 20 bp, Homo sapiens
gaccagttgggagcactgga

SEQ ID NO: 3212748 - DNA, 18 bp, Homo sapiens
gaccataattttttttaa

SEQ ID NO: 3212749 - DNA, 12 bp, Homo sapiens
gaccatcctggc

SEQ ID NO: 3212750 - DNA, 20 bp, Homo sapiens
gaccatcctggccaacatga

SEQ ID NO: 3212751 - DNA, 13 bp, Homo sapiens
gaccatcctggct

SEQ ID NO: 3212752 - DNA, 15 bp, Homo sapiens
gaccatgtgtcactt

SEQ ID NO: 3212753 - DNA, 20 bp, Homo sapiens
gaccatgtgtcacttgtgct

SEQ ID NO: 3212754 - DNA, 13 bp, Homo sapiens
gaccatgttcatt

SEQ ID NO: 3212755 - DNA, 14 bp, Homo sapiens
gaccatgttcatta

SEQ ID NO: 3212756 - DNA, 17 bp, Homo sapiens
gaccatgttcattataa

SEQ ID NO: 3212757 - DNA, 20 bp, Homo sapiens
gaccattctgtgaccaaaat

SEQ ID NO: 3212758 - DNA, 18 bp, Homo sapiens
gaccattgagtccctgct

SEQ ID NO: 3212759 - DNA, 13 bp, Homo sapiens
gaccatttataat

SEQ ID NO: 3212760 - DNA, 21 bp, Homo sapiens
gaccatttataatgttagtag

SEQ ID NO: 3212761 - DNA, 23 bp, Homo sapiens
gacccaagccctgaggcctgagg

SEQ ID NO: 3212762 - DNA, 18 bp, Homo sapiens
gacccaatgtaggagctg

SEQ ID NO: 3212763 - DNA, 19 bp, Homo sapiens
gacccaccaaactgcacac

SEQ ID NO: 3212764 - DNA, 18 bp, Homo sapiens
gacccaccccacctgcag

SEQ ID NO: 3212765 - DNA, 23 bp, Homo sapiens
gactccagaatctgctgttgcca

SEQ ID NO: 3212766 - DNA, 20 bp, Homo sapiens
gactccagagtctgagcccc

SEQ ID NO: 3212767 - DNA, 20 bp, Homo sapiens
gactccagcctgcctggcag

SEQ ID NO: 3212768 - DNA, 12 bp, Homo sapiens
gactccaggccc

SEQ ID NO: 3212769 - DNA, 12 bp, Homo sapiens
gactccaggctt

SEQ ID NO: 3212770 - DNA, 21 bp, Homo sapiens
gactcccaagtttccatagca

SEQ ID NO: 3212771 - DNA, 19 bp, Homo sapiens
gactccctcctcacctctg

SEQ ID NO: 3212772 - DNA, 24 bp, Homo sapiens
gactccctcctcacctctggactg

SEQ ID NO: 3212773 - DNA, 13 bp, Homo sapiens
gactccggcctgt

SEQ ID NO: 3212774 - DNA, 16 bp, Homo sapiens
gactccgttggccact

SEQ ID NO: 3212775 - DNA, 18 bp, Homo sapiens
gactcctacctgccctgg

SEQ ID NO: 3212776 - DNA, 19 bp, Homo sapiens
gactcctacctgccctgga

SEQ ID NO: 3212777 - DNA, 13 bp, Homo sapiens
gactcctctgggc

SEQ ID NO: 3212778 - DNA, 15 bp, Homo sapiens
gactcctctgggcct

SEQ ID NO: 3212779 - DNA, 13 bp, Homo sapiens
gactcctgccctg

SEQ ID NO: 3212780 - DNA, 19 bp, Homo sapiens
gactcctgctggtacctgc

SEQ ID NO: 3212781 - DNA, 14 bp, Homo sapiens
gactcctggtctgt

SEQ ID NO: 3212782 - DNA, 17 bp, Homo sapiens
gactcctggtgcccctc

SEQ ID NO: 3212783 - DNA, 24 bp, Homo sapiens
gactcctggtgcccctcgccagct

SEQ ID NO: 3212784 - DNA, 15 bp, Homo sapiens
gactcgcttgtaaat

SEQ ID NO: 3212785 - DNA, 14 bp, Homo sapiens
gactcgggggtggg

SEQ ID NO: 3212786 - DNA, 13 bp, Homo sapiens
gactctaagctgt

SEQ ID NO: 3212787 - DNA, 17 bp, Homo sapiens
gactctaagctgtgtgc

SEQ ID NO: 3212788 - DNA, 18 bp, Homo sapiens
gactctaagctgtgtgca

SEQ ID NO: 3212789 - DNA, 19 bp, Homo sapiens
gactctaagctgtgtgcag

SEQ ID NO: 3212790 - DNA, 18 bp, Homo sapiens
gactctagagtccaaggt

SEQ ID NO: 3212791 - DNA, 15 bp, Homo sapiens
gactctcagcccaga

SEQ ID NO: 3212792 - DNA, 19 bp, Homo sapiens
gactctctgtgacctgccc

SEQ ID NO: 3212793 - DNA, 15 bp, Homo sapiens
gactctgaaaaacat

SEQ ID NO: 3212794 - DNA, 14 bp, Homo sapiens
gactctgaaatctg

SEQ ID NO: 3212795 - DNA, 21 bp, Homo sapiens
gactctgagcgggaggcagag

SEQ ID NO: 3212796 - DNA, 19 bp, Homo sapiens
gactctgaggctctttctg

SEQ ID NO: 3212797 - DNA, 19 bp, Homo sapiens
gactctgcacatgtcttgt

SEQ ID NO: 3212798 - DNA, 14 bp, Homo sapiens
gactctgcactctc

SEQ ID NO: 3212799 - DNA, 19 bp, Homo sapiens
gactctgcatcccagcacc

SEQ ID NO: 3212800 - DNA, 22 bp, Homo sapiens
gactctgcatcccagcacctgc

SEQ ID NO: 3212801 - DNA, 13 bp, Homo sapiens
gactctggatatt

SEQ ID NO: 3212802 - DNA, 14 bp, Homo sapiens
gactctggccctgg

SEQ ID NO: 3212803 - DNA, 17 bp, Homo sapiens
gactctggccctggccc

SEQ ID NO: 3212804 - DNA, 19 bp, Homo sapiens
gactctggtttctcattct

SEQ ID NO: 3212805 - DNA, 17 bp, Homo sapiens
gactctgtggggccttg

SEQ ID NO: 3212806 - DNA, 18 bp, Homo sapiens
gactcttcgatgtgccca

SEQ ID NO: 3212807 - DNA, 21 bp, Homo sapiens
gactcttctcggctcaggctc

SEQ ID NO: 3212808 - DNA, 23 bp, Homo sapiens
gactctttctgaaggaagagaag

SEQ ID NO: 3212809 - DNA, 17 bp, Homo sapiens
gactcttttgccattaa

SEQ ID NO: 3212810 - DNA, 19 bp, Homo sapiens
gactctttttagggccagg

SEQ ID NO: 3212811 - DNA, 22 bp, Homo sapiens
gactctttttagggccaggcag

SEQ ID NO: 3212812 - DNA, 20 bp, Homo sapiens
gactgaaaatatataagctc

SEQ ID NO: 3212813 - DNA, 12 bp, Homo sapiens
gactgaaagcag

SEQ ID NO: 3212814 - DNA, 14 bp, Homo sapiens
gactgaaagcagca

SEQ ID NO: 3212815 - DNA, 13 bp, Homo sapiens
gactgaagaggaa

SEQ ID NO: 3212816 - DNA, 16 bp, Homo sapiens
gactgaagcctgcagg

SEQ ID NO: 3212817 - DNA, 23 bp, Homo sapiens
gactgaaggggcacaccactgcc

SEQ ID NO: 3212818 - DNA, 13 bp, Homo sapiens
gactgactgagac

SEQ ID NO: 3212819 - DNA, 21 bp, Homo sapiens
gactgacttgtttgtcttcca

SEQ ID NO: 3212820 - DNA, 13 bp, Homo sapiens
gactgagaacttt

SEQ ID NO: 3212821 - DNA, 15 bp, Homo sapiens
gactgagcagccgcc

SEQ ID NO: 3212822 - DNA, 20 bp, Homo sapiens
gactgagccaaggaggcctg

SEQ ID NO: 3212823 - DNA, 21 bp, Homo sapiens
gactgagcggccgcagagact

SEQ ID NO: 3212824 - DNA, 20 bp, Homo sapiens
gactgaggtataaagacaag

SEQ ID NO: 3212825 - DNA, 14 bp, Homo sapiens
gactgagtcagatg

SEQ ID NO: 3212826 - DNA, 21 bp, Homo sapiens
gactgagtcccctccaggaag

SEQ ID NO: 3212827 - DNA, 16 bp, Homo sapiens
gactgatttcagagtg

SEQ ID NO: 3212828 - DNA, 15 bp, Homo sapiens
gactgcaaacttttt

SEQ ID NO: 3212829 - DNA, 16 bp, Homo sapiens
gactgcaaactttttt

SEQ ID NO: 3212830 - DNA, 15 bp, Homo sapiens
gactgcacagcggcc

SEQ ID NO: 3212831 - DNA, 21 bp, Homo sapiens
gactgcatgtaccatttgcat

SEQ ID NO: 3212832 - DNA, 20 bp, Homo sapiens
gactgcatttaaatttgatt

SEQ ID NO: 3212833 - DNA, 14 bp, Homo sapiens
gactgccaagccag

SEQ ID NO: 3212834 - DNA, 15 bp, Homo sapiens
gactgccaagccaga

SEQ ID NO: 3212835 - DNA, 15 bp, Homo sapiens
gactgcccctgctgt

SEQ ID NO: 3212836 - DNA, 13 bp, Homo sapiens
gactgcctctgcc

SEQ ID NO: 3212837 - DNA, 14 bp, Homo sapiens
gactgcctctgcca

SEQ ID NO: 3212838 - DNA, 15 bp, Homo sapiens
gactgcgttctgcaa

SEQ ID NO: 3212839 - DNA, 16 bp, Homo sapiens
gactgctacctctgag

SEQ ID NO: 3212840 - DNA, 17 bp, Homo sapiens
gactgctacctctgaga

SEQ ID NO: 3212841 - DNA, 20 bp, Homo sapiens
gactgctacctctgagaaga

SEQ ID NO: 3212842 - DNA, 18 bp, Homo sapiens
gactgctagtgttctgtc

SEQ ID NO: 3212843 - DNA, 15 bp, Homo sapiens
gactgctccccagcc

SEQ ID NO: 3212844 - DNA, 20 bp, Homo sapiens
gactgctccccagccctggc

SEQ ID NO: 3212845 - DNA, 14 bp, Homo sapiens
gactgctgggactg

SEQ ID NO: 3212846 - DNA, 19 bp, Homo sapiens
gactgctgggactggccag

SEQ ID NO: 3212847 - DNA, 16 bp, Homo sapiens
gactgcttcccatcct

SEQ ID NO: 3212848 - DNA, 20 bp, Homo sapiens
gactgcttcccatcctaccc

SEQ ID NO: 3212849 - DNA, 19 bp, Homo sapiens
gactggaagacacttcaga

SEQ ID NO: 3212850 - DNA, 16 bp, Homo sapiens
gactggaagcacagct

SEQ ID NO: 3212851 - DNA, 23 bp, Homo sapiens
gactggagaccgcttcacccctg

SEQ ID NO: 3212852 - DNA, 23 bp, Homo sapiens
gactggaggcccctggagccaga

SEQ ID NO: 3212853 - DNA, 18 bp, Homo sapiens
gactggaggtgggcatgc

SEQ ID NO: 3212854 - DNA, 15 bp, Homo sapiens
gactggagtgaggct

SEQ ID NO: 3212855 - DNA, 22 bp, Homo sapiens
gactggagtgaggcttccaggc

SEQ ID NO: 3212856 - DNA, 23 bp, Homo sapiens
gactggagtgaggcttccaggct

SEQ ID NO: 3212857 - DNA, 16 bp, Homo sapiens
gactggcaaaggacca

SEQ ID NO: 3212858 - DNA, 18 bp, Homo sapiens
gactggcaagaggcctca

SEQ ID NO: 3212859 - DNA, 14 bp, Homo sapiens
gactggcaataaac

SEQ ID NO: 3212860 - DNA, 15 bp, Homo sapiens
gactggcaataaact

SEQ ID NO: 3212861 - DNA, 11 bp, Homo sapiens
gactggcaggc

SEQ ID NO: 3212862 - DNA, 23 bp, Homo sapiens
gactggcaggtgcagatgggctg

SEQ ID NO: 3212863 - DNA, 19 bp, Homo sapiens
gactggccagttgcccaga

SEQ ID NO: 3212864 - DNA, 20 bp, Homo sapiens
gactggccagttgcccagag

SEQ ID NO: 3212865 - DNA, 21 bp, Homo sapiens
gactggccagttgcccagagc

SEQ ID NO: 3212866 - DNA, 14 bp, Homo sapiens
gactggccgggcag

SEQ ID NO: 3212867 - DNA, 14 bp, Homo sapiens
gactggcggagaag

SEQ ID NO: 3212868 - DNA, 22 bp, Homo sapiens
gactggcgttcacctccctgct

SEQ ID NO: 3212869 - DNA, 17 bp, Homo sapiens
gactggctagagtcctc

SEQ ID NO: 3212870 - DNA, 16 bp, Homo sapiens
gactggctggctgcag

SEQ ID NO: 3212871 - DNA, 15 bp, Homo sapiens
gactggctgtctgcc

SEQ ID NO: 3212872 - DNA, 19 bp, Homo sapiens
gactggctgtctgcctgta

SEQ ID NO: 3212873 - DNA, 17 bp, Homo sapiens
gactgggagccacttct

SEQ ID NO: 3212874 - DNA, 17 bp, Homo sapiens
gactgggagtcagagcc

SEQ ID NO: 3212875 - DNA, 18 bp, Homo sapiens
gactgggagtcagagccc

SEQ ID NO: 3212876 - DNA, 20 bp, Homo sapiens
gactgggcctcccttgggct

SEQ ID NO: 3212877 - DNA, 16 bp, Homo sapiens
gactggggatgtggga

SEQ ID NO: 3212878 - DNA, 14 bp, Homo sapiens
gactggggggcttg

SEQ ID NO: 3212879 - DNA, 14 bp, Homo sapiens
gactggggtggcct

SEQ ID NO: 3212880 - DNA, 18 bp, Homo sapiens
gactggggtggcctcaag

SEQ ID NO: 3212881 - DNA, 23 bp, Homo sapiens
gactgggtctcgctttgttgccc

SEQ ID NO: 3212882 - DNA, 14 bp, Homo sapiens
gactggtccagctc

SEQ ID NO: 3212883 - DNA, 18 bp, Homo sapiens
gactggtttacaggccct

SEQ ID NO: 3212884 - DNA, 16 bp, Homo sapiens
gactgtactggccagt

SEQ ID NO: 3212885 - DNA, 22 bp, Homo sapiens
gactgtagattgcttctgtagt

SEQ ID NO: 3212886 - DNA, 18 bp, Homo sapiens
gactgtataggtagatcc

SEQ ID NO: 3212887 - DNA, 16 bp, Homo sapiens
gactgtcctctcccct

SEQ ID NO: 3212888 - DNA, 20 bp, Homo sapiens
gactgtcctctcccctccag

SEQ ID NO: 3212889 - DNA, 22 bp, Homo sapiens
gactgtcggagaggctgtctgg

SEQ ID NO: 3212890 - DNA, 23 bp, Homo sapiens
gactgtcggagaggctgtctggg

SEQ ID NO: 3212891 - DNA, 20 bp, Homo sapiens
gagaagagggcccagcccag

SEQ ID NO: 3212892 - DNA, 14 bp, Homo sapiens
gagaagagggcctg

SEQ ID NO: 3212893 - DNA, 15 bp, Homo sapiens
gagaagagggcctgt

SEQ ID NO: 3212894 - DNA, 22 bp, Homo sapiens
gagaagataattgttgaaattt

SEQ ID NO: 3212895 - DNA, 21 bp, Homo sapiens
gagaagccatgtactcaagta

SEQ ID NO: 3212896 - DNA, 13 bp, Homo sapiens
gagaagccttcag

SEQ ID NO: 3212897 - DNA, 16 bp, Homo sapiens
gagaagcggatttcca

SEQ ID NO: 3212898 - DNA, 12 bp, Homo sapiens
gagaagctgaaa

SEQ ID NO: 3212899 - DNA, 13 bp, Homo sapiens
gagaaggaacagg

SEQ ID NO: 3212900 - DNA, 23 bp, Homo sapiens
gagaaggacccggaggggcctgg

SEQ ID NO: 3212901 - DNA, 14 bp, Homo sapiens
gagaaggagagaaa

SEQ ID NO: 3212902 - DNA, 15 bp, Homo sapiens
gagaaggcgaggaga

SEQ ID NO: 3212903 - DNA, 24 bp, Homo sapiens
gagaagggaagaaggggccatcac

SEQ ID NO: 3212904 - DNA, 20 bp, Homo sapiens
gagaagggataaccctacac

SEQ ID NO: 3212905 - DNA, 17 bp, Homo sapiens
gagaagggcataaaaca

SEQ ID NO: 3212906 - DNA, 17 bp, Homo sapiens
gagaagtgaatgctggg

SEQ ID NO: 3212907 - DNA, 19 bp, Homo sapiens
gagaagtgaatgctgggac

SEQ ID NO: 3212908 - DNA, 19 bp, Homo sapiens
gagaagtgccttctccttc

SEQ ID NO: 3212909 - DNA, 19 bp, Homo sapiens
gagaagttctcaaagttaa

SEQ ID NO: 3212910 - DNA, 15 bp, Homo sapiens
gagaagttgtgaaag

SEQ ID NO: 3212911 - DNA, 22 bp, Homo sapiens
gagaatcactaggtaacttatt

SEQ ID NO: 3212912 - DNA, 20 bp, Homo sapiens
gagaatcactgcagcccagg

SEQ ID NO: 3212913 - DNA, 20 bp, Homo sapiens
gagaatcccactttctatag

SEQ ID NO: 3212914 - DNA, 14 bp, Homo sapiens
gagaatcccttaaa

SEQ ID NO: 3212915 - DNA, 17 bp, Homo sapiens
gagaatgagggccaaga

SEQ ID NO: 3212916 - DNA, 12 bp, Homo sapiens
gagaatgcacag

SEQ ID NO: 3212917 - DNA, 22 bp, Homo sapiens
gagaatggaaaccacaactttt

SEQ ID NO: 3212918 - DNA, 22 bp, Homo sapiens
gagaatggctgggtcagggcca

SEQ ID NO: 3212919 - DNA, 20 bp, Homo sapiens
gagaatggtgtgaacccggg

SEQ ID NO: 3212920 - DNA, 21 bp, Homo sapiens
gagaatggtgtgaacccggga

SEQ ID NO: 3212921 - DNA, 22 bp, Homo sapiens
gagaatgtgtgtgtgtggcagg

SEQ ID NO: 3212922 - DNA, 15 bp, Homo sapiens
gagaattaaaactca

SEQ ID NO: 3212923 - DNA, 17 bp, Homo sapiens
gagaattgggattacat

SEQ ID NO: 3212924 - DNA, 15 bp, Homo sapiens
gagaattgtatcatt

SEQ ID NO: 3212925 - DNA, 21 bp, Homo sapiens
gagaatttaagtagaaaagtt

SEQ ID NO: 3212926 - DNA, 23 bp, Homo sapiens
gagaatttctaaaaagattagca

SEQ ID NO: 3212927 - DNA, 15 bp, Homo sapiens
gagaattttaaatta

SEQ ID NO: 3212928 - DNA, 15 bp, Homo sapiens
gagacaaatctttaa

SEQ ID NO: 3212929 - DNA, 16 bp, Homo sapiens
gagacaagccctggca

SEQ ID NO: 3212930 - DNA, 23 bp, Homo sapiens
gagacacacaattcattggctcc

SEQ ID NO: 3212931 - DNA, 18 bp, Homo sapiens
gagacacatacagagtgg

SEQ ID NO: 3212932 - DNA, 16 bp, Homo sapiens
gagacacggagcccag

SEQ ID NO: 3212933 - DNA, 15 bp, Homo sapiens
gagacactggcccct

SEQ ID NO: 3212934 - DNA, 16 bp, Homo sapiens
gagacagaagcaggct

SEQ ID NO: 3212935 - DNA, 16 bp, Homo sapiens
gagacagaatgtatct

SEQ ID NO: 3212936 - DNA, 12 bp, Homo sapiens
gagacagacaca

SEQ ID NO: 3212937 - DNA, 19 bp, Homo sapiens
gagacagagttttcactct

SEQ ID NO: 3212938 - DNA, 13 bp, Homo sapiens
gagacagccccag

SEQ ID NO: 3212939 - DNA, 19 bp, Homo sapiens
gagacagccccagagcagg

SEQ ID NO: 3212940 - DNA, 16 bp, Homo sapiens
gagacagcttctctgc

SEQ ID NO: 3212941 - DNA, 17 bp, Homo sapiens
gagacagcttctctgca

SEQ ID NO: 3212942 - DNA, 12 bp, Homo sapiens
gagacaggaagg

SEQ ID NO: 3212943 - DNA, 18 bp, Homo sapiens
gagacagggtaggaaagg

SEQ ID NO: 3212944 - DNA, 19 bp, Homo sapiens
gagacagtccagtgtcacc

SEQ ID NO: 3212945 - DNA, 17 bp, Homo sapiens
gagacagtcctttccca

SEQ ID NO: 3212946 - DNA, 16 bp, Homo sapiens
gagacagttcaagaaa

SEQ ID NO: 3212947 - DNA, 18 bp, Homo sapiens
gagacataaatgttcact

SEQ ID NO: 3212948 - DNA, 17 bp, Homo sapiens
gagaccaagtcctggct

SEQ ID NO: 3212949 - DNA, 14 bp, Homo sapiens
gagaccagcctggc

SEQ ID NO: 3212950 - DNA, 17 bp, Homo sapiens
gagaccaggctgtgtcc

SEQ ID NO: 3212951 - DNA, 13 bp, Homo sapiens
gagaccagtgtat

SEQ ID NO: 3212952 - DNA, 23 bp, Homo sapiens
gagaccagtgtatcaggtcaggg

SEQ ID NO: 3212953 - DNA, 22 bp, Homo sapiens
gagaccagttgggagcactgga

SEQ ID NO: 3212954 - DNA, 23 bp, Homo sapiens
gagaccagttgggagcactggag

SEQ ID NO: 3212955 - DNA, 15 bp, Homo sapiens
gagaccatcctggct

SEQ ID NO: 3212956 - DNA, 18 bp, Homo sapiens
gagaccatgcagagcgcc

SEQ ID NO: 3212957 - DNA, 13 bp, Homo sapiens
gagacccccacac

SEQ ID NO: 3212958 - DNA, 14 bp, Homo sapiens
gagacccccacacc

SEQ ID NO: 3212959 - DNA, 16 bp, Homo sapiens
gagacccccaggcctg

SEQ ID NO: 3212960 - DNA, 16 bp, Homo sapiens
gagaccccgcacccgg

SEQ ID NO: 3212961 - DNA, 14 bp, Homo sapiens
gagacccctgtctc

SEQ ID NO: 3212962 - DNA, 17 bp, Homo sapiens
gagaccctacaggagag

SEQ ID NO: 3212963 - DNA, 22 bp, Homo sapiens
gagaccctgcaaacagaacagg

SEQ ID NO: 3212964 - DNA, 14 bp, Homo sapiens
gagaccctgggaga

SEQ ID NO: 3212965 - DNA, 18 bp, Homo sapiens
gagaccctgggagagaag

SEQ ID NO: 3212966 - DNA, 19 bp, Homo sapiens
gagaccgcttcacccctgc

SEQ ID NO: 3212967 - DNA, 20 bp, Homo sapiens
gagaccggggtatcctgggg

SEQ ID NO: 3212968 - DNA, 15 bp, Homo sapiens
gagaccgtcctcacc

SEQ ID NO: 3212969 - DNA, 16 bp, Homo sapiens
gagacctacctcaggt

SEQ ID NO: 3212970 - DNA, 15 bp, Homo sapiens
gagacctcaagccct

SEQ ID NO: 3212971 - DNA, 17 bp, Homo sapiens
gagacctcaagccctga

SEQ ID NO: 3212972 - DNA, 11 bp, Homo sapiens
gagacctcatc

SEQ ID NO: 3212973 - DNA, 20 bp, Homo sapiens
gagacctcatcaggatgaac

SEQ ID NO: 3212974 - DNA, 21 bp, Homo sapiens
gagacctcatcaggatgaacc

SEQ ID NO: 3212975 - DNA, 15 bp, Homo sapiens
gagacctgaagtgtg

SEQ ID NO: 3212976 - DNA, 14 bp, Homo sapiens
gagacggagtccca

SEQ ID NO: 3212977 - DNA, 15 bp, Homo sapiens
gagactaagccctgt

SEQ ID NO: 3212978 - DNA, 16 bp, Homo sapiens
gagactaagccctgtc

SEQ ID NO: 3212979 - DNA, 16 bp, Homo sapiens
gagactagattgcctt

SEQ ID NO: 3212980 - DNA, 21 bp, Homo sapiens
gagactatggagcctggcaca

SEQ ID NO: 3212981 - DNA, 15 bp, Homo sapiens
gagactatggcctcg

SEQ ID NO: 3212982 - DNA, 20 bp, Homo sapiens
gagactcagcgctcctcctg

SEQ ID NO: 3212983 - DNA, 22 bp, Homo sapiens
gagactcagcgctcctcctgtg

SEQ ID NO: 3212984 - DNA, 17 bp, Homo sapiens
gagactccagaatctgc

SEQ ID NO: 3212985 - DNA, 17 bp, Homo sapiens
gagactcctgccctgtt

SEQ ID NO: 3212986 - DNA, 23 bp, Homo sapiens
gagactcctggtctgtgaagagc

SEQ ID NO: 3212987 - DNA, 14 bp, Homo sapiens
gagactctgtctca

SEQ ID NO: 3212988 - DNA, 15 bp, Homo sapiens
gagactgaaagcagc

SEQ ID NO: 3212989 - DNA, 21 bp, Homo sapiens
gagactgaaagcagcagctag

SEQ ID NO: 3212990 - DNA, 16 bp, Homo sapiens
gagactgcgttctgca

SEQ ID NO: 3212991 - DNA, 20 bp, Homo sapiens
gagactgcttcccatcctac

SEQ ID NO: 3212992 - DNA, 22 bp, Homo sapiens
gagactgcttcccatcctaccc

SEQ ID NO: 3212993 - DNA, 17 bp, Homo sapiens
gagactggcacttagcc

SEQ ID NO: 3212994 - DNA, 14 bp, Homo sapiens
gagactggcaggcg

SEQ ID NO: 3212995 - DNA, 15 bp, Homo sapiens
gagactggcaggcgg

SEQ ID NO: 3212996 - DNA, 16 bp, Homo sapiens
gagactggcaggcggg

SEQ ID NO: 3212997 - DNA, 16 bp, Homo sapiens
gagactgggagccact

SEQ ID NO: 3212998 - DNA, 15 bp, Homo sapiens
gagactgggatggga

SEQ ID NO: 3212999 - DNA, 13 bp, Homo sapiens
gagactggggtgg

SEQ ID NO: 3213000 - DNA, 16 bp, Homo sapiens
gagactggtcctgtgt

SEQ ID NO: 3213001 - DNA, 17 bp, Homo sapiens
gagactgtcggagaggc

SEQ ID NO: 3213002 - DNA, 23 bp, Homo sapiens
gagactgtctcaagagggcactg

SEQ ID NO: 3213003 - DNA, 23 bp, Homo sapiens
gagacttactgggtgaggaaatc

SEQ ID NO: 3213004 - DNA, 21 bp, Homo sapiens
gagacttagggcaccaggggt

SEQ ID NO: 3213005 - DNA, 19 bp, Homo sapiens
gagacttctgcttttcaac

SEQ ID NO: 3213006 - DNA, 13 bp, Homo sapiens
gagacttgtatga

SEQ ID NO: 3213007 - DNA, 13 bp, Homo sapiens
gagactttgtaga

SEQ ID NO: 3213008 - DNA, 11 bp, Homo sapiens
gagagaaaaaa

SEQ ID NO: 3213009 - DNA, 21 bp, Homo sapiens
gagagaaagagagaagccagc

SEQ ID NO: 3213010 - DNA, 15 bp, Homo sapiens
gagagaaagtgggtg

SEQ ID NO: 3213011 - DNA, 16 bp, Homo sapiens
gagagaaattctgtta

SEQ ID NO: 3213012 - DNA, 16 bp, Homo sapiens
gagagaagccacgctg

SEQ ID NO: 3213013 - DNA, 12 bp, Homo sapiens
gagagaagccag

SEQ ID NO: 3213014 - DNA, 13 bp, Homo sapiens
gagagaagccagc

SEQ ID NO: 3213015 - DNA, 17 bp, Homo sapiens
gagagaattaaaactca

SEQ ID NO: 3213016 - DNA, 15 bp, Homo sapiens
gagagaccccgcacc

SEQ ID NO: 3213017 - DNA, 12 bp, Homo sapiens
gagcaagactct

SEQ ID NO: 3213018 - DNA, 13 bp, Homo sapiens
gagcaagccctac

SEQ ID NO: 3213019 - DNA, 16 bp, Homo sapiens
gagcacaaacattttt

SEQ ID NO: 3213020 - DNA, 22 bp, Homo sapiens
gagcacaagaggagatccaggg

SEQ ID NO: 3213021 - DNA, 20 bp, Homo sapiens
gagcacactttagtggccga

SEQ ID NO: 3213022 - DNA, 12 bp, Homo sapiens
gagcacagccct

SEQ ID NO: 3213023 - DNA, 14 bp, Homo sapiens
gagcacagccctgg

SEQ ID NO: 3213024 - DNA, 16 bp, Homo sapiens
gagcacaggtcccacc

SEQ ID NO: 3213025 - DNA, 17 bp, Homo sapiens
gagcacccagagcaccc

SEQ ID NO: 3213026 - DNA, 11 bp, Homo sapiens
gagcaccccca

SEQ ID NO: 3213027 - DNA, 12 bp, Homo sapiens
gagcacctcacc

SEQ ID NO: 3213028 - DNA, 16 bp, Homo sapiens
gagcaccttcctcact

SEQ ID NO: 3213029 - DNA, 21 bp, Homo sapiens
gagcactaaggtgtgctctga

SEQ ID NO: 3213030 - DNA, 21 bp, Homo sapiens
gagcactctgagtttaccatt

SEQ ID NO: 3213031 - DNA, 14 bp, Homo sapiens
gagcactggagtgc

SEQ ID NO: 3213032 - DNA, 15 bp, Homo sapiens
gagcactggccagag

SEQ ID NO: 3213033 - DNA, 17 bp, Homo sapiens
gagcactggccagagag

SEQ ID NO: 3213034 - DNA, 16 bp, Homo sapiens
gagcacttgcgtcctg

SEQ ID NO: 3213035 - DNA, 14 bp, Homo sapiens
gagcagacaggagg

SEQ ID NO: 3213036 - DNA, 15 bp, Homo sapiens
gagcagagcaggcaa

SEQ ID NO: 3213037 - DNA, 13 bp, Homo sapiens
gagcagaggcagc

SEQ ID NO: 3213038 - DNA, 14 bp, Homo sapiens
gagcagaggtctcc

SEQ ID NO: 3213039 - DNA, 21 bp, Homo sapiens
gagcagccgccagctgggagc

SEQ ID NO: 3213040 - DNA, 15 bp, Homo sapiens
gagcagcctgatggc

SEQ ID NO: 3213041 - DNA, 12 bp, Homo sapiens
gagcagctagct

SEQ ID NO: 3213042 - DNA, 17 bp, Homo sapiens
gagcagcttccttctgg

SEQ ID NO: 3213043 - DNA, 23 bp, Homo sapiens
gagcagcttccttctgggactgg

SEQ ID NO: 3213044 - DNA, 17 bp, Homo sapiens
gagcagctttaaactca

SEQ ID NO: 3213045 - DNA, 18 bp, Homo sapiens
gagcagctttaaactcag

SEQ ID NO: 3213046 - DNA, 22 bp, Homo sapiens
gagcaggaagcattcagagagc

SEQ ID NO: 3213047 - DNA, 23 bp, Homo sapiens
gagcaggaagcattcagagagca

SEQ ID NO: 3213048 - DNA, 15 bp, Homo sapiens
gagcaggaaggcctg

SEQ ID NO: 3213049 - DNA, 20 bp, Homo sapiens
gagcaggacctcccttccga

SEQ ID NO: 3213050 - DNA, 13 bp, Homo sapiens
gagcaggagcccc

SEQ ID NO: 3213051 - DNA, 23 bp, Homo sapiens
gagcaggaggccaataaaaagtt

SEQ ID NO: 3213052 - DNA, 22 bp, Homo sapiens
gagcaggcacgggtggtccccg

SEQ ID NO: 3213053 - DNA, 19 bp, Homo sapiens
gagcaggccggaaccacag

SEQ ID NO: 3213054 - DNA, 17 bp, Homo sapiens
gagcagggaaggcctga

SEQ ID NO: 3213055 - DNA, 22 bp, Homo sapiens
gagcagggattaacctctgcac

SEQ ID NO: 3213056 - DNA, 13 bp, Homo sapiens
gagcaggggcagg

SEQ ID NO: 3213057 - DNA, 16 bp, Homo sapiens
gagcaggggcagggtg

SEQ ID NO: 3213058 - DNA, 13 bp, Homo sapiens
gagcaggggctcc

SEQ ID NO: 3213059 - DNA, 17 bp, Homo sapiens
gagcagggtcagtggaa

SEQ ID NO: 3213060 - DNA, 16 bp, Homo sapiens
gagcagggtgttggga

SEQ ID NO: 3213061 - DNA, 22 bp, Homo sapiens
gagcaggttccccaagggccct

SEQ ID NO: 3213062 - DNA, 16 bp, Homo sapiens
gagcagtcctgcctca

SEQ ID NO: 3213063 - DNA, 14 bp, Homo sapiens
gagcagtggctggt

SEQ ID NO: 3213064 - DNA, 23 bp, Homo sapiens
gagcagtggctggtccagggcta

SEQ ID NO: 3213065 - DNA, 11 bp, Homo sapiens
gagcagtgtct

SEQ ID NO: 3213066 - DNA, 18 bp, Homo sapiens
gagcagttttcccctggc

SEQ ID NO: 3213067 - DNA, 16 bp, Homo sapiens
gagcatacaaaataaa

SEQ ID NO: 3213068 - DNA, 18 bp, Homo sapiens
gagcatagcagaggggcc

SEQ ID NO: 3213069 - DNA, 20 bp, Homo sapiens
gagcatagcagaggggccag

SEQ ID NO: 3213070 - DNA, 22 bp, Homo sapiens
gagcatatttgccaataaagct

SEQ ID NO: 3213071 - DNA, 15 bp, Homo sapiens
gagcatcagccagtg

SEQ ID NO: 3213072 - DNA, 13 bp, Homo sapiens
gagcatcccggag

SEQ ID NO: 3213073 - DNA, 14 bp, Homo sapiens
gagcatcctgagcc

SEQ ID NO: 3213074 - DNA, 15 bp, Homo sapiens
gagcatcctgagccc

SEQ ID NO: 3213075 - DNA, 23 bp, Homo sapiens
gagcatgatgggaatagggagac

SEQ ID NO: 3213076 - DNA, 22 bp, Homo sapiens
gagcatgcattttcttgtatga

SEQ ID NO: 3213077 - DNA, 16 bp, Homo sapiens
gagcatggatgcattt

SEQ ID NO: 3213078 - DNA, 19 bp, Homo sapiens
gagcatggatgcatttcaa

SEQ ID NO: 3213079 - DNA, 13 bp, Homo sapiens
gagcatgggtgtg

SEQ ID NO: 3213080 - DNA, 22 bp, Homo sapiens
gagcatgtactgagccttgtaa

SEQ ID NO: 3213081 - DNA, 18 bp, Homo sapiens
gagcatgttttgtataca

SEQ ID NO: 3213082 - DNA, 22 bp, Homo sapiens
gagcatttaatggcagctagtg

SEQ ID NO: 3213083 - DNA, 20 bp, Homo sapiens
gagcattttgataccagaag

SEQ ID NO: 3213084 - DNA, 14 bp, Homo sapiens
gagccaaattttat

SEQ ID NO: 3213085 - DNA, 20 bp, Homo sapiens
gagccaacagaagcttccat

SEQ ID NO: 3213086 - DNA, 14 bp, Homo sapiens
gagccaacctcggc

SEQ ID NO: 3213087 - DNA, 20 bp, Homo sapiens
gagccaactctaacaggcac

SEQ ID NO: 3213088 - DNA, 15 bp, Homo sapiens
gagccaactgctgct

SEQ ID NO: 3213089 - DNA, 17 bp, Homo sapiens
gagccaaggaggcctgg

SEQ ID NO: 3213090 - DNA, 18 bp, Homo sapiens
gagccaataaacctgtaa

SEQ ID NO: 3213091 - DNA, 20 bp, Homo sapiens
gagccaatgttttccaccca

SEQ ID NO: 3213092 - DNA, 19 bp, Homo sapiens
gagccaatttaaagaaaac

SEQ ID NO: 3213093 - DNA, 12 bp, Homo sapiens
gagccaccagtt

SEQ ID NO: 3213094 - DNA, 13 bp, Homo sapiens
gagccaccagttc

SEQ ID NO: 3213095 - DNA, 13 bp, Homo sapiens
gagccacctggat

SEQ ID NO: 3213096 - DNA, 15 bp, Homo sapiens
gagccacctggatct

SEQ ID NO: 3213097 - DNA, 17 bp, Homo sapiens
gagccactcctgtcccg

SEQ ID NO: 3213098 - DNA, 21 bp, Homo sapiens
gagccactcgcagtcgcagga

SEQ ID NO: 3213099 - DNA, 16 bp, Homo sapiens
gagccactgagcctgg

SEQ ID NO: 3213100 - DNA, 13 bp, Homo sapiens
gagccactgcacc

SEQ ID NO: 3213101 - DNA, 23 bp, Homo sapiens
gaagccttaagccataggcccag

SEQ ID NO: 3213102 - DNA, 19 bp, Homo sapiens
gaagccttaatttgcacag

SEQ ID NO: 3213103 - DNA, 16 bp, Homo sapiens
gaagccttcagctcca

SEQ ID NO: 3213104 - DNA, 20 bp, Homo sapiens
gaagccttctgcagcaggaa

SEQ ID NO: 3213105 - DNA, 22 bp, Homo sapiens
gaagccttgcctaaatttaatg

SEQ ID NO: 3213106 - DNA, 16 bp, Homo sapiens
gaagcgacccagggga

SEQ ID NO: 3213107 - DNA, 16 bp, Homo sapiens
gaagcgagcactgacc

SEQ ID NO: 3213108 - DNA, 17 bp, Homo sapiens
gaagcggagcttgcagt

SEQ ID NO: 3213109 - DNA, 14 bp, Homo sapiens
gaagcggatttcca

SEQ ID NO: 3213110 - DNA, 20 bp, Homo sapiens
gaagctactgtgtgtgtgaa

SEQ ID NO: 3213111 - DNA, 22 bp, Homo sapiens
gaagctactgtgtgtgtgaatg

SEQ ID NO: 3213112 - DNA, 19 bp, Homo sapiens
gaagctccgctttctaccc

SEQ ID NO: 3213113 - DNA, 22 bp, Homo sapiens
gaagctccgctttctacccagc

SEQ ID NO: 3213114 - DNA, 20 bp, Homo sapiens
gaagctcgccccacctccac

SEQ ID NO: 3213115 - DNA, 20 bp, Homo sapiens
gaagctctggctgaaccctg

SEQ ID NO: 3213116 - DNA, 17 bp, Homo sapiens
gaagctgagggcaaatc

SEQ ID NO: 3213117 - DNA, 17 bp, Homo sapiens
gaagctgcaggggcagg

SEQ ID NO: 3213118 - DNA, 13 bp, Homo sapiens
gaagctgccagcc

SEQ ID NO: 3213119 - DNA, 15 bp, Homo sapiens
gaagctgccagccca

SEQ ID NO: 3213120 - DNA, 18 bp, Homo sapiens
gaagctgccagcccagaa

SEQ ID NO: 3213121 - DNA, 13 bp, Homo sapiens
gaagctgctccag

SEQ ID NO: 3213122 - DNA, 20 bp, Homo sapiens
gaagctgctccaggcctgca

SEQ ID NO: 3213123 - DNA, 12 bp, Homo sapiens
gaagctggactt

SEQ ID NO: 3213124 - DNA, 20 bp, Homo sapiens
gaagctggacttctgtgggc

SEQ ID NO: 3213125 - DNA, 19 bp, Homo sapiens
gaagctggaggctccagga

SEQ ID NO: 3213126 - DNA, 16 bp, Homo sapiens
gaagctgtactcagag

SEQ ID NO: 3213127 - DNA, 19 bp, Homo sapiens
gaagctgtactcagagcag

SEQ ID NO: 3213128 - DNA, 20 bp, Homo sapiens
gaagctgtactcagagcaga

SEQ ID NO: 3213129 - DNA, 21 bp, Homo sapiens
gaagctgtactcagagcagag

SEQ ID NO: 3213130 - DNA, 23 bp, Homo sapiens
gaagctgtactcagagcagagca

SEQ ID NO: 3213131 - DNA, 23 bp, Homo sapiens
gaagctgtagtagccctttctgt

SEQ ID NO: 3213132 - DNA, 18 bp, Homo sapiens
gaagctgtgttgaaacag

SEQ ID NO: 3213133 - DNA, 19 bp, Homo sapiens
gaagctgtgttgaaacaga

SEQ ID NO: 3213134 - DNA, 22 bp, Homo sapiens
gaagctgtgttgaaacagaaaa

SEQ ID NO: 3213135 - DNA, 21 bp, Homo sapiens
gaagctgttgtacatttatga

SEQ ID NO: 3213136 - DNA, 16 bp, Homo sapiens
gaagctgttgtgtgag

SEQ ID NO: 3213137 - DNA, 19 bp, Homo sapiens
gaagcttctaataaattat

SEQ ID NO: 3213138 - DNA, 18 bp, Homo sapiens
gaagcttgagcctccccc

SEQ ID NO: 3213139 - DNA, 23 bp, Homo sapiens
gaaggaaagatttgtgaactgga

SEQ ID NO: 3213140 - DNA, 14 bp, Homo sapiens
gaaggaagagaaga

SEQ ID NO: 3213141 - DNA, 22 bp, Homo sapiens
gaaggaataaattgctccttga

SEQ ID NO: 3213142 - DNA, 15 bp, Homo sapiens
gaaggaatagccaga

SEQ ID NO: 3213143 - DNA, 17 bp, Homo sapiens
gaaggaatagccagaga

SEQ ID NO: 3213144 - DNA, 23 bp, Homo sapiens
gaaggaatagccagagaggagca

SEQ ID NO: 3213145 - DNA, 15 bp, Homo sapiens
gaaggacagactggc

SEQ ID NO: 3213146 - DNA, 17 bp, Homo sapiens
gaaggacagactggccg

SEQ ID NO: 3213147 - DNA, 19 bp, Homo sapiens
gaaggacaggaccctcagg

SEQ ID NO: 3213148 - DNA, 21 bp, Homo sapiens
gaaggacattgcggacagcca

SEQ ID NO: 3213149 - DNA, 15 bp, Homo sapiens
gaaggaccagccctt

SEQ ID NO: 3213150 - DNA, 20 bp, Homo sapiens
gaaggagagaaagtgggtga

SEQ ID NO: 3213151 - DNA, 19 bp, Homo sapiens
gaaggagagcaagaaggaa

SEQ ID NO: 3213152 - DNA, 15 bp, Homo sapiens
gaaggagagcctgct

SEQ ID NO: 3213153 - DNA, 19 bp, Homo sapiens
gaaggagcggcgccctgga

SEQ ID NO: 3213154 - DNA, 22 bp, Homo sapiens
gaaggaggaatgctggactgga

SEQ ID NO: 3213155 - DNA, 21 bp, Homo sapiens
gaaggagggcagagccatggg

SEQ ID NO: 3213156 - DNA, 18 bp, Homo sapiens
gaaggaggggaagctgca

SEQ ID NO: 3213157 - DNA, 24 bp, Homo sapiens
gaaggagggggttcttcctcacct

SEQ ID NO: 3213158 - DNA, 16 bp, Homo sapiens
gaaggatccaggaata

SEQ ID NO: 3213159 - DNA, 15 bp, Homo sapiens
gaaggatgctctttc

SEQ ID NO: 3213160 - DNA, 17 bp, Homo sapiens
gaaggattatggaaaaa

SEQ ID NO: 3213161 - DNA, 15 bp, Homo sapiens
gaaggcaaagcacga

SEQ ID NO: 3213162 - DNA, 15 bp, Homo sapiens
gaaggcaaatataag

SEQ ID NO: 3213163 - DNA, 14 bp, Homo sapiens
gaaggcaagagggg

SEQ ID NO: 3213164 - DNA, 14 bp, Homo sapiens
gaaggcagacagca

SEQ ID NO: 3213165 - DNA, 13 bp, Homo sapiens
gaaggcagagaaa

SEQ ID NO: 3213166 - DNA, 14 bp, Homo sapiens
gaaggcagagaaat

SEQ ID NO: 3213167 - DNA, 13 bp, Homo sapiens
gaaggcagggcag

SEQ ID NO: 3213168 - DNA, 22 bp, Homo sapiens
gaaggcagggggaaggtggggt

SEQ ID NO: 3213169 - DNA, 16 bp, Homo sapiens
gaaggcagtctgaacc

SEQ ID NO: 3213170 - DNA, 17 bp, Homo sapiens
gaaggcatcagtcccta

SEQ ID NO: 3213171 - DNA, 14 bp, Homo sapiens
gaaggcatgagaaa

SEQ ID NO: 3213172 - DNA, 19 bp, Homo sapiens
gaaggcatttgcagggtcc

SEQ ID NO: 3213173 - DNA, 20 bp, Homo sapiens
gaaggcctccctagccagca

SEQ ID NO: 3213174 - DNA, 20 bp, Homo sapiens
gaaggcctgacttctgctgg

SEQ ID NO: 3213175 - DNA, 16 bp, Homo sapiens
gaaggcctggctggaa

SEQ ID NO: 3213176 - DNA, 22 bp, Homo sapiens
gaaggcctggctggaagagggt

SEQ ID NO: 3213177 - DNA, 12 bp, Homo sapiens
gaaggcgaggag

SEQ ID NO: 3213178 - DNA, 13 bp, Homo sapiens
gaaggctgccaac

SEQ ID NO: 3213179 - DNA, 13 bp, Homo sapiens
gaaggctggctga

SEQ ID NO: 3213180 - DNA, 16 bp, Homo sapiens
gaaggcttgggatttg

SEQ ID NO: 3213181 - DNA, 17 bp, Homo sapiens
gaagggaagaaggggcc

SEQ ID NO: 3213182 - DNA, 18 bp, Homo sapiens
gaagggaagaaggggcca

SEQ ID NO: 3213183 - DNA, 20 bp, Homo sapiens
gaagggaagaaggggccatc

SEQ ID NO: 3213184 - DNA, 19 bp, Homo sapiens
gaagggaatcctcctccag

SEQ ID NO: 3213185 - DNA, 21 bp, Homo sapiens
gaagggaccaaggcaaggcag

SEQ ID NO: 3213186 - DNA, 23 bp, Homo sapiens
gaagggcaggaaggagagcctgc

SEQ ID NO: 3213187 - DNA, 16 bp, Homo sapiens
gaagggcattctttcc

SEQ ID NO: 3213188 - DNA, 19 bp, Homo sapiens
gaagggccagtcctgcctg

SEQ ID NO: 3213189 - DNA, 22 bp, Homo sapiens
gaagggcctgcccagttgcact

SEQ ID NO: 3213190 - DNA, 14 bp, Homo sapiens
gaaggggagtgagc

SEQ ID NO: 3213191 - DNA, 22 bp, Homo sapiens
gaaggggcacaccactgccctg

SEQ ID NO: 3213192 - DNA, 20 bp, Homo sapiens
gatgagatttgccagcacag

SEQ ID NO: 3213193 - DNA, 16 bp, Homo sapiens
gatgagatttttaaaa

SEQ ID NO: 3213194 - DNA, 20 bp, Homo sapiens
gatgagcagaccagctttga

SEQ ID NO: 3213195 - DNA, 20 bp, Homo sapiens
gatgagcccagccctgttct

SEQ ID NO: 3213196 - DNA, 23 bp, Homo sapiens
gatgagccgctgtgagcccctgg

SEQ ID NO: 3213197 - DNA, 22 bp, Homo sapiens
gatgaggagtaaaattcagttt

SEQ ID NO: 3213198 - DNA, 19 bp, Homo sapiens
gatgaggtcagttgtgttt

SEQ ID NO: 3213199 - DNA, 17 bp, Homo sapiens
gatgaggttctgagacc

SEQ ID NO: 3213200 - DNA, 14 bp, Homo sapiens
gatgagttaactgt

SEQ ID NO: 3213201 - DNA, 18 bp, Homo sapiens
gatgagttaactgtgaaa

SEQ ID NO: 3213202 - DNA, 17 bp, Homo sapiens
gatgataacacttaaaa

SEQ ID NO: 3213203 - DNA, 21 bp, Homo sapiens
gatgatacaagattagaagct

SEQ ID NO: 3213204 - DNA, 18 bp, Homo sapiens
gatgatagaggattttat

SEQ ID NO: 3213205 - DNA, 21 bp, Homo sapiens
gatgatctactcagaaatttt

SEQ ID NO: 3213206 - DNA, 14 bp, Homo sapiens
gatgatctttgcag

SEQ ID NO: 3213207 - DNA, 19 bp, Homo sapiens
gattctatagttctagaca

SEQ ID NO: 3213208 - DNA, 21 bp, Homo sapiens
gattctattatatattttata

SEQ ID NO: 3213209 - DNA, 11 bp, Homo sapiens
gattctcagat

SEQ ID NO: 3213210 - DNA, 15 bp, Homo sapiens
gattctcctgcctca

SEQ ID NO: 3213211 - DNA, 17 bp, Homo sapiens
gattctcctgcctcagc

SEQ ID NO: 3213212 - DNA, 18 bp, Homo sapiens
gattctcctgcctcagcc

SEQ ID NO: 3213213 - DNA, 23 bp, Homo sapiens
gattctctggctgtaaggctcta

SEQ ID NO: 3213214 - DNA, 15 bp, Homo sapiens
gattctctgtgtcta

SEQ ID NO: 3213215 - DNA, 23 bp, Homo sapiens
gattctgaaatttttttcctaag

SEQ ID NO: 3213216 - DNA, 16 bp, Homo sapiens
gattctgatttcagtt

SEQ ID NO: 3213217 - DNA, 19 bp, Homo sapiens
gattctgatttcagttttt

SEQ ID NO: 3213218 - DNA, 22 bp, Homo sapiens
gattctgatttcagtttttcat

SEQ ID NO: 3213219 - DNA, 15 bp, Homo sapiens
gattctgatttgtat

SEQ ID NO: 3213220 - DNA, 16 bp, Homo sapiens
gattctgatttgtatt

SEQ ID NO: 3213221 - DNA, 18 bp, Homo sapiens
gattctgcagtaaatctt

SEQ ID NO: 3213222 - DNA, 11 bp, Homo sapiens
gattctgctgg

SEQ ID NO: 3213223 - DNA, 16 bp, Homo sapiens
gattctggctttaagc

SEQ ID NO: 3213224 - DNA, 11 bp, Homo sapiens
gattctgggaa

SEQ ID NO: 3213225 - DNA, 12 bp, Homo sapiens
gattctgggaag

SEQ ID NO: 3213226 - DNA, 22 bp, Homo sapiens
gattctgggaggaagcaggttg

SEQ ID NO: 3213227 - DNA, 22 bp, Homo sapiens
gattctgggaggcaagaaaagg

SEQ ID NO: 3213228 - DNA, 17 bp, Homo sapiens
gattctgggatgctcct

SEQ ID NO: 3213229 - DNA, 17 bp, Homo sapiens
gattctggttccagggt

SEQ ID NO: 3213230 - DNA, 22 bp, Homo sapiens
gattctggttccagggtccctc

SEQ ID NO: 3213231 - DNA, 15 bp, Homo sapiens
gattctgtggaacaa

SEQ ID NO: 3213232 - DNA, 16 bp, Homo sapiens
gattcttcaaaagcat

SEQ ID NO: 3213233 - DNA, 19 bp, Homo sapiens
gattctttaatagaagttt

SEQ ID NO: 3213234 - DNA, 19 bp, Homo sapiens
gattcttttaaattagaaa

SEQ ID NO: 3213235 - DNA, 16 bp, Homo sapiens
gattgaagggtcctgc

SEQ ID NO: 3213236 - DNA, 12 bp, Homo sapiens
gattgagaagcc

SEQ ID NO: 3213237 - DNA, 14 bp, Homo sapiens
gattgagaagccat

SEQ ID NO: 3213238 - DNA, 13 bp, Homo sapiens
gattgagaaggag

SEQ ID NO: 3213239 - DNA, 17 bp, Homo sapiens
gattgaggggccctggc

SEQ ID NO: 3213240 - DNA, 14 bp, Homo sapiens
gattgagtgagggc

SEQ ID NO: 3213241 - DNA, 15 bp, Homo sapiens
gattgatttgaagaa

SEQ ID NO: 3213242 - DNA, 18 bp, Homo sapiens
gattgcaacaggctgggc

SEQ ID NO: 3213243 - DNA, 21 bp, Homo sapiens
gattgcaacaggctgggcttc

SEQ ID NO: 3213244 - DNA, 14 bp, Homo sapiens
gattgcacagaatt

SEQ ID NO: 3213245 - DNA, 15 bp, Homo sapiens
gattgcacagaattt

SEQ ID NO: 3213246 - DNA, 21 bp, Homo sapiens
gattgcagaaaggagagacgt

SEQ ID NO: 3213247 - DNA, 18 bp, Homo sapiens
gattggaagaaacacgtg

SEQ ID NO: 3213248 - DNA, 14 bp, Homo sapiens
gattggacattttc

SEQ ID NO: 3213249 - DNA, 16 bp, Homo sapiens
gattggacggcctgat

SEQ ID NO: 3213250 - DNA, 20 bp, Homo sapiens
gattggcctgtagagttgct

SEQ ID NO: 3213251 - DNA, 19 bp, Homo sapiens
gattgtaaaaataatcagt

SEQ ID NO: 3213252 - DNA, 20 bp, Homo sapiens
gattgtaaaatagcttgtat

SEQ ID NO: 3213253 - DNA, 13 bp, Homo sapiens
gattgtaaacttc

SEQ ID NO: 3213254 - DNA, 16 bp, Homo sapiens
gattgtctcagggccg

SEQ ID NO: 3213255 - DNA, 18 bp, Homo sapiens
gattgtggaaaaccagga

SEQ ID NO: 3213256 - DNA, 18 bp, Homo sapiens
gattgttcgggtgtgcaa

SEQ ID NO: 3213257 - DNA, 13 bp, Homo sapiens
gattgttgtttgc

SEQ ID NO: 3213258 - DNA, 11 bp, Homo sapiens
gattgtttcta

SEQ ID NO: 3213259 - DNA, 18 bp, Homo sapiens
gattgtttctatacaaat

SEQ ID NO: 3213260 - DNA, 12 bp, Homo sapiens
gattgttttatc

SEQ ID NO: 3213261 - DNA, 16 bp, Homo sapiens
gatttaaaagcctgct

SEQ ID NO: 3213262 - DNA, 17 bp, Homo sapiens
gatttaaacacacagat

SEQ ID NO: 3213263 - DNA, 18 bp, Homo sapiens
gatttaacagtcatttaa

SEQ ID NO: 3213264 - DNA, 16 bp, Homo sapiens
gatttaagcacaaact

SEQ ID NO: 3213265 - DNA, 22 bp, Homo sapiens
gatttaagggatggaaaaggaa

SEQ ID NO: 3213266 - DNA, 14 bp, Homo sapiens
gatttaataaaata

SEQ ID NO: 3213267 - DNA, 15 bp, Homo sapiens
gatttaataaaataa

SEQ ID NO: 3213268 - DNA, 19 bp, Homo sapiens
gatttaataaaataattct

SEQ ID NO: 3213269 - DNA, 22 bp, Homo sapiens
gatttaataaaataattctaaa

SEQ ID NO: 3213270 - DNA, 13 bp, Homo sapiens
gatttaatttcca

SEQ ID NO: 3213271 - DNA, 19 bp, Homo sapiens
gatttacatgtatggttac

SEQ ID NO: 3213272 - DNA, 20 bp, Homo sapiens
gatttacccagaatgtcaga

SEQ ID NO: 3213273 - DNA, 21 bp, Homo sapiens
gatttacccagaatgtcagat

SEQ ID NO: 3213274 - DNA, 15 bp, Homo sapiens
gatttaccctttata

SEQ ID NO: 3213275 - DNA, 20 bp, Homo sapiens
gatttacctgttttcgcacc

SEQ ID NO: 3213276 - DNA, 17 bp, Homo sapiens
gatttaccttttctgtt

SEQ ID NO: 3213277 - DNA, 20 bp, Homo sapiens
gatttagaaaaaagtttaca

SEQ ID NO: 3213278 - DNA, 15 bp, Homo sapiens
gatttaggagcagaa

SEQ ID NO: 3213279 - DNA, 16 bp, Homo sapiens
gatttaggagcagaaa

SEQ ID NO: 3213280 - DNA, 20 bp, Homo sapiens
gatttatagtttgtacatgc

SEQ ID NO: 3213281 - DNA, 15 bp, Homo sapiens
gatttatctttatac

SEQ ID NO: 3213282 - DNA, 12 bp, Homo sapiens
gatttatggttt

SEQ ID NO: 3213283 - DNA, 20 bp, Homo sapiens
gatttatttttcagttccaa

SEQ ID NO: 3213284 - DNA, 12 bp, Homo sapiens
gatttcaacata

SEQ ID NO: 3213285 - DNA, 22 bp, Homo sapiens
gatttcaagaaaaaataaatgg

SEQ ID NO: 3213286 - DNA, 15 bp, Homo sapiens
gatttcaagcctgcc

SEQ ID NO: 3213287 - DNA, 16 bp, Homo sapiens
gatttcagaagagact

SEQ ID NO: 3213288 - DNA, 22 bp, Homo sapiens
gatttcaggatactctgtcaga

SEQ ID NO: 3213289 - DNA, 16 bp, Homo sapiens
gatttcatacctcaga

SEQ ID NO: 3213290 - DNA, 23 bp, Homo sapiens
gatttcatacctcagaatgtaaa

SEQ ID NO: 3213291 - DNA, 18 bp, Homo sapiens
gatttcatagttcagaat

SEQ ID NO: 3213292 - DNA, 14 bp, Homo sapiens
gatttcatattgat

SEQ ID NO: 3213293 - DNA, 17 bp, Homo sapiens
gatttcatcttctggaa

SEQ ID NO: 3213294 - DNA, 18 bp, Homo sapiens
gatttcatcttctggaat

SEQ ID NO: 3213295 - DNA, 16 bp, Homo sapiens
gatttcatgctatctc

SEQ ID NO: 3213296 - DNA, 20 bp, Homo sapiens
gatttcatttcaactgtttg

SEQ ID NO: 3213297 - DNA, 21 bp, Homo sapiens
gatttcatttcaactgtttgc

SEQ ID NO: 3213298 - DNA, 17 bp, Homo sapiens
gatttccaggcccctga

SEQ ID NO: 3213299 - DNA, 16 bp, Homo sapiens
gatttccatctctggt

SEQ ID NO: 3213300 - DNA, 14 bp, Homo sapiens
gatttccatttctg

SEQ ID NO: 3213301 - DNA, 15 bp, Homo sapiens
gatttccatttctga

SEQ ID NO: 3213302 - DNA, 17 bp, Homo sapiens
gatttccttgaatgtgg

SEQ ID NO: 3213303 - DNA, 19 bp, Homo sapiens
gatttcgtgggtctgtttt

SEQ ID NO: 3213304 - DNA, 14 bp, Homo sapiens
gatttctaatcaaa

SEQ ID NO: 3213305 - DNA, 17 bp, Homo sapiens
gatttctatggctttca

SEQ ID NO: 3213306 - DNA, 22 bp, Homo sapiens
gatttctcattgacttttataa

SEQ ID NO: 3213307 - DNA, 18 bp, Homo sapiens
gatttctggttctgatgc

SEQ ID NO: 3213308 - DNA, 15 bp, Homo sapiens
gatttcttagagatt

SEQ ID NO: 3213309 - DNA, 12 bp, Homo sapiens
gatttcttaggg

SEQ ID NO: 3213310 - DNA, 15 bp, Homo sapiens
gatttcttcagaatt

SEQ ID NO: 3213311 - DNA, 23 bp, Homo sapiens
gatttctttctttgcaccaaaga

SEQ ID NO: 3213312 - DNA, 16 bp, Homo sapiens
gatttgaaaaatataa

SEQ ID NO: 3213313 - DNA, 18 bp, Homo sapiens
gatttgatgctgtttgac

SEQ ID NO: 3213314 - DNA, 15 bp, Homo sapiens
gatttgatgtgactt

SEQ ID NO: 3213315 - DNA, 19 bp, Homo sapiens
gatttgatgtgactttttt

SEQ ID NO: 3213316 - DNA, 13 bp, Homo sapiens
gatttgcatggat

SEQ ID NO: 3213317 - DNA, 15 bp, Homo sapiens
gatttgcatggattt

SEQ ID NO: 3213318 - DNA, 17 bp, Homo sapiens
gatttgcattgaacaca

SEQ ID NO: 3213319 - DNA, 20 bp, Homo sapiens
gatttgccagcacaggggcc

SEQ ID NO: 3213320 - DNA, 17 bp, Homo sapiens
gatttgcccatttacac

SEQ ID NO: 3213321 - DNA, 20 bp, Homo sapiens
gatttggcttgacaaaggca

SEQ ID NO: 3213322 - DNA, 11 bp, Homo sapiens
gatttgtagca

SEQ ID NO: 3213323 - DNA, 17 bp, Homo sapiens
gatttgtagcactgagg

SEQ ID NO: 3213324 - DNA, 20 bp, Homo sapiens
gatttgtcccagcctggggc

SEQ ID NO: 3213325 - DNA, 16 bp, Homo sapiens
gatttgtgaactggaa

SEQ ID NO: 3213326 - DNA, 19 bp, Homo sapiens
gatttgttaatgatagcta

SEQ ID NO: 3213327 - DNA, 14 bp, Homo sapiens
gatttgttttgaat

SEQ ID NO: 3213328 - DNA, 18 bp, Homo sapiens
gatttgttttgaattttg

SEQ ID NO: 3213329 - DNA, 19 bp, Homo sapiens
gatagtgggatttccagaa

SEQ ID NO: 3213330 - DNA, 23 bp, Homo sapiens
gatagtgggcaccccactgcaat

SEQ ID NO: 3213331 - DNA, 15 bp, Homo sapiens
gatataaaatgtgca

SEQ ID NO: 3213332 - DNA, 12 bp, Homo sapiens
gatataagagaa

SEQ ID NO: 3213333 - DNA, 15 bp, Homo sapiens
gatataagagaagtc

SEQ ID NO: 3213334 - DNA, 19 bp, Homo sapiens
gatataagagaagtctcat

SEQ ID NO: 3213335 - DNA, 20 bp, Homo sapiens
gatataagagaagtctcatt

SEQ ID NO: 3213336 - DNA, 14 bp, Homo sapiens
gatataatgtattt

SEQ ID NO: 3213337 - DNA, 17 bp, Homo sapiens
gatataatgtattttca

SEQ ID NO: 3213338 - DNA, 18 bp, Homo sapiens
gatatacaaagtgtacca

SEQ ID NO: 3213339 - DNA, 17 bp, Homo sapiens
gatatactctagatgaa

SEQ ID NO: 3213340 - DNA, 15 bp, Homo sapiens
gatatactgcagctt

SEQ ID NO: 3213341 - DNA, 14 bp, Homo sapiens
gatatactttgtgg

SEQ ID NO: 3213342 - DNA, 21 bp, Homo sapiens
gatatagttttacttttaaac

SEQ ID NO: 3213343 - DNA, 24 bp, Homo sapiens
gatatagttttacttttaaactgt

SEQ ID NO: 3213344 - DNA, 23 bp, Homo sapiens
gatatatgctctgcatgttacat

SEQ ID NO: 3213345 - DNA, 17 bp, Homo sapiens
gatatattattgtaagt

SEQ ID NO: 3213346 - DNA, 15 bp, Homo sapiens
gatatatttaagcct

SEQ ID NO: 3213347 - DNA, 23 bp, Homo sapiens
gatatatttcacttttgttctgc

SEQ ID NO: 3213348 - DNA, 14 bp, Homo sapiens
gatatattttacaa

SEQ ID NO: 3213349 - DNA, 15 bp, Homo sapiens
gatatccatcttttt

SEQ ID NO: 3213350 - DNA, 21 bp, Homo sapiens
gatatccctgatcctaactga

SEQ ID NO: 3213351 - DNA, 16 bp, Homo sapiens
gatatccttatcagag

SEQ ID NO: 3213352 - DNA, 17 bp, Homo sapiens
gatatctatatttttat

SEQ ID NO: 3213353 - DNA, 22 bp, Homo sapiens
gagggagggggaagtcgaagga

SEQ ID NO: 3213354 - DNA, 13 bp, Homo sapiens
gagggagggggct

SEQ ID NO: 3213355 - DNA, 15 bp, Homo sapiens
gagggaggtgtttaa

SEQ ID NO: 3213356 - DNA, 16 bp, Homo sapiens
gagggagtgacagagg

SEQ ID NO: 3213357 - DNA, 22 bp, Homo sapiens
gagggagtgacagaggcagccc

SEQ ID NO: 3213358 - DNA, 19 bp, Homo sapiens
gagggagtgttcaaaatac

SEQ ID NO: 3213359 - DNA, 15 bp, Homo sapiens
gagggatacaagaga

SEQ ID NO: 3213360 - DNA, 17 bp, Homo sapiens
gagggatgctgcctgag

SEQ ID NO: 3213361 - DNA, 18 bp, Homo sapiens
gagggatgctgctccgcc

SEQ ID NO: 3213362 - DNA, 21 bp, Homo sapiens
gagggattctggttccagggt

SEQ ID NO: 3213363 - DNA, 16 bp, Homo sapiens
gagggattgaggggcc

SEQ ID NO: 3213364 - DNA, 19 bp, Homo sapiens
gagggattggccgcttggc

SEQ ID NO: 3213365 - DNA, 19 bp, Homo sapiens
gagggcacagccctccgac

SEQ ID NO: 3213366 - DNA, 12 bp, Homo sapiens
gagggcactggt

SEQ ID NO: 3213367 - DNA, 16 bp, Homo sapiens
gagggcactggtggcc

SEQ ID NO: 3213368 - DNA, 13 bp, Homo sapiens
gagggcagagcca

SEQ ID NO: 3213369 - DNA, 18 bp, Homo sapiens
gagggcatgcgcacaagg

SEQ ID NO: 3213370 - DNA, 13 bp, Homo sapiens
gagggcccagagc

SEQ ID NO: 3213371 - DNA, 20 bp, Homo sapiens
gagggcccagagcaggaagc

SEQ ID NO: 3213372 - DNA, 14 bp, Homo sapiens
gagggcccagccca

SEQ ID NO: 3213373 - DNA, 12 bp, Homo sapiens
gagggcccagct

SEQ ID NO: 3213374 - DNA, 14 bp, Homo sapiens
gagggcccagctgt

SEQ ID NO: 3213375 - DNA, 20 bp, Homo sapiens
gagggccgtaccccaccctc

SEQ ID NO: 3213376 - DNA, 16 bp, Homo sapiens
gagggcggagccggcc

SEQ ID NO: 3213377 - DNA, 19 bp, Homo sapiens
gagggctcgaggggtgggc

SEQ ID NO: 3213378 - DNA, 13 bp, Homo sapiens
gagggctgccctg

SEQ ID NO: 3213379 - DNA, 16 bp, Homo sapiens
gagggctggaggccca

SEQ ID NO: 3213380 - DNA, 10 bp, Homo sapiens
gagggctggc

SEQ ID NO: 3213381 - DNA, 14 bp, Homo sapiens
gagggctggctggc

SEQ ID NO: 3213382 - DNA, 18 bp, Homo sapiens
gagggctggctggcctca

SEQ ID NO: 3213383 - DNA, 23 bp, Homo sapiens
gaggggaagaaacactttctctt

SEQ ID NO: 3213384 - DNA, 16 bp, Homo sapiens
gaggggaaggggcggt

SEQ ID NO: 3213385 - DNA, 14 bp, Homo sapiens
gaatctataaaaga

SEQ ID NO: 3213386 - DNA, 17 bp, Homo sapiens
gaatctatatttaacaa

SEQ ID NO: 3213387 - DNA, 15 bp, Homo sapiens
gaatctcaaaattag

SEQ ID NO: 3213388 - DNA, 16 bp, Homo sapiens
gaatctcaaataacta

SEQ ID NO: 3213389 - DNA, 16 bp, Homo sapiens
gaatctcaagattcta

SEQ ID NO: 3213390 - DNA, 16 bp, Homo sapiens
gaatctcataattgga

SEQ ID NO: 3213391 - DNA, 18 bp, Homo sapiens
gaatctcccactccagcg

SEQ ID NO: 3213392 - DNA, 14 bp, Homo sapiens
gaatctctgtgcct

SEQ ID NO: 3213393 - DNA, 14 bp, Homo sapiens
gaatctgaatgtaa

SEQ ID NO: 3213394 - DNA, 17 bp, Homo sapiens
gaatctgagctgcaggt

SEQ ID NO: 3213395 - DNA, 17 bp, Homo sapiens
gaatctgatttttatga

SEQ ID NO: 3213396 - DNA, 15 bp, Homo sapiens
gaatctgctgttgcc

SEQ ID NO: 3213397 - DNA, 22 bp, Homo sapiens
gaatctggagaccagggagcct

SEQ ID NO: 3213398 - DNA, 13 bp, Homo sapiens
gaatctgtgcaaa

SEQ ID NO: 3213399 - DNA, 16 bp, Homo sapiens
gaatcttaatttatta

SEQ ID NO: 3213400 - DNA, 20 bp, Homo sapiens
gaatcttctcatcttttatc

SEQ ID NO: 3213401 - DNA, 14 bp, Homo sapiens
gaatcttgtctaac

SEQ ID NO: 3213402 - DNA, 22 bp, Homo sapiens
gaatctttagagaagtatacat

SEQ ID NO: 3213403 - DNA, 23 bp, Homo sapiens
gaatctttagagaagtatacata

SEQ ID NO: 3213404 - DNA, 20 bp, Homo sapiens
gaatctttccaataaaccag

SEQ ID NO: 3213405 - DNA, 14 bp, Homo sapiens
gaatgaaaacattt

SEQ ID NO: 3213406 - DNA, 18 bp, Homo sapiens
gaatgaaaagctgctggt

SEQ ID NO: 3213407 - DNA, 12 bp, Homo sapiens
gaatgaaaataa

SEQ ID NO: 3213408 - DNA, 18 bp, Homo sapiens
gaatgaaaataactgaac

SEQ ID NO: 3213409 - DNA, 22 bp, Homo sapiens
gaatgaaaatgcagtcctgagg

SEQ ID NO: 3213410 - DNA, 15 bp, Homo sapiens
gaatgaaagctgttc

SEQ ID NO: 3213411 - DNA, 14 bp, Homo sapiens
gaatgaaatgtatg

SEQ ID NO: 3213412 - DNA, 18 bp, Homo sapiens
gaatgaaccacatcttgc

SEQ ID NO: 3213413 - DNA, 22 bp, Homo sapiens
gaatgaaccacatcttgctctg

SEQ ID NO: 3213414 - DNA, 23 bp, Homo sapiens
gaatgaaccacatcttgctctgc

SEQ ID NO: 3213415 - DNA, 17 bp, Homo sapiens
gaatgaagcagtatttt

SEQ ID NO: 3213416 - DNA, 15 bp, Homo sapiens
gaatgaatacagcat

SEQ ID NO: 3213417 - DNA, 12 bp, Homo sapiens
gaatgagcccag

SEQ ID NO: 3213418 - DNA, 13 bp, Homo sapiens
gaatgagcccaga

SEQ ID NO: 3213419 - DNA, 20 bp, Homo sapiens
gaatgagcccagagaacagc

SEQ ID NO: 3213420 - DNA, 16 bp, Homo sapiens
gaatgaggaaaattct

SEQ ID NO: 3213421 - DNA, 23 bp, Homo sapiens
gaatgaggaataataagttaaac

SEQ ID NO: 3213422 - DNA, 15 bp, Homo sapiens
gaatgaggtgggagg

SEQ ID NO: 3213423 - DNA, 20 bp, Homo sapiens
gaatgatagcccagaacaaa

SEQ ID NO: 3213424 - DNA, 13 bp, Homo sapiens
gaatgattaatca

SEQ ID NO: 3213425 - DNA, 16 bp, Homo sapiens
gaatgattaatcaaag

SEQ ID NO: 3213426 - DNA, 20 bp, Homo sapiens
gaatgattcatgttatattt

SEQ ID NO: 3213427 - DNA, 22 bp, Homo sapiens
gaatgcaaaattgttttcactt

SEQ ID NO: 3213428 - DNA, 12 bp, Homo sapiens
gaatgcaagagt

SEQ ID NO: 3213429 - DNA, 20 bp, Homo sapiens
gaatgcacaagaatggatca

SEQ ID NO: 3213430 - DNA, 22 bp, Homo sapiens
gaatgcacactagcctctccag

SEQ ID NO: 3213431 - DNA, 17 bp, Homo sapiens
gaatgcacagatatact

SEQ ID NO: 3213432 - DNA, 19 bp, Homo sapiens
gaatgcagattcctgggcc

SEQ ID NO: 3213433 - DNA, 14 bp, Homo sapiens
gaatgcataaataa

SEQ ID NO: 3213434 - DNA, 13 bp, Homo sapiens
gaatgcattcaaa

SEQ ID NO: 3213435 - DNA, 17 bp, Homo sapiens
gaatgcctcctgtgggg

SEQ ID NO: 3213436 - DNA, 18 bp, Homo sapiens
gaatgcctcctgtgggga

SEQ ID NO: 3213437 - DNA, 16 bp, Homo sapiens
gaatgcctcgctccct

SEQ ID NO: 3213438 - DNA, 14 bp, Homo sapiens
gaatgcctgtgcca

SEQ ID NO: 3213439 - DNA, 13 bp, Homo sapiens
gaatgctcccagc

SEQ ID NO: 3213440 - DNA, 16 bp, Homo sapiens
gaatgctcccagctgt

SEQ ID NO: 3213441 - DNA, 17 bp, Homo sapiens
gaatgctctgtgccaga

SEQ ID NO: 3213442 - DNA, 13 bp, Homo sapiens
gaatgctgggact

SEQ ID NO: 3213443 - DNA, 14 bp, Homo sapiens
gaatgctgggactc

SEQ ID NO: 3213444 - DNA, 16 bp, Homo sapiens
gaatgctgggactcag

SEQ ID NO: 3213445 - DNA, 13 bp, Homo sapiens
gaatgctgtgtta

SEQ ID NO: 3213446 - DNA, 14 bp, Homo sapiens
gaatgctgtgttaa

SEQ ID NO: 3213447 - DNA, 12 bp, Homo sapiens
gaatgcttctca

SEQ ID NO: 3213448 - DNA, 21 bp, Homo sapiens
gaatgcttttagtgtgtgcat

SEQ ID NO: 3213449 - DNA, 18 bp, Homo sapiens
gaatgctttttgaatgtt

SEQ ID NO: 3213450 - DNA, 12 bp, Homo sapiens
gaatggaaaaat

SEQ ID NO: 3213451 - DNA, 13 bp, Homo sapiens
gaatggaagcaaa

SEQ ID NO: 3213452 - DNA, 20 bp, Homo sapiens
gaatggaagcaaagtgctgg

SEQ ID NO: 3213453 - DNA, 19 bp, Homo sapiens
gaatggacatcctgtataa

SEQ ID NO: 3213454 - DNA, 14 bp, Homo sapiens
gaatggagcctgct

SEQ ID NO: 3213455 - DNA, 14 bp, Homo sapiens
gaatggatcacaag

SEQ ID NO: 3213456 - DNA, 21 bp, Homo sapiens
gaatggcaatagggtagaatg

SEQ ID NO: 3213457 - DNA, 15 bp, Homo sapiens
gaatggcaggggaag

SEQ ID NO: 3213458 - DNA, 19 bp, Homo sapiens
gaatggcaggggaagcctt

SEQ ID NO: 3213459 - DNA, 23 bp, Homo sapiens
gaatggcaggggaagccttgcac

SEQ ID NO: 3213460 - DNA, 21 bp, Homo sapiens
gaatggcctgccttgaagcca

SEQ ID NO: 3213461 - DNA, 15 bp, Homo sapiens
gaatggctgggtcag

SEQ ID NO: 3213462 - DNA, 20 bp, Homo sapiens
gaatggtacatgtcttccat

SEQ ID NO: 3213463 - DNA, 17 bp, Homo sapiens
gaatggttaataaaact

SEQ ID NO: 3213464 - DNA, 20 bp, Homo sapiens
gaatggttccatgcctgagg

SEQ ID NO: 3213465 - DNA, 22 bp, Homo sapiens
gaatggttccatgcctgagggt

SEQ ID NO: 3213466 - DNA, 14 bp, Homo sapiens
gaatgtaagaaaac

SEQ ID NO: 3213467 - DNA, 13 bp, Homo sapiens
gaatgtaatcaat

SEQ ID NO: 3213468 - DNA, 20 bp, Homo sapiens
gaatgtaatttgtgtaataa

SEQ ID NO: 3213469 - DNA, 15 bp, Homo sapiens
gaatgtagctggttt

SEQ ID NO: 3213470 - DNA, 15 bp, Homo sapiens
gaatgtatcaggaaa

SEQ ID NO: 3213471 - DNA, 16 bp, Homo sapiens
gaatgtatcaggaaat

SEQ ID NO: 3213472 - DNA, 21 bp, Homo sapiens
gacaggcgagagaggagccag

SEQ ID NO: 3213473 - DNA, 17 bp, Homo sapiens
gacaggctcttagcagc

SEQ ID NO: 3213474 - DNA, 16 bp, Homo sapiens
gacagggaagagcaga

SEQ ID NO: 3213475 - DNA, 17 bp, Homo sapiens
gacagggaggacgctct

SEQ ID NO: 3213476 - DNA, 16 bp, Homo sapiens
gacagggaggtgaccc

SEQ ID NO: 3213477 - DNA, 15 bp, Homo sapiens
gacagggcatggcca

SEQ ID NO: 3213478 - DNA, 20 bp, Homo sapiens
gacagggcatggccaggtgg

SEQ ID NO: 3213479 - DNA, 14 bp, Homo sapiens
gacagggccagtgg

SEQ ID NO: 3213480 - DNA, 20 bp, Homo sapiens
gacagggccagtggggcctg

SEQ ID NO: 3213481 - DNA, 22 bp, Homo sapiens
gacagggccagtggggcctgtg

SEQ ID NO: 3213482 - DNA, 15 bp, Homo sapiens
gacagggtaggaaag

SEQ ID NO: 3213483 - DNA, 17 bp, Homo sapiens
gacagggtaggaaaggg

SEQ ID NO: 3213484 - DNA, 17 bp, Homo sapiens
gacagggtttcaccatg

SEQ ID NO: 3213485 - DNA, 14 bp, Homo sapiens
gacaggtaaattaa

SEQ ID NO: 3213486 - DNA, 16 bp, Homo sapiens
gacagtatcccacatc

SEQ ID NO: 3213487 - DNA, 18 bp, Homo sapiens
gacagtatcccacatcca

SEQ ID NO: 3213488 - DNA, 22 bp, Homo sapiens
gacagtatgagtcaatgtgcag

SEQ ID NO: 3213489 - DNA, 23 bp, Homo sapiens
gacagtcactgccactttgcaca

SEQ ID NO: 3213490 - DNA, 17 bp, Homo sapiens
gacagtcatcatcaggg

SEQ ID NO: 3213491 - DNA, 18 bp, Homo sapiens
gacagtcatcatcagggc

SEQ ID NO: 3213492 - DNA, 21 bp, Homo sapiens
gacagtcatcatcagggcctg

SEQ ID NO: 3213493 - DNA, 22 bp, Homo sapiens
gacagtcatcatcagggcctgg

SEQ ID NO: 3213494 - DNA, 14 bp, Homo sapiens
gacagtcctgggag

SEQ ID NO: 3213495 - DNA, 18 bp, Homo sapiens
gacagtcctgggagaacc

SEQ ID NO: 3213496 - DNA, 20 bp, Homo sapiens
gacagtcctttcccaccatt

SEQ ID NO: 3213497 - DNA, 13 bp, Homo sapiens
gacagtcttgtgc

SEQ ID NO: 3213498 - DNA, 19 bp, Homo sapiens
gacagtctttgatcatcat

SEQ ID NO: 3213499 - DNA, 15 bp, Homo sapiens
gacagtgaatttggg

SEQ ID NO: 3213500 - DNA, 15 bp, Homo sapiens
gacagtgatctccat

SEQ ID NO: 3213501 - DNA, 21 bp, Homo sapiens
gacagtgatctccatatgtta

SEQ ID NO: 3213502 - DNA, 12 bp, Homo sapiens
gacagtgccatc

SEQ ID NO: 3213503 - DNA, 14 bp, Homo sapiens
gacagtgccatccc

SEQ ID NO: 3213504 - DNA, 14 bp, Homo sapiens
gacagtgcccatgc

SEQ ID NO: 3213505 - DNA, 13 bp, Homo sapiens
gacagtgcctggg

SEQ ID NO: 3213506 - DNA, 17 bp, Homo sapiens
gacagtgcctgggaatg

SEQ ID NO: 3213507 - DNA, 15 bp, Homo sapiens
gacagtgccttctct

SEQ ID NO: 3213508 - DNA, 17 bp, Homo sapiens
gacagtgcttcagcctg

SEQ ID NO: 3213509 - DNA, 18 bp, Homo sapiens
gacagtgcttcagcctga

SEQ ID NO: 3213510 - DNA, 20 bp, Homo sapiens
gacagtgcttcagcctgagg

SEQ ID NO: 3213511 - DNA, 20 bp, Homo sapiens
gacagtgttccccgatacca

SEQ ID NO: 3213512 - DNA, 21 bp, Homo sapiens
gacagttatactgtcggtttt

SEQ ID NO: 3213513 - DNA, 17 bp, Homo sapiens
gacagttcatatgtacc

SEQ ID NO: 3213514 - DNA, 13 bp, Homo sapiens
gacagttggcaga

SEQ ID NO: 3213515 - DNA, 14 bp, Homo sapiens
gacagttggcagag

SEQ ID NO: 3213516 - DNA, 19 bp, Homo sapiens
gacagtttaccagttgcct

SEQ ID NO: 3213517 - DNA, 12 bp, Homo sapiens
gacagtttctta

SEQ ID NO: 3213518 - DNA, 21 bp, Homo sapiens
gacagtttcttagctttttaa

SEQ ID NO: 3213519 - DNA, 14 bp, Homo sapiens
gacataacgttttt

SEQ ID NO: 3213520 - DNA, 21 bp, Homo sapiens
gacataacgtttttcctttaa

SEQ ID NO: 3213521 - DNA, 23 bp, Homo sapiens
gacataacgtttttcctttaaaa

SEQ ID NO: 3213522 - DNA, 17 bp, Homo sapiens
gacatacgaaacacaaa

SEQ ID NO: 3213523 - DNA, 22 bp, Homo sapiens
gacatactccttccatcaaata

SEQ ID NO: 3213524 - DNA, 15 bp, Homo sapiens
gacatactctctgcc

SEQ ID NO: 3213525 - DNA, 16 bp, Homo sapiens
gacatactctctgcct

SEQ ID NO: 3213526 - DNA, 22 bp, Homo sapiens
gacatactctctgcctggtggt

SEQ ID NO: 3213527 - DNA, 20 bp, Homo sapiens
gacatagatattttcacaat

SEQ ID NO: 3213528 - DNA, 22 bp, Homo sapiens
gacatagcccatccctgcctgg

SEQ ID NO: 3213529 - DNA, 21 bp, Homo sapiens
gacatatgggatattcccaag

SEQ ID NO: 3213530 - DNA, 13 bp, Homo sapiens
gacatattatgcc

SEQ ID NO: 3213531 - DNA, 18 bp, Homo sapiens
gacatcacagcagcctcc

SEQ ID NO: 3213532 - DNA, 15 bp, Homo sapiens
gacatcacttgtaca

SEQ ID NO: 3213533 - DNA, 16 bp, Homo sapiens
gacatcacttgtacaa

SEQ ID NO: 3213534 - DNA, 20 bp, Homo sapiens
gacatcagaggttctttgag

SEQ ID NO: 3213535 - DNA, 18 bp, Homo sapiens
gacatcatgaattttaca

SEQ ID NO: 3213536 - DNA, 12 bp, Homo sapiens
gacatcccttcc

SEQ ID NO: 3213537 - DNA, 15 bp, Homo sapiens
gacatcccttcctgg

SEQ ID NO: 3213538 - DNA, 13 bp, Homo sapiens
gacatcctcttct

SEQ ID NO: 3213539 - DNA, 21 bp, Homo sapiens
gacatcctgtataagcactga

SEQ ID NO: 3213540 - DNA, 17 bp, Homo sapiens
gacatctcaggggccag

SEQ ID NO: 3213541 - DNA, 18 bp, Homo sapiens
gacatctcaggggccaga

SEQ ID NO: 3213542 - DNA, 20 bp, Homo sapiens
gacatctcaggggccagagg

SEQ ID NO: 3213543 - DNA, 23 bp, Homo sapiens
gacatctcctggctaagcctctg

SEQ ID NO: 3213544 - DNA, 18 bp, Homo sapiens
gacatctggaatctggag

SEQ ID NO: 3213545 - DNA, 21 bp, Homo sapiens
gagcccatgttctgcccccag

SEQ ID NO: 3213546 - DNA, 14 bp, Homo sapiens
gagccccacacgga

SEQ ID NO: 3213547 - DNA, 16 bp, Homo sapiens
gagccccacacggagg

SEQ ID NO: 3213548 - DNA, 16 bp, Homo sapiens
gagccccaggcctctg

SEQ ID NO: 3213549 - DNA, 17 bp, Homo sapiens
gagccccaggcctctgt

SEQ ID NO: 3213550 - DNA, 18 bp, Homo sapiens
gagccccaggggggcctc

SEQ ID NO: 3213551 - DNA, 21 bp, Homo sapiens
gagccccaggggggcctcctc

SEQ ID NO: 3213552 - DNA, 14 bp, Homo sapiens
gagccccagggtct

SEQ ID NO: 3213553 - DNA, 14 bp, Homo sapiens
gagcccccaccttg

SEQ ID NO: 3213554 - DNA, 22 bp, Homo sapiens
gagcccccagatagagctgggt

SEQ ID NO: 3213555 - DNA, 20 bp, Homo sapiens
gagcccccagccctgggaac

SEQ ID NO: 3213556 - DNA, 22 bp, Homo sapiens
gagcccccccaacactgtgccc

SEQ ID NO: 3213557 - DNA, 13 bp, Homo sapiens
gagccccgaggcc

SEQ ID NO: 3213558 - DNA, 13 bp, Homo sapiens
gagccccgcagac

SEQ ID NO: 3213559 - DNA, 14 bp, Homo sapiens
gagccccgccctct

SEQ ID NO: 3213560 - DNA, 15 bp, Homo sapiens
gagccccgccctctt

SEQ ID NO: 3213561 - DNA, 21 bp, Homo sapiens
gagcccctcctccagcccctg

SEQ ID NO: 3213562 - DNA, 12 bp, Homo sapiens
gagcccctcctg

SEQ ID NO: 3213563 - DNA, 15 bp, Homo sapiens
gagcccgggctgcct

SEQ ID NO: 3213564 - DNA, 18 bp, Homo sapiens
gagcccgggctgcctggg

SEQ ID NO: 3213565 - DNA, 19 bp, Homo sapiens
gagccctaaccccttccag

SEQ ID NO: 3213566 - DNA, 22 bp, Homo sapiens
gagccctactccctgcagatgc

SEQ ID NO: 3213567 - DNA, 16 bp, Homo sapiens
gagccctcaactattc

SEQ ID NO: 3213568 - DNA, 17 bp, Homo sapiens
gagccctgaccttggct

SEQ ID NO: 3213569 - DNA, 15 bp, Homo sapiens
gagccctgccctgca

SEQ ID NO: 3213570 - DNA, 17 bp, Homo sapiens
gagccctgctgtgggag

SEQ ID NO: 3213571 - DNA, 19 bp, Homo sapiens
gagccctggacacccctgc

SEQ ID NO: 3213572 - DNA, 14 bp, Homo sapiens
gagccctggctggg

SEQ ID NO: 3213573 - DNA, 23 bp, Homo sapiens
gagccctggggactgttccaaag

SEQ ID NO: 3213574 - DNA, 15 bp, Homo sapiens
gagccctggtggcag

SEQ ID NO: 3213575 - DNA, 19 bp, Homo sapiens
gagccctgtggccgccacc

SEQ ID NO: 3213576 - DNA, 22 bp, Homo sapiens
gagccctgtggccgccacctga

SEQ ID NO: 3213577 - DNA, 16 bp, Homo sapiens
gagcccttcactgcca

SEQ ID NO: 3213578 - DNA, 18 bp, Homo sapiens
gagcccttcactgccatg

SEQ ID NO: 3213579 - DNA, 22 bp, Homo sapiens
gagcccttgcctccccatttcc

SEQ ID NO: 3213580 - DNA, 15 bp, Homo sapiens
gagcccttggcccct

SEQ ID NO: 3213581 - DNA, 20 bp, Homo sapiens
gagccgagatcacgccactg

SEQ ID NO: 3213582 - DNA, 21 bp, Homo sapiens
gagccgagattgcaccactgc

SEQ ID NO: 3213583 - DNA, 20 bp, Homo sapiens
gagccggccaccagatgctg

SEQ ID NO: 3213584 - DNA, 22 bp, Homo sapiens
gagccggggagtttctttcctg

SEQ ID NO: 3213585 - DNA, 17 bp, Homo sapiens
gagcctagcggagccca

SEQ ID NO: 3213586 - DNA, 18 bp, Homo sapiens
gagcctagcggagcccag

SEQ ID NO: 3213587 - DNA, 23 bp, Homo sapiens
gagcctagcggagcccagcctgg

SEQ ID NO: 3213588 - DNA, 14 bp, Homo sapiens
gagcctagctcctg

SEQ ID NO: 3213589 - DNA, 15 bp, Homo sapiens
gagcctagctcctgc

SEQ ID NO: 3213590 - DNA, 21 bp, Homo sapiens
gagcctaggaccactcagccc

SEQ ID NO: 3213591 - DNA, 20 bp, Homo sapiens
gagcctcagcatcctggcac

SEQ ID NO: 3213592 - DNA, 20 bp, Homo sapiens
gagcctcggccctagcattg

SEQ ID NO: 3213593 - DNA, 17 bp, Homo sapiens
gagcctgagtcagggcc

SEQ ID NO: 3213594 - DNA, 12 bp, Homo sapiens
gagcctgcagtt

SEQ ID NO: 3213595 - DNA, 15 bp, Homo sapiens
gagcctgcagttatt

SEQ ID NO: 3213596 - DNA, 12 bp, Homo sapiens
gagcctgcctaa

SEQ ID NO: 3213597 - DNA, 23 bp, Homo sapiens
gagcctgcctaaccaggcccagc

SEQ ID NO: 3213598 - DNA, 10 bp, Homo sapiens
gagcctgctg

SEQ ID NO: 3213599 - DNA, 13 bp, Homo sapiens
gagcctgctggca

SEQ ID NO: 3213600 - DNA, 15 bp, Homo sapiens
gagcctgctggcacc

SEQ ID NO: 3213601 - DNA, 23 bp, Homo sapiens
gagcctggctcttgtgctggatg

SEQ ID NO: 3213602 - DNA, 18 bp, Homo sapiens
gagcctgtgcgtcccagc

SEQ ID NO: 3213603 - DNA, 13 bp, Homo sapiens
gagccttcaagtg

SEQ ID NO: 3213604 - DNA, 14 bp, Homo sapiens
gagccttcaagtgc

SEQ ID NO: 3213605 - DNA, 22 bp, Homo sapiens
gagccttcagaatgctcctgag

SEQ ID NO: 3213606 - DNA, 20 bp, Homo sapiens
gagccttgtgagatccttca

SEQ ID NO: 3213607 - DNA, 21 bp, Homo sapiens
gagcgaagggggtcaaaggaa

SEQ ID NO: 3213608 - DNA, 19 bp, Homo sapiens
gagcgagagatcaaagatg

SEQ ID NO: 3213609 - DNA, 13 bp, Homo sapiens
gagcgaggaaagg

SEQ ID NO: 3213610 - DNA, 15 bp, Homo sapiens
gagcgaggaaaggat

SEQ ID NO: 3213611 - DNA, 12 bp, Homo sapiens
gagcgaggaggc

SEQ ID NO: 3213612 - DNA, 21 bp, Homo sapiens
gagcgaggaggcgcggcctcc

SEQ ID NO: 3213613 - DNA, 12 bp, Homo sapiens
gagcgcaagata

SEQ ID NO: 3213614 - DNA, 13 bp, Homo sapiens
gagcgcaagatag

SEQ ID NO: 3213615 - DNA, 20 bp, Homo sapiens
gagcgcacctgccccctggt

SEQ ID NO: 3213616 - DNA, 22 bp, Homo sapiens
gagcgccgtgagttctcagggc

SEQ ID NO: 3213617 - DNA, 19 bp, Homo sapiens
gagcgcctccatccaaggc

SEQ ID NO: 3213618 - DNA, 17 bp, Homo sapiens
gagcgcctgtgcacaca

SEQ ID NO: 3213619 - DNA, 16 bp, Homo sapiens
gagcgcggctggctct

SEQ ID NO: 3213620 - DNA, 17 bp, Homo sapiens
gagcgcggctggctctg

SEQ ID NO: 3213621 - DNA, 20 bp, Homo sapiens
gagcggcgccctggacttgg

SEQ ID NO: 3213622 - DNA, 21 bp, Homo sapiens
gagcggctgctcgcccaggaa

SEQ ID NO: 3213623 - DNA, 13 bp, Homo sapiens
gagcgggaggcag

SEQ ID NO: 3213624 - DNA, 16 bp, Homo sapiens
gagcggtctcaggctg

SEQ ID NO: 3213625 - DNA, 23 bp, Homo sapiens
gagcggtctcaggctggtgggag

SEQ ID NO: 3213626 - DNA, 17 bp, Homo sapiens
gagcggtggccctgtcc

SEQ ID NO: 3213627 - DNA, 23 bp, Homo sapiens
gagcggtggccctgtccctccca

SEQ ID NO: 3213628 - DNA, 20 bp, Homo sapiens
gagcgttagactgacttgtt

SEQ ID NO: 3213629 - DNA, 16 bp, Homo sapiens
gagcgttcccagcagg

SEQ ID NO: 3213630 - DNA, 11 bp, Homo sapiens
gagctaaggct

SEQ ID NO: 3213631 - DNA, 22 bp, Homo sapiens
gagctaagggtgggtgctcaga

SEQ ID NO: 3213632 - DNA, 16 bp, Homo sapiens
gagctagcctgaagga

SEQ ID NO: 3213633 - DNA, 20 bp, Homo sapiens
gagctatgattatgccactg

SEQ ID NO: 3213634 - DNA, 20 bp, Homo sapiens
gagctatggagagaattaaa

SEQ ID NO: 3213635 - DNA, 21 bp, Homo sapiens
gagctcaagcccttggggagg

SEQ ID NO: 3213636 - DNA, 15 bp, Homo sapiens
gagctcaccctgccc

SEQ ID NO: 3213637 - DNA, 22 bp, Homo sapiens
gagctcaccctgcccgctccca

SEQ ID NO: 3213638 - DNA, 13 bp, Homo sapiens
gagctccactctg

SEQ ID NO: 3213639 - DNA, 16 bp, Homo sapiens
gagctccactctgctt

SEQ ID NO: 3213640 - DNA, 21 bp, Homo sapiens
gagctccactctgcttctctg

SEQ ID NO: 3213641 - DNA, 22 bp, Homo sapiens
gagctccccagatctcccactg

SEQ ID NO: 3213642 - DNA, 11 bp, Homo sapiens
gagctcctggc

SEQ ID NO: 3213643 - DNA, 12 bp, Homo sapiens
gagctcctggcc

SEQ ID NO: 3213644 - DNA, 16 bp, Homo sapiens
gagctcctggccagga

SEQ ID NO: 3213645 - DNA, 16 bp, Homo sapiens
gagctctgaaatcttc

SEQ ID NO: 3213646 - DNA, 23 bp, Homo sapiens
gagctctgacccttgggcctggg

SEQ ID NO: 3213647 - DNA, 17 bp, Homo sapiens
gagctctgtatggtcag

SEQ ID NO: 3213648 - DNA, 18 bp, Homo sapiens
gagctctgtatggtcagg

SEQ ID NO: 3213649 - DNA, 17 bp, Homo sapiens
gagctcttcaggcctcc

SEQ ID NO: 3213650 - DNA, 22 bp, Homo sapiens
gagctcttcaggcctccctctc

SEQ ID NO: 3213651 - DNA, 21 bp, Homo sapiens
gagctcttcctatccctctcc

SEQ ID NO: 3213652 - DNA, 14 bp, Homo sapiens
gagctcttggcctt

SEQ ID NO: 3213653 - DNA, 18 bp, Homo sapiens
gagctcttggcctttgca

SEQ ID NO: 3213654 - DNA, 19 bp, Homo sapiens
gagctgacgggaggcccca

SEQ ID NO: 3213655 - DNA, 21 bp, Homo sapiens
gagctgagatcgtgctactgc

SEQ ID NO: 3213656 - DNA, 13 bp, Homo sapiens
gagctgaggactc

SEQ ID NO: 3213657 - DNA, 16 bp, Homo sapiens
gagctgaggactctgc

SEQ ID NO: 3213658 - DNA, 14 bp, Homo sapiens
gagctgaggtttca

SEQ ID NO: 3213659 - DNA, 23 bp, Homo sapiens
gagctgaggtttcacccttaacc

SEQ ID NO: 3213660 - DNA, 15 bp, Homo sapiens
gagctgagtggccag

SEQ ID NO: 3213661 - DNA, 16 bp, Homo sapiens
gagctgatataaattc

SEQ ID NO: 3213662 - DNA, 20 bp, Homo sapiens
gagctgatttccaggcccct

SEQ ID NO: 3213663 - DNA, 21 bp, Homo sapiens
gagctgatttccaggcccctg

SEQ ID NO: 3213664 - DNA, 22 bp, Homo sapiens
gagctgcactgatcacccaatg

SEQ ID NO: 3213665 - DNA, 22 bp, Homo sapiens
gagctgcacttggcctcagctg

SEQ ID NO: 3213666 - DNA, 11 bp, Homo sapiens
gagctgcctgg

SEQ ID NO: 3213667 - DNA, 12 bp, Homo sapiens
gagctgcctgga

SEQ ID NO: 3213668 - DNA, 21 bp, Homo sapiens
gagctgcctggatgagaaaca

SEQ ID NO: 3213669 - DNA, 15 bp, Homo sapiens
gagctgcctgttcag

SEQ ID NO: 3213670 - DNA, 17 bp, Homo sapiens
gcccccttgccctccgc

SEQ ID NO: 3213671 - DNA, 18 bp, Homo sapiens
gccccctttcagatgtct

SEQ ID NO: 3213672 - DNA, 23 bp, Homo sapiens
gccccctttcagatgtcttctgc

SEQ ID NO: 3213673 - DNA, 18 bp, Homo sapiens
gccccgaggccttctctg

SEQ ID NO: 3213674 - DNA, 22 bp, Homo sapiens
gccccgaggccttctctgaagg

SEQ ID NO: 3213675 - DNA, 13 bp, Homo sapiens
gccccgccagggc

SEQ ID NO: 3213676 - DNA, 17 bp, Homo sapiens
gccccgccctcttcctg

SEQ ID NO: 3213677 - DNA, 14 bp, Homo sapiens
gccccgcctccccg

SEQ ID NO: 3213678 - DNA, 13 bp, Homo sapiens
gccccgccttcct

SEQ ID NO: 3213679 - DNA, 19 bp, Homo sapiens
gccccggaggaagcttggg

SEQ ID NO: 3213680 - DNA, 18 bp, Homo sapiens
gccccggatcagagcagg

SEQ ID NO: 3213681 - DNA, 21 bp, Homo sapiens
gccccggatcagagcaggacc

SEQ ID NO: 3213682 - DNA, 22 bp, Homo sapiens
gccccggatcagagcaggacct

SEQ ID NO: 3213683 - DNA, 15 bp, Homo sapiens
gccccggccacctct

SEQ ID NO: 3213684 - DNA, 14 bp, Homo sapiens
gccccggccccagc

SEQ ID NO: 3213685 - DNA, 16 bp, Homo sapiens
gccccggccccagcca

SEQ ID NO: 3213686 - DNA, 18 bp, Homo sapiens
gccccgggcaaagggtct

SEQ ID NO: 3213687 - DNA, 18 bp, Homo sapiens
gccccggtggctgggcag

SEQ ID NO: 3213688 - DNA, 18 bp, Homo sapiens
gcccctaccctggacttg

SEQ ID NO: 3213689 - DNA, 19 bp, Homo sapiens
gcccctagaaacccaagct

SEQ ID NO: 3213690 - DNA, 14 bp, Homo sapiens
gcccctagcccagg

SEQ ID NO: 3213691 - DNA, 19 bp, Homo sapiens
gcccctagcccaggagaga

SEQ ID NO: 3213692 - DNA, 17 bp, Homo sapiens
gcccctaggctgctgct

SEQ ID NO: 3213693 - DNA, 19 bp, Homo sapiens
gcccctcaacagccaagtg

SEQ ID NO: 3213694 - DNA, 13 bp, Homo sapiens
gcccctcagagcc

SEQ ID NO: 3213695 - DNA, 23 bp, Homo sapiens
gcccctccacgcctcctggccag

SEQ ID NO: 3213696 - DNA, 14 bp, Homo sapiens
gcccctccatccac

SEQ ID NO: 3213697 - DNA, 15 bp, Homo sapiens
gcccctcccccaacc

SEQ ID NO: 3213698 - DNA, 16 bp, Homo sapiens
gcccctccccctgcca

SEQ ID NO: 3213699 - DNA, 15 bp, Homo sapiens
gcccctcctccagcc

SEQ ID NO: 3213700 - DNA, 20 bp, Homo sapiens
gcccctcctccagcccctgt

SEQ ID NO: 3213701 - DNA, 21 bp, Homo sapiens
gcccctcctccagcccctgtc

SEQ ID NO: 3213702 - DNA, 15 bp, Homo sapiens
gcccctcgccagctt

SEQ ID NO: 3213703 - DNA, 23 bp, Homo sapiens
gcccctcgccagcttctcctgcg

SEQ ID NO: 3213704 - DNA, 23 bp, Homo sapiens
gcccctcgcctgtggagctcagc

SEQ ID NO: 3213705 - DNA, 14 bp, Homo sapiens
gcccctctcaccaa

SEQ ID NO: 3213706 - DNA, 18 bp, Homo sapiens
gcccctctggtcgctcct

SEQ ID NO: 3213707 - DNA, 20 bp, Homo sapiens
gcccctcttattcctctagg

SEQ ID NO: 3213708 - DNA, 17 bp, Homo sapiens
gcccctgatcactccca

SEQ ID NO: 3213709 - DNA, 13 bp, Homo sapiens
gcccctgcacaaa

SEQ ID NO: 3213710 - DNA, 15 bp, Homo sapiens
gcccctgcagcacgg

SEQ ID NO: 3213711 - DNA, 14 bp, Homo sapiens
gcccctgcatcccc

SEQ ID NO: 3213712 - DNA, 16 bp, Homo sapiens
gcccctgccaccctgg

SEQ ID NO: 3213713 - DNA, 14 bp, Homo sapiens
gcccctgcccggct

SEQ ID NO: 3213714 - DNA, 13 bp, Homo sapiens
gcccctgcctggg

SEQ ID NO: 3213715 - DNA, 16 bp, Homo sapiens
gcccctgcgtggcctg

SEQ ID NO: 3213716 - DNA, 22 bp, Homo sapiens
gcccctgcgtggcctgagtcct

SEQ ID NO: 3213717 - DNA, 23 bp, Homo sapiens
gcccctgcgtggcctgagtcctg

SEQ ID NO: 3213718 - DNA, 12 bp, Homo sapiens
gcccctgctggt

SEQ ID NO: 3213719 - DNA, 20 bp, Homo sapiens
gcccctgctgtcttccccac

SEQ ID NO: 3213720 - DNA, 15 bp, Homo sapiens
gcccctgcttctcca

SEQ ID NO: 3213721 - DNA, 19 bp, Homo sapiens
gcccctggacaagcagagg

SEQ ID NO: 3213722 - DNA, 14 bp, Homo sapiens
gcccctggagccag

SEQ ID NO: 3213723 - DNA, 21 bp, Homo sapiens
gcccctggcagcacagcccag

SEQ ID NO: 3213724 - DNA, 23 bp, Homo sapiens
gcccctggcagcacagcccaggg

SEQ ID NO: 3213725 - DNA, 12 bp, Homo sapiens
gcccctggccca

SEQ ID NO: 3213726 - DNA, 12 bp, Homo sapiens
gcccctgggctt

SEQ ID NO: 3213727 - DNA, 17 bp, Homo sapiens
gcccctggggcctagac

SEQ ID NO: 3213728 - DNA, 18 bp, Homo sapiens
gcccctgtggagactggg

SEQ ID NO: 3213729 - DNA, 16 bp, Homo sapiens
gcccctgtggccaact

SEQ ID NO: 3213730 - DNA, 17 bp, Homo sapiens
gcccctgtggccaactg

SEQ ID NO: 3213731 - DNA, 23 bp, Homo sapiens
gccccttaagggttgaaggcagt

SEQ ID NO: 3213732 - DNA, 22 bp, Homo sapiens
gccccttcctgggtatttattc

SEQ ID NO: 3213733 - DNA, 21 bp, Homo sapiens
gccaggctgctaacctggaaa

SEQ ID NO: 3213734 - DNA, 17 bp, Homo sapiens
gccaggctggtccgagc

SEQ ID NO: 3213735 - DNA, 20 bp, Homo sapiens
gccagggcaatgatgaatga

SEQ ID NO: 3213736 - DNA, 17 bp, Homo sapiens
gccagggcagggccacc

SEQ ID NO: 3213737 - DNA, 17 bp, Homo sapiens
gccagggccctgcagag

SEQ ID NO: 3213738 - DNA, 18 bp, Homo sapiens
gccagggctgccctgaga

SEQ ID NO: 3213739 - DNA, 11 bp, Homo sapiens
gccagggctgg

SEQ ID NO: 3213740 - DNA, 14 bp, Homo sapiens
gccagggctgggga

SEQ ID NO: 3213741 - DNA, 19 bp, Homo sapiens
gccagggctggggacagag

SEQ ID NO: 3213742 - DNA, 21 bp, Homo sapiens
gccagggctggggacagaggg

SEQ ID NO: 3213743 - DNA, 21 bp, Homo sapiens
gccagggggactagcccctgt

SEQ ID NO: 3213744 - DNA, 17 bp, Homo sapiens
gccagggtctctccctc

SEQ ID NO: 3213745 - DNA, 22 bp, Homo sapiens
gccagggtctgtgtgaatgtgg

SEQ ID NO: 3213746 - DNA, 20 bp, Homo sapiens
gccagggtggtcttgatctc

SEQ ID NO: 3213747 - DNA, 15 bp, Homo sapiens
gccaggtaatgtgaa

SEQ ID NO: 3213748 - DNA, 21 bp, Homo sapiens
gccaggtactgcattctctcc

SEQ ID NO: 3213749 - DNA, 22 bp, Homo sapiens
gccaggtactgcattctctccc

SEQ ID NO: 3213750 - DNA, 16 bp, Homo sapiens
gccaggtatggctctg

SEQ ID NO: 3213751 - DNA, 21 bp, Homo sapiens
gccaggtcaccctttgctgtg

SEQ ID NO: 3213752 - DNA, 17 bp, Homo sapiens
gccaggtgagctctgac

SEQ ID NO: 3213753 - DNA, 17 bp, Homo sapiens
gccaggtgaggtccacc

SEQ ID NO: 3213754 - DNA, 18 bp, Homo sapiens
gccaggttcacactcaga

SEQ ID NO: 3213755 - DNA, 23 bp, Homo sapiens
gccaggttctccgttagctcctg

SEQ ID NO: 3213756 - DNA, 13 bp, Homo sapiens
gccaggttttctg

SEQ ID NO: 3213757 - DNA, 17 bp, Homo sapiens
gccaggtttttggtctg

SEQ ID NO: 3213758 - DNA, 22 bp, Homo sapiens
gccagtaacgcgtcttcctgag

SEQ ID NO: 3213759 - DNA, 23 bp, Homo sapiens
gccagtattagactggaagttca

SEQ ID NO: 3213760 - DNA, 16 bp, Homo sapiens
gccagtcctcctggga

SEQ ID NO: 3213761 - DNA, 14 bp, Homo sapiens
gccagtcctgcctg

SEQ ID NO: 3213762 - DNA, 16 bp, Homo sapiens
gccagtcctgcctggc

SEQ ID NO: 3213763 - DNA, 17 bp, Homo sapiens
gccagtcctgcctggcc

SEQ ID NO: 3213764 - DNA, 19 bp, Homo sapiens
gccagtcctgcctggccag

SEQ ID NO: 3213765 - DNA, 16 bp, Homo sapiens
gccagtctgggctgcc

SEQ ID NO: 3213766 - DNA, 13 bp, Homo sapiens
gccagtctgtgga

SEQ ID NO: 3213767 - DNA, 19 bp, Homo sapiens
gccagtcttgcctaggcca

SEQ ID NO: 3213768 - DNA, 20 bp, Homo sapiens
gccagtcttgcctaggccaa

SEQ ID NO: 3213769 - DNA, 15 bp, Homo sapiens
gccagtgaaatgtga

SEQ ID NO: 3213770 - DNA, 14 bp, Homo sapiens
gccagtgaatctgt

SEQ ID NO: 3213771 - DNA, 13 bp, Homo sapiens
gccagtgactttt

SEQ ID NO: 3213772 - DNA, 15 bp, Homo sapiens
gccagtgactttttc

SEQ ID NO: 3213773 - DNA, 19 bp, Homo sapiens
gccagtgactttttctgag

SEQ ID NO: 3213774 - DNA, 14 bp, Homo sapiens
gccagtgcagccac

SEQ ID NO: 3213775 - DNA, 16 bp, Homo sapiens
gccagtgcagccactg

SEQ ID NO: 3213776 - DNA, 18 bp, Homo sapiens
gccagtgcagccactggc

SEQ ID NO: 3213777 - DNA, 18 bp, Homo sapiens
gccagtggaaattcaggt

SEQ ID NO: 3213778 - DNA, 14 bp, Homo sapiens
gccagtggggcctg

SEQ ID NO: 3213779 - DNA, 13 bp, Homo sapiens
gccagtgtctgtc

SEQ ID NO: 3213780 - DNA, 16 bp, Homo sapiens
gccagtgtctgtcccg

SEQ ID NO: 3213781 - DNA, 21 bp, Homo sapiens
gccagtgtctgtcccggggtc

SEQ ID NO: 3213782 - DNA, 12 bp, Homo sapiens
gccagtgtcttt

SEQ ID NO: 3213783 - DNA, 22 bp, Homo sapiens
gccagttcaaagtgtatattta

SEQ ID NO: 3213784 - DNA, 14 bp, Homo sapiens
gccagttgcccaga

SEQ ID NO: 3213785 - DNA, 17 bp, Homo sapiens
gccagttgcccagagca

SEQ ID NO: 3213786 - DNA, 18 bp, Homo sapiens
gccagttgcccagagcac

SEQ ID NO: 3213787 - DNA, 22 bp, Homo sapiens
gccagttggtggggccaggcca

SEQ ID NO: 3213788 - DNA, 18 bp, Homo sapiens
gccataaacggttcctgg

SEQ ID NO: 3213789 - DNA, 22 bp, Homo sapiens
gccataaacggttcctggtgac

SEQ ID NO: 3213790 - DNA, 21 bp, Homo sapiens
gccataaatcagccgcaagga

SEQ ID NO: 3213791 - DNA, 13 bp, Homo sapiens
gccataacttgaa

SEQ ID NO: 3213792 - DNA, 14 bp, Homo sapiens
gccataattttgca

SEQ ID NO: 3213793 - DNA, 16 bp, Homo sapiens
gccatagagtttaaca

SEQ ID NO: 3213794 - DNA, 21 bp, Homo sapiens
gccatagcctccacggagagc

SEQ ID NO: 3213795 - DNA, 16 bp, Homo sapiens
gccatagtcacatggc

SEQ ID NO: 3213796 - DNA, 16 bp, Homo sapiens
gccatataagtttgaa

SEQ ID NO: 3213797 - DNA, 17 bp, Homo sapiens
gccatataagtttgaag

SEQ ID NO: 3213798 - DNA, 21 bp, Homo sapiens
gccatatataacagatacatt

SEQ ID NO: 3213799 - DNA, 18 bp, Homo sapiens
gccatcaaaatgcttttt

SEQ ID NO: 3213800 - DNA, 18 bp, Homo sapiens
gccatcacaggatgccag

SEQ ID NO: 3213801 - DNA, 14 bp, Homo sapiens
gccatcaccgctgg

SEQ ID NO: 3213802 - DNA, 17 bp, Homo sapiens
gccatcaccgctgggtg

SEQ ID NO: 3213803 - DNA, 19 bp, Homo sapiens
gccatccaggttcagcttg

SEQ ID NO: 3213804 - DNA, 20 bp, Homo sapiens
gccatccaggttcagcttgt

SEQ ID NO: 3213805 - DNA, 12 bp, Homo sapiens
gccatccctgtg

SEQ ID NO: 3213806 - DNA, 13 bp, Homo sapiens
gccatccctgtga

SEQ ID NO: 3213807 - DNA, 14 bp, Homo sapiens
gccatccctgtgag

SEQ ID NO: 3213808 - DNA, 23 bp, Homo sapiens
gccatccctttttttacatttca

SEQ ID NO: 3213809 - DNA, 17 bp, Homo sapiens
gccatctcagcttgctg

SEQ ID NO: 3213810 - DNA, 12 bp, Homo sapiens
gccgaggcccag

SEQ ID NO: 3213811 - DNA, 15 bp, Homo sapiens
gccgaggcccagcgg

SEQ ID NO: 3213812 - DNA, 21 bp, Homo sapiens
gccgaggcccagcgggcagat

SEQ ID NO: 3213813 - DNA, 18 bp, Homo sapiens
gccgagggtcctggctcc

SEQ ID NO: 3213814 - DNA, 14 bp, Homo sapiens
gccgagtgctctga

SEQ ID NO: 3213815 - DNA, 13 bp, Homo sapiens
gccgatggaaaat

SEQ ID NO: 3213816 - DNA, 13 bp, Homo sapiens
gccgatggagaca

SEQ ID NO: 3213817 - DNA, 21 bp, Homo sapiens
gccgatggagacaccaaccga

SEQ ID NO: 3213818 - DNA, 17 bp, Homo sapiens
gccgcaagtctgcagcc

SEQ ID NO: 3213819 - DNA, 15 bp, Homo sapiens
gccgcaccctgcacc

SEQ ID NO: 3213820 - DNA, 17 bp, Homo sapiens
gccgcagcctccctctg

SEQ ID NO: 3213821 - DNA, 19 bp, Homo sapiens
gccgcagctcttgcccttc

SEQ ID NO: 3213822 - DNA, 14 bp, Homo sapiens
gccgcaggtgggtg

SEQ ID NO: 3213823 - DNA, 14 bp, Homo sapiens
gccgccaccagccc

SEQ ID NO: 3213824 - DNA, 15 bp, Homo sapiens
gccgccacctgaggt

SEQ ID NO: 3213825 - DNA, 16 bp, Homo sapiens
gccgccacggcctggc

SEQ ID NO: 3213826 - DNA, 17 bp, Homo sapiens
gccgccattgccaccag

SEQ ID NO: 3213827 - DNA, 12 bp, Homo sapiens
gccgccccagcc

SEQ ID NO: 3213828 - DNA, 17 bp, Homo sapiens
gccgccccagccccttc

SEQ ID NO: 3213829 - DNA, 15 bp, Homo sapiens
gccgccccctcctga

SEQ ID NO: 3213830 - DNA, 12 bp, Homo sapiens
gccgccctgggc

SEQ ID NO: 3213831 - DNA, 16 bp, Homo sapiens
gccgccgcgggtgtgc

SEQ ID NO: 3213832 - DNA, 17 bp, Homo sapiens
gccgccggaagtggctc

SEQ ID NO: 3213833 - DNA, 17 bp, Homo sapiens
gccgcctaggctcagcg

SEQ ID NO: 3213834 - DNA, 12 bp, Homo sapiens
gccgcctcccag

SEQ ID NO: 3213835 - DNA, 14 bp, Homo sapiens
gccgcctcccagcc

SEQ ID NO: 3213836 - DNA, 15 bp, Homo sapiens
gccgcctcccagcct

SEQ ID NO: 3213837 - DNA, 17 bp, Homo sapiens
gccgcctcccagcctgg

SEQ ID NO: 3213838 - DNA, 22 bp, Homo sapiens
gccgcctcctcggggctccagg

SEQ ID NO: 3213839 - DNA, 15 bp, Homo sapiens
gccgcctgctccctg

SEQ ID NO: 3213840 - DNA, 17 bp, Homo sapiens
gccgcctgctccctgca

SEQ ID NO: 3213841 - DNA, 14 bp, Homo sapiens
gccgcctgctcctc

SEQ ID NO: 3213842 - DNA, 15 bp, Homo sapiens
gccgcctgctcctca

SEQ ID NO: 3213843 - DNA, 19 bp, Homo sapiens
gccgcctgctcctcactgg

SEQ ID NO: 3213844 - DNA, 19 bp, Homo sapiens
gccgcgctcccctggaagc

SEQ ID NO: 3213845 - DNA, 15 bp, Homo sapiens
gccgcgggacagcca

SEQ ID NO: 3213846 - DNA, 17 bp, Homo sapiens
gccgcgtttagaccaag

SEQ ID NO: 3213847 - DNA, 20 bp, Homo sapiens
gccgcgtttagaccaaggaa

SEQ ID NO: 3213848 - DNA, 15 bp, Homo sapiens
gccgctacctccctc

SEQ ID NO: 3213849 - DNA, 12 bp, Homo sapiens
gccgctccaggg

SEQ ID NO: 3213850 - DNA, 15 bp, Homo sapiens
gccgctccaggggtg

SEQ ID NO: 3213851 - DNA, 16 bp, Homo sapiens
gccgctcctctctaga

SEQ ID NO: 3213852 - DNA, 16 bp, Homo sapiens
gccgctcggaggcccc

SEQ ID NO: 3213853 - DNA, 20 bp, Homo sapiens
gccgctcggaggccccaaag

SEQ ID NO: 3213854 - DNA, 14 bp, Homo sapiens
gccgctgcaccacg

SEQ ID NO: 3213855 - DNA, 20 bp, Homo sapiens
gccgctgcagggctcccatg

SEQ ID NO: 3213856 - DNA, 22 bp, Homo sapiens
gccgctgcagggctcccatggg

SEQ ID NO: 3213857 - DNA, 12 bp, Homo sapiens
gccgctgccacg

SEQ ID NO: 3213858 - DNA, 12 bp, Homo sapiens
gccgctgtgagc

SEQ ID NO: 3213859 - DNA, 17 bp, Homo sapiens
gccgctgtgagcccctg

SEQ ID NO: 3213860 - DNA, 19 bp, Homo sapiens
gccggaaccacagggccag

SEQ ID NO: 3213861 - DNA, 21 bp, Homo sapiens
gccggcaaccccagttctgct

SEQ ID NO: 3213862 - DNA, 22 bp, Homo sapiens
gccggcacccacaagtgccact

SEQ ID NO: 3213863 - DNA, 18 bp, Homo sapiens
gccggccaccagatgctg

SEQ ID NO: 3213864 - DNA, 12 bp, Homo sapiens
gccggcctctct

SEQ ID NO: 3213865 - DNA, 13 bp, Homo sapiens
gccggcctctctg

SEQ ID NO: 3213866 - DNA, 14 bp, Homo sapiens
gccggcctctctgg

SEQ ID NO: 3213867 - DNA, 18 bp, Homo sapiens
gccggcctctctggcctc

SEQ ID NO: 3213868 - DNA, 20 bp, Homo sapiens
gccggcctctctggcctccc

SEQ ID NO: 3213869 - DNA, 17 bp, Homo sapiens
gccggctgtgctcagag

SEQ ID NO: 3213870 - DNA, 18 bp, Homo sapiens
gccggctgtgctcagaga

SEQ ID NO: 3213871 - DNA, 18 bp, Homo sapiens
gccgggcaggtcctgccc

SEQ ID NO: 3213872 - DNA, 19 bp, Homo sapiens
gccgggcaggtcctgccca

SEQ ID NO: 3213873 - DNA, 19 bp, Homo sapiens
gccgggcccctgggcttgg

SEQ ID NO: 3213874 - DNA, 14 bp, Homo sapiens
gccgggcgcggtgg

SEQ ID NO: 3213875 - DNA, 16 bp, Homo sapiens
gccgggcgcggtggct

SEQ ID NO: 3213876 - DNA, 19 bp, Homo sapiens
gccgggcgtggtggcgggc

SEQ ID NO: 3213877 - DNA, 16 bp, Homo sapiens
gccggggaagctgcca

SEQ ID NO: 3213878 - DNA, 13 bp, Homo sapiens
gccgggggagggg

SEQ ID NO: 3213879 - DNA, 18 bp, Homo sapiens
gccgggttctagtctcct

SEQ ID NO: 3213880 - DNA, 20 bp, Homo sapiens
gccggtagaggctccccagg

SEQ ID NO: 3213881 - DNA, 22 bp, Homo sapiens
gccggtcgggcagccagcagag

SEQ ID NO: 3213882 - DNA, 20 bp, Homo sapiens
gccggtctgcaagtcagagg

SEQ ID NO: 3213883 - DNA, 16 bp, Homo sapiens
gccggtgggaccctgt

SEQ ID NO: 3213884 - DNA, 14 bp, Homo sapiens
gccgtaccccaccc

SEQ ID NO: 3213885 - DNA, 16 bp, Homo sapiens
gccgtaccccaccctc

SEQ ID NO: 3213886 - DNA, 19 bp, Homo sapiens
gccgtagggagtacctgct

SEQ ID NO: 3213887 - DNA, 18 bp, Homo sapiens
gcctccgagagggagaga

SEQ ID NO: 3213888 - DNA, 20 bp, Homo sapiens
gcctccgccaagatctacag

SEQ ID NO: 3213889 - DNA, 17 bp, Homo sapiens
gcctccgctggctttgg

SEQ ID NO: 3213890 - DNA, 14 bp, Homo sapiens
gcctccggaagctg

SEQ ID NO: 3213891 - DNA, 20 bp, Homo sapiens
gcctccgtttatgggccttg

SEQ ID NO: 3213892 - DNA, 22 bp, Homo sapiens
gcctccgtttatgggccttgct

SEQ ID NO: 3213893 - DNA, 19 bp, Homo sapiens
gcctcctcacccccagctt

SEQ ID NO: 3213894 - DNA, 12 bp, Homo sapiens
gcctcctcatcc

SEQ ID NO: 3213895 - DNA, 14 bp, Homo sapiens
gcctcctcccccac

SEQ ID NO: 3213896 - DNA, 15 bp, Homo sapiens
gcctcctcccccacc

SEQ ID NO: 3213897 - DNA, 15 bp, Homo sapiens
gcctcctcctgacca

SEQ ID NO: 3213898 - DNA, 21 bp, Homo sapiens
gcctcctcggagagcagcagc

SEQ ID NO: 3213899 - DNA, 18 bp, Homo sapiens
gcctcctcggggctccag

SEQ ID NO: 3213900 - DNA, 20 bp, Homo sapiens
gcctcctctggacggcaggc

SEQ ID NO: 3213901 - DNA, 13 bp, Homo sapiens
gcctcctcttcac

SEQ ID NO: 3213902 - DNA, 15 bp, Homo sapiens
gcctcctgagcctgt

SEQ ID NO: 3213903 - DNA, 16 bp, Homo sapiens
gcctcctgagcctgtg

SEQ ID NO: 3213904 - DNA, 19 bp, Homo sapiens
gcctcctgagcctgtgggt

SEQ ID NO: 3213905 - DNA, 20 bp, Homo sapiens
gcctcctgcccagtccccca

SEQ ID NO: 3213906 - DNA, 12 bp, Homo sapiens
gcctcctgggaa

SEQ ID NO: 3213907 - DNA, 15 bp, Homo sapiens
gcctcctgtacctca

SEQ ID NO: 3213908 - DNA, 16 bp, Homo sapiens
gcctcctgtacctcag

SEQ ID NO: 3213909 - DNA, 16 bp, Homo sapiens
gcctcctgtgtactgt

SEQ ID NO: 3213910 - DNA, 19 bp, Homo sapiens
gcctcctgtgtactgtgtc

SEQ ID NO: 3213911 - DNA, 18 bp, Homo sapiens
gcctcctgttctgcccac

SEQ ID NO: 3213912 - DNA, 16 bp, Homo sapiens
gcctccttccacctcc

SEQ ID NO: 3213913 - DNA, 20 bp, Homo sapiens
gcctccttccttgctgtcct

SEQ ID NO: 3213914 - DNA, 16 bp, Homo sapiens
gcctcgaactggctgc

SEQ ID NO: 3213915 - DNA, 17 bp, Homo sapiens
gcctcgaactggctgca

SEQ ID NO: 3213916 - DNA, 22 bp, Homo sapiens
gcctcgaactggctgcaaaggg

SEQ ID NO: 3213917 - DNA, 13 bp, Homo sapiens
gcctcgaggcacc

SEQ ID NO: 3213918 - DNA, 16 bp, Homo sapiens
gcctcgaggcaccggc

SEQ ID NO: 3213919 - DNA, 22 bp, Homo sapiens
gcctcgaggcaccggcgctgca

SEQ ID NO: 3213920 - DNA, 20 bp, Homo sapiens
gcctcgcctccccaccctcc

SEQ ID NO: 3213921 - DNA, 15 bp, Homo sapiens
gcctcgctcccttca

SEQ ID NO: 3213922 - DNA, 13 bp, Homo sapiens
gcctctcaagtag

SEQ ID NO: 3213923 - DNA, 18 bp, Homo sapiens
gcctctcaagtagctggg

SEQ ID NO: 3213924 - DNA, 13 bp, Homo sapiens
gcctctcacacac

SEQ ID NO: 3213925 - DNA, 18 bp, Homo sapiens
gcctctcatcaactgaat

SEQ ID NO: 3213926 - DNA, 15 bp, Homo sapiens
gcctctcccggctgc

SEQ ID NO: 3213927 - DNA, 16 bp, Homo sapiens
gcctctcccggctgcc

SEQ ID NO: 3213928 - DNA, 20 bp, Homo sapiens
gcctctcccggctgcctgcc

SEQ ID NO: 3213929 - DNA, 18 bp, Homo sapiens
gcctctcccgtcagggcc

SEQ ID NO: 3213930 - DNA, 23 bp, Homo sapiens
gcctctcccgtcagggcccaagt

SEQ ID NO: 3213931 - DNA, 22 bp, Homo sapiens
gcctctcgctcctcaacccctc

SEQ ID NO: 3213932 - DNA, 13 bp, Homo sapiens
gcctctctagcac

SEQ ID NO: 3213933 - DNA, 18 bp, Homo sapiens
gcctctctggcctcccac

SEQ ID NO: 3213934 - DNA, 19 bp, Homo sapiens
gcctctctggcctcccacc

SEQ ID NO: 3213935 - DNA, 23 bp, Homo sapiens
gcctctctggcctcccacccgat

SEQ ID NO: 3213936 - DNA, 16 bp, Homo sapiens
gcctctcttttccccg

SEQ ID NO: 3213937 - DNA, 17 bp, Homo sapiens
gcctctgacacacagct

SEQ ID NO: 3213938 - DNA, 19 bp, Homo sapiens
gcctctgacacacagctct

SEQ ID NO: 3213939 - DNA, 13 bp, Homo sapiens
gcctctgacccct

SEQ ID NO: 3213940 - DNA, 14 bp, Homo sapiens
gcctctgacccctc

SEQ ID NO: 3213941 - DNA, 16 bp, Homo sapiens
gcctctgacccctcct

SEQ ID NO: 3213942 - DNA, 24 bp, Homo sapiens
gcctctgactctgagtccactgct

SEQ ID NO: 3213943 - DNA, 14 bp, Homo sapiens
gcctctgagcccaa

SEQ ID NO: 3213944 - DNA, 18 bp, Homo sapiens
gcctctgatatgggactg

SEQ ID NO: 3213945 - DNA, 19 bp, Homo sapiens
gcctctgatatgggactga

SEQ ID NO: 3213946 - DNA, 12 bp, Homo sapiens
gcctctgcattc

SEQ ID NO: 3213947 - DNA, 22 bp, Homo sapiens
gcctctgcccctcccaacccag

SEQ ID NO: 3213948 - DNA, 12 bp, Homo sapiens
gcctctgcctgt

SEQ ID NO: 3213949 - DNA, 13 bp, Homo sapiens
gcctctgctccct

SEQ ID NO: 3213950 - DNA, 14 bp, Homo sapiens
gcctctgctccctc

SEQ ID NO: 3213951 - DNA, 18 bp, Homo sapiens
gcctctggaggcctctgg

SEQ ID NO: 3213952 - DNA, 22 bp, Homo sapiens
gcctctggaggcctctggccct

SEQ ID NO: 3213953 - DNA, 15 bp, Homo sapiens
gcctctggccaggca

SEQ ID NO: 3213954 - DNA, 13 bp, Homo sapiens
gcctctggccctc

SEQ ID NO: 3213955 - DNA, 17 bp, Homo sapiens
gcctctggccgccaccc

SEQ ID NO: 3213956 - DNA, 19 bp, Homo sapiens
gcctctggccgccaccccc

SEQ ID NO: 3213957 - DNA, 18 bp, Homo sapiens
gcctctggctagaggcca

SEQ ID NO: 3213958 - DNA, 21 bp, Homo sapiens
gcctctggctccacacctcca

SEQ ID NO: 3213959 - DNA, 11 bp, Homo sapiens
gcctctgtgct

SEQ ID NO: 3213960 - DNA, 12 bp, Homo sapiens
gcctctgtgctg

SEQ ID NO: 3213961 - DNA, 15 bp, Homo sapiens
gcctctgtgtccttc

SEQ ID NO: 3213962 - DNA, 18 bp, Homo sapiens
gcctcttaaagctgcctg

SEQ ID NO: 3213963 - DNA, 19 bp, Homo sapiens
gcctcttaaagctgcctgt

SEQ ID NO: 3213964 - DNA, 20 bp, Homo sapiens
gcctcttaaagctgcctgta

SEQ ID NO: 3213965 - DNA, 22 bp, Homo sapiens
gcctcttaaagctgcctgtagt

SEQ ID NO: 3213966 - DNA, 14 bp, Homo sapiens
gcctcttccaccca

SEQ ID NO: 3213967 - DNA, 21 bp, Homo sapiens
gcctcttccagtcttcctgac

SEQ ID NO: 3213968 - DNA, 20 bp, Homo sapiens
gcctcttgagcagtggctgg

SEQ ID NO: 3213969 - DNA, 21 bp, Homo sapiens
gcctcttgagcagtggctggt

SEQ ID NO: 3213970 - DNA, 14 bp, Homo sapiens
gcctcttgtgctca

SEQ ID NO: 3213971 - DNA, 16 bp, Homo sapiens
gcctctttccctagga

SEQ ID NO: 3213972 - DNA, 23 bp, Homo sapiens
gcctcttttcacattttttttct

SEQ ID NO: 3213973 - DNA, 12 bp, Homo sapiens
gcctcttttctc

SEQ ID NO: 3213974 - DNA, 15 bp, Homo sapiens
gcctgaaaaatggga

SEQ ID NO: 3213975 - DNA, 21 bp, Homo sapiens
gcctagcgatctctcctggcc

SEQ ID NO: 3213976 - DNA, 16 bp, Homo sapiens
gcctagcggagcccag

SEQ ID NO: 3213977 - DNA, 17 bp, Homo sapiens
gcctagcggagcccagc

SEQ ID NO: 3213978 - DNA, 20 bp, Homo sapiens
gcctagcggagcccagcctg

SEQ ID NO: 3213979 - DNA, 15 bp, Homo sapiens
gcctagctcctgcca

SEQ ID NO: 3213980 - DNA, 19 bp, Homo sapiens
gcctagctgcctagcaagc

SEQ ID NO: 3213981 - DNA, 17 bp, Homo sapiens
gcctaggaattcccagc

SEQ ID NO: 3213982 - DNA, 19 bp, Homo sapiens
gcctaggaccactcagccc

SEQ ID NO: 3213983 - DNA, 21 bp, Homo sapiens
gcctaggaccactcagcccct

SEQ ID NO: 3213984 - DNA, 11 bp, Homo sapiens
gcctaggagat

SEQ ID NO: 3213985 - DNA, 20 bp, Homo sapiens
gcctaggagatatctgaggg

SEQ ID NO: 3213986 - DNA, 16 bp, Homo sapiens
gcctaggattctaaaa

SEQ ID NO: 3213987 - DNA, 21 bp, Homo sapiens
gcctaggccaaatgcacaagc

SEQ ID NO: 3213988 - DNA, 21 bp, Homo sapiens
gcctaggctaggacgttggcc

SEQ ID NO: 3213989 - DNA, 14 bp, Homo sapiens
gcctaggtgacaga

SEQ ID NO: 3213990 - DNA, 16 bp, Homo sapiens
gcctaggtgcagctcc

SEQ ID NO: 3213991 - DNA, 17 bp, Homo sapiens
gcctaggtgcagctcct

SEQ ID NO: 3213992 - DNA, 22 bp, Homo sapiens
gcctagttcctgtggccaggag

SEQ ID NO: 3213993 - DNA, 21 bp, Homo sapiens
gcctataatgaagctttatac

SEQ ID NO: 3213994 - DNA, 20 bp, Homo sapiens
gcctatcagagttgctgcaa

SEQ ID NO: 3213995 - DNA, 21 bp, Homo sapiens
gcctatgagcatcctgagccc

SEQ ID NO: 3213996 - DNA, 23 bp, Homo sapiens
gcctatgcaaaaagaggatccgt

SEQ ID NO: 3213997 - DNA, 20 bp, Homo sapiens
gcctatgcacatatggactc

SEQ ID NO: 3213998 - DNA, 15 bp, Homo sapiens
gcctattcccacacc

SEQ ID NO: 3213999 - DNA, 15 bp, Homo sapiens
gcctcaaaggcccgc

SEQ ID NO: 3214000 - DNA, 13 bp, Homo sapiens
gcctcaaggactt

SEQ ID NO: 3214001 - DNA, 20 bp, Homo sapiens
gcctcaaggttttaggttct

SEQ ID NO: 3214002 - DNA, 24 bp, Homo sapiens
gcctcaagtgattctcctgcctca

SEQ ID NO: 3214003 - DNA, 15 bp, Homo sapiens
gcctcacccacccct

SEQ ID NO: 3214004 - DNA, 17 bp, Homo sapiens
gcctcacccacccctgc

SEQ ID NO: 3214005 - DNA, 18 bp, Homo sapiens
gcctcacccacccctgca

SEQ ID NO: 3214006 - DNA, 19 bp, Homo sapiens
gcctcactaatttttgtat

SEQ ID NO: 3214007 - DNA, 16 bp, Homo sapiens
gcctcactggctgggg

SEQ ID NO: 3214008 - DNA, 13 bp, Homo sapiens
gcctcactggggg

SEQ ID NO: 3214009 - DNA, 15 bp, Homo sapiens
gcctcactgggggct

SEQ ID NO: 3214010 - DNA, 20 bp, Homo sapiens
gcctcacttgaatgtgtcac

SEQ ID NO: 3214011 - DNA, 13 bp, Homo sapiens
gcctcactttcca

SEQ ID NO: 3214012 - DNA, 23 bp, Homo sapiens
gcctcagaattgatcattttccc

SEQ ID NO: 3214013 - DNA, 16 bp, Homo sapiens
gcctcagaccccaggt

SEQ ID NO: 3214014 - DNA, 11 bp, Homo sapiens
gcctcagagga

SEQ ID NO: 3214015 - DNA, 14 bp, Homo sapiens
gcctcagccctcag

SEQ ID NO: 3214016 - DNA, 22 bp, Homo sapiens
gcctcagcctcccaaagtgctg

SEQ ID NO: 3214017 - DNA, 23 bp, Homo sapiens
gcctcagctacccactatccttc

SEQ ID NO: 3214018 - DNA, 15 bp, Homo sapiens
gcctcagctgcctca

SEQ ID NO: 3214019 - DNA, 13 bp, Homo sapiens
gcctcagctggct

SEQ ID NO: 3214020 - DNA, 15 bp, Homo sapiens
gcctcagctggctgt

SEQ ID NO: 3214021 - DNA, 12 bp, Homo sapiens
gcctcaggctct

SEQ ID NO: 3214022 - DNA, 13 bp, Homo sapiens
gcctcaggctctg

SEQ ID NO: 3214023 - DNA, 16 bp, Homo sapiens
gcctcaggctctgcac

SEQ ID NO: 3214024 - DNA, 12 bp, Homo sapiens
gcctcaggctgc

SEQ ID NO: 3214025 - DNA, 15 bp, Homo sapiens
gcctcagggccagga

SEQ ID NO: 3214026 - DNA, 16 bp, Homo sapiens
gcctcagtatatttaa

SEQ ID NO: 3214027 - DNA, 15 bp, Homo sapiens
gcctcagtcctcccc

SEQ ID NO: 3214028 - DNA, 22 bp, Homo sapiens
gcctcagtcctcccctcacagc

SEQ ID NO: 3214029 - DNA, 24 bp, Homo sapiens
gcctcagtcctcccctcacagcct

SEQ ID NO: 3214030 - DNA, 14 bp, Homo sapiens
gcctcagtggcagc

SEQ ID NO: 3214031 - DNA, 16 bp, Homo sapiens
gcctcagttcaacctg

SEQ ID NO: 3214032 - DNA, 15 bp, Homo sapiens
gcctcagttcccagc

SEQ ID NO: 3214033 - DNA, 23 bp, Homo sapiens
gcctcagttcccagctccccccg

SEQ ID NO: 3214034 - DNA, 19 bp, Homo sapiens
gcctcagtttctccatcag

SEQ ID NO: 3214035 - DNA, 22 bp, Homo sapiens
gcctcagtttctccatcagctt

SEQ ID NO: 3214036 - DNA, 15 bp, Homo sapiens
gcctcatatttaaag

SEQ ID NO: 3214037 - DNA, 14 bp, Homo sapiens
gcctcatccctcgg

SEQ ID NO: 3214038 - DNA, 24 bp, Homo sapiens
gcctcatccctcggaagccgtctg

SEQ ID NO: 3214039 - DNA, 17 bp, Homo sapiens
gcctcatgccacacctt

SEQ ID NO: 3214040 - DNA, 18 bp, Homo sapiens
gcctcatgccacaccttc

SEQ ID NO: 3214041 - DNA, 17 bp, Homo sapiens
gcctcatgcctgctgag

SEQ ID NO: 3214042 - DNA, 15 bp, Homo sapiens
gcctcatgtggctgg

SEQ ID NO: 3214043 - DNA, 17 bp, Homo sapiens
gcctcatgtggctggaa

SEQ ID NO: 3214044 - DNA, 22 bp, Homo sapiens
gcctccaaatgccaacttgtcc

SEQ ID NO: 3214045 - DNA, 22 bp, Homo sapiens
gcctccaacgcccctgtggcca

SEQ ID NO: 3214046 - DNA, 20 bp, Homo sapiens
gcctccaagcctgcctccca

SEQ ID NO: 3214047 - DNA, 15 bp, Homo sapiens
gcctccaagggtttc

SEQ ID NO: 3214048 - DNA, 15 bp, Homo sapiens
gcctccacagcgagg

SEQ ID NO: 3214049 - DNA, 12 bp, Homo sapiens
gcctccaccacc

SEQ ID NO: 3214050 - DNA, 18 bp, Homo sapiens
gcctccaccaccactggc

SEQ ID NO: 3214051 - DNA, 14 bp, Homo sapiens
gcctccacggagag

SEQ ID NO: 3214052 - DNA, 19 bp, Homo sapiens
gcctccagaactcactggg

SEQ ID NO: 3214053 - DNA, 12 bp, Homo sapiens
gcctccagagcc

SEQ ID NO: 3214054 - DNA, 13 bp, Homo sapiens
gcctccagagcca

SEQ ID NO: 3214055 - DNA, 16 bp, Homo sapiens
gcctccagagccagcc

SEQ ID NO: 3214056 - DNA, 24 bp, Homo sapiens
gcctccagagccagcctgggactc

SEQ ID NO: 3214057 - DNA, 18 bp, Homo sapiens
gcgcctggcacatttcag

SEQ ID NO: 3214058 - DNA, 16 bp, Homo sapiens
gcgcctgtgcacacac

SEQ ID NO: 3214059 - DNA, 23 bp, Homo sapiens
gcgcctttccgcggagcccttgg

SEQ ID NO: 3214060 - DNA, 20 bp, Homo sapiens
gcgcgagggcctcaaaggcc

SEQ ID NO: 3214061 - DNA, 17 bp, Homo sapiens
gcgcggaggagctagcc

SEQ ID NO: 3214062 - DNA, 12 bp, Homo sapiens
gcgcggccagcg

SEQ ID NO: 3214063 - DNA, 18 bp, Homo sapiens
gcgcggcctcccgaggag

SEQ ID NO: 3214064 - DNA, 21 bp, Homo sapiens
gcgcggcctcccgaggagggg

SEQ ID NO: 3214065 - DNA, 22 bp, Homo sapiens
gcgcggcctcccgaggaggggc

SEQ ID NO: 3214066 - DNA, 15 bp, Homo sapiens
gcgcggctggctctg

SEQ ID NO: 3214067 - DNA, 20 bp, Homo sapiens
gcgctcagacggcggccagg

SEQ ID NO: 3214068 - DNA, 22 bp, Homo sapiens
gcgctcagacggcggccaggca

SEQ ID NO: 3214069 - DNA, 16 bp, Homo sapiens
gcgctcaggacccagg

SEQ ID NO: 3214070 - DNA, 20 bp, Homo sapiens
gcgctcaggacccaggccct

SEQ ID NO: 3214071 - DNA, 15 bp, Homo sapiens
gcgctcagtaaacgg

SEQ ID NO: 3214072 - DNA, 17 bp, Homo sapiens
gcgctcagtaaacggga

SEQ ID NO: 3214073 - DNA, 16 bp, Homo sapiens
gcgctcccagcctgcc

SEQ ID NO: 3214074 - DNA, 17 bp, Homo sapiens
gcgctcccagcctgccc

SEQ ID NO: 3214075 - DNA, 12 bp, Homo sapiens
gcgctcctcctg

SEQ ID NO: 3214076 - DNA, 13 bp, Homo sapiens
gcgctcctcctgt

SEQ ID NO: 3214077 - DNA, 14 bp, Homo sapiens
gcgctcctcctgtg

SEQ ID NO: 3214078 - DNA, 15 bp, Homo sapiens
gcgctcgcccagcag

SEQ ID NO: 3214079 - DNA, 15 bp, Homo sapiens
gcgctcggcaggaag

SEQ ID NO: 3214080 - DNA, 16 bp, Homo sapiens
gcgctcttggtccctg

SEQ ID NO: 3214081 - DNA, 23 bp, Homo sapiens
gcgctgctcttatgccatttgtt

SEQ ID NO: 3214082 - DNA, 18 bp, Homo sapiens
gcgctgtttttgttgtgt

SEQ ID NO: 3214083 - DNA, 19 bp, Homo sapiens
gcctgaaacagccatgtcc

SEQ ID NO: 3214084 - DNA, 13 bp, Homo sapiens
gcctgacagaaac

SEQ ID NO: 3214085 - DNA, 15 bp, Homo sapiens
gcctgaccccttgct

SEQ ID NO: 3214086 - DNA, 22 bp, Homo sapiens
gcctgaccccttgctcccttca

SEQ ID NO: 3214087 - DNA, 17 bp, Homo sapiens
gcctgacctgagactgt

SEQ ID NO: 3214088 - DNA, 15 bp, Homo sapiens
gcctgaccttccttc

SEQ ID NO: 3214089 - DNA, 20 bp, Homo sapiens
gcctgagagaattggctcaa

SEQ ID NO: 3214090 - DNA, 22 bp, Homo sapiens
gcctgagaggcaggcatagagg

SEQ ID NO: 3214091 - DNA, 13 bp, Homo sapiens
gcctgagagtatt

SEQ ID NO: 3214092 - DNA, 21 bp, Homo sapiens
gcctgagagtatttaggcaga

SEQ ID NO: 3214093 - DNA, 22 bp, Homo sapiens
gcctgagcaacagagtgagacc

SEQ ID NO: 3214094 - DNA, 22 bp, Homo sapiens
gcctgagccctactccctgcag

SEQ ID NO: 3214095 - DNA, 23 bp, Homo sapiens
gcctgagccttagctcccagcta

SEQ ID NO: 3214096 - DNA, 17 bp, Homo sapiens
gcctgagctcactcggc

SEQ ID NO: 3214097 - DNA, 13 bp, Homo sapiens
gcctgagctcctg

SEQ ID NO: 3214098 - DNA, 19 bp, Homo sapiens
gcctgagctcctgctgcgg

SEQ ID NO: 3214099 - DNA, 17 bp, Homo sapiens
gcctgaggcctgtgcct

SEQ ID NO: 3214100 - DNA, 15 bp, Homo sapiens
gcctgaggctgagac

SEQ ID NO: 3214101 - DNA, 18 bp, Homo sapiens
gcctgaggctgagactgc

SEQ ID NO: 3214102 - DNA, 13 bp, Homo sapiens
gcctgaggctggg

SEQ ID NO: 3214103 - DNA, 12 bp, Homo sapiens
gcctgagggtgg

SEQ ID NO: 3214104 - DNA, 15 bp, Homo sapiens
gcctgagggtggaga

SEQ ID NO: 3214105 - DNA, 13 bp, Homo sapiens
gcctgaggtctgt

SEQ ID NO: 3214106 - DNA, 18 bp, Homo sapiens
gcctgaggtctgtacgtt

SEQ ID NO: 3214107 - DNA, 13 bp, Homo sapiens
gcctgagtctcct

SEQ ID NO: 3214108 - DNA, 14 bp, Homo sapiens
gcctgatctcttcc

SEQ ID NO: 3214109 - DNA, 15 bp, Homo sapiens
gcctgatctcttcct

SEQ ID NO: 3214110 - DNA, 17 bp, Homo sapiens
gcctgatctcttcctgt

SEQ ID NO: 3214111 - DNA, 19 bp, Homo sapiens
gcctgatgagatttttaaa

SEQ ID NO: 3214112 - DNA, 14 bp, Homo sapiens
gcctgatgctccct

SEQ ID NO: 3214113 - DNA, 16 bp, Homo sapiens
gcctgatgctgccccg

SEQ ID NO: 3214114 - DNA, 15 bp, Homo sapiens
gcctgatggccaagg

SEQ ID NO: 3214115 - DNA, 16 bp, Homo sapiens
gcctgatggccaaggg

SEQ ID NO: 3214116 - DNA, 18 bp, Homo sapiens
gcctgcaatctgagccag

SEQ ID NO: 3214117 - DNA, 15 bp, Homo sapiens
gcctgcaatttcata

SEQ ID NO: 3214118 - DNA, 16 bp, Homo sapiens
gcctgcacaataaaaa

SEQ ID NO: 3214119 - DNA, 14 bp, Homo sapiens
gcctgcaccaggag

SEQ ID NO: 3214120 - DNA, 10 bp, Homo sapiens
gcctgcagcc

SEQ ID NO: 3214121 - DNA, 17 bp, Homo sapiens
gcctgcagtcctggaag

SEQ ID NO: 3214122 - DNA, 16 bp, Homo sapiens
gcctgcagtcttctgg

SEQ ID NO: 3214123 - DNA, 14 bp, Homo sapiens
gctagttgggcttc

SEQ ID NO: 3214124 - DNA, 16 bp, Homo sapiens
gctagttgggcttcct

SEQ ID NO: 3214125 - DNA, 21 bp, Homo sapiens
gctagttgggcttcctcatag

SEQ ID NO: 3214126 - DNA, 23 bp, Homo sapiens
gctagttttcagctgctcagaat

SEQ ID NO: 3214127 - DNA, 22 bp, Homo sapiens
gctataaattttttgaaacaca

SEQ ID NO: 3214128 - DNA, 13 bp, Homo sapiens
gctataatcatta

SEQ ID NO: 3214129 - DNA, 18 bp, Homo sapiens
gctataatcattagtttt

SEQ ID NO: 3214130 - DNA, 20 bp, Homo sapiens
gctatacacaagcaatgcaa

SEQ ID NO: 3214131 - DNA, 14 bp, Homo sapiens
gctatacacacaca

SEQ ID NO: 3214132 - DNA, 21 bp, Homo sapiens
gctatactgcatactttttaa

SEQ ID NO: 3214133 - DNA, 21 bp, Homo sapiens
gctatagcaaaaatagttaaa

SEQ ID NO: 3214134 - DNA, 16 bp, Homo sapiens
gctatagctacaggaa

SEQ ID NO: 3214135 - DNA, 18 bp, Homo sapiens
gctatagctacaggaagc

SEQ ID NO: 3214136 - DNA, 15 bp, Homo sapiens
gctatatatataaat

SEQ ID NO: 3214137 - DNA, 15 bp, Homo sapiens
gctatatccatgtac

SEQ ID NO: 3214138 - DNA, 15 bp, Homo sapiens
gctatatctatatat

SEQ ID NO: 3214139 - DNA, 19 bp, Homo sapiens
gctatatctatatataatt

SEQ ID NO: 3214140 - DNA, 16 bp, Homo sapiens
gctatcaaaagaaata

SEQ ID NO: 3214141 - DNA, 20 bp, Homo sapiens
gctatcaaaagaaatagaaa

SEQ ID NO: 3214142 - DNA, 23 bp, Homo sapiens
gctatcaaaagaaatagaaaagg

SEQ ID NO: 3214143 - DNA, 19 bp, Homo sapiens
gctatcacctagcagcctc

SEQ ID NO: 3214144 - DNA, 23 bp, Homo sapiens
gctatcagcaatactcatcagag

SEQ ID NO: 3214145 - DNA, 19 bp, Homo sapiens
gctatccccatctccctgc

SEQ ID NO: 3214146 - DNA, 22 bp, Homo sapiens
gctatccccatctccctgcctg

SEQ ID NO: 3214147 - DNA, 14 bp, Homo sapiens
gctatctaaagttt

SEQ ID NO: 3214148 - DNA, 13 bp, Homo sapiens
gctatctctgtgt

SEQ ID NO: 3214149 - DNA, 21 bp, Homo sapiens
gctatggcaagggggtgtcat

SEQ ID NO: 3214150 - DNA, 13 bp, Homo sapiens
gctatgggagccc

SEQ ID NO: 3214151 - DNA, 14 bp, Homo sapiens
gctatgggagcccc

SEQ ID NO: 3214152 - DNA, 19 bp, Homo sapiens
gctatgggagccccagggt

SEQ ID NO: 3214153 - DNA, 15 bp, Homo sapiens
gctatggttgccacc

SEQ ID NO: 3214154 - DNA, 21 bp, Homo sapiens
gctatggttgccaccccaacc

SEQ ID NO: 3214155 - DNA, 16 bp, Homo sapiens
gctattaaaaaagtct

SEQ ID NO: 3214156 - DNA, 13 bp, Homo sapiens
gctattacaaata

SEQ ID NO: 3214157 - DNA, 13 bp, Homo sapiens
gctattagccagg

SEQ ID NO: 3214158 - DNA, 21 bp, Homo sapiens
gctattattttcactgtagaa

SEQ ID NO: 3214159 - DNA, 18 bp, Homo sapiens
gctattcagtaataactc

SEQ ID NO: 3214160 - DNA, 12 bp, Homo sapiens
gctattgttgtg

SEQ ID NO: 3214161 - DNA, 15 bp, Homo sapiens
gctattgttgtgggc

SEQ ID NO: 3214162 - DNA, 13 bp, Homo sapiens
gctatttatgcaa

SEQ ID NO: 3214163 - DNA, 15 bp, Homo sapiens
gctatttattttcct

SEQ ID NO: 3214164 - DNA, 15 bp, Homo sapiens
gctatttcatctatt

SEQ ID NO: 3214165 - DNA, 23 bp, Homo sapiens
gctatttgaagaaaaaaatgtac

SEQ ID NO: 3214166 - DNA, 16 bp, Homo sapiens
gctatttgtgtgtatg

SEQ ID NO: 3214167 - DNA, 23 bp, Homo sapiens
gctatttttcttgttgcatcttt

SEQ ID NO: 3214168 - DNA, 14 bp, Homo sapiens
gctcaaaaggaaac

SEQ ID NO: 3214169 - DNA, 23 bp, Homo sapiens
gctcaaatctattcagacaagca

SEQ ID NO: 3214170 - DNA, 19 bp, Homo sapiens
gctcaactctacccctgct

SEQ ID NO: 3214171 - DNA, 22 bp, Homo sapiens
gctcaatattcctgaatgaaat

SEQ ID NO: 3214172 - DNA, 21 bp, Homo sapiens
gctcaatgcattgtcttgtgg

SEQ ID NO: 3214173 - DNA, 14 bp, Homo sapiens
gctcacaaaccatg

SEQ ID NO: 3214174 - DNA, 22 bp, Homo sapiens
gctcacagtacagcatgtgcct

SEQ ID NO: 3214175 - DNA, 15 bp, Homo sapiens
gctcaccagccccag

SEQ ID NO: 3214176 - DNA, 17 bp, Homo sapiens
gctcaccccatcatccc

SEQ ID NO: 3214177 - DNA, 11 bp, Homo sapiens
gctcacccctg

SEQ ID NO: 3214178 - DNA, 15 bp, Homo sapiens
gctcacccctgggca

SEQ ID NO: 3214179 - DNA, 19 bp, Homo sapiens
gctcacccctgggcaggcg

SEQ ID NO: 3214180 - DNA, 19 bp, Homo sapiens
gctcaccctgcccgctccc

SEQ ID NO: 3214181 - DNA, 16 bp, Homo sapiens
gctcaccgcccatcag

SEQ ID NO: 3214182 - DNA, 17 bp, Homo sapiens
gctcaccgcccatcagg

SEQ ID NO: 3214183 - DNA, 19 bp, Homo sapiens
gctcacctagagccagacc

SEQ ID NO: 3214184 - DNA, 20 bp, Homo sapiens
gctcacctagagccagacca

SEQ ID NO: 3214185 - DNA, 22 bp, Homo sapiens
gctcacgcctatgatcccagca

SEQ ID NO: 3214186 - DNA, 22 bp, Homo sapiens
gctcacgctcccccgcagtccc

SEQ ID NO: 3214187 - DNA, 22 bp, Homo sapiens
gctcacggggcctccaacccat

SEQ ID NO: 3214188 - DNA, 17 bp, Homo sapiens
gctcactgaaacctctg

SEQ ID NO: 3214189 - DNA, 20 bp, Homo sapiens
gctcactgaaacctctgcct

SEQ ID NO: 3214190 - DNA, 11 bp, Homo sapiens
gctcactgcag

SEQ ID NO: 3214191 - DNA, 15 bp, Homo sapiens
gctcactgcagcctc

SEQ ID NO: 3214192 - DNA, 14 bp, Homo sapiens
gctcactgccaggc

SEQ ID NO: 3214193 - DNA, 19 bp, Homo sapiens
gctcactgccaggccagcc

SEQ ID NO: 3214194 - DNA, 13 bp, Homo sapiens
gctcactgttgtg

SEQ ID NO: 3214195 - DNA, 14 bp, Homo sapiens
gctcagaacccagg

SEQ ID NO: 3214196 - DNA, 18 bp, Homo sapiens
gctcagaacccagggctc

SEQ ID NO: 3214197 - DNA, 18 bp, Homo sapiens
gctcagacggcggccagg

SEQ ID NO: 3214198 - DNA, 19 bp, Homo sapiens
gctcagacggcggccaggc

SEQ ID NO: 3214199 - DNA, 19 bp, Homo sapiens
gctcagcaaggggctctgc

SEQ ID NO: 3214200 - DNA, 19 bp, Homo sapiens
gctcagccccgagctgtcc

SEQ ID NO: 3214201 - DNA, 21 bp, Homo sapiens
gctcagccctccctgcccctc

SEQ ID NO: 3214202 - DNA, 21 bp, Homo sapiens
gctcagcggggacagctcctt

SEQ ID NO: 3214203 - DNA, 23 bp, Homo sapiens
gctcagcggggacagctccttct

SEQ ID NO: 3214204 - DNA, 20 bp, Homo sapiens
gctcagctactgatttttgt

SEQ ID NO: 3214205 - DNA, 16 bp, Homo sapiens
gctcagcttcttccta

SEQ ID NO: 3214206 - DNA, 12 bp, Homo sapiens
gctcaggaccca

SEQ ID NO: 3214207 - DNA, 15 bp, Homo sapiens
gctcaggacccaggc

SEQ ID NO: 3214208 - DNA, 15 bp, Homo sapiens
gctcaggaggcgccc

SEQ ID NO: 3214209 - DNA, 13 bp, Homo sapiens
gctcaggaggctt

SEQ ID NO: 3214210 - DNA, 20 bp, Homo sapiens
gctcaggcaagcccctcagc

SEQ ID NO: 3214211 - DNA, 20 bp, Homo sapiens
gctcaggcagctcgaggccc

SEQ ID NO: 3214212 - DNA, 24 bp, Homo sapiens
gctcaggcgatccacctgtctcag

SEQ ID NO: 3214213 - DNA, 13 bp, Homo sapiens
gctcaggctctgc

SEQ ID NO: 3214214 - DNA, 15 bp, Homo sapiens
gctcaggctctgctg

SEQ ID NO: 3214215 - DNA, 16 bp, Homo sapiens
gctcaggctctgctgg

SEQ ID NO: 3214216 - DNA, 23 bp, Homo sapiens
gctcagggccatgctgaggcctg

SEQ ID NO: 3214217 - DNA, 23 bp, Homo sapiens
gctcagggctggagtgcgctctt

SEQ ID NO: 3214218 - DNA, 21 bp, Homo sapiens
gctcaggtcacataaaacttt

SEQ ID NO: 3214219 - DNA, 16 bp, Homo sapiens
gctcaggtgtccctgc

SEQ ID NO: 3214220 - DNA, 18 bp, Homo sapiens
gctcaggtgtccctgcac

SEQ ID NO: 3214221 - DNA, 16 bp, Homo sapiens
gctcagtaatttgagg

SEQ ID NO: 3214222 - DNA, 21 bp, Homo sapiens
gctcagtaatttgaggacaac

SEQ ID NO: 3214223 - DNA, 16 bp, Homo sapiens
gctcagtctccctttc

SEQ ID NO: 3214224 - DNA, 20 bp, Homo sapiens
gctcagtgcttgggctccac

SEQ ID NO: 3214225 - DNA, 16 bp, Homo sapiens
gctcataaaaataaaa

SEQ ID NO: 3214226 - DNA, 21 bp, Homo sapiens
gctcataaaatggaagcaatt

SEQ ID NO: 3214227 - DNA, 20 bp, Homo sapiens
gctcatacaaaataaatggt

SEQ ID NO: 3214228 - DNA, 18 bp, Homo sapiens
gctcatgcatagtcccag

SEQ ID NO: 3214229 - DNA, 19 bp, Homo sapiens
gctcatgcctgtaaccctg

SEQ ID NO: 3214230 - DNA, 22 bp, Homo sapiens
gctcatggcgtaatgggcctgc

SEQ ID NO: 3214231 - DNA, 11 bp, Homo sapiens
gctcatttaag

SEQ ID NO: 3214232 - DNA, 14 bp, Homo sapiens
gctcatttttgctg

SEQ ID NO: 3214233 - DNA, 14 bp, Homo sapiens
gctccaacagaaat

SEQ ID NO: 3214234 - DNA, 18 bp, Homo sapiens
gctccaagacctaggctc

SEQ ID NO: 3214235 - DNA, 22 bp, Homo sapiens
gctccaagacctgttggttcca

SEQ ID NO: 3214236 - DNA, 22 bp, Homo sapiens
gcgtgtgtagagttaagaagct

SEQ ID NO: 3214237 - DNA, 11 bp, Homo sapiens
gcgtgtgtatc

SEQ ID NO: 3214238 - DNA, 12 bp, Homo sapiens
gcgtgtgtatcc

SEQ ID NO: 3214239 - DNA, 22 bp, Homo sapiens
gcgttattggtcggcagccttc

SEQ ID NO: 3214240 - DNA, 16 bp, Homo sapiens
gcgttcctttcttttc

SEQ ID NO: 3214241 - DNA, 14 bp, Homo sapiens
gcgttggagccact

SEQ ID NO: 3214242 - DNA, 21 bp, Homo sapiens
gcgttggagccactcctgtcc

SEQ ID NO: 3214243 - DNA, 15 bp, Homo sapiens
gcgttggtgccactt

SEQ ID NO: 3214244 - DNA, 22 bp, Homo sapiens
gcgtttagtttctagaggcctc

SEQ ID NO: 3214245 - DNA, 20 bp, Homo sapiens
gcgtttcaccatgttggcca

SEQ ID NO: 3214246 - DNA, 18 bp, Homo sapiens
gctaaaaatgagcttgat

SEQ ID NO: 3214247 - DNA, 23 bp, Homo sapiens
gctaaagagcccttgcctcccca

SEQ ID NO: 3214248 - DNA, 21 bp, Homo sapiens
gctaaagataattgctattta

SEQ ID NO: 3214249 - DNA, 13 bp, Homo sapiens
gctaaagccagga

SEQ ID NO: 3214250 - DNA, 16 bp, Homo sapiens
gctaaattctatgtta

SEQ ID NO: 3214251 - DNA, 18 bp, Homo sapiens
gctaaattctatgttaaa

SEQ ID NO: 3214252 - DNA, 19 bp, Homo sapiens
gctaaattctatgttaaat

SEQ ID NO: 3214253 - DNA, 15 bp, Homo sapiens
gctaaatttttaact

SEQ ID NO: 3214254 - DNA, 15 bp, Homo sapiens
gctaacaaactagaa

SEQ ID NO: 3214255 - DNA, 14 bp, Homo sapiens
gctaacaaagacaa

SEQ ID NO: 3214256 - DNA, 14 bp, Homo sapiens
gctaacattttaaa

SEQ ID NO: 3214257 - DNA, 16 bp, Homo sapiens
gctaacgggaggctgg

SEQ ID NO: 3214258 - DNA, 19 bp, Homo sapiens
gctaacgggaggctgggca

SEQ ID NO: 3214259 - DNA, 13 bp, Homo sapiens
gctaactgtaaat

SEQ ID NO: 3214260 - DNA, 14 bp, Homo sapiens
gctaactgtaaatc

SEQ ID NO: 3214261 - DNA, 21 bp, Homo sapiens
gctaagatgagatttgccagc

SEQ ID NO: 3214262 - DNA, 23 bp, Homo sapiens
gctaagatgagatttgccagcac

SEQ ID NO: 3214263 - DNA, 12 bp, Homo sapiens
gctaagcctctg

SEQ ID NO: 3214264 - DNA, 19 bp, Homo sapiens
gctaagctggctctgtttg

SEQ ID NO: 3214265 - DNA, 23 bp, Homo sapiens
gctaaggcccccaaacatagccc

SEQ ID NO: 3214266 - DNA, 22 bp, Homo sapiens
gctaagggtgggtgctcagaat

SEQ ID NO: 3214267 - DNA, 16 bp, Homo sapiens
gctaaggttctaaggc

SEQ ID NO: 3214268 - DNA, 22 bp, Homo sapiens
gctaagtctttcccaatctcta

SEQ ID NO: 3214269 - DNA, 12 bp, Homo sapiens
gctaataaactg

SEQ ID NO: 3214270 - DNA, 19 bp, Homo sapiens
gctaataaactgtattaaa

SEQ ID NO: 3214271 - DNA, 11 bp, Homo sapiens
gctaataaatc

SEQ ID NO: 3214272 - DNA, 14 bp, Homo sapiens
gctaatcagcattc

SEQ ID NO: 3214273 - DNA, 16 bp, Homo sapiens
gctaatcagcattctc

SEQ ID NO: 3214274 - DNA, 15 bp, Homo sapiens
gctaatcagtgtctc

SEQ ID NO: 3214275 - DNA, 18 bp, Homo sapiens
gctaatcagtgtctcaca

SEQ ID NO: 3214276 - DNA, 18 bp, Homo sapiens
gctaatctgtagggctgg

SEQ ID NO: 3214277 - DNA, 22 bp, Homo sapiens
gctaatctgtagggctggacct

SEQ ID NO: 3214278 - DNA, 21 bp, Homo sapiens
gctaatgaagggaaaggatat

SEQ ID NO: 3214279 - DNA, 13 bp, Homo sapiens
gctaatgggacac

SEQ ID NO: 3214280 - DNA, 15 bp, Homo sapiens
gctaatgggacacta

SEQ ID NO: 3214281 - DNA, 13 bp, Homo sapiens
gctaatgtaaact

SEQ ID NO: 3214282 - DNA, 16 bp, Homo sapiens
gctaatttaaagagac

SEQ ID NO: 3214283 - DNA, 13 bp, Homo sapiens
gctaatttgcatt

SEQ ID NO: 3214284 - DNA, 19 bp, Homo sapiens
gctaattttctcaaaagca

SEQ ID NO: 3214285 - DNA, 22 bp, Homo sapiens
gctaattttctcaaaagcattt

SEQ ID NO: 3214286 - DNA, 16 bp, Homo sapiens
gctaatttttcatttt

SEQ ID NO: 3214287 - DNA, 15 bp, Homo sapiens
gctaatttttgtaat

SEQ ID NO: 3214288 - DNA, 18 bp, Homo sapiens
gctaattttttgtacttt

SEQ ID NO: 3214289 - DNA, 19 bp, Homo sapiens
gctacagcaatttctaatt

SEQ ID NO: 3214290 - DNA, 21 bp, Homo sapiens
gctacagctttcttgctccct

SEQ ID NO: 3214291 - DNA, 15 bp, Homo sapiens
gctacaggaggggtc

SEQ ID NO: 3214292 - DNA, 20 bp, Homo sapiens
gctaccaaagcaccttagct

SEQ ID NO: 3214293 - DNA, 19 bp, Homo sapiens
gctaccagtatttagaagc

SEQ ID NO: 3214294 - DNA, 22 bp, Homo sapiens
gctaccagtatttagaagccaa

SEQ ID NO: 3214295 - DNA, 21 bp, Homo sapiens
gctacccaggaggctgaggtg

SEQ ID NO: 3214296 - DNA, 22 bp, Homo sapiens
gctaccccttctttgcagggct

SEQ ID NO: 3214297 - DNA, 19 bp, Homo sapiens
gctacccttttcctttgtg

SEQ ID NO: 3214298 - DNA, 16 bp, Homo sapiens
gctaccctttttctcc

SEQ ID NO: 3214299 - DNA, 18 bp, Homo sapiens
gctaccctttttctccag

SEQ ID NO: 3214300 - DNA, 19 bp, Homo sapiens
gctaccctttttctccagc

SEQ ID NO: 3214301 - DNA, 14 bp, Homo sapiens
gctaccgttgactt

SEQ ID NO: 3214302 - DNA, 14 bp, Homo sapiens
gctacctccctccc

SEQ ID NO: 3214303 - DNA, 14 bp, Homo sapiens
gctacctctctgtc

SEQ ID NO: 3214304 - DNA, 15 bp, Homo sapiens
gctacctctctgtcc

SEQ ID NO: 3214305 - DNA, 21 bp, Homo sapiens
gctacctctctgtcccttgct

SEQ ID NO: 3214306 - DNA, 22 bp, Homo sapiens
gctacctctctgtcccttgctg

SEQ ID NO: 3214307 - DNA, 15 bp, Homo sapiens
gctactataaagaga

SEQ ID NO: 3214308 - DNA, 21 bp, Homo sapiens
gctactataatcaaatgattt

SEQ ID NO: 3214309 - DNA, 15 bp, Homo sapiens
gctactcagaagcct

SEQ ID NO: 3214310 - DNA, 17 bp, Homo sapiens
gctactcagaagcctga

SEQ ID NO: 3214311 - DNA, 20 bp, Homo sapiens
gctactcgggaggctgaggc

SEQ ID NO: 3214312 - DNA, 20 bp, Homo sapiens
gctactctgtccaggccact

SEQ ID NO: 3214313 - DNA, 15 bp, Homo sapiens
gctactggattctta

SEQ ID NO: 3214314 - DNA, 19 bp, Homo sapiens
gctactggcagctcctctc

SEQ ID NO: 3214315 - DNA, 18 bp, Homo sapiens
gctactgtaattttatat

SEQ ID NO: 3214316 - DNA, 12 bp, Homo sapiens
gctactgtctca

SEQ ID NO: 3214317 - DNA, 16 bp, Homo sapiens
gctactgtctttggaa

SEQ ID NO: 3214318 - DNA, 19 bp, Homo sapiens
gctactgttgtaagaattc

SEQ ID NO: 3214319 - DNA, 13 bp, Homo sapiens
gctacttaagaga

SEQ ID NO: 3214320 - DNA, 16 bp, Homo sapiens
gctacttaagagaaat

SEQ ID NO: 3214321 - DNA, 17 bp, Homo sapiens
gctacttaattcctttc

SEQ ID NO: 3214322 - DNA, 23 bp, Homo sapiens
gctacttgcttgaagttttcagt

SEQ ID NO: 3214323 - DNA, 12 bp, Homo sapiens
gctactttccat

SEQ ID NO: 3214324 - DNA, 15 bp, Homo sapiens
gctactttccatttg

SEQ ID NO: 3214325 - DNA, 18 bp, Homo sapiens
gctactttggtttctgtc

SEQ ID NO: 3214326 - DNA, 12 bp, Homo sapiens
gctagaactccc

SEQ ID NO: 3214327 - DNA, 13 bp, Homo sapiens
gctagaactccct

SEQ ID NO: 3214328 - DNA, 16 bp, Homo sapiens
gctagaactccctttc

SEQ ID NO: 3214329 - DNA, 19 bp, Homo sapiens
gctagaacttttttaaata

SEQ ID NO: 3214330 - DNA, 20 bp, Homo sapiens
gctagaacttttttaaataa

SEQ ID NO: 3214331 - DNA, 21 bp, Homo sapiens
gctagaacttttttaaataaa

SEQ ID NO: 3214332 - DNA, 22 bp, Homo sapiens
gctagaacttttttaaataaac

SEQ ID NO: 3214333 - DNA, 21 bp, Homo sapiens
gctagaggccagccccaccca

SEQ ID NO: 3214334 - DNA, 23 bp, Homo sapiens
gctagccaatattaaaagagacc

SEQ ID NO: 3214335 - DNA, 12 bp, Homo sapiens
gctagccagagg

SEQ ID NO: 3214336 - DNA, 19 bp, Homo sapiens
gctagccccagagatgcca

SEQ ID NO: 3214337 - DNA, 22 bp, Homo sapiens
gctagccccagagatgccagcc

SEQ ID NO: 3214338 - DNA, 18 bp, Homo sapiens
gctagcctgaaggattct

SEQ ID NO: 3214339 - DNA, 17 bp, Homo sapiens
gctagcgatttcagacc

SEQ ID NO: 3214340 - DNA, 23 bp, Homo sapiens
gctagcttctgcttttctgccct

SEQ ID NO: 3214341 - DNA, 21 bp, Homo sapiens
gctagcttgacacagtcagca

SEQ ID NO: 3214342 - DNA, 21 bp, Homo sapiens
gctagcttttaggaaaatcac

SEQ ID NO: 3214343 - DNA, 20 bp, Homo sapiens
gctaggaagagcaggactcc

SEQ ID NO: 3214344 - DNA, 20 bp, Homo sapiens
gctaggacccctccatgtgg

SEQ ID NO: 3214345 - DNA, 17 bp, Homo sapiens
gctaggacgttggcctc

SEQ ID NO: 3214346 - DNA, 18 bp, Homo sapiens
gcaggactccaggcccaa

SEQ ID NO: 3214347 - DNA, 22 bp, Homo sapiens
gcaggactccaggcccaaggct

SEQ ID NO: 3214348 - DNA, 19 bp, Homo sapiens
gcaggactttgaggcaagt

SEQ ID NO: 3214349 - DNA, 20 bp, Homo sapiens
gcaggagaatcactgcagcc

SEQ ID NO: 3214350 - DNA, 17 bp, Homo sapiens
gcaggagaggctgggct

SEQ ID NO: 3214351 - DNA, 19 bp, Homo sapiens
gcaggagattgagaaggag

SEQ ID NO: 3214352 - DNA, 20 bp, Homo sapiens
gcaggagcatcctctgctgg

SEQ ID NO: 3214353 - DNA, 12 bp, Homo sapiens
gcaggagcgtga

SEQ ID NO: 3214354 - DNA, 21 bp, Homo sapiens
gcaggaggatcacttgaggcc

SEQ ID NO: 3214355 - DNA, 18 bp, Homo sapiens
gcaggagggccctacctg

SEQ ID NO: 3214356 - DNA, 17 bp, Homo sapiens
gcaggagtaataaattt

SEQ ID NO: 3214357 - DNA, 16 bp, Homo sapiens
gcaggagtctctgcca

SEQ ID NO: 3214358 - DNA, 21 bp, Homo sapiens
gcaggagtctctgccacccac

SEQ ID NO: 3214359 - DNA, 18 bp, Homo sapiens
gcaggagtggtgcagaca

SEQ ID NO: 3214360 - DNA, 19 bp, Homo sapiens
gcaggagtggtgcagacag

SEQ ID NO: 3214361 - DNA, 17 bp, Homo sapiens
gcaggagtgtcctgccc

SEQ ID NO: 3214362 - DNA, 18 bp, Homo sapiens
gcaggcaaaaaagggaca

SEQ ID NO: 3214363 - DNA, 20 bp, Homo sapiens
gcaggcaaaaaagggacagc

SEQ ID NO: 3214364 - DNA, 19 bp, Homo sapiens
gcaggcaatgctgtacttt

SEQ ID NO: 3214365 - DNA, 17 bp, Homo sapiens
gcaggcacacagcagcc

SEQ ID NO: 3214366 - DNA, 18 bp, Homo sapiens
gcaggcacacagcagccc

SEQ ID NO: 3214367 - DNA, 19 bp, Homo sapiens
gcaggcacacagcagcccc

SEQ ID NO: 3214368 - DNA, 19 bp, Homo sapiens
gcaggcatgcttctcaccg

SEQ ID NO: 3214369 - DNA, 16 bp, Homo sapiens
gcaggcattgaggaag

SEQ ID NO: 3214370 - DNA, 18 bp, Homo sapiens
gcaggcattgaggaagag

SEQ ID NO: 3214371 - DNA, 20 bp, Homo sapiens
gcaggccaagagcagaggca

SEQ ID NO: 3214372 - DNA, 13 bp, Homo sapiens
gcaggccctgcag

SEQ ID NO: 3214373 - DNA, 12 bp, Homo sapiens
gcaggccctggc

SEQ ID NO: 3214374 - DNA, 16 bp, Homo sapiens
gcaggccctggcctcc

SEQ ID NO: 3214375 - DNA, 19 bp, Homo sapiens
gcaggccctttgaagcctc

SEQ ID NO: 3214376 - DNA, 17 bp, Homo sapiens
gcaggccggaaccacag

SEQ ID NO: 3214377 - DNA, 20 bp, Homo sapiens
gcaggccggaaccacagggc

SEQ ID NO: 3214378 - DNA, 21 bp, Homo sapiens
gcaggcctccaacgcccctgt

SEQ ID NO: 3214379 - DNA, 22 bp, Homo sapiens
gcaggcctccaacgcccctgtg

SEQ ID NO: 3214380 - DNA, 13 bp, Homo sapiens
gcaggcctgggac

SEQ ID NO: 3214381 - DNA, 14 bp, Homo sapiens
gcaggcctgggacc

SEQ ID NO: 3214382 - DNA, 20 bp, Homo sapiens
gcaggcggggggggcgcctg

SEQ ID NO: 3214383 - DNA, 23 bp, Homo sapiens
gcaggcggggggggcgcctggag

SEQ ID NO: 3214384 - DNA, 16 bp, Homo sapiens
gcaggcgtgactcagc

SEQ ID NO: 3214385 - DNA, 15 bp, Homo sapiens
gcaggctcactgcca

SEQ ID NO: 3214386 - DNA, 12 bp, Homo sapiens
gcaggctctggg

SEQ ID NO: 3214387 - DNA, 19 bp, Homo sapiens
gcaggctctgggctcaggg

SEQ ID NO: 3214388 - DNA, 20 bp, Homo sapiens
gcaggctctgggctcagggc

SEQ ID NO: 3214389 - DNA, 21 bp, Homo sapiens
gcaggctctgggctcagggct

SEQ ID NO: 3214390 - DNA, 20 bp, Homo sapiens
gcaggctggaggtaaggcct

SEQ ID NO: 3214391 - DNA, 11 bp, Homo sapiens
gcaggctgggc

SEQ ID NO: 3214392 - DNA, 12 bp, Homo sapiens
gcaggctgggcc

SEQ ID NO: 3214393 - DNA, 15 bp, Homo sapiens
gcaggctgggccatg

SEQ ID NO: 3214394 - DNA, 18 bp, Homo sapiens
gcaggcttaataaaaatg

SEQ ID NO: 3214395 - DNA, 22 bp, Homo sapiens
gcaggcttaataaaaatgacag

SEQ ID NO: 3214396 - DNA, 14 bp, Homo sapiens
gcagggaagagggc

SEQ ID NO: 3214397 - DNA, 19 bp, Homo sapiens
gcagggaaggacaggaccc

SEQ ID NO: 3214398 - DNA, 16 bp, Homo sapiens
gcagggaaggcctgac

SEQ ID NO: 3214399 - DNA, 14 bp, Homo sapiens
gcagggagggcagt

SEQ ID NO: 3214400 - DNA, 18 bp, Homo sapiens
gcagggagggcagttttc

SEQ ID NO: 3214401 - DNA, 14 bp, Homo sapiens
gcagggaggggagg

SEQ ID NO: 3214402 - DNA, 20 bp, Homo sapiens
gcagggaggggaggcagatg

SEQ ID NO: 3214403 - DNA, 20 bp, Homo sapiens
gcagggaggtcaggccctgg

SEQ ID NO: 3214404 - DNA, 20 bp, Homo sapiens
gcagggatgggggtggctgg

SEQ ID NO: 3214405 - DNA, 21 bp, Homo sapiens
gcagggatgggggtggctggg

SEQ ID NO: 3214406 - DNA, 19 bp, Homo sapiens
gcagggattaacctctgca

SEQ ID NO: 3214407 - DNA, 22 bp, Homo sapiens
gcagggattaacctctgcacta

SEQ ID NO: 3214408 - DNA, 23 bp, Homo sapiens
gcagggcaaatgacatgcactga

SEQ ID NO: 3214409 - DNA, 12 bp, Homo sapiens
gcagggcagcag

SEQ ID NO: 3214410 - DNA, 15 bp, Homo sapiens
gcagggcagccccac

SEQ ID NO: 3214411 - DNA, 22 bp, Homo sapiens
gcagggcatctcctgtgcatgg

SEQ ID NO: 3214412 - DNA, 19 bp, Homo sapiens
gcagggccaccccactcta

SEQ ID NO: 3214413 - DNA, 15 bp, Homo sapiens
gcagggccaggactg

SEQ ID NO: 3214414 - DNA, 12 bp, Homo sapiens
gcagggccaggc

SEQ ID NO: 3214415 - DNA, 18 bp, Homo sapiens
gcagggccatctgactgc

SEQ ID NO: 3214416 - DNA, 14 bp, Homo sapiens
gcagggcccacgtg

SEQ ID NO: 3214417 - DNA, 20 bp, Homo sapiens
gcagggcccacgtgtatagt

SEQ ID NO: 3214418 - DNA, 21 bp, Homo sapiens
gcagggcccttggggctgggg

SEQ ID NO: 3214419 - DNA, 12 bp, Homo sapiens
gcagggctcagc

SEQ ID NO: 3214420 - DNA, 13 bp, Homo sapiens
gcagggctcagga

SEQ ID NO: 3214421 - DNA, 13 bp, Homo sapiens
gcagggctggccc

SEQ ID NO: 3214422 - DNA, 13 bp, Homo sapiens
gcaggggcctgga

SEQ ID NO: 3214423 - DNA, 20 bp, Homo sapiens
gcaggggcctggagatcctc

SEQ ID NO: 3214424 - DNA, 13 bp, Homo sapiens
gcaggggctctgg

SEQ ID NO: 3214425 - DNA, 14 bp, Homo sapiens
gcaggggctctgga

SEQ ID NO: 3214426 - DNA, 22 bp, Homo sapiens
gcaggggggctgtgccaacctg

SEQ ID NO: 3214427 - DNA, 17 bp, Homo sapiens
gcaggggtcagagcact

SEQ ID NO: 3214428 - DNA, 19 bp, Homo sapiens
gcaggggtcagtgcagcag

SEQ ID NO: 3214429 - DNA, 22 bp, Homo sapiens
gcaggggtcagtgcagcagagg

SEQ ID NO: 3214430 - DNA, 15 bp, Homo sapiens
gcaggggtccctgct

SEQ ID NO: 3214431 - DNA, 21 bp, Homo sapiens
gcaggggtgggggtggaggct

SEQ ID NO: 3214432 - DNA, 23 bp, Homo sapiens
gcaggggtgggggtggaggcttc

SEQ ID NO: 3214433 - DNA, 13 bp, Homo sapiens
gcaggggtggtgg

SEQ ID NO: 3214434 - DNA, 20 bp, Homo sapiens
gcaggggtggtggagggggc

SEQ ID NO: 3214435 - DNA, 15 bp, Homo sapiens
gcaggggttgcagtg

SEQ ID NO: 3214436 - DNA, 21 bp, Homo sapiens
gcagggtcccatttctcactg

SEQ ID NO: 3214437 - DNA, 21 bp, Homo sapiens
gcagggtcctcttctgggcct

SEQ ID NO: 3214438 - DNA, 17 bp, Homo sapiens
gcagggtctcactctgt

SEQ ID NO: 3214439 - DNA, 19 bp, Homo sapiens
gcagggtctgtttggactg

SEQ ID NO: 3214440 - DNA, 18 bp, Homo sapiens
gcaggtacttcctcctga

SEQ ID NO: 3214441 - DNA, 23 bp, Homo sapiens
gcaggtagatcgcttgagcccag

SEQ ID NO: 3214442 - DNA, 19 bp, Homo sapiens
gcaggtagccagggggact

SEQ ID NO: 3214443 - DNA, 14 bp, Homo sapiens
gcaggtcctgccca

SEQ ID NO: 3214444 - DNA, 15 bp, Homo sapiens
gcaggtcctgcccat

SEQ ID NO: 3214445 - DNA, 21 bp, Homo sapiens
gcaggtcctgcccatgtgtcc

SEQ ID NO: 3214446 - DNA, 18 bp, Homo sapiens
gcaggtgattggaccagg

SEQ ID NO: 3214447 - DNA, 21 bp, Homo sapiens
gcaggtgattggaccaggcca

SEQ ID NO: 3214448 - DNA, 15 bp, Homo sapiens
gcaggtgcagatggg

SEQ ID NO: 3214449 - DNA, 18 bp, Homo sapiens
gcaggtgcagatgggctg

SEQ ID NO: 3214450 - DNA, 15 bp, Homo sapiens
gcaggtgcctccagg

SEQ ID NO: 3214451 - DNA, 21 bp, Homo sapiens
gcaggtgcctccaggtgtgca

SEQ ID NO: 3214452 - DNA, 12 bp, Homo sapiens
gcaggtgggcag

SEQ ID NO: 3214453 - DNA, 14 bp, Homo sapiens
gcaggtgggcagac

SEQ ID NO: 3214454 - DNA, 14 bp, Homo sapiens
gcaggtgggtgctg

SEQ ID NO: 3214455 - DNA, 22 bp, Homo sapiens
gcaggtgggtgctgccctgtgt

SEQ ID NO: 3214456 - DNA, 21 bp, Homo sapiens
gcaggtggtggcactgagccc

SEQ ID NO: 3214457 - DNA, 23 bp, Homo sapiens
gcaggtggtggcactgagccccc

SEQ ID NO: 3214458 - DNA, 13 bp, Homo sapiens
gcaggtgtcatat

SEQ ID NO: 3214459 - DNA, 14 bp, Homo sapiens
gcaggtgtcctttc

SEQ ID NO: 3214460 - DNA, 19 bp, Homo sapiens
gcaggtgtcctttcccctc

SEQ ID NO: 3214461 - DNA, 18 bp, Homo sapiens
gcaggtgtggtggctcat

SEQ ID NO: 3214462 - DNA, 19 bp, Homo sapiens
gcaggtgtggtggctcatg

SEQ ID NO: 3214463 - DNA, 15 bp, Homo sapiens
gcaggttccccaagg

SEQ ID NO: 3214464 - DNA, 23 bp, Homo sapiens
gcaggttccccaagggccctggc

SEQ ID NO: 3214465 - DNA, 16 bp, Homo sapiens
gcaggttgaggggctc

SEQ ID NO: 3214466 - DNA, 14 bp, Homo sapiens
gcagtaaaaactgt

SEQ ID NO: 3214467 - DNA, 14 bp, Homo sapiens
gcagtaaagagaaa

SEQ ID NO: 3214468 - DNA, 15 bp, Homo sapiens
gcagtaaagagaaac

SEQ ID NO: 3214469 - DNA, 13 bp, Homo sapiens
gcagtaataaaaa

SEQ ID NO: 3214470 - DNA, 16 bp, Homo sapiens
gcagtacctataaagt

SEQ ID NO: 3214471 - DNA, 14 bp, Homo sapiens
gcagtacctgggaa

SEQ ID NO: 3214472 - DNA, 18 bp, Homo sapiens
gcagtacctgggaaagga

SEQ ID NO: 3214473 - DNA, 13 bp, Homo sapiens
gcagtaggggagg

SEQ ID NO: 3214474 - DNA, 17 bp, Homo sapiens
gcagtagtttggtttga

SEQ ID NO: 3214475 - DNA, 17 bp, Homo sapiens
gcagtcaccaccacccg

SEQ ID NO: 3214476 - DNA, 20 bp, Homo sapiens
gcagtcactgggagaggtta

SEQ ID NO: 3214477 - DNA, 16 bp, Homo sapiens
gcagtcagatttttaa

SEQ ID NO: 3214478 - DNA, 14 bp, Homo sapiens
gcagtcatctactt

SEQ ID NO: 3214479 - DNA, 22 bp, Homo sapiens
gcagtcccagtattctcagagc

SEQ ID NO: 3214480 - DNA, 23 bp, Homo sapiens
gcagtcccattcatattaagaca

SEQ ID NO: 3214481 - DNA, 16 bp, Homo sapiens
gcagtccccagccctt

SEQ ID NO: 3214482 - DNA, 17 bp, Homo sapiens
gcagtccccagcccttc

SEQ ID NO: 3214483 - DNA, 23 bp, Homo sapiens
gcagtccctgagaccatttaaca

SEQ ID NO: 3214484 - DNA, 12 bp, Homo sapiens
gcagtccgcagt

SEQ ID NO: 3214485 - DNA, 17 bp, Homo sapiens
gcagtcctgaggagagg

SEQ ID NO: 3214486 - DNA, 18 bp, Homo sapiens
gcagtcctgcctcagcct

SEQ ID NO: 3214487 - DNA, 21 bp, Homo sapiens
gcagtcgcaggatccgctgcc

SEQ ID NO: 3214488 - DNA, 22 bp, Homo sapiens
gcagtcgcaggatccgctgcca

SEQ ID NO: 3214489 - DNA, 16 bp, Homo sapiens
gcagtcgggggctggc

SEQ ID NO: 3214490 - DNA, 20 bp, Homo sapiens
gcagtcgggggctggcctag

SEQ ID NO: 3214491 - DNA, 21 bp, Homo sapiens
gcagtcgggggctggcctagg

SEQ ID NO: 3214492 - DNA, 22 bp, Homo sapiens
gcagtcgtcgcacagtctctct

SEQ ID NO: 3214493 - DNA, 13 bp, Homo sapiens
gcagtcgtgcctg

SEQ ID NO: 3214494 - DNA, 18 bp, Homo sapiens
gcagtcgtgcctgtgtcc

SEQ ID NO: 3214495 - DNA, 21 bp, Homo sapiens
gcagtcgtgtaattggcccaa

SEQ ID NO: 3214496 - DNA, 16 bp, Homo sapiens
gcagtctccttcagca

SEQ ID NO: 3214497 - DNA, 18 bp, Homo sapiens
gcagtctccttcagcacg

SEQ ID NO: 3214498 - DNA, 14 bp, Homo sapiens
gcagtctctatatt

SEQ ID NO: 3214499 - DNA, 20 bp, Homo sapiens
gcagtctctatattatgtct

SEQ ID NO: 3214500 - DNA, 13 bp, Homo sapiens
gcagtctgaaccc

SEQ ID NO: 3214501 - DNA, 18 bp, Homo sapiens
gcagtctgaacccttgtg

SEQ ID NO: 3214502 - DNA, 16 bp, Homo sapiens
gcagtctggcctgggc

SEQ ID NO: 3214503 - DNA, 15 bp, Homo sapiens
gcagtcttctgggct

SEQ ID NO: 3214504 - DNA, 17 bp, Homo sapiens
gcagtcttctgggctgc

SEQ ID NO: 3214505 - DNA, 12 bp, Homo sapiens
gcagtcttgctc

SEQ ID NO: 3214506 - DNA, 14 bp, Homo sapiens
gcagtcttgctctg

SEQ ID NO: 3214507 - DNA, 16 bp, Homo sapiens
gcagtgaaaaatatgt

SEQ ID NO: 3214508 - DNA, 14 bp, Homo sapiens
gcagtgaactattt

SEQ ID NO: 3214509 - DNA, 21 bp, Homo sapiens
gcagtgaattgtgaccaagtt

SEQ ID NO: 3214510 - DNA, 19 bp, Homo sapiens
gcagtgacacaatctcggc

SEQ ID NO: 3214511 - DNA, 14 bp, Homo sapiens
gcagtgactggcag

SEQ ID NO: 3214512 - DNA, 15 bp, Homo sapiens
gcagtgactggcagg

SEQ ID NO: 3214513 - DNA, 18 bp, Homo sapiens
gcagtgactggcaggtgc

SEQ ID NO: 3214514 - DNA, 15 bp, Homo sapiens
gcagtgactttgtat

SEQ ID NO: 3214515 - DNA, 22 bp, Homo sapiens
gcagtgagaaaaagctcctgtc

SEQ ID NO: 3214516 - DNA, 14 bp, Homo sapiens
gcagtgagcggaga

SEQ ID NO: 3214517 - DNA, 13 bp, Homo sapiens
gcagtgcatgtga

SEQ ID NO: 3214518 - DNA, 20 bp, Homo sapiens
gcagtgcatgtgaagcatgc

SEQ ID NO: 3214519 - DNA, 12 bp, Homo sapiens
gcagtgccaccc

SEQ ID NO: 3214520 - DNA, 18 bp, Homo sapiens
gcagtgcccatgtgtaca

SEQ ID NO: 3214521 - DNA, 19 bp, Homo sapiens
gcagtgcccatgtgtacat

SEQ ID NO: 3214522 - DNA, 17 bp, Homo sapiens
gcagtgcctcgaggcac

SEQ ID NO: 3214523 - DNA, 19 bp, Homo sapiens
gcagtgcctcgaggcaccg

SEQ ID NO: 3214524 - DNA, 23 bp, Homo sapiens
gcagtgccttggggaatttcctc

SEQ ID NO: 3214525 - DNA, 22 bp, Homo sapiens
gcagtgctagtgagctgggcat

SEQ ID NO: 3214526 - DNA, 14 bp, Homo sapiens
gcagtgctgggacc

SEQ ID NO: 3214527 - DNA, 14 bp, Homo sapiens
gcagtggaggtggg

SEQ ID NO: 3214528 - DNA, 16 bp, Homo sapiens
gcagtggcaggggagc

SEQ ID NO: 3214529 - DNA, 19 bp, Homo sapiens
gcagtggcgcattctaggc

SEQ ID NO: 3214530 - DNA, 22 bp, Homo sapiens
gcagtggcttttcatggccctt

SEQ ID NO: 3214531 - DNA, 11 bp, Homo sapiens
gcagtgggagc

SEQ ID NO: 3214532 - DNA, 18 bp, Homo sapiens
gcagtgggagctgcctgt

SEQ ID NO: 3214533 - DNA, 21 bp, Homo sapiens
gcagtggtgcgatctgggttc

SEQ ID NO: 3214534 - DNA, 14 bp, Homo sapiens
gcagtgtgcccccc

SEQ ID NO: 3214535 - DNA, 20 bp, Homo sapiens
gcagtgttccccatctgggt

SEQ ID NO: 3214536 - DNA, 16 bp, Homo sapiens
gcagtgttcgcttggc

SEQ ID NO: 3214537 - DNA, 17 bp, Homo sapiens
gcagttagctgaagaat

SEQ ID NO: 3214538 - DNA, 22 bp, Homo sapiens
gcagttagctgaagaattgaaa

SEQ ID NO: 3214539 - DNA, 20 bp, Homo sapiens
gcagttataacagatgtgaa

SEQ ID NO: 3214540 - DNA, 21 bp, Homo sapiens
gcagttataacagatgtgaaa

SEQ ID NO: 3214541 - DNA, 19 bp, Homo sapiens
gcagttcagcaccacccta

SEQ ID NO: 3214542 - DNA, 23 bp, Homo sapiens
gcagttcccccaacctcagactt

SEQ ID NO: 3214543 - DNA, 15 bp, Homo sapiens
gcagttctcactcct

SEQ ID NO: 3214544 - DNA, 12 bp, Homo sapiens
gcagttctgtta

SEQ ID NO: 3214545 - DNA, 16 bp, Homo sapiens
gcagttgactttctcc

SEQ ID NO: 3214546 - DNA, 23 bp, Homo sapiens
gcagtttttcaggagcgcaagat

SEQ ID NO: 3214547 - DNA, 12 bp, Homo sapiens
gcagttttttga

SEQ ID NO: 3214548 - DNA, 13 bp, Homo sapiens
gcataaaacagct

SEQ ID NO: 3214549 - DNA, 12 bp, Homo sapiens
gcataaactgtt

SEQ ID NO: 3214550 - DNA, 19 bp, Homo sapiens
gcataaagctcaaatgaaa

SEQ ID NO: 3214551 - DNA, 18 bp, Homo sapiens
gcataaataaaactgaat

SEQ ID NO: 3214552 - DNA, 19 bp, Homo sapiens
gcataaataaaactgaatc

SEQ ID NO: 3214553 - DNA, 15 bp, Homo sapiens
gcataaatatgcagt

SEQ ID NO: 3214554 - DNA, 19 bp, Homo sapiens
gcataacctgtctcacctg

SEQ ID NO: 3214555 - DNA, 18 bp, Homo sapiens
gcataagattaaaggaag

SEQ ID NO: 3214556 - DNA, 23 bp, Homo sapiens
gcataagattaaaggaaggaaaa

SEQ ID NO: 3214557 - DNA, 14 bp, Homo sapiens
gcataataagctaa

SEQ ID NO: 3214558 - DNA, 13 bp, Homo sapiens
gcataatgctttg

SEQ ID NO: 3214559 - DNA, 21 bp, Homo sapiens
gcataattttgtgttgtacaa

SEQ ID NO: 3214560 - DNA, 17 bp, Homo sapiens
gcatacacacatgccct

SEQ ID NO: 3214561 - DNA, 21 bp, Homo sapiens
gcatacacacatgccctcctg

SEQ ID NO: 3214562 - DNA, 14 bp, Homo sapiens
gcataccacttgaa

SEQ ID NO: 3214563 - DNA, 23 bp, Homo sapiens
gcataccaggttttacacttgca

SEQ ID NO: 3214564 - DNA, 22 bp, Homo sapiens
gcatactgagccaagtataatt

SEQ ID NO: 3214565 - DNA, 23 bp, Homo sapiens
gcatactgagccaagtataattt

SEQ ID NO: 3214566 - DNA, 16 bp, Homo sapiens
gcatactttgtaaata

SEQ ID NO: 3214567 - DNA, 15 bp, Homo sapiens
gcatagacatggatg

SEQ ID NO: 3214568 - DNA, 20 bp, Homo sapiens
gcatagactgaggtataaag

SEQ ID NO: 3214569 - DNA, 13 bp, Homo sapiens
gcatagagccctg

SEQ ID NO: 3214570 - DNA, 23 bp, Homo sapiens
gcatagatgttttggtagattaa

SEQ ID NO: 3214571 - DNA, 19 bp, Homo sapiens
gcatagcagaggggccagg

SEQ ID NO: 3214572 - DNA, 24 bp, Homo sapiens
gcatagcagaggggccaggcccag

SEQ ID NO: 3214573 - DNA, 15 bp, Homo sapiens
gcatagctctggggt

SEQ ID NO: 3214574 - DNA, 22 bp, Homo sapiens
gcataggcctgggtgctggctg

SEQ ID NO: 3214575 - DNA, 12 bp, Homo sapiens
gcatagtgctgg

SEQ ID NO: 3214576 - DNA, 18 bp, Homo sapiens
gcatatccaccacctccc

SEQ ID NO: 3214577 - DNA, 15 bp, Homo sapiens
gcatatcctgagcca

SEQ ID NO: 3214578 - DNA, 12 bp, Homo sapiens
gcatatgttgaa

SEQ ID NO: 3214579 - DNA, 14 bp, Homo sapiens
gcatatgttgaata

SEQ ID NO: 3214580 - DNA, 19 bp, Homo sapiens
gcatatgttgaatactttt

SEQ ID NO: 3214581 - DNA, 15 bp, Homo sapiens
gcatattctattgta

SEQ ID NO: 3214582 - DNA, 23 bp, Homo sapiens
gcatatttatccaaaatgtgtat

SEQ ID NO: 3214583 - DNA, 23 bp, Homo sapiens
gcatatttattgcattgctggta

SEQ ID NO: 3214584 - DNA, 19 bp, Homo sapiens
gcatatttgccaataaagc

SEQ ID NO: 3214585 - DNA, 14 bp, Homo sapiens
gcatattttgctgg

SEQ ID NO: 3214586 - DNA, 23 bp, Homo sapiens
gcatcaagaggtgggagggccct

SEQ ID NO: 3214587 - DNA, 21 bp, Homo sapiens
gcatcaaggtcagcatgagga

SEQ ID NO: 3214588 - DNA, 19 bp, Homo sapiens
gcatcaatacaaccagccc

SEQ ID NO: 3214589 - DNA, 17 bp, Homo sapiens
gcatcacagggcagagc

SEQ ID NO: 3214590 - DNA, 21 bp, Homo sapiens
gcatcacagggcagagccggg

SEQ ID NO: 3214591 - DNA, 13 bp, Homo sapiens
gcatcacctcagg

SEQ ID NO: 3214592 - DNA, 15 bp, Homo sapiens
gcatcacctcaggcc

SEQ ID NO: 3214593 - DNA, 17 bp, Homo sapiens
gcatcacctcaggccag

SEQ ID NO: 3214594 - DNA, 20 bp, Homo sapiens
gcatcactccccaaggaaga

SEQ ID NO: 3214595 - DNA, 18 bp, Homo sapiens
gcatcactgggtgttgat

SEQ ID NO: 3214596 - DNA, 14 bp, Homo sapiens
gcatcaggcactgg

SEQ ID NO: 3214597 - DNA, 12 bp, Homo sapiens
gcatcagggtta

SEQ ID NO: 3214598 - DNA, 19 bp, Homo sapiens
gcatcagtccctatgtatt

SEQ ID NO: 3214599 - DNA, 15 bp, Homo sapiens
gcatcagttctacgg

SEQ ID NO: 3214600 - DNA, 14 bp, Homo sapiens
gcatcatctgtaga

SEQ ID NO: 3214601 - DNA, 14 bp, Homo sapiens
gcatcatggtggat

SEQ ID NO: 3214602 - DNA, 15 bp, Homo sapiens
gcatccaatctcaag

SEQ ID NO: 3214603 - DNA, 17 bp, Homo sapiens
gcatccacccagtgctg

SEQ ID NO: 3214604 - DNA, 19 bp, Homo sapiens
gcatccacccagtgctgcc

SEQ ID NO: 3214605 - DNA, 20 bp, Homo sapiens
gcatccaccttggctctgcc

SEQ ID NO: 3214606 - DNA, 12 bp, Homo sapiens
gcatccagcctg

SEQ ID NO: 3214607 - DNA, 13 bp, Homo sapiens
gcatccagcctgt

SEQ ID NO: 3214608 - DNA, 14 bp, Homo sapiens
gcatccagcctgtg

SEQ ID NO: 3214609 - DNA, 17 bp, Homo sapiens
gcatccagcctgtgtgt

SEQ ID NO: 3214610 - DNA, 20 bp, Homo sapiens
gcatcccaggatgctgggtg

SEQ ID NO: 3214611 - DNA, 21 bp, Homo sapiens
gcatcccaggggaccacacct

SEQ ID NO: 3214612 - DNA, 20 bp, Homo sapiens
gcatccccttggctgtgagg

SEQ ID NO: 3214613 - DNA, 19 bp, Homo sapiens
gcatcccggaggaaatctg

SEQ ID NO: 3214614 - DNA, 22 bp, Homo sapiens
gcatcccggaggaaatctgcag

SEQ ID NO: 3214615 - DNA, 19 bp, Homo sapiens
gcatccctggagcaggagc

SEQ ID NO: 3214616 - DNA, 20 bp, Homo sapiens
gcatccgcaggtgctggtcc

SEQ ID NO: 3214617 - DNA, 20 bp, Homo sapiens
gcatcctccacatcctgtgt

SEQ ID NO: 3214618 - DNA, 22 bp, Homo sapiens
gcatcctccacatcctgtgtca

SEQ ID NO: 3214619 - DNA, 15 bp, Homo sapiens
gcatcctccggagag

SEQ ID NO: 3214620 - DNA, 15 bp, Homo sapiens
gcatcctgcctgggt

SEQ ID NO: 3214621 - DNA, 16 bp, Homo sapiens
gcatcctgcctgggtg

SEQ ID NO: 3214622 - DNA, 11 bp, Homo sapiens
gcatcctggat

SEQ ID NO: 3214623 - DNA, 13 bp, Homo sapiens
gcatcctggatga

SEQ ID NO: 3214624 - DNA, 16 bp, Homo sapiens
gcatccttcctataac

SEQ ID NO: 3214625 - DNA, 19 bp, Homo sapiens
gcatccttcctataacttg

SEQ ID NO: 3214626 - DNA, 12 bp, Homo sapiens
gcatcgcaggag

SEQ ID NO: 3214627 - DNA, 22 bp, Homo sapiens
gcatcggacaagacccccagca

SEQ ID NO: 3214628 - DNA, 18 bp, Homo sapiens
gcatcgggagcacccaga

SEQ ID NO: 3214629 - DNA, 22 bp, Homo sapiens
gcatcgtagaagagatgtggca

SEQ ID NO: 3214630 - DNA, 19 bp, Homo sapiens
gcatcgtgacccttcaggg

SEQ ID NO: 3214631 - DNA, 21 bp, Homo sapiens
gcatctcaaaacagagggctg

SEQ ID NO: 3214632 - DNA, 17 bp, Homo sapiens
gcatctctgtactttgc

SEQ ID NO: 3214633 - DNA, 20 bp, Homo sapiens
gcatctgaatgaaaataact

SEQ ID NO: 3214634 - DNA, 19 bp, Homo sapiens
gcatctgacacaaaaaaag

SEQ ID NO: 3214635 - DNA, 17 bp, Homo sapiens
gcatctgcccctccccc

SEQ ID NO: 3214636 - DNA, 18 bp, Homo sapiens
gcatctgcccctccccca

SEQ ID NO: 3214637 - DNA, 22 bp, Homo sapiens
gcatctggctgtttagcagaac

SEQ ID NO: 3214638 - DNA, 18 bp, Homo sapiens
gcatctgtgatgggagcg

SEQ ID NO: 3214639 - DNA, 20 bp, Homo sapiens
gcatcttcgtcttcactctt

SEQ ID NO: 3214640 - DNA, 23 bp, Homo sapiens
gcatcttcgtcttcactcttagg

SEQ ID NO: 3214641 - DNA, 23 bp, Homo sapiens
gcatctttggggaggtgttcact

SEQ ID NO: 3214642 - DNA, 23 bp, Homo sapiens
gcatgaaaaatcatgggccagag

SEQ ID NO: 3214643 - DNA, 20 bp, Homo sapiens
gcatgaaattgtatctcagt

SEQ ID NO: 3214644 - DNA, 18 bp, Homo sapiens
gcatgaaattttgcctgc

SEQ ID NO: 3214645 - DNA, 14 bp, Homo sapiens
gcatgaagagaagc

SEQ ID NO: 3214646 - DNA, 23 bp, Homo sapiens
gcatgacctaccaggacagaact

SEQ ID NO: 3214647 - DNA, 16 bp, Homo sapiens
gcatgacctgtgacca

SEQ ID NO: 3214648 - DNA, 21 bp, Homo sapiens
gcatgacttgtagcatattct

SEQ ID NO: 3214649 - DNA, 20 bp, Homo sapiens
gcatgagccactgagcctgg

SEQ ID NO: 3214650 - DNA, 21 bp, Homo sapiens
gcatgagccactgagcctggc

SEQ ID NO: 3214651 - DNA, 15 bp, Homo sapiens
gcatgatatcttcaa

SEQ ID NO: 3214652 - DNA, 19 bp, Homo sapiens
gcatgatgaaactgtcata

SEQ ID NO: 3214653 - DNA, 15 bp, Homo sapiens
gcatgattttgtaac

SEQ ID NO: 3214654 - DNA, 14 bp, Homo sapiens
gcatgcacagctgt

SEQ ID NO: 3214655 - DNA, 16 bp, Homo sapiens
gcatgccaccctcaca

SEQ ID NO: 3214656 - DNA, 18 bp, Homo sapiens
gcatgccaccctcacaca

SEQ ID NO: 3214657 - DNA, 16 bp, Homo sapiens
gcatgccccggccacc

SEQ ID NO: 3214658 - DNA, 18 bp, Homo sapiens
gcatgccccttggctgga

SEQ ID NO: 3214659 - DNA, 23 bp, Homo sapiens
gcatgccgggcccctccatccac

SEQ ID NO: 3214660 - DNA, 13 bp, Homo sapiens
gcatgccttgtgc

SEQ ID NO: 3214661 - DNA, 14 bp, Homo sapiens
gcatgcttaaattt

SEQ ID NO: 3214662 - DNA, 13 bp, Homo sapiens
gcatgcttcccag

SEQ ID NO: 3214663 - DNA, 16 bp, Homo sapiens
gcatgcttcccagagg

SEQ ID NO: 3214664 - DNA, 19 bp, Homo sapiens
gcatgcttcccagagggag

SEQ ID NO: 3214665 - DNA, 22 bp, Homo sapiens
gcatgcttcccagagggagcag

SEQ ID NO: 3214666 - DNA, 12 bp, Homo sapiens
gcatggaaaaat

SEQ ID NO: 3214667 - DNA, 13 bp, Homo sapiens
gcatggaaaaatg

SEQ ID NO: 3214668 - DNA, 16 bp, Homo sapiens
gcatggacctaacatt

SEQ ID NO: 3214669 - DNA, 19 bp, Homo sapiens
gcatggaggaggagggagg

SEQ ID NO: 3214670 - DNA, 17 bp, Homo sapiens
gcatggagtgtgtattg

SEQ ID NO: 3214671 - DNA, 24 bp, Homo sapiens
gcatggagtgtgtattgttcccag

SEQ ID NO: 3214672 - DNA, 15 bp, Homo sapiens
gcatggatgcatttc

SEQ ID NO: 3214673 - DNA, 19 bp, Homo sapiens
gcatggatgcatttcaaat

SEQ ID NO: 3214674 - DNA, 21 bp, Homo sapiens
gcatggattttggataaatca

SEQ ID NO: 3214675 - DNA, 16 bp, Homo sapiens
gcatggcaggctgggt

SEQ ID NO: 3214676 - DNA, 14 bp, Homo sapiens
gcatggccaggtgg

SEQ ID NO: 3214677 - DNA, 13 bp, Homo sapiens
gcatggccctggg

SEQ ID NO: 3214678 - DNA, 16 bp, Homo sapiens
gcatggccctggggtc

SEQ ID NO: 3214679 - DNA, 17 bp, Homo sapiens
gcatggctccagaaatg

SEQ ID NO: 3214680 - DNA, 19 bp, Homo sapiens
gcatggctccagaaatgtc

SEQ ID NO: 3214681 - DNA, 17 bp, Homo sapiens
gcatgggcgcaggccca

SEQ ID NO: 3214682 - DNA, 21 bp, Homo sapiens
gcatgggggcaccgggctcca

SEQ ID NO: 3214683 - DNA, 21 bp, Homo sapiens
gcatgggtgaagggagagcca

SEQ ID NO: 3214684 - DNA, 18 bp, Homo sapiens
gcatggtaccagccctgg

SEQ ID NO: 3214685 - DNA, 19 bp, Homo sapiens
gcatggtgttttcattccc

SEQ ID NO: 3214686 - DNA, 19 bp, Homo sapiens
gcatggttccttccctggg

SEQ ID NO: 3214687 - DNA, 18 bp, Homo sapiens
gcatgtaccatttgcatg

SEQ ID NO: 3214688 - DNA, 20 bp, Homo sapiens
gcatgtaccatttgcatggc

SEQ ID NO: 3214689 - DNA, 21 bp, Homo sapiens
gcatgtcagacagaacttgaa

SEQ ID NO: 3214690 - DNA, 13 bp, Homo sapiens
gcatgtcccaccc

SEQ ID NO: 3214691 - DNA, 19 bp, Homo sapiens
gcatgtcccacccacccgc

SEQ ID NO: 3214692 - DNA, 23 bp, Homo sapiens
gcatgtccctaccgagtctcttc

SEQ ID NO: 3214693 - DNA, 19 bp, Homo sapiens
gcatgtcctgtaaaggtta

SEQ ID NO: 3214694 - DNA, 15 bp, Homo sapiens
gcatgtcgcacaatg

SEQ ID NO: 3214695 - DNA, 17 bp, Homo sapiens
gcatgtcttttaaaatg

SEQ ID NO: 3214696 - DNA, 16 bp, Homo sapiens
gcatgtgaagcatgct

SEQ ID NO: 3214697 - DNA, 22 bp, Homo sapiens
gcatgtgaagcatgctttgctg

SEQ ID NO: 3214698 - DNA, 13 bp, Homo sapiens
gcatgtgatctcc

SEQ ID NO: 3214699 - DNA, 12 bp, Homo sapiens
gcatgtggcctg

SEQ ID NO: 3214700 - DNA, 12 bp, Homo sapiens
gcatgtgtattt

SEQ ID NO: 3214701 - DNA, 14 bp, Homo sapiens
gcatgtgtcagagt

SEQ ID NO: 3214702 - DNA, 15 bp, Homo sapiens
gcatgtgtcagagtg

SEQ ID NO: 3214703 - DNA, 13 bp, Homo sapiens
gcatgtgtgcctg

SEQ ID NO: 3214704 - DNA, 11 bp, Homo sapiens
gcatgtgtgta

SEQ ID NO: 3214705 - DNA, 13 bp, Homo sapiens
gcatgtgtgtata

SEQ ID NO: 3214706 - DNA, 15 bp, Homo sapiens
gcatgtgtgtataag

SEQ ID NO: 3214707 - DNA, 20 bp, Homo sapiens
gcatgttcacccttatagtc

SEQ ID NO: 3214708 - DNA, 21 bp, Homo sapiens
gcatgttcacccttatagtct

SEQ ID NO: 3214709 - DNA, 22 bp, Homo sapiens
gcatgttctctgaggacactaa

SEQ ID NO: 3214710 - DNA, 15 bp, Homo sapiens
gcatgtttccagcag

SEQ ID NO: 3214711 - DNA, 12 bp, Homo sapiens
gcatgtttgctg

SEQ ID NO: 3214712 - DNA, 18 bp, Homo sapiens
gcatgttttgtatacaaa

SEQ ID NO: 3214713 - DNA, 20 bp, Homo sapiens
gcatgttttgtatacaaata

SEQ ID NO: 3214714 - DNA, 18 bp, Homo sapiens
gcatgttttgtgcatttg

SEQ ID NO: 3214715 - DNA, 22 bp, Homo sapiens
gcattaaattcacaaactttta

SEQ ID NO: 3214716 - DNA, 22 bp, Homo sapiens
gcattaactaatctattgggtt

SEQ ID NO: 3214717 - DNA, 12 bp, Homo sapiens
gcattaatgttt

SEQ ID NO: 3214718 - DNA, 14 bp, Homo sapiens
gcattaatgtttct

SEQ ID NO: 3214719 - DNA, 21 bp, Homo sapiens
gcattacccccaacctcattt

SEQ ID NO: 3214720 - DNA, 21 bp, Homo sapiens
gcattagaaatagacagtata

SEQ ID NO: 3214721 - DNA, 15 bp, Homo sapiens
gcattagaattattt

SEQ ID NO: 3214722 - DNA, 18 bp, Homo sapiens
gcattagaattatttaaa

SEQ ID NO: 3214723 - DNA, 21 bp, Homo sapiens
gcattagagtcaactacacaa

SEQ ID NO: 3214724 - DNA, 22 bp, Homo sapiens
gcattagcacagattttaattg

SEQ ID NO: 3214725 - DNA, 14 bp, Homo sapiens
gcattatgcaatta

SEQ ID NO: 3214726 - DNA, 21 bp, Homo sapiens
gcattatgtccactgtgtata

SEQ ID NO: 3214727 - DNA, 14 bp, Homo sapiens
gcattattaaattg

SEQ ID NO: 3214728 - DNA, 16 bp, Homo sapiens
gcattattatcattga

SEQ ID NO: 3214729 - DNA, 16 bp, Homo sapiens
gcattattcatttagt

SEQ ID NO: 3214730 - DNA, 19 bp, Homo sapiens
gcattcacatttagaaaag

SEQ ID NO: 3214731 - DNA, 17 bp, Homo sapiens
gcattcatttgtttttt

SEQ ID NO: 3214732 - DNA, 21 bp, Homo sapiens
gcccagtcccccaaccccagc

SEQ ID NO: 3214733 - DNA, 19 bp, Homo sapiens
gcccagtctggaatgcagt

SEQ ID NO: 3214734 - DNA, 22 bp, Homo sapiens
gcccagtctggaatgcagtggt

SEQ ID NO: 3214735 - DNA, 15 bp, Homo sapiens
gcccagtgccactgc

SEQ ID NO: 3214736 - DNA, 19 bp, Homo sapiens
gcccagtgctgctgtaaat

SEQ ID NO: 3214737 - DNA, 21 bp, Homo sapiens
gcccataatagttagccctca

SEQ ID NO: 3214738 - DNA, 22 bp, Homo sapiens
gcccataatagttagccctcag

SEQ ID NO: 3214739 - DNA, 14 bp, Homo sapiens
gcccatactcagcc

SEQ ID NO: 3214740 - DNA, 16 bp, Homo sapiens
gcccatactcagcctg

SEQ ID NO: 3214741 - DNA, 20 bp, Homo sapiens
gcccatactcagcctgctgc

SEQ ID NO: 3214742 - DNA, 21 bp, Homo sapiens
gcccatcacagggttgggccc

SEQ ID NO: 3214743 - DNA, 22 bp, Homo sapiens
gcccatccattaggccagcaac

SEQ ID NO: 3214744 - DNA, 17 bp, Homo sapiens
gcccatctcagcctcct

SEQ ID NO: 3214745 - DNA, 19 bp, Homo sapiens
gcccatctcaggtgccact

SEQ ID NO: 3214746 - DNA, 20 bp, Homo sapiens
gcccatctcaggtgccactc

SEQ ID NO: 3214747 - DNA, 23 bp, Homo sapiens
gcccatctcggagcatcccggag

SEQ ID NO: 3214748 - DNA, 15 bp, Homo sapiens
gcccatgcccacctg

SEQ ID NO: 3214749 - DNA, 20 bp, Homo sapiens
gcccatggcccccaataaag

SEQ ID NO: 3214750 - DNA, 14 bp, Homo sapiens
gcccatggccctgt

SEQ ID NO: 3214751 - DNA, 14 bp, Homo sapiens
gcccatggcctctg

SEQ ID NO: 3214752 - DNA, 19 bp, Homo sapiens
gcccatgggagccaggccc

SEQ ID NO: 3214753 - DNA, 18 bp, Homo sapiens
gcccatgggatatgtggt

SEQ ID NO: 3214754 - DNA, 19 bp, Homo sapiens
gcccatgtcgcgctcagca

SEQ ID NO: 3214755 - DNA, 20 bp, Homo sapiens
gcccatgtcgcgctcagcat

SEQ ID NO: 3214756 - DNA, 14 bp, Homo sapiens
gcccatgtgtcccc

SEQ ID NO: 3214757 - DNA, 23 bp, Homo sapiens
gcccatgtgtcccctcactctgt

SEQ ID NO: 3214758 - DNA, 20 bp, Homo sapiens
gcccatgttctgcccccagc

SEQ ID NO: 3214759 - DNA, 15 bp, Homo sapiens
gcccattaggtccct

SEQ ID NO: 3214760 - DNA, 14 bp, Homo sapiens
gcccattcccacca

SEQ ID NO: 3214761 - DNA, 18 bp, Homo sapiens
gcccatttcaattctcaa

SEQ ID NO: 3214762 - DNA, 19 bp, Homo sapiens
gcccatttcaattctcaaa

SEQ ID NO: 3214763 - DNA, 20 bp, Homo sapiens
gccccaaacgggctgccctg

SEQ ID NO: 3214764 - DNA, 13 bp, Homo sapiens
gccccaagcagcc

SEQ ID NO: 3214765 - DNA, 14 bp, Homo sapiens
gccccaagcagcca

SEQ ID NO: 3214766 - DNA, 17 bp, Homo sapiens
gccccaagcagccagcc

SEQ ID NO: 3214767 - DNA, 19 bp, Homo sapiens
gccccaagcagccagccag

SEQ ID NO: 3214768 - DNA, 22 bp, Homo sapiens
gccccaagcagccagccagtct

SEQ ID NO: 3214769 - DNA, 13 bp, Homo sapiens
gccccaagtcctg

SEQ ID NO: 3214770 - DNA, 19 bp, Homo sapiens
gccccaagtcctgaagagg

SEQ ID NO: 3214771 - DNA, 11 bp, Homo sapiens
gccccacagct

SEQ ID NO: 3214772 - DNA, 15 bp, Homo sapiens
gccccacagctacct

SEQ ID NO: 3214773 - DNA, 11 bp, Homo sapiens
gccccacccag

SEQ ID NO: 3214774 - DNA, 15 bp, Homo sapiens
gccccacccaggagg

SEQ ID NO: 3214775 - DNA, 15 bp, Homo sapiens
gccccacccccagcc

SEQ ID NO: 3214776 - DNA, 22 bp, Homo sapiens
gccccacccctaagtgcccaaa

SEQ ID NO: 3214777 - DNA, 24 bp, Homo sapiens
gccccaccctgggccctgggctgg

SEQ ID NO: 3214778 - DNA, 17 bp, Homo sapiens
gccccacctacttgtga

SEQ ID NO: 3214779 - DNA, 12 bp, Homo sapiens
gccccacctcca

SEQ ID NO: 3214780 - DNA, 18 bp, Homo sapiens
gccccacctccacctgtg

SEQ ID NO: 3214781 - DNA, 12 bp, Homo sapiens
gccccactgatg

SEQ ID NO: 3214782 - DNA, 18 bp, Homo sapiens
gccccactgatgctgttc

SEQ ID NO: 3214783 - DNA, 15 bp, Homo sapiens
gccccactgccagca

SEQ ID NO: 3214784 - DNA, 16 bp, Homo sapiens
gccccactgccagcag

SEQ ID NO: 3214785 - DNA, 19 bp, Homo sapiens
gccccagacaacagcccag

SEQ ID NO: 3214786 - DNA, 17 bp, Homo sapiens
gccccagaccccagggc

SEQ ID NO: 3214787 - DNA, 19 bp, Homo sapiens
gccccagaccccagggcag

SEQ ID NO: 3214788 - DNA, 11 bp, Homo sapiens
gccccagagag

SEQ ID NO: 3214789 - DNA, 21 bp, Homo sapiens
gccccagagatgccagccctt

SEQ ID NO: 3214790 - DNA, 22 bp, Homo sapiens
gccccagagatgccagcccttc

SEQ ID NO: 3214791 - DNA, 22 bp, Homo sapiens
gccccagagcagggtgttggga

SEQ ID NO: 3214792 - DNA, 13 bp, Homo sapiens
gccccagagctgt

SEQ ID NO: 3214793 - DNA, 18 bp, Homo sapiens
gccccagaggccctggag

SEQ ID NO: 3214794 - DNA, 16 bp, Homo sapiens
gccccagatctgcctg

SEQ ID NO: 3214795 - DNA, 20 bp, Homo sapiens
gccccagatctgcctgggcc

SEQ ID NO: 3214796 - DNA, 21 bp, Homo sapiens
gccccagatctgcctgggcct

SEQ ID NO: 3214797 - DNA, 20 bp, Homo sapiens
gccccagcacagcttgacct

SEQ ID NO: 3214798 - DNA, 21 bp, Homo sapiens
gccagaccaaggcgagtttcc

SEQ ID NO: 3214799 - DNA, 16 bp, Homo sapiens
gccagaccagcaggct

SEQ ID NO: 3214800 - DNA, 18 bp, Homo sapiens
gccagaccagcaggctgg

SEQ ID NO: 3214801 - DNA, 20 bp, Homo sapiens
gccagactctaggttataca

SEQ ID NO: 3214802 - DNA, 12 bp, Homo sapiens
gccagagacata

SEQ ID NO: 3214803 - DNA, 21 bp, Homo sapiens
gccagagagcctggtgctgct

SEQ ID NO: 3214804 - DNA, 17 bp, Homo sapiens
gccagagaggagcacct

SEQ ID NO: 3214805 - DNA, 16 bp, Homo sapiens
gccagagagggcccag

SEQ ID NO: 3214806 - DNA, 20 bp, Homo sapiens
gccagagagggcccagctgt

SEQ ID NO: 3214807 - DNA, 16 bp, Homo sapiens
gccagagatgcaatat

SEQ ID NO: 3214808 - DNA, 14 bp, Homo sapiens
gccagagctggaag

SEQ ID NO: 3214809 - DNA, 20 bp, Homo sapiens
gccagagctggaaggcaggg

SEQ ID NO: 3214810 - DNA, 18 bp, Homo sapiens
gccagaggaactgtccag

SEQ ID NO: 3214811 - DNA, 20 bp, Homo sapiens
gccagaggaactgtccagag

SEQ ID NO: 3214812 - DNA, 24 bp, Homo sapiens
gccagaggaactgtccagagagca

SEQ ID NO: 3214813 - DNA, 19 bp, Homo sapiens
gccagaggaatcctggcag

SEQ ID NO: 3214814 - DNA, 22 bp, Homo sapiens
gccagaggaatcctggcagccc

SEQ ID NO: 3214815 - DNA, 23 bp, Homo sapiens
gccagaggaatcctggcagccca

SEQ ID NO: 3214816 - DNA, 24 bp, Homo sapiens
gccagaggaatcctggcagcccag

SEQ ID NO: 3214817 - DNA, 18 bp, Homo sapiens
gccagagggagtgacaga

SEQ ID NO: 3214818 - DNA, 21 bp, Homo sapiens
gccagagggagtgacagaggc

SEQ ID NO: 3214819 - DNA, 22 bp, Homo sapiens
gccagagggagtgacagaggca

SEQ ID NO: 3214820 - DNA, 23 bp, Homo sapiens
gccagagggagtgacagaggcag

SEQ ID NO: 3214821 - DNA, 15 bp, Homo sapiens
gccagagggcttgtg

SEQ ID NO: 3214822 - DNA, 14 bp, Homo sapiens
gccagaggggaagg

SEQ ID NO: 3214823 - DNA, 17 bp, Homo sapiens
gccagaggtgggcaggt

SEQ ID NO: 3214824 - DNA, 14 bp, Homo sapiens
gccagagtggcctg

SEQ ID NO: 3214825 - DNA, 18 bp, Homo sapiens
gccagagtggcctggcca

SEQ ID NO: 3214826 - DNA, 22 bp, Homo sapiens
gccagagtggcctggccaggag

SEQ ID NO: 3214827 - DNA, 15 bp, Homo sapiens
gccagatgcaccagc

SEQ ID NO: 3214828 - DNA, 17 bp, Homo sapiens
gccagatgcaccagccc

SEQ ID NO: 3214829 - DNA, 18 bp, Homo sapiens
gccagatgcaccagccct

SEQ ID NO: 3214830 - DNA, 21 bp, Homo sapiens
gccagatggcccctccactgg

SEQ ID NO: 3214831 - DNA, 15 bp, Homo sapiens
gccagatggcccgga

SEQ ID NO: 3214832 - DNA, 14 bp, Homo sapiens
gccagatttgtctt

SEQ ID NO: 3214833 - DNA, 12 bp, Homo sapiens
gccagcaacgct

SEQ ID NO: 3214834 - DNA, 15 bp, Homo sapiens
gccagcaaggcaggt

SEQ ID NO: 3214835 - DNA, 16 bp, Homo sapiens
gccagcaaggcaggtt

SEQ ID NO: 3214836 - DNA, 21 bp, Homo sapiens
gccagcaatgatgtccagaag

SEQ ID NO: 3214837 - DNA, 22 bp, Homo sapiens
gccagcaatgatgtccagaaga

SEQ ID NO: 3214838 - DNA, 15 bp, Homo sapiens
gccagcacaggggcc

SEQ ID NO: 3214839 - DNA, 15 bp, Homo sapiens
gccagcaccctctcc

SEQ ID NO: 3214840 - DNA, 14 bp, Homo sapiens
gccagcacgcctgg

SEQ ID NO: 3214841 - DNA, 16 bp, Homo sapiens
gccagcacgcctggct

SEQ ID NO: 3214842 - DNA, 19 bp, Homo sapiens
gccagcagaactgaagtgt

SEQ ID NO: 3214843 - DNA, 22 bp, Homo sapiens
gccagcagaagcagggtaccct

SEQ ID NO: 3214844 - DNA, 15 bp, Homo sapiens
gccagcagcagcagg

SEQ ID NO: 3214845 - DNA, 19 bp, Homo sapiens
gccagcagcagcaggtgat

SEQ ID NO: 3214846 - DNA, 22 bp, Homo sapiens
gccagccaagctttaaattatg

SEQ ID NO: 3214847 - DNA, 21 bp, Homo sapiens
gccagccagtcttgcctaggc

SEQ ID NO: 3214848 - DNA, 21 bp, Homo sapiens
gccagccagtgccattccact

SEQ ID NO: 3214849 - DNA, 16 bp, Homo sapiens
gccagcccagaacacc

SEQ ID NO: 3214850 - DNA, 14 bp, Homo sapiens
gccagcccagccag

SEQ ID NO: 3214851 - DNA, 17 bp, Homo sapiens
gccagcccagccaggcc

SEQ ID NO: 3214852 - DNA, 17 bp, Homo sapiens
gccagccccacacagct

SEQ ID NO: 3214853 - DNA, 23 bp, Homo sapiens
gccagccccacccccagccaggc

SEQ ID NO: 3214854 - DNA, 15 bp, Homo sapiens
gccagcccctcttcc

SEQ ID NO: 3214855 - DNA, 20 bp, Homo sapiens
gccagcccctcttccccaat

SEQ ID NO: 3214856 - DNA, 18 bp, Homo sapiens
gccagcccctgcctgggt

SEQ ID NO: 3214857 - DNA, 19 bp, Homo sapiens
gccagcccttcaggaagca

SEQ ID NO: 3214858 - DNA, 22 bp, Homo sapiens
gccagcccttcctctcactcct

SEQ ID NO: 3214859 - DNA, 15 bp, Homo sapiens
gccagccgccctggg

SEQ ID NO: 3214860 - DNA, 18 bp, Homo sapiens
gccagccgccctgggctg

SEQ ID NO: 3214861 - DNA, 16 bp, Homo sapiens
gccagccggtgcctgg

SEQ ID NO: 3214862 - DNA, 17 bp, Homo sapiens
gccagccggtgcctggc

SEQ ID NO: 3214863 - DNA, 17 bp, Homo sapiens
gccagcctagcccttgt

SEQ ID NO: 3214864 - DNA, 18 bp, Homo sapiens
gccagcctccgagaggga

SEQ ID NO: 3214865 - DNA, 21 bp, Homo sapiens
gccagcctccgagagggagag

SEQ ID NO: 3214866 - DNA, 13 bp, Homo sapiens
gccagcctgacct

SEQ ID NO: 3214867 - DNA, 17 bp, Homo sapiens
gccagcctgaccttcct

SEQ ID NO: 3214868 - DNA, 16 bp, Homo sapiens
gccagcctggcttctg

SEQ ID NO: 3214869 - DNA, 20 bp, Homo sapiens
gccagcctggcttctggagc

SEQ ID NO: 3214870 - DNA, 12 bp, Homo sapiens
gccagcctggga

SEQ ID NO: 3214871 - DNA, 20 bp, Homo sapiens
gccagcctgggactcccagt

SEQ ID NO: 3214872 - DNA, 17 bp, Homo sapiens
gccagcctggggcctgg

SEQ ID NO: 3214873 - DNA, 20 bp, Homo sapiens
gccagcctggggcctggcag

SEQ ID NO: 3214874 - DNA, 20 bp, Homo sapiens
gccagcctgtcccatggaca

SEQ ID NO: 3214875 - DNA, 18 bp, Homo sapiens
gccagccttgagccctgg

SEQ ID NO: 3214876 - DNA, 14 bp, Homo sapiens
gccacaaggctggc

SEQ ID NO: 3214877 - DNA, 15 bp, Homo sapiens
gccacaagtcttcca

SEQ ID NO: 3214878 - DNA, 21 bp, Homo sapiens
gccacaatgaacatccctttt

SEQ ID NO: 3214879 - DNA, 18 bp, Homo sapiens
gccacacaaacgtttact

SEQ ID NO: 3214880 - DNA, 17 bp, Homo sapiens
gccacacccagcggccc

SEQ ID NO: 3214881 - DNA, 13 bp, Homo sapiens
gccacacctggcc

SEQ ID NO: 3214882 - DNA, 22 bp, Homo sapiens
gccacacttcaggctcttctcc

SEQ ID NO: 3214883 - DNA, 16 bp, Homo sapiens
gccacagacccctggg

SEQ ID NO: 3214884 - DNA, 19 bp, Homo sapiens
gccacagacccctgggagc

SEQ ID NO: 3214885 - DNA, 23 bp, Homo sapiens
gccacagagaaagtacttctcca

SEQ ID NO: 3214886 - DNA, 12 bp, Homo sapiens
gccacagccccc

SEQ ID NO: 3214887 - DNA, 13 bp, Homo sapiens
gccacagccgcct

SEQ ID NO: 3214888 - DNA, 14 bp, Homo sapiens
gccacagccgcctt

SEQ ID NO: 3214889 - DNA, 17 bp, Homo sapiens
gccacagccgcctttgg

SEQ ID NO: 3214890 - DNA, 19 bp, Homo sapiens
gccacagccgcctttgggt

SEQ ID NO: 3214891 - DNA, 20 bp, Homo sapiens
gccacagccgcctttgggtt

SEQ ID NO: 3214892 - DNA, 23 bp, Homo sapiens
gccacagccttcggacagacata

SEQ ID NO: 3214893 - DNA, 10 bp, Homo sapiens
gccacagctt

SEQ ID NO: 3214894 - DNA, 12 bp, Homo sapiens
gccacagctttt

SEQ ID NO: 3214895 - DNA, 15 bp, Homo sapiens
gccacagcttttgca

SEQ ID NO: 3214896 - DNA, 12 bp, Homo sapiens
gccacaggcctc

SEQ ID NO: 3214897 - DNA, 16 bp, Homo sapiens
gccacaggcctccctg

SEQ ID NO: 3214898 - DNA, 15 bp, Homo sapiens
gccacatacaggtgc

SEQ ID NO: 3214899 - DNA, 15 bp, Homo sapiens
gccacatcaaacctt

SEQ ID NO: 3214900 - DNA, 13 bp, Homo sapiens
gccacatggagcc

SEQ ID NO: 3214901 - DNA, 22 bp, Homo sapiens
gccacatttagtcctgtactgt

SEQ ID NO: 3214902 - DNA, 19 bp, Homo sapiens
gccaccaaagctgcccact

SEQ ID NO: 3214903 - DNA, 17 bp, Homo sapiens
gccaccacgtctgccag

SEQ ID NO: 3214904 - DNA, 20 bp, Homo sapiens
gccaccacgtctgccaggcc

SEQ ID NO: 3214905 - DNA, 22 bp, Homo sapiens
gccaccacgtctgccaggccca

SEQ ID NO: 3214906 - DNA, 12 bp, Homo sapiens
gccaccagagac

SEQ ID NO: 3214907 - DNA, 22 bp, Homo sapiens
gccaccagagaccgtcctcacc

SEQ ID NO: 3214908 - DNA, 23 bp, Homo sapiens
gccaccagagaccgtcctcaccc

SEQ ID NO: 3214909 - DNA, 20 bp, Homo sapiens
gccaccagcccgcaactctc

SEQ ID NO: 3214910 - DNA, 12 bp, Homo sapiens
gccaccaggcca

SEQ ID NO: 3214911 - DNA, 15 bp, Homo sapiens
gccaccaggccacct

SEQ ID NO: 3214912 - DNA, 20 bp, Homo sapiens
gccaccaggccacctcccca

SEQ ID NO: 3214913 - DNA, 16 bp, Homo sapiens
gccaccaggctggcgc

SEQ ID NO: 3214914 - DNA, 20 bp, Homo sapiens
gccaccaggctggcgcagcc

SEQ ID NO: 3214915 - DNA, 11 bp, Homo sapiens
gccaccagttc

SEQ ID NO: 3214916 - DNA, 13 bp, Homo sapiens
gccaccagttctc

SEQ ID NO: 3214917 - DNA, 19 bp, Homo sapiens
gccaccagttctcatgggt

SEQ ID NO: 3214918 - DNA, 23 bp, Homo sapiens
gccaccatattcagtgctgtggc

SEQ ID NO: 3214919 - DNA, 16 bp, Homo sapiens
gccaccatccccaccc

SEQ ID NO: 3214920 - DNA, 17 bp, Homo sapiens
gccaccatcctgcagcc

SEQ ID NO: 3214921 - DNA, 14 bp, Homo sapiens
gccaccccaaccca

SEQ ID NO: 3214922 - DNA, 14 bp, Homo sapiens
gccaccccactcta

SEQ ID NO: 3214923 - DNA, 14 bp, Homo sapiens
gccacccccatctt

SEQ ID NO: 3214924 - DNA, 22 bp, Homo sapiens
gccacccccatcttccacctgt

SEQ ID NO: 3214925 - DNA, 19 bp, Homo sapiens
gccaccccgggctctctgc

SEQ ID NO: 3214926 - DNA, 15 bp, Homo sapiens
gccaccctcacacac

SEQ ID NO: 3214927 - DNA, 19 bp, Homo sapiens
gccaccctggggagaaagt

SEQ ID NO: 3214928 - DNA, 14 bp, Homo sapiens
gccaccgtttcttc

SEQ ID NO: 3214929 - DNA, 24 bp, Homo sapiens
gccaccgtttcttcctgccagcag

SEQ ID NO: 3214930 - DNA, 14 bp, Homo sapiens
gccacctcctcccc

SEQ ID NO: 3214931 - DNA, 13 bp, Homo sapiens
gccacctctccaa

SEQ ID NO: 3214932 - DNA, 17 bp, Homo sapiens
gccacctctccaagggc

SEQ ID NO: 3214933 - DNA, 22 bp, Homo sapiens
gccacctctgcggaccccagct

SEQ ID NO: 3214934 - DNA, 23 bp, Homo sapiens
gccacctctgcggaccccagctg

SEQ ID NO: 3214935 - DNA, 15 bp, Homo sapiens
gccacctgaggtggg

SEQ ID NO: 3214936 - DNA, 20 bp, Homo sapiens
gccacctgaggtgggcccag

SEQ ID NO: 3214937 - DNA, 23 bp, Homo sapiens
gccacctgaggtgggctggggct

SEQ ID NO: 3214938 - DNA, 13 bp, Homo sapiens
gccacgaccagcc

SEQ ID NO: 3214939 - DNA, 18 bp, Homo sapiens
gccacgaccagccccttc

SEQ ID NO: 3214940 - DNA, 21 bp, Homo sapiens
gccacgaccagccccttcctg

SEQ ID NO: 3214941 - DNA, 14 bp, Homo sapiens
gccacgcactgggc

SEQ ID NO: 3214942 - DNA, 12 bp, Homo sapiens
gccacgccccag

SEQ ID NO: 3214943 - DNA, 16 bp, Homo sapiens
gccacgccccagcccg

SEQ ID NO: 3214944 - DNA, 18 bp, Homo sapiens
gccacgccccagcccgac

SEQ ID NO: 3214945 - DNA, 15 bp, Homo sapiens
gccacgctccagctg

SEQ ID NO: 3214946 - DNA, 16 bp, Homo sapiens
gccacgctccagctgc

SEQ ID NO: 3214947 - DNA, 18 bp, Homo sapiens
gccacgctgtcctctcga

SEQ ID NO: 3214948 - DNA, 14 bp, Homo sapiens
gccacgctttgctg

SEQ ID NO: 3214949 - DNA, 22 bp, Homo sapiens
gccacggaggagggatgctgct

SEQ ID NO: 3214950 - DNA, 14 bp, Homo sapiens
gccacggccaggcc

SEQ ID NO: 3214951 - DNA, 15 bp, Homo sapiens
gccacggccaggcca

SEQ ID NO: 3214952 - DNA, 19 bp, Homo sapiens
gccacggccaggccagagg

SEQ ID NO: 3214953 - DNA, 23 bp, Homo sapiens
gccacggcctggctggtgggaag

SEQ ID NO: 3214954 - DNA, 23 bp, Homo sapiens
gccacgtcccagcatccctggag

SEQ ID NO: 3214955 - DNA, 14 bp, Homo sapiens
gccacgtgaatggc

SEQ ID NO: 3214956 - DNA, 21 bp, Homo sapiens
gccacgtgggcaaacaggcag

SEQ ID NO: 3214957 - DNA, 13 bp, Homo sapiens
gcagctgcttttg

SEQ ID NO: 3214958 - DNA, 12 bp, Homo sapiens
gcagctgggctg

SEQ ID NO: 3214959 - DNA, 19 bp, Homo sapiens
gcagcttgagggttgggct

SEQ ID NO: 3214960 - DNA, 14 bp, Homo sapiens
gcagcttgccccgg

SEQ ID NO: 3214961 - DNA, 21 bp, Homo sapiens
gcagctttaaactcagggaca

SEQ ID NO: 3214962 - DNA, 12 bp, Homo sapiens
gcagctttggga

SEQ ID NO: 3214963 - DNA, 22 bp, Homo sapiens
gcagctttttattccctgccca

SEQ ID NO: 3214964 - DNA, 14 bp, Homo sapiens
gcaggaacgagcac

SEQ ID NO: 3214965 - DNA, 15 bp, Homo sapiens
gcaggaacgagcact

SEQ ID NO: 3214966 - DNA, 18 bp, Homo sapiens
gcaggaacgagcactggc

SEQ ID NO: 3214967 - DNA, 23 bp, Homo sapiens
gcaggaacgagcactggccagag

SEQ ID NO: 3214968 - DNA, 20 bp, Homo sapiens
gcaggaagcattcagagagc

SEQ ID NO: 3214969 - DNA, 13 bp, Homo sapiens
gcaggaaggagag

SEQ ID NO: 3214970 - DNA, 17 bp, Homo sapiens
gcaggaaggagagcctg

SEQ ID NO: 3214971 - DNA, 15 bp, Homo sapiens
gcaggaaggagcggc

SEQ ID NO: 3214972 - DNA, 23 bp, Homo sapiens
gcaggaaggagcggcgccctgga

SEQ ID NO: 3214973 - DNA, 13 bp, Homo sapiens
gcaggaaggcctg

SEQ ID NO: 3214974 - DNA, 17 bp, Homo sapiens
gcaggaaggcctgggtg

SEQ ID NO: 3214975 - DNA, 10 bp, Homo sapiens
gcaggaatgg

SEQ ID NO: 3214976 - DNA, 18 bp, Homo sapiens
gcaggaattggtggcaga

SEQ ID NO: 3214977 - DNA, 19 bp, Homo sapiens
gcaggaattggtggcagat

SEQ ID NO: 3214978 - DNA, 17 bp, Homo sapiens
gcaggacacatcccggc

SEQ ID NO: 3214979 - DNA, 20 bp, Homo sapiens
gcaggacctactaggagagg

SEQ ID NO: 3214980 - DNA, 21 bp, Homo sapiens
gcaggacctcccttccgaccc

SEQ ID NO: 3214981 - DNA, 14 bp, Homo sapiens
gcaggacctggcat

SEQ ID NO: 3214982 - DNA, 20 bp, Homo sapiens
gcaggacctggcatcatggt

SEQ ID NO: 3214983 - DNA, 22 bp, Homo sapiens
gcaggacctggcatcatggtgg

SEQ ID NO: 3214984 - DNA, 23 bp, Homo sapiens
gcaggactcacaggttggaagag

SEQ ID NO: 3214985 - DNA, 15 bp, Homo sapiens
ctaaatagttctatc

SEQ ID NO: 3214986 - DNA, 18 bp, Homo sapiens
ctaaatatccaaagactg

SEQ ID NO: 3214987 - DNA, 23 bp, Homo sapiens
ctaaatatgaaccctttgtttct

SEQ ID NO: 3214988 - DNA, 12 bp, Homo sapiens
ctaaatctattt

SEQ ID NO: 3214989 - DNA, 16 bp, Homo sapiens
ctaaatctcctatttt

SEQ ID NO: 3214990 - DNA, 17 bp, Homo sapiens
ctaaatctcctattttt

SEQ ID NO: 3214991 - DNA, 15 bp, Homo sapiens
ctaaatctctaatat

SEQ ID NO: 3214992 - DNA, 21 bp, Homo sapiens
ctaaatgcagacaacaccttc

SEQ ID NO: 3214993 - DNA, 22 bp, Homo sapiens
ctaaatgcatatcctgagccat

SEQ ID NO: 3214994 - DNA, 19 bp, Homo sapiens
ctaaatgccttagaaatgt

SEQ ID NO: 3214995 - DNA, 16 bp, Homo sapiens
ctaaatggcctcatgt

SEQ ID NO: 3214996 - DNA, 17 bp, Homo sapiens
ctaaattctatgttaaa

SEQ ID NO: 3214997 - DNA, 12 bp, Homo sapiens
ctaaattgtata

SEQ ID NO: 3214998 - DNA, 21 bp, Homo sapiens
ctaaattgtatacattttgtt

SEQ ID NO: 3214999 - DNA, 17 bp, Homo sapiens
ctaaatttaaatttaaa

SEQ ID NO: 3215000 - DNA, 17 bp, Homo sapiens
ctaaatttaatgctgcc

SEQ ID NO: 3215001 - DNA, 13 bp, Homo sapiens
ctaaatttaatta

SEQ ID NO: 3215002 - DNA, 18 bp, Homo sapiens
ctaaatttaattacctta

SEQ ID NO: 3215003 - DNA, 13 bp, Homo sapiens
ctaaatttcttct

SEQ ID NO: 3215004 - DNA, 17 bp, Homo sapiens
ctaaatttcttttgcta

SEQ ID NO: 3215005 - DNA, 18 bp, Homo sapiens
ctaaatttgatacttata

SEQ ID NO: 3215006 - DNA, 23 bp, Homo sapiens
ctaaatttgatacttatattttc

SEQ ID NO: 3215007 - DNA, 16 bp, Homo sapiens
ctaaattttaaagcca

SEQ ID NO: 3215008 - DNA, 17 bp, Homo sapiens
ctaaattttaaagccat

SEQ ID NO: 3215009 - DNA, 17 bp, Homo sapiens
ctaacaaaagatgaaag

SEQ ID NO: 3215010 - DNA, 19 bp, Homo sapiens
ctaacaaaagatgaaagca

SEQ ID NO: 3215011 - DNA, 22 bp, Homo sapiens
ctaacaagatttgtaattacag

SEQ ID NO: 3215012 - DNA, 21 bp, Homo sapiens
ctaacaataatatttcaagtg

SEQ ID NO: 3215013 - DNA, 23 bp, Homo sapiens
ctaacaataatatttcaagtgcc

SEQ ID NO: 3215014 - DNA, 14 bp, Homo sapiens
ctaacacccagtct

SEQ ID NO: 3215015 - DNA, 20 bp, Homo sapiens
ctaacactggcatgttcaaa

SEQ ID NO: 3215016 - DNA, 23 bp, Homo sapiens
ctaacagcaacagcaagaaataa

SEQ ID NO: 3215017 - DNA, 22 bp, Homo sapiens
ctaacagccctcctctgcactc

SEQ ID NO: 3215018 - DNA, 16 bp, Homo sapiens
ctaacataaaatctgt

SEQ ID NO: 3215019 - DNA, 12 bp, Homo sapiens
ctaacatataat

SEQ ID NO: 3215020 - DNA, 15 bp, Homo sapiens
ctaacatcccactta

SEQ ID NO: 3215021 - DNA, 16 bp, Homo sapiens
ctaacatggtttaaaa

SEQ ID NO: 3215022 - DNA, 17 bp, Homo sapiens
ctaacattatattgcaa

SEQ ID NO: 3215023 - DNA, 20 bp, Homo sapiens
ctaacattatattgcaatga

SEQ ID NO: 3215024 - DNA, 20 bp, Homo sapiens
ctaaccaagctgagtttcct

SEQ ID NO: 3215025 - DNA, 17 bp, Homo sapiens
ctaaccacgctggacct

SEQ ID NO: 3215026 - DNA, 14 bp, Homo sapiens
ctaaccaggcccag

SEQ ID NO: 3215027 - DNA, 21 bp, Homo sapiens
ctaaccagggaagctgtccct

SEQ ID NO: 3215028 - DNA, 20 bp, Homo sapiens
ctaaccagtacctctgtata

SEQ ID NO: 3215029 - DNA, 18 bp, Homo sapiens
ctaaccccaacgcacagg

SEQ ID NO: 3215030 - DNA, 22 bp, Homo sapiens
ctaaccccaacgcacaggaaaa

SEQ ID NO: 3215031 - DNA, 14 bp, Homo sapiens
ctaaccccttccag

SEQ ID NO: 3215032 - DNA, 19 bp, Homo sapiens
ctaaccccttccagatcac

SEQ ID NO: 3215033 - DNA, 23 bp, Homo sapiens
ctaaccctatactgtagtattct

SEQ ID NO: 3215034 - DNA, 20 bp, Homo sapiens
ctaaccctcccatggcacct

SEQ ID NO: 3215035 - DNA, 12 bp, Homo sapiens
ctaacctggaaa

SEQ ID NO: 3215036 - DNA, 17 bp, Homo sapiens
ctaacctggacctggaa

SEQ ID NO: 3215037 - DNA, 17 bp, Homo sapiens
ctaacctgggttccctt

SEQ ID NO: 3215038 - DNA, 20 bp, Homo sapiens
ctaacgggaggctgggcaca

SEQ ID NO: 3215039 - DNA, 15 bp, Homo sapiens
ctaactaactggcag

SEQ ID NO: 3215040 - DNA, 16 bp, Homo sapiens
ctaactagaattagta

SEQ ID NO: 3215041 - DNA, 15 bp, Homo sapiens
ctaactagacaccaa

SEQ ID NO: 3215042 - DNA, 16 bp, Homo sapiens
ctaactcaaatacaca

SEQ ID NO: 3215043 - DNA, 20 bp, Homo sapiens
ctaactcaaatacacatttg

SEQ ID NO: 3215044 - DNA, 12 bp, Homo sapiens
ctaactccactg

SEQ ID NO: 3215045 - DNA, 22 bp, Homo sapiens
ctaactcctgccattcttctgg

SEQ ID NO: 3215046 - DNA, 19 bp, Homo sapiens
ctaactcttttctattttg

SEQ ID NO: 3215047 - DNA, 20 bp, Homo sapiens
ctaactgctacaaatactct

SEQ ID NO: 3215048 - DNA, 18 bp, Homo sapiens
ctaactgtaaatcatgtt

SEQ ID NO: 3215049 - DNA, 19 bp, Homo sapiens
ctaacttattttatttcca

SEQ ID NO: 3215050 - DNA, 22 bp, Homo sapiens
ctaactttagaagtgcatttct

SEQ ID NO: 3215051 - DNA, 19 bp, Homo sapiens
ctaacttttcaatgacatt

SEQ ID NO: 3215052 - DNA, 15 bp, Homo sapiens
ctaagaaaagatttt

SEQ ID NO: 3215053 - DNA, 17 bp, Homo sapiens
ctaagaaacttttgtaa

SEQ ID NO: 3215054 - DNA, 18 bp, Homo sapiens
ctaagaagcttctaataa

SEQ ID NO: 3215055 - DNA, 22 bp, Homo sapiens
ctaagaagcttctaataaatta

SEQ ID NO: 3215056 - DNA, 18 bp, Homo sapiens
ctaagaataataaaatca

SEQ ID NO: 3215057 - DNA, 17 bp, Homo sapiens
ctaagactcaaatgttc

SEQ ID NO: 3215058 - DNA, 21 bp, Homo sapiens
ctaagactcaaatgttctaag

SEQ ID NO: 3215059 - DNA, 17 bp, Homo sapiens
ctaagacttactctaag

SEQ ID NO: 3215060 - DNA, 19 bp, Homo sapiens
ctaagagaagttattttct

SEQ ID NO: 3215061 - DNA, 21 bp, Homo sapiens
ctaagagacacatacagagtg

SEQ ID NO: 3215062 - DNA, 17 bp, Homo sapiens
ctaagagatttatcttt

SEQ ID NO: 3215063 - DNA, 11 bp, Homo sapiens
ctaagagccat

SEQ ID NO: 3215064 - DNA, 22 bp, Homo sapiens
ctaagagtgctgggcattttta

SEQ ID NO: 3215065 - DNA, 16 bp, Homo sapiens
ctaagatcttagattc

SEQ ID NO: 3215066 - DNA, 11 bp, Homo sapiens
ctaagattcta

SEQ ID NO: 3215067 - DNA, 12 bp, Homo sapiens
ctaagattctaa

SEQ ID NO: 3215068 - DNA, 14 bp, Homo sapiens
ctaagattctagat

SEQ ID NO: 3215069 - DNA, 12 bp, Homo sapiens
ctaagattctga

SEQ ID NO: 3215070 - DNA, 19 bp, Homo sapiens
ctaagattctgattttagg

SEQ ID NO: 3215071 - DNA, 23 bp, Homo sapiens
ctaagattcttttaaattagaaa

SEQ ID NO: 3215072 - DNA, 19 bp, Homo sapiens
ctaagcatgtgtcccagga

SEQ ID NO: 3215073 - DNA, 18 bp, Homo sapiens
ctaagccctcgaaccaag

SEQ ID NO: 3215074 - DNA, 22 bp, Homo sapiens
ctaagccctcgaaccaaggcag

SEQ ID NO: 3215075 - DNA, 20 bp, Homo sapiens
ctaagccctgtcgagacact

SEQ ID NO: 3215076 - DNA, 16 bp, Homo sapiens
ctaagccctttgccat

SEQ ID NO: 3215077 - DNA, 12 bp, Homo sapiens
ctaagcctctgc

SEQ ID NO: 3215078 - DNA, 16 bp, Homo sapiens
ctaagcctttccataa

SEQ ID NO: 3215079 - DNA, 17 bp, Homo sapiens
ctaagcctttccataag

SEQ ID NO: 3215080 - DNA, 14 bp, Homo sapiens
ctaagctaggaatg

SEQ ID NO: 3215081 - DNA, 18 bp, Homo sapiens
ctaagctggctctgtttg

SEQ ID NO: 3215082 - DNA, 12 bp, Homo sapiens
ctaagctgtgtg

SEQ ID NO: 3215083 - DNA, 13 bp, Homo sapiens
ctaagctgtgtgc

SEQ ID NO: 3215084 - DNA, 15 bp, Homo sapiens
ctaaggaaccttcct

SEQ ID NO: 3215085 - DNA, 18 bp, Homo sapiens
ctaaggaatgcacaaatt

SEQ ID NO: 3215086 - DNA, 11 bp, Homo sapiens
ctaaggacaca

SEQ ID NO: 3215087 - DNA, 19 bp, Homo sapiens
ctaaggacctgaaattcca

SEQ ID NO: 3215088 - DNA, 20 bp, Homo sapiens
ctaaggataatgaaataatc

SEQ ID NO: 3215089 - DNA, 12 bp, Homo sapiens
ctaaggatctct

SEQ ID NO: 3215090 - DNA, 18 bp, Homo sapiens
ctaaggatctctcaggag

SEQ ID NO: 3215091 - DNA, 18 bp, Homo sapiens
ctaaggatgtcacagggc

SEQ ID NO: 3215092 - DNA, 13 bp, Homo sapiens
ctaaggcctactt

SEQ ID NO: 3215093 - DNA, 14 bp, Homo sapiens
ctaaggcctaggat

SEQ ID NO: 3215094 - DNA, 19 bp, Homo sapiens
ctaaggcctaggattctaa

SEQ ID NO: 3215095 - DNA, 20 bp, Homo sapiens
ctaaggcctaggattctaaa

SEQ ID NO: 3215096 - DNA, 16 bp, Homo sapiens
ctaaggctcctgtttt

SEQ ID NO: 3215097 - DNA, 18 bp, Homo sapiens
ctaaggctctatgagtct

SEQ ID NO: 3215098 - DNA, 20 bp, Homo sapiens
ctaaggctctatgagtctag

SEQ ID NO: 3215099 - DNA, 23 bp, Homo sapiens
ctaaggctctatgagtctagatg

SEQ ID NO: 3215100 - DNA, 13 bp, Homo sapiens
ctaaggctctgag

SEQ ID NO: 3215101 - DNA, 15 bp, Homo sapiens
ctaaggctctgagag

SEQ ID NO: 3215102 - DNA, 19 bp, Homo sapiens
ctaaggctctgagagtcta

SEQ ID NO: 3215103 - DNA, 11 bp, Homo sapiens
ctaagggggag

SEQ ID NO: 3215104 - DNA, 21 bp, Homo sapiens
ctaagggtcgaaagctctaga

SEQ ID NO: 3215105 - DNA, 22 bp, Homo sapiens
ctaagggtcgaaagctctagaa

SEQ ID NO: 3215106 - DNA, 14 bp, Homo sapiens
ctaagggtgggtgc

SEQ ID NO: 3215107 - DNA, 18 bp, Homo sapiens
ctaagggtgggtgctcag

SEQ ID NO: 3215108 - DNA, 21 bp, Homo sapiens
ctaagggtgggtgctcagaat

SEQ ID NO: 3215109 - DNA, 11 bp, Homo sapiens
ctaaggttcta

SEQ ID NO: 3215110 - DNA, 12 bp, Homo sapiens
ctaaggttctaa

SEQ ID NO: 3215111 - DNA, 16 bp, Homo sapiens
ctaaggttctaaggcc

SEQ ID NO: 3215112 - DNA, 17 bp, Homo sapiens
ctaaggttctaaggcct

SEQ ID NO: 3215113 - DNA, 11 bp, Homo sapiens
ctaagtattta

SEQ ID NO: 3215114 - DNA, 14 bp, Homo sapiens
cgtggtcaccttcg

SEQ ID NO: 3215115 - DNA, 21 bp, Homo sapiens
cgtggtcaccttcgagtagag

SEQ ID NO: 3215116 - DNA, 15 bp, Homo sapiens
cgtggtcactgctgt

SEQ ID NO: 3215117 - DNA, 20 bp, Homo sapiens
cgtggtcactgtgcactgcc

SEQ ID NO: 3215118 - DNA, 17 bp, Homo sapiens
cgtggtcagagtgccac

SEQ ID NO: 3215119 - DNA, 17 bp, Homo sapiens
cgtggtcatgaatagaa

SEQ ID NO: 3215120 - DNA, 13 bp, Homo sapiens
cgtggttcttaaa

SEQ ID NO: 3215121 - DNA, 20 bp, Homo sapiens
cgtgtacagctcccttccct

SEQ ID NO: 3215122 - DNA, 18 bp, Homo sapiens
cgtgtatagtatctgtat

SEQ ID NO: 3215123 - DNA, 18 bp, Homo sapiens
cgtgtcaatttccctcag

SEQ ID NO: 3215124 - DNA, 14 bp, Homo sapiens
cgtgtcccaaggag

SEQ ID NO: 3215125 - DNA, 18 bp, Homo sapiens
cgtgtcccaaggagctga

SEQ ID NO: 3215126 - DNA, 15 bp, Homo sapiens
cgtgtccctctcgga

SEQ ID NO: 3215127 - DNA, 15 bp, Homo sapiens
cgtgtcgtgggtgtg

SEQ ID NO: 3215128 - DNA, 14 bp, Homo sapiens
cgtgtctctcccac

SEQ ID NO: 3215129 - DNA, 14 bp, Homo sapiens
cgtgtctctgagga

SEQ ID NO: 3215130 - DNA, 13 bp, Homo sapiens
cgtgtcttccact

SEQ ID NO: 3215131 - DNA, 18 bp, Homo sapiens
cgtgtgaagccacggaag

SEQ ID NO: 3215132 - DNA, 23 bp, Homo sapiens
cgtgtgagaagtgaatgctggga

SEQ ID NO: 3215133 - DNA, 16 bp, Homo sapiens
cgtgtggatcttgcca

SEQ ID NO: 3215134 - DNA, 18 bp, Homo sapiens
cgtgtggatcttgccaca

SEQ ID NO: 3215135 - DNA, 21 bp, Homo sapiens
cgtgtgggtcccgcactctgc

SEQ ID NO: 3215136 - DNA, 23 bp, Homo sapiens
cgtgtgtaaatatgtacatttgt

SEQ ID NO: 3215137 - DNA, 12 bp, Homo sapiens
cgtgtgtagagt

SEQ ID NO: 3215138 - DNA, 22 bp, Homo sapiens
cgtgtgtagagttaagaagctg

SEQ ID NO: 3215139 - DNA, 19 bp, Homo sapiens
cgtgtgtatccgactctaa

SEQ ID NO: 3215140 - DNA, 15 bp, Homo sapiens
cgtgtgttctatcca

SEQ ID NO: 3215141 - DNA, 20 bp, Homo sapiens
cgttaacctttttgtaaata

SEQ ID NO: 3215142 - DNA, 13 bp, Homo sapiens
cgttaagggcaga

SEQ ID NO: 3215143 - DNA, 14 bp, Homo sapiens
cgttaagggcagag

SEQ ID NO: 3215144 - DNA, 23 bp, Homo sapiens
cgttactcagggctcctcccagc

SEQ ID NO: 3215145 - DNA, 13 bp, Homo sapiens
cgttagctttttc

SEQ ID NO: 3215146 - DNA, 16 bp, Homo sapiens
cgttcacctccctgct

SEQ ID NO: 3215147 - DNA, 13 bp, Homo sapiens
cgttcactccaat

SEQ ID NO: 3215148 - DNA, 19 bp, Homo sapiens
cgttcagtgtcccaggcag

SEQ ID NO: 3215149 - DNA, 21 bp, Homo sapiens
cgttcatatgctctgctttta

SEQ ID NO: 3215150 - DNA, 22 bp, Homo sapiens
cgttccacagttgccaccacct

SEQ ID NO: 3215151 - DNA, 14 bp, Homo sapiens
cgttccccttggct

SEQ ID NO: 3215152 - DNA, 19 bp, Homo sapiens
cgttccccttggcttcctc

SEQ ID NO: 3215153 - DNA, 18 bp, Homo sapiens
cgttcgatttctacctca

SEQ ID NO: 3215154 - DNA, 14 bp, Homo sapiens
cgttctcacaccca

SEQ ID NO: 3215155 - DNA, 15 bp, Homo sapiens
cgttctcacacccac

SEQ ID NO: 3215156 - DNA, 16 bp, Homo sapiens
cgttctcacacccacc

SEQ ID NO: 3215157 - DNA, 18 bp, Homo sapiens
cgttctcacacccaccgt

SEQ ID NO: 3215158 - DNA, 12 bp, Homo sapiens
cgttctgttctg

SEQ ID NO: 3215159 - DNA, 12 bp, Homo sapiens
cgttgcatgtcg

SEQ ID NO: 3215160 - DNA, 18 bp, Homo sapiens
cgttggacttttcgttaa

SEQ ID NO: 3215161 - DNA, 14 bp, Homo sapiens
cgttggagactgaa

SEQ ID NO: 3215162 - DNA, 23 bp, Homo sapiens
cgttggcctcagggccaggaagg

SEQ ID NO: 3215163 - DNA, 21 bp, Homo sapiens
cgtttagtttctagaggcctc

SEQ ID NO: 3215164 - DNA, 15 bp, Homo sapiens
cgtttattttcaaga

SEQ ID NO: 3215165 - DNA, 22 bp, Homo sapiens
cgtttcagcgactccgttggcc

SEQ ID NO: 3215166 - DNA, 11 bp, Homo sapiens
cgtttccatca

SEQ ID NO: 3215167 - DNA, 18 bp, Homo sapiens
cgtttctccacctagact

SEQ ID NO: 3215168 - DNA, 18 bp, Homo sapiens
cgtttggtttgcgcagta

SEQ ID NO: 3215169 - DNA, 16 bp, Homo sapiens
cgttttagaagagagc

SEQ ID NO: 3215170 - DNA, 18 bp, Homo sapiens
cgttttattgtgttttta

SEQ ID NO: 3215171 - DNA, 19 bp, Homo sapiens
cgttttccaaactgactca

SEQ ID NO: 3215172 - DNA, 20 bp, Homo sapiens
cgttttgaagctactgtgtg

SEQ ID NO: 3215173 - DNA, 12 bp, Homo sapiens
cgttttgcctgt

SEQ ID NO: 3215174 - DNA, 11 bp, Homo sapiens
cgttttgtcac

SEQ ID NO: 3215175 - DNA, 13 bp, Homo sapiens
cgttttgtctgtg

SEQ ID NO: 3215176 - DNA, 14 bp, Homo sapiens
cgttttgtttgaaa

SEQ ID NO: 3215177 - DNA, 12 bp, Homo sapiens
cgtttttacata

SEQ ID NO: 3215178 - DNA, 15 bp, Homo sapiens
cgtttttgtattttc

SEQ ID NO: 3215179 - DNA, 21 bp, Homo sapiens
cgtttttgtattttcatgaaa

SEQ ID NO: 3215180 - DNA, 19 bp, Homo sapiens
ctaaaaaaaaaaaggccgc

SEQ ID NO: 3215181 - DNA, 14 bp, Homo sapiens
ctaaaaaaaagatg

SEQ ID NO: 3215182 - DNA, 11 bp, Homo sapiens
ctaaaaaaagt

SEQ ID NO: 3215183 - DNA, 14 bp, Homo sapiens
ctaaaaaaagtgca

SEQ ID NO: 3215184 - DNA, 19 bp, Homo sapiens
ctaaaaaaagtgcatgatg

SEQ ID NO: 3215185 - DNA, 11 bp, Homo sapiens
ctaaaaaacat

SEQ ID NO: 3215186 - DNA, 22 bp, Homo sapiens
ctaaaaaacataaatttcttta

SEQ ID NO: 3215187 - DNA, 20 bp, Homo sapiens
ctaaaaacatttactgacca

SEQ ID NO: 3215188 - DNA, 15 bp, Homo sapiens
ctaaaaagattagca

SEQ ID NO: 3215189 - DNA, 23 bp, Homo sapiens
ctaaaaatatgcagaatctctgc

SEQ ID NO: 3215190 - DNA, 22 bp, Homo sapiens
ctaaaaatattataacttaaaa

SEQ ID NO: 3215191 - DNA, 13 bp, Homo sapiens
ctaaaaatccaga

SEQ ID NO: 3215192 - DNA, 17 bp, Homo sapiens
ctaaaacaaaatctgaa

SEQ ID NO: 3215193 - DNA, 18 bp, Homo sapiens
ctaaaacaaaatctgaac

SEQ ID NO: 3215194 - DNA, 18 bp, Homo sapiens
ctaaaactggcctgactt

SEQ ID NO: 3215195 - DNA, 20 bp, Homo sapiens
ctaaaagaatattcagagaa

SEQ ID NO: 3215196 - DNA, 23 bp, Homo sapiens
ctaaaaggtatgcaatcaaatct

SEQ ID NO: 3215197 - DNA, 13 bp, Homo sapiens
ctaaaagtaaaca

SEQ ID NO: 3215198 - DNA, 12 bp, Homo sapiens
ctaaaagttcat

SEQ ID NO: 3215199 - DNA, 18 bp, Homo sapiens
ctaaaagttcataacagt

SEQ ID NO: 3215200 - DNA, 14 bp, Homo sapiens
ctaaaatacattta

SEQ ID NO: 3215201 - DNA, 23 bp, Homo sapiens
ctaaaatatttattttttttaag

SEQ ID NO: 3215202 - DNA, 19 bp, Homo sapiens
ctaaaatcattgtcaaaat

SEQ ID NO: 3215203 - DNA, 21 bp, Homo sapiens
ctaaaatcttatagttctagg

SEQ ID NO: 3215204 - DNA, 16 bp, Homo sapiens
ctaaaatcttggaagt

SEQ ID NO: 3215205 - DNA, 22 bp, Homo sapiens
ctaaaatgtgatgttctaaggc

SEQ ID NO: 3215206 - DNA, 17 bp, Homo sapiens
ctaaaattaggactgta

SEQ ID NO: 3215207 - DNA, 18 bp, Homo sapiens
ctaaaattgtatgaaaat

SEQ ID NO: 3215208 - DNA, 23 bp, Homo sapiens
ctaaaatttaatttcttttttcc

SEQ ID NO: 3215209 - DNA, 17 bp, Homo sapiens
ctaaacaagaaccattt

SEQ ID NO: 3215210 - DNA, 19 bp, Homo sapiens
ctaaacaagaatcagtcta

SEQ ID NO: 3215211 - DNA, 13 bp, Homo sapiens
ctaaacagatata

SEQ ID NO: 3215212 - DNA, 16 bp, Homo sapiens
ctaaacataattgtgg

SEQ ID NO: 3215213 - DNA, 18 bp, Homo sapiens
ctaaacatccaatatttt

SEQ ID NO: 3215214 - DNA, 17 bp, Homo sapiens
ctaaacattttgttatt

SEQ ID NO: 3215215 - DNA, 17 bp, Homo sapiens
ctaaaccaactctaata

SEQ ID NO: 3215216 - DNA, 20 bp, Homo sapiens
ctaaacggttcagtttcttc

SEQ ID NO: 3215217 - DNA, 16 bp, Homo sapiens
ctaaactagtttttcc

SEQ ID NO: 3215218 - DNA, 21 bp, Homo sapiens
ctaaactatctgtatttatta

SEQ ID NO: 3215219 - DNA, 13 bp, Homo sapiens
ctaaactttattt

SEQ ID NO: 3215220 - DNA, 18 bp, Homo sapiens
ctaaactttatttgtaaa

SEQ ID NO: 3215221 - DNA, 18 bp, Homo sapiens
ctaaactttttttctgta

SEQ ID NO: 3215222 - DNA, 21 bp, Homo sapiens
ctaaagaaaaatatcttggcc

SEQ ID NO: 3215223 - DNA, 12 bp, Homo sapiens
ctaaagaccaaa

SEQ ID NO: 3215224 - DNA, 19 bp, Homo sapiens
ctaaagagagaatgtagat

SEQ ID NO: 3215225 - DNA, 16 bp, Homo sapiens
ctaaagagcccttgcc

SEQ ID NO: 3215226 - DNA, 22 bp, Homo sapiens
ctaaagagcccttgcctcccca

SEQ ID NO: 3215227 - DNA, 15 bp, Homo sapiens
ctaaagataatatta

SEQ ID NO: 3215228 - DNA, 21 bp, Homo sapiens
ctaaagatggagtttctaagg

SEQ ID NO: 3215229 - DNA, 12 bp, Homo sapiens
ctaaagcacttt

SEQ ID NO: 3215230 - DNA, 20 bp, Homo sapiens
ctaaagcactttgcacttaa

SEQ ID NO: 3215231 - DNA, 21 bp, Homo sapiens
ctaaagcactttgcacttaat

SEQ ID NO: 3215232 - DNA, 12 bp, Homo sapiens
ctaaagctctga

SEQ ID NO: 3215233 - DNA, 15 bp, Homo sapiens
ctaaagggagaagga

SEQ ID NO: 3215234 - DNA, 19 bp, Homo sapiens
cgcccaccgtgggcagtgc

SEQ ID NO: 3215235 - DNA, 21 bp, Homo sapiens
cgcccacctagtgcttccact

SEQ ID NO: 3215236 - DNA, 14 bp, Homo sapiens
cgcccacctcccca

SEQ ID NO: 3215237 - DNA, 12 bp, Homo sapiens
cgcccagtctgg

SEQ ID NO: 3215238 - DNA, 13 bp, Homo sapiens
cgcccagtctgga

SEQ ID NO: 3215239 - DNA, 12 bp, Homo sapiens
cgccccacctcc

SEQ ID NO: 3215240 - DNA, 19 bp, Homo sapiens
cgccccagataccagcccc

SEQ ID NO: 3215241 - DNA, 20 bp, Homo sapiens
cgccccagataccagcccct

SEQ ID NO: 3215242 - DNA, 12 bp, Homo sapiens
cgccccagcccg

SEQ ID NO: 3215243 - DNA, 11 bp, Homo sapiens
cgcccccagcc

SEQ ID NO: 3215244 - DNA, 17 bp, Homo sapiens
cgccccctccgccctgc

SEQ ID NO: 3215245 - DNA, 18 bp, Homo sapiens
cgtggggtgtgctgggag

SEQ ID NO: 3215246 - DNA, 21 bp, Homo sapiens
cgtgggtcactacagggagaa

SEQ ID NO: 3215247 - DNA, 18 bp, Homo sapiens
cgtgggtctgttttcctt

SEQ ID NO: 3215248 - DNA, 20 bp, Homo sapiens
cgtgggtctgttttcctttc

SEQ ID NO: 3215249 - DNA, 13 bp, Homo sapiens
cgtggtagaggcc

SEQ ID NO: 3215250 - DNA, 18 bp, Homo sapiens
ctagatttgtccttttat

SEQ ID NO: 3215251 - DNA, 23 bp, Homo sapiens
ctagattttaatttatttgtttc

SEQ ID NO: 3215252 - DNA, 16 bp, Homo sapiens
ctagcaagctggcctc

SEQ ID NO: 3215253 - DNA, 12 bp, Homo sapiens
ctagcagacaga

SEQ ID NO: 3215254 - DNA, 16 bp, Homo sapiens
ctagcagacagaaact

SEQ ID NO: 3215255 - DNA, 21 bp, Homo sapiens
ctagcagacagaaactggatt

SEQ ID NO: 3215256 - DNA, 22 bp, Homo sapiens
ctagcaggcctaagacatgtga

SEQ ID NO: 3215257 - DNA, 17 bp, Homo sapiens
ctagcagggaacactaa

SEQ ID NO: 3215258 - DNA, 17 bp, Homo sapiens
ctagcagtgaactattt

SEQ ID NO: 3215259 - DNA, 21 bp, Homo sapiens
ctagcatagaatagcgacagg

SEQ ID NO: 3215260 - DNA, 14 bp, Homo sapiens
ctagccaaggctag

SEQ ID NO: 3215261 - DNA, 20 bp, Homo sapiens
ctagccagcacttgtatata

SEQ ID NO: 3215262 - DNA, 13 bp, Homo sapiens
ctagccaggagtc

SEQ ID NO: 3215263 - DNA, 19 bp, Homo sapiens
ctagccaggagtctgtgct

SEQ ID NO: 3215264 - DNA, 20 bp, Homo sapiens
ctagccaggagtctgtgctc

SEQ ID NO: 3215265 - DNA, 19 bp, Homo sapiens
ctagccagtgctccaggca

SEQ ID NO: 3215266 - DNA, 12 bp, Homo sapiens
ctagcccaccct

SEQ ID NO: 3215267 - DNA, 14 bp, Homo sapiens
ctagcccaccctgc

SEQ ID NO: 3215268 - DNA, 18 bp, Homo sapiens
ctagcccaccctgctgcc

SEQ ID NO: 3215269 - DNA, 16 bp, Homo sapiens
ctagcccaggagagag

SEQ ID NO: 3215270 - DNA, 17 bp, Homo sapiens
ctagcccaggagagaga

SEQ ID NO: 3215271 - DNA, 19 bp, Homo sapiens
ctagcccaggagagagaaa

SEQ ID NO: 3215272 - DNA, 20 bp, Homo sapiens
ctagcccaggagagagaaag

SEQ ID NO: 3215273 - DNA, 21 bp, Homo sapiens
ctagccccagagatgccagcc

SEQ ID NO: 3215274 - DNA, 23 bp, Homo sapiens
ctagccccagagatgccagccct

SEQ ID NO: 3215275 - DNA, 20 bp, Homo sapiens
ctagcccctgtggagactgg

SEQ ID NO: 3215276 - DNA, 18 bp, Homo sapiens
ctagccctctcacattta

SEQ ID NO: 3215277 - DNA, 19 bp, Homo sapiens
ctagccctctcacatttat

SEQ ID NO: 3215278 - DNA, 18 bp, Homo sapiens
ctagcctatttacctgca

SEQ ID NO: 3215279 - DNA, 18 bp, Homo sapiens
ctagcctgaaggattctg

SEQ ID NO: 3215280 - DNA, 22 bp, Homo sapiens
ctagcctgaaggattctgggaa

SEQ ID NO: 3215281 - DNA, 19 bp, Homo sapiens
ctagcctgcattgagcttg

SEQ ID NO: 3215282 - DNA, 15 bp, Homo sapiens
ctagcctgggccaga

SEQ ID NO: 3215283 - DNA, 22 bp, Homo sapiens
ctagcctgtgcctctgggactg

SEQ ID NO: 3215284 - DNA, 16 bp, Homo sapiens
ctagcctgtttcttcc

SEQ ID NO: 3215285 - DNA, 22 bp, Homo sapiens
ctagccttagaagtcacacagt

SEQ ID NO: 3215286 - DNA, 13 bp, Homo sapiens
ctagccttgcttg

SEQ ID NO: 3215287 - DNA, 14 bp, Homo sapiens
ctagccttgcttgt

SEQ ID NO: 3215288 - DNA, 16 bp, Homo sapiens
ctagcctttggctctg

SEQ ID NO: 3215289 - DNA, 17 bp, Homo sapiens
ctagcctttggctctgg

SEQ ID NO: 3215290 - DNA, 18 bp, Homo sapiens
ctagcctttggctctgga

SEQ ID NO: 3215291 - DNA, 19 bp, Homo sapiens
ctagcgatctctcctggcc

SEQ ID NO: 3215292 - DNA, 14 bp, Homo sapiens
ctagcggagcccag

SEQ ID NO: 3215293 - DNA, 22 bp, Homo sapiens
ctagcggagcccagcctgggag

SEQ ID NO: 3215294 - DNA, 14 bp, Homo sapiens
ctagctagaaatat

SEQ ID NO: 3215295 - DNA, 15 bp, Homo sapiens
ctagctagaaatatg

SEQ ID NO: 3215296 - DNA, 17 bp, Homo sapiens
ctagctcctgccacatg

SEQ ID NO: 3215297 - DNA, 21 bp, Homo sapiens
ctagctgcctagcaagctggc

SEQ ID NO: 3215298 - DNA, 13 bp, Homo sapiens
ctagctggcagga

SEQ ID NO: 3215299 - DNA, 14 bp, Homo sapiens
ctagctggcaggac

SEQ ID NO: 3215300 - DNA, 13 bp, Homo sapiens
ctagctggctctg

SEQ ID NO: 3215301 - DNA, 15 bp, Homo sapiens
ctagctggtggtttc

SEQ ID NO: 3215302 - DNA, 13 bp, Homo sapiens
ctagcttctgctt

SEQ ID NO: 3215303 - DNA, 14 bp, Homo sapiens
ctagctttttaatt

SEQ ID NO: 3215304 - DNA, 17 bp, Homo sapiens
ctaggaatgaaatcctg

SEQ ID NO: 3215305 - DNA, 20 bp, Homo sapiens
ctaggacacagttcctggga

SEQ ID NO: 3215306 - DNA, 22 bp, Homo sapiens
ctaggaccactcagcccctagg

SEQ ID NO: 3215307 - DNA, 21 bp, Homo sapiens
ctaggaccatggttaagagtc

SEQ ID NO: 3215308 - DNA, 17 bp, Homo sapiens
ctaggacgttggcctca

SEQ ID NO: 3215309 - DNA, 24 bp, Homo sapiens
ctaggacgttggcctcagggccag

SEQ ID NO: 3215310 - DNA, 15 bp, Homo sapiens
ctaggactctgaggc

SEQ ID NO: 3215311 - DNA, 12 bp, Homo sapiens
ctaggactgagg

SEQ ID NO: 3215312 - DNA, 18 bp, Homo sapiens
ctaggagaaccaaatctg

SEQ ID NO: 3215313 - DNA, 21 bp, Homo sapiens
ctaggagaaccaaatctggaa

SEQ ID NO: 3215314 - DNA, 23 bp, Homo sapiens
ctaggagaaccaaatctggaagc

SEQ ID NO: 3215315 - DNA, 20 bp, Homo sapiens
ctaggagagactgaaagcag

SEQ ID NO: 3215316 - DNA, 21 bp, Homo sapiens
ctaggagagactgaaagcagc

SEQ ID NO: 3215317 - DNA, 19 bp, Homo sapiens
ctaggagtatatttccgca

SEQ ID NO: 3215318 - DNA, 22 bp, Homo sapiens
ctaggatagctaactgtaaatc

SEQ ID NO: 3215319 - DNA, 15 bp, Homo sapiens
ctaggatagttgatg

SEQ ID NO: 3215320 - DNA, 19 bp, Homo sapiens
ctaggatagttgatgcatg

SEQ ID NO: 3215321 - DNA, 21 bp, Homo sapiens
ctaggatagttgatgcatgtt

SEQ ID NO: 3215322 - DNA, 14 bp, Homo sapiens
ctaggatggttctg

SEQ ID NO: 3215323 - DNA, 16 bp, Homo sapiens
ctaggatggttctgtg

SEQ ID NO: 3215324 - DNA, 14 bp, Homo sapiens
ctaggattgggcct

SEQ ID NO: 3215325 - DNA, 18 bp, Homo sapiens
ctaggattgggcctccca

SEQ ID NO: 3215326 - DNA, 18 bp, Homo sapiens
ctaggcatcccaggggac

SEQ ID NO: 3215327 - DNA, 22 bp, Homo sapiens
ctaggccaaatgcacaagctca

SEQ ID NO: 3215328 - DNA, 19 bp, Homo sapiens
ctaggccacaccatctcct

SEQ ID NO: 3215329 - DNA, 15 bp, Homo sapiens
ctaggccccagaggc

SEQ ID NO: 3215330 - DNA, 16 bp, Homo sapiens
ctaggccccagaggcc

SEQ ID NO: 3215331 - DNA, 16 bp, Homo sapiens
ctaggcccccacttgc

SEQ ID NO: 3215332 - DNA, 20 bp, Homo sapiens
ctaggcccccacttgcctct

SEQ ID NO: 3215333 - DNA, 22 bp, Homo sapiens
ctaggcccctcctagacccagg

SEQ ID NO: 3215334 - DNA, 16 bp, Homo sapiens
ctaggcctctccagtt

SEQ ID NO: 3215335 - DNA, 14 bp, Homo sapiens
ctaggcctttcctg

SEQ ID NO: 3215336 - DNA, 19 bp, Homo sapiens
ctaggcgattttgtctacc

SEQ ID NO: 3215337 - DNA, 13 bp, Homo sapiens
ctaggctaggacg

SEQ ID NO: 3215338 - DNA, 13 bp, Homo sapiens
ctaggctgttttc

SEQ ID NO: 3215339 - DNA, 21 bp, Homo sapiens
ctaggcttcagcatatttata

SEQ ID NO: 3215340 - DNA, 18 bp, Homo sapiens
ctaggcttcaggccgagc

SEQ ID NO: 3215341 - DNA, 18 bp, Homo sapiens
ctagggagccatttgaga

SEQ ID NO: 3215342 - DNA, 23 bp, Homo sapiens
ctagggaggaccttatctgtgcg

SEQ ID NO: 3215343 - DNA, 15 bp, Homo sapiens
ctagggattcaggct

SEQ ID NO: 3215344 - DNA, 23 bp, Homo sapiens
ctatatttattttcagtatactg

SEQ ID NO: 3215345 - DNA, 21 bp, Homo sapiens
ctatatttgtgctatttaatt

SEQ ID NO: 3215346 - DNA, 16 bp, Homo sapiens
ctatattttaatagaa

SEQ ID NO: 3215347 - DNA, 17 bp, Homo sapiens
ctatcaagtcaatcatt

SEQ ID NO: 3215348 - DNA, 23 bp, Homo sapiens
ctatcaagtgtgctttagcttga

SEQ ID NO: 3215349 - DNA, 16 bp, Homo sapiens
ctatcacctatttcca

SEQ ID NO: 3215350 - DNA, 21 bp, Homo sapiens
ctatcagcaatactcatcaga

SEQ ID NO: 3215351 - DNA, 17 bp, Homo sapiens
ctatcatttttgtacag

SEQ ID NO: 3215352 - DNA, 18 bp, Homo sapiens
ctatcatttttgtacagt

SEQ ID NO: 3215353 - DNA, 14 bp, Homo sapiens
ctatccaaacatgt

SEQ ID NO: 3215354 - DNA, 23 bp, Homo sapiens
ctatccaaagaacttgatttgca

SEQ ID NO: 3215355 - DNA, 13 bp, Homo sapiens
ctatccacagaga

SEQ ID NO: 3215356 - DNA, 17 bp, Homo sapiens
ctatccacagagagtcc

SEQ ID NO: 3215357 - DNA, 19 bp, Homo sapiens
ctatccacagagagtccca

SEQ ID NO: 3215358 - DNA, 23 bp, Homo sapiens
ctatccacagagagtcccactgc

SEQ ID NO: 3215359 - DNA, 21 bp, Homo sapiens
ctatccactgggcacaactgc

SEQ ID NO: 3215360 - DNA, 15 bp, Homo sapiens
ctatccatgcaccaa

SEQ ID NO: 3215361 - DNA, 18 bp, Homo sapiens
ctatccatgcaccaaact

SEQ ID NO: 3215362 - DNA, 16 bp, Homo sapiens
ctatcccaatcaaaga

SEQ ID NO: 3215363 - DNA, 23 bp, Homo sapiens
ctatccccatctccctgcctggc

SEQ ID NO: 3215364 - DNA, 18 bp, Homo sapiens
ctatccctaggcacttaa

SEQ ID NO: 3215365 - DNA, 15 bp, Homo sapiens
ctatccgctgccagc

SEQ ID NO: 3215366 - DNA, 23 bp, Homo sapiens
ctatcctgacttctaatatcatt

SEQ ID NO: 3215367 - DNA, 16 bp, Homo sapiens
ctatccttccagtggc

SEQ ID NO: 3215368 - DNA, 12 bp, Homo sapiens
ctatccttcgtg

SEQ ID NO: 3215369 - DNA, 14 bp, Homo sapiens
ctatctaaatgttg

SEQ ID NO: 3215370 - DNA, 20 bp, Homo sapiens
ctatctaggtggagttgaaa

SEQ ID NO: 3215371 - DNA, 22 bp, Homo sapiens
ctatctaggtggagttgaaaga

SEQ ID NO: 3215372 - DNA, 19 bp, Homo sapiens
ctatctcccccaacccacc

SEQ ID NO: 3215373 - DNA, 23 bp, Homo sapiens
ctatctcccccaacccacctctg

SEQ ID NO: 3215374 - DNA, 17 bp, Homo sapiens
ctatctctgtgtgcaca

SEQ ID NO: 3215375 - DNA, 12 bp, Homo sapiens
ctatctgtattt

SEQ ID NO: 3215376 - DNA, 16 bp, Homo sapiens
ctatctgtctggtggc

SEQ ID NO: 3215377 - DNA, 23 bp, Homo sapiens
ctatctgttcccctgtcctgtga

SEQ ID NO: 3215378 - DNA, 15 bp, Homo sapiens
ctatcttcttcaaat

SEQ ID NO: 3215379 - DNA, 18 bp, Homo sapiens
ctatcttcttcaaataca

SEQ ID NO: 3215380 - DNA, 20 bp, Homo sapiens
ctatcttcttcaaatacaaa

SEQ ID NO: 3215381 - DNA, 13 bp, Homo sapiens
ctccatccaaggc

SEQ ID NO: 3215382 - DNA, 14 bp, Homo sapiens
ctccatccaaggcc

SEQ ID NO: 3215383 - DNA, 12 bp, Homo sapiens
ctccatccctct

SEQ ID NO: 3215384 - DNA, 22 bp, Homo sapiens
ctccatccctctaatgagactg

SEQ ID NO: 3215385 - DNA, 16 bp, Homo sapiens
ctccatccctggcccc

SEQ ID NO: 3215386 - DNA, 19 bp, Homo sapiens
ctccatccctggccccctc

SEQ ID NO: 3215387 - DNA, 13 bp, Homo sapiens
ctccatcctgagg

SEQ ID NO: 3215388 - DNA, 18 bp, Homo sapiens
ctccatcctgaggctcca

SEQ ID NO: 3215389 - DNA, 20 bp, Homo sapiens
ctccatcctgaggctccact

SEQ ID NO: 3215390 - DNA, 23 bp, Homo sapiens
ctccatcctgaggctccacttgg

SEQ ID NO: 3215391 - DNA, 14 bp, Homo sapiens
ctccatctccactc

SEQ ID NO: 3215392 - DNA, 21 bp, Homo sapiens
ctccatctctcatcctccagt

SEQ ID NO: 3215393 - DNA, 21 bp, Homo sapiens
ctccatgactggctgtctgcc

SEQ ID NO: 3215394 - DNA, 16 bp, Homo sapiens
ctccatgattctctga

SEQ ID NO: 3215395 - DNA, 21 bp, Homo sapiens
ctccatgattctctgagtggt

SEQ ID NO: 3215396 - DNA, 14 bp, Homo sapiens
ctccatgcctctgg

SEQ ID NO: 3215397 - DNA, 20 bp, Homo sapiens
ctccatgcctctggaggcct

SEQ ID NO: 3215398 - DNA, 18 bp, Homo sapiens
ctccatgctcctcactgc

SEQ ID NO: 3215399 - DNA, 17 bp, Homo sapiens
ctccatgctgcctccag

SEQ ID NO: 3215400 - DNA, 20 bp, Homo sapiens
ctccatttggtcctttctcc

SEQ ID NO: 3215401 - DNA, 21 bp, Homo sapiens
ctccatttggtcctttctcca

SEQ ID NO: 3215402 - DNA, 23 bp, Homo sapiens
ctcccaaagctcagacttgccag

SEQ ID NO: 3215403 - DNA, 22 bp, Homo sapiens
ctcccaaagtgctgagattaca

SEQ ID NO: 3215404 - DNA, 16 bp, Homo sapiens
ctcccaaagtgctggg

SEQ ID NO: 3215405 - DNA, 22 bp, Homo sapiens
ctcccaacccattcactacagg

SEQ ID NO: 3215406 - DNA, 18 bp, Homo sapiens
ctcccaacccccctcctg

SEQ ID NO: 3215407 - DNA, 14 bp, Homo sapiens
ctcccaaccctggc

SEQ ID NO: 3215408 - DNA, 21 bp, Homo sapiens
ctcccaagacttcattgtccc

SEQ ID NO: 3215409 - DNA, 22 bp, Homo sapiens
ctcccaagacttcattgtccct

SEQ ID NO: 3215410 - DNA, 21 bp, Homo sapiens
ctcccaaggctgcgtctggag

SEQ ID NO: 3215411 - DNA, 23 bp, Homo sapiens
ctcccaaggctgcgtctggaggg

SEQ ID NO: 3215412 - DNA, 17 bp, Homo sapiens
ctcccaaggtcctctca

SEQ ID NO: 3215413 - DNA, 18 bp, Homo sapiens
ctcccaaggtcctctcag

SEQ ID NO: 3215414 - DNA, 19 bp, Homo sapiens
ctcccaaggtcctctcagt

SEQ ID NO: 3215415 - DNA, 19 bp, Homo sapiens
ctcccaagtttccatagca

SEQ ID NO: 3215416 - DNA, 17 bp, Homo sapiens
ctcccacagagtgctgg

SEQ ID NO: 3215417 - DNA, 21 bp, Homo sapiens
ctcccacagagtgctggactg

SEQ ID NO: 3215418 - DNA, 22 bp, Homo sapiens
ctcccacagagtgctggactgt

SEQ ID NO: 3215419 - DNA, 14 bp, Homo sapiens
ctcccacaggccct

SEQ ID NO: 3215420 - DNA, 20 bp, Homo sapiens
ctcccacaggcccttcctct

SEQ ID NO: 3215421 - DNA, 17 bp, Homo sapiens
ctcccaccactccactc

SEQ ID NO: 3215422 - DNA, 15 bp, Homo sapiens
ctcccacccccatct

SEQ ID NO: 3215423 - DNA, 22 bp, Homo sapiens
ctcccacccccttctctgctcc

SEQ ID NO: 3215424 - DNA, 17 bp, Homo sapiens
ctcccaccccggcctcc

SEQ ID NO: 3215425 - DNA, 19 bp, Homo sapiens
ctcccaccccggcctccac

SEQ ID NO: 3215426 - DNA, 23 bp, Homo sapiens
ctcccacccgatgctgctttccc

SEQ ID NO: 3215427 - DNA, 23 bp, Homo sapiens
ctcccaccctgtacctcatccca

SEQ ID NO: 3215428 - DNA, 12 bp, Homo sapiens
ctcccaccgccc

SEQ ID NO: 3215429 - DNA, 20 bp, Homo sapiens
ctcccaccgcccccacccct

SEQ ID NO: 3215430 - DNA, 16 bp, Homo sapiens
ctcccacctcagcctc

SEQ ID NO: 3215431 - DNA, 23 bp, Homo sapiens
ctcccacctctccttttgaggct

SEQ ID NO: 3215432 - DNA, 15 bp, Homo sapiens
ctcccacctgacaca

SEQ ID NO: 3215433 - DNA, 14 bp, Homo sapiens
ctcccactcttgaa

SEQ ID NO: 3215434 - DNA, 17 bp, Homo sapiens
ctcccactcttgaagag

SEQ ID NO: 3215435 - DNA, 14 bp, Homo sapiens
ctcccactgcgggg

SEQ ID NO: 3215436 - DNA, 15 bp, Homo sapiens
ctcccagaggagcca

SEQ ID NO: 3215437 - DNA, 14 bp, Homo sapiens
ctcccagaggtcca

SEQ ID NO: 3215438 - DNA, 17 bp, Homo sapiens
ctcccagaggtccagcc

SEQ ID NO: 3215439 - DNA, 19 bp, Homo sapiens
ctcccagaggtccagccca

SEQ ID NO: 3215440 - DNA, 20 bp, Homo sapiens
ctcccagaggtccagcccat

SEQ ID NO: 3215441 - DNA, 19 bp, Homo sapiens
ctcccagcactccccttgc

SEQ ID NO: 3215442 - DNA, 17 bp, Homo sapiens
ctccctccagtaccata

SEQ ID NO: 3215443 - DNA, 12 bp, Homo sapiens
ctccctccccag

SEQ ID NO: 3215444 - DNA, 21 bp, Homo sapiens
ctccctcccctgccctggtcc

SEQ ID NO: 3215445 - DNA, 14 bp, Homo sapiens
ctccctcctcacct

SEQ ID NO: 3215446 - DNA, 18 bp, Homo sapiens
ctccctcctcacctctgg

SEQ ID NO: 3215447 - DNA, 16 bp, Homo sapiens
ctccctcctccaggcc

SEQ ID NO: 3215448 - DNA, 17 bp, Homo sapiens
ctccctctcaggatcca

SEQ ID NO: 3215449 - DNA, 12 bp, Homo sapiens
ctccctctctct

SEQ ID NO: 3215450 - DNA, 21 bp, Homo sapiens
ctccctctctcttctgctcca

SEQ ID NO: 3215451 - DNA, 14 bp, Homo sapiens
ctccctctgacctg

SEQ ID NO: 3215452 - DNA, 17 bp, Homo sapiens
ctccctctgacctgcag

SEQ ID NO: 3215453 - DNA, 18 bp, Homo sapiens
ctccctctgatttttcat

SEQ ID NO: 3215454 - DNA, 13 bp, Homo sapiens
ctccctctgcccc

SEQ ID NO: 3215455 - DNA, 14 bp, Homo sapiens
ctccctctgccttc

SEQ ID NO: 3215456 - DNA, 22 bp, Homo sapiens
ctccctctgccttcaggcttct

SEQ ID NO: 3215457 - DNA, 12 bp, Homo sapiens
ctccctcttcca

SEQ ID NO: 3215458 - DNA, 12 bp, Homo sapiens
ctccctcttgtt

SEQ ID NO: 3215459 - DNA, 17 bp, Homo sapiens
ctccctcttgttttgtt

SEQ ID NO: 3215460 - DNA, 15 bp, Homo sapiens
ctccctgaagccagc

SEQ ID NO: 3215461 - DNA, 18 bp, Homo sapiens
ctccctgaagccagcctt

SEQ ID NO: 3215462 - DNA, 18 bp, Homo sapiens
ctccctgactccctgtgg

SEQ ID NO: 3215463 - DNA, 19 bp, Homo sapiens
ctccctgactccctgtggg

SEQ ID NO: 3215464 - DNA, 17 bp, Homo sapiens
ctccctgccaagtctca

SEQ ID NO: 3215465 - DNA, 17 bp, Homo sapiens
ctccctgcccctccctt

SEQ ID NO: 3215466 - DNA, 18 bp, Homo sapiens
ctccctgcccctcccttc

SEQ ID NO: 3215467 - DNA, 13 bp, Homo sapiens
ctccctgcctggc

SEQ ID NO: 3215468 - DNA, 15 bp, Homo sapiens
ctccctgcctggccc

SEQ ID NO: 3215469 - DNA, 16 bp, Homo sapiens
ctccctgctcagtgct

SEQ ID NO: 3215470 - DNA, 22 bp, Homo sapiens
ctccctgctgtgccatgctggg

SEQ ID NO: 3215471 - DNA, 10 bp, Homo sapiens
ctccctggag

SEQ ID NO: 3215472 - DNA, 12 bp, Homo sapiens
ctccctggagcc

SEQ ID NO: 3215473 - DNA, 13 bp, Homo sapiens
ctccctggagccc

SEQ ID NO: 3215474 - DNA, 16 bp, Homo sapiens
ctccctggcagacaca

SEQ ID NO: 3215475 - DNA, 14 bp, Homo sapiens
ctccctggcaggat

SEQ ID NO: 3215476 - DNA, 17 bp, Homo sapiens
ctccctggcaggatgct

SEQ ID NO: 3215477 - DNA, 18 bp, Homo sapiens
ctccctggcaggatgctg

SEQ ID NO: 3215478 - DNA, 14 bp, Homo sapiens
ctccctggctccct

SEQ ID NO: 3215479 - DNA, 16 bp, Homo sapiens
ctccctggctccctcc

SEQ ID NO: 3215480 - DNA, 15 bp, Homo sapiens
ctccctggctctcag

SEQ ID NO: 3215481 - DNA, 18 bp, Homo sapiens
ctccctgtacagtgttac

SEQ ID NO: 3215482 - DNA, 20 bp, Homo sapiens
ctccctgtagctctgcctcc

SEQ ID NO: 3215483 - DNA, 22 bp, Homo sapiens
ctccctgtagtgaatcctctgt

SEQ ID NO: 3215484 - DNA, 16 bp, Homo sapiens
ctccctgtctctgcat

SEQ ID NO: 3215485 - DNA, 23 bp, Homo sapiens
ctccctgtgggggtggccatccc

SEQ ID NO: 3215486 - DNA, 21 bp, Homo sapiens
ctccctgtgtccacctgtggg

SEQ ID NO: 3215487 - DNA, 22 bp, Homo sapiens
ctccctgttgacgaagtctctt

SEQ ID NO: 3215488 - DNA, 17 bp, Homo sapiens
ctcccttaaggtctcca

SEQ ID NO: 3215489 - DNA, 12 bp, Homo sapiens
ctcccttcaacc

SEQ ID NO: 3215490 - DNA, 20 bp, Homo sapiens
ctcccttcaaccattcccca

SEQ ID NO: 3215491 - DNA, 21 bp, Homo sapiens
ctcccttcaaccattccccat

SEQ ID NO: 3215492 - DNA, 17 bp, Homo sapiens
ctcccttccgaccctct

SEQ ID NO: 3215493 - DNA, 20 bp, Homo sapiens
ctcccttccgaccctctggg

SEQ ID NO: 3215494 - DNA, 22 bp, Homo sapiens
ctcccttccgaccctctgggaa

SEQ ID NO: 3215495 - DNA, 22 bp, Homo sapiens
ctcccttcctatgctgttcact

SEQ ID NO: 3215496 - DNA, 17 bp, Homo sapiens
ctcccttcctggcctca

SEQ ID NO: 3215497 - DNA, 12 bp, Homo sapiens
ctcccttccttt

SEQ ID NO: 3215498 - DNA, 20 bp, Homo sapiens
ctcccttccttttccctgct

SEQ ID NO: 3215499 - DNA, 14 bp, Homo sapiens
ctcccttgctggcc

SEQ ID NO: 3215500 - DNA, 15 bp, Homo sapiens
ctcccttgctggccc

SEQ ID NO: 3215501 - DNA, 17 bp, Homo sapiens
ctcccttgctggcccca

SEQ ID NO: 3215502 - DNA, 14 bp, Homo sapiens
ctcccttgggctgg

SEQ ID NO: 3215503 - DNA, 16 bp, Homo sapiens
ctccctttctctctcc

SEQ ID NO: 3215504 - DNA, 14 bp, Homo sapiens
ctccctttttatat

SEQ ID NO: 3215505 - DNA, 21 bp, Homo sapiens
ctccctttttatatcccattt

SEQ ID NO: 3215506 - DNA, 15 bp, Homo sapiens
ctccgaccagacacc

SEQ ID NO: 3215507 - DNA, 17 bp, Homo sapiens
ctccgagacagtccagt

SEQ ID NO: 3215508 - DNA, 13 bp, Homo sapiens
ctccgagaggtgg

SEQ ID NO: 3215509 - DNA, 15 bp, Homo sapiens
ctccgcagttcctgt

SEQ ID NO: 3215510 - DNA, 12 bp, Homo sapiens
ctccgccagcct

SEQ ID NO: 3215511 - DNA, 13 bp, Homo sapiens
ctccgccagcctc

SEQ ID NO: 3215512 - DNA, 14 bp, Homo sapiens
ctccgccagcctcc

SEQ ID NO: 3215513 - DNA, 14 bp, Homo sapiens
ctcagccaagcttg

SEQ ID NO: 3215514 - DNA, 13 bp, Homo sapiens
ctcagccacgacc

SEQ ID NO: 3215515 - DNA, 14 bp, Homo sapiens
ctcagccacgacca

SEQ ID NO: 3215516 - DNA, 16 bp, Homo sapiens
ctcagccacgaccagc

SEQ ID NO: 3215517 - DNA, 15 bp, Homo sapiens
ctcagccagtgggga

SEQ ID NO: 3215518 - DNA, 14 bp, Homo sapiens
ctcagcccacctgc

SEQ ID NO: 3215519 - DNA, 13 bp, Homo sapiens
ctcagcccagaag

SEQ ID NO: 3215520 - DNA, 16 bp, Homo sapiens
ctcagcccccaggcca

SEQ ID NO: 3215521 - DNA, 18 bp, Homo sapiens
ctcagcccccaggccagg

SEQ ID NO: 3215522 - DNA, 16 bp, Homo sapiens
ctcagccccgagctgt

SEQ ID NO: 3215523 - DNA, 19 bp, Homo sapiens
ctcagccccgagctgtccc

SEQ ID NO: 3215524 - DNA, 15 bp, Homo sapiens
ctcagcccctaggag

SEQ ID NO: 3215525 - DNA, 15 bp, Homo sapiens
ctcagccctgaggtg

SEQ ID NO: 3215526 - DNA, 13 bp, Homo sapiens
ctcagcccttgcc

SEQ ID NO: 3215527 - DNA, 23 bp, Homo sapiens
ctcagcccttgcccccatccctc

SEQ ID NO: 3215528 - DNA, 16 bp, Homo sapiens
ctcagcctagcacagg

SEQ ID NO: 3215529 - DNA, 12 bp, Homo sapiens
ctcagcctcaga

SEQ ID NO: 3215530 - DNA, 14 bp, Homo sapiens
ctcagcctcagagg

SEQ ID NO: 3215531 - DNA, 20 bp, Homo sapiens
ctcagcctcagaggagctct

SEQ ID NO: 3215532 - DNA, 13 bp, Homo sapiens
ctcagcctcccag

SEQ ID NO: 3215533 - DNA, 19 bp, Homo sapiens
ctcagcctcccgaatagct

SEQ ID NO: 3215534 - DNA, 22 bp, Homo sapiens
ctcagcctcccgaatagctggg

SEQ ID NO: 3215535 - DNA, 23 bp, Homo sapiens
ctcagcctcccgaatagctggga

SEQ ID NO: 3215536 - DNA, 15 bp, Homo sapiens
ctcagcctcctgagc

SEQ ID NO: 3215537 - DNA, 17 bp, Homo sapiens
ctcagcctcctgagcct

SEQ ID NO: 3215538 - DNA, 21 bp, Homo sapiens
ctcagcctcctgagcctgtgg

SEQ ID NO: 3215539 - DNA, 22 bp, Homo sapiens
ctcagcctctcaagtagctggg

SEQ ID NO: 3215540 - DNA, 15 bp, Homo sapiens
ctcagcctgctgccc

SEQ ID NO: 3215541 - DNA, 19 bp, Homo sapiens
ctcagcctgctgcccaggc

SEQ ID NO: 3215542 - DNA, 19 bp, Homo sapiens
ctcagccttcagacagaga

SEQ ID NO: 3215543 - DNA, 14 bp, Homo sapiens
ctcagcgctcctcc

SEQ ID NO: 3215544 - DNA, 17 bp, Homo sapiens
ctcagcgctcctcctgt

SEQ ID NO: 3215545 - DNA, 20 bp, Homo sapiens
ctcagcgctcctcctgtgtg

SEQ ID NO: 3215546 - DNA, 21 bp, Homo sapiens
ctcagcgctcctcctgtgtga

SEQ ID NO: 3215547 - DNA, 13 bp, Homo sapiens
ctcagcggggaca

SEQ ID NO: 3215548 - DNA, 15 bp, Homo sapiens
ctcagcggggacagc

SEQ ID NO: 3215549 - DNA, 21 bp, Homo sapiens
ctcagcggggacagctccttc

SEQ ID NO: 3215550 - DNA, 19 bp, Homo sapiens
ctcagctacccactatcct

SEQ ID NO: 3215551 - DNA, 21 bp, Homo sapiens
ctcagctacccactatccttc

SEQ ID NO: 3215552 - DNA, 19 bp, Homo sapiens
ctcagctccaggtggctct

SEQ ID NO: 3215553 - DNA, 19 bp, Homo sapiens
ctcagctcccaaggctctg

SEQ ID NO: 3215554 - DNA, 14 bp, Homo sapiens
ctcagctccccctg

SEQ ID NO: 3215555 - DNA, 16 bp, Homo sapiens
ctcagctccccctgtc

SEQ ID NO: 3215556 - DNA, 18 bp, Homo sapiens
ctcagctccccctgtccc

SEQ ID NO: 3215557 - DNA, 16 bp, Homo sapiens
ctcagctgtcctgcag

SEQ ID NO: 3215558 - DNA, 13 bp, Homo sapiens
ctcagctttgaga

SEQ ID NO: 3215559 - DNA, 14 bp, Homo sapiens
ctcagctttttccc

SEQ ID NO: 3215560 - DNA, 14 bp, Homo sapiens
ctcagcttttttct

SEQ ID NO: 3215561 - DNA, 15 bp, Homo sapiens
ctcaggaactagact

SEQ ID NO: 3215562 - DNA, 14 bp, Homo sapiens
ctcaggaagtccag

SEQ ID NO: 3215563 - DNA, 16 bp, Homo sapiens
ctcaggaagtccagcc

SEQ ID NO: 3215564 - DNA, 19 bp, Homo sapiens
ctcaggaagtccagccact

SEQ ID NO: 3215565 - DNA, 18 bp, Homo sapiens
ctcaggaattcagtgcct

SEQ ID NO: 3215566 - DNA, 19 bp, Homo sapiens
ctcaggaattcagtgcctt

SEQ ID NO: 3215567 - DNA, 21 bp, Homo sapiens
ctcaggaattcagtgccttca

SEQ ID NO: 3215568 - DNA, 16 bp, Homo sapiens
ctcaggaattccaatt

SEQ ID NO: 3215569 - DNA, 16 bp, Homo sapiens
ctcaggactcctctcc

SEQ ID NO: 3215570 - DNA, 18 bp, Homo sapiens
ctcaggagatggagggct

SEQ ID NO: 3215571 - DNA, 22 bp, Homo sapiens
ctcaggagatggagggcttggc

SEQ ID NO: 3215572 - DNA, 18 bp, Homo sapiens
ctcaggaggcaggacctt

SEQ ID NO: 3215573 - DNA, 14 bp, Homo sapiens
ctcaggaggctgag

SEQ ID NO: 3215574 - DNA, 16 bp, Homo sapiens
ctcaggaggctgaggg

SEQ ID NO: 3215575 - DNA, 12 bp, Homo sapiens
ctcaggatccaa

SEQ ID NO: 3215576 - DNA, 21 bp, Homo sapiens
ctcaggcaagcccctcagccc

SEQ ID NO: 3215577 - DNA, 23 bp, Homo sapiens
ctcaggcaagcccctcagccctt

SEQ ID NO: 3215578 - DNA, 14 bp, Homo sapiens
ctcaggcacacagc

SEQ ID NO: 3215579 - DNA, 14 bp, Homo sapiens
ctcaggcactagcc

SEQ ID NO: 3215580 - DNA, 15 bp, Homo sapiens
ctcaggcactagcct

SEQ ID NO: 3215581 - DNA, 19 bp, Homo sapiens
ctcaggcactagcctttgg

SEQ ID NO: 3215582 - DNA, 15 bp, Homo sapiens
ctcaggcagctcaag

SEQ ID NO: 3215583 - DNA, 19 bp, Homo sapiens
ctcaggccaacaagccaac

SEQ ID NO: 3215584 - DNA, 15 bp, Homo sapiens
ctcaggccaggtgca

SEQ ID NO: 3215585 - DNA, 19 bp, Homo sapiens
ctcaggcctaggaggcccc

SEQ ID NO: 3215586 - DNA, 18 bp, Homo sapiens
ctcatgccacaccttctt

SEQ ID NO: 3215587 - DNA, 21 bp, Homo sapiens
ctcatgcccaccccctgccct

SEQ ID NO: 3215588 - DNA, 23 bp, Homo sapiens
ctcatgccccctttcagatgtct

SEQ ID NO: 3215589 - DNA, 12 bp, Homo sapiens
ctcatgcctgct

SEQ ID NO: 3215590 - DNA, 18 bp, Homo sapiens
ctcatgcctgctgagaga

SEQ ID NO: 3215591 - DNA, 19 bp, Homo sapiens
ctcatgctgtgtttgtttt

SEQ ID NO: 3215592 - DNA, 16 bp, Homo sapiens
ctcatggcccccaggg

SEQ ID NO: 3215593 - DNA, 17 bp, Homo sapiens
ctcatggcccccagggg

SEQ ID NO: 3215594 - DNA, 22 bp, Homo sapiens
ctcatggcccccaggggcagga

SEQ ID NO: 3215595 - DNA, 19 bp, Homo sapiens
ctcatggcccctctgacct

SEQ ID NO: 3215596 - DNA, 19 bp, Homo sapiens
ctcatgggtggcactcagt

SEQ ID NO: 3215597 - DNA, 16 bp, Homo sapiens
ctcatgtaacattggt

SEQ ID NO: 3215598 - DNA, 18 bp, Homo sapiens
ctcatgtaacattggtga

SEQ ID NO: 3215599 - DNA, 12 bp, Homo sapiens
ctcatgtatctt

SEQ ID NO: 3215600 - DNA, 12 bp, Homo sapiens
ctcatgtggctg

SEQ ID NO: 3215601 - DNA, 15 bp, Homo sapiens
ctcatgtggctggaa

SEQ ID NO: 3215602 - DNA, 17 bp, Homo sapiens
ctcatgttactcagtgt

SEQ ID NO: 3215603 - DNA, 21 bp, Homo sapiens
ctcatgtttatgaaaataaat

SEQ ID NO: 3215604 - DNA, 17 bp, Homo sapiens
ctcattccaacagtgag

SEQ ID NO: 3215605 - DNA, 15 bp, Homo sapiens
ctcattcgcctttgt

SEQ ID NO: 3215606 - DNA, 12 bp, Homo sapiens
ctcattcttctg

SEQ ID NO: 3215607 - DNA, 15 bp, Homo sapiens
ctcattgaaatgtca

SEQ ID NO: 3215608 - DNA, 12 bp, Homo sapiens
ctcattgacttt

SEQ ID NO: 3215609 - DNA, 16 bp, Homo sapiens
ctcattgcagcagata

SEQ ID NO: 3215610 - DNA, 21 bp, Homo sapiens
ctcattgcagcagataacttt

SEQ ID NO: 3215611 - DNA, 15 bp, Homo sapiens
ctcattgctgagcct

SEQ ID NO: 3215612 - DNA, 20 bp, Homo sapiens
ctcattgctgagcctctgct

SEQ ID NO: 3215613 - DNA, 17 bp, Homo sapiens
ctcatttgtcacacact

SEQ ID NO: 3215614 - DNA, 20 bp, Homo sapiens
ctcatttttcatactgaaaa

SEQ ID NO: 3215615 - DNA, 23 bp, Homo sapiens
ctcatttttttttttgtttctga

SEQ ID NO: 3215616 - DNA, 21 bp, Homo sapiens
ctccaaaaaaaaaaaaaatac

SEQ ID NO: 3215617 - DNA, 15 bp, Homo sapiens
ctccaaaagcactta

SEQ ID NO: 3215618 - DNA, 22 bp, Homo sapiens
ctccaaaatgttggtcatttta

SEQ ID NO: 3215619 - DNA, 16 bp, Homo sapiens
ctccaaacaccggcag

SEQ ID NO: 3215620 - DNA, 14 bp, Homo sapiens
ctccaaaggggctg

SEQ ID NO: 3215621 - DNA, 20 bp, Homo sapiens
ctccaaaggggctgctgggg

SEQ ID NO: 3215622 - DNA, 20 bp, Homo sapiens
ctccaacacaaggctccaag

SEQ ID NO: 3215623 - DNA, 21 bp, Homo sapiens
ctccaacacaaggctccaaga

SEQ ID NO: 3215624 - DNA, 23 bp, Homo sapiens
ctccaacacaaggctccaagacc

SEQ ID NO: 3215625 - DNA, 18 bp, Homo sapiens
ctccaaccaaataagact

SEQ ID NO: 3215626 - DNA, 22 bp, Homo sapiens
ctccaacccccgccacctcagg

SEQ ID NO: 3215627 - DNA, 20 bp, Homo sapiens
ctccaacgcccctgtggcca

SEQ ID NO: 3215628 - DNA, 22 bp, Homo sapiens
ctccaacgcccctgtggccaac

SEQ ID NO: 3215629 - DNA, 22 bp, Homo sapiens
ctccaagataagcctgagcctt

SEQ ID NO: 3215630 - DNA, 12 bp, Homo sapiens
ctccaagattct

SEQ ID NO: 3215631 - DNA, 18 bp, Homo sapiens
ctccaagattctagatga

SEQ ID NO: 3215632 - DNA, 15 bp, Homo sapiens
ctccaagccccatct

SEQ ID NO: 3215633 - DNA, 17 bp, Homo sapiens
ctccaagccccatcttc

SEQ ID NO: 3215634 - DNA, 18 bp, Homo sapiens
ctccaagccccatcttct

SEQ ID NO: 3215635 - DNA, 15 bp, Homo sapiens
ctccaagcctgcctc

SEQ ID NO: 3215636 - DNA, 18 bp, Homo sapiens
ctccaaggatcctctcca

SEQ ID NO: 3215637 - DNA, 22 bp, Homo sapiens
ctccaagggcttctgcaccctc

SEQ ID NO: 3215638 - DNA, 23 bp, Homo sapiens
ctccaagggcttctgcaccctcc

SEQ ID NO: 3215639 - DNA, 18 bp, Homo sapiens
ctccaaggtgatgttgta

SEQ ID NO: 3215640 - DNA, 17 bp, Homo sapiens
ctccaagtctctctgtg

SEQ ID NO: 3215641 - DNA, 18 bp, Homo sapiens
ctccaagtctctctgtga

SEQ ID NO: 3215642 - DNA, 19 bp, Homo sapiens
ctccaagtctctctgtgaa

SEQ ID NO: 3215643 - DNA, 17 bp, Homo sapiens
ctccaagtctgtacctc

SEQ ID NO: 3215644 - DNA, 19 bp, Homo sapiens
ctccaagtctgtacctcaa

SEQ ID NO: 3215645 - DNA, 20 bp, Homo sapiens
ctccaagtctgtacctcaaa

SEQ ID NO: 3215646 - DNA, 16 bp, Homo sapiens
ctccaataaagtgcct

SEQ ID NO: 3215647 - DNA, 19 bp, Homo sapiens
ctccaataaagtgccttct

SEQ ID NO: 3215648 - DNA, 19 bp, Homo sapiens
ctattctgtcagtgttaaa

SEQ ID NO: 3215649 - DNA, 20 bp, Homo sapiens
ctattgaattcggaactgtc

SEQ ID NO: 3215650 - DNA, 13 bp, Homo sapiens
ctattgacttcaa

SEQ ID NO: 3215651 - DNA, 16 bp, Homo sapiens
ctattgacttcaatga

SEQ ID NO: 3215652 - DNA, 15 bp, Homo sapiens
ctattgatgtacagt

SEQ ID NO: 3215653 - DNA, 20 bp, Homo sapiens
ctattgatgtacagtctgtc

SEQ ID NO: 3215654 - DNA, 18 bp, Homo sapiens
ctattgatttttacttca

SEQ ID NO: 3215655 - DNA, 18 bp, Homo sapiens
ctattgcagttatagaaa

SEQ ID NO: 3215656 - DNA, 21 bp, Homo sapiens
ctattgcttcaccatggcctt

SEQ ID NO: 3215657 - DNA, 23 bp, Homo sapiens
ctattggccaacaatcctttctg

SEQ ID NO: 3215658 - DNA, 22 bp, Homo sapiens
ctattgtcccctagcaaggcat

SEQ ID NO: 3215659 - DNA, 16 bp, Homo sapiens
ctattgttactctggt

SEQ ID NO: 3215660 - DNA, 20 bp, Homo sapiens
ctattgttactctggttctt

SEQ ID NO: 3215661 - DNA, 16 bp, Homo sapiens
ctattgttgtgggctt

SEQ ID NO: 3215662 - DNA, 13 bp, Homo sapiens
ctatttaaactat

SEQ ID NO: 3215663 - DNA, 13 bp, Homo sapiens
ctatttaaattct

SEQ ID NO: 3215664 - DNA, 14 bp, Homo sapiens
ctatttaaattctt

SEQ ID NO: 3215665 - DNA, 20 bp, Homo sapiens
ctatttaatatctggcactg

SEQ ID NO: 3215666 - DNA, 12 bp, Homo sapiens
ctatttaatatt

SEQ ID NO: 3215667 - DNA, 16 bp, Homo sapiens
ctatttatctgtgttt

SEQ ID NO: 3215668 - DNA, 15 bp, Homo sapiens
ctatttattagccaa

SEQ ID NO: 3215669 - DNA, 12 bp, Homo sapiens
ctatttattggg

SEQ ID NO: 3215670 - DNA, 14 bp, Homo sapiens
ctatttattgggga

SEQ ID NO: 3215671 - DNA, 14 bp, Homo sapiens
ctatttatttactg

SEQ ID NO: 3215672 - DNA, 17 bp, Homo sapiens
ctatttattttcctaaa

SEQ ID NO: 3215673 - DNA, 18 bp, Homo sapiens
ctatttattttcctaaag

SEQ ID NO: 3215674 - DNA, 14 bp, Homo sapiens
ctatttccattcca

SEQ ID NO: 3215675 - DNA, 22 bp, Homo sapiens
ctatttccccaggggaaaatga

SEQ ID NO: 3215676 - DNA, 16 bp, Homo sapiens
ctatttctctccccac

SEQ ID NO: 3215677 - DNA, 21 bp, Homo sapiens
ctatttctgggtcttttgcta

SEQ ID NO: 3215678 - DNA, 14 bp, Homo sapiens
ctatttgaaatact

SEQ ID NO: 3215679 - DNA, 21 bp, Homo sapiens
ctatttgaaatactaaaagca

SEQ ID NO: 3215680 - DNA, 12 bp, Homo sapiens
ctatttgaagaa

SEQ ID NO: 3215681 - DNA, 23 bp, Homo sapiens
ctatttgccatgggcttcactgt

SEQ ID NO: 3215682 - DNA, 18 bp, Homo sapiens
ctatttgtaaatctgcca

SEQ ID NO: 3215683 - DNA, 21 bp, Homo sapiens
ctatttgtaaatctgccacaa

SEQ ID NO: 3215684 - DNA, 17 bp, Homo sapiens
ctatttgtctttcagga

SEQ ID NO: 3215685 - DNA, 15 bp, Homo sapiens
ctatttgttcagaga

SEQ ID NO: 3215686 - DNA, 14 bp, Homo sapiens
ctattttaaaataa

SEQ ID NO: 3215687 - DNA, 20 bp, Homo sapiens
ctattttaaaataaattagt

SEQ ID NO: 3215688 - DNA, 16 bp, Homo sapiens
ctattttactttgtac

SEQ ID NO: 3215689 - DNA, 13 bp, Homo sapiens
ctattttcacaat

SEQ ID NO: 3215690 - DNA, 12 bp, Homo sapiens
ctattttcagaa

SEQ ID NO: 3215691 - DNA, 15 bp, Homo sapiens
ctattttcagaatct

SEQ ID NO: 3215692 - DNA, 18 bp, Homo sapiens
ctattttcagaatctgaa

SEQ ID NO: 3215693 - DNA, 22 bp, Homo sapiens
ctattttcagaatctgaatgta

SEQ ID NO: 3215694 - DNA, 14 bp, Homo sapiens
ctattttctacaat

SEQ ID NO: 3215695 - DNA, 12 bp, Homo sapiens
ctattttcttaa

SEQ ID NO: 3215696 - DNA, 23 bp, Homo sapiens
ctattttgggtattaatatatag

SEQ ID NO: 3215697 - DNA, 19 bp, Homo sapiens
ctattttgtaaactcaaaa

SEQ ID NO: 3215698 - DNA, 11 bp, Homo sapiens
ctattttgtga

SEQ ID NO: 3215699 - DNA, 16 bp, Homo sapiens
ctattttgtgatgatg

SEQ ID NO: 3215700 - DNA, 12 bp, Homo sapiens
ctatttttatca

SEQ ID NO: 3215701 - DNA, 15 bp, Homo sapiens
ctatttttatcatga

SEQ ID NO: 3215702 - DNA, 17 bp, Homo sapiens
ctatttttatcatgaat

SEQ ID NO: 3215703 - DNA, 19 bp, Homo sapiens
ctatttttatcatgaattc

SEQ ID NO: 3215704 - DNA, 13 bp, Homo sapiens
ctatttttcaatc

SEQ ID NO: 3215705 - DNA, 15 bp, Homo sapiens
ctatttttcaatcat

SEQ ID NO: 3215706 - DNA, 21 bp, Homo sapiens
ctatttttggcagtctgaatt

SEQ ID NO: 3215707 - DNA, 19 bp, Homo sapiens
ctatttttttaaaatcact

SEQ ID NO: 3215708 - DNA, 18 bp, Homo sapiens
ctatttttttaactgaaa

SEQ ID NO: 3215709 - DNA, 23 bp, Homo sapiens
ctatttttttaactgaaaatgta

SEQ ID NO: 3215710 - DNA, 19 bp, Homo sapiens
ctcaaaaaacattgttttg

SEQ ID NO: 3215711 - DNA, 17 bp, Homo sapiens
ctcaaaacgggtcagta

SEQ ID NO: 3215712 - DNA, 20 bp, Homo sapiens
ctcaaaagagaaaaacaaaa

SEQ ID NO: 3215713 - DNA, 12 bp, Homo sapiens
ctcaaaagcatt

SEQ ID NO: 3215714 - DNA, 14 bp, Homo sapiens
ctcaaaagcattta

SEQ ID NO: 3215715 - DNA, 15 bp, Homo sapiens
ctcaaaagtctattt

SEQ ID NO: 3215716 - DNA, 18 bp, Homo sapiens
ctcaaaatatttgtacat

SEQ ID NO: 3215717 - DNA, 13 bp, Homo sapiens
ctcaaacctcctc

SEQ ID NO: 3215718 - DNA, 14 bp, Homo sapiens
ctcaaacctcctct

SEQ ID NO: 3215719 - DNA, 20 bp, Homo sapiens
ctcaaactaaaagacatttg

SEQ ID NO: 3215720 - DNA, 21 bp, Homo sapiens
ctcaaactcctgacctcaggt

SEQ ID NO: 3215721 - DNA, 20 bp, Homo sapiens
ctcaaacttttcccctgtcc

SEQ ID NO: 3215722 - DNA, 13 bp, Homo sapiens
ctcaaagaaagtg

SEQ ID NO: 3215723 - DNA, 14 bp, Homo sapiens
ctcaaagaggcctt

SEQ ID NO: 3215724 - DNA, 15 bp, Homo sapiens
ctcaaagtctgcaac

SEQ ID NO: 3215725 - DNA, 23 bp, Homo sapiens
ctcaaagtgactattcagttttc

SEQ ID NO: 3215726 - DNA, 20 bp, Homo sapiens
ctcaaagttaattcacctat

SEQ ID NO: 3215727 - DNA, 23 bp, Homo sapiens
ctcaaagttaattcacctatgtt

SEQ ID NO: 3215728 - DNA, 15 bp, Homo sapiens
ctcaaagttttgaaa

SEQ ID NO: 3215729 - DNA, 19 bp, Homo sapiens
ctcaaagttttgaaaagct

SEQ ID NO: 3215730 - DNA, 17 bp, Homo sapiens
ctcaaatacacatttgc

SEQ ID NO: 3215731 - DNA, 21 bp, Homo sapiens
ctcaaataggctattaaaaaa

SEQ ID NO: 3215732 - DNA, 22 bp, Homo sapiens
ctcaaatctattcagacaagca

SEQ ID NO: 3215733 - DNA, 20 bp, Homo sapiens
ctcaaatgagtaacatttgc

SEQ ID NO: 3215734 - DNA, 19 bp, Homo sapiens
ctcaaatgttctaagtttc

SEQ ID NO: 3215735 - DNA, 21 bp, Homo sapiens
ctcaaatgttctaagtttcta

SEQ ID NO: 3215736 - DNA, 12 bp, Homo sapiens
ctcaaatttgga

SEQ ID NO: 3215737 - DNA, 15 bp, Homo sapiens
ctcaacagccaagtg

SEQ ID NO: 3215738 - DNA, 18 bp, Homo sapiens
ctcaacaggcccagggag

SEQ ID NO: 3215739 - DNA, 20 bp, Homo sapiens
ctcaacatgttactgaccag

SEQ ID NO: 3215740 - DNA, 19 bp, Homo sapiens
ctcaacccccatttctatt

SEQ ID NO: 3215741 - DNA, 15 bp, Homo sapiens
ctcaacctcctgggc

SEQ ID NO: 3215742 - DNA, 12 bp, Homo sapiens
ctcaacctcttc

SEQ ID NO: 3215743 - DNA, 13 bp, Homo sapiens
ctcaacctcttct

SEQ ID NO: 3215744 - DNA, 16 bp, Homo sapiens
ctcaacgtattgtttc

SEQ ID NO: 3215745 - DNA, 20 bp, Homo sapiens
ctcaactctacccctgctcc

SEQ ID NO: 3215746 - DNA, 13 bp, Homo sapiens
ctcaactgcctac

SEQ ID NO: 3215747 - DNA, 19 bp, Homo sapiens
ctcaagaagacatggagac

SEQ ID NO: 3215748 - DNA, 17 bp, Homo sapiens
ctcaagagggcactggt

SEQ ID NO: 3215749 - DNA, 21 bp, Homo sapiens
ctcaagagggcactggtggcc

SEQ ID NO: 3215750 - DNA, 17 bp, Homo sapiens
ctcaagatactgctact

SEQ ID NO: 3215751 - DNA, 16 bp, Homo sapiens
ctcaagattctacttg

SEQ ID NO: 3215752 - DNA, 16 bp, Homo sapiens
ctcaagcaataattgt

SEQ ID NO: 3215753 - DNA, 20 bp, Homo sapiens
ctcaagccaatcccctcctt

SEQ ID NO: 3215754 - DNA, 12 bp, Homo sapiens
ctcaagccccag

SEQ ID NO: 3215755 - DNA, 14 bp, Homo sapiens
ctcaagccccagca

SEQ ID NO: 3215756 - DNA, 18 bp, Homo sapiens
ctcaagccccatttcctc

SEQ ID NO: 3215757 - DNA, 13 bp, Homo sapiens
ctcaagccctgag

SEQ ID NO: 3215758 - DNA, 16 bp, Homo sapiens
ctcaagcgattctcct

SEQ ID NO: 3215759 - DNA, 14 bp, Homo sapiens
ctcaaggaaagggg

SEQ ID NO: 3215760 - DNA, 14 bp, Homo sapiens
ctcaaggaatcttt

SEQ ID NO: 3215761 - DNA, 21 bp, Homo sapiens
ctcaaggaatctttaagcaga

SEQ ID NO: 3215762 - DNA, 10 bp, Homo sapiens
ctcaaggact

SEQ ID NO: 3215763 - DNA, 20 bp, Homo sapiens
ctcaaggataccttcttatt

SEQ ID NO: 3215764 - DNA, 15 bp, Homo sapiens
ctcaaggcccagcca

SEQ ID NO: 3215765 - DNA, 19 bp, Homo sapiens
ctcaaggttttaggttcta

SEQ ID NO: 3215766 - DNA, 22 bp, Homo sapiens
ctcaaggttttaggttctaaag

SEQ ID NO: 3215767 - DNA, 14 bp, Homo sapiens
ctcaagtaaaagaa

SEQ ID NO: 3215768 - DNA, 16 bp, Homo sapiens
ctcaagtcttccctga

SEQ ID NO: 3215769 - DNA, 17 bp, Homo sapiens
ctcaagtgattctcctg

SEQ ID NO: 3215770 - DNA, 20 bp, Homo sapiens
ctcaagtgattctcctgcct

SEQ ID NO: 3215771 - DNA, 9 bp, Homo sapiens
ctcaagtgc

SEQ ID NO: 3215772 - DNA, 13 bp, Homo sapiens
ctcaagttctaag

SEQ ID NO: 3215773 - DNA, 19 bp, Homo sapiens
ctcaagttctaagattcta

SEQ ID NO: 3215774 - DNA, 13 bp, Homo sapiens
ctcaagtttaaaa

SEQ ID NO: 3215775 - DNA, 17 bp, Homo sapiens
ctcaataaacatttcat

SEQ ID NO: 3215776 - DNA, 21 bp, Homo sapiens
ctcaataaacatttcatttcc

SEQ ID NO: 3215777 - DNA, 14 bp, Homo sapiens
ctcaatactacctc

SEQ ID NO: 3215778 - DNA, 12 bp, Homo sapiens
ctcaatattaaa

SEQ ID NO: 3215779 - DNA, 18 bp, Homo sapiens
ctcaatattcctgaatga

SEQ ID NO: 3215780 - DNA, 15 bp, Homo sapiens
ctcaatcaagaaaat

SEQ ID NO: 3215781 - DNA, 16 bp, Homo sapiens
ctcaatgagctcttcc

SEQ ID NO: 3215782 - DNA, 22 bp, Homo sapiens
ctcaatgcattgtcttgtggag

SEQ ID NO: 3215783 - DNA, 16 bp, Homo sapiens
ctcaatgcctggagac

SEQ ID NO: 3215784 - DNA, 18 bp, Homo sapiens
ctcaatgcctggagacag

SEQ ID NO: 3215785 - DNA, 20 bp, Homo sapiens
ctcaatggactggaagggga

SEQ ID NO: 3215786 - DNA, 23 bp, Homo sapiens
ctcaatggcctaaaactggcctg

SEQ ID NO: 3215787 - DNA, 12 bp, Homo sapiens
ctcaatgtttga

SEQ ID NO: 3215788 - DNA, 15 bp, Homo sapiens
ctcaattgtttttgt

SEQ ID NO: 3215789 - DNA, 23 bp, Homo sapiens
ctcaattttatccctcacctgta

SEQ ID NO: 3215790 - DNA, 16 bp, Homo sapiens
ctcaatttttgtctca

SEQ ID NO: 3215791 - DNA, 22 bp, Homo sapiens
ctcacaaaccatgcaaatgcta

SEQ ID NO: 3215792 - DNA, 19 bp, Homo sapiens
ctcacaagcgctcccagcc

SEQ ID NO: 3215793 - DNA, 22 bp, Homo sapiens
ctcacaagggctctcaaagtat

SEQ ID NO: 3215794 - DNA, 17 bp, Homo sapiens
ctcacaatccttgccac

SEQ ID NO: 3215795 - DNA, 15 bp, Homo sapiens
ctcacacacacagct

SEQ ID NO: 3215796 - DNA, 19 bp, Homo sapiens
ctcacacacacagctgggc

SEQ ID NO: 3215797 - DNA, 23 bp, Homo sapiens
ctcacacccaccgtccgccctgc

SEQ ID NO: 3215798 - DNA, 17 bp, Homo sapiens
ctcacagaacccttgga

SEQ ID NO: 3215799 - DNA, 20 bp, Homo sapiens
ctcacagacctggagcccct

SEQ ID NO: 3215800 - DNA, 23 bp, Homo sapiens
ctcacagacctggagcccctggg

SEQ ID NO: 3215801 - DNA, 21 bp, Homo sapiens
ctcacagattgaggtaataat

SEQ ID NO: 3215802 - DNA, 15 bp, Homo sapiens
ctcacagcacatgct

SEQ ID NO: 3215803 - DNA, 20 bp, Homo sapiens
ctcacagcacttgttttcag

SEQ ID NO: 3215804 - DNA, 19 bp, Homo sapiens
ctcacagcctctgacccct

SEQ ID NO: 3215805 - DNA, 22 bp, Homo sapiens
ctcacagcctctgacccctcct

SEQ ID NO: 3215806 - DNA, 19 bp, Homo sapiens
ctcacagccttggctcctg

SEQ ID NO: 3215807 - DNA, 23 bp, Homo sapiens
ctcacagccttggctcctgagaa

SEQ ID NO: 3215808 - DNA, 13 bp, Homo sapiens
ctcacaggcctct

SEQ ID NO: 3215809 - DNA, 15 bp, Homo sapiens
ctcacaggcctctct

SEQ ID NO: 3215810 - DNA, 19 bp, Homo sapiens
ctcacaggcctctcttttc

SEQ ID NO: 3215811 - DNA, 16 bp, Homo sapiens
ctcacagtaacccaaa

SEQ ID NO: 3215812 - DNA, 20 bp, Homo sapiens
ctcacagtaacccaaacctc

SEQ ID NO: 3215813 - DNA, 20 bp, Homo sapiens
ctcacagtacagcatgtgcc

SEQ ID NO: 3215814 - DNA, 19 bp, Homo sapiens
ctcacagtctctttaatct

SEQ ID NO: 3215815 - DNA, 12 bp, Homo sapiens
ctcacagtgacc

SEQ ID NO: 3215816 - DNA, 15 bp, Homo sapiens
ctcacattcctaggg

SEQ ID NO: 3215817 - DNA, 12 bp, Homo sapiens
ctcacatttatg

SEQ ID NO: 3215818 - DNA, 15 bp, Homo sapiens
ctcacatttattctg

SEQ ID NO: 3215819 - DNA, 19 bp, Homo sapiens
ctcacatttattctgctca

SEQ ID NO: 3215820 - DNA, 13 bp, Homo sapiens
ctcaccaaggtga

SEQ ID NO: 3215821 - DNA, 15 bp, Homo sapiens
ctcaccaccacacta

SEQ ID NO: 3215822 - DNA, 20 bp, Homo sapiens
ctcaccaccacactacacag

SEQ ID NO: 3215823 - DNA, 13 bp, Homo sapiens
ctcaccagcccca

SEQ ID NO: 3215824 - DNA, 16 bp, Homo sapiens
ctcaccagccccactg

SEQ ID NO: 3215825 - DNA, 18 bp, Homo sapiens
ctcaccagccccactgcc

SEQ ID NO: 3215826 - DNA, 19 bp, Homo sapiens
ctcaccagccccagtgccc

SEQ ID NO: 3215827 - DNA, 21 bp, Homo sapiens
ctcaccagccccagtgcccac

SEQ ID NO: 3215828 - DNA, 19 bp, Homo sapiens
ctcaccagctgctgctctg

SEQ ID NO: 3215829 - DNA, 23 bp, Homo sapiens
ctcaccagtgtcccctccactgt

SEQ ID NO: 3215830 - DNA, 14 bp, Homo sapiens
ctcaccatgtaaaa

SEQ ID NO: 3215831 - DNA, 17 bp, Homo sapiens
ctcacccacccctgcac

SEQ ID NO: 3215832 - DNA, 14 bp, Homo sapiens
ctcacccccagctt

SEQ ID NO: 3215833 - DNA, 18 bp, Homo sapiens
ctcacccccagctttgct

SEQ ID NO: 3215834 - DNA, 14 bp, Homo sapiens
ctcacccccatccc

SEQ ID NO: 3215835 - DNA, 14 bp, Homo sapiens
ctcaccccctcacc

SEQ ID NO: 3215836 - DNA, 15 bp, Homo sapiens
ctcaccccctcctgg

SEQ ID NO: 3215837 - DNA, 17 bp, Homo sapiens
ctcaccccctcctggca

SEQ ID NO: 3215838 - DNA, 12 bp, Homo sapiens
ctcacccctggg

SEQ ID NO: 3215839 - DNA, 14 bp, Homo sapiens
ctcacccctgggca

SEQ ID NO: 3215840 - DNA, 15 bp, Homo sapiens
ctcacccctgggcag

SEQ ID NO: 3215841 - DNA, 17 bp, Homo sapiens
ctcacccctgggcaggc

SEQ ID NO: 3215842 - DNA, 18 bp, Homo sapiens
ctcacccctgggcaggcg

SEQ ID NO: 3215843 - DNA, 19 bp, Homo sapiens
ctcacccctgtcctcactg

SEQ ID NO: 3215844 - DNA, 20 bp, Homo sapiens
ctcacccctgtcctcactgc

SEQ ID NO: 3215845 - DNA, 21 bp, Homo sapiens
ctcacccctgtcctcactgct

SEQ ID NO: 3215846 - DNA, 17 bp, Homo sapiens
ctcaccctactctggat

SEQ ID NO: 3215847 - DNA, 22 bp, Homo sapiens
ctcaccctcccaagtagctggg

SEQ ID NO: 3215848 - DNA, 13 bp, Homo sapiens
ctcaccctgggag

SEQ ID NO: 3215849 - DNA, 21 bp, Homo sapiens
ctcaccgcagtcgtcgcacag

SEQ ID NO: 3215850 - DNA, 12 bp, Homo sapiens
ctcaccgcttcc

SEQ ID NO: 3215851 - DNA, 18 bp, Homo sapiens
ctcaccgcttccctcctg

SEQ ID NO: 3215852 - DNA, 19 bp, Homo sapiens
ctcaccgtgcagagctgca

SEQ ID NO: 3215853 - DNA, 15 bp, Homo sapiens
ctcacctcatgccca

SEQ ID NO: 3215854 - DNA, 18 bp, Homo sapiens
ctcacctctacccaaacc

SEQ ID NO: 3215855 - DNA, 22 bp, Homo sapiens
ctcacctctggactggctagag

SEQ ID NO: 3215856 - DNA, 14 bp, Homo sapiens
ctcacgtcaaatgc

SEQ ID NO: 3215857 - DNA, 21 bp, Homo sapiens
ctcacgtgtcagaagcctcca

SEQ ID NO: 3215858 - DNA, 13 bp, Homo sapiens
ctcactaattttt

SEQ ID NO: 3215859 - DNA, 23 bp, Homo sapiens
ctcactaatttttgtattatttt

SEQ ID NO: 3215860 - DNA, 15 bp, Homo sapiens
ctcactaggccccca

SEQ ID NO: 3215861 - DNA, 22 bp, Homo sapiens
ctcactaggcccccacttgcct

SEQ ID NO: 3215862 - DNA, 17 bp, Homo sapiens
ctcactatgttgcccag

SEQ ID NO: 3215863 - DNA, 21 bp, Homo sapiens
ctcactatgttgcccaggcag

SEQ ID NO: 3215864 - DNA, 23 bp, Homo sapiens
ctcactatgttgcccaggcaggt

SEQ ID NO: 3215865 - DNA, 14 bp, Homo sapiens
ctcactccacagag

SEQ ID NO: 3215866 - DNA, 12 bp, Homo sapiens
ctcactccccag

SEQ ID NO: 3215867 - DNA, 19 bp, Homo sapiens
ctcactccccagccccacc

SEQ ID NO: 3215868 - DNA, 13 bp, Homo sapiens
ctcactcctacct

SEQ ID NO: 3215869 - DNA, 16 bp, Homo sapiens
ctcactcctgcctccg

SEQ ID NO: 3215870 - DNA, 11 bp, Homo sapiens
ctcactctgcc

SEQ ID NO: 3215871 - DNA, 15 bp, Homo sapiens
ctcactctgccaggg

SEQ ID NO: 3215872 - DNA, 18 bp, Homo sapiens
ctcactctgccagggcag

SEQ ID NO: 3215873 - DNA, 13 bp, Homo sapiens
ctcactctgtcag

SEQ ID NO: 3215874 - DNA, 15 bp, Homo sapiens
ctcactctgtcagcc

SEQ ID NO: 3215875 - DNA, 18 bp, Homo sapiens
ctcactctgtcagccagc

SEQ ID NO: 3215876 - DNA, 13 bp, Homo sapiens
ctcactctgtcgc

SEQ ID NO: 3215877 - DNA, 21 bp, Homo sapiens
ctcactctgtcgcccagtctg

SEQ ID NO: 3215878 - DNA, 23 bp, Homo sapiens
ctcactgaaacatggctgtgttt

SEQ ID NO: 3215879 - DNA, 19 bp, Homo sapiens
ctcactgaaacctctgcct

SEQ ID NO: 3215880 - DNA, 14 bp, Homo sapiens
ctcactgcagcctc

SEQ ID NO: 3215881 - DNA, 15 bp, Homo sapiens
ctcactgcagcctca

SEQ ID NO: 3215882 - DNA, 19 bp, Homo sapiens
ctcactgccaggccagcct

SEQ ID NO: 3215883 - DNA, 12 bp, Homo sapiens
ctcactgcccgc

SEQ ID NO: 3215884 - DNA, 18 bp, Homo sapiens
ctcactgcccgcacaccc

SEQ ID NO: 3215885 - DNA, 19 bp, Homo sapiens
ctcactgcccgcacaccct

SEQ ID NO: 3215886 - DNA, 14 bp, Homo sapiens
ctcactgctcaaga

SEQ ID NO: 3215887 - DNA, 21 bp, Homo sapiens
ctcactgctcaagaagacatg

SEQ ID NO: 3215888 - DNA, 13 bp, Homo sapiens
ctcactgggggct

SEQ ID NO: 3215889 - DNA, 18 bp, Homo sapiens
ctcactgggggctttggg

SEQ ID NO: 3215890 - DNA, 12 bp, Homo sapiens
ctcactgggtgg

SEQ ID NO: 3215891 - DNA, 23 bp, Homo sapiens
ctcactggttttacttacaaaaa

SEQ ID NO: 3215892 - DNA, 24 bp, Homo sapiens
ctcactgtgggaaggccagctgcc

SEQ ID NO: 3215893 - DNA, 19 bp, Homo sapiens
ctcactgtgtcacccaggc

SEQ ID NO: 3215894 - DNA, 21 bp, Homo sapiens
ctcactgttccctctgctcct

SEQ ID NO: 3215895 - DNA, 15 bp, Homo sapiens
ctcactgttgaattt

SEQ ID NO: 3215896 - DNA, 22 bp, Homo sapiens
ctcactgttgcccaggctggcg

SEQ ID NO: 3215897 - DNA, 14 bp, Homo sapiens
ctcactgttgtgaa

SEQ ID NO: 3215898 - DNA, 21 bp, Homo sapiens
ctcactgtttgtttttattta

SEQ ID NO: 3215899 - DNA, 14 bp, Homo sapiens
ctcacttagtcctt

SEQ ID NO: 3215900 - DNA, 18 bp, Homo sapiens
ctcacttccatacagctc

SEQ ID NO: 3215901 - DNA, 15 bp, Homo sapiens
ctcctcagatggggc

SEQ ID NO: 3215902 - DNA, 13 bp, Homo sapiens
ctcctcagccccc

SEQ ID NO: 3215903 - DNA, 16 bp, Homo sapiens
ctcctcagggtggggg

SEQ ID NO: 3215904 - DNA, 21 bp, Homo sapiens
ctcctcatccccacaatctgg

SEQ ID NO: 3215905 - DNA, 12 bp, Homo sapiens
ctcctcatcccg

SEQ ID NO: 3215906 - DNA, 11 bp, Homo sapiens
ctcctcatgta

SEQ ID NO: 3215907 - DNA, 20 bp, Homo sapiens
ctcctcatgtacataccctg

SEQ ID NO: 3215908 - DNA, 19 bp, Homo sapiens
ctcctccacagtgctgctt

SEQ ID NO: 3215909 - DNA, 15 bp, Homo sapiens
ctcctccagcccctg

SEQ ID NO: 3215910 - DNA, 17 bp, Homo sapiens
ctcctccagcccctgtc

SEQ ID NO: 3215911 - DNA, 18 bp, Homo sapiens
ctcctccaggcctgcctc

SEQ ID NO: 3215912 - DNA, 23 bp, Homo sapiens
ctcctccaggcctgcctcccact

SEQ ID NO: 3215913 - DNA, 23 bp, Homo sapiens
ctcctccagtgtgggcttgacca

SEQ ID NO: 3215914 - DNA, 18 bp, Homo sapiens
ctcctccatctttctaca

SEQ ID NO: 3215915 - DNA, 22 bp, Homo sapiens
ctcctcccacccggctgcagag

SEQ ID NO: 3215916 - DNA, 15 bp, Homo sapiens
ctcctcccagcgtgt

SEQ ID NO: 3215917 - DNA, 23 bp, Homo sapiens
ctcctcccaggcgccccttcccc

SEQ ID NO: 3215918 - DNA, 17 bp, Homo sapiens
ctcctccccaaatcaat

SEQ ID NO: 3215919 - DNA, 11 bp, Homo sapiens
ctcctccccca

SEQ ID NO: 3215920 - DNA, 15 bp, Homo sapiens
ctcctcccccacccc

SEQ ID NO: 3215921 - DNA, 15 bp, Homo sapiens
ctcctccccttcctc

SEQ ID NO: 3215922 - DNA, 17 bp, Homo sapiens
ctcctccccttcctctt

SEQ ID NO: 3215923 - DNA, 12 bp, Homo sapiens
ctcctccctgcc

SEQ ID NO: 3215924 - DNA, 20 bp, Homo sapiens
ctcctccctgccccccaagg

SEQ ID NO: 3215925 - DNA, 19 bp, Homo sapiens
ctcctccctggctgccctg

SEQ ID NO: 3215926 - DNA, 13 bp, Homo sapiens
ctcctcctcggaa

SEQ ID NO: 3215927 - DNA, 15 bp, Homo sapiens
ctcctcctgccctgt

SEQ ID NO: 3215928 - DNA, 16 bp, Homo sapiens
ctcctcctgccctgtc

SEQ ID NO: 3215929 - DNA, 13 bp, Homo sapiens
ctcctccttgccc

SEQ ID NO: 3215930 - DNA, 15 bp, Homo sapiens
ctcctcctttttcca

SEQ ID NO: 3215931 - DNA, 20 bp, Homo sapiens
ctcctcggagagcagcagca

SEQ ID NO: 3215932 - DNA, 19 bp, Homo sapiens
ctcctcggccccctccatc

SEQ ID NO: 3215933 - DNA, 17 bp, Homo sapiens
ctcctcgggccgaggcc

SEQ ID NO: 3215934 - DNA, 19 bp, Homo sapiens
ctcctcgggccgaggccca

SEQ ID NO: 3215935 - DNA, 18 bp, Homo sapiens
ctcctcggggctccaggc

SEQ ID NO: 3215936 - DNA, 19 bp, Homo sapiens
ctcctcgttcctttctcct

SEQ ID NO: 3215937 - DNA, 20 bp, Homo sapiens
ctcctctcacctctccctcg

SEQ ID NO: 3215938 - DNA, 11 bp, Homo sapiens
ctcctctccag

SEQ ID NO: 3215939 - DNA, 13 bp, Homo sapiens
ctcctctcccatc

SEQ ID NO: 3215940 - DNA, 18 bp, Homo sapiens
ctcctctcccatccttga

SEQ ID NO: 3215941 - DNA, 22 bp, Homo sapiens
ctcctctccccagcaagtgaga

SEQ ID NO: 3215942 - DNA, 21 bp, Homo sapiens
ctcctctccttgggctcctgg

SEQ ID NO: 3215943 - DNA, 12 bp, Homo sapiens
ctcctctgcact

SEQ ID NO: 3215944 - DNA, 13 bp, Homo sapiens
ctcctctgcactc

SEQ ID NO: 3215945 - DNA, 18 bp, Homo sapiens
ctcctctgcagtgccttg

SEQ ID NO: 3215946 - DNA, 16 bp, Homo sapiens
ctcctctgggcctggg

SEQ ID NO: 3215947 - DNA, 18 bp, Homo sapiens
ctcctctgggcctggggt

SEQ ID NO: 3215948 - DNA, 20 bp, Homo sapiens
ctcctctgggcctggggtgc

SEQ ID NO: 3215949 - DNA, 12 bp, Homo sapiens
ctcctctgtcca

SEQ ID NO: 3215950 - DNA, 15 bp, Homo sapiens
ctcctctgtccaggc

SEQ ID NO: 3215951 - DNA, 17 bp, Homo sapiens
ctcctctgtcctgcttc

SEQ ID NO: 3215952 - DNA, 18 bp, Homo sapiens
ctcctcttcaccccggca

SEQ ID NO: 3215953 - DNA, 22 bp, Homo sapiens
ctcctcttcaccccggcaggcc

SEQ ID NO: 3215954 - DNA, 12 bp, Homo sapiens
ctcctcttgcca

SEQ ID NO: 3215955 - DNA, 13 bp, Homo sapiens
ctcctcttggaat

SEQ ID NO: 3215956 - DNA, 14 bp, Homo sapiens
ctcctcttggaatt

SEQ ID NO: 3215957 - DNA, 15 bp, Homo sapiens
ctcctctttcctctc

SEQ ID NO: 3215958 - DNA, 21 bp, Homo sapiens
ctcctgaaacccaaagccctg

SEQ ID NO: 3215959 - DNA, 19 bp, Homo sapiens
ctcctgaaccgcacagctc

SEQ ID NO: 3215960 - DNA, 23 bp, Homo sapiens
ctcctgaaccgcacagctcagga

SEQ ID NO: 3215961 - DNA, 16 bp, Homo sapiens
ctcctgacaagttatt

SEQ ID NO: 3215962 - DNA, 18 bp, Homo sapiens
ctcctgacagaaggtgcc

SEQ ID NO: 3215963 - DNA, 23 bp, Homo sapiens
ctcctgacccagtccccgtgccc

SEQ ID NO: 3215964 - DNA, 13 bp, Homo sapiens
ctcctgagcctgt

SEQ ID NO: 3215965 - DNA, 14 bp, Homo sapiens
ctcctgagcctgtg

SEQ ID NO: 3215966 - DNA, 19 bp, Homo sapiens
ctcctgaggggcatctgcc

SEQ ID NO: 3215967 - DNA, 21 bp, Homo sapiens
ctcctgaggggcatctgcccc

SEQ ID NO: 3215968 - DNA, 22 bp, Homo sapiens
ctcctgaggggcatctgcccct

SEQ ID NO: 3215969 - DNA, 14 bp, Homo sapiens
ctcctgattttgta

SEQ ID NO: 3215970 - DNA, 19 bp, Homo sapiens
ctcctgcacttacttgctt

SEQ ID NO: 3215971 - DNA, 20 bp, Homo sapiens
ctcctgcagacacctggact

SEQ ID NO: 3215972 - DNA, 21 bp, Homo sapiens
ctcctgcagacacctggactg

SEQ ID NO: 3215973 - DNA, 19 bp, Homo sapiens
ctcctgcagcatggtccct

SEQ ID NO: 3215974 - DNA, 22 bp, Homo sapiens
ctacagacctgctttttgaaat

SEQ ID NO: 3215975 - DNA, 16 bp, Homo sapiens
ctacagacttctccag

SEQ ID NO: 3215976 - DNA, 21 bp, Homo sapiens
ctacagacttctccagaccca

SEQ ID NO: 3215977 - DNA, 21 bp, Homo sapiens
ctacagagccgagcaatattt

SEQ ID NO: 3215978 - DNA, 21 bp, Homo sapiens
ctacagaggaaacaatattta

SEQ ID NO: 3215979 - DNA, 22 bp, Homo sapiens
ctacagaggccatgggcctcct

SEQ ID NO: 3215980 - DNA, 20 bp, Homo sapiens
ctacagaggtctctgccggc

SEQ ID NO: 3215981 - DNA, 23 bp, Homo sapiens
ctacagaggtctctgccggctct

SEQ ID NO: 3215982 - DNA, 21 bp, Homo sapiens
ctacagatcctttttccatca

SEQ ID NO: 3215983 - DNA, 12 bp, Homo sapiens
ctacagatgtgg

SEQ ID NO: 3215984 - DNA, 18 bp, Homo sapiens
ctacagccttgtccccct

SEQ ID NO: 3215985 - DNA, 19 bp, Homo sapiens
ctacagctaatcagcattc

SEQ ID NO: 3215986 - DNA, 11 bp, Homo sapiens
ctacagctttc

SEQ ID NO: 3215987 - DNA, 17 bp, Homo sapiens
ctacagctttcttgctc

SEQ ID NO: 3215988 - DNA, 17 bp, Homo sapiens
ctacaggacaaagggag

SEQ ID NO: 3215989 - DNA, 18 bp, Homo sapiens
ctacaggacaaagggagg

SEQ ID NO: 3215990 - DNA, 20 bp, Homo sapiens
ctacaggacaaagggaggga

SEQ ID NO: 3215991 - DNA, 22 bp, Homo sapiens
ctacaggtgaaggctctcaccc

SEQ ID NO: 3215992 - DNA, 12 bp, Homo sapiens
ctacagtacaat

SEQ ID NO: 3215993 - DNA, 18 bp, Homo sapiens
ctacagtcaagatagaaa

SEQ ID NO: 3215994 - DNA, 12 bp, Homo sapiens
ctacagtgccaa

SEQ ID NO: 3215995 - DNA, 18 bp, Homo sapiens
ctacagtgccaactcctc

SEQ ID NO: 3215996 - DNA, 20 bp, Homo sapiens
ctacagtgccaactcctcac

SEQ ID NO: 3215997 - DNA, 16 bp, Homo sapiens
ctacagtggttttata

SEQ ID NO: 3215998 - DNA, 21 bp, Homo sapiens
ctacagtggttttatactgaa

SEQ ID NO: 3215999 - DNA, 20 bp, Homo sapiens
ctacagttgttttttgaaaa

SEQ ID NO: 3216000 - DNA, 17 bp, Homo sapiens
ctacagttttaactgtg

SEQ ID NO: 3216001 - DNA, 19 bp, Homo sapiens
ctacagttttaactgtgga

SEQ ID NO: 3216002 - DNA, 17 bp, Homo sapiens
ctacataaactgacttt

SEQ ID NO: 3216003 - DNA, 18 bp, Homo sapiens
ctacataaactgacttta

SEQ ID NO: 3216004 - DNA, 14 bp, Homo sapiens
ctacatcccagcct

SEQ ID NO: 3216005 - DNA, 15 bp, Homo sapiens
ctacatcttctgcct

SEQ ID NO: 3216006 - DNA, 16 bp, Homo sapiens
ctacatcttctgcctt

SEQ ID NO: 3216007 - DNA, 10 bp, Homo sapiens
ctacatgaaa

SEQ ID NO: 3216008 - DNA, 15 bp, Homo sapiens
ctacatgaaacagaa

SEQ ID NO: 3216009 - DNA, 16 bp, Homo sapiens
ctacatgaaacagaaa

SEQ ID NO: 3216010 - DNA, 18 bp, Homo sapiens
ctacatgaaacagaaaca

SEQ ID NO: 3216011 - DNA, 16 bp, Homo sapiens
ctacatgactgggcct

SEQ ID NO: 3216012 - DNA, 18 bp, Homo sapiens
ctacatgactgggcctcc

SEQ ID NO: 3216013 - DNA, 13 bp, Homo sapiens
ctacatgagaaca

SEQ ID NO: 3216014 - DNA, 14 bp, Homo sapiens
ctacatgagaacaa

SEQ ID NO: 3216015 - DNA, 22 bp, Homo sapiens
ctacatgcaaggcactgtacta

SEQ ID NO: 3216016 - DNA, 21 bp, Homo sapiens
ctacatgctctttttctgtga

SEQ ID NO: 3216017 - DNA, 22 bp, Homo sapiens
ctacatgtattgcacattgtaa

SEQ ID NO: 3216018 - DNA, 14 bp, Homo sapiens
ctacattaacttga

SEQ ID NO: 3216019 - DNA, 23 bp, Homo sapiens
ctacattccctctcctgcccaga

SEQ ID NO: 3216020 - DNA, 16 bp, Homo sapiens
ctaccaactttactgt

SEQ ID NO: 3216021 - DNA, 15 bp, Homo sapiens
ctaccacaaggaaaa

SEQ ID NO: 3216022 - DNA, 16 bp, Homo sapiens
ctaccacaaggaaaat

SEQ ID NO: 3216023 - DNA, 15 bp, Homo sapiens
ctaccacagtgtctg

SEQ ID NO: 3216024 - DNA, 19 bp, Homo sapiens
ctaccacgggtctgccatg

SEQ ID NO: 3216025 - DNA, 22 bp, Homo sapiens
ctaccagcgccaaatgttcatc

SEQ ID NO: 3216026 - DNA, 15 bp, Homo sapiens
ctaccaggcaaattc

SEQ ID NO: 3216027 - DNA, 13 bp, Homo sapiens
ctaccagtattta

SEQ ID NO: 3216028 - DNA, 20 bp, Homo sapiens
ctaccagtatttagaagcca

SEQ ID NO: 3216029 - DNA, 16 bp, Homo sapiens
ctaccatcagggacag

SEQ ID NO: 3216030 - DNA, 14 bp, Homo sapiens
ctaccatgctgctt

SEQ ID NO: 3216031 - DNA, 13 bp, Homo sapiens
ctaccattcagtg

SEQ ID NO: 3216032 - DNA, 12 bp, Homo sapiens
ctaccatttcac

SEQ ID NO: 3216033 - DNA, 17 bp, Homo sapiens
ctacccaaaccctaggt

SEQ ID NO: 3216034 - DNA, 15 bp, Homo sapiens
ctacccaaccactca

SEQ ID NO: 3216035 - DNA, 16 bp, Homo sapiens
ctacccaaccactcaa

SEQ ID NO: 3216036 - DNA, 23 bp, Homo sapiens
ctacccaccgatggagcccccag

SEQ ID NO: 3216037 - DNA, 19 bp, Homo sapiens
ctacccactatccttcgtg

SEQ ID NO: 3216038 - DNA, 18 bp, Homo sapiens
ctacccatgagcctgccc

SEQ ID NO: 3216039 - DNA, 12 bp, Homo sapiens
ctaccccagtcc

SEQ ID NO: 3216040 - DNA, 17 bp, Homo sapiens
ctaccccagtcccaggg

SEQ ID NO: 3216041 - DNA, 16 bp, Homo sapiens
ctaccccatctccaag

SEQ ID NO: 3216042 - DNA, 14 bp, Homo sapiens
ctacccccttttca

SEQ ID NO: 3216043 - DNA, 15 bp, Homo sapiens
ctacccccttttcag

SEQ ID NO: 3216044 - DNA, 23 bp, Homo sapiens
ctacccccttttcagctgagccc

SEQ ID NO: 3216045 - DNA, 24 bp, Homo sapiens
ctacccccttttcagctgagccct

SEQ ID NO: 3216046 - DNA, 15 bp, Homo sapiens
ctaccccgcagacac

SEQ ID NO: 3216047 - DNA, 13 bp, Homo sapiens
ctacccctttctt

SEQ ID NO: 3216048 - DNA, 17 bp, Homo sapiens
ctacccctttcttctcg

SEQ ID NO: 3216049 - DNA, 19 bp, Homo sapiens
ctaccctagccattcctgg

SEQ ID NO: 3216050 - DNA, 12 bp, Homo sapiens
ctaccctcccac

SEQ ID NO: 3216051 - DNA, 13 bp, Homo sapiens
ctaccctcccacc

SEQ ID NO: 3216052 - DNA, 16 bp, Homo sapiens
ctaccctcccaccccc

SEQ ID NO: 3216053 - DNA, 14 bp, Homo sapiens
ctaccctccttcca

SEQ ID NO: 3216054 - DNA, 17 bp, Homo sapiens
ctaccctcgggcccacc

SEQ ID NO: 3216055 - DNA, 22 bp, Homo sapiens
ctaccctcgggcccacctggcc

SEQ ID NO: 3216056 - DNA, 15 bp, Homo sapiens
ctaccctgctccctg

SEQ ID NO: 3216057 - DNA, 13 bp, Homo sapiens
ctaccctggactt

SEQ ID NO: 3216058 - DNA, 14 bp, Homo sapiens
ctaccctgtgtata

SEQ ID NO: 3216059 - DNA, 18 bp, Homo sapiens
ctaccctttttctccagc

SEQ ID NO: 3216060 - DNA, 19 bp, Homo sapiens
ctaccgagtctcttctcca

SEQ ID NO: 3216061 - DNA, 23 bp, Homo sapiens
ctaccgagtctcttctccactgg

SEQ ID NO: 3216062 - DNA, 17 bp, Homo sapiens
ctaccgccctgggctgg

SEQ ID NO: 3216063 - DNA, 18 bp, Homo sapiens
ctaccgccctgggctgga

SEQ ID NO: 3216064 - DNA, 20 bp, Homo sapiens
ctaccgccctgggctggact

SEQ ID NO: 3216065 - DNA, 16 bp, Homo sapiens
ctaccgtcttttcctg

SEQ ID NO: 3216066 - DNA, 11 bp, Homo sapiens
ctacctcagcc

SEQ ID NO: 3216067 - DNA, 13 bp, Homo sapiens
ctacctcagcctc

SEQ ID NO: 3216068 - DNA, 13 bp, Homo sapiens
ctacctcaggcag

SEQ ID NO: 3216069 - DNA, 14 bp, Homo sapiens
ctacctcaggcagg

SEQ ID NO: 3216070 - DNA, 11 bp, Homo sapiens
ctacctccctc

SEQ ID NO: 3216071 - DNA, 12 bp, Homo sapiens
ctacctccctcc

SEQ ID NO: 3216072 - DNA, 23 bp, Homo sapiens
ctacctccttagctttccctgtg

SEQ ID NO: 3216073 - DNA, 16 bp, Homo sapiens
ctacctgaacattgta

SEQ ID NO: 3216074 - DNA, 14 bp, Homo sapiens
ctacctgagctaaa

SEQ ID NO: 3216075 - DNA, 15 bp, Homo sapiens
ctacctgaggccagg

SEQ ID NO: 3216076 - DNA, 14 bp, Homo sapiens
ctacctgccctgga

SEQ ID NO: 3216077 - DNA, 18 bp, Homo sapiens
ctacctgccctggaacat

SEQ ID NO: 3216078 - DNA, 17 bp, Homo sapiens
ctacctgctggacagcc

SEQ ID NO: 3216079 - DNA, 15 bp, Homo sapiens
ctctggggtgggcag

SEQ ID NO: 3216080 - DNA, 21 bp, Homo sapiens
ctctggtaaagttacactttt

SEQ ID NO: 3216081 - DNA, 17 bp, Homo sapiens
ctctggtaatattgact

SEQ ID NO: 3216082 - DNA, 15 bp, Homo sapiens
ctctggtccacacta

SEQ ID NO: 3216083 - DNA, 18 bp, Homo sapiens
ctctggtccacactagaa

SEQ ID NO: 3216084 - DNA, 17 bp, Homo sapiens
ctctggtggcacaggag

SEQ ID NO: 3216085 - DNA, 15 bp, Homo sapiens
ctctggttatctaat

SEQ ID NO: 3216086 - DNA, 21 bp, Homo sapiens
ctctggttgtctagtcattgt

SEQ ID NO: 3216087 - DNA, 23 bp, Homo sapiens
ctctggttgtttctgttccaaat

SEQ ID NO: 3216088 - DNA, 18 bp, Homo sapiens
ctctggttttcctctgct

SEQ ID NO: 3216089 - DNA, 11 bp, Homo sapiens
ctctgtacttt

SEQ ID NO: 3216090 - DNA, 12 bp, Homo sapiens
ctctgtactttt

SEQ ID NO: 3216091 - DNA, 20 bp, Homo sapiens
ctctgtacttttcattctct

SEQ ID NO: 3216092 - DNA, 15 bp, Homo sapiens
ctctgtatagaaatc

SEQ ID NO: 3216093 - DNA, 18 bp, Homo sapiens
ctctgtatagaaatctaa

SEQ ID NO: 3216094 - DNA, 15 bp, Homo sapiens
ctctgtcaatgaaaa

SEQ ID NO: 3216095 - DNA, 23 bp, Homo sapiens
ctctgtcagatgggaagacatga

SEQ ID NO: 3216096 - DNA, 13 bp, Homo sapiens
ctctgtccaggcc

SEQ ID NO: 3216097 - DNA, 14 bp, Homo sapiens
ctctgtccaggcca

SEQ ID NO: 3216098 - DNA, 15 bp, Homo sapiens
ctctgtccaggccac

SEQ ID NO: 3216099 - DNA, 22 bp, Homo sapiens
ctctgtccaggccactgtggcc

SEQ ID NO: 3216100 - DNA, 14 bp, Homo sapiens
ctctgtccctgtcc

SEQ ID NO: 3216101 - DNA, 16 bp, Homo sapiens
ctctgtcccttgctgt

SEQ ID NO: 3216102 - DNA, 13 bp, Homo sapiens
ctctgtcctactt

SEQ ID NO: 3216103 - DNA, 19 bp, Homo sapiens
ctctgtcgcccagtctgga

SEQ ID NO: 3216104 - DNA, 16 bp, Homo sapiens
ctctgtctacccagtg

SEQ ID NO: 3216105 - DNA, 14 bp, Homo sapiens
ctctgtctcatcct

SEQ ID NO: 3216106 - DNA, 17 bp, Homo sapiens
ctctgtctcatcctcct

SEQ ID NO: 3216107 - DNA, 18 bp, Homo sapiens
ctctgtctcatcctcctg

SEQ ID NO: 3216108 - DNA, 19 bp, Homo sapiens
ctctgtctcatcctcctgg

SEQ ID NO: 3216109 - DNA, 18 bp, Homo sapiens
ctctgtgaacgatttaga

SEQ ID NO: 3216110 - DNA, 14 bp, Homo sapiens
ctctgtgaatacaa

SEQ ID NO: 3216111 - DNA, 17 bp, Homo sapiens
ctctgtgaatacaatta

SEQ ID NO: 3216112 - DNA, 19 bp, Homo sapiens
ctctgtgaatacaattaaa

SEQ ID NO: 3216113 - DNA, 13 bp, Homo sapiens
ctctgtgccttcg

SEQ ID NO: 3216114 - DNA, 14 bp, Homo sapiens
ctctgtgctgacat

SEQ ID NO: 3216115 - DNA, 22 bp, Homo sapiens
ctctgtgcttttaaatgcataa

SEQ ID NO: 3216116 - DNA, 16 bp, Homo sapiens
ctctgtggaggggccc

SEQ ID NO: 3216117 - DNA, 13 bp, Homo sapiens
ctctgtggcctgt

SEQ ID NO: 3216118 - DNA, 18 bp, Homo sapiens
ctctgtgtatttgctttt

SEQ ID NO: 3216119 - DNA, 20 bp, Homo sapiens
ctctgtgtcaggtggggcag

SEQ ID NO: 3216120 - DNA, 22 bp, Homo sapiens
ctctgtgtcaggtggggcagct

SEQ ID NO: 3216121 - DNA, 23 bp, Homo sapiens
ctctgtgtcaggtggggcagctt

SEQ ID NO: 3216122 - DNA, 18 bp, Homo sapiens
ctctgtgtctaagattct

SEQ ID NO: 3216123 - DNA, 16 bp, Homo sapiens
ctctgtgtctttctct

SEQ ID NO: 3216124 - DNA, 16 bp, Homo sapiens
ctctgtgttcccagag

SEQ ID NO: 3216125 - DNA, 18 bp, Homo sapiens
ctctgtgttcccagaggc

SEQ ID NO: 3216126 - DNA, 13 bp, Homo sapiens
ctctgtgtttaaa

SEQ ID NO: 3216127 - DNA, 19 bp, Homo sapiens
ctctgtgtttgttcctaca

SEQ ID NO: 3216128 - DNA, 16 bp, Homo sapiens
ctctgttaaggttgaa

SEQ ID NO: 3216129 - DNA, 18 bp, Homo sapiens
ctctgttaaggttgaact

SEQ ID NO: 3216130 - DNA, 19 bp, Homo sapiens
ctctgttaaggttgaactt

SEQ ID NO: 3216131 - DNA, 22 bp, Homo sapiens
ctctgttaaggttgaactttgc

SEQ ID NO: 3216132 - DNA, 15 bp, Homo sapiens
ctctgttacccaggc

SEQ ID NO: 3216133 - DNA, 13 bp, Homo sapiens
ctctgttcatttc

SEQ ID NO: 3216134 - DNA, 13 bp, Homo sapiens
ctctgttccccca

SEQ ID NO: 3216135 - DNA, 19 bp, Homo sapiens
ctctgttcctgagccccca

SEQ ID NO: 3216136 - DNA, 23 bp, Homo sapiens
ctctgttctgtttggcacttgta

SEQ ID NO: 3216137 - DNA, 14 bp, Homo sapiens
ctctgttctttata

SEQ ID NO: 3216138 - DNA, 16 bp, Homo sapiens
ctctgtttctccttct

SEQ ID NO: 3216139 - DNA, 23 bp, Homo sapiens
ctctgtttgatgctatttatgca

SEQ ID NO: 3216140 - DNA, 14 bp, Homo sapiens
ctcttaaattatat

SEQ ID NO: 3216141 - DNA, 17 bp, Homo sapiens
ctcttaagcagcatgga

SEQ ID NO: 3216142 - DNA, 12 bp, Homo sapiens
ctcttaatctgt

SEQ ID NO: 3216143 - DNA, 21 bp, Homo sapiens
ctcttacagtgtttggacagg

SEQ ID NO: 3216144 - DNA, 18 bp, Homo sapiens
ctcttaccgtagcctccg

SEQ ID NO: 3216145 - DNA, 18 bp, Homo sapiens
ctcttactacactgagga

SEQ ID NO: 3216146 - DNA, 23 bp, Homo sapiens
ctcttactttcctttccccagcc

SEQ ID NO: 3216147 - DNA, 18 bp, Homo sapiens
ctcttaggatatttgagt

SEQ ID NO: 3216148 - DNA, 13 bp, Homo sapiens
ctcttagtgcccg

SEQ ID NO: 3216149 - DNA, 16 bp, Homo sapiens
ctcttagtgcccgcct

SEQ ID NO: 3216150 - DNA, 21 bp, Homo sapiens
ctcttatctcagtcatgcata

SEQ ID NO: 3216151 - DNA, 18 bp, Homo sapiens
ctcttatgccatttgttt

SEQ ID NO: 3216152 - DNA, 15 bp, Homo sapiens
ctcttattcctctag

SEQ ID NO: 3216153 - DNA, 18 bp, Homo sapiens
ctcttattcctctaggca

SEQ ID NO: 3216154 - DNA, 14 bp, Homo sapiens
ctcttattctaata

SEQ ID NO: 3216155 - DNA, 19 bp, Homo sapiens
ctcttattgcccacgctgg

SEQ ID NO: 3216156 - DNA, 20 bp, Homo sapiens
ctcttattgcccacgctgga

SEQ ID NO: 3216157 - DNA, 14 bp, Homo sapiens
ctcttcaatctctt

SEQ ID NO: 3216158 - DNA, 17 bp, Homo sapiens
ctcttcaccccccactc

SEQ ID NO: 3216159 - DNA, 21 bp, Homo sapiens
ctcttcaccccggcaggccct

SEQ ID NO: 3216160 - DNA, 23 bp, Homo sapiens
ctcttcaccccggcaggccctgc

SEQ ID NO: 3216161 - DNA, 12 bp, Homo sapiens
ctcttcagaact

SEQ ID NO: 3216162 - DNA, 14 bp, Homo sapiens
ctcttcagcccctt

SEQ ID NO: 3216163 - DNA, 20 bp, Homo sapiens
ctcttcaggcctccctctct

SEQ ID NO: 3216164 - DNA, 15 bp, Homo sapiens
ctcttcaggttctta

SEQ ID NO: 3216165 - DNA, 17 bp, Homo sapiens
ctcttcagtgactcctg

SEQ ID NO: 3216166 - DNA, 20 bp, Homo sapiens
ctcttcagtgactcctgctg

SEQ ID NO: 3216167 - DNA, 23 bp, Homo sapiens
ctcttcagtgactcctgctggta

SEQ ID NO: 3216168 - DNA, 19 bp, Homo sapiens
ctcttcatactttttttca

SEQ ID NO: 3216169 - DNA, 22 bp, Homo sapiens
ctcttcattccattgacttaga

SEQ ID NO: 3216170 - DNA, 21 bp, Homo sapiens
ctcttcatttttttttcaatc

SEQ ID NO: 3216171 - DNA, 19 bp, Homo sapiens
ctcttccagtcttcctgac

SEQ ID NO: 3216172 - DNA, 15 bp, Homo sapiens
ctcttccccttgccc

SEQ ID NO: 3216173 - DNA, 19 bp, Homo sapiens
ctgaacacaggcagctttc

SEQ ID NO: 3216174 - DNA, 13 bp, Homo sapiens
ctgaacagctgta

SEQ ID NO: 3216175 - DNA, 13 bp, Homo sapiens
ctgaacatgttta

SEQ ID NO: 3216176 - DNA, 21 bp, Homo sapiens
ctgaacatttgctttgttttc

SEQ ID NO: 3216177 - DNA, 20 bp, Homo sapiens
ctgaaccaaattgcactgaa

SEQ ID NO: 3216178 - DNA, 16 bp, Homo sapiens
ctgaaccacaaaaaaa

SEQ ID NO: 3216179 - DNA, 12 bp, Homo sapiens
ctgaaccatgtg

SEQ ID NO: 3216180 - DNA, 15 bp, Homo sapiens
ctgaaccccatgggc

SEQ ID NO: 3216181 - DNA, 17 bp, Homo sapiens
ctgaaccccatgggctt

SEQ ID NO: 3216182 - DNA, 21 bp, Homo sapiens
ctgaaccccgtcgaggggctc

SEQ ID NO: 3216183 - DNA, 17 bp, Homo sapiens
ctgaaccctgtgctggt

SEQ ID NO: 3216184 - DNA, 16 bp, Homo sapiens
ctgaaccgcaaggagc

SEQ ID NO: 3216185 - DNA, 22 bp, Homo sapiens
ctgaactaataaatctgttgcc

SEQ ID NO: 3216186 - DNA, 14 bp, Homo sapiens
ctgaactcttcaga

SEQ ID NO: 3216187 - DNA, 13 bp, Homo sapiens
ctgaactgaggag

SEQ ID NO: 3216188 - DNA, 22 bp, Homo sapiens
ctgaacttcaggataataaagt

SEQ ID NO: 3216189 - DNA, 17 bp, Homo sapiens
ctgaactttctccctca

SEQ ID NO: 3216190 - DNA, 19 bp, Homo sapiens
ctgaactttctccctcatc

SEQ ID NO: 3216191 - DNA, 21 bp, Homo sapiens
ctgaacttttggctaacagaa

SEQ ID NO: 3216192 - DNA, 14 bp, Homo sapiens
ctgaagaaaaaatc

SEQ ID NO: 3216193 - DNA, 20 bp, Homo sapiens
ctgaagaaatctttccagtt

SEQ ID NO: 3216194 - DNA, 15 bp, Homo sapiens
ctgaagaattaagat

SEQ ID NO: 3216195 - DNA, 13 bp, Homo sapiens
ctgaagaattgaa

SEQ ID NO: 3216196 - DNA, 18 bp, Homo sapiens
ctgaagaattgaaaagtt

SEQ ID NO: 3216197 - DNA, 20 bp, Homo sapiens
ctgaagagagggacaggcac

SEQ ID NO: 3216198 - DNA, 20 bp, Homo sapiens
ctgaagagctattatataaa

SEQ ID NO: 3216199 - DNA, 14 bp, Homo sapiens
ctgaagaggcgggc

SEQ ID NO: 3216200 - DNA, 15 bp, Homo sapiens
ctgaagaggcgggcc

SEQ ID NO: 3216201 - DNA, 23 bp, Homo sapiens
ctgaagaggcgggccagccaggc

SEQ ID NO: 3216202 - DNA, 19 bp, Homo sapiens
ctgaagaggcttctcctgt

SEQ ID NO: 3216203 - DNA, 15 bp, Homo sapiens
ctgaagatcagaaca

SEQ ID NO: 3216204 - DNA, 15 bp, Homo sapiens
ctgaagcagcctctc

SEQ ID NO: 3216205 - DNA, 15 bp, Homo sapiens
ctgaagccctcccag

SEQ ID NO: 3216206 - DNA, 21 bp, Homo sapiens
ctgaaggaaaaacacaagcaa

SEQ ID NO: 3216207 - DNA, 22 bp, Homo sapiens
ctgaaggaataaattgctcctt

SEQ ID NO: 3216208 - DNA, 16 bp, Homo sapiens
ctgaaggaatagccag

SEQ ID NO: 3216209 - DNA, 20 bp, Homo sapiens
ctgaaggaatagccagagag

SEQ ID NO: 3216210 - DNA, 19 bp, Homo sapiens
ctgaaggacattgcggaca

SEQ ID NO: 3216211 - DNA, 20 bp, Homo sapiens
ctgaaggacattgcggacag

SEQ ID NO: 3216212 - DNA, 21 bp, Homo sapiens
ctgaaggacattgcggacagc

SEQ ID NO: 3216213 - DNA, 16 bp, Homo sapiens
ctgaaggattctggga

SEQ ID NO: 3216214 - DNA, 21 bp, Homo sapiens
ctgaaggcagtggcaggggag

SEQ ID NO: 3216215 - DNA, 14 bp, Homo sapiens
ctgaaggggcacac

SEQ ID NO: 3216216 - DNA, 16 bp, Homo sapiens
ctgaaggggcacacca

SEQ ID NO: 3216217 - DNA, 16 bp, Homo sapiens
ctgaagtactaacaca

SEQ ID NO: 3216218 - DNA, 20 bp, Homo sapiens
ctgaagtacttaaacttcca

SEQ ID NO: 3216219 - DNA, 16 bp, Homo sapiens
ctgaagtcacacagtg

SEQ ID NO: 3216220 - DNA, 14 bp, Homo sapiens
ctgaagtcactgca

SEQ ID NO: 3216221 - DNA, 15 bp, Homo sapiens
ctgaagtcactgcac

SEQ ID NO: 3216222 - DNA, 16 bp, Homo sapiens
ctgaagtcactgcaca

SEQ ID NO: 3216223 - DNA, 17 bp, Homo sapiens
ctgaagtcactgcacag

SEQ ID NO: 3216224 - DNA, 19 bp, Homo sapiens
ctgaagtgagcacagccta

SEQ ID NO: 3216225 - DNA, 11 bp, Homo sapiens
ctgaagttttt

SEQ ID NO: 3216226 - DNA, 16 bp, Homo sapiens
ctgaagtttttgaaat

SEQ ID NO: 3216227 - DNA, 18 bp, Homo sapiens
ctgaagtttttgaaatac

SEQ ID NO: 3216228 - DNA, 19 bp, Homo sapiens
ctgaagtttttgaaatacc

SEQ ID NO: 3216229 - DNA, 21 bp, Homo sapiens
ctgaagtttttgaaatacctt

SEQ ID NO: 3216230 - DNA, 23 bp, Homo sapiens
ctgaagtttttgaaatacctttg

SEQ ID NO: 3216231 - DNA, 14 bp, Homo sapiens
ctgaataaatggta

SEQ ID NO: 3216232 - DNA, 20 bp, Homo sapiens
ctgaataccacttacctcaa

SEQ ID NO: 3216233 - DNA, 19 bp, Homo sapiens
ctgaatagtcttcagagat

SEQ ID NO: 3216234 - DNA, 17 bp, Homo sapiens
ctgaatatacagcaggt

SEQ ID NO: 3216235 - DNA, 19 bp, Homo sapiens
ctgaatatctgttcacttt

SEQ ID NO: 3216236 - DNA, 13 bp, Homo sapiens
ctgaatccacctc

SEQ ID NO: 3216237 - DNA, 16 bp, Homo sapiens
ctgaatccacctcgga

SEQ ID NO: 3216238 - DNA, 19 bp, Homo sapiens
ctgaatcgagtgagacaaa

SEQ ID NO: 3216239 - DNA, 15 bp, Homo sapiens
ctgaatctgtgcaaa

SEQ ID NO: 3216240 - DNA, 17 bp, Homo sapiens
ctgaatgaaaataactg

SEQ ID NO: 3216241 - DNA, 14 bp, Homo sapiens
ctgaatgaagcagt

SEQ ID NO: 3216242 - DNA, 14 bp, Homo sapiens
ctgaatgaagctga

SEQ ID NO: 3216243 - DNA, 23 bp, Homo sapiens
ctgaatgactccactgtttttct

SEQ ID NO: 3216244 - DNA, 20 bp, Homo sapiens
ctgaatgaggtcagcatgtc

SEQ ID NO: 3216245 - DNA, 14 bp, Homo sapiens
ctgaatgcataaat

SEQ ID NO: 3216246 - DNA, 15 bp, Homo sapiens
ctgaatgcataaata

SEQ ID NO: 3216247 - DNA, 23 bp, Homo sapiens
ctgaatgcctcgctcccttcaag

SEQ ID NO: 3216248 - DNA, 18 bp, Homo sapiens
ctgaatggttccatgcct

SEQ ID NO: 3216249 - DNA, 19 bp, Homo sapiens
ctgaatggttttcaaaata

SEQ ID NO: 3216250 - DNA, 13 bp, Homo sapiens
ctgaatgtaaaag

SEQ ID NO: 3216251 - DNA, 22 bp, Homo sapiens
ctgaatgtaatttgtgtaataa

SEQ ID NO: 3216252 - DNA, 23 bp, Homo sapiens
ctgaatgtgcctaatggagaaga

SEQ ID NO: 3216253 - DNA, 13 bp, Homo sapiens
ctgaatgttctga

SEQ ID NO: 3216254 - DNA, 23 bp, Homo sapiens
ctgaatgttctgacattaacagt

SEQ ID NO: 3216255 - DNA, 19 bp, Homo sapiens
ctgaatgtttattccttga

SEQ ID NO: 3216256 - DNA, 14 bp, Homo sapiens
ctgaattaattaat

SEQ ID NO: 3216257 - DNA, 23 bp, Homo sapiens
ctgaattatctatacatatcttt

SEQ ID NO: 3216258 - DNA, 21 bp, Homo sapiens
ctgaattcaaagcttgtgaaa

SEQ ID NO: 3216259 - DNA, 22 bp, Homo sapiens
ctgaattcaaagcttgtgaaaa

SEQ ID NO: 3216260 - DNA, 13 bp, Homo sapiens
ctgaattcctgtc

SEQ ID NO: 3216261 - DNA, 17 bp, Homo sapiens
ctgaattctatttgctg

SEQ ID NO: 3216262 - DNA, 17 bp, Homo sapiens
ctgaattgtcagatgtg

SEQ ID NO: 3216263 - DNA, 12 bp, Homo sapiens
ctgaatttggag

SEQ ID NO: 3216264 - DNA, 15 bp, Homo sapiens
ctgaattttgggact

SEQ ID NO: 3216265 - DNA, 20 bp, Homo sapiens
ctgaattttgggacttctac

SEQ ID NO: 3216266 - DNA, 19 bp, Homo sapiens
ctgacaaccattaaagtca

SEQ ID NO: 3216267 - DNA, 20 bp, Homo sapiens
ctgacaagggctgacctgcc

SEQ ID NO: 3216268 - DNA, 13 bp, Homo sapiens
ctgacaagttatt

SEQ ID NO: 3216269 - DNA, 14 bp, Homo sapiens
ctgacacaccaggc

SEQ ID NO: 3216270 - DNA, 23 bp, Homo sapiens
ctgacacaccaggcgctaattca

SEQ ID NO: 3216271 - DNA, 13 bp, Homo sapiens
ctgacacactaac

SEQ ID NO: 3216272 - DNA, 16 bp, Homo sapiens
ctgacacactaaccaa

SEQ ID NO: 3216273 - DNA, 19 bp, Homo sapiens
ctgacacactaaccaagct

SEQ ID NO: 3216274 - DNA, 20 bp, Homo sapiens
ctgacacactaaccaagctg

SEQ ID NO: 3216275 - DNA, 21 bp, Homo sapiens
ctctccgaccagacaccttga

SEQ ID NO: 3216276 - DNA, 21 bp, Homo sapiens
ctctcctagagacagaagcag

SEQ ID NO: 3216277 - DNA, 15 bp, Homo sapiens
ctctcctctctgctt

SEQ ID NO: 3216278 - DNA, 22 bp, Homo sapiens
ctctcctcttgccactgcctct

SEQ ID NO: 3216279 - DNA, 12 bp, Homo sapiens
ctctcctgccca

SEQ ID NO: 3216280 - DNA, 12 bp, Homo sapiens
ctctcctggcct

SEQ ID NO: 3216281 - DNA, 20 bp, Homo sapiens
ctctcctgtaagccaaagaa

SEQ ID NO: 3216282 - DNA, 21 bp, Homo sapiens
ctctcctgtctgccctctggg

SEQ ID NO: 3216283 - DNA, 20 bp, Homo sapiens
ctctcctgtttcccttccct

SEQ ID NO: 3216284 - DNA, 14 bp, Homo sapiens
ctctccttcctgtg

SEQ ID NO: 3216285 - DNA, 16 bp, Homo sapiens
ctctccttcgtgtctc

SEQ ID NO: 3216286 - DNA, 17 bp, Homo sapiens
ctctccttcgtgtctct

SEQ ID NO: 3216287 - DNA, 22 bp, Homo sapiens
ctctccttcgtgtctctcccac

SEQ ID NO: 3216288 - DNA, 16 bp, Homo sapiens
ctctccttgggctcct

SEQ ID NO: 3216289 - DNA, 17 bp, Homo sapiens
ctctccttgggctcctg

SEQ ID NO: 3216290 - DNA, 19 bp, Homo sapiens
ctctccttgggctcctggc

SEQ ID NO: 3216291 - DNA, 23 bp, Homo sapiens
ctctccttgggctcctggctgcc

SEQ ID NO: 3216292 - DNA, 21 bp, Homo sapiens
ctctcctttctttttcttctt

SEQ ID NO: 3216293 - DNA, 23 bp, Homo sapiens
ctctcctttctttttcttcttcc

SEQ ID NO: 3216294 - DNA, 18 bp, Homo sapiens
ctctccttttccttacca

SEQ ID NO: 3216295 - DNA, 17 bp, Homo sapiens
ctctccttttcttttgt

SEQ ID NO: 3216296 - DNA, 21 bp, Homo sapiens
ctctccttttcttttgttact

SEQ ID NO: 3216297 - DNA, 14 bp, Homo sapiens
ctctcgaccttctg

SEQ ID NO: 3216298 - DNA, 15 bp, Homo sapiens
ctctcggggcccttg

SEQ ID NO: 3216299 - DNA, 23 bp, Homo sapiens
ctctcggggcccttggggcctgg

SEQ ID NO: 3216300 - DNA, 21 bp, Homo sapiens
ctctctaaactggtacaattt

SEQ ID NO: 3216301 - DNA, 15 bp, Homo sapiens
ctctctacagtgcca

SEQ ID NO: 3216302 - DNA, 20 bp, Homo sapiens
ctctctactcctacctcagc

SEQ ID NO: 3216303 - DNA, 22 bp, Homo sapiens
ctctctagcacaatttgcacta

SEQ ID NO: 3216304 - DNA, 22 bp, Homo sapiens
ctctctaggagggagccttgtg

SEQ ID NO: 3216305 - DNA, 17 bp, Homo sapiens
ctctctcactcacattt

SEQ ID NO: 3216306 - DNA, 21 bp, Homo sapiens
ctctctcagagcatctggctg

SEQ ID NO: 3216307 - DNA, 22 bp, Homo sapiens
ctctctcagagcatctggctgt

SEQ ID NO: 3216308 - DNA, 14 bp, Homo sapiens
ctctctcatcttgt

SEQ ID NO: 3216309 - DNA, 12 bp, Homo sapiens
ctctctccagat

SEQ ID NO: 3216310 - DNA, 14 bp, Homo sapiens
ctctctccagatgt

SEQ ID NO: 3216311 - DNA, 17 bp, Homo sapiens
ctctctccagatgtttc

SEQ ID NO: 3216312 - DNA, 12 bp, Homo sapiens
ctctctccagga

SEQ ID NO: 3216313 - DNA, 19 bp, Homo sapiens
ctctctcccctcaaagtct

SEQ ID NO: 3216314 - DNA, 11 bp, Homo sapiens
ctctctcctct

SEQ ID NO: 3216315 - DNA, 15 bp, Homo sapiens
ctctctctctcccct

SEQ ID NO: 3216316 - DNA, 12 bp, Homo sapiens
ctctctctctct

SEQ ID NO: 3216317 - DNA, 16 bp, Homo sapiens
ctctctcttcctaccc

SEQ ID NO: 3216318 - DNA, 18 bp, Homo sapiens
ctctctcttctgctccac

SEQ ID NO: 3216319 - DNA, 14 bp, Homo sapiens
ctctctgcccctga

SEQ ID NO: 3216320 - DNA, 9 bp, Homo sapiens
ctctctgct

SEQ ID NO: 3216321 - DNA, 18 bp, Homo sapiens
ctctctgctccttcactg

SEQ ID NO: 3216322 - DNA, 12 bp, Homo sapiens
ctctctgctcta

SEQ ID NO: 3216323 - DNA, 18 bp, Homo sapiens
ctctctgctctagccagg

SEQ ID NO: 3216324 - DNA, 20 bp, Homo sapiens
ctctctgctgagctgggccc

SEQ ID NO: 3216325 - DNA, 17 bp, Homo sapiens
ctctctggccttcggcc

SEQ ID NO: 3216326 - DNA, 16 bp, Homo sapiens
ctctctgggacctcct

SEQ ID NO: 3216327 - DNA, 15 bp, Homo sapiens
ctctctgggcccagg

SEQ ID NO: 3216328 - DNA, 17 bp, Homo sapiens
ctctctggggccctggg

SEQ ID NO: 3216329 - DNA, 23 bp, Homo sapiens
ctctctggggccctgggcctcag

SEQ ID NO: 3216330 - DNA, 15 bp, Homo sapiens
ctctctgtataaaca

SEQ ID NO: 3216331 - DNA, 16 bp, Homo sapiens
ctctctgtataaacat

SEQ ID NO: 3216332 - DNA, 20 bp, Homo sapiens
ctctctgtataaacattaaa

SEQ ID NO: 3216333 - DNA, 14 bp, Homo sapiens
ctctctgtgaatac

SEQ ID NO: 3216334 - DNA, 17 bp, Homo sapiens
ctctctgtgtctttctc

SEQ ID NO: 3216335 - DNA, 20 bp, Homo sapiens
ctctctgtgtctttctctct

SEQ ID NO: 3216336 - DNA, 20 bp, Homo sapiens
ctctcttaaagttggaattt

SEQ ID NO: 3216337 - DNA, 15 bp, Homo sapiens
ctctcttcagactct

SEQ ID NO: 3216338 - DNA, 22 bp, Homo sapiens
ctctcttcagactctcagccca

SEQ ID NO: 3216339 - DNA, 14 bp, Homo sapiens
ctctcttccctcag

SEQ ID NO: 3216340 - DNA, 15 bp, Homo sapiens
ctctcttccctttcc

SEQ ID NO: 3216341 - DNA, 23 bp, Homo sapiens
ctctcttccctttccccagcatc

SEQ ID NO: 3216342 - DNA, 18 bp, Homo sapiens
ctctcttctgctccaccc

SEQ ID NO: 3216343 - DNA, 13 bp, Homo sapiens
ctctcttgcaccc

SEQ ID NO: 3216344 - DNA, 16 bp, Homo sapiens
ctctcttgcacccgcc

SEQ ID NO: 3216345 - DNA, 14 bp, Homo sapiens
ctctcttggctcta

SEQ ID NO: 3216346 - DNA, 18 bp, Homo sapiens
ctctctttatacagctgt

SEQ ID NO: 3216347 - DNA, 16 bp, Homo sapiens
ctctctttctagaggt

SEQ ID NO: 3216348 - DNA, 13 bp, Homo sapiens
ctctcttttcatt

SEQ ID NO: 3216349 - DNA, 18 bp, Homo sapiens
ctctcttttcattgtgta

SEQ ID NO: 3216350 - DNA, 16 bp, Homo sapiens
ctctcttttccccgcc

SEQ ID NO: 3216351 - DNA, 23 bp, Homo sapiens
ctctcttttccccgcctgcagtc

SEQ ID NO: 3216352 - DNA, 12 bp, Homo sapiens
ctctcttttctg

SEQ ID NO: 3216353 - DNA, 14 bp, Homo sapiens
ctctcttttctgta

SEQ ID NO: 3216354 - DNA, 18 bp, Homo sapiens
ctctcttttctgtacttc

SEQ ID NO: 3216355 - DNA, 21 bp, Homo sapiens
ctctcttttgaggtccctgta

SEQ ID NO: 3216356 - DNA, 19 bp, Homo sapiens
ctctctttttggaggtgct

SEQ ID NO: 3216357 - DNA, 23 bp, Homo sapiens
ctctgaaaagcaattgccctgta

SEQ ID NO: 3216358 - DNA, 22 bp, Homo sapiens
ctctgaaatctgaagacctcga

SEQ ID NO: 3216359 - DNA, 16 bp, Homo sapiens
ctctgaactttggaga

SEQ ID NO: 3216360 - DNA, 18 bp, Homo sapiens
ctcttgagcagtggctgg

SEQ ID NO: 3216361 - DNA, 23 bp, Homo sapiens
ctcttgagtttgtcgctcatgtg

SEQ ID NO: 3216362 - DNA, 18 bp, Homo sapiens
ctcttgatacccccctct

SEQ ID NO: 3216363 - DNA, 12 bp, Homo sapiens
ctcttgcacccg

SEQ ID NO: 3216364 - DNA, 15 bp, Homo sapiens
ctcttgcacccgcct

SEQ ID NO: 3216365 - DNA, 20 bp, Homo sapiens
ctcttgcacccgcctctccc

SEQ ID NO: 3216366 - DNA, 21 bp, Homo sapiens
ctcttgcacccgcctctcccg

SEQ ID NO: 3216367 - DNA, 17 bp, Homo sapiens
ctcttgccactgcctct

SEQ ID NO: 3216368 - DNA, 20 bp, Homo sapiens
ctcttgccactgcctcttcc

SEQ ID NO: 3216369 - DNA, 20 bp, Homo sapiens
ctcttgcccatcctgactga

SEQ ID NO: 3216370 - DNA, 13 bp, Homo sapiens
ctcttgcctctct

SEQ ID NO: 3216371 - DNA, 22 bp, Homo sapiens
ctcttgcgtgtcaatttccctc

SEQ ID NO: 3216372 - DNA, 12 bp, Homo sapiens
ctcttgctcaaa

SEQ ID NO: 3216373 - DNA, 19 bp, Homo sapiens
ctcttgctcaaaaatctgt

SEQ ID NO: 3216374 - DNA, 15 bp, Homo sapiens
ctcttgctctttcta

SEQ ID NO: 3216375 - DNA, 12 bp, Homo sapiens
ctcttgctgtct

SEQ ID NO: 3216376 - DNA, 14 bp, Homo sapiens
ctcttgcttgtcat

SEQ ID NO: 3216377 - DNA, 11 bp, Homo sapiens
ctcttggaaaa

SEQ ID NO: 3216378 - DNA, 22 bp, Homo sapiens
ctcttggaattacaagccctgg

SEQ ID NO: 3216379 - DNA, 16 bp, Homo sapiens
ctcttggcctttgcat

SEQ ID NO: 3216380 - DNA, 23 bp, Homo sapiens
ctcttgggaactccactctcctt

SEQ ID NO: 3216381 - DNA, 21 bp, Homo sapiens
ctcttgggttcaagcgattct

SEQ ID NO: 3216382 - DNA, 15 bp, Homo sapiens
ctcttgtaaagactg

SEQ ID NO: 3216383 - DNA, 16 bp, Homo sapiens
ctcttgtaaagactgg

SEQ ID NO: 3216384 - DNA, 12 bp, Homo sapiens
ctcttgtagaag

SEQ ID NO: 3216385 - DNA, 20 bp, Homo sapiens
ctcttgtataagatcctaga

SEQ ID NO: 3216386 - DNA, 15 bp, Homo sapiens
ctcttgtattaaact

SEQ ID NO: 3216387 - DNA, 13 bp, Homo sapiens
ctcttgtcatttt

SEQ ID NO: 3216388 - DNA, 21 bp, Homo sapiens
ctcttgtcccacgtgtcttcc

SEQ ID NO: 3216389 - DNA, 18 bp, Homo sapiens
ctcttgtccctttcccta

SEQ ID NO: 3216390 - DNA, 14 bp, Homo sapiens
ctcttgtgatttct

SEQ ID NO: 3216391 - DNA, 19 bp, Homo sapiens
ctcttgtgctcacgctccc

SEQ ID NO: 3216392 - DNA, 23 bp, Homo sapiens
ctcttgtggtgcattgaaagaag

SEQ ID NO: 3216393 - DNA, 19 bp, Homo sapiens
ctcttgtttttattaattt

SEQ ID NO: 3216394 - DNA, 23 bp, Homo sapiens
ctcttgtttttattaatttatat

SEQ ID NO: 3216395 - DNA, 13 bp, Homo sapiens
ctctttaaaatat

SEQ ID NO: 3216396 - DNA, 20 bp, Homo sapiens
ctctttaagggcatgccttg

SEQ ID NO: 3216397 - DNA, 21 bp, Homo sapiens
ctctttaagggcatgccttgt

SEQ ID NO: 3216398 - DNA, 19 bp, Homo sapiens
ctctttaagttttgattaa

SEQ ID NO: 3216399 - DNA, 16 bp, Homo sapiens
ctctttaatcttcagt

SEQ ID NO: 3216400 - DNA, 22 bp, Homo sapiens
ctctttaatgtcacaggcaggt

SEQ ID NO: 3216401 - DNA, 23 bp, Homo sapiens
ctctttactcccttcctggcctc

SEQ ID NO: 3216402 - DNA, 16 bp, Homo sapiens
ctctttagtataattg

SEQ ID NO: 3216403 - DNA, 17 bp, Homo sapiens
ctctttatgactgtttt

SEQ ID NO: 3216404 - DNA, 15 bp, Homo sapiens
ctctttccctgcgag

SEQ ID NO: 3216405 - DNA, 23 bp, Homo sapiens
ctctttctacatgactgggcctc

SEQ ID NO: 3216406 - DNA, 17 bp, Homo sapiens
ctctttctctgccagtg

SEQ ID NO: 3216407 - DNA, 18 bp, Homo sapiens
ctctttctgaaggaagag

SEQ ID NO: 3216408 - DNA, 11 bp, Homo sapiens
ctctttctgta

SEQ ID NO: 3216409 - DNA, 21 bp, Homo sapiens
ctctttcttataatactctgt

SEQ ID NO: 3216410 - DNA, 14 bp, Homo sapiens
ctctttcttccctc

SEQ ID NO: 3216411 - DNA, 17 bp, Homo sapiens
ctctttcttccctcgtg

SEQ ID NO: 3216412 - DNA, 13 bp, Homo sapiens
ctctttcttcctt

SEQ ID NO: 3216413 - DNA, 14 bp, Homo sapiens
ctctttcttccttt

SEQ ID NO: 3216414 - DNA, 17 bp, Homo sapiens
ctctttcttcctttcta

SEQ ID NO: 3216415 - DNA, 23 bp, Homo sapiens
ctctttgacaattcctagataaa

SEQ ID NO: 3216416 - DNA, 15 bp, Homo sapiens
ctctttgtaatttaa

SEQ ID NO: 3216417 - DNA, 16 bp, Homo sapiens
ctctttgtaatttaat

SEQ ID NO: 3216418 - DNA, 18 bp, Homo sapiens
ctctttgtaatttaatga

SEQ ID NO: 3216419 - DNA, 16 bp, Homo sapiens
ctcttttatatttgta

SEQ ID NO: 3216420 - DNA, 14 bp, Homo sapiens
ctcttttcacattt

SEQ ID NO: 3216421 - DNA, 15 bp, Homo sapiens
ctcttttcacatttt

SEQ ID NO: 3216422 - DNA, 23 bp, Homo sapiens
ctcttttccactccattgtcgta

SEQ ID NO: 3216423 - DNA, 12 bp, Homo sapiens
ctcttttccccg

SEQ ID NO: 3216424 - DNA, 17 bp, Homo sapiens
ctcttttccctctctag

SEQ ID NO: 3216425 - DNA, 15 bp, Homo sapiens
ctcttttctattttg

SEQ ID NO: 3216426 - DNA, 13 bp, Homo sapiens
ctcttttctcttt

SEQ ID NO: 3216427 - DNA, 14 bp, Homo sapiens
ctcttttctgcatc

SEQ ID NO: 3216428 - DNA, 15 bp, Homo sapiens
ctcttttctgcatca

SEQ ID NO: 3216429 - DNA, 15 bp, Homo sapiens
ctcttttgtaaatta

SEQ ID NO: 3216430 - DNA, 22 bp, Homo sapiens
ctctttttagggccaggcaggt

SEQ ID NO: 3216431 - DNA, 21 bp, Homo sapiens
ctctttttccatcataattct

SEQ ID NO: 3216432 - DNA, 22 bp, Homo sapiens
ctctttttctgtgataactctg

SEQ ID NO: 3216433 - DNA, 21 bp, Homo sapiens
ctcttttttactcattgaaat

SEQ ID NO: 3216434 - DNA, 21 bp, Homo sapiens
ctgaaaaaacacctagcttta

SEQ ID NO: 3216435 - DNA, 15 bp, Homo sapiens
ctgaaaaagtagatt

SEQ ID NO: 3216436 - DNA, 15 bp, Homo sapiens
ctgaaaaattccttt

SEQ ID NO: 3216437 - DNA, 19 bp, Homo sapiens
ctgaaaaccatctggcctg

SEQ ID NO: 3216438 - DNA, 17 bp, Homo sapiens
ctgaaaacttagccaga

SEQ ID NO: 3216439 - DNA, 16 bp, Homo sapiens
ctgaaaagaaggaaag

SEQ ID NO: 3216440 - DNA, 18 bp, Homo sapiens
ctgaaaagactcagtgtt

SEQ ID NO: 3216441 - DNA, 19 bp, Homo sapiens
ctgaaaagactcagtgttc

SEQ ID NO: 3216442 - DNA, 18 bp, Homo sapiens
ctgaaaataccatcaggc

SEQ ID NO: 3216443 - DNA, 15 bp, Homo sapiens
ctgaaaatataaaac

SEQ ID NO: 3216444 - DNA, 14 bp, Homo sapiens
ctgaaaatgcaaag

SEQ ID NO: 3216445 - DNA, 19 bp, Homo sapiens
ctgaaaatgcaaagctgaa

SEQ ID NO: 3216446 - DNA, 14 bp, Homo sapiens
ctgaaaatgtatgt

SEQ ID NO: 3216447 - DNA, 17 bp, Homo sapiens
ctgaaaatgtcacattc

SEQ ID NO: 3216448 - DNA, 13 bp, Homo sapiens
ctgaaaatgtgaa

SEQ ID NO: 3216449 - DNA, 21 bp, Homo sapiens
ctgaaaatgtgaataaaatta

SEQ ID NO: 3216450 - DNA, 13 bp, Homo sapiens
ctgaaaatgtgct

SEQ ID NO: 3216451 - DNA, 18 bp, Homo sapiens
ctgaaacacgaaacttgt

SEQ ID NO: 3216452 - DNA, 20 bp, Homo sapiens
ctgaaacacgaaacttgtta

SEQ ID NO: 3216453 - DNA, 13 bp, Homo sapiens
ctgaaacatttca

SEQ ID NO: 3216454 - DNA, 18 bp, Homo sapiens
ctgaaaccacagtttcat

SEQ ID NO: 3216455 - DNA, 22 bp, Homo sapiens
ctgaaaccattttcccatcatc

SEQ ID NO: 3216456 - DNA, 19 bp, Homo sapiens
ctgaaacccaaagccctgg

SEQ ID NO: 3216457 - DNA, 19 bp, Homo sapiens
ctgaaactcatagacactg

SEQ ID NO: 3216458 - DNA, 13 bp, Homo sapiens
ctgaaacttccct

SEQ ID NO: 3216459 - DNA, 15 bp, Homo sapiens
ctgaaagaaacagtt

SEQ ID NO: 3216460 - DNA, 13 bp, Homo sapiens
ctgacacaggaaa

SEQ ID NO: 3216461 - DNA, 18 bp, Homo sapiens
ctgacacctaccatgctg

SEQ ID NO: 3216462 - DNA, 20 bp, Homo sapiens
ctgacacctaccatgctgct

SEQ ID NO: 3216463 - DNA, 19 bp, Homo sapiens
ctgacactgagccccacct

SEQ ID NO: 3216464 - DNA, 19 bp, Homo sapiens
ctgacacttcaaggtgaca

SEQ ID NO: 3216465 - DNA, 19 bp, Homo sapiens
ctgacactttaattaccaa

SEQ ID NO: 3216466 - DNA, 19 bp, Homo sapiens
ctgacagaaagattttcct

SEQ ID NO: 3216467 - DNA, 14 bp, Homo sapiens
ctgacagaaggact

SEQ ID NO: 3216468 - DNA, 16 bp, Homo sapiens
ctgacagaaggtgcca

SEQ ID NO: 3216469 - DNA, 21 bp, Homo sapiens
ctgacagaaggtgccacttta

SEQ ID NO: 3216470 - DNA, 12 bp, Homo sapiens
ctgacagacaca

SEQ ID NO: 3216471 - DNA, 21 bp, Homo sapiens
ctgacagacacaggcccggct

SEQ ID NO: 3216472 - DNA, 18 bp, Homo sapiens
ctgacagatgtcagccga

SEQ ID NO: 3216473 - DNA, 20 bp, Homo sapiens
ctgacagcctcccaccccca

SEQ ID NO: 3216474 - DNA, 20 bp, Homo sapiens
ctgacaggcaatgctggctg

SEQ ID NO: 3216475 - DNA, 15 bp, Homo sapiens
ctgacagtttttctg

SEQ ID NO: 3216476 - DNA, 16 bp, Homo sapiens
ctgacataatggggat

SEQ ID NO: 3216477 - DNA, 23 bp, Homo sapiens
ctgacataatggggattaattag

SEQ ID NO: 3216478 - DNA, 18 bp, Homo sapiens
ctgacatcccttcctgga

SEQ ID NO: 3216479 - DNA, 16 bp, Homo sapiens
ctgacatctgtgtttc

SEQ ID NO: 3216480 - DNA, 21 bp, Homo sapiens
ctgacatctgtgtttcaagtg

SEQ ID NO: 3216481 - DNA, 18 bp, Homo sapiens
ctgacatggctctggact

SEQ ID NO: 3216482 - DNA, 19 bp, Homo sapiens
ctgacatggctctggactc

SEQ ID NO: 3216483 - DNA, 19 bp, Homo sapiens
ctgattagaaatgaccaat

SEQ ID NO: 3216484 - DNA, 23 bp, Homo sapiens
ctgattagaaatgaccaatatta

SEQ ID NO: 3216485 - DNA, 15 bp, Homo sapiens
ctgattatgaaatgt

SEQ ID NO: 3216486 - DNA, 15 bp, Homo sapiens
ctgattcactgcatg

SEQ ID NO: 3216487 - DNA, 22 bp, Homo sapiens
ctgattcataataaatatctgt

SEQ ID NO: 3216488 - DNA, 12 bp, Homo sapiens
ctgattctctac

SEQ ID NO: 3216489 - DNA, 14 bp, Homo sapiens
ctgattctggcttt

SEQ ID NO: 3216490 - DNA, 14 bp, Homo sapiens
ctgattctgggatg

SEQ ID NO: 3216491 - DNA, 19 bp, Homo sapiens
ctgattctgggatgctcct

SEQ ID NO: 3216492 - DNA, 15 bp, Homo sapiens
ctgattggacatttt

SEQ ID NO: 3216493 - DNA, 20 bp, Homo sapiens
ctgattggcttgtagaattg

SEQ ID NO: 3216494 - DNA, 21 bp, Homo sapiens
ctgattgtggatcttttcatt

SEQ ID NO: 3216495 - DNA, 19 bp, Homo sapiens
ctgatttacatgtatggtt

SEQ ID NO: 3216496 - DNA, 14 bp, Homo sapiens
ctgatttatttcta

SEQ ID NO: 3216497 - DNA, 13 bp, Homo sapiens
ctgatttcacaac

SEQ ID NO: 3216498 - DNA, 12 bp, Homo sapiens
ctgatttcagga

SEQ ID NO: 3216499 - DNA, 19 bp, Homo sapiens
ctgatttcagtttttcatt

SEQ ID NO: 3216500 - DNA, 13 bp, Homo sapiens
ctgatttcccctc

SEQ ID NO: 3216501 - DNA, 16 bp, Homo sapiens
ctgatttctatggctt

SEQ ID NO: 3216502 - DNA, 18 bp, Homo sapiens
ctgatttctatggctttc

SEQ ID NO: 3216503 - DNA, 13 bp, Homo sapiens
ctgatttcttgct

SEQ ID NO: 3216504 - DNA, 23 bp, Homo sapiens
ctgatttgatgatacatttcatt

SEQ ID NO: 3216505 - DNA, 21 bp, Homo sapiens
ctgattttcaaagctttttcc

SEQ ID NO: 3216506 - DNA, 18 bp, Homo sapiens
ctgattttgtagttaatt

SEQ ID NO: 3216507 - DNA, 17 bp, Homo sapiens
ctgatttttaaagtact

SEQ ID NO: 3216508 - DNA, 16 bp, Homo sapiens
ctgcaaaaaaagcctc

SEQ ID NO: 3216509 - DNA, 17 bp, Homo sapiens
ctgcaaaaaaagcctcc

SEQ ID NO: 3216510 - DNA, 19 bp, Homo sapiens
ctgcaaaaaaagcctccaa

SEQ ID NO: 3216511 - DNA, 11 bp, Homo sapiens
ctgcaaaattt

SEQ ID NO: 3216512 - DNA, 22 bp, Homo sapiens
ctgcaaacaccaacatgttggg

SEQ ID NO: 3216513 - DNA, 19 bp, Homo sapiens
ctgcaaacagaacagggtc

SEQ ID NO: 3216514 - DNA, 14 bp, Homo sapiens
ctgcaaaccttcct

SEQ ID NO: 3216515 - DNA, 15 bp, Homo sapiens
ctgcaaaccttcctg

SEQ ID NO: 3216516 - DNA, 16 bp, Homo sapiens
ctgcaaaccttcctgg

SEQ ID NO: 3216517 - DNA, 19 bp, Homo sapiens
ctgcaaaccttcctgggag

SEQ ID NO: 3216518 - DNA, 23 bp, Homo sapiens
ctgcaaaccttcctgggaggaca

SEQ ID NO: 3216519 - DNA, 12 bp, Homo sapiens
ctgcaaagaaag

SEQ ID NO: 3216520 - DNA, 12 bp, Homo sapiens
ctgcaaagacag

SEQ ID NO: 3216521 - DNA, 13 bp, Homo sapiens
ctgcaaaggcctg

SEQ ID NO: 3216522 - DNA, 14 bp, Homo sapiens
ctgcaaaggcctgg

SEQ ID NO: 3216523 - DNA, 21 bp, Homo sapiens
ctgcaaaggcctgggctggcc

SEQ ID NO: 3216524 - DNA, 21 bp, Homo sapiens
ctgcaaagggtatcaggtgct

SEQ ID NO: 3216525 - DNA, 23 bp, Homo sapiens
ctgcaaaggtggcaatgcttaaa

SEQ ID NO: 3216526 - DNA, 21 bp, Homo sapiens
ctgcaaagtgattcactgtgc

SEQ ID NO: 3216527 - DNA, 15 bp, Homo sapiens
ctgcaaataaagcct

SEQ ID NO: 3216528 - DNA, 17 bp, Homo sapiens
ctgcaaataaagccttt

SEQ ID NO: 3216529 - DNA, 18 bp, Homo sapiens
ctgcaaataaagcctttt

SEQ ID NO: 3216530 - DNA, 18 bp, Homo sapiens
ctgcaacagagagaaaaa

SEQ ID NO: 3216531 - DNA, 22 bp, Homo sapiens
ctgcaacctccgcctcttgggt

SEQ ID NO: 3216532 - DNA, 23 bp, Homo sapiens
ctgcaacttccgctgaggggtct

SEQ ID NO: 3216533 - DNA, 21 bp, Homo sapiens
ctgcaactttaagcagctctt

SEQ ID NO: 3216534 - DNA, 17 bp, Homo sapiens
ctgcaagcacagccctt

SEQ ID NO: 3216535 - DNA, 18 bp, Homo sapiens
ctgcaagccccagggcct

SEQ ID NO: 3216536 - DNA, 20 bp, Homo sapiens
ctgcaagccccagggcctgg

SEQ ID NO: 3216537 - DNA, 13 bp, Homo sapiens
ctgcaaggcccac

SEQ ID NO: 3216538 - DNA, 14 bp, Homo sapiens
ctgcaaggcccaca

SEQ ID NO: 3216539 - DNA, 20 bp, Homo sapiens
ctgcaaggcccacaggaggc

SEQ ID NO: 3216540 - DNA, 17 bp, Homo sapiens
ctgcaaggtactctggt

SEQ ID NO: 3216541 - DNA, 18 bp, Homo sapiens
ctgcaaggtactctggtg

SEQ ID NO: 3216542 - DNA, 17 bp, Homo sapiens
ctgcaaggtctttggtt

SEQ ID NO: 3216543 - DNA, 14 bp, Homo sapiens
ctgcaagtgtctgg

SEQ ID NO: 3216544 - DNA, 16 bp, Homo sapiens
ctgcaataacttctga

SEQ ID NO: 3216545 - DNA, 12 bp, Homo sapiens
ctgcaatagaga

SEQ ID NO: 3216546 - DNA, 15 bp, Homo sapiens
ctgcaatagagactg

SEQ ID NO: 3216547 - DNA, 19 bp, Homo sapiens
ctgcaatagagactgtaga

SEQ ID NO: 3216548 - DNA, 21 bp, Homo sapiens
ctgcaatagagactgtagatt

SEQ ID NO: 3216549 - DNA, 19 bp, Homo sapiens
ctgcaatgccagtcctgca

SEQ ID NO: 3216550 - DNA, 22 bp, Homo sapiens
ctgcaatgccagtcctgcagga

SEQ ID NO: 3216551 - DNA, 20 bp, Homo sapiens
ctgcaatgcttctgtagctt

SEQ ID NO: 3216552 - DNA, 15 bp, Homo sapiens
ctgcaattcccctct

SEQ ID NO: 3216553 - DNA, 17 bp, Homo sapiens
ctgcaattcccctctgc

SEQ ID NO: 3216554 - DNA, 20 bp, Homo sapiens
ctgcaattcccctctgctgc

SEQ ID NO: 3216555 - DNA, 18 bp, Homo sapiens
ctgcaatttcatatgctg

SEQ ID NO: 3216556 - DNA, 20 bp, Homo sapiens
ctgcaatttcatatgctgta

SEQ ID NO: 3216557 - DNA, 23 bp, Homo sapiens
ctgcacacaagcccacagcacag

SEQ ID NO: 3216558 - DNA, 13 bp, Homo sapiens
ctgcacacacagc

SEQ ID NO: 3216559 - DNA, 15 bp, Homo sapiens
ctgcacacacagctc

SEQ ID NO: 3216560 - DNA, 20 bp, Homo sapiens
ctgcacacacctccgagaca

SEQ ID NO: 3216561 - DNA, 22 bp, Homo sapiens
ctgcacacacctccgagacagt

SEQ ID NO: 3216562 - DNA, 16 bp, Homo sapiens
ctgcacagacaagcag

SEQ ID NO: 3216563 - DNA, 22 bp, Homo sapiens
ctgcacagacaagcagcccttg

SEQ ID NO: 3216564 - DNA, 14 bp, Homo sapiens
ctgcacagagctct

SEQ ID NO: 3216565 - DNA, 18 bp, Homo sapiens
ctgcacagagctctccag

SEQ ID NO: 3216566 - DNA, 13 bp, Homo sapiens
ctgcacagatgga

SEQ ID NO: 3216567 - DNA, 20 bp, Homo sapiens
ctgcacaggcacacagggcc

SEQ ID NO: 3216568 - DNA, 21 bp, Homo sapiens
ctgcacagtgcatctcagccc

SEQ ID NO: 3216569 - DNA, 15 bp, Homo sapiens
ctgcacagttgaagg

SEQ ID NO: 3216570 - DNA, 23 bp, Homo sapiens
ctgcacatgaatcccacccacat

SEQ ID NO: 3216571 - DNA, 23 bp, Homo sapiens
ctgcacatgactcgggggtgggg

SEQ ID NO: 3216572 - DNA, 21 bp, Homo sapiens
ctgcacatgtcttgtacatgt

SEQ ID NO: 3216573 - DNA, 12 bp, Homo sapiens
ctgcacatgtgc

SEQ ID NO: 3216574 - DNA, 20 bp, Homo sapiens
ctgcacatgtgccacacagt

SEQ ID NO: 3216575 - DNA, 20 bp, Homo sapiens
ctgcaccagagcaacctctc

SEQ ID NO: 3216576 - DNA, 22 bp, Homo sapiens
ctgcaccagagtgaaagggcta

SEQ ID NO: 3216577 - DNA, 14 bp, Homo sapiens
ctgcacccaactac

SEQ ID NO: 3216578 - DNA, 19 bp, Homo sapiens
ctgcacccagcagtgtcac

SEQ ID NO: 3216579 - DNA, 20 bp, Homo sapiens
ctgcacccagctccaggggc

SEQ ID NO: 3216580 - DNA, 16 bp, Homo sapiens
ctgcaccctccaccct

SEQ ID NO: 3216581 - DNA, 15 bp, Homo sapiens
ctgcaccctggaaag

SEQ ID NO: 3216582 - DNA, 19 bp, Homo sapiens
ctgcacccttgtacagtgt

SEQ ID NO: 3216583 - DNA, 20 bp, Homo sapiens
ctgcaccgggccacagagaa

SEQ ID NO: 3216584 - DNA, 13 bp, Homo sapiens
ctgcacctgccag

SEQ ID NO: 3216585 - DNA, 17 bp, Homo sapiens
ctgcacctgccagcctg

SEQ ID NO: 3216586 - DNA, 17 bp, Homo sapiens
ctgcacctgctgcgtcc

SEQ ID NO: 3216587 - DNA, 21 bp, Homo sapiens
ctgcacctgctgcgtccccac

SEQ ID NO: 3216588 - DNA, 23 bp, Homo sapiens
ctgcaccttcactctccagggta

SEQ ID NO: 3216589 - DNA, 18 bp, Homo sapiens
ctgcacgtatacacccag

SEQ ID NO: 3216590 - DNA, 19 bp, Homo sapiens
ctgcacgtatacacccaga

SEQ ID NO: 3216591 - DNA, 21 bp, Homo sapiens
ctgcactaaagccagcctgac

SEQ ID NO: 3216592 - DNA, 23 bp, Homo sapiens
ctgcactaaagccagcctgacct

SEQ ID NO: 3216593 - DNA, 18 bp, Homo sapiens
ctgcacttgcagactcta

SEQ ID NO: 3216594 - DNA, 16 bp, Homo sapiens
ctgcacttggcctcag

SEQ ID NO: 3216595 - DNA, 17 bp, Homo sapiens
ctgcagaaatttgcaac

SEQ ID NO: 3216596 - DNA, 19 bp, Homo sapiens
ctgcagaacagtgaaaggt

SEQ ID NO: 3216597 - DNA, 21 bp, Homo sapiens
ctgcagaagaagctggtgccc

SEQ ID NO: 3216598 - DNA, 14 bp, Homo sapiens
ctgcagaaggaaag

SEQ ID NO: 3216599 - DNA, 15 bp, Homo sapiens
ctgcagaaggaaaga

SEQ ID NO: 3216600 - DNA, 19 bp, Homo sapiens
ctgcagacacctggactga

SEQ ID NO: 3216601 - DNA, 22 bp, Homo sapiens
ctgcagacacctggactgagcc

SEQ ID NO: 3216602 - DNA, 14 bp, Homo sapiens
ctgcagactgctag

SEQ ID NO: 3216603 - DNA, 14 bp, Homo sapiens
ctgcagacttccca

SEQ ID NO: 3216604 - DNA, 16 bp, Homo sapiens
ctgcagagctgaccca

SEQ ID NO: 3216605 - DNA, 17 bp, Homo sapiens
ctgcagagctgacccag

SEQ ID NO: 3216606 - DNA, 19 bp, Homo sapiens
ctgcagaggaccacagtgg

SEQ ID NO: 3216607 - DNA, 21 bp, Homo sapiens
ctgcagaggaccacagtgggt

SEQ ID NO: 3216608 - DNA, 12 bp, Homo sapiens
ctgcagagggac

SEQ ID NO: 3216609 - DNA, 14 bp, Homo sapiens
ctgcagagggacca

SEQ ID NO: 3216610 - DNA, 23 bp, Homo sapiens
ctgcagaggggaaaccagtgtag

SEQ ID NO: 3216611 - DNA, 22 bp, Homo sapiens
ctgcagaggggaaagacttcca

SEQ ID NO: 3216612 - DNA, 16 bp, Homo sapiens
ctgcagatcttccgtg

SEQ ID NO: 3216613 - DNA, 22 bp, Homo sapiens
ctgcagatgccaccctagccaa

SEQ ID NO: 3216614 - DNA, 14 bp, Homo sapiens
ctgcagatttgata

SEQ ID NO: 3216615 - DNA, 17 bp, Homo sapiens
ctgcagcaaacactcca

SEQ ID NO: 3216616 - DNA, 12 bp, Homo sapiens
ctgcagcacctc

SEQ ID NO: 3216617 - DNA, 19 bp, Homo sapiens
ctgcagcagagtgagcaag

SEQ ID NO: 3216618 - DNA, 19 bp, Homo sapiens
ctgcagcatgacctgtgac

SEQ ID NO: 3216619 - DNA, 22 bp, Homo sapiens
ctgcagcatgacctgtgaccag

SEQ ID NO: 3216620 - DNA, 23 bp, Homo sapiens
ctgcagcatggtccctgccttag

SEQ ID NO: 3216621 - DNA, 20 bp, Homo sapiens
ctgcagcccaaaacccaggg

SEQ ID NO: 3216622 - DNA, 16 bp, Homo sapiens
ctgcagcccttgggca

SEQ ID NO: 3216623 - DNA, 20 bp, Homo sapiens
ctgcagcctcaacctcctgg

SEQ ID NO: 3216624 - DNA, 13 bp, Homo sapiens
ctgcagcctcctc

SEQ ID NO: 3216625 - DNA, 13 bp, Homo sapiens
ctgcagctgggcc

SEQ ID NO: 3216626 - DNA, 16 bp, Homo sapiens
ctgcagctgggcccca

SEQ ID NO: 3216627 - DNA, 20 bp, Homo sapiens
ctgcagctgggccccatgct

SEQ ID NO: 3216628 - DNA, 21 bp, Homo sapiens
ctgcagctgggccccatgctc

SEQ ID NO: 3216629 - DNA, 22 bp, Homo sapiens
ctgcagctgggccccatgctct

SEQ ID NO: 3216630 - DNA, 23 bp, Homo sapiens
ctgcagctgggccccatgctctg

SEQ ID NO: 3216631 - DNA, 13 bp, Homo sapiens
ctgcagctgggct

SEQ ID NO: 3216632 - DNA, 14 bp, Homo sapiens
ctgcagctgggctg

SEQ ID NO: 3216633 - DNA, 12 bp, Homo sapiens
ctgcagcttggg

SEQ ID NO: 3216634 - DNA, 22 bp, Homo sapiens
ctgcagcttgggagagcccctg

SEQ ID NO: 3216635 - DNA, 18 bp, Homo sapiens
ctgcaggaaatagtcact

SEQ ID NO: 3216636 - DNA, 15 bp, Homo sapiens
ctgcaggaacgagca

SEQ ID NO: 3216637 - DNA, 19 bp, Homo sapiens
ctgcaggacttgagaagac

SEQ ID NO: 3216638 - DNA, 14 bp, Homo sapiens
ctgcaggcaggaac

SEQ ID NO: 3216639 - DNA, 22 bp, Homo sapiens
ctgcaggcaggaacaaacaggg

SEQ ID NO: 3216640 - DNA, 13 bp, Homo sapiens
ctgcaggccctgg

SEQ ID NO: 3216641 - DNA, 16 bp, Homo sapiens
ctgcaggccctggcct

SEQ ID NO: 3216642 - DNA, 16 bp, Homo sapiens
ctgcaggctgagccac

SEQ ID NO: 3216643 - DNA, 17 bp, Homo sapiens
ctgcagggacagagcat

SEQ ID NO: 3216644 - DNA, 17 bp, Homo sapiens
ctgcagggactgccagt

SEQ ID NO: 3216645 - DNA, 13 bp, Homo sapiens
ctgcagggccagg

SEQ ID NO: 3216646 - DNA, 15 bp, Homo sapiens
ctgcagggccaggac

SEQ ID NO: 3216647 - DNA, 16 bp, Homo sapiens
ctgcagggccaggact

SEQ ID NO: 3216648 - DNA, 14 bp, Homo sapiens
ctgcagggccatct

SEQ ID NO: 3216649 - DNA, 22 bp, Homo sapiens
ctgcagggccatctgactgcca

SEQ ID NO: 3216650 - DNA, 23 bp, Homo sapiens
ctgcagggcgcccctgggagaca

SEQ ID NO: 3216651 - DNA, 12 bp, Homo sapiens
ctgcaggggagc

SEQ ID NO: 3216652 - DNA, 20 bp, Homo sapiens
ctgcaggggcaggagaggct

SEQ ID NO: 3216653 - DNA, 21 bp, Homo sapiens
ctgcaggggcaggagaggctg

SEQ ID NO: 3216654 - DNA, 22 bp, Homo sapiens
ctgcaggggcaggagaggctgg

SEQ ID NO: 3216655 - DNA, 23 bp, Homo sapiens
ctgcaggggcaggagaggctggg

SEQ ID NO: 3216656 - DNA, 16 bp, Homo sapiens
ctgcaggggctctgga

SEQ ID NO: 3216657 - DNA, 19 bp, Homo sapiens
ctgcaggggctctggagag

SEQ ID NO: 3216658 - DNA, 23 bp, Homo sapiens
ctgcagggggtgtgtctgctcag

SEQ ID NO: 3216659 - DNA, 15 bp, Homo sapiens
ctgcaggtacttcct

SEQ ID NO: 3216660 - DNA, 16 bp, Homo sapiens
ctgcaggtacttcctc

SEQ ID NO: 3216661 - DNA, 20 bp, Homo sapiens
ctgcaggtacttcctcctga

SEQ ID NO: 3216662 - DNA, 21 bp, Homo sapiens
ctgcaggtcagtttggaatga

SEQ ID NO: 3216663 - DNA, 13 bp, Homo sapiens
ctgcaggtgggac

SEQ ID NO: 3216664 - DNA, 18 bp, Homo sapiens
ctgcaggttggaccccag

SEQ ID NO: 3216665 - DNA, 15 bp, Homo sapiens
ctgcagtaaaacaca

SEQ ID NO: 3216666 - DNA, 14 bp, Homo sapiens
ctgcagtaaatctt

SEQ ID NO: 3216667 - DNA, 17 bp, Homo sapiens
ctgcagtcttctgggct

SEQ ID NO: 3216668 - DNA, 14 bp, Homo sapiens
ctgcagtgtgcccc

SEQ ID NO: 3216669 - DNA, 17 bp, Homo sapiens
ctgcagtgttcgcttgg

SEQ ID NO: 3216670 - DNA, 18 bp, Homo sapiens
ctgcagtgttcgcttggc

SEQ ID NO: 3216671 - DNA, 22 bp, Homo sapiens
ctgcagtgttcgcttggctcca

SEQ ID NO: 3216672 - DNA, 18 bp, Homo sapiens
ctgcagtttttcaggagc

SEQ ID NO: 3216673 - DNA, 13 bp, Homo sapiens
ctgcatcatctgt

SEQ ID NO: 3216674 - DNA, 14 bp, Homo sapiens
ctgcatcatctgta

SEQ ID NO: 3216675 - DNA, 17 bp, Homo sapiens
ctgcatcatctgtagat

SEQ ID NO: 3216676 - DNA, 15 bp, Homo sapiens
ctgcatcccagcacc

SEQ ID NO: 3216677 - DNA, 12 bp, Homo sapiens
ctgcatcccctt

SEQ ID NO: 3216678 - DNA, 22 bp, Homo sapiens
ctgcatccccttggctgtgagg

SEQ ID NO: 3216679 - DNA, 18 bp, Homo sapiens
ctgcatcttggttatttc

SEQ ID NO: 3216680 - DNA, 20 bp, Homo sapiens
ctgcatgacctaccaggaca

SEQ ID NO: 3216681 - DNA, 22 bp, Homo sapiens
ctgcatgcctggtctttcctct

SEQ ID NO: 3216682 - DNA, 18 bp, Homo sapiens
ctgcatggacctaacatt

SEQ ID NO: 3216683 - DNA, 22 bp, Homo sapiens
ctgcatggacctaacattcgat

SEQ ID NO: 3216684 - DNA, 19 bp, Homo sapiens
ctgcatgggggcaccgggc

SEQ ID NO: 3216685 - DNA, 22 bp, Homo sapiens
ctgcatgtggcttttttaaaaa

SEQ ID NO: 3216686 - DNA, 15 bp, Homo sapiens
ctgcattagaaaaag

SEQ ID NO: 3216687 - DNA, 23 bp, Homo sapiens
ctgcattcatttttatagcaaca

SEQ ID NO: 3216688 - DNA, 22 bp, Homo sapiens
ctgcattcctgtaacttttaat

SEQ ID NO: 3216689 - DNA, 22 bp, Homo sapiens
ctgcattctctcccatcctggg

SEQ ID NO: 3216690 - DNA, 18 bp, Homo sapiens
ctgcatttaaatttgatt

SEQ ID NO: 3216691 - DNA, 13 bp, Homo sapiens
ctgcatttagcac

SEQ ID NO: 3216692 - DNA, 15 bp, Homo sapiens
ctgcatttagcacaa

SEQ ID NO: 3216693 - DNA, 18 bp, Homo sapiens
ctgcatttagcacaaaaa

SEQ ID NO: 3216694 - DNA, 22 bp, Homo sapiens
ctgcatttgtgaaatgatggtg

SEQ ID NO: 3216695 - DNA, 18 bp, Homo sapiens
ctgcatttttagaccatt

SEQ ID NO: 3216696 - DNA, 16 bp, Homo sapiens
ctgccaaaggatgtga

SEQ ID NO: 3216697 - DNA, 22 bp, Homo sapiens
ctgccaaaggatgtgatatata

SEQ ID NO: 3216698 - DNA, 14 bp, Homo sapiens
ctgccaaataaaca

SEQ ID NO: 3216699 - DNA, 16 bp, Homo sapiens
ctgccaaataaacagc

SEQ ID NO: 3216700 - DNA, 20 bp, Homo sapiens
ctgccaaataaacagctatt

SEQ ID NO: 3216701 - DNA, 19 bp, Homo sapiens
ctgccaagactcctcaggc

SEQ ID NO: 3216702 - DNA, 13 bp, Homo sapiens
ctgccaagccaga

SEQ ID NO: 3216703 - DNA, 14 bp, Homo sapiens
ctgccaagccagat

SEQ ID NO: 3216704 - DNA, 21 bp, Homo sapiens
ctgccaaggccagagtggcct

SEQ ID NO: 3216705 - DNA, 22 bp, Homo sapiens
ctgccaaggccagagtggcctg

SEQ ID NO: 3216706 - DNA, 22 bp, Homo sapiens
ctgccaagtggggatggggcct

SEQ ID NO: 3216707 - DNA, 21 bp, Homo sapiens
ctgccacaccagtcacatgac

SEQ ID NO: 3216708 - DNA, 15 bp, Homo sapiens
ctgccacactctgac

SEQ ID NO: 3216709 - DNA, 20 bp, Homo sapiens
ctgcctgggctgttggcact

SEQ ID NO: 3216710 - DNA, 19 bp, Homo sapiens
ctgctccatgactggctgt

SEQ ID NO: 3216711 - DNA, 15 bp, Homo sapiens
ctgctcccagcagcc

SEQ ID NO: 3216712 - DNA, 14 bp, Homo sapiens
ctgccacccactca

SEQ ID NO: 3216713 - DNA, 16 bp, Homo sapiens
ctgccacccactcagg

SEQ ID NO: 3216714 - DNA, 19 bp, Homo sapiens
ctgccacccgcttcctgtt

SEQ ID NO: 3216715 - DNA, 21 bp, Homo sapiens
ctgccaccctggggagaaagt

SEQ ID NO: 3216716 - DNA, 19 bp, Homo sapiens
ctgccactcactaggcccc

SEQ ID NO: 3216717 - DNA, 12 bp, Homo sapiens
ctgccactttgc

SEQ ID NO: 3216718 - DNA, 17 bp, Homo sapiens
ctgccactttgcacatt

SEQ ID NO: 3216719 - DNA, 20 bp, Homo sapiens
ctgccactttgcacattttg

SEQ ID NO: 3216720 - DNA, 16 bp, Homo sapiens
ctgccagcacgcctgg

SEQ ID NO: 3216721 - DNA, 15 bp, Homo sapiens
ctgccagcagcagca

SEQ ID NO: 3216722 - DNA, 21 bp, Homo sapiens
ctgccagcagcagcaggtgat

SEQ ID NO: 3216723 - DNA, 18 bp, Homo sapiens
ctgccagccccacacagc

SEQ ID NO: 3216724 - DNA, 12 bp, Homo sapiens
ctgccagcctgg

SEQ ID NO: 3216725 - DNA, 19 bp, Homo sapiens
ctgccagcctggcttctgg

SEQ ID NO: 3216726 - DNA, 20 bp, Homo sapiens
ctgccagcctggcttctgga

SEQ ID NO: 3216727 - DNA, 20 bp, Homo sapiens
ctgccagccttgagccctgg

SEQ ID NO: 3216728 - DNA, 16 bp, Homo sapiens
ctgccagctgccttcc

SEQ ID NO: 3216729 - DNA, 17 bp, Homo sapiens
ctgccaggcacctggcc

SEQ ID NO: 3216730 - DNA, 22 bp, Homo sapiens
ctgccaggcacctggcctgctg

SEQ ID NO: 3216731 - DNA, 23 bp, Homo sapiens
ctgccaggccagcctccgagagg

SEQ ID NO: 3216732 - DNA, 12 bp, Homo sapiens
ctgccaggccca

SEQ ID NO: 3216733 - DNA, 20 bp, Homo sapiens
ctgccaggcccatctcaggt

SEQ ID NO: 3216734 - DNA, 23 bp, Homo sapiens
ctgccaggcccatctcaggtgcc

SEQ ID NO: 3216735 - DNA, 14 bp, Homo sapiens
ctgccaggcgttgg

SEQ ID NO: 3216736 - DNA, 19 bp, Homo sapiens
ctgccaggcgttggtgcca

SEQ ID NO: 3216737 - DNA, 16 bp, Homo sapiens
ctgccagggcagtgct

SEQ ID NO: 3216738 - DNA, 12 bp, Homo sapiens
ctgccagggctt

SEQ ID NO: 3216739 - DNA, 14 bp, Homo sapiens
ctgccagggcttcc

SEQ ID NO: 3216740 - DNA, 22 bp, Homo sapiens
ctgccagtccccctgccccagg

SEQ ID NO: 3216741 - DNA, 18 bp, Homo sapiens
ctgccagtctcactgtgg

SEQ ID NO: 3216742 - DNA, 15 bp, Homo sapiens
ctgccagtggatccc

SEQ ID NO: 3216743 - DNA, 15 bp, Homo sapiens
ctgccagtgtggaac

SEQ ID NO: 3216744 - DNA, 17 bp, Homo sapiens
ctgccatatataacaga

SEQ ID NO: 3216745 - DNA, 20 bp, Homo sapiens
ctgccatattctgttggcca

SEQ ID NO: 3216746 - DNA, 18 bp, Homo sapiens
ctgccatcaccgctgggt

SEQ ID NO: 3216747 - DNA, 20 bp, Homo sapiens
ctgccatcaccgctgggtgg

SEQ ID NO: 3216748 - DNA, 16 bp, Homo sapiens
ctgccatccaggttca

SEQ ID NO: 3216749 - DNA, 20 bp, Homo sapiens
ctgccatctagccagcccct

SEQ ID NO: 3216750 - DNA, 23 bp, Homo sapiens
ctgccatgatagctggggcttca

SEQ ID NO: 3216751 - DNA, 16 bp, Homo sapiens
ctgccatgccactgcc

SEQ ID NO: 3216752 - DNA, 19 bp, Homo sapiens
ctgccatgccactgccagg

SEQ ID NO: 3216753 - DNA, 22 bp, Homo sapiens
ctgccatgccactgccaggcac

SEQ ID NO: 3216754 - DNA, 16 bp, Homo sapiens
ctgccatgccaggaac

SEQ ID NO: 3216755 - DNA, 22 bp, Homo sapiens
ctgccatgccaggaacctgtcc

SEQ ID NO: 3216756 - DNA, 14 bp, Homo sapiens
ctgccatgctctgg

SEQ ID NO: 3216757 - DNA, 14 bp, Homo sapiens
ctgccatggcgtgt

SEQ ID NO: 3216758 - DNA, 23 bp, Homo sapiens
ctgccatggctaggtagaagtga

SEQ ID NO: 3216759 - DNA, 14 bp, Homo sapiens
ctgccatgggccag

SEQ ID NO: 3216760 - DNA, 22 bp, Homo sapiens
ctgccattacagaggtattaaa

SEQ ID NO: 3216761 - DNA, 20 bp, Homo sapiens
ctgccattattttctgtcag

SEQ ID NO: 3216762 - DNA, 22 bp, Homo sapiens
ctgccattattttctgtcagat

SEQ ID NO: 3216763 - DNA, 17 bp, Homo sapiens
ctgccattcttctggtg

SEQ ID NO: 3216764 - DNA, 19 bp, Homo sapiens
ctgccattgggaccctcca

SEQ ID NO: 3216765 - DNA, 21 bp, Homo sapiens
ctgccattgggaccctccagt

SEQ ID NO: 3216766 - DNA, 23 bp, Homo sapiens
ctgccattgggaccctccagtgc

SEQ ID NO: 3216767 - DNA, 13 bp, Homo sapiens
ctgccatttaaaa

SEQ ID NO: 3216768 - DNA, 13 bp, Homo sapiens
ctgccatttccct

SEQ ID NO: 3216769 - DNA, 20 bp, Homo sapiens
ctgccatttgcaccctccgc

SEQ ID NO: 3216770 - DNA, 14 bp, Homo sapiens
ctgcccaagcccag

SEQ ID NO: 3216771 - DNA, 22 bp, Homo sapiens
ctgcccaatgctttgggaggcc

SEQ ID NO: 3216772 - DNA, 14 bp, Homo sapiens
ctgcccaccccctc

SEQ ID NO: 3216773 - DNA, 16 bp, Homo sapiens
ctgcccaccccctcaa

SEQ ID NO: 3216774 - DNA, 17 bp, Homo sapiens
ctgcccacgatcccctc

SEQ ID NO: 3216775 - DNA, 17 bp, Homo sapiens
ctgcccacgcagaggac

SEQ ID NO: 3216776 - DNA, 18 bp, Homo sapiens
ctgcccacgcagaggacg

SEQ ID NO: 3216777 - DNA, 23 bp, Homo sapiens
ctgcccactgtttctcttgagct

SEQ ID NO: 3216778 - DNA, 19 bp, Homo sapiens
ctgcccacttagccgtcca

SEQ ID NO: 3216779 - DNA, 23 bp, Homo sapiens
ctgcccacttagccgtccatggc

SEQ ID NO: 3216780 - DNA, 23 bp, Homo sapiens
ctgcccagaacccttcctgagac

SEQ ID NO: 3216781 - DNA, 18 bp, Homo sapiens
ctgcccagacccctctgg

SEQ ID NO: 3216782 - DNA, 21 bp, Homo sapiens
ctgcccagacccctctggcca

SEQ ID NO: 3216783 - DNA, 22 bp, Homo sapiens
ctgcccagacccctctggccag

SEQ ID NO: 3216784 - DNA, 12 bp, Homo sapiens
ctgcccaggaga

SEQ ID NO: 3216785 - DNA, 13 bp, Homo sapiens
ctgcccaggagac

SEQ ID NO: 3216786 - DNA, 21 bp, Homo sapiens
ctgcccaggagacagaccact

SEQ ID NO: 3216787 - DNA, 15 bp, Homo sapiens
ctgcccaggccacag

SEQ ID NO: 3216788 - DNA, 15 bp, Homo sapiens
ctgcccaggcccctg

SEQ ID NO: 3216789 - DNA, 14 bp, Homo sapiens
ctgcccaggggtgc

SEQ ID NO: 3216790 - DNA, 18 bp, Homo sapiens
ctgcccaggggtgccccc

SEQ ID NO: 3216791 - DNA, 20 bp, Homo sapiens
ctgcccaggggtgccccctc

SEQ ID NO: 3216792 - DNA, 13 bp, Homo sapiens
ctgcccagtcccc

SEQ ID NO: 3216793 - DNA, 20 bp, Homo sapiens
ctgcccagtgttgtttgtaa

SEQ ID NO: 3216794 - DNA, 23 bp, Homo sapiens
ctgccccaaataacttcagtcct

SEQ ID NO: 3216795 - DNA, 16 bp, Homo sapiens
ctgccccaagcagcca

SEQ ID NO: 3216796 - DNA, 18 bp, Homo sapiens
ctgccccaagcagccagc

SEQ ID NO: 3216797 - DNA, 13 bp, Homo sapiens
ctgccccaagccc

SEQ ID NO: 3216798 - DNA, 14 bp, Homo sapiens
ctgccccacacgga

SEQ ID NO: 3216799 - DNA, 21 bp, Homo sapiens
ctgccccacacggactcccgg

SEQ ID NO: 3216800 - DNA, 16 bp, Homo sapiens
ctgccccacccacccc

SEQ ID NO: 3216801 - DNA, 17 bp, Homo sapiens
ctgccccacccacccca

SEQ ID NO: 3216802 - DNA, 15 bp, Homo sapiens
ctgccccaccctaac

SEQ ID NO: 3216803 - DNA, 13 bp, Homo sapiens
ctgccccagccca

SEQ ID NO: 3216804 - DNA, 13 bp, Homo sapiens
ctgccccagctct

SEQ ID NO: 3216805 - DNA, 15 bp, Homo sapiens
ctgccccagctctgg

SEQ ID NO: 3216806 - DNA, 16 bp, Homo sapiens
ctgccccagctctggc

SEQ ID NO: 3216807 - DNA, 18 bp, Homo sapiens
ctgccccagctctggctt

SEQ ID NO: 3216808 - DNA, 13 bp, Homo sapiens
ctgccccaggcct

SEQ ID NO: 3216809 - DNA, 16 bp, Homo sapiens
ctgcccccaacactcc

SEQ ID NO: 3216810 - DNA, 21 bp, Homo sapiens
ctgcccccaacactccaggcc

SEQ ID NO: 3216811 - DNA, 22 bp, Homo sapiens
ctgcccccaacactccaggccc

SEQ ID NO: 3216812 - DNA, 12 bp, Homo sapiens
ctgcccccacga

SEQ ID NO: 3216813 - DNA, 14 bp, Homo sapiens
ctgcccccagccca

SEQ ID NO: 3216814 - DNA, 21 bp, Homo sapiens
ctgcccccatctccccaggcc

SEQ ID NO: 3216815 - DNA, 22 bp, Homo sapiens
ctgcccccatctccccaggcct

SEQ ID NO: 3216816 - DNA, 21 bp, Homo sapiens
ctgccccccagcctctggcat

SEQ ID NO: 3216817 - DNA, 13 bp, Homo sapiens
ctgccccccgagg

SEQ ID NO: 3216818 - DNA, 18 bp, Homo sapiens
ctgccccccgaggctgct

SEQ ID NO: 3216819 - DNA, 19 bp, Homo sapiens
ctgccccccgaggctgcta

SEQ ID NO: 3216820 - DNA, 17 bp, Homo sapiens
ctgccccctcccactct

SEQ ID NO: 3216821 - DNA, 20 bp, Homo sapiens
ctgccccctcccactcttga

SEQ ID NO: 3216822 - DNA, 14 bp, Homo sapiens
ctgccccctggctg

SEQ ID NO: 3216823 - DNA, 17 bp, Homo sapiens
ctgccccgcccagctgc

SEQ ID NO: 3216824 - DNA, 14 bp, Homo sapiens
ctgccccgccccca

SEQ ID NO: 3216825 - DNA, 17 bp, Homo sapiens
ctgccccgcccccagtc

SEQ ID NO: 3216826 - DNA, 19 bp, Homo sapiens
ctgccccgttccctgtcag

SEQ ID NO: 3216827 - DNA, 20 bp, Homo sapiens
ctgccccgttccctgtcaga

SEQ ID NO: 3216828 - DNA, 12 bp, Homo sapiens
ctgcccctagga

SEQ ID NO: 3216829 - DNA, 20 bp, Homo sapiens
ctgcccctcccaacccagcc

SEQ ID NO: 3216830 - DNA, 14 bp, Homo sapiens
ctgcccctccccca

SEQ ID NO: 3216831 - DNA, 13 bp, Homo sapiens
ctgcccctccctt

SEQ ID NO: 3216832 - DNA, 17 bp, Homo sapiens
ctgcccctcccttcaac

SEQ ID NO: 3216833 - DNA, 21 bp, Homo sapiens
ctgcccctgatcactcccagc

SEQ ID NO: 3216834 - DNA, 11 bp, Homo sapiens
ctgcccctgca

SEQ ID NO: 3216835 - DNA, 17 bp, Homo sapiens
cgagggaggaacacctg

SEQ ID NO: 3216836 - DNA, 13 bp, Homo sapiens
cgagggcagctgc

SEQ ID NO: 3216837 - DNA, 16 bp, Homo sapiens
cgagggcagctgctat

SEQ ID NO: 3216838 - DNA, 15 bp, Homo sapiens
cgaggggcagggaag

SEQ ID NO: 3216839 - DNA, 15 bp, Homo sapiens
cgaggggggccccgg

SEQ ID NO: 3216840 - DNA, 14 bp, Homo sapiens
cgaggtcaggagat

SEQ ID NO: 3216841 - DNA, 14 bp, Homo sapiens
cgagtagctgggac

SEQ ID NO: 3216842 - DNA, 16 bp, Homo sapiens
cgagtcacctgcaagc

SEQ ID NO: 3216843 - DNA, 16 bp, Homo sapiens
cgagtcaccttccagg

SEQ ID NO: 3216844 - DNA, 16 bp, Homo sapiens
cgagtctcttctccac

SEQ ID NO: 3216845 - DNA, 17 bp, Homo sapiens
cgagtctcttctccact

SEQ ID NO: 3216846 - DNA, 21 bp, Homo sapiens
cgagtgatttccatctctggt

SEQ ID NO: 3216847 - DNA, 20 bp, Homo sapiens
cgagtggattgtaggtgcaa

SEQ ID NO: 3216848 - DNA, 12 bp, Homo sapiens
ccttttggcact

SEQ ID NO: 3216849 - DNA, 23 bp, Homo sapiens
ccttttgtatcttcctttcttgt

SEQ ID NO: 3216850 - DNA, 19 bp, Homo sapiens
ccttttgtccccagggccc

SEQ ID NO: 3216851 - DNA, 20 bp, Homo sapiens
ccttttgtccccagggcccc

SEQ ID NO: 3216852 - DNA, 18 bp, Homo sapiens
cctttttatttgcatgtg

SEQ ID NO: 3216853 - DNA, 12 bp, Homo sapiens
cctttttcaatg

SEQ ID NO: 3216854 - DNA, 22 bp, Homo sapiens
cctttttcatatgttgctcagt

SEQ ID NO: 3216855 - DNA, 13 bp, Homo sapiens
cctttttccatca

SEQ ID NO: 3216856 - DNA, 14 bp, Homo sapiens
cctttttccatcat

SEQ ID NO: 3216857 - DNA, 20 bp, Homo sapiens
cctttttccatcattttaca

SEQ ID NO: 3216858 - DNA, 16 bp, Homo sapiens
cctttttcctagcctg

SEQ ID NO: 3216859 - DNA, 14 bp, Homo sapiens
cctttttgtataaa

SEQ ID NO: 3216860 - DNA, 17 bp, Homo sapiens
cctttttgtatgtgaac

SEQ ID NO: 3216861 - DNA, 14 bp, Homo sapiens
ccttttttaagatt

SEQ ID NO: 3216862 - DNA, 20 bp, Homo sapiens
ccttttttaagatttttctc

SEQ ID NO: 3216863 - DNA, 14 bp, Homo sapiens
ccttttttcaatat

SEQ ID NO: 3216864 - DNA, 18 bp, Homo sapiens
cctgtcgagacacttgcc

SEQ ID NO: 3216865 - DNA, 23 bp, Homo sapiens
cctgtcgagttcggctctgggtg

SEQ ID NO: 3216866 - DNA, 14 bp, Homo sapiens
cctgtcgtgccagt

SEQ ID NO: 3216867 - DNA, 19 bp, Homo sapiens
cctgtctaggtctcctcag

SEQ ID NO: 3216868 - DNA, 15 bp, Homo sapiens
cctgtctcagcctcc

SEQ ID NO: 3216869 - DNA, 15 bp, Homo sapiens
cctgtctcagctgtt

SEQ ID NO: 3216870 - DNA, 18 bp, Homo sapiens
cctgtctcatccccaggg

SEQ ID NO: 3216871 - DNA, 16 bp, Homo sapiens
cctgtctccactgtgc

SEQ ID NO: 3216872 - DNA, 14 bp, Homo sapiens
cctgtctctgcctg

SEQ ID NO: 3216873 - DNA, 16 bp, Homo sapiens
cctgtctctgcctgcg

SEQ ID NO: 3216874 - DNA, 17 bp, Homo sapiens
cctgtctgactactttg

SEQ ID NO: 3216875 - DNA, 16 bp, Homo sapiens
cctgtcttcacctgcc

SEQ ID NO: 3216876 - DNA, 19 bp, Homo sapiens
cctgtcttcacctgccacc

SEQ ID NO: 3216877 - DNA, 23 bp, Homo sapiens
cctgtcttcacctgccaccacac

SEQ ID NO: 3216878 - DNA, 19 bp, Homo sapiens
cctgtcttcagagaaccca

SEQ ID NO: 3216879 - DNA, 21 bp, Homo sapiens
cctgtcttctgggcacagtgg

SEQ ID NO: 3216880 - DNA, 17 bp, Homo sapiens
cctgtcttggggccact

SEQ ID NO: 3216881 - DNA, 10 bp, Homo sapiens
cctgtgaatg

SEQ ID NO: 3216882 - DNA, 22 bp, Homo sapiens
cctgtgaatgccactgccttcg

SEQ ID NO: 3216883 - DNA, 15 bp, Homo sapiens
cctgtgaatggaagc

SEQ ID NO: 3216884 - DNA, 16 bp, Homo sapiens
cctgtgaatggaggca

SEQ ID NO: 3216885 - DNA, 18 bp, Homo sapiens
cctgtgaatggaggcaga

SEQ ID NO: 3216886 - DNA, 19 bp, Homo sapiens
cctgtgacatggtgcctga

SEQ ID NO: 3216887 - DNA, 13 bp, Homo sapiens
cctgtgcacacac

SEQ ID NO: 3216888 - DNA, 17 bp, Homo sapiens
cctgtgcacacacacac

SEQ ID NO: 3216889 - DNA, 19 bp, Homo sapiens
cctgtgcagcagcccagct

SEQ ID NO: 3216890 - DNA, 23 bp, Homo sapiens
cctgtgcagcagcccagcttcct

SEQ ID NO: 3216891 - DNA, 14 bp, Homo sapiens
cctgtgcatgtatg

SEQ ID NO: 3216892 - DNA, 20 bp, Homo sapiens
cctgtgccactttgactcag

SEQ ID NO: 3216893 - DNA, 21 bp, Homo sapiens
cctgtgccactttgactcaga

SEQ ID NO: 3216894 - DNA, 13 bp, Homo sapiens
cctgtgccatcac

SEQ ID NO: 3216895 - DNA, 18 bp, Homo sapiens
cctgtgccctcaccacca

SEQ ID NO: 3216896 - DNA, 20 bp, Homo sapiens
cctgtgcctcctcaccccca

SEQ ID NO: 3216897 - DNA, 21 bp, Homo sapiens
cctgtgcctcctcacccccag

SEQ ID NO: 3216898 - DNA, 20 bp, Homo sapiens
cctgtgcctctgggactgga

SEQ ID NO: 3216899 - DNA, 17 bp, Homo sapiens
cctgtgcctgccatggg

SEQ ID NO: 3216900 - DNA, 22 bp, Homo sapiens
cctgtgcctgccatgggccagc

SEQ ID NO: 3216901 - DNA, 14 bp, Homo sapiens
cctgtgcctgtcag

SEQ ID NO: 3216902 - DNA, 21 bp, Homo sapiens
cctgtgctagaagctccatgg

SEQ ID NO: 3216903 - DNA, 19 bp, Homo sapiens
cctgtgctagttttacaga

SEQ ID NO: 3216904 - DNA, 18 bp, Homo sapiens
cctgtgctccgtgcctcc

SEQ ID NO: 3216905 - DNA, 19 bp, Homo sapiens
cctgtgctccgtgcctcca

SEQ ID NO: 3216906 - DNA, 20 bp, Homo sapiens
cctgtgctccgtgcctccac

SEQ ID NO: 3216907 - DNA, 22 bp, Homo sapiens
cctgtgctccgtgcctccacca

SEQ ID NO: 3216908 - DNA, 13 bp, Homo sapiens
ccttgatcatttt

SEQ ID NO: 3216909 - DNA, 23 bp, Homo sapiens
ccttgattgttcgggtgtgcaat

SEQ ID NO: 3216910 - DNA, 19 bp, Homo sapiens
ccttgatttaaacacacag

SEQ ID NO: 3216911 - DNA, 18 bp, Homo sapiens
ccttgcacccctcactct

SEQ ID NO: 3216912 - DNA, 15 bp, Homo sapiens
ccttgcagctagttt

SEQ ID NO: 3216913 - DNA, 18 bp, Homo sapiens
ccttgcaggggtcccccc

SEQ ID NO: 3216914 - DNA, 19 bp, Homo sapiens
ccttgcagttcagcaccac

SEQ ID NO: 3216915 - DNA, 21 bp, Homo sapiens
ccttgcatccattgttgtgtc

SEQ ID NO: 3216916 - DNA, 14 bp, Homo sapiens
ccttgccaaagcac

SEQ ID NO: 3216917 - DNA, 12 bp, Homo sapiens
ccttgccatcac

SEQ ID NO: 3216918 - DNA, 15 bp, Homo sapiens
ccttgccccacagtt

SEQ ID NO: 3216919 - DNA, 20 bp, Homo sapiens
ccttgccccacagttgtgtt

SEQ ID NO: 3216920 - DNA, 19 bp, Homo sapiens
ccttgccctccgcctggga

SEQ ID NO: 3216921 - DNA, 12 bp, Homo sapiens
ccttgccctgac

SEQ ID NO: 3216922 - DNA, 13 bp, Homo sapiens
ccttgccctgacc

SEQ ID NO: 3216923 - DNA, 15 bp, Homo sapiens
ccttgccctgacctc

SEQ ID NO: 3216924 - DNA, 23 bp, Homo sapiens
ccttgccctgacctcccagccct

SEQ ID NO: 3216925 - DNA, 18 bp, Homo sapiens
ccttgcccttgccctgac

SEQ ID NO: 3216926 - DNA, 23 bp, Homo sapiens
ccttgcctaaatttaatgctgcc

SEQ ID NO: 3216927 - DNA, 16 bp, Homo sapiens
ccttgcctcaatgcca

SEQ ID NO: 3216928 - DNA, 19 bp, Homo sapiens
ccttgcctcaatgccagta

SEQ ID NO: 3216929 - DNA, 13 bp, Homo sapiens
ccttgccttcccc

SEQ ID NO: 3216930 - DNA, 14 bp, Homo sapiens
ccttgccttcccct

SEQ ID NO: 3216931 - DNA, 18 bp, Homo sapiens
ccttgccttcccctgtct

SEQ ID NO: 3216932 - DNA, 14 bp, Homo sapiens
ccttgctaattttc

SEQ ID NO: 3216933 - DNA, 14 bp, Homo sapiens
ccttgctacctcaa

SEQ ID NO: 3216934 - DNA, 17 bp, Homo sapiens
ccttgctacctcaaggg

SEQ ID NO: 3216935 - DNA, 13 bp, Homo sapiens
ccttgctcccttc

SEQ ID NO: 3216936 - DNA, 16 bp, Homo sapiens
ccttgctcctagcaga

SEQ ID NO: 3216937 - DNA, 22 bp, Homo sapiens
ccttgctctcccctgccctgct

SEQ ID NO: 3216938 - DNA, 13 bp, Homo sapiens
ccttgctctccct

SEQ ID NO: 3216939 - DNA, 16 bp, Homo sapiens
ccttgctgctgctgca

SEQ ID NO: 3216940 - DNA, 13 bp, Homo sapiens
ccttgctggcccc

SEQ ID NO: 3216941 - DNA, 14 bp, Homo sapiens
ccttgctggcccca

SEQ ID NO: 3216942 - DNA, 19 bp, Homo sapiens
ccttgctggccccagccct

SEQ ID NO: 3216943 - DNA, 20 bp, Homo sapiens
ccttgctggccccagccctg

SEQ ID NO: 3216944 - DNA, 16 bp, Homo sapiens
ccttgctgtcctaggc

SEQ ID NO: 3216945 - DNA, 13 bp, Homo sapiens
ccttgctgtcctg

SEQ ID NO: 3216946 - DNA, 21 bp, Homo sapiens
ccttgctgtttgtcctgagat

SEQ ID NO: 3216947 - DNA, 19 bp, Homo sapiens
ccttgctttcctgggcctt

SEQ ID NO: 3216948 - DNA, 15 bp, Homo sapiens
ccttgctttcggagc

SEQ ID NO: 3216949 - DNA, 15 bp, Homo sapiens
ccttgctttgggctt

SEQ ID NO: 3216950 - DNA, 17 bp, Homo sapiens
ccttggagagacacagc

SEQ ID NO: 3216951 - DNA, 17 bp, Homo sapiens
ccttggaggagagagac

SEQ ID NO: 3216952 - DNA, 18 bp, Homo sapiens
ccttggaggagagagacc

SEQ ID NO: 3216953 - DNA, 13 bp, Homo sapiens
ccttggattccct

SEQ ID NO: 3216954 - DNA, 14 bp, Homo sapiens
ccttggcaccaaag

SEQ ID NO: 3216955 - DNA, 23 bp, Homo sapiens
ccttggcaccaaagatgcagccg

SEQ ID NO: 3216956 - DNA, 19 bp, Homo sapiens
ccttggcaggtcctggcca

SEQ ID NO: 3216957 - DNA, 16 bp, Homo sapiens
ccttggcatgggcgca

SEQ ID NO: 3216958 - DNA, 16 bp, Homo sapiens
ccttggccggctgtgc

SEQ ID NO: 3216959 - DNA, 20 bp, Homo sapiens
ccttggccggctgtgctcag

SEQ ID NO: 3216960 - DNA, 23 bp, Homo sapiens
ccttggcctagcccaccctgctg

SEQ ID NO: 3216961 - DNA, 22 bp, Homo sapiens
ccttggcctgtctcatccccag

SEQ ID NO: 3216962 - DNA, 23 bp, Homo sapiens
ccttggcctgtctcatccccagg

SEQ ID NO: 3216963 - DNA, 15 bp, Homo sapiens
ccttggctcagacat

SEQ ID NO: 3216964 - DNA, 19 bp, Homo sapiens
ccttggctctgccagtgga

SEQ ID NO: 3216965 - DNA, 20 bp, Homo sapiens
ccttggctgacatgaagctg

SEQ ID NO: 3216966 - DNA, 12 bp, Homo sapiens
ccttggctgcag

SEQ ID NO: 3216967 - DNA, 13 bp, Homo sapiens
ccttggctgcagg

SEQ ID NO: 3216968 - DNA, 21 bp, Homo sapiens
ccttggctgttggcagtgagt

SEQ ID NO: 3216969 - DNA, 19 bp, Homo sapiens
ccttggctttatgcacatt

SEQ ID NO: 3216970 - DNA, 23 bp, Homo sapiens
ccttgggaggttttattctgact

SEQ ID NO: 3216971 - DNA, 18 bp, Homo sapiens
ccttgggatcagatcaag

SEQ ID NO: 3216972 - DNA, 17 bp, Homo sapiens
ccttgggcatccaccca

SEQ ID NO: 3216973 - DNA, 18 bp, Homo sapiens
ccttgggcatccacccag

SEQ ID NO: 3216974 - DNA, 22 bp, Homo sapiens
ccttgggcatccacccagtgct

SEQ ID NO: 3216975 - DNA, 24 bp, Homo sapiens
ccttgggcatccacccagtgctgc

SEQ ID NO: 3216976 - DNA, 20 bp, Homo sapiens
ccttgggcctgggcctctgc

SEQ ID NO: 3216977 - DNA, 19 bp, Homo sapiens
ccttgggccttgctgctgc

SEQ ID NO: 3216978 - DNA, 14 bp, Homo sapiens
ccttgggctcctgg

SEQ ID NO: 3216979 - DNA, 18 bp, Homo sapiens
ccttgggctcctggctgc

SEQ ID NO: 3216980 - DNA, 19 bp, Homo sapiens
ccttgggctcctggctgcc

SEQ ID NO: 3216981 - DNA, 21 bp, Homo sapiens
ccttgggctcctggctgccag

SEQ ID NO: 3216982 - DNA, 23 bp, Homo sapiens
ccttgggctcctggctgccaggc

SEQ ID NO: 3216983 - DNA, 14 bp, Homo sapiens
ccttgggctgctcc

SEQ ID NO: 3216984 - DNA, 17 bp, Homo sapiens
ccttgggctgctcctca

SEQ ID NO: 3216985 - DNA, 18 bp, Homo sapiens
ccttgggctgctcctcat

SEQ ID NO: 3216986 - DNA, 22 bp, Homo sapiens
ccttgggctgggacttcttacc

SEQ ID NO: 3216987 - DNA, 22 bp, Homo sapiens
ccttggggaggacaaaacttct

SEQ ID NO: 3216988 - DNA, 23 bp, Homo sapiens
ccttggggaggacaaaacttctt

SEQ ID NO: 3216989 - DNA, 12 bp, Homo sapiens
ccttggggaggg

SEQ ID NO: 3216990 - DNA, 14 bp, Homo sapiens
ccttggggcctggc

SEQ ID NO: 3216991 - DNA, 13 bp, Homo sapiens
ccttggggctggg

SEQ ID NO: 3216992 - DNA, 18 bp, Homo sapiens
ccttgggtcattgacctc

SEQ ID NO: 3216993 - DNA, 19 bp, Homo sapiens
ccttgggtcattgacctct

SEQ ID NO: 3216994 - DNA, 21 bp, Homo sapiens
ccttggtctttgtatcttcca

SEQ ID NO: 3216995 - DNA, 17 bp, Homo sapiens
ccttgtaaccagtgcag

SEQ ID NO: 3216996 - DNA, 16 bp, Homo sapiens
ccttgtaattctaaat

SEQ ID NO: 3216997 - DNA, 13 bp, Homo sapiens
ccttgtactctta

SEQ ID NO: 3216998 - DNA, 14 bp, Homo sapiens
ccttgtactcttag

SEQ ID NO: 3216999 - DNA, 16 bp, Homo sapiens
ccttgtactcttagga

SEQ ID NO: 3217000 - DNA, 16 bp, Homo sapiens
ccttgtattttgttaa

SEQ ID NO: 3217001 - DNA, 16 bp, Homo sapiens
ccttgtcactggtaga

SEQ ID NO: 3217002 - DNA, 14 bp, Homo sapiens
ccttgtcctgccag

SEQ ID NO: 3217003 - DNA, 18 bp, Homo sapiens
ccttgtcctgccagctgc

SEQ ID NO: 3217004 - DNA, 20 bp, Homo sapiens
ccttgtcctgccagctgcct

SEQ ID NO: 3217005 - DNA, 21 bp, Homo sapiens
ccttgtcctgccagctgcctt

SEQ ID NO: 3217006 - DNA, 14 bp, Homo sapiens
ccttgtcctttccc

SEQ ID NO: 3217007 - DNA, 23 bp, Homo sapiens
ccttgtctagtttcccacattcc

SEQ ID NO: 3217008 - DNA, 19 bp, Homo sapiens
ccttgtctcctactcctga

SEQ ID NO: 3217009 - DNA, 19 bp, Homo sapiens
ccttgtctttactgacaag

SEQ ID NO: 3217010 - DNA, 16 bp, Homo sapiens
ccttgtgagagcccat

SEQ ID NO: 3217011 - DNA, 13 bp, Homo sapiens
ccttgtgccctgc

SEQ ID NO: 3217012 - DNA, 14 bp, Homo sapiens
ccttgtgccctgcc

SEQ ID NO: 3217013 - DNA, 16 bp, Homo sapiens
ccttgtgccctgcccc

SEQ ID NO: 3217014 - DNA, 21 bp, Homo sapiens
ccttgtgcttggtggggctcg

SEQ ID NO: 3217015 - DNA, 24 bp, Homo sapiens
ccttgtgcttggtggggctcgtgg

SEQ ID NO: 3217016 - DNA, 12 bp, Homo sapiens
ccttgtggcaga

SEQ ID NO: 3217017 - DNA, 13 bp, Homo sapiens
ccttgtggcagag

SEQ ID NO: 3217018 - DNA, 12 bp, Homo sapiens
ccttgtggcttc

SEQ ID NO: 3217019 - DNA, 16 bp, Homo sapiens
ccttgttacttctgag

SEQ ID NO: 3217020 - DNA, 18 bp, Homo sapiens
ccttgttacttctgaggt

SEQ ID NO: 3217021 - DNA, 19 bp, Homo sapiens
ccttgttacttctgaggta

SEQ ID NO: 3217022 - DNA, 14 bp, Homo sapiens
ccttgttctatttt

SEQ ID NO: 3217023 - DNA, 16 bp, Homo sapiens
ccttgttggtcagagg

SEQ ID NO: 3217024 - DNA, 18 bp, Homo sapiens
ccttgttttctctgtgtg

SEQ ID NO: 3217025 - DNA, 15 bp, Homo sapiens
cctttaagaacctta

SEQ ID NO: 3217026 - DNA, 16 bp, Homo sapiens
cctttaagaaccttaa

SEQ ID NO: 3217027 - DNA, 14 bp, Homo sapiens
cctttaagccaaag

SEQ ID NO: 3217028 - DNA, 13 bp, Homo sapiens
cctttaatgcatc

SEQ ID NO: 3217029 - DNA, 16 bp, Homo sapiens
cctttacaaaagaaat

SEQ ID NO: 3217030 - DNA, 16 bp, Homo sapiens
cctttacaatgtgaat

SEQ ID NO: 3217031 - DNA, 18 bp, Homo sapiens
cctttacaccaactccta

SEQ ID NO: 3217032 - DNA, 23 bp, Homo sapiens
cctttacattcaacttttctaag

SEQ ID NO: 3217033 - DNA, 19 bp, Homo sapiens
cctttacgtgtttaaaaaa

SEQ ID NO: 3217034 - DNA, 21 bp, Homo sapiens
cctttagcacgtttaaagttc

SEQ ID NO: 3217035 - DNA, 20 bp, Homo sapiens
cctttagcgcccagttgggt

SEQ ID NO: 3217036 - DNA, 16 bp, Homo sapiens
cctttaggtctggttg

SEQ ID NO: 3217037 - DNA, 19 bp, Homo sapiens
cctttagtacctgaaaagt

SEQ ID NO: 3217038 - DNA, 17 bp, Homo sapiens
cctttagtatcagtgtt

SEQ ID NO: 3217039 - DNA, 23 bp, Homo sapiens
cctttattaccccctccttcaga

SEQ ID NO: 3217040 - DNA, 17 bp, Homo sapiens
cctttcaccctcatgaa

SEQ ID NO: 3217041 - DNA, 18 bp, Homo sapiens
cctttcaccctcatgaaa

SEQ ID NO: 3217042 - DNA, 19 bp, Homo sapiens
cctttcaccctcatgaaaa

SEQ ID NO: 3217043 - DNA, 22 bp, Homo sapiens
cctttcacctttgtgtattttt

SEQ ID NO: 3217044 - DNA, 13 bp, Homo sapiens
cctttcagatgtc

SEQ ID NO: 3217045 - DNA, 17 bp, Homo sapiens
cctttcagatgtcttct

SEQ ID NO: 3217046 - DNA, 19 bp, Homo sapiens
cctttcagatgtcttctgc

SEQ ID NO: 3217047 - DNA, 12 bp, Homo sapiens
cctttcagggaa

SEQ ID NO: 3217048 - DNA, 20 bp, Homo sapiens
cctttcagggaatttcagga

SEQ ID NO: 3217049 - DNA, 17 bp, Homo sapiens
cctttccccagcatcac

SEQ ID NO: 3217050 - DNA, 22 bp, Homo sapiens
cctttccccagcatcactcccc

SEQ ID NO: 3217051 - DNA, 23 bp, Homo sapiens
cctttccccagcatcactcccca

SEQ ID NO: 3217052 - DNA, 13 bp, Homo sapiens
cctttccccagcc

SEQ ID NO: 3217053 - DNA, 17 bp, Homo sapiens
cctttcccctctctgcc

SEQ ID NO: 3217054 - DNA, 14 bp, Homo sapiens
cctttccccttccc

SEQ ID NO: 3217055 - DNA, 14 bp, Homo sapiens
cctttccctcgcta

SEQ ID NO: 3217056 - DNA, 15 bp, Homo sapiens
cctttcccttcttgg

SEQ ID NO: 3217057 - DNA, 16 bp, Homo sapiens
cctttccggcacactg

SEQ ID NO: 3217058 - DNA, 20 bp, Homo sapiens
cctttccggcacactgccaa

SEQ ID NO: 3217059 - DNA, 21 bp, Homo sapiens
cctttccggcacactgccaaa

SEQ ID NO: 3217060 - DNA, 20 bp, Homo sapiens
cctttcctaggcccaggcct

SEQ ID NO: 3217061 - DNA, 17 bp, Homo sapiens
cctttcctcctttatca

SEQ ID NO: 3217062 - DNA, 18 bp, Homo sapiens
cctttcctcctttatcac

SEQ ID NO: 3217063 - DNA, 17 bp, Homo sapiens
cctttcctctctcctgt

SEQ ID NO: 3217064 - DNA, 18 bp, Homo sapiens
cctttcctgttcagcatt

SEQ ID NO: 3217065 - DNA, 13 bp, Homo sapiens
cctttctccagcc

SEQ ID NO: 3217066 - DNA, 22 bp, Homo sapiens
cctttctccagccagcaatgat

SEQ ID NO: 3217067 - DNA, 15 bp, Homo sapiens
cctttctcccagtga

SEQ ID NO: 3217068 - DNA, 13 bp, Homo sapiens
cctttctctctcc

SEQ ID NO: 3217069 - DNA, 16 bp, Homo sapiens
cctttctctctcctct

SEQ ID NO: 3217070 - DNA, 18 bp, Homo sapiens
cctttctctctcctctct

SEQ ID NO: 3217071 - DNA, 18 bp, Homo sapiens
cctttctgcccacttccc

SEQ ID NO: 3217072 - DNA, 12 bp, Homo sapiens
cctttctgcctt

SEQ ID NO: 3217073 - DNA, 13 bp, Homo sapiens
cctttctggaagt

SEQ ID NO: 3217074 - DNA, 17 bp, Homo sapiens
cctttctggaagtttct

SEQ ID NO: 3217075 - DNA, 17 bp, Homo sapiens
cctttcttgtctttcct

SEQ ID NO: 3217076 - DNA, 19 bp, Homo sapiens
cctttcttttccccctttg

SEQ ID NO: 3217077 - DNA, 14 bp, Homo sapiens
cctttgaagcctca

SEQ ID NO: 3217078 - DNA, 13 bp, Homo sapiens
cctttgacttcag

SEQ ID NO: 3217079 - DNA, 20 bp, Homo sapiens
cctttgacttcagctgcctg

SEQ ID NO: 3217080 - DNA, 16 bp, Homo sapiens
cctttgatcccagaaa

SEQ ID NO: 3217081 - DNA, 14 bp, Homo sapiens
cctttgattatgca

SEQ ID NO: 3217082 - DNA, 18 bp, Homo sapiens
cctttgcaaatcagtgtt

SEQ ID NO: 3217083 - DNA, 15 bp, Homo sapiens
cctttgcaccctgta

SEQ ID NO: 3217084 - DNA, 16 bp, Homo sapiens
cctttgcaccctgtag

SEQ ID NO: 3217085 - DNA, 21 bp, Homo sapiens
cctttgcaccctgtagatgtt

SEQ ID NO: 3217086 - DNA, 13 bp, Homo sapiens
cctttgcactgag

SEQ ID NO: 3217087 - DNA, 17 bp, Homo sapiens
cctttgcactgagggcc

SEQ ID NO: 3217088 - DNA, 18 bp, Homo sapiens
cctttgcactgagggcca

SEQ ID NO: 3217089 - DNA, 19 bp, Homo sapiens
cctttgcatagctctcctt

SEQ ID NO: 3217090 - DNA, 12 bp, Homo sapiens
cctttgcattta

SEQ ID NO: 3217091 - DNA, 22 bp, Homo sapiens
cctttgcctttcttctgccctt

SEQ ID NO: 3217092 - DNA, 14 bp, Homo sapiens
cctttgctatgtaa

SEQ ID NO: 3217093 - DNA, 13 bp, Homo sapiens
cctttggaaagcc

SEQ ID NO: 3217094 - DNA, 12 bp, Homo sapiens
cctttggaggga

SEQ ID NO: 3217095 - DNA, 14 bp, Homo sapiens
cctttggctctgga

SEQ ID NO: 3217096 - DNA, 23 bp, Homo sapiens
cctttgggcctctgcttctctca

SEQ ID NO: 3217097 - DNA, 14 bp, Homo sapiens
cctttggttctggc

SEQ ID NO: 3217098 - DNA, 18 bp, Homo sapiens
cctttgtaagacatttgt

SEQ ID NO: 3217099 - DNA, 12 bp, Homo sapiens
cctttgtaagtt

SEQ ID NO: 3217100 - DNA, 14 bp, Homo sapiens
cctttgtaagttat

SEQ ID NO: 3217101 - DNA, 16 bp, Homo sapiens
cctttgtcttgtactt

SEQ ID NO: 3217102 - DNA, 17 bp, Homo sapiens
cctttgtcttgtacttc

SEQ ID NO: 3217103 - DNA, 20 bp, Homo sapiens
cctttgtcttgtacttctgt

SEQ ID NO: 3217104 - DNA, 22 bp, Homo sapiens
cctttgtgcacatttatttcct

SEQ ID NO: 3217105 - DNA, 12 bp, Homo sapiens
cctttgtgctgt

SEQ ID NO: 3217106 - DNA, 13 bp, Homo sapiens
cctttgtgtttat

SEQ ID NO: 3217107 - DNA, 15 bp, Homo sapiens
cctttgtgtttatat

SEQ ID NO: 3217108 - DNA, 20 bp, Homo sapiens
cctttgttcccaaggacttc

SEQ ID NO: 3217109 - DNA, 13 bp, Homo sapiens
cctttgtttcttg

SEQ ID NO: 3217110 - DNA, 23 bp, Homo sapiens
cctttgttttgatgtttgtggcc

SEQ ID NO: 3217111 - DNA, 20 bp, Homo sapiens
ccttttaacattttgttctt

SEQ ID NO: 3217112 - DNA, 13 bp, Homo sapiens
ccttttagaaacc

SEQ ID NO: 3217113 - DNA, 19 bp, Homo sapiens
ccttttatcccaaagttgt

SEQ ID NO: 3217114 - DNA, 17 bp, Homo sapiens
ccttttatctgcagaac

SEQ ID NO: 3217115 - DNA, 22 bp, Homo sapiens
ccttttatgtagtaattgacat

SEQ ID NO: 3217116 - DNA, 23 bp, Homo sapiens
ccttttattataagtcttacata

SEQ ID NO: 3217117 - DNA, 15 bp, Homo sapiens
ccttttattgacaca

SEQ ID NO: 3217118 - DNA, 21 bp, Homo sapiens
ccttttcagctgagccctggg

SEQ ID NO: 3217119 - DNA, 18 bp, Homo sapiens
ccttttcccctacagaat

SEQ ID NO: 3217120 - DNA, 13 bp, Homo sapiens
ccttttccctgct

SEQ ID NO: 3217121 - DNA, 15 bp, Homo sapiens
ccttttccctgcttc

SEQ ID NO: 3217122 - DNA, 11 bp, Homo sapiens
ccttttcctgt

SEQ ID NO: 3217123 - DNA, 13 bp, Homo sapiens
ccttttctgttta

SEQ ID NO: 3217124 - DNA, 17 bp, Homo sapiens
ccttttctgtttaggaa

SEQ ID NO: 3217125 - DNA, 16 bp, Homo sapiens
ccttttcttcattttg

SEQ ID NO: 3217126 - DNA, 21 bp, Homo sapiens
ccttttcttttgttactgttc

SEQ ID NO: 3217127 - DNA, 23 bp, Homo sapiens
ccttttcttttgttactgttctt

SEQ ID NO: 3217128 - DNA, 13 bp, Homo sapiens
ccttttgacactg

SEQ ID NO: 3217129 - DNA, 18 bp, Homo sapiens
ccttttgacactgctcta

SEQ ID NO: 3217130 - DNA, 21 bp, Homo sapiens
ccttttgaggagccccagcta

SEQ ID NO: 3217131 - DNA, 15 bp, Homo sapiens
ccttttgcagaagag

SEQ ID NO: 3217132 - DNA, 18 bp, Homo sapiens
ccttttgcataagattaa

SEQ ID NO: 3217133 - DNA, 18 bp, Homo sapiens
ccttttgcctggctgtgg

SEQ ID NO: 3217134 - DNA, 12 bp, Homo sapiens
ccttttgctgcg

SEQ ID NO: 3217135 - DNA, 22 bp, Homo sapiens
ccttttggataagtttctattc

SEQ ID NO: 3217136 - DNA, 19 bp, Homo sapiens
cctggggcgggcccctcat

SEQ ID NO: 3217137 - DNA, 13 bp, Homo sapiens
cctggggctccct

SEQ ID NO: 3217138 - DNA, 15 bp, Homo sapiens
cctggggctccctct

SEQ ID NO: 3217139 - DNA, 16 bp, Homo sapiens
cctggggctcctttct

SEQ ID NO: 3217140 - DNA, 18 bp, Homo sapiens
cctggggcttctcctgac

SEQ ID NO: 3217141 - DNA, 13 bp, Homo sapiens
cctgggggagaga

SEQ ID NO: 3217142 - DNA, 19 bp, Homo sapiens
cctgggggagttttcctct

SEQ ID NO: 3217143 - DNA, 22 bp, Homo sapiens
cctgggggccttgggtgagtgg

SEQ ID NO: 3217144 - DNA, 17 bp, Homo sapiens
cctgggggtggcaggca

SEQ ID NO: 3217145 - DNA, 18 bp, Homo sapiens
cctgggggtggcaggcac

SEQ ID NO: 3217146 - DNA, 18 bp, Homo sapiens
cctgggggttctttcttc

SEQ ID NO: 3217147 - DNA, 21 bp, Homo sapiens
cctgggggttctttcttcctc

SEQ ID NO: 3217148 - DNA, 20 bp, Homo sapiens
cctgggggtttcacctgggc

SEQ ID NO: 3217149 - DNA, 21 bp, Homo sapiens
cctggggtataaaactttcct

SEQ ID NO: 3217150 - DNA, 15 bp, Homo sapiens
cctggggtctgagca

SEQ ID NO: 3217151 - DNA, 21 bp, Homo sapiens
cctggggtgcatcctcctcag

SEQ ID NO: 3217152 - DNA, 18 bp, Homo sapiens
cctgggtactgaaagcct

SEQ ID NO: 3217153 - DNA, 19 bp, Homo sapiens
cctgggtcaaaaaaaagaa

SEQ ID NO: 3217154 - DNA, 17 bp, Homo sapiens
cctgggtccaaataaaa

SEQ ID NO: 3217155 - DNA, 14 bp, Homo sapiens
cctgggtgacattt

SEQ ID NO: 3217156 - DNA, 15 bp, Homo sapiens
cctgggtgacatttg

SEQ ID NO: 3217157 - DNA, 16 bp, Homo sapiens
cctgggtggaaatcct

SEQ ID NO: 3217158 - DNA, 22 bp, Homo sapiens
cctgggtggatcggcctcctct

SEQ ID NO: 3217159 - DNA, 15 bp, Homo sapiens
cctgggtgggacagc

SEQ ID NO: 3217160 - DNA, 18 bp, Homo sapiens
cctgggtgggacagcctc

SEQ ID NO: 3217161 - DNA, 20 bp, Homo sapiens
cctgggtgggtggtggggag

SEQ ID NO: 3217162 - DNA, 22 bp, Homo sapiens
cctgggtgggtggtggggaggg

SEQ ID NO: 3217163 - DNA, 23 bp, Homo sapiens
cctgggtgggtggtggggagggg

SEQ ID NO: 3217164 - DNA, 13 bp, Homo sapiens
cctgggttccctt

SEQ ID NO: 3217165 - DNA, 15 bp, Homo sapiens
cctgggttgggggca

SEQ ID NO: 3217166 - DNA, 13 bp, Homo sapiens
cctgggtttcctg

SEQ ID NO: 3217167 - DNA, 18 bp, Homo sapiens
cctgggtttcctgcaggc

SEQ ID NO: 3217168 - DNA, 23 bp, Homo sapiens
cctggtaaccaaatattaaagat

SEQ ID NO: 3217169 - DNA, 14 bp, Homo sapiens
cctggtaccctcct

SEQ ID NO: 3217170 - DNA, 15 bp, Homo sapiens
cctggtaccctcctg

SEQ ID NO: 3217171 - DNA, 23 bp, Homo sapiens
cctggtcacaggactctgcctcc

SEQ ID NO: 3217172 - DNA, 20 bp, Homo sapiens
cctggtcacagggcatgccc

SEQ ID NO: 3217173 - DNA, 23 bp, Homo sapiens
cctggtccctcacccccatggcc

SEQ ID NO: 3217174 - DNA, 15 bp, Homo sapiens
cctggtccttccagg

SEQ ID NO: 3217175 - DNA, 18 bp, Homo sapiens
cctggtccttccaggccc

SEQ ID NO: 3217176 - DNA, 12 bp, Homo sapiens
cctggtgcccct

SEQ ID NO: 3217177 - DNA, 23 bp, Homo sapiens
cctggtgcccctcgccagcttct

SEQ ID NO: 3217178 - DNA, 15 bp, Homo sapiens
cctggtgccctgaga

SEQ ID NO: 3217179 - DNA, 16 bp, Homo sapiens
cctggtgccctgagac

SEQ ID NO: 3217180 - DNA, 15 bp, Homo sapiens
cctggtgctgccaca

SEQ ID NO: 3217181 - DNA, 12 bp, Homo sapiens
cctggtgctgct

SEQ ID NO: 3217182 - DNA, 17 bp, Homo sapiens
cctggtggacagtcctg

SEQ ID NO: 3217183 - DNA, 19 bp, Homo sapiens
cctggtggacagtcctggg

SEQ ID NO: 3217184 - DNA, 13 bp, Homo sapiens
cctggtggcacca

SEQ ID NO: 3217185 - DNA, 15 bp, Homo sapiens
cctggtggcaccaga

SEQ ID NO: 3217186 - DNA, 23 bp, Homo sapiens
cctggtggcaccagatgcaacct

SEQ ID NO: 3217187 - DNA, 13 bp, Homo sapiens
cctgctgtgggag

SEQ ID NO: 3217188 - DNA, 22 bp, Homo sapiens
cctgcttaatcttcaaagcctt

SEQ ID NO: 3217189 - DNA, 18 bp, Homo sapiens
cctgcttcccacctccct

SEQ ID NO: 3217190 - DNA, 20 bp, Homo sapiens
cctgcttcccacctccctgc

SEQ ID NO: 3217191 - DNA, 24 bp, Homo sapiens
cctgcttcccacctccctgcccag

SEQ ID NO: 3217192 - DNA, 13 bp, Homo sapiens
cctgcttcccctt

SEQ ID NO: 3217193 - DNA, 14 bp, Homo sapiens
cctgcttcctgaaa

SEQ ID NO: 3217194 - DNA, 15 bp, Homo sapiens
cctgcttcctgaaat

SEQ ID NO: 3217195 - DNA, 14 bp, Homo sapiens
cctgcttctccagc

SEQ ID NO: 3217196 - DNA, 18 bp, Homo sapiens
cctgctttgggctgccct

SEQ ID NO: 3217197 - DNA, 23 bp, Homo sapiens
cctgcttttccaggatcctgcag

SEQ ID NO: 3217198 - DNA, 13 bp, Homo sapiens
cctgcttttgcat

SEQ ID NO: 3217199 - DNA, 22 bp, Homo sapiens
cctgctttttgaaatgaaattt

SEQ ID NO: 3217200 - DNA, 12 bp, Homo sapiens
cctggaaacagc

SEQ ID NO: 3217201 - DNA, 12 bp, Homo sapiens
cctggaaaccac

SEQ ID NO: 3217202 - DNA, 15 bp, Homo sapiens
cctggaaaggctcag

SEQ ID NO: 3217203 - DNA, 17 bp, Homo sapiens
cctggaaaggctcagtc

SEQ ID NO: 3217204 - DNA, 23 bp, Homo sapiens
cctggaaaggctcagtctcagga

SEQ ID NO: 3217205 - DNA, 14 bp, Homo sapiens
cctggaaaggggag

SEQ ID NO: 3217206 - DNA, 16 bp, Homo sapiens
cctggaaccagggagg

SEQ ID NO: 3217207 - DNA, 21 bp, Homo sapiens
cctggaaccagggaggagagg

SEQ ID NO: 3217208 - DNA, 15 bp, Homo sapiens
cctggaaccttgctg

SEQ ID NO: 3217209 - DNA, 16 bp, Homo sapiens
cctggaaccttgctgt

SEQ ID NO: 3217210 - DNA, 21 bp, Homo sapiens
cctggaaccttgctgtcctga

SEQ ID NO: 3217211 - DNA, 17 bp, Homo sapiens
cctggacacccctgctc

SEQ ID NO: 3217212 - DNA, 20 bp, Homo sapiens
cctggacatttgccttgctg

SEQ ID NO: 3217213 - DNA, 14 bp, Homo sapiens
cctggacctggaac

SEQ ID NO: 3217214 - DNA, 12 bp, Homo sapiens
cctggactctgc

SEQ ID NO: 3217215 - DNA, 14 bp, Homo sapiens
cctggactgggagg

SEQ ID NO: 3217216 - DNA, 17 bp, Homo sapiens
cctggactgggaggtag

SEQ ID NO: 3217217 - DNA, 14 bp, Homo sapiens
cctggactttcctg

SEQ ID NO: 3217218 - DNA, 22 bp, Homo sapiens
cctggagaaaaaaattgctctg

SEQ ID NO: 3217219 - DNA, 17 bp, Homo sapiens
cctggagaaggaagctg

SEQ ID NO: 3217220 - DNA, 17 bp, Homo sapiens
cctggagacgtggaacc

SEQ ID NO: 3217221 - DNA, 22 bp, Homo sapiens
cctggagacgtggaacctctgt

SEQ ID NO: 3217222 - DNA, 23 bp, Homo sapiens
cctggagacttagggcaccaggg

SEQ ID NO: 3217223 - DNA, 23 bp, Homo sapiens
cctggagagggtctcgctgtcac

SEQ ID NO: 3217224 - DNA, 18 bp, Homo sapiens
cctggagcagaccacccc

SEQ ID NO: 3217225 - DNA, 14 bp, Homo sapiens
cctggagcaggagc

SEQ ID NO: 3217226 - DNA, 15 bp, Homo sapiens
cctggagcaggagcc

SEQ ID NO: 3217227 - DNA, 15 bp, Homo sapiens
cctggagccaactgc

SEQ ID NO: 3217228 - DNA, 22 bp, Homo sapiens
cctggagcccctgggtgggtgg

SEQ ID NO: 3217229 - DNA, 12 bp, Homo sapiens
cctggagccctg

SEQ ID NO: 3217230 - DNA, 13 bp, Homo sapiens
cctggagccctgt

SEQ ID NO: 3217231 - DNA, 22 bp, Homo sapiens
cctggagccctgttggcagctc

SEQ ID NO: 3217232 - DNA, 20 bp, Homo sapiens
cctggaggaattcagctcag

SEQ ID NO: 3217233 - DNA, 16 bp, Homo sapiens
cctggaggatttcatc

SEQ ID NO: 3217234 - DNA, 16 bp, Homo sapiens
cctggaggtctccagg

SEQ ID NO: 3217235 - DNA, 15 bp, Homo sapiens
cctggagtataatat

SEQ ID NO: 3217236 - DNA, 21 bp, Homo sapiens
cctggatcacgacgctgcaga

SEQ ID NO: 3217237 - DNA, 22 bp, Homo sapiens
cctggatcacgacgctgcagag

SEQ ID NO: 3217238 - DNA, 15 bp, Homo sapiens
cctggatccagcact

SEQ ID NO: 3217239 - DNA, 16 bp, Homo sapiens
cctggatctaccagca

SEQ ID NO: 3217240 - DNA, 22 bp, Homo sapiens
cctggatctaccagcataaata

SEQ ID NO: 3217241 - DNA, 21 bp, Homo sapiens
cctggatgagaaacagctcag

SEQ ID NO: 3217242 - DNA, 20 bp, Homo sapiens
cctggatgaggcacttctgt

SEQ ID NO: 3217243 - DNA, 16 bp, Homo sapiens
cctggatgggcattgg

SEQ ID NO: 3217244 - DNA, 22 bp, Homo sapiens
cctggatttatagtatgtgact

SEQ ID NO: 3217245 - DNA, 21 bp, Homo sapiens
cctggatttctggttctgatg

SEQ ID NO: 3217246 - DNA, 12 bp, Homo sapiens
cctggcaatagt

SEQ ID NO: 3217247 - DNA, 21 bp, Homo sapiens
cctggcaatagtgtgttctga

SEQ ID NO: 3217248 - DNA, 21 bp, Homo sapiens
cctggcacacatcaggagttc

SEQ ID NO: 3217249 - DNA, 18 bp, Homo sapiens
cctggcacagggcagtgg

SEQ ID NO: 3217250 - DNA, 21 bp, Homo sapiens
cctggcacatttcagggagaa

SEQ ID NO: 3217251 - DNA, 18 bp, Homo sapiens
cctggcacccggcccctg

SEQ ID NO: 3217252 - DNA, 22 bp, Homo sapiens
cctggcacccggcccctgctgg

SEQ ID NO: 3217253 - DNA, 16 bp, Homo sapiens
cctggcacgccctact

SEQ ID NO: 3217254 - DNA, 21 bp, Homo sapiens
cctggcacgccctactccact

SEQ ID NO: 3217255 - DNA, 13 bp, Homo sapiens
cctggcagcacag

SEQ ID NO: 3217256 - DNA, 22 bp, Homo sapiens
cctgagtcctggtccctctgag

SEQ ID NO: 3217257 - DNA, 14 bp, Homo sapiens
cctgagtcggcccc

SEQ ID NO: 3217258 - DNA, 19 bp, Homo sapiens
cctgagtcggccccacatg

SEQ ID NO: 3217259 - DNA, 21 bp, Homo sapiens
cctgagtcggccccacatggg

SEQ ID NO: 3217260 - DNA, 22 bp, Homo sapiens
cctgagtcgtacagaaagctgc

SEQ ID NO: 3217261 - DNA, 14 bp, Homo sapiens
cctgagtctcctgt

SEQ ID NO: 3217262 - DNA, 15 bp, Homo sapiens
cctgagtctcctgtg

SEQ ID NO: 3217263 - DNA, 16 bp, Homo sapiens
cctgagtctcctgtgc

SEQ ID NO: 3217264 - DNA, 20 bp, Homo sapiens
cctgagtgtgggcttctgaa

SEQ ID NO: 3217265 - DNA, 20 bp, Homo sapiens
cctgagttcatccaggccca

SEQ ID NO: 3217266 - DNA, 17 bp, Homo sapiens
cctgataaagcacagct

SEQ ID NO: 3217267 - DNA, 18 bp, Homo sapiens
cctgataaagcacagctg

SEQ ID NO: 3217268 - DNA, 17 bp, Homo sapiens
cctgatcactagcctgt

SEQ ID NO: 3217269 - DNA, 23 bp, Homo sapiens
cctgatcgccaacctttccccca

SEQ ID NO: 3217270 - DNA, 18 bp, Homo sapiens
cctgatcttacagaaaat

SEQ ID NO: 3217271 - DNA, 16 bp, Homo sapiens
cctgatgagattttta

SEQ ID NO: 3217272 - DNA, 23 bp, Homo sapiens
cctgatgctccctcccctgccct

SEQ ID NO: 3217273 - DNA, 22 bp, Homo sapiens
cctgatgctgccccgttccctg

SEQ ID NO: 3217274 - DNA, 21 bp, Homo sapiens
cctgatggcacttagctatca

SEQ ID NO: 3217275 - DNA, 14 bp, Homo sapiens
cctgatggccaaga

SEQ ID NO: 3217276 - DNA, 16 bp, Homo sapiens
cctgatggccaagagc

SEQ ID NO: 3217277 - DNA, 21 bp, Homo sapiens
cctgatggccaagggggtgga

SEQ ID NO: 3217278 - DNA, 23 bp, Homo sapiens
cctgatggtcagctcccttctct

SEQ ID NO: 3217279 - DNA, 17 bp, Homo sapiens
cctgatgttaaaattcc

SEQ ID NO: 3217280 - DNA, 15 bp, Homo sapiens
cctgattatttatcc

SEQ ID NO: 3217281 - DNA, 13 bp, Homo sapiens
cctgattgacctg

SEQ ID NO: 3217282 - DNA, 15 bp, Homo sapiens
cctgattgtattttt

SEQ ID NO: 3217283 - DNA, 20 bp, Homo sapiens
cctgattgtgtatattcata

SEQ ID NO: 3217284 - DNA, 15 bp, Homo sapiens
cctgatttcagaaga

SEQ ID NO: 3217285 - DNA, 20 bp, Homo sapiens
cctgatttctacaactggag

SEQ ID NO: 3217286 - DNA, 22 bp, Homo sapiens
cctgattttttttccttttaat

SEQ ID NO: 3217287 - DNA, 21 bp, Homo sapiens
cctgcaaacagaacagggtca

SEQ ID NO: 3217288 - DNA, 15 bp, Homo sapiens
cctgcaaagacagta

SEQ ID NO: 3217289 - DNA, 15 bp, Homo sapiens
cctgcaaagctggtt

SEQ ID NO: 3217290 - DNA, 20 bp, Homo sapiens
cctgcaactcaaggactttg

SEQ ID NO: 3217291 - DNA, 18 bp, Homo sapiens
cctgcaacttccgctgag

SEQ ID NO: 3217292 - DNA, 19 bp, Homo sapiens
cctgcaacttccgctgagg

SEQ ID NO: 3217293 - DNA, 16 bp, Homo sapiens
cctgcaagccccaggg

SEQ ID NO: 3217294 - DNA, 20 bp, Homo sapiens
cctgcaagccccagggcctg

SEQ ID NO: 3217295 - DNA, 21 bp, Homo sapiens
cctgcaagccccagggcctgg

SEQ ID NO: 3217296 - DNA, 22 bp, Homo sapiens
cctgcaagccccagggcctggg

SEQ ID NO: 3217297 - DNA, 21 bp, Homo sapiens
cctgcaagcctgtctgagact

SEQ ID NO: 3217298 - DNA, 15 bp, Homo sapiens
cctgcaaggcccaca

SEQ ID NO: 3217299 - DNA, 19 bp, Homo sapiens
cctgcaaggcccacaggag

SEQ ID NO: 3217300 - DNA, 21 bp, Homo sapiens
cctgcaaggcccacaggaggc

SEQ ID NO: 3217301 - DNA, 16 bp, Homo sapiens
cctgcaatcccagcac

SEQ ID NO: 3217302 - DNA, 18 bp, Homo sapiens
cctgcaatcccagcacct

SEQ ID NO: 3217303 - DNA, 20 bp, Homo sapiens
cctgcacaataaaaatgttt

SEQ ID NO: 3217304 - DNA, 22 bp, Homo sapiens
cctgcacacaagcccacagcac

SEQ ID NO: 3217305 - DNA, 17 bp, Homo sapiens
cctgcacaggcacacag

SEQ ID NO: 3217306 - DNA, 15 bp, Homo sapiens
cctgcacctgctgcg

SEQ ID NO: 3217307 - DNA, 19 bp, Homo sapiens
cctgcacctgctgcgtccc

SEQ ID NO: 3217308 - DNA, 14 bp, Homo sapiens
cctgcacctgtgca

SEQ ID NO: 3217309 - DNA, 15 bp, Homo sapiens
cctgcacctgtgcag

SEQ ID NO: 3217310 - DNA, 18 bp, Homo sapiens
cctgcacgtatacaccca

SEQ ID NO: 3217311 - DNA, 18 bp, Homo sapiens
cctgcacgtcatgggagg

SEQ ID NO: 3217312 - DNA, 17 bp, Homo sapiens
cctgcactccccgaacc

SEQ ID NO: 3217313 - DNA, 16 bp, Homo sapiens
cctgcagaggaccaca

SEQ ID NO: 3217314 - DNA, 21 bp, Homo sapiens
cctgcagaggaccacagtggg

SEQ ID NO: 3217315 - DNA, 15 bp, Homo sapiens
cctgcagatgccacc

SEQ ID NO: 3217316 - DNA, 21 bp, Homo sapiens
cctgcagcaaacactccaccc

SEQ ID NO: 3217317 - DNA, 22 bp, Homo sapiens
cctcctgtgtgtgcgcctacag

SEQ ID NO: 3217318 - DNA, 17 bp, Homo sapiens
cctcctgttctgcccac

SEQ ID NO: 3217319 - DNA, 19 bp, Homo sapiens
cctcctgttctgcccacga

SEQ ID NO: 3217320 - DNA, 21 bp, Homo sapiens
cctccttagctttccctgtgc

SEQ ID NO: 3217321 - DNA, 23 bp, Homo sapiens
cctccttagctttccctgtgcca

SEQ ID NO: 3217322 - DNA, 23 bp, Homo sapiens
cctccttatcctacagtacaatc

SEQ ID NO: 3217323 - DNA, 20 bp, Homo sapiens
cctccttccttgctgtccta

SEQ ID NO: 3217324 - DNA, 21 bp, Homo sapiens
cctccttgtctagtttcccac

SEQ ID NO: 3217325 - DNA, 23 bp, Homo sapiens
cctccttgtctagtttcccacat

SEQ ID NO: 3217326 - DNA, 19 bp, Homo sapiens
cctcctttcatcacactgg

SEQ ID NO: 3217327 - DNA, 14 bp, Homo sapiens
cctcctttctgtgc

SEQ ID NO: 3217328 - DNA, 16 bp, Homo sapiens
cctcctttctgtgccc

SEQ ID NO: 3217329 - DNA, 22 bp, Homo sapiens
cctcctttctgtgccctactca

SEQ ID NO: 3217330 - DNA, 16 bp, Homo sapiens
cctcctttgtaaacca

SEQ ID NO: 3217331 - DNA, 21 bp, Homo sapiens
cctcctttttccatgccctaa

SEQ ID NO: 3217332 - DNA, 16 bp, Homo sapiens
cctcgaaccaaggcag

SEQ ID NO: 3217333 - DNA, 20 bp, Homo sapiens
cctcgaaccaaggcagcctc

SEQ ID NO: 3217334 - DNA, 17 bp, Homo sapiens
cctcgacagcgcccctg

SEQ ID NO: 3217335 - DNA, 20 bp, Homo sapiens
cctcgagatgggtgctggtc

SEQ ID NO: 3217336 - DNA, 14 bp, Homo sapiens
cctcgagcagagag

SEQ ID NO: 3217337 - DNA, 16 bp, Homo sapiens
cctcgagcagatgatg

SEQ ID NO: 3217338 - DNA, 22 bp, Homo sapiens
cctcgaggcaccggcgctgcag

SEQ ID NO: 3217339 - DNA, 14 bp, Homo sapiens
cctcgccagcttct

SEQ ID NO: 3217340 - DNA, 16 bp, Homo sapiens
cctcgccagcttctcc

SEQ ID NO: 3217341 - DNA, 19 bp, Homo sapiens
cctcgccagcttctcctgc

SEQ ID NO: 3217342 - DNA, 17 bp, Homo sapiens
cctcgccggccttgttt

SEQ ID NO: 3217343 - DNA, 14 bp, Homo sapiens
cctcgcctccccac

SEQ ID NO: 3217344 - DNA, 13 bp, Homo sapiens
cctcgcctgacaa

SEQ ID NO: 3217345 - DNA, 15 bp, Homo sapiens
cctcgctcccttcaa

SEQ ID NO: 3217346 - DNA, 18 bp, Homo sapiens
cctcggaaccgctcacct

SEQ ID NO: 3217347 - DNA, 22 bp, Homo sapiens
cctcggaagccgtctgactcca

SEQ ID NO: 3217348 - DNA, 18 bp, Homo sapiens
cctcggagagcagcagca

SEQ ID NO: 3217349 - DNA, 21 bp, Homo sapiens
cctcggagcatggtgttttca

SEQ ID NO: 3217350 - DNA, 16 bp, Homo sapiens
cctcggagggatggag

SEQ ID NO: 3217351 - DNA, 22 bp, Homo sapiens
cctcggcctcccaaagtgctgg

SEQ ID NO: 3217352 - DNA, 15 bp, Homo sapiens
cctcggcttgtgggc

SEQ ID NO: 3217353 - DNA, 17 bp, Homo sapiens
cctcggcttgtgggctg

SEQ ID NO: 3217354 - DNA, 17 bp, Homo sapiens
cctcgggaagcagccag

SEQ ID NO: 3217355 - DNA, 14 bp, Homo sapiens
cctcgggcccacct

SEQ ID NO: 3217356 - DNA, 20 bp, Homo sapiens
cctcgggcccacctggccac

SEQ ID NO: 3217357 - DNA, 17 bp, Homo sapiens
cctcgggccgaggccca

SEQ ID NO: 3217358 - DNA, 18 bp, Homo sapiens
cctcgggccgaggcccag

SEQ ID NO: 3217359 - DNA, 18 bp, Homo sapiens
cctcggggacaccagagc

SEQ ID NO: 3217360 - DNA, 22 bp, Homo sapiens
cctcggggggtcacaggcccag

SEQ ID NO: 3217361 - DNA, 17 bp, Homo sapiens
cctcggtggctgcacag

SEQ ID NO: 3217362 - DNA, 14 bp, Homo sapiens
cctcgtccacaggg

SEQ ID NO: 3217363 - DNA, 18 bp, Homo sapiens
cctcgtccacaggggcag

SEQ ID NO: 3217364 - DNA, 21 bp, Homo sapiens
cctcgtccacaggggcaggcc

SEQ ID NO: 3217365 - DNA, 22 bp, Homo sapiens
cctcgtccacaggggcaggcct

SEQ ID NO: 3217366 - DNA, 18 bp, Homo sapiens
cctcgtcctgtcccagag

SEQ ID NO: 3217367 - DNA, 19 bp, Homo sapiens
cctcgtgcctgggggagag

SEQ ID NO: 3217368 - DNA, 18 bp, Homo sapiens
cctcgtggtccccaacag

SEQ ID NO: 3217369 - DNA, 15 bp, Homo sapiens
cctcgttggaagagg

SEQ ID NO: 3217370 - DNA, 19 bp, Homo sapiens
cctctaaggttgggcaggg

SEQ ID NO: 3217371 - DNA, 14 bp, Homo sapiens
cctctactttccag

SEQ ID NO: 3217372 - DNA, 18 bp, Homo sapiens
cctctactttccaggcta

SEQ ID NO: 3217373 - DNA, 16 bp, Homo sapiens
cctctaggcaagcagg

SEQ ID NO: 3217374 - DNA, 23 bp, Homo sapiens
cctctaggcaagcaggacctggc

SEQ ID NO: 3217375 - DNA, 13 bp, Homo sapiens
cctctagtgccct

SEQ ID NO: 3217376 - DNA, 13 bp, Homo sapiens
cctctagtgcctt

SEQ ID NO: 3217377 - DNA, 15 bp, Homo sapiens
cctctagtgccttct

SEQ ID NO: 3217378 - DNA, 16 bp, Homo sapiens
cctctatacatctctc

SEQ ID NO: 3217379 - DNA, 17 bp, Homo sapiens
cctctatacatctctcc

SEQ ID NO: 3217380 - DNA, 14 bp, Homo sapiens
cctctattgatgta

SEQ ID NO: 3217381 - DNA, 23 bp, Homo sapiens
cctctattgatgtacagtctgtc

SEQ ID NO: 3217382 - DNA, 17 bp, Homo sapiens
cctctatttattagcca

SEQ ID NO: 3217383 - DNA, 21 bp, Homo sapiens
cctctatttattagccaactg

SEQ ID NO: 3217384 - DNA, 17 bp, Homo sapiens
cctctcaagtagctggg

SEQ ID NO: 3217385 - DNA, 18 bp, Homo sapiens
cctctcaagtagctggga

SEQ ID NO: 3217386 - DNA, 15 bp, Homo sapiens
cctctcactcctgcc

SEQ ID NO: 3217387 - DNA, 18 bp, Homo sapiens
cctctcactcctgcctcc

SEQ ID NO: 3217388 - DNA, 19 bp, Homo sapiens
cctctcactcctgcctccg

SEQ ID NO: 3217389 - DNA, 18 bp, Homo sapiens
cctctcagctccaggtgg

SEQ ID NO: 3217390 - DNA, 21 bp, Homo sapiens
cctcttccccttgcccttgcc

SEQ ID NO: 3217391 - DNA, 16 bp, Homo sapiens
cctcttcctccctcat

SEQ ID NO: 3217392 - DNA, 20 bp, Homo sapiens
cctcttcctgacgaaactgg

SEQ ID NO: 3217393 - DNA, 21 bp, Homo sapiens
cctcttcctgtgatccaccca

SEQ ID NO: 3217394 - DNA, 17 bp, Homo sapiens
cctcttctattttgtaa

SEQ ID NO: 3217395 - DNA, 15 bp, Homo sapiens
cctcttctcaagtgc

SEQ ID NO: 3217396 - DNA, 19 bp, Homo sapiens
cctcttctcgtgcctcccc

SEQ ID NO: 3217397 - DNA, 16 bp, Homo sapiens
cctcttctgccaagag

SEQ ID NO: 3217398 - DNA, 16 bp, Homo sapiens
cctcttcttcttcaga

SEQ ID NO: 3217399 - DNA, 17 bp, Homo sapiens
cctcttcttcttcagaa

SEQ ID NO: 3217400 - DNA, 14 bp, Homo sapiens
cctcttgccactgc

SEQ ID NO: 3217401 - DNA, 23 bp, Homo sapiens
cctcttgccactgcctcttcctc

SEQ ID NO: 3217402 - DNA, 18 bp, Homo sapiens
cctcttgcctctctcagg

SEQ ID NO: 3217403 - DNA, 16 bp, Homo sapiens
cctcttgctgtctctg

SEQ ID NO: 3217404 - DNA, 18 bp, Homo sapiens
cctcttggaattacaagc

SEQ ID NO: 3217405 - DNA, 23 bp, Homo sapiens
cctcttggaattacaagccctgg

SEQ ID NO: 3217406 - DNA, 23 bp, Homo sapiens
cctcttggtgtgattgcacagaa

SEQ ID NO: 3217407 - DNA, 12 bp, Homo sapiens
cctcttgttttg

SEQ ID NO: 3217408 - DNA, 15 bp, Homo sapiens
cctcttgttttgttt

SEQ ID NO: 3217409 - DNA, 19 bp, Homo sapiens
cctctttactcccttcctg

SEQ ID NO: 3217410 - DNA, 23 bp, Homo sapiens
cctctttcaagcagtcgtgcctg

SEQ ID NO: 3217411 - DNA, 14 bp, Homo sapiens
cctctttccctgcg

SEQ ID NO: 3217412 - DNA, 19 bp, Homo sapiens
cctcttttgttaaataata

SEQ ID NO: 3217413 - DNA, 13 bp, Homo sapiens
cctcttttttcgt

SEQ ID NO: 3217414 - DNA, 19 bp, Homo sapiens
cctcttttttcgtttgttt

SEQ ID NO: 3217415 - DNA, 21 bp, Homo sapiens
cctgaaaatgtttttctgcca

SEQ ID NO: 3217416 - DNA, 13 bp, Homo sapiens
cctgaaaattgta

SEQ ID NO: 3217417 - DNA, 18 bp, Homo sapiens
cctgaaacagccatgtcc

SEQ ID NO: 3217418 - DNA, 22 bp, Homo sapiens
cctgaaagaggctgaggcctgg

SEQ ID NO: 3217419 - DNA, 14 bp, Homo sapiens
cctgaaagggcact

SEQ ID NO: 3217420 - DNA, 20 bp, Homo sapiens
cctgaaagggcacttaattt

SEQ ID NO: 3217421 - DNA, 14 bp, Homo sapiens
cctgaaataaacac

SEQ ID NO: 3217422 - DNA, 15 bp, Homo sapiens
cctgaaataaacact

SEQ ID NO: 3217423 - DNA, 14 bp, Homo sapiens
cctgaaattccaaa

SEQ ID NO: 3217424 - DNA, 15 bp, Homo sapiens
cctgaaattccaaag

SEQ ID NO: 3217425 - DNA, 21 bp, Homo sapiens
cctgaacaagaattggaagct

SEQ ID NO: 3217426 - DNA, 14 bp, Homo sapiens
cctgaaccatgtgg

SEQ ID NO: 3217427 - DNA, 17 bp, Homo sapiens
cctgaaccccatgggct

SEQ ID NO: 3217428 - DNA, 18 bp, Homo sapiens
cctgaaccccatgggctt

SEQ ID NO: 3217429 - DNA, 19 bp, Homo sapiens
cctgaaccccatgggcttg

SEQ ID NO: 3217430 - DNA, 15 bp, Homo sapiens
cctgaaccgcacagc

SEQ ID NO: 3217431 - DNA, 20 bp, Homo sapiens
cctgaaccgcacagctcagg

SEQ ID NO: 3217432 - DNA, 22 bp, Homo sapiens
cctgaaccgcacagctcaggag

SEQ ID NO: 3217433 - DNA, 14 bp, Homo sapiens
cctgaactgaggag

SEQ ID NO: 3217434 - DNA, 13 bp, Homo sapiens
cctgaactttctc

SEQ ID NO: 3217435 - DNA, 21 bp, Homo sapiens
cctgaagactcattcttctgt

SEQ ID NO: 3217436 - DNA, 16 bp, Homo sapiens
cctgaagtcacacagt

SEQ ID NO: 3217437 - DNA, 19 bp, Homo sapiens
cctgaagtcacacagtgag

SEQ ID NO: 3217438 - DNA, 20 bp, Homo sapiens
cctgaagtcacacagtgagt

SEQ ID NO: 3217439 - DNA, 20 bp, Homo sapiens
cctgaataccacttacctca

SEQ ID NO: 3217440 - DNA, 18 bp, Homo sapiens
cctgaatctgtgcaaaca

SEQ ID NO: 3217441 - DNA, 21 bp, Homo sapiens
cctgaatgtttaaagatcatg

SEQ ID NO: 3217442 - DNA, 12 bp, Homo sapiens
cctgaatttccc

SEQ ID NO: 3217443 - DNA, 21 bp, Homo sapiens
cctgaattttgttgctgtttt

SEQ ID NO: 3217444 - DNA, 18 bp, Homo sapiens
cctgacaaccactggtct

SEQ ID NO: 3217445 - DNA, 17 bp, Homo sapiens
cctgacaatggcagcta

SEQ ID NO: 3217446 - DNA, 18 bp, Homo sapiens
cctgacaatggcagctag

SEQ ID NO: 3217447 - DNA, 14 bp, Homo sapiens
cctgacacactaac

SEQ ID NO: 3217448 - DNA, 23 bp, Homo sapiens
cctgacacactaaccaagctgag

SEQ ID NO: 3217449 - DNA, 19 bp, Homo sapiens
cctaagggtcgaaagctct

SEQ ID NO: 3217450 - DNA, 14 bp, Homo sapiens
cctaagtactgtaa

SEQ ID NO: 3217451 - DNA, 16 bp, Homo sapiens
cctaagtcctttatgt

SEQ ID NO: 3217452 - DNA, 16 bp, Homo sapiens
cctaagtgcccaaagt

SEQ ID NO: 3217453 - DNA, 17 bp, Homo sapiens
cctaagtgcccaaagtg

SEQ ID NO: 3217454 - DNA, 21 bp, Homo sapiens
cctaatccctgggcattgctt

SEQ ID NO: 3217455 - DNA, 14 bp, Homo sapiens
cctaatctcatacc

SEQ ID NO: 3217456 - DNA, 18 bp, Homo sapiens
cctaatctcatacctctg

SEQ ID NO: 3217457 - DNA, 21 bp, Homo sapiens
cctaatctcatacctctgacc

SEQ ID NO: 3217458 - DNA, 18 bp, Homo sapiens
cctaatgtctcactgttc

SEQ ID NO: 3217459 - DNA, 23 bp, Homo sapiens
cctaatgtctcactgttctgcaa

SEQ ID NO: 3217460 - DNA, 21 bp, Homo sapiens
cctaattaatatattaaaatt

SEQ ID NO: 3217461 - DNA, 16 bp, Homo sapiens
cctaattaccagtctt

SEQ ID NO: 3217462 - DNA, 15 bp, Homo sapiens
cctaattcttctgtc

SEQ ID NO: 3217463 - DNA, 14 bp, Homo sapiens
cctaatttatgtgc

SEQ ID NO: 3217464 - DNA, 14 bp, Homo sapiens
cctaatttctcctc

SEQ ID NO: 3217465 - DNA, 18 bp, Homo sapiens
cctaattttaaataattt

SEQ ID NO: 3217466 - DNA, 20 bp, Homo sapiens
cctacaaccatccctgccac

SEQ ID NO: 3217467 - DNA, 19 bp, Homo sapiens
cctacaagagcagcctgtg

SEQ ID NO: 3217468 - DNA, 21 bp, Homo sapiens
cctacaagagcagcctgtggc

SEQ ID NO: 3217469 - DNA, 16 bp, Homo sapiens
cctacaataaactggt

SEQ ID NO: 3217470 - DNA, 21 bp, Homo sapiens
cctacactgatgcaaggatta

SEQ ID NO: 3217471 - DNA, 16 bp, Homo sapiens
cctacagacaaggagg

SEQ ID NO: 3217472 - DNA, 17 bp, Homo sapiens
cctacagaggtctctgc

SEQ ID NO: 3217473 - DNA, 14 bp, Homo sapiens
cctacagatgaact

SEQ ID NO: 3217474 - DNA, 17 bp, Homo sapiens
cctacagctttgatccc

SEQ ID NO: 3217475 - DNA, 13 bp, Homo sapiens
cctacagtacaat

SEQ ID NO: 3217476 - DNA, 22 bp, Homo sapiens
cctacagttttaactgtggata

SEQ ID NO: 3217477 - DNA, 16 bp, Homo sapiens
cctacattccctctcc

SEQ ID NO: 3217478 - DNA, 18 bp, Homo sapiens
cctacattccctctcctg

SEQ ID NO: 3217479 - DNA, 23 bp, Homo sapiens
cctacattccctctcctgcccag

SEQ ID NO: 3217480 - DNA, 13 bp, Homo sapiens
cctaccacagtgt

SEQ ID NO: 3217481 - DNA, 15 bp, Homo sapiens
cctaccacagtgtct

SEQ ID NO: 3217482 - DNA, 15 bp, Homo sapiens
cctaccagttgccct

SEQ ID NO: 3217483 - DNA, 16 bp, Homo sapiens
cctaccatcagggaca

SEQ ID NO: 3217484 - DNA, 13 bp, Homo sapiens
cctacccaccctc

SEQ ID NO: 3217485 - DNA, 14 bp, Homo sapiens
cctaccctggactt

SEQ ID NO: 3217486 - DNA, 20 bp, Homo sapiens
cctaccgaaaccttgccttt

SEQ ID NO: 3217487 - DNA, 16 bp, Homo sapiens
cctaccgagtctcttc

SEQ ID NO: 3217488 - DNA, 23 bp, Homo sapiens
cctaccgagtctcttctccactg

SEQ ID NO: 3217489 - DNA, 19 bp, Homo sapiens
cctacctcaggttgctggt

SEQ ID NO: 3217490 - DNA, 23 bp, Homo sapiens
cctacctcaggttgctggttgct

SEQ ID NO: 3217491 - DNA, 13 bp, Homo sapiens
cctacctgatgga

SEQ ID NO: 3217492 - DNA, 14 bp, Homo sapiens
cctacctgtgcctg

SEQ ID NO: 3217493 - DNA, 21 bp, Homo sapiens
cctacgagggaggaacacctg

SEQ ID NO: 3217494 - DNA, 22 bp, Homo sapiens
cctacgagggaggaacacctga

SEQ ID NO: 3217495 - DNA, 20 bp, Homo sapiens
cctactaaaaaagttattat

SEQ ID NO: 3217496 - DNA, 19 bp, Homo sapiens
cctactaggagaggggggc

SEQ ID NO: 3217497 - DNA, 17 bp, Homo sapiens
cctactatgtgctgggt

SEQ ID NO: 3217498 - DNA, 19 bp, Homo sapiens
cctactatgtgctgggtgc

SEQ ID NO: 3217499 - DNA, 21 bp, Homo sapiens
cctactatgtgctgggtgcct

SEQ ID NO: 3217500 - DNA, 17 bp, Homo sapiens
cctactccactgccctg

SEQ ID NO: 3217501 - DNA, 18 bp, Homo sapiens
cctactccctcttccaaa

SEQ ID NO: 3217502 - DNA, 13 bp, Homo sapiens
cctactccctgca

SEQ ID NO: 3217503 - DNA, 20 bp, Homo sapiens
cctactcctgactcctacct

SEQ ID NO: 3217504 - DNA, 15 bp, Homo sapiens
cctactcttcagggt

SEQ ID NO: 3217505 - DNA, 15 bp, Homo sapiens
cctactgtcctcaga

SEQ ID NO: 3217506 - DNA, 16 bp, Homo sapiens
cctactgtcctcagag

SEQ ID NO: 3217507 - DNA, 15 bp, Homo sapiens
cctactgttcctttc

SEQ ID NO: 3217508 - DNA, 17 bp, Homo sapiens
cctactgttcctttcag

SEQ ID NO: 3217509 - DNA, 15 bp, Homo sapiens
cctactgttctaaag

SEQ ID NO: 3217510 - DNA, 13 bp, Homo sapiens
cctacttcctgtg

SEQ ID NO: 3217511 - DNA, 20 bp, Homo sapiens
cctacttctgactttacttg

SEQ ID NO: 3217512 - DNA, 15 bp, Homo sapiens
cctactttgactttt

SEQ ID NO: 3217513 - DNA, 19 bp, Homo sapiens
cctactttgcttccgccac

SEQ ID NO: 3217514 - DNA, 18 bp, Homo sapiens
cctagaaacccaagctcc

SEQ ID NO: 3217515 - DNA, 21 bp, Homo sapiens
cctagaacactaactcaccag

SEQ ID NO: 3217516 - DNA, 15 bp, Homo sapiens
cctagaatctttatt

SEQ ID NO: 3217517 - DNA, 16 bp, Homo sapiens
cctagaattttctccc

SEQ ID NO: 3217518 - DNA, 19 bp, Homo sapiens
cctagactgtaaacctctc

SEQ ID NO: 3217519 - DNA, 14 bp, Homo sapiens
cctagactgttact

SEQ ID NO: 3217520 - DNA, 20 bp, Homo sapiens
cctagacttcccaacagcct

SEQ ID NO: 3217521 - DNA, 21 bp, Homo sapiens
cctagagaagataattgttga

SEQ ID NO: 3217522 - DNA, 13 bp, Homo sapiens
cctagagccagac

SEQ ID NO: 3217523 - DNA, 16 bp, Homo sapiens
cctagagccagaccaa

SEQ ID NO: 3217524 - DNA, 16 bp, Homo sapiens
cctagatcctaagggt

SEQ ID NO: 3217525 - DNA, 16 bp, Homo sapiens
cctagcagtgaactat

SEQ ID NO: 3217526 - DNA, 22 bp, Homo sapiens
cctagcattgcacttggcctca

SEQ ID NO: 3217527 - DNA, 16 bp, Homo sapiens
cctagccattcctggt

SEQ ID NO: 3217528 - DNA, 23 bp, Homo sapiens
cctagcccagcgctctgcctcac

SEQ ID NO: 3217529 - DNA, 19 bp, Homo sapiens
cctagcccaggagagagaa

SEQ ID NO: 3217530 - DNA, 18 bp, Homo sapiens
cctagcccttgtcccttt

SEQ ID NO: 3217531 - DNA, 20 bp, Homo sapiens
cctagcctgtgcctctggga

SEQ ID NO: 3217532 - DNA, 19 bp, Homo sapiens
cctagccttagaagtcaca

SEQ ID NO: 3217533 - DNA, 21 bp, Homo sapiens
cctagcgatctctcctggcct

SEQ ID NO: 3217534 - DNA, 16 bp, Homo sapiens
cctagctgtgtgaata

SEQ ID NO: 3217535 - DNA, 22 bp, Homo sapiens
cctagctgtgtgaatacctgct

SEQ ID NO: 3217536 - DNA, 17 bp, Homo sapiens
cctagctttagaccctg

SEQ ID NO: 3217537 - DNA, 18 bp, Homo sapiens
cctagctttagaccctgg

SEQ ID NO: 3217538 - DNA, 20 bp, Homo sapiens
cctagctttagaccctgggt

SEQ ID NO: 3217539 - DNA, 21 bp, Homo sapiens
cagggaaggtggggccctgcc

SEQ ID NO: 3217540 - DNA, 16 bp, Homo sapiens
cagggaatcagggacc

SEQ ID NO: 3217541 - DNA, 20 bp, Homo sapiens
cagggaatcagggaccagct

SEQ ID NO: 3217542 - DNA, 14 bp, Homo sapiens
cagggaatccaagc

SEQ ID NO: 3217543 - DNA, 18 bp, Homo sapiens
cagggaatccaagcctcc

SEQ ID NO: 3217544 - DNA, 12 bp, Homo sapiens
cagggaatccag

SEQ ID NO: 3217545 - DNA, 15 bp, Homo sapiens
cagggaatggagaat

SEQ ID NO: 3217546 - DNA, 16 bp, Homo sapiens
cagggaatttctatct

SEQ ID NO: 3217547 - DNA, 21 bp, Homo sapiens
cagggacaaaacactgtgtcc

SEQ ID NO: 3217548 - DNA, 21 bp, Homo sapiens
cagggacaagccctggagaaa

SEQ ID NO: 3217549 - DNA, 19 bp, Homo sapiens
cagggacacaaagaggaat

SEQ ID NO: 3217550 - DNA, 15 bp, Homo sapiens
cagggacagagccat

SEQ ID NO: 3217551 - DNA, 12 bp, Homo sapiens
cagggacaggat

SEQ ID NO: 3217552 - DNA, 20 bp, Homo sapiens
cagggaccactgggtgagag

SEQ ID NO: 3217553 - DNA, 19 bp, Homo sapiens
cagggaccggtgctgcagg

SEQ ID NO: 3217554 - DNA, 14 bp, Homo sapiens
cagggacttggaca

SEQ ID NO: 3217555 - DNA, 16 bp, Homo sapiens
cagggacttggacagg

SEQ ID NO: 3217556 - DNA, 15 bp, Homo sapiens
cagggagcaagacag

SEQ ID NO: 3217557 - DNA, 16 bp, Homo sapiens
cagggagcaagacaga

SEQ ID NO: 3217558 - DNA, 12 bp, Homo sapiens
cagggagcctcc

SEQ ID NO: 3217559 - DNA, 22 bp, Homo sapiens
cagggagcctttggttctggcc

SEQ ID NO: 3217560 - DNA, 18 bp, Homo sapiens
cagggaggaggtggcagc

SEQ ID NO: 3217561 - DNA, 19 bp, Homo sapiens
cagggaggaggtggcagcc

SEQ ID NO: 3217562 - DNA, 20 bp, Homo sapiens
cagggaggaggtggcagccc

SEQ ID NO: 3217563 - DNA, 18 bp, Homo sapiens
cagggagggaagtgtgag

SEQ ID NO: 3217564 - DNA, 13 bp, Homo sapiens
cagggaggggagg

SEQ ID NO: 3217565 - DNA, 14 bp, Homo sapiens
cagggaggggaggc

SEQ ID NO: 3217566 - DNA, 16 bp, Homo sapiens
cagggaggggaggcag

SEQ ID NO: 3217567 - DNA, 20 bp, Homo sapiens
cagggaggtcaggccctgga

SEQ ID NO: 3217568 - DNA, 15 bp, Homo sapiens
cagggagtgatgatt

SEQ ID NO: 3217569 - DNA, 22 bp, Homo sapiens
cagggagtgctggctcacagta

SEQ ID NO: 3217570 - DNA, 18 bp, Homo sapiens
cagggatgctgggctggg

SEQ ID NO: 3217571 - DNA, 17 bp, Homo sapiens
cagggatgggggtggct

SEQ ID NO: 3217572 - DNA, 18 bp, Homo sapiens
cagggatgggggtggctg

SEQ ID NO: 3217573 - DNA, 17 bp, Homo sapiens
cagggattaacctctgc

SEQ ID NO: 3217574 - DNA, 18 bp, Homo sapiens
cagggattaacctctgca

SEQ ID NO: 3217575 - DNA, 14 bp, Homo sapiens
cagggcaaatgaca

SEQ ID NO: 3217576 - DNA, 21 bp, Homo sapiens
cagggcaaatgacatgcactg

SEQ ID NO: 3217577 - DNA, 18 bp, Homo sapiens
cagggcaatgatgaatga

SEQ ID NO: 3217578 - DNA, 15 bp, Homo sapiens
cagggcacaccgggc

SEQ ID NO: 3217579 - DNA, 17 bp, Homo sapiens
cagggcacaccgggcac

SEQ ID NO: 3217580 - DNA, 16 bp, Homo sapiens
cagggcacgcaggacc

SEQ ID NO: 3217581 - DNA, 18 bp, Homo sapiens
cagggcacgcaggaccag

SEQ ID NO: 3217582 - DNA, 19 bp, Homo sapiens
cagggcacgcaggaccagt

SEQ ID NO: 3217583 - DNA, 22 bp, Homo sapiens
cagggcaggggatgcccagaag

SEQ ID NO: 3217584 - DNA, 15 bp, Homo sapiens
cagggcaggggtggt

SEQ ID NO: 3217585 - DNA, 17 bp, Homo sapiens
cagggcagggtgggcag

SEQ ID NO: 3217586 - DNA, 23 bp, Homo sapiens
cagggcagggtgggcagcctatg

SEQ ID NO: 3217587 - DNA, 22 bp, Homo sapiens
cagggcagtgctagtgagctgg

SEQ ID NO: 3217588 - DNA, 13 bp, Homo sapiens
cagggcatctcct

SEQ ID NO: 3217589 - DNA, 14 bp, Homo sapiens
cagggcatctcctg

SEQ ID NO: 3217590 - DNA, 19 bp, Homo sapiens
cagggcatgcattttgcag

SEQ ID NO: 3217591 - DNA, 14 bp, Homo sapiens
cagggcattcgggc

SEQ ID NO: 3217592 - DNA, 19 bp, Homo sapiens
cagggcattcgggccacag

SEQ ID NO: 3217593 - DNA, 22 bp, Homo sapiens
cagggcattcgggccacagggc

SEQ ID NO: 3217594 - DNA, 17 bp, Homo sapiens
cagggccaacttgaggg

SEQ ID NO: 3217595 - DNA, 18 bp, Homo sapiens
cagggccaccccactcta

SEQ ID NO: 3217596 - DNA, 22 bp, Homo sapiens
cagggccaccccactctacctc

SEQ ID NO: 3217597 - DNA, 16 bp, Homo sapiens
cagggccacgctccag

SEQ ID NO: 3217598 - DNA, 17 bp, Homo sapiens
cagggccacgctccagc

SEQ ID NO: 3217599 - DNA, 21 bp, Homo sapiens
cagggccagaaggagggcaga

SEQ ID NO: 3217600 - DNA, 23 bp, Homo sapiens
cagggccagactggaagacactt

SEQ ID NO: 3217601 - DNA, 12 bp, Homo sapiens
cagggccagagg

SEQ ID NO: 3217602 - DNA, 13 bp, Homo sapiens
cagggccagggcc

SEQ ID NO: 3217603 - DNA, 15 bp, Homo sapiens
cagggccagggccct

SEQ ID NO: 3217604 - DNA, 21 bp, Homo sapiens
cagggccagtcctcctgggag

SEQ ID NO: 3217605 - DNA, 15 bp, Homo sapiens
cagggccagtggggc

SEQ ID NO: 3217606 - DNA, 17 bp, Homo sapiens
cagggccagtggggcct

SEQ ID NO: 3217607 - DNA, 18 bp, Homo sapiens
cagggccagtggggcctg

SEQ ID NO: 3217608 - DNA, 19 bp, Homo sapiens
cagggccagtggggcctgt

SEQ ID NO: 3217609 - DNA, 23 bp, Homo sapiens
cagggccatctgactgccaagcc

SEQ ID NO: 3217610 - DNA, 14 bp, Homo sapiens
cagggccatgctga

SEQ ID NO: 3217611 - DNA, 16 bp, Homo sapiens
cagggccatgctgagg

SEQ ID NO: 3217612 - DNA, 17 bp, Homo sapiens
cagggccatgctgaggc

SEQ ID NO: 3217613 - DNA, 22 bp, Homo sapiens
cagggccatgctgaggcctggg

SEQ ID NO: 3217614 - DNA, 19 bp, Homo sapiens
cagggcccaagtccctgtt

SEQ ID NO: 3217615 - DNA, 16 bp, Homo sapiens
cagggcccagaggctg

SEQ ID NO: 3217616 - DNA, 15 bp, Homo sapiens
cagggccccagaagg

SEQ ID NO: 3217617 - DNA, 15 bp, Homo sapiens
cagggcccctccctc

SEQ ID NO: 3217618 - DNA, 19 bp, Homo sapiens
cagggcccctccctctgcc

SEQ ID NO: 3217619 - DNA, 22 bp, Homo sapiens
cagggcccctccctctgcccca

SEQ ID NO: 3217620 - DNA, 17 bp, Homo sapiens
cagggcccgcagtgctg

SEQ ID NO: 3217621 - DNA, 18 bp, Homo sapiens
cagggcccgcagtgctgg

SEQ ID NO: 3217622 - DNA, 20 bp, Homo sapiens
cagggcccggccacacccag

SEQ ID NO: 3217623 - DNA, 13 bp, Homo sapiens
cagggccctgcag

SEQ ID NO: 3217624 - DNA, 14 bp, Homo sapiens
cagggccctgcaga

SEQ ID NO: 3217625 - DNA, 17 bp, Homo sapiens
cagggcccttggggctg

SEQ ID NO: 3217626 - DNA, 20 bp, Homo sapiens
cagggcccttggggctgggg

SEQ ID NO: 3217627 - DNA, 16 bp, Homo sapiens
ccctgcccaaaccctt

SEQ ID NO: 3217628 - DNA, 14 bp, Homo sapiens
ccctgcccaagggc

SEQ ID NO: 3217629 - DNA, 16 bp, Homo sapiens
ccctgcccaagggcct

SEQ ID NO: 3217630 - DNA, 13 bp, Homo sapiens
ccctgccccagcc

SEQ ID NO: 3217631 - DNA, 15 bp, Homo sapiens
ccctgccccagccca

SEQ ID NO: 3217632 - DNA, 19 bp, Homo sapiens
ccctgccccagcccaagtc

SEQ ID NO: 3217633 - DNA, 22 bp, Homo sapiens
ccctgcccccatctccccaggc

SEQ ID NO: 3217634 - DNA, 21 bp, Homo sapiens
ccctgccccccctaagagaca

SEQ ID NO: 3217635 - DNA, 17 bp, Homo sapiens
ccctgcccctcccttca

SEQ ID NO: 3217636 - DNA, 18 bp, Homo sapiens
ccctgcccctcccttcaa

SEQ ID NO: 3217637 - DNA, 14 bp, Homo sapiens
ccctgcccggctgc

SEQ ID NO: 3217638 - DNA, 22 bp, Homo sapiens
ccctgcccggtggtttgccatg

SEQ ID NO: 3217639 - DNA, 16 bp, Homo sapiens
ccctgccctcgtggcc

SEQ ID NO: 3217640 - DNA, 12 bp, Homo sapiens
ccctgccctggt

SEQ ID NO: 3217641 - DNA, 14 bp, Homo sapiens
ccctgccctggtcc

SEQ ID NO: 3217642 - DNA, 13 bp, Homo sapiens
ccctgcctgccca

SEQ ID NO: 3217643 - DNA, 13 bp, Homo sapiens
ccctgcctggaac

SEQ ID NO: 3217644 - DNA, 11 bp, Homo sapiens
ccctgcctggg

SEQ ID NO: 3217645 - DNA, 14 bp, Homo sapiens
ccctgcctgggttg

SEQ ID NO: 3217646 - DNA, 22 bp, Homo sapiens
ccctgccttatcttgcacccca

SEQ ID NO: 3217647 - DNA, 22 bp, Homo sapiens
ccctgccttgggccttgctgct

SEQ ID NO: 3217648 - DNA, 17 bp, Homo sapiens
ccctgcgaaggggccct

SEQ ID NO: 3217649 - DNA, 21 bp, Homo sapiens
ccctgcgaaggggccctggtc

SEQ ID NO: 3217650 - DNA, 22 bp, Homo sapiens
ccctgcgcctgtgatgctgggc

SEQ ID NO: 3217651 - DNA, 13 bp, Homo sapiens
ccctgcggcctcc

SEQ ID NO: 3217652 - DNA, 18 bp, Homo sapiens
ccctgcgggcgcgggcag

SEQ ID NO: 3217653 - DNA, 21 bp, Homo sapiens
ccctgcgggcgcgggcagcca

SEQ ID NO: 3217654 - DNA, 21 bp, Homo sapiens
ccctgcggtcaggctgggcag

SEQ ID NO: 3217655 - DNA, 15 bp, Homo sapiens
ccctgcgtggcctga

SEQ ID NO: 3217656 - DNA, 17 bp, Homo sapiens
ccctgcgtggcctgagt

SEQ ID NO: 3217657 - DNA, 22 bp, Homo sapiens
ccctgcgtgggggccagtcagg

SEQ ID NO: 3217658 - DNA, 11 bp, Homo sapiens
ccctgctacct

SEQ ID NO: 3217659 - DNA, 17 bp, Homo sapiens
ccctgctacctgttctt

SEQ ID NO: 3217660 - DNA, 13 bp, Homo sapiens
ccctgctcagtgc

SEQ ID NO: 3217661 - DNA, 16 bp, Homo sapiens
ccctgctcagtgcttg

SEQ ID NO: 3217662 - DNA, 17 bp, Homo sapiens
ccctgctccaccagcag

SEQ ID NO: 3217663 - DNA, 17 bp, Homo sapiens
ccctgctcccacagaac

SEQ ID NO: 3217664 - DNA, 14 bp, Homo sapiens
ccctgctcccattc

SEQ ID NO: 3217665 - DNA, 14 bp, Homo sapiens
ccctgctcctcctg

SEQ ID NO: 3217666 - DNA, 19 bp, Homo sapiens
ccctgctctacccatgagc

SEQ ID NO: 3217667 - DNA, 21 bp, Homo sapiens
ccctgctctacccatgagcct

SEQ ID NO: 3217668 - DNA, 23 bp, Homo sapiens
ccctgctctacccatgagcctgc

SEQ ID NO: 3217669 - DNA, 21 bp, Homo sapiens
ccctgctctccgaccagacac

SEQ ID NO: 3217670 - DNA, 22 bp, Homo sapiens
ccctgctctccgaccagacacc

SEQ ID NO: 3217671 - DNA, 20 bp, Homo sapiens
ccctgctgccgcctcccagc

SEQ ID NO: 3217672 - DNA, 22 bp, Homo sapiens
ccctgctgccgcctcccagcct

SEQ ID NO: 3217673 - DNA, 23 bp, Homo sapiens
ccctgctgccgcctcccagcctg

SEQ ID NO: 3217674 - DNA, 20 bp, Homo sapiens
ccctgctgctgccagggctt

SEQ ID NO: 3217675 - DNA, 19 bp, Homo sapiens
ccctgctggttcagggttg

SEQ ID NO: 3217676 - DNA, 17 bp, Homo sapiens
ccctgctgtgccatgct

SEQ ID NO: 3217677 - DNA, 18 bp, Homo sapiens
ccctgctgtgctgctcaa

SEQ ID NO: 3217678 - DNA, 14 bp, Homo sapiens
ccctgcttccagga

SEQ ID NO: 3217679 - DNA, 12 bp, Homo sapiens
ccctgcttctcc

SEQ ID NO: 3217680 - DNA, 23 bp, Homo sapiens
ccctgcttctccagcctggaccc

SEQ ID NO: 3217681 - DNA, 18 bp, Homo sapiens
ccctgctttggctgaggg

SEQ ID NO: 3217682 - DNA, 22 bp, Homo sapiens
ccctgctttttttcttaaaagt

SEQ ID NO: 3217683 - DNA, 19 bp, Homo sapiens
ccctggaaaggggagttga

SEQ ID NO: 3217684 - DNA, 9 bp, Homo sapiens
ccctggaat

SEQ ID NO: 3217685 - DNA, 18 bp, Homo sapiens
ccctggaattcagcaccc

SEQ ID NO: 3217686 - DNA, 19 bp, Homo sapiens
ccctggaattcagcaccct

SEQ ID NO: 3217687 - DNA, 21 bp, Homo sapiens
ccctggaattcagcaccctgg

SEQ ID NO: 3217688 - DNA, 23 bp, Homo sapiens
ccctggaattcagcaccctgggt

SEQ ID NO: 3217689 - DNA, 13 bp, Homo sapiens
ccctggacacagc

SEQ ID NO: 3217690 - DNA, 16 bp, Homo sapiens
ccctggacacagctct

SEQ ID NO: 3217691 - DNA, 17 bp, Homo sapiens
ccctggacacagctctt

SEQ ID NO: 3217692 - DNA, 17 bp, Homo sapiens
ccctggacttgcctctg

SEQ ID NO: 3217693 - DNA, 14 bp, Homo sapiens
ccctggagcaggag

SEQ ID NO: 3217694 - DNA, 12 bp, Homo sapiens
ccctggagccct

SEQ ID NO: 3217695 - DNA, 18 bp, Homo sapiens
ccctggagcctccactgc

SEQ ID NO: 3217696 - DNA, 19 bp, Homo sapiens
ccctggaggcactgaagtg

SEQ ID NO: 3217697 - DNA, 23 bp, Homo sapiens
ccctggatcacgacgctgcagag

SEQ ID NO: 3217698 - DNA, 24 bp, Homo sapiens
ccctggatcacgacgctgcagagc

SEQ ID NO: 3217699 - DNA, 11 bp, Homo sapiens
ccctggcaccc

SEQ ID NO: 3217700 - DNA, 16 bp, Homo sapiens
ccctggcagcacagcc

SEQ ID NO: 3217701 - DNA, 23 bp, Homo sapiens
ccctggcagcacagcccagggcc

SEQ ID NO: 3217702 - DNA, 13 bp, Homo sapiens
ccctggcagcagc

SEQ ID NO: 3217703 - DNA, 16 bp, Homo sapiens
ccctggcagcagcagg

SEQ ID NO: 3217704 - DNA, 19 bp, Homo sapiens
ccctggcaggatgctgagc

SEQ ID NO: 3217705 - DNA, 15 bp, Homo sapiens
ccctggccagccctt

SEQ ID NO: 3217706 - DNA, 15 bp, Homo sapiens
ccctggcccatctca

SEQ ID NO: 3217707 - DNA, 19 bp, Homo sapiens
ccctggcccatctcagcct

SEQ ID NO: 3217708 - DNA, 22 bp, Homo sapiens
ccctggcccatctcagcctcct

SEQ ID NO: 3217709 - DNA, 20 bp, Homo sapiens
ccctggccccctccctggat

SEQ ID NO: 3217710 - DNA, 21 bp, Homo sapiens
ccctggccccctccctggatg

SEQ ID NO: 3217711 - DNA, 10 bp, Homo sapiens
ccctggccct

SEQ ID NO: 3217712 - DNA, 16 bp, Homo sapiens
ccctggccctgaggtg

SEQ ID NO: 3217713 - DNA, 17 bp, Homo sapiens
ccctggccctttcccct

SEQ ID NO: 3217714 - DNA, 22 bp, Homo sapiens
ccctggccctttccccttcccc

SEQ ID NO: 3217715 - DNA, 22 bp, Homo sapiens
ccctggcctcagttcccagctc

SEQ ID NO: 3217716 - DNA, 14 bp, Homo sapiens
ccctggcctcccct

SEQ ID NO: 3217717 - DNA, 14 bp, Homo sapiens
ccctggcctgaact

SEQ ID NO: 3217718 - DNA, 20 bp, Homo sapiens
ccctggcctgaactgaggag

SEQ ID NO: 3217719 - DNA, 20 bp, Homo sapiens
ccctggccttaaaaggggcc

SEQ ID NO: 3217720 - DNA, 12 bp, Homo sapiens
ccctggctccct

SEQ ID NO: 3217721 - DNA, 13 bp, Homo sapiens
ccctggctccctc

SEQ ID NO: 3217722 - DNA, 13 bp, Homo sapiens
ccctggctgccct

SEQ ID NO: 3217723 - DNA, 15 bp, Homo sapiens
ccctggctgccctgg

SEQ ID NO: 3217724 - DNA, 19 bp, Homo sapiens
ccctggctgccctggccct

SEQ ID NO: 3217725 - DNA, 15 bp, Homo sapiens
ccctggctgctgccc

SEQ ID NO: 3217726 - DNA, 22 bp, Homo sapiens
ccctggctgctgcccccacccc

SEQ ID NO: 3217727 - DNA, 22 bp, Homo sapiens
ccctggctgttctgtggttcct

SEQ ID NO: 3217728 - DNA, 19 bp, Homo sapiens
ccctggcttttcactgctg

SEQ ID NO: 3217729 - DNA, 18 bp, Homo sapiens
ccctgggaaccactccca

SEQ ID NO: 3217730 - DNA, 16 bp, Homo sapiens
ccctgggaaggctaag

SEQ ID NO: 3217731 - DNA, 17 bp, Homo sapiens
ccctgggagccagtcct

SEQ ID NO: 3217732 - DNA, 19 bp, Homo sapiens
ccctgggatgggaccaggg

SEQ ID NO: 3217733 - DNA, 13 bp, Homo sapiens
ccctgggctctgc

SEQ ID NO: 3217734 - DNA, 12 bp, Homo sapiens
ccctgggctgga

SEQ ID NO: 3217735 - DNA, 15 bp, Homo sapiens
ccctgggctggactg

SEQ ID NO: 3217736 - DNA, 16 bp, Homo sapiens
ccctgggctggactgg

SEQ ID NO: 3217737 - DNA, 17 bp, Homo sapiens
ccctgggctggactgga

SEQ ID NO: 3217738 - DNA, 16 bp, Homo sapiens
ccctgggctgtctgtc

SEQ ID NO: 3217739 - DNA, 18 bp, Homo sapiens
ccctgggctgtctgtcac

SEQ ID NO: 3217740 - DNA, 20 bp, Homo sapiens
ccctgggctgtctgtcacca

SEQ ID NO: 3217741 - DNA, 17 bp, Homo sapiens
ccctgggcttggcctgc

SEQ ID NO: 3217742 - DNA, 15 bp, Homo sapiens
ccctggggcctagac

SEQ ID NO: 3217743 - DNA, 18 bp, Homo sapiens
ccctggggcttctcctga

SEQ ID NO: 3217744 - DNA, 21 bp, Homo sapiens
ccctggggcttctcctgaccc

SEQ ID NO: 3217745 - DNA, 17 bp, Homo sapiens
ccctggggtggccacca

SEQ ID NO: 3217746 - DNA, 19 bp, Homo sapiens
ccctgggtgccattcccag

SEQ ID NO: 3217747 - DNA, 18 bp, Homo sapiens
ccctgggtgggctctgtg

SEQ ID NO: 3217748 - DNA, 16 bp, Homo sapiens
ccctgggtgggtggtg

SEQ ID NO: 3217749 - DNA, 15 bp, Homo sapiens
ccctggtcctgaggg

SEQ ID NO: 3217750 - DNA, 17 bp, Homo sapiens
ccctggtccttccaggc

SEQ ID NO: 3217751 - DNA, 16 bp, Homo sapiens
ccctggtgcctggctc

SEQ ID NO: 3217752 - DNA, 13 bp, Homo sapiens
ccctggtgctgcc

SEQ ID NO: 3217753 - DNA, 15 bp, Homo sapiens
ccccttttgcctggc

SEQ ID NO: 3217754 - DNA, 18 bp, Homo sapiens
ccccttttgcctggctgt

SEQ ID NO: 3217755 - DNA, 20 bp, Homo sapiens
ccccttttgcctggctgtgg

SEQ ID NO: 3217756 - DNA, 23 bp, Homo sapiens
cccgaaggttatggtcaatccca

SEQ ID NO: 3217757 - DNA, 14 bp, Homo sapiens
cccgaatagctggg

SEQ ID NO: 3217758 - DNA, 22 bp, Homo sapiens
cccgaatagctgggactacagg

SEQ ID NO: 3217759 - DNA, 18 bp, Homo sapiens
cccgacactgctgcacca

SEQ ID NO: 3217760 - DNA, 19 bp, Homo sapiens
cccgacactgctgcaccag

SEQ ID NO: 3217761 - DNA, 17 bp, Homo sapiens
cccgacagtgccatccc

SEQ ID NO: 3217762 - DNA, 19 bp, Homo sapiens
cccgacagtgccatcccca

SEQ ID NO: 3217763 - DNA, 23 bp, Homo sapiens
cccgagatgtgacccaccagtgc

SEQ ID NO: 3217764 - DNA, 17 bp, Homo sapiens
cccgagctcttggcctt

SEQ ID NO: 3217765 - DNA, 22 bp, Homo sapiens
cccgaggagctgggcccctgca

SEQ ID NO: 3217766 - DNA, 12 bp, Homo sapiens
cccgaggagggg

SEQ ID NO: 3217767 - DNA, 17 bp, Homo sapiens
cccgaggaggggcccgg

SEQ ID NO: 3217768 - DNA, 15 bp, Homo sapiens
cccgaggccttctct

SEQ ID NO: 3217769 - DNA, 20 bp, Homo sapiens
cccgaggccttctctgaagg

SEQ ID NO: 3217770 - DNA, 15 bp, Homo sapiens
cccgaggctgctaga

SEQ ID NO: 3217771 - DNA, 17 bp, Homo sapiens
cccgaggggggccccgg

SEQ ID NO: 3217772 - DNA, 18 bp, Homo sapiens
cccgaggggggccccggg

SEQ ID NO: 3217773 - DNA, 15 bp, Homo sapiens
cccgagtacagtctg

SEQ ID NO: 3217774 - DNA, 23 bp, Homo sapiens
cccgatgctgctttcccctgtgg

SEQ ID NO: 3217775 - DNA, 16 bp, Homo sapiens
cccgcaactctccagc

SEQ ID NO: 3217776 - DNA, 17 bp, Homo sapiens
cccgcaactctccagcc

SEQ ID NO: 3217777 - DNA, 21 bp, Homo sapiens
cccgcacaccctcactctgcc

SEQ ID NO: 3217778 - DNA, 22 bp, Homo sapiens
cccgcacaccctcactctgcca

SEQ ID NO: 3217779 - DNA, 12 bp, Homo sapiens
cccgcacacctg

SEQ ID NO: 3217780 - DNA, 19 bp, Homo sapiens
cccgcaccccggcctcagg

SEQ ID NO: 3217781 - DNA, 12 bp, Homo sapiens
cccgcactctgc

SEQ ID NO: 3217782 - DNA, 15 bp, Homo sapiens
cccgcagacaccttg

SEQ ID NO: 3217783 - DNA, 18 bp, Homo sapiens
cccgcagacctccccagc

SEQ ID NO: 3217784 - DNA, 19 bp, Homo sapiens
cccgcagtccccagccctt

SEQ ID NO: 3217785 - DNA, 12 bp, Homo sapiens
cccgcagtgctg

SEQ ID NO: 3217786 - DNA, 14 bp, Homo sapiens
cccgccacacagac

SEQ ID NO: 3217787 - DNA, 17 bp, Homo sapiens
cccgccagggctgggga

SEQ ID NO: 3217788 - DNA, 15 bp, Homo sapiens
cccgcccacccacgc

SEQ ID NO: 3217789 - DNA, 16 bp, Homo sapiens
cccgcccacccacgca

SEQ ID NO: 3217790 - DNA, 17 bp, Homo sapiens
cccgccctcaggctccg

SEQ ID NO: 3217791 - DNA, 13 bp, Homo sapiens
cccgcctccctct

SEQ ID NO: 3217792 - DNA, 24 bp, Homo sapiens
cccgcctccctctcagaggcctgc

SEQ ID NO: 3217793 - DNA, 12 bp, Homo sapiens
cccgcctgccac

SEQ ID NO: 3217794 - DNA, 14 bp, Homo sapiens
cccgcctgccctca

SEQ ID NO: 3217795 - DNA, 11 bp, Homo sapiens
cccgcctggcc

SEQ ID NO: 3217796 - DNA, 13 bp, Homo sapiens
cccgcctggccag

SEQ ID NO: 3217797 - DNA, 15 bp, Homo sapiens
cccgcctggccagga

SEQ ID NO: 3217798 - DNA, 16 bp, Homo sapiens
cccgcctggccaggag

SEQ ID NO: 3217799 - DNA, 14 bp, Homo sapiens
cccgcctgttcccc

SEQ ID NO: 3217800 - DNA, 23 bp, Homo sapiens
cccgccttccgccccttcccttc

SEQ ID NO: 3217801 - DNA, 11 bp, Homo sapiens
cccgccttcct

SEQ ID NO: 3217802 - DNA, 17 bp, Homo sapiens
cccgccttcctcctcca

SEQ ID NO: 3217803 - DNA, 19 bp, Homo sapiens
cccgccttcctcctccaca

SEQ ID NO: 3217804 - DNA, 20 bp, Homo sapiens
cccgccttcctcctccacag

SEQ ID NO: 3217805 - DNA, 23 bp, Homo sapiens
cccgccttcctgggcagcctttc

SEQ ID NO: 3217806 - DNA, 15 bp, Homo sapiens
cccgcgcctccttcc

SEQ ID NO: 3217807 - DNA, 14 bp, Homo sapiens
cccgcgctctttct

SEQ ID NO: 3217808 - DNA, 21 bp, Homo sapiens
cccgcgggagacagcttctct

SEQ ID NO: 3217809 - DNA, 12 bp, Homo sapiens
cccgctcagccc

SEQ ID NO: 3217810 - DNA, 14 bp, Homo sapiens
cccgctcagccctc

SEQ ID NO: 3217811 - DNA, 15 bp, Homo sapiens
cccgctcagccctcc

SEQ ID NO: 3217812 - DNA, 14 bp, Homo sapiens
cccgctcccaggtt

SEQ ID NO: 3217813 - DNA, 16 bp, Homo sapiens
cccgctcctgccgcag

SEQ ID NO: 3217814 - DNA, 18 bp, Homo sapiens
cccgctcctgccgcagac

SEQ ID NO: 3217815 - DNA, 23 bp, Homo sapiens
cccgctcctgccgcagacgggca

SEQ ID NO: 3217816 - DNA, 14 bp, Homo sapiens
cccgctcttgccct

SEQ ID NO: 3217817 - DNA, 21 bp, Homo sapiens
cccgctgagctgagtggccag

SEQ ID NO: 3217818 - DNA, 22 bp, Homo sapiens
cccgctgcaagtcagattgctg

SEQ ID NO: 3217819 - DNA, 20 bp, Homo sapiens
cccggacatactctctgcct

SEQ ID NO: 3217820 - DNA, 13 bp, Homo sapiens
cccggagcacagc

SEQ ID NO: 3217821 - DNA, 21 bp, Homo sapiens
cccggagcacagccctgggag

SEQ ID NO: 3217822 - DNA, 17 bp, Homo sapiens
cccggaggggcctggca

SEQ ID NO: 3217823 - DNA, 18 bp, Homo sapiens
cccggaggttgggtgggc

SEQ ID NO: 3217824 - DNA, 16 bp, Homo sapiens
cccggatcagagcagg

SEQ ID NO: 3217825 - DNA, 20 bp, Homo sapiens
cccggatcagagcaggacct

SEQ ID NO: 3217826 - DNA, 21 bp, Homo sapiens
cccggatcagagcaggacctc

SEQ ID NO: 3217827 - DNA, 15 bp, Homo sapiens
cccggatgctgcttc

SEQ ID NO: 3217828 - DNA, 16 bp, Homo sapiens
cccggattctgggagg

SEQ ID NO: 3217829 - DNA, 17 bp, Homo sapiens
cccggcaccctctggcc

SEQ ID NO: 3217830 - DNA, 12 bp, Homo sapiens
cccggcaggccc

SEQ ID NO: 3217831 - DNA, 17 bp, Homo sapiens
cccggcaggccctgcag

SEQ ID NO: 3217832 - DNA, 14 bp, Homo sapiens
cccggcagggcggg

SEQ ID NO: 3217833 - DNA, 15 bp, Homo sapiens
cccggccacacccag

SEQ ID NO: 3217834 - DNA, 17 bp, Homo sapiens
cccggccacacccagcg

SEQ ID NO: 3217835 - DNA, 12 bp, Homo sapiens
cccggccacctc

SEQ ID NO: 3217836 - DNA, 13 bp, Homo sapiens
cccggccacctct

SEQ ID NO: 3217837 - DNA, 15 bp, Homo sapiens
cccggccacctctgc

SEQ ID NO: 3217838 - DNA, 11 bp, Homo sapiens
cccggccagcg

SEQ ID NO: 3217839 - DNA, 13 bp, Homo sapiens
cccggccagcggg

SEQ ID NO: 3217840 - DNA, 18 bp, Homo sapiens
cccggccccggccccagc

SEQ ID NO: 3217841 - DNA, 15 bp, Homo sapiens
cccggcccctgctgg

SEQ ID NO: 3217842 - DNA, 17 bp, Homo sapiens
cccggcctcttccaccc

SEQ ID NO: 3217843 - DNA, 21 bp, Homo sapiens
cccggcctgctcccagcagcc

SEQ ID NO: 3217844 - DNA, 11 bp, Homo sapiens
cccggctccag

SEQ ID NO: 3217845 - DNA, 12 bp, Homo sapiens
cccggctgcgga

SEQ ID NO: 3217846 - DNA, 21 bp, Homo sapiens
cccggctgggtcggccctgcc

SEQ ID NO: 3217847 - DNA, 16 bp, Homo sapiens
cccgggaactcctgcc

SEQ ID NO: 3217848 - DNA, 19 bp, Homo sapiens
cccgggagcctaggaccac

SEQ ID NO: 3217849 - DNA, 23 bp, Homo sapiens
cccgggaggcagaggttgcagtg

SEQ ID NO: 3217850 - DNA, 23 bp, Homo sapiens
cccgggagggcggcacaggtcgg

SEQ ID NO: 3217851 - DNA, 16 bp, Homo sapiens
cccgggccacgcccca

SEQ ID NO: 3217852 - DNA, 22 bp, Homo sapiens
cccgggccacgccccagcccga

SEQ ID NO: 3217853 - DNA, 17 bp, Homo sapiens
cccgggctctctgctgt

SEQ ID NO: 3217854 - DNA, 12 bp, Homo sapiens
cccgggctgcct

SEQ ID NO: 3217855 - DNA, 13 bp, Homo sapiens
cccgggctgcctg

SEQ ID NO: 3217856 - DNA, 14 bp, Homo sapiens
cccgggctggagaa

SEQ ID NO: 3217857 - DNA, 15 bp, Homo sapiens
cccggggaccctgtg

SEQ ID NO: 3217858 - DNA, 17 bp, Homo sapiens
cccggggaccctgtgac

SEQ ID NO: 3217859 - DNA, 21 bp, Homo sapiens
cccggggaccctgtgacatgg

SEQ ID NO: 3217860 - DNA, 14 bp, Homo sapiens
cccggggccagcac

SEQ ID NO: 3217861 - DNA, 16 bp, Homo sapiens
cccggggccagcactt

SEQ ID NO: 3217862 - DNA, 16 bp, Homo sapiens
cccggggctggcaagc

SEQ ID NO: 3217863 - DNA, 17 bp, Homo sapiens
cccggggctggcaagca

SEQ ID NO: 3217864 - DNA, 22 bp, Homo sapiens
cccggggctggcaagcagggaa

SEQ ID NO: 3217865 - DNA, 18 bp, Homo sapiens
cccgggggagcccagtga

SEQ ID NO: 3217866 - DNA, 22 bp, Homo sapiens
cccggggtcctgtggcaggcag

SEQ ID NO: 3217867 - DNA, 22 bp, Homo sapiens
cccggtggcggcagggccaggc

SEQ ID NO: 3217868 - DNA, 14 bp, Homo sapiens
cccgtacctcttcc

SEQ ID NO: 3217869 - DNA, 14 bp, Homo sapiens
cccgtagtctcctg

SEQ ID NO: 3217870 - DNA, 16 bp, Homo sapiens
cccgtagtctcctggg

SEQ ID NO: 3217871 - DNA, 17 bp, Homo sapiens
cccgtcagggcccaagt

SEQ ID NO: 3217872 - DNA, 13 bp, Homo sapiens
cccgtcctgcctg

SEQ ID NO: 3217873 - DNA, 14 bp, Homo sapiens
cccgtcctgcctgt

SEQ ID NO: 3217874 - DNA, 20 bp, Homo sapiens
cccgtcgaggggctctcagc

SEQ ID NO: 3217875 - DNA, 18 bp, Homo sapiens
ccctcctccagcccctgt

SEQ ID NO: 3217876 - DNA, 19 bp, Homo sapiens
ccctcctccagcccctgtc

SEQ ID NO: 3217877 - DNA, 15 bp, Homo sapiens
ccctcctcgggccga

SEQ ID NO: 3217878 - DNA, 14 bp, Homo sapiens
ccctcctctcccat

SEQ ID NO: 3217879 - DNA, 13 bp, Homo sapiens
ccctcctcttgga

SEQ ID NO: 3217880 - DNA, 15 bp, Homo sapiens
ccctcctgctcctcc

SEQ ID NO: 3217881 - DNA, 17 bp, Homo sapiens
ccctcctgctcctccct

SEQ ID NO: 3217882 - DNA, 23 bp, Homo sapiens
ccctcctgtgctgggggaatgag

SEQ ID NO: 3217883 - DNA, 17 bp, Homo sapiens
ccctccttgggtcattg

SEQ ID NO: 3217884 - DNA, 14 bp, Homo sapiens
ccctcctttcacca

SEQ ID NO: 3217885 - DNA, 16 bp, Homo sapiens
ccctcgaaccaaggca

SEQ ID NO: 3217886 - DNA, 19 bp, Homo sapiens
ccctcgaaccaaggcagcc

SEQ ID NO: 3217887 - DNA, 15 bp, Homo sapiens
ccctgtccctcccac

SEQ ID NO: 3217888 - DNA, 16 bp, Homo sapiens
ccctgtccctcccacc

SEQ ID NO: 3217889 - DNA, 23 bp, Homo sapiens
ccctgtccctcccacctctgtga

SEQ ID NO: 3217890 - DNA, 24 bp, Homo sapiens
ccctgtccctcccacctctgtgac

SEQ ID NO: 3217891 - DNA, 15 bp, Homo sapiens
ccctgtccggcccag

SEQ ID NO: 3217892 - DNA, 17 bp, Homo sapiens
ccctgtcctcactgctc

SEQ ID NO: 3217893 - DNA, 14 bp, Homo sapiens
ccctgtcctgtgaa

SEQ ID NO: 3217894 - DNA, 20 bp, Homo sapiens
ccctgtcctgtgaatggaag

SEQ ID NO: 3217895 - DNA, 14 bp, Homo sapiens
ccctgtccttccct

SEQ ID NO: 3217896 - DNA, 18 bp, Homo sapiens
ccctgtccttccctgttc

SEQ ID NO: 3217897 - DNA, 14 bp, Homo sapiens
ccctgtctctgcat

SEQ ID NO: 3217898 - DNA, 17 bp, Homo sapiens
ccctgtcttctgggcac

SEQ ID NO: 3217899 - DNA, 19 bp, Homo sapiens
ccctgtcttctgggcacag

SEQ ID NO: 3217900 - DNA, 21 bp, Homo sapiens
ccctgtgacatggtgcctgag

SEQ ID NO: 3217901 - DNA, 24 bp, Homo sapiens
ccctgtgacatggtgcctgagagg

SEQ ID NO: 3217902 - DNA, 20 bp, Homo sapiens
ccctgtgcctaacaccagcg

SEQ ID NO: 3217903 - DNA, 22 bp, Homo sapiens
ccctgtgcctaacaccagcgtt

SEQ ID NO: 3217904 - DNA, 18 bp, Homo sapiens
ccctgtgctccgtgcctc

SEQ ID NO: 3217905 - DNA, 14 bp, Homo sapiens
ccctgtgctggtgt

SEQ ID NO: 3217906 - DNA, 22 bp, Homo sapiens
ccctgtgctggtgtcctgacca

SEQ ID NO: 3217907 - DNA, 21 bp, Homo sapiens
ccctgtgcttggaaacctttt

SEQ ID NO: 3217908 - DNA, 16 bp, Homo sapiens
ccctgtggccaactgc

SEQ ID NO: 3217909 - DNA, 18 bp, Homo sapiens
ccctgtggccaactgcaa

SEQ ID NO: 3217910 - DNA, 14 bp, Homo sapiens
ccctgtggggatct

SEQ ID NO: 3217911 - DNA, 20 bp, Homo sapiens
ccctgtggggatctcagggg

SEQ ID NO: 3217912 - DNA, 19 bp, Homo sapiens
ccctgtgtatacagccctg

SEQ ID NO: 3217913 - DNA, 18 bp, Homo sapiens
ccctgtgttgtctctaga

SEQ ID NO: 3217914 - DNA, 19 bp, Homo sapiens
ccctgttcatgtgcctctg

SEQ ID NO: 3217915 - DNA, 21 bp, Homo sapiens
ccctgttcatgtgcctctgcg

SEQ ID NO: 3217916 - DNA, 21 bp, Homo sapiens
ccctgttctaagggggagggg

SEQ ID NO: 3217917 - DNA, 12 bp, Homo sapiens
ccctgttcttcc

SEQ ID NO: 3217918 - DNA, 16 bp, Homo sapiens
ccctgttcttcctcca

SEQ ID NO: 3217919 - DNA, 18 bp, Homo sapiens
ccctgttggcagctctag

SEQ ID NO: 3217920 - DNA, 19 bp, Homo sapiens
ccctgtttcaatcactgtc

SEQ ID NO: 3217921 - DNA, 16 bp, Homo sapiens
ccctgttttctgagcc

SEQ ID NO: 3217922 - DNA, 18 bp, Homo sapiens
ccctgttttctgagcccg

SEQ ID NO: 3217923 - DNA, 15 bp, Homo sapiens
cccttaacccaagga

SEQ ID NO: 3217924 - DNA, 16 bp, Homo sapiens
cccttaacccaaggag

SEQ ID NO: 3217925 - DNA, 22 bp, Homo sapiens
cccttaacccaaggagcacagg

SEQ ID NO: 3217926 - DNA, 19 bp, Homo sapiens
cccttacagtgaagatgtt

SEQ ID NO: 3217927 - DNA, 17 bp, Homo sapiens
cccttaccccttagcct

SEQ ID NO: 3217928 - DNA, 21 bp, Homo sapiens
cccttagaagagagccagtaa

SEQ ID NO: 3217929 - DNA, 14 bp, Homo sapiens
cccttagcagggaa

SEQ ID NO: 3217930 - DNA, 21 bp, Homo sapiens
cccttaggccccgtggtgaca

SEQ ID NO: 3217931 - DNA, 15 bp, Homo sapiens
cccttagtcccccaa

SEQ ID NO: 3217932 - DNA, 18 bp, Homo sapiens
cccttagtcccccaactc

SEQ ID NO: 3217933 - DNA, 12 bp, Homo sapiens
cccttattttca

SEQ ID NO: 3217934 - DNA, 18 bp, Homo sapiens
cccttcaaccattcccca

SEQ ID NO: 3217935 - DNA, 16 bp, Homo sapiens
cccttcactgccatga

SEQ ID NO: 3217936 - DNA, 21 bp, Homo sapiens
cccttcaggaagcaggtgtcc

SEQ ID NO: 3217937 - DNA, 13 bp, Homo sapiens
cccttcagggcca

SEQ ID NO: 3217938 - DNA, 16 bp, Homo sapiens
cccttcagtcttaata

SEQ ID NO: 3217939 - DNA, 18 bp, Homo sapiens
cccttccacctcctagag

SEQ ID NO: 3217940 - DNA, 12 bp, Homo sapiens
cccttccactgc

SEQ ID NO: 3217941 - DNA, 13 bp, Homo sapiens
cccttccactgcc

SEQ ID NO: 3217942 - DNA, 14 bp, Homo sapiens
cccttccactgcct

SEQ ID NO: 3217943 - DNA, 16 bp, Homo sapiens
cccttccactgcctct

SEQ ID NO: 3217944 - DNA, 20 bp, Homo sapiens
cccttccactgcctctgcct

SEQ ID NO: 3217945 - DNA, 21 bp, Homo sapiens
cccttccacttctaactccac

SEQ ID NO: 3217946 - DNA, 20 bp, Homo sapiens
cccttccagatcactgccac

SEQ ID NO: 3217947 - DNA, 11 bp, Homo sapiens
cccttccagga

SEQ ID NO: 3217948 - DNA, 18 bp, Homo sapiens
cccttcccaatcagcact

SEQ ID NO: 3217949 - DNA, 21 bp, Homo sapiens
cccttcccaatcagcactgaa

SEQ ID NO: 3217950 - DNA, 17 bp, Homo sapiens
cccttccccaggcccac

SEQ ID NO: 3217951 - DNA, 15 bp, Homo sapiens
cccttcccctccctg

SEQ ID NO: 3217952 - DNA, 19 bp, Homo sapiens
cccttcccctccctggctc

SEQ ID NO: 3217953 - DNA, 14 bp, Homo sapiens
cccttccctgtccc

SEQ ID NO: 3217954 - DNA, 15 bp, Homo sapiens
cccttccctgtccct

SEQ ID NO: 3217955 - DNA, 14 bp, Homo sapiens
cccttcccttccac

SEQ ID NO: 3217956 - DNA, 18 bp, Homo sapiens
cccttccgaccctctggg

SEQ ID NO: 3217957 - DNA, 19 bp, Homo sapiens
cccttccgaccctctggga

SEQ ID NO: 3217958 - DNA, 21 bp, Homo sapiens
cccttccgaccctctgggaac

SEQ ID NO: 3217959 - DNA, 21 bp, Homo sapiens
cccttcctagtgaaccacagg

SEQ ID NO: 3217960 - DNA, 20 bp, Homo sapiens
cccttcctccctgtctctgc

SEQ ID NO: 3217961 - DNA, 13 bp, Homo sapiens
cccttcctctcac

SEQ ID NO: 3217962 - DNA, 19 bp, Homo sapiens
cccttcctctcactcctgc

SEQ ID NO: 3217963 - DNA, 13 bp, Homo sapiens
cccttcctctcca

SEQ ID NO: 3217964 - DNA, 17 bp, Homo sapiens
cccttcctctccactgc

SEQ ID NO: 3217965 - DNA, 20 bp, Homo sapiens
cccttcctctccactgcctt

SEQ ID NO: 3217966 - DNA, 12 bp, Homo sapiens
cccttcctggaa

SEQ ID NO: 3217967 - DNA, 17 bp, Homo sapiens
cccttcctggaaacagc

SEQ ID NO: 3217968 - DNA, 18 bp, Homo sapiens
cccttcctggaaacagca

SEQ ID NO: 3217969 - DNA, 18 bp, Homo sapiens
cccttcctggcctcactg

SEQ ID NO: 3217970 - DNA, 23 bp, Homo sapiens
cccttcctggcctcactggctgg

SEQ ID NO: 3217971 - DNA, 22 bp, Homo sapiens
cccttcctttggtgcctcactg

SEQ ID NO: 3217972 - DNA, 15 bp, Homo sapiens
cccttcgctcctgtg

SEQ ID NO: 3217973 - DNA, 15 bp, Homo sapiens
cccttctcacagcac

SEQ ID NO: 3217974 - DNA, 14 bp, Homo sapiens
cccttctctgctcc

SEQ ID NO: 3217975 - DNA, 16 bp, Homo sapiens
cccttctctgctccac

SEQ ID NO: 3217976 - DNA, 17 bp, Homo sapiens
cccttctctgctccacc

SEQ ID NO: 3217977 - DNA, 23 bp, Homo sapiens
cccttctctgtagggaactctgg

SEQ ID NO: 3217978 - DNA, 15 bp, Homo sapiens
cccttctcttagtta

SEQ ID NO: 3217979 - DNA, 19 bp, Homo sapiens
cccttcttgggccccagac

SEQ ID NO: 3217980 - DNA, 21 bp, Homo sapiens
cccttcttgggccccagaccc

SEQ ID NO: 3217981 - DNA, 21 bp, Homo sapiens
cccttcttggtgcttacacat

SEQ ID NO: 3217982 - DNA, 15 bp, Homo sapiens
cccttcttttatgag

SEQ ID NO: 3217983 - DNA, 19 bp, Homo sapiens
cccttctttttcttctttt

SEQ ID NO: 3217984 - DNA, 17 bp, Homo sapiens
cccttgaaattttaaac

SEQ ID NO: 3217985 - DNA, 14 bp, Homo sapiens
cccttgaaggaaga

SEQ ID NO: 3217986 - DNA, 22 bp, Homo sapiens
cccttgagaaaccttattgtac

SEQ ID NO: 3217987 - DNA, 13 bp, Homo sapiens
cccttgagggaga

SEQ ID NO: 3217988 - DNA, 21 bp, Homo sapiens
cccttgatttaaacacacaga

SEQ ID NO: 3217989 - DNA, 14 bp, Homo sapiens
cccttgcaggggtc

SEQ ID NO: 3217990 - DNA, 13 bp, Homo sapiens
cccttgccctgac

SEQ ID NO: 3217991 - DNA, 19 bp, Homo sapiens
cccttgccctgacctccca

SEQ ID NO: 3217992 - DNA, 18 bp, Homo sapiens
cccttgcccttgccctga

SEQ ID NO: 3217993 - DNA, 16 bp, Homo sapiens
cccttgccctttccat

SEQ ID NO: 3217994 - DNA, 15 bp, Homo sapiens
cccttgcctccccat

SEQ ID NO: 3217995 - DNA, 14 bp, Homo sapiens
cccttgccttcccc

SEQ ID NO: 3217996 - DNA, 21 bp, Homo sapiens
cccttgccttcccctgtcttc

SEQ ID NO: 3217997 - DNA, 13 bp, Homo sapiens
cccttgctgcccg

SEQ ID NO: 3217998 - DNA, 14 bp, Homo sapiens
cccttgctgtatgc

SEQ ID NO: 3217999 - DNA, 13 bp, Homo sapiens
cccttgctttcct

SEQ ID NO: 3218000 - DNA, 17 bp, Homo sapiens
cccttgctttcctgggc

SEQ ID NO: 3218001 - DNA, 15 bp, Homo sapiens
cccttggacacttgg

SEQ ID NO: 3218002 - DNA, 14 bp, Homo sapiens
cccttggaggagag

SEQ ID NO: 3218003 - DNA, 16 bp, Homo sapiens
cccttgggacagccag

SEQ ID NO: 3218004 - DNA, 19 bp, Homo sapiens
cccttgggacagccagagc

SEQ ID NO: 3218005 - DNA, 15 bp, Homo sapiens
cccttgggcagttct

SEQ ID NO: 3218006 - DNA, 20 bp, Homo sapiens
cccttgggcagttctcactc

SEQ ID NO: 3218007 - DNA, 22 bp, Homo sapiens
cccttgggcagttctcactcct

SEQ ID NO: 3218008 - DNA, 20 bp, Homo sapiens
cccttgggcctgggcctctg

SEQ ID NO: 3218009 - DNA, 14 bp, Homo sapiens
cccttggggcctgg

SEQ ID NO: 3218010 - DNA, 15 bp, Homo sapiens
cccttggggcctggc

SEQ ID NO: 3218011 - DNA, 17 bp, Homo sapiens
cccttggggcctggctt

SEQ ID NO: 3218012 - DNA, 18 bp, Homo sapiens
cccttggggcctggcttg

SEQ ID NO: 3218013 - DNA, 20 bp, Homo sapiens
cccttggggtaagccagagc

SEQ ID NO: 3218014 - DNA, 15 bp, Homo sapiens
cccttgggttctgat

SEQ ID NO: 3218015 - DNA, 16 bp, Homo sapiens
cccttgtcctgccagc

SEQ ID NO: 3218016 - DNA, 18 bp, Homo sapiens
cccttgtcctgccagctg

SEQ ID NO: 3218017 - DNA, 22 bp, Homo sapiens
cccttgtcctgccagctgcctt

SEQ ID NO: 3218018 - DNA, 12 bp, Homo sapiens
cccttgtctgag

SEQ ID NO: 3218019 - DNA, 19 bp, Homo sapiens
cccttgtttgtcccttcta

SEQ ID NO: 3218020 - DNA, 21 bp, Homo sapiens
ccctttagccaaacccttgtc

SEQ ID NO: 3218021 - DNA, 16 bp, Homo sapiens
ccctttcagagacagc

SEQ ID NO: 3218022 - DNA, 13 bp, Homo sapiens
ccctttccagtta

SEQ ID NO: 3218023 - DNA, 15 bp, Homo sapiens
ccctttccccttccc

SEQ ID NO: 3218024 - DNA, 15 bp, Homo sapiens
ccctttccctcgcta

SEQ ID NO: 3218025 - DNA, 20 bp, Homo sapiens
ccctttccggcacactgcca

SEQ ID NO: 3218026 - DNA, 12 bp, Homo sapiens
ccctttcctaaa

SEQ ID NO: 3218027 - DNA, 14 bp, Homo sapiens
ccctttctctctcc

SEQ ID NO: 3218028 - DNA, 22 bp, Homo sapiens
ccctttctctctcctctctgct

SEQ ID NO: 3218029 - DNA, 14 bp, Homo sapiens
ccctttctcttctt

SEQ ID NO: 3218030 - DNA, 14 bp, Homo sapiens
ccctttctggctct

SEQ ID NO: 3218031 - DNA, 17 bp, Homo sapiens
ccctttcttggccagtt

SEQ ID NO: 3218032 - DNA, 17 bp, Homo sapiens
ccctttgaagcctcagc

SEQ ID NO: 3218033 - DNA, 21 bp, Homo sapiens
ccctttgacttcagctgcctg

SEQ ID NO: 3218034 - DNA, 17 bp, Homo sapiens
ccctttgcccagaaaga

SEQ ID NO: 3218035 - DNA, 20 bp, Homo sapiens
ccctttggtttttttcttct

SEQ ID NO: 3218036 - DNA, 13 bp, Homo sapiens
cccttttaatata

SEQ ID NO: 3218037 - DNA, 21 bp, Homo sapiens
cccttttcagctgagccctgg

SEQ ID NO: 3218038 - DNA, 13 bp, Homo sapiens
cccttttcctgtc

SEQ ID NO: 3218039 - DNA, 16 bp, Homo sapiens
cccttttctacagtta

SEQ ID NO: 3218040 - DNA, 14 bp, Homo sapiens
cccttttctgttta

SEQ ID NO: 3218041 - DNA, 16 bp, Homo sapiens
cccttttctgtttagg

SEQ ID NO: 3218042 - DNA, 23 bp, Homo sapiens
cccttttcttttctaccctagcc

SEQ ID NO: 3218043 - DNA, 15 bp, Homo sapiens
cccttttgcctggct

SEQ ID NO: 3218044 - DNA, 16 bp, Homo sapiens
cccttttgcctggctg

SEQ ID NO: 3218045 - DNA, 20 bp, Homo sapiens
cccttttgttgagccaggcc

SEQ ID NO: 3218046 - DNA, 14 bp, Homo sapiens
ccgaactgtgcctt

SEQ ID NO: 3218047 - DNA, 18 bp, Homo sapiens
ccgaagaatggagaggaa

SEQ ID NO: 3218048 - DNA, 18 bp, Homo sapiens
ccgaagccgcctgtggac

SEQ ID NO: 3218049 - DNA, 17 bp, Homo sapiens
ccgaagctctggctgaa

SEQ ID NO: 3218050 - DNA, 20 bp, Homo sapiens
ccgaatagctgggactacag

SEQ ID NO: 3218051 - DNA, 14 bp, Homo sapiens
ccgaatcccccagg

SEQ ID NO: 3218052 - DNA, 22 bp, Homo sapiens
ccgaattcgctgttaccgcctg

SEQ ID NO: 3218053 - DNA, 14 bp, Homo sapiens
ccgacactgctgca

SEQ ID NO: 3218054 - DNA, 13 bp, Homo sapiens
ccgacagcctggc

SEQ ID NO: 3218055 - DNA, 14 bp, Homo sapiens
ccgacaggccctgg

SEQ ID NO: 3218056 - DNA, 14 bp, Homo sapiens
ccgacagtgccatc

SEQ ID NO: 3218057 - DNA, 17 bp, Homo sapiens
ccgaccacttccagggg

SEQ ID NO: 3218058 - DNA, 23 bp, Homo sapiens
ccgaccctcatggcccccagggg

SEQ ID NO: 3218059 - DNA, 15 bp, Homo sapiens
ccgaccctctgggaa

SEQ ID NO: 3218060 - DNA, 18 bp, Homo sapiens
ccgaccctctgggaacct

SEQ ID NO: 3218061 - DNA, 17 bp, Homo sapiens
ccgacgcgtctcctgtt

SEQ ID NO: 3218062 - DNA, 16 bp, Homo sapiens
ccgactaccccagtcc

SEQ ID NO: 3218063 - DNA, 13 bp, Homo sapiens
ccgactcaggtcc

SEQ ID NO: 3218064 - DNA, 14 bp, Homo sapiens
ccgactctaagctg

SEQ ID NO: 3218065 - DNA, 15 bp, Homo sapiens
ccgactctaagctgt

SEQ ID NO: 3218066 - DNA, 20 bp, Homo sapiens
ccgactctaagctgtgtgca

SEQ ID NO: 3218067 - DNA, 19 bp, Homo sapiens
ccgactctggccctggccc

SEQ ID NO: 3218068 - DNA, 14 bp, Homo sapiens
ccgactgctttgga

SEQ ID NO: 3218069 - DNA, 14 bp, Homo sapiens
ccgactgggctcaa

SEQ ID NO: 3218070 - DNA, 13 bp, Homo sapiens
ccgagacacaggc

SEQ ID NO: 3218071 - DNA, 13 bp, Homo sapiens
ccgagacagtcca

SEQ ID NO: 3218072 - DNA, 20 bp, Homo sapiens
ccgagatgtgacccaccagt

SEQ ID NO: 3218073 - DNA, 11 bp, Homo sapiens
ccgagattgca

SEQ ID NO: 3218074 - DNA, 16 bp, Homo sapiens
ccgagattgcgccact

SEQ ID NO: 3218075 - DNA, 17 bp, Homo sapiens
ccgagattgcgccactg

SEQ ID NO: 3218076 - DNA, 23 bp, Homo sapiens
ccgagcaaagatcaaaataaaaa

SEQ ID NO: 3218077 - DNA, 21 bp, Homo sapiens
ccgagccaggttcacactcag

SEQ ID NO: 3218078 - DNA, 14 bp, Homo sapiens
ccgagcctaatgaa

SEQ ID NO: 3218079 - DNA, 17 bp, Homo sapiens
ccgagcgttcccagcag

SEQ ID NO: 3218080 - DNA, 20 bp, Homo sapiens
ccgagctcttggcctttgca

SEQ ID NO: 3218081 - DNA, 15 bp, Homo sapiens
ccgaggagctgggcc

SEQ ID NO: 3218082 - DNA, 12 bp, Homo sapiens
ccgaggaggggc

SEQ ID NO: 3218083 - DNA, 11 bp, Homo sapiens
ccgaggccagt

SEQ ID NO: 3218084 - DNA, 15 bp, Homo sapiens
ccgaggcccagcggg

SEQ ID NO: 3218085 - DNA, 17 bp, Homo sapiens
ccgaggccttctctgaa

SEQ ID NO: 3218086 - DNA, 15 bp, Homo sapiens
ccgaggggccgggga

SEQ ID NO: 3218087 - DNA, 15 bp, Homo sapiens
ccgaggggggccccg

SEQ ID NO: 3218088 - DNA, 21 bp, Homo sapiens
ccgagggtcctggctcctgag

SEQ ID NO: 3218089 - DNA, 13 bp, Homo sapiens
ccgagtacagtct

SEQ ID NO: 3218090 - DNA, 14 bp, Homo sapiens
ccgagtagctggga

SEQ ID NO: 3218091 - DNA, 19 bp, Homo sapiens
ccgagtctcttctccactg

SEQ ID NO: 3218092 - DNA, 17 bp, Homo sapiens
ccgagtctgggacacaa

SEQ ID NO: 3218093 - DNA, 19 bp, Homo sapiens
ccgagtgatttccatctct

SEQ ID NO: 3218094 - DNA, 21 bp, Homo sapiens
ccgagtgatttccatctctgg

SEQ ID NO: 3218095 - DNA, 16 bp, Homo sapiens
ccgagtgcggcgtgga

SEQ ID NO: 3218096 - DNA, 17 bp, Homo sapiens
ccgagtgcggcgtggag

SEQ ID NO: 3218097 - DNA, 11 bp, Homo sapiens
ccgatgctgct

SEQ ID NO: 3218098 - DNA, 17 bp, Homo sapiens
ccgatgtcgacatgttt

SEQ ID NO: 3218099 - DNA, 21 bp, Homo sapiens
ccgcaaaccccctttgtgctg

SEQ ID NO: 3218100 - DNA, 13 bp, Homo sapiens
ccgcacaccctca

SEQ ID NO: 3218101 - DNA, 14 bp, Homo sapiens
ccgcacaccctcac

SEQ ID NO: 3218102 - DNA, 20 bp, Homo sapiens
ccgcacaccctcactctgcc

SEQ ID NO: 3218103 - DNA, 12 bp, Homo sapiens
ccgcacagcagc

SEQ ID NO: 3218104 - DNA, 16 bp, Homo sapiens
ccgcacagcagcctgc

SEQ ID NO: 3218105 - DNA, 19 bp, Homo sapiens
ccgcaccagctgctctgcc

SEQ ID NO: 3218106 - DNA, 22 bp, Homo sapiens
ccgcaccagctgctctgcccct

SEQ ID NO: 3218107 - DNA, 20 bp, Homo sapiens
ccgcaccccgatgtggacct

SEQ ID NO: 3218108 - DNA, 19 bp, Homo sapiens
ccgcaccccggcctcaggg

SEQ ID NO: 3218109 - DNA, 13 bp, Homo sapiens
ccgcaccctgcac

SEQ ID NO: 3218110 - DNA, 14 bp, Homo sapiens
ccgcaccctgcacc

SEQ ID NO: 3218111 - DNA, 17 bp, Homo sapiens
ccgcaccctgcacctgc

SEQ ID NO: 3218112 - DNA, 23 bp, Homo sapiens
ccgcaccctgcacctgctgcgtc

SEQ ID NO: 3218113 - DNA, 15 bp, Homo sapiens
ccgcagacaccttgg

SEQ ID NO: 3218114 - DNA, 16 bp, Homo sapiens
ccgcagacctccccag

SEQ ID NO: 3218115 - DNA, 17 bp, Homo sapiens
ccgcagacctccccagc

SEQ ID NO: 3218116 - DNA, 19 bp, Homo sapiens
ccgcagacctccccagccc

SEQ ID NO: 3218117 - DNA, 21 bp, Homo sapiens
ccgcagccagccggtgcctgg

SEQ ID NO: 3218118 - DNA, 22 bp, Homo sapiens
ccgcagcccgtgaagcagtgcc

SEQ ID NO: 3218119 - DNA, 14 bp, Homo sapiens
ccgcagctcttgcc

SEQ ID NO: 3218120 - DNA, 16 bp, Homo sapiens
ccgcagtgctgggacc

SEQ ID NO: 3218121 - DNA, 17 bp, Homo sapiens
ccgcagtgctgggacca

SEQ ID NO: 3218122 - DNA, 20 bp, Homo sapiens
ccgcagtgctgggaccagag

SEQ ID NO: 3218123 - DNA, 17 bp, Homo sapiens
ccgcattggtgactcac

SEQ ID NO: 3218124 - DNA, 14 bp, Homo sapiens
ccgccacagccttc

SEQ ID NO: 3218125 - DNA, 11 bp, Homo sapiens
ccgccaccagc

SEQ ID NO: 3218126 - DNA, 15 bp, Homo sapiens
ccgccacccccatct

SEQ ID NO: 3218127 - DNA, 16 bp, Homo sapiens
ccgccacccccatctt

SEQ ID NO: 3218128 - DNA, 22 bp, Homo sapiens
ccgccacctgaggtgggctggg

SEQ ID NO: 3218129 - DNA, 13 bp, Homo sapiens
ccgccacggcctg

SEQ ID NO: 3218130 - DNA, 16 bp, Homo sapiens
ccgccacgtcccagca

SEQ ID NO: 3218131 - DNA, 18 bp, Homo sapiens
ccgccactcagccatttc

SEQ ID NO: 3218132 - DNA, 15 bp, Homo sapiens
ccgccagagggcttg

SEQ ID NO: 3218133 - DNA, 12 bp, Homo sapiens
ccgccagctggg

SEQ ID NO: 3218134 - DNA, 11 bp, Homo sapiens
ccgccagggct

SEQ ID NO: 3218135 - DNA, 15 bp, Homo sapiens
ccgcccacaccctcg

SEQ ID NO: 3218136 - DNA, 22 bp, Homo sapiens
ccgcccagagacccaagctgcc

SEQ ID NO: 3218137 - DNA, 14 bp, Homo sapiens
ccgccccctcctga

SEQ ID NO: 3218138 - DNA, 16 bp, Homo sapiens
ccgcccctgcagcacg

SEQ ID NO: 3218139 - DNA, 13 bp, Homo sapiens
ccgccctcttcct

SEQ ID NO: 3218140 - DNA, 14 bp, Homo sapiens
ccgccctgccactc

SEQ ID NO: 3218141 - DNA, 21 bp, Homo sapiens
ccgccctgctcctccctggct

SEQ ID NO: 3218142 - DNA, 15 bp, Homo sapiens
ccgccctgggctgga

SEQ ID NO: 3218143 - DNA, 16 bp, Homo sapiens
ccgccctgggctggac

SEQ ID NO: 3218144 - DNA, 17 bp, Homo sapiens
ccgccctgggctggact

SEQ ID NO: 3218145 - DNA, 24 bp, Homo sapiens
ccgccctgggctgtctgtcaccag

SEQ ID NO: 3218146 - DNA, 15 bp, Homo sapiens
ccgccgactttgtac

SEQ ID NO: 3218147 - DNA, 19 bp, Homo sapiens
ccgccgactttgtaccccc

SEQ ID NO: 3218148 - DNA, 17 bp, Homo sapiens
ccgccgccaccagcccg

SEQ ID NO: 3218149 - DNA, 19 bp, Homo sapiens
ccgccgccaccagcccgca

SEQ ID NO: 3218150 - DNA, 14 bp, Homo sapiens
ccgcctcccagcct

SEQ ID NO: 3218151 - DNA, 15 bp, Homo sapiens
ccgcctcccagcctg

SEQ ID NO: 3218152 - DNA, 11 bp, Homo sapiens
ccgcctctggc

SEQ ID NO: 3218153 - DNA, 17 bp, Homo sapiens
ccgcctgacagaaacca

SEQ ID NO: 3218154 - DNA, 13 bp, Homo sapiens
ccgcctgccaccg

SEQ ID NO: 3218155 - DNA, 16 bp, Homo sapiens
ccgcctgcctctgcct

SEQ ID NO: 3218156 - DNA, 14 bp, Homo sapiens
ccgcctgctcctca

SEQ ID NO: 3218157 - DNA, 12 bp, Homo sapiens
ccgcctggccag

SEQ ID NO: 3218158 - DNA, 16 bp, Homo sapiens
ccgcctggccaggagc

SEQ ID NO: 3218159 - DNA, 17 bp, Homo sapiens
ccgcctggccaggagca

SEQ ID NO: 3218160 - DNA, 21 bp, Homo sapiens
ccgcctggccaggagcaggca

SEQ ID NO: 3218161 - DNA, 15 bp, Homo sapiens
ccgcctggccagggc

SEQ ID NO: 3218162 - DNA, 22 bp, Homo sapiens
ccgccttaatctggaaggcccc

SEQ ID NO: 3218163 - DNA, 12 bp, Homo sapiens
ccgccttccttg

SEQ ID NO: 3218164 - DNA, 22 bp, Homo sapiens
ccgccttccttgaccttcctct

SEQ ID NO: 3218165 - DNA, 13 bp, Homo sapiens
ccgcctttgggtt

SEQ ID NO: 3218166 - DNA, 12 bp, Homo sapiens
ccgccttttgta

SEQ ID NO: 3218167 - DNA, 16 bp, Homo sapiens
ccgcgcctccttcctt

SEQ ID NO: 3218168 - DNA, 15 bp, Homo sapiens
ccgcggagcccttgg

SEQ ID NO: 3218169 - DNA, 17 bp, Homo sapiens
ccgcgggacagccaagc

SEQ ID NO: 3218170 - DNA, 17 bp, Homo sapiens
ccgcgggagacagcttc

SEQ ID NO: 3218171 - DNA, 23 bp, Homo sapiens
ccgcgggagacagcttctctgca

SEQ ID NO: 3218172 - DNA, 19 bp, Homo sapiens
ccgcgggttccgcaggcag

SEQ ID NO: 3218173 - DNA, 14 bp, Homo sapiens
ccgcggtgctctgg

SEQ ID NO: 3218174 - DNA, 18 bp, Homo sapiens
ccgctaagttgctgatgg

SEQ ID NO: 3218175 - DNA, 21 bp, Homo sapiens
ccgctaggagagactgaaagc

SEQ ID NO: 3218176 - DNA, 17 bp, Homo sapiens
ccgctcacctagagcca

SEQ ID NO: 3218177 - DNA, 19 bp, Homo sapiens
ccgctcacctagagccaga

SEQ ID NO: 3218178 - DNA, 12 bp, Homo sapiens
ccgctcagccct

SEQ ID NO: 3218179 - DNA, 19 bp, Homo sapiens
ccgctcagccctccctgcc

SEQ ID NO: 3218180 - DNA, 21 bp, Homo sapiens
ccgctcagccctccctgcccc

SEQ ID NO: 3218181 - DNA, 15 bp, Homo sapiens
ccgctcccgctccca

SEQ ID NO: 3218182 - DNA, 17 bp, Homo sapiens
ccgctcccgctcccagg

SEQ ID NO: 3218183 - DNA, 19 bp, Homo sapiens
ccgctcctcccctcttgag

SEQ ID NO: 3218184 - DNA, 18 bp, Homo sapiens
ccgctcggaggccccaaa

SEQ ID NO: 3218185 - DNA, 20 bp, Homo sapiens
ccgctcggaggccccaaagg

SEQ ID NO: 3218186 - DNA, 22 bp, Homo sapiens
ccgctcggaggccccaaaggaa

SEQ ID NO: 3218187 - DNA, 19 bp, Homo sapiens
ccgctgagctgagtggcca

SEQ ID NO: 3218188 - DNA, 21 bp, Homo sapiens
ccgctgcaagtcagattgctg

SEQ ID NO: 3218189 - DNA, 16 bp, Homo sapiens
ccgctgcaatgcctag

SEQ ID NO: 3218190 - DNA, 18 bp, Homo sapiens
ccgctgcaatgcctagac

SEQ ID NO: 3218191 - DNA, 16 bp, Homo sapiens
ccgctgcagggctccc

SEQ ID NO: 3218192 - DNA, 24 bp, Homo sapiens
ccgctgccaccacgtctgccaggc

SEQ ID NO: 3218193 - DNA, 16 bp, Homo sapiens
ccgctgccagcacaga

SEQ ID NO: 3218194 - DNA, 17 bp, Homo sapiens
ccgctgccgctgcacca

SEQ ID NO: 3218195 - DNA, 16 bp, Homo sapiens
ccgctgtaagctcctt

SEQ ID NO: 3218196 - DNA, 16 bp, Homo sapiens
ccgctgtcgccccagg

SEQ ID NO: 3218197 - DNA, 18 bp, Homo sapiens
ccgctgtcgccccaggcc

SEQ ID NO: 3218198 - DNA, 21 bp, Homo sapiens
ccgctgtcgccccaggccctc

SEQ ID NO: 3218199 - DNA, 18 bp, Homo sapiens
ccgcttcacccctgcact

SEQ ID NO: 3218200 - DNA, 15 bp, Homo sapiens
ccgcttccctattta

SEQ ID NO: 3218201 - DNA, 13 bp, Homo sapiens
ccgcttccttaga

SEQ ID NO: 3218202 - DNA, 15 bp, Homo sapiens
ccgcttctgcctgca

SEQ ID NO: 3218203 - DNA, 19 bp, Homo sapiens
ccgcttgtggggacccagg

SEQ ID NO: 3218204 - DNA, 12 bp, Homo sapiens
ccgctttctacc

SEQ ID NO: 3218205 - DNA, 23 bp, Homo sapiens
ccgctttctacccagcgagccct

SEQ ID NO: 3218206 - DNA, 11 bp, Homo sapiens
ccggaaagaag

SEQ ID NO: 3218207 - DNA, 15 bp, Homo sapiens
ccggaaccacagggc

SEQ ID NO: 3218208 - DNA, 17 bp, Homo sapiens
ccggactggtgccctcc

SEQ ID NO: 3218209 - DNA, 23 bp, Homo sapiens
ccggagatagatgactttgcaga

SEQ ID NO: 3218210 - DNA, 17 bp, Homo sapiens
ccggagattggacggcc

SEQ ID NO: 3218211 - DNA, 21 bp, Homo sapiens
ccggagattggacggcctgat

SEQ ID NO: 3218212 - DNA, 17 bp, Homo sapiens
ccggagcacagccctgg

SEQ ID NO: 3218213 - DNA, 18 bp, Homo sapiens
ccggagcacagccctggg

SEQ ID NO: 3218214 - DNA, 20 bp, Homo sapiens
ccggagcacagccctgggag

SEQ ID NO: 3218215 - DNA, 15 bp, Homo sapiens
ccggagctttcaaag

SEQ ID NO: 3218216 - DNA, 15 bp, Homo sapiens
ccggaggggcctggc

SEQ ID NO: 3218217 - DNA, 13 bp, Homo sapiens
ccggatcagagca

SEQ ID NO: 3218218 - DNA, 20 bp, Homo sapiens
ccggatcagagcaggacctc

SEQ ID NO: 3218219 - DNA, 21 bp, Homo sapiens
ccggatcagagcaggacctcc

SEQ ID NO: 3218220 - DNA, 16 bp, Homo sapiens
ccggattggcttgtgt

SEQ ID NO: 3218221 - DNA, 22 bp, Homo sapiens
ccggattggcttgtgtgtttca

SEQ ID NO: 3218222 - DNA, 23 bp, Homo sapiens
ccggcaaccccagttctgctcct

SEQ ID NO: 3218223 - DNA, 14 bp, Homo sapiens
ccggcacactgcca

SEQ ID NO: 3218224 - DNA, 19 bp, Homo sapiens
ccggcacagggtctgctct

SEQ ID NO: 3218225 - DNA, 15 bp, Homo sapiens
ccggccaatggaaac

SEQ ID NO: 3218226 - DNA, 17 bp, Homo sapiens
ccggccaatggaaacct

SEQ ID NO: 3218227 - DNA, 18 bp, Homo sapiens
ccggccaatggaaacctc

SEQ ID NO: 3218228 - DNA, 17 bp, Homo sapiens
ccggccaccagatgctg

SEQ ID NO: 3218229 - DNA, 13 bp, Homo sapiens
ccggccacctctg

SEQ ID NO: 3218230 - DNA, 16 bp, Homo sapiens
ccggccagcgggcaca

SEQ ID NO: 3218231 - DNA, 15 bp, Homo sapiens
ccggccatactgcct

SEQ ID NO: 3218232 - DNA, 13 bp, Homo sapiens
ccggccccagcca

SEQ ID NO: 3218233 - DNA, 14 bp, Homo sapiens
ccggccccagccag

SEQ ID NO: 3218234 - DNA, 16 bp, Homo sapiens
ccggccccagccagag

SEQ ID NO: 3218235 - DNA, 17 bp, Homo sapiens
ccggccccagccagagt

SEQ ID NO: 3218236 - DNA, 16 bp, Homo sapiens
ccggccccggccccag

SEQ ID NO: 3218237 - DNA, 17 bp, Homo sapiens
ccggcccctccccctga

SEQ ID NO: 3218238 - DNA, 15 bp, Homo sapiens
ccggcccctgctggt

SEQ ID NO: 3218239 - DNA, 12 bp, Homo sapiens
ccggcccctggc

SEQ ID NO: 3218240 - DNA, 14 bp, Homo sapiens
ccggccgatggaga

SEQ ID NO: 3218241 - DNA, 14 bp, Homo sapiens
ccggccggcctggc

SEQ ID NO: 3218242 - DNA, 15 bp, Homo sapiens
ccggccggcctggca

SEQ ID NO: 3218243 - DNA, 17 bp, Homo sapiens
ccggccggcctggcacc

SEQ ID NO: 3218244 - DNA, 14 bp, Homo sapiens
ccggcctcagggcg

SEQ ID NO: 3218245 - DNA, 16 bp, Homo sapiens
ccggcctcagggcgct

SEQ ID NO: 3218246 - DNA, 18 bp, Homo sapiens
ccggcctctctggcctcc

SEQ ID NO: 3218247 - DNA, 14 bp, Homo sapiens
ccggcctcttccac

SEQ ID NO: 3218248 - DNA, 13 bp, Homo sapiens
ccggcgccgggca

SEQ ID NO: 3218249 - DNA, 21 bp, Homo sapiens
ccggcgctgattcctcgtgtc

SEQ ID NO: 3218250 - DNA, 13 bp, Homo sapiens
ccggcgctgcagg

SEQ ID NO: 3218251 - DNA, 22 bp, Homo sapiens
ccggctatgggggcactgagga

SEQ ID NO: 3218252 - DNA, 15 bp, Homo sapiens
ccggctccaggctcc

SEQ ID NO: 3218253 - DNA, 21 bp, Homo sapiens
ccggctccaggctcctttagc

SEQ ID NO: 3218254 - DNA, 16 bp, Homo sapiens
ccggctcgtgtattta

SEQ ID NO: 3218255 - DNA, 21 bp, Homo sapiens
ccggctgctgtgtgtgagcag

SEQ ID NO: 3218256 - DNA, 20 bp, Homo sapiens
ccggctgggtcggccctgcc

SEQ ID NO: 3218257 - DNA, 22 bp, Homo sapiens
ccggctgggtcggccctgccca

SEQ ID NO: 3218258 - DNA, 23 bp, Homo sapiens
ccggctgtggagcaaaaggcagc

SEQ ID NO: 3218259 - DNA, 17 bp, Homo sapiens
ccgggaaccaagcagga

SEQ ID NO: 3218260 - DNA, 16 bp, Homo sapiens
ccgggacccacggagc

SEQ ID NO: 3218261 - DNA, 16 bp, Homo sapiens
ccgggacttcaaagcc

SEQ ID NO: 3218262 - DNA, 11 bp, Homo sapiens
ccgggcagaaa

SEQ ID NO: 3218263 - DNA, 11 bp, Homo sapiens
ccgggcaggcg

SEQ ID NO: 3218264 - DNA, 16 bp, Homo sapiens
ccgggcaggtcctgcc

SEQ ID NO: 3218265 - DNA, 18 bp, Homo sapiens
ccgggccacgccccagcc

SEQ ID NO: 3218266 - DNA, 14 bp, Homo sapiens
ccgggcccctgggc

SEQ ID NO: 3218267 - DNA, 13 bp, Homo sapiens
ccgggcctggggc

SEQ ID NO: 3218268 - DNA, 14 bp, Homo sapiens
ccgggcgcggtggc

SEQ ID NO: 3218269 - DNA, 21 bp, Homo sapiens
ccgggcgcggtggcgggcacc

SEQ ID NO: 3218270 - DNA, 15 bp, Homo sapiens
ccgggctgcctgggc

SEQ ID NO: 3218271 - DNA, 16 bp, Homo sapiens
ccgggctgcctgggct

SEQ ID NO: 3218272 - DNA, 16 bp, Homo sapiens
ccgggctggagaaaga

SEQ ID NO: 3218273 - DNA, 13 bp, Homo sapiens
ccgggctgggagc

SEQ ID NO: 3218274 - DNA, 19 bp, Homo sapiens
ccgggctgggagctctgca

SEQ ID NO: 3218275 - DNA, 18 bp, Homo sapiens
ccggggaagctgccagcc

SEQ ID NO: 3218276 - DNA, 22 bp, Homo sapiens
ccggggagtttctttcctgcct

SEQ ID NO: 3218277 - DNA, 23 bp, Homo sapiens
ccggggcaaggtctccttactct

SEQ ID NO: 3218278 - DNA, 12 bp, Homo sapiens
ccggggctggca

SEQ ID NO: 3218279 - DNA, 20 bp, Homo sapiens
ccggggtctgtgctgtgcct

SEQ ID NO: 3218280 - DNA, 22 bp, Homo sapiens
ccggggtctgtgctgtgcctgc

SEQ ID NO: 3218281 - DNA, 14 bp, Homo sapiens
ccgggtgggcctgg

SEQ ID NO: 3218282 - DNA, 17 bp, Homo sapiens
ccgggtgggcctggcct

SEQ ID NO: 3218283 - DNA, 20 bp, Homo sapiens
ccgggtgggcctggcctgag

SEQ ID NO: 3218284 - DNA, 15 bp, Homo sapiens
ccgggtgtggcctca

SEQ ID NO: 3218285 - DNA, 17 bp, Homo sapiens
ccgggtgtggcctcagc

SEQ ID NO: 3218286 - DNA, 20 bp, Homo sapiens
ccgggtgtggcctcagccct

SEQ ID NO: 3218287 - DNA, 17 bp, Homo sapiens
ccgggttctagtctcct

SEQ ID NO: 3218288 - DNA, 15 bp, Homo sapiens
ccggtagaggctccc

SEQ ID NO: 3218289 - DNA, 19 bp, Homo sapiens
ccggtagaggctccccagg

SEQ ID NO: 3218290 - DNA, 22 bp, Homo sapiens
ccggtagaggctccccagggct

SEQ ID NO: 3218291 - DNA, 24 bp, Homo sapiens
ccggtagaggctccccagggctcc

SEQ ID NO: 3218292 - DNA, 16 bp, Homo sapiens
ccggtagggaggcagc

SEQ ID NO: 3218293 - DNA, 12 bp, Homo sapiens
ccggtcagtgcc

SEQ ID NO: 3218294 - DNA, 15 bp, Homo sapiens
ccggtcagtgccttt

SEQ ID NO: 3218295 - DNA, 18 bp, Homo sapiens
ccggtcccctgcctggaa

SEQ ID NO: 3218296 - DNA, 18 bp, Homo sapiens
ccggtcgggcagccagca

SEQ ID NO: 3218297 - DNA, 20 bp, Homo sapiens
ccggtcgggcagccagcaga

SEQ ID NO: 3218298 - DNA, 16 bp, Homo sapiens
ccggtctgcaagtcag

SEQ ID NO: 3218299 - DNA, 13 bp, Homo sapiens
ccggtgctgcagg

SEQ ID NO: 3218300 - DNA, 14 bp, Homo sapiens
ccggtggctgggca

SEQ ID NO: 3218301 - DNA, 15 bp, Homo sapiens
ccggtgttctaagat

SEQ ID NO: 3218302 - DNA, 15 bp, Homo sapiens
ccggtttctttttaa

SEQ ID NO: 3218303 - DNA, 14 bp, Homo sapiens
ccgtaatttaactt

SEQ ID NO: 3218304 - DNA, 22 bp, Homo sapiens
ccgtacctcttcccatgactgc

SEQ ID NO: 3218305 - DNA, 15 bp, Homo sapiens
ccgtactatggctcc

SEQ ID NO: 3218306 - DNA, 13 bp, Homo sapiens
ccgtagtctcctg

SEQ ID NO: 3218307 - DNA, 14 bp, Homo sapiens
ccgtagtctcctgg

SEQ ID NO: 3218308 - DNA, 20 bp, Homo sapiens
ccgtcaccacgactggccag

SEQ ID NO: 3218309 - DNA, 14 bp, Homo sapiens
ccgtcagggcccaa

SEQ ID NO: 3218310 - DNA, 21 bp, Homo sapiens
ccgtcatggcttaatgtttat

SEQ ID NO: 3218311 - DNA, 17 bp, Homo sapiens
ccgtcatgttcctcaaa

SEQ ID NO: 3218312 - DNA, 15 bp, Homo sapiens
ccgtcattgctgctg

SEQ ID NO: 3218313 - DNA, 13 bp, Homo sapiens
ccgtccacccagg

SEQ ID NO: 3218314 - DNA, 16 bp, Homo sapiens
ccgtccacccaggctg

SEQ ID NO: 3218315 - DNA, 19 bp, Homo sapiens
ccgtccacccaggctgcac

SEQ ID NO: 3218316 - DNA, 14 bp, Homo sapiens
ccgtccatggcacc

SEQ ID NO: 3218317 - DNA, 14 bp, Homo sapiens
ccgtcctcacccct

SEQ ID NO: 3218318 - DNA, 20 bp, Homo sapiens
ccgtcctcacccctgtcctc

SEQ ID NO: 3218319 - DNA, 13 bp, Homo sapiens
ccgtcctgcctgt

SEQ ID NO: 3218320 - DNA, 14 bp, Homo sapiens
ccgtcctgcctgtg

SEQ ID NO: 3218321 - DNA, 19 bp, Homo sapiens
ccgtccttcccctcttctt

SEQ ID NO: 3218322 - DNA, 19 bp, Homo sapiens
ccgtctgactccagagtct

SEQ ID NO: 3218323 - DNA, 20 bp, Homo sapiens
ccgtctgactccagagtctg

SEQ ID NO: 3218324 - DNA, 16 bp, Homo sapiens
ccgtctggcccaccag

SEQ ID NO: 3218325 - DNA, 17 bp, Homo sapiens
ccgtctggcccaccagg

SEQ ID NO: 3218326 - DNA, 12 bp, Homo sapiens
ccgtctgttttt

SEQ ID NO: 3218327 - DNA, 18 bp, Homo sapiens
ccgtgaaaacggagctga

SEQ ID NO: 3218328 - DNA, 16 bp, Homo sapiens
ccgtgaactgtgcata

SEQ ID NO: 3218329 - DNA, 16 bp, Homo sapiens
ccgtgaagcagtgcct

SEQ ID NO: 3218330 - DNA, 10 bp, Homo sapiens
ccgtgaccta

SEQ ID NO: 3218331 - DNA, 21 bp, Homo sapiens
ccgtgacctattcaccctcca

SEQ ID NO: 3218332 - DNA, 19 bp, Homo sapiens
ccgtgagcaggaaggcctg

SEQ ID NO: 3218333 - DNA, 20 bp, Homo sapiens
ccgtgagcgcctgtgcacac

SEQ ID NO: 3218334 - DNA, 16 bp, Homo sapiens
ccgtgagttctcaggg

SEQ ID NO: 3218335 - DNA, 18 bp, Homo sapiens
ccgtgagttctcagggct

SEQ ID NO: 3218336 - DNA, 23 bp, Homo sapiens
ccgtgagttctcagggctcctgc

SEQ ID NO: 3218337 - DNA, 23 bp, Homo sapiens
ccgtgatccatccatctccaggg

SEQ ID NO: 3218338 - DNA, 14 bp, Homo sapiens
ccgtgatctcccct

SEQ ID NO: 3218339 - DNA, 16 bp, Homo sapiens
ccgtgatctcccctca

SEQ ID NO: 3218340 - DNA, 19 bp, Homo sapiens
ccgtgatggagaggacaga

SEQ ID NO: 3218341 - DNA, 23 bp, Homo sapiens
ccgtgatggagaggacagagcag

SEQ ID NO: 3218342 - DNA, 19 bp, Homo sapiens
ccgtgccaaagtctccctt

SEQ ID NO: 3218343 - DNA, 20 bp, Homo sapiens
ccgtgcccccgcctgccacc

SEQ ID NO: 3218344 - DNA, 21 bp, Homo sapiens
ccgtgcccccgcctgccaccg

SEQ ID NO: 3218345 - DNA, 15 bp, Homo sapiens
ccgtgccccgcctcc

SEQ ID NO: 3218346 - DNA, 15 bp, Homo sapiens
ccgtgccttcagctc

SEQ ID NO: 3218347 - DNA, 18 bp, Homo sapiens
ccgtgctgtcttctggtc

SEQ ID NO: 3218348 - DNA, 23 bp, Homo sapiens
ccgtgctgtcttctggtctgtgt

SEQ ID NO: 3218349 - DNA, 12 bp, Homo sapiens
ccgtggacaggc

SEQ ID NO: 3218350 - DNA, 16 bp, Homo sapiens
ccgtggaggaggaagg

SEQ ID NO: 3218351 - DNA, 19 bp, Homo sapiens
ccgtggccatccctgtgag

SEQ ID NO: 3218352 - DNA, 18 bp, Homo sapiens
ccgtggccccgccctcag

SEQ ID NO: 3218353 - DNA, 15 bp, Homo sapiens
ccgtggccctgccct

SEQ ID NO: 3218354 - DNA, 15 bp, Homo sapiens
ccgtggcttcccgct

SEQ ID NO: 3218355 - DNA, 21 bp, Homo sapiens
ccgtggcttcccgctcagccc

SEQ ID NO: 3218356 - DNA, 23 bp, Homo sapiens
ccgtggcttcccgctcagccctc

SEQ ID NO: 3218357 - DNA, 20 bp, Homo sapiens
ccgtgggggccacatttcac

SEQ ID NO: 3218358 - DNA, 16 bp, Homo sapiens
ccgtggtagaggcctg

SEQ ID NO: 3218359 - DNA, 17 bp, Homo sapiens
ccgtggtagaggcctgg

SEQ ID NO: 3218360 - DNA, 15 bp, Homo sapiens
ccgtggtcagagtgc

SEQ ID NO: 3218361 - DNA, 17 bp, Homo sapiens
ccgtggtcagagtgcca

SEQ ID NO: 3218362 - DNA, 21 bp, Homo sapiens
ccgtggtcagagtgccactgc

SEQ ID NO: 3218363 - DNA, 22 bp, Homo sapiens
ccgtggtgacatttcccaagtc

SEQ ID NO: 3218364 - DNA, 23 bp, Homo sapiens
ccgtggtgacatttcccaagtca

SEQ ID NO: 3218365 - DNA, 22 bp, Homo sapiens
ccgtggtggcggtggctgcccc

SEQ ID NO: 3218366 - DNA, 22 bp, Homo sapiens
ccgtgtgagtgtgacagggcca

SEQ ID NO: 3218367 - DNA, 17 bp, Homo sapiens
ccgttagctcctgtggc

SEQ ID NO: 3218368 - DNA, 21 bp, Homo sapiens
ccgttattataattgtatcag

SEQ ID NO: 3218369 - DNA, 20 bp, Homo sapiens
ccgttccaccccaagagaac

SEQ ID NO: 3218370 - DNA, 22 bp, Homo sapiens
ccgttcctgacatcacagcagc

SEQ ID NO: 3218371 - DNA, 21 bp, Homo sapiens
ccccgccttccgccccttccc

SEQ ID NO: 3218372 - DNA, 21 bp, Homo sapiens
ccccggacatactctctgcct

SEQ ID NO: 3218373 - DNA, 14 bp, Homo sapiens
ccccggccacctct

SEQ ID NO: 3218374 - DNA, 17 bp, Homo sapiens
ccccggccacctctgcg

SEQ ID NO: 3218375 - DNA, 13 bp, Homo sapiens
ccccggcctcagg

SEQ ID NO: 3218376 - DNA, 24 bp, Homo sapiens
ccccggctgcttggcagttgcagt

SEQ ID NO: 3218377 - DNA, 17 bp, Homo sapiens
ccccgggctctctgctg

SEQ ID NO: 3218378 - DNA, 20 bp, Homo sapiens
ccccgggctggagaaagagc

SEQ ID NO: 3218379 - DNA, 22 bp, Homo sapiens
ccccgggctggagaaagagctg

SEQ ID NO: 3218380 - DNA, 12 bp, Homo sapiens
ccccggggctgg

SEQ ID NO: 3218381 - DNA, 14 bp, Homo sapiens
ccccggggctggca

SEQ ID NO: 3218382 - DNA, 14 bp, Homo sapiens
ccccgtctctacta

SEQ ID NO: 3218383 - DNA, 21 bp, Homo sapiens
ccccgtggtgacatttcccaa

SEQ ID NO: 3218384 - DNA, 22 bp, Homo sapiens
ccccgtgtgcacaccaccctcc

SEQ ID NO: 3218385 - DNA, 16 bp, Homo sapiens
ccccgttacagctccc

SEQ ID NO: 3218386 - DNA, 14 bp, Homo sapiens
ccccgtttctggtg

SEQ ID NO: 3218387 - DNA, 17 bp, Homo sapiens
cccctaaacccctgtcc

SEQ ID NO: 3218388 - DNA, 16 bp, Homo sapiens
cccctacccaccgatg

SEQ ID NO: 3218389 - DNA, 18 bp, Homo sapiens
cccctacgcgccttgtct

SEQ ID NO: 3218390 - DNA, 18 bp, Homo sapiens
cccctagaaacccaagct

SEQ ID NO: 3218391 - DNA, 21 bp, Homo sapiens
cccctagaaacccaagctcct

SEQ ID NO: 3218392 - DNA, 20 bp, Homo sapiens
cccctagcccaggagagaga

SEQ ID NO: 3218393 - DNA, 17 bp, Homo sapiens
cccctaggatgctgcag

SEQ ID NO: 3218394 - DNA, 21 bp, Homo sapiens
cccctaggatgctgcagcaga

SEQ ID NO: 3218395 - DNA, 12 bp, Homo sapiens
cccctatcctct

SEQ ID NO: 3218396 - DNA, 20 bp, Homo sapiens
cccctatccttggcaccaaa

SEQ ID NO: 3218397 - DNA, 18 bp, Homo sapiens
cccctcaaatcgtccagc

SEQ ID NO: 3218398 - DNA, 13 bp, Homo sapiens
cccctcacagcct

SEQ ID NO: 3218399 - DNA, 12 bp, Homo sapiens
cccctcacctcc

SEQ ID NO: 3218400 - DNA, 14 bp, Homo sapiens
cccctcacctcctc

SEQ ID NO: 3218401 - DNA, 15 bp, Homo sapiens
cccctcactctgtca

SEQ ID NO: 3218402 - DNA, 22 bp, Homo sapiens
cccctcactctgtcagccagcc

SEQ ID NO: 3218403 - DNA, 20 bp, Homo sapiens
cccctcagagccctgccctg

SEQ ID NO: 3218404 - DNA, 13 bp, Homo sapiens
cccctcagccctt

SEQ ID NO: 3218405 - DNA, 14 bp, Homo sapiens
cccctcagcccttg

SEQ ID NO: 3218406 - DNA, 12 bp, Homo sapiens
cccctccactgg

SEQ ID NO: 3218407 - DNA, 12 bp, Homo sapiens
cccctccactgt

SEQ ID NO: 3218408 - DNA, 15 bp, Homo sapiens
cccctccatccaccc

SEQ ID NO: 3218409 - DNA, 14 bp, Homo sapiens
cccctcccagggcc

SEQ ID NO: 3218410 - DNA, 13 bp, Homo sapiens
cccctcccatctg

SEQ ID NO: 3218411 - DNA, 16 bp, Homo sapiens
cccctcccccaacccc

SEQ ID NO: 3218412 - DNA, 21 bp, Homo sapiens
cccctcccccaacccccaccc

SEQ ID NO: 3218413 - DNA, 14 bp, Homo sapiens
cccctcccctcctt

SEQ ID NO: 3218414 - DNA, 14 bp, Homo sapiens
cccctccctctgcc

SEQ ID NO: 3218415 - DNA, 16 bp, Homo sapiens
cccctccctctgcccc

SEQ ID NO: 3218416 - DNA, 14 bp, Homo sapiens
cccctccctggatg

SEQ ID NO: 3218417 - DNA, 13 bp, Homo sapiens
cccctccctggct

SEQ ID NO: 3218418 - DNA, 18 bp, Homo sapiens
cccctccgccctgccact

SEQ ID NO: 3218419 - DNA, 12 bp, Homo sapiens
cccctcctcagt

SEQ ID NO: 3218420 - DNA, 13 bp, Homo sapiens
cccctcctcagtg

SEQ ID NO: 3218421 - DNA, 13 bp, Homo sapiens
cccctcctccagc

SEQ ID NO: 3218422 - DNA, 19 bp, Homo sapiens
cccctcctctagctgtggg

SEQ ID NO: 3218423 - DNA, 13 bp, Homo sapiens
cccctcctctccc

SEQ ID NO: 3218424 - DNA, 15 bp, Homo sapiens
cccctcctgctcctc

SEQ ID NO: 3218425 - DNA, 18 bp, Homo sapiens
cccctcctgctcctccct

SEQ ID NO: 3218426 - DNA, 12 bp, Homo sapiens
cccctcctggca

SEQ ID NO: 3218427 - DNA, 14 bp, Homo sapiens
cccctcgccagctt

SEQ ID NO: 3218428 - DNA, 15 bp, Homo sapiens
cccctcgccagcttc

SEQ ID NO: 3218429 - DNA, 15 bp, Homo sapiens
cccctctccttctta

SEQ ID NO: 3218430 - DNA, 14 bp, Homo sapiens
cccctctctgcccc

SEQ ID NO: 3218431 - DNA, 17 bp, Homo sapiens
cccctctctgcccctga

SEQ ID NO: 3218432 - DNA, 22 bp, Homo sapiens
cccctctgccggtcgggcagcc

SEQ ID NO: 3218433 - DNA, 12 bp, Homo sapiens
cccctctggtcg

SEQ ID NO: 3218434 - DNA, 18 bp, Homo sapiens
cccctcttattcctctag

SEQ ID NO: 3218435 - DNA, 23 bp, Homo sapiens
cccctcttcttctgaagatcaga

SEQ ID NO: 3218436 - DNA, 19 bp, Homo sapiens
cccctgagatcccctgagc

SEQ ID NO: 3218437 - DNA, 20 bp, Homo sapiens
cccctgagatcccctgagcc

SEQ ID NO: 3218438 - DNA, 13 bp, Homo sapiens
cccctgaggactg

SEQ ID NO: 3218439 - DNA, 14 bp, Homo sapiens
cccctgatcactcc

SEQ ID NO: 3218440 - DNA, 15 bp, Homo sapiens
cccctgatcactccc

SEQ ID NO: 3218441 - DNA, 15 bp, Homo sapiens
cccctgcaaagacag

SEQ ID NO: 3218442 - DNA, 12 bp, Homo sapiens
cccctgccacca

SEQ ID NO: 3218443 - DNA, 12 bp, Homo sapiens
cccctgccccca

SEQ ID NO: 3218444 - DNA, 13 bp, Homo sapiens
cccctgccctggt

SEQ ID NO: 3218445 - DNA, 17 bp, Homo sapiens
cccctgccctggtccag

SEQ ID NO: 3218446 - DNA, 11 bp, Homo sapiens
cccctgcctgg

SEQ ID NO: 3218447 - DNA, 14 bp, Homo sapiens
cccctgcctggaac

SEQ ID NO: 3218448 - DNA, 21 bp, Homo sapiens
cccctgcctgggttgggggca

SEQ ID NO: 3218449 - DNA, 22 bp, Homo sapiens
cccctgcggtcaggctgggcag

SEQ ID NO: 3218450 - DNA, 19 bp, Homo sapiens
cccctgctactcctgtgct

SEQ ID NO: 3218451 - DNA, 19 bp, Homo sapiens
cccctgctccaccagcagc

SEQ ID NO: 3218452 - DNA, 20 bp, Homo sapiens
cccctgctccaccagcagca

SEQ ID NO: 3218453 - DNA, 18 bp, Homo sapiens
cccctgctcccagcctgc

SEQ ID NO: 3218454 - DNA, 11 bp, Homo sapiens
cccctgctggt

SEQ ID NO: 3218455 - DNA, 13 bp, Homo sapiens
cccctgctggttc

SEQ ID NO: 3218456 - DNA, 11 bp, Homo sapiens
cccctgctgtc

SEQ ID NO: 3218457 - DNA, 15 bp, Homo sapiens
cccctgctgtgctgc

SEQ ID NO: 3218458 - DNA, 13 bp, Homo sapiens
cccctgcttctcc

SEQ ID NO: 3218459 - DNA, 11 bp, Homo sapiens
cccctggagcc

SEQ ID NO: 3218460 - DNA, 21 bp, Homo sapiens
cccctggcccatctcagcctc

SEQ ID NO: 3218461 - DNA, 13 bp, Homo sapiens
cccctggccctgc

SEQ ID NO: 3218462 - DNA, 20 bp, Homo sapiens
cccctggcctcagttcccag

SEQ ID NO: 3218463 - DNA, 20 bp, Homo sapiens
cccctgggcatcttctggct

SEQ ID NO: 3218464 - DNA, 19 bp, Homo sapiens
cccctgggcctcatcacag

SEQ ID NO: 3218465 - DNA, 11 bp, Homo sapiens
cccctgggctc

SEQ ID NO: 3218466 - DNA, 13 bp, Homo sapiens
cccctgggctctg

SEQ ID NO: 3218467 - DNA, 15 bp, Homo sapiens
cccctgggctctgcc

SEQ ID NO: 3218468 - DNA, 12 bp, Homo sapiens
cccctggggcct

SEQ ID NO: 3218469 - DNA, 20 bp, Homo sapiens
cccctggggcttctcctgac

SEQ ID NO: 3218470 - DNA, 21 bp, Homo sapiens
cccctgggtgggtggtgggga

SEQ ID NO: 3218471 - DNA, 17 bp, Homo sapiens
cccctgtacccagctcc

SEQ ID NO: 3218472 - DNA, 20 bp, Homo sapiens
cccctgtagactagtgccgt

SEQ ID NO: 3218473 - DNA, 22 bp, Homo sapiens
cccctgtcccatgcaggccctt

SEQ ID NO: 3218474 - DNA, 14 bp, Homo sapiens
cccctgtcctcact

SEQ ID NO: 3218475 - DNA, 14 bp, Homo sapiens
cccctgtcctgtga

SEQ ID NO: 3218476 - DNA, 17 bp, Homo sapiens
cccctgtcttcacctgc

SEQ ID NO: 3218477 - DNA, 20 bp, Homo sapiens
cccctgtcttcacctgccac

SEQ ID NO: 3218478 - DNA, 15 bp, Homo sapiens
cccctgtgccctgca

SEQ ID NO: 3218479 - DNA, 11 bp, Homo sapiens
cccctgtgctc

SEQ ID NO: 3218480 - DNA, 14 bp, Homo sapiens
cccctgtggccaac

SEQ ID NO: 3218481 - DNA, 20 bp, Homo sapiens
cccctgtggggatctcaggg

SEQ ID NO: 3218482 - DNA, 15 bp, Homo sapiens
cccctgttcactcta

SEQ ID NO: 3218483 - DNA, 13 bp, Homo sapiens
cccctgttctaag

SEQ ID NO: 3218484 - DNA, 17 bp, Homo sapiens
ccccttccaaataataa

SEQ ID NO: 3218485 - DNA, 14 bp, Homo sapiens
ccccttccatgtgg

SEQ ID NO: 3218486 - DNA, 12 bp, Homo sapiens
ccccttccccct

SEQ ID NO: 3218487 - DNA, 22 bp, Homo sapiens
ccccttcctttggtgcctcact

SEQ ID NO: 3218488 - DNA, 14 bp, Homo sapiens
ccccttcgctcctg

SEQ ID NO: 3218489 - DNA, 21 bp, Homo sapiens
ccccttctctccctgccagag

SEQ ID NO: 3218490 - DNA, 21 bp, Homo sapiens
ccccttgatttaaacacacag

SEQ ID NO: 3218491 - DNA, 14 bp, Homo sapiens
ccccttgccctccg

SEQ ID NO: 3218492 - DNA, 17 bp, Homo sapiens
ccccttgccctccgcct

SEQ ID NO: 3218493 - DNA, 21 bp, Homo sapiens
ccccttgcccttgccctgacc

SEQ ID NO: 3218494 - DNA, 24 bp, Homo sapiens
ccccttgcccttgccctgacctcc

SEQ ID NO: 3218495 - DNA, 21 bp, Homo sapiens
ccccttggaggagagagaccc

SEQ ID NO: 3218496 - DNA, 13 bp, Homo sapiens
cccctttcctaaa

SEQ ID NO: 3218497 - DNA, 22 bp, Homo sapiens
cccctttcctggacactcagac

SEQ ID NO: 3218498 - DNA, 20 bp, Homo sapiens
cataatgtttttcctttctt

SEQ ID NO: 3218499 - DNA, 14 bp, Homo sapiens
cataattatgacag

SEQ ID NO: 3218500 - DNA, 21 bp, Homo sapiens
cataattctaatctaacaatg

SEQ ID NO: 3218501 - DNA, 13 bp, Homo sapiens
cataattgtggat

SEQ ID NO: 3218502 - DNA, 18 bp, Homo sapiens
cataatttagttgtttct

SEQ ID NO: 3218503 - DNA, 15 bp, Homo sapiens
cataatttggaggga

SEQ ID NO: 3218504 - DNA, 13 bp, Homo sapiens
cataattttgtgt

SEQ ID NO: 3218505 - DNA, 17 bp, Homo sapiens
catacaaaataaatggt

SEQ ID NO: 3218506 - DNA, 15 bp, Homo sapiens
catacagagtgggcc

SEQ ID NO: 3218507 - DNA, 19 bp, Homo sapiens
catacagggtctcttcctt

SEQ ID NO: 3218508 - DNA, 20 bp, Homo sapiens
catacagggtctcttccttc

SEQ ID NO: 3218509 - DNA, 12 bp, Homo sapiens
catacagttttc

SEQ ID NO: 3218510 - DNA, 17 bp, Homo sapiens
catacatgcaaaaagaa

SEQ ID NO: 3218511 - DNA, 14 bp, Homo sapiens
catacattaaaact

SEQ ID NO: 3218512 - DNA, 19 bp, Homo sapiens
catacattaaaactaggta

SEQ ID NO: 3218513 - DNA, 17 bp, Homo sapiens
catacatttataatgtt

SEQ ID NO: 3218514 - DNA, 22 bp, Homo sapiens
catacatttataatgtttgcta

SEQ ID NO: 3218515 - DNA, 22 bp, Homo sapiens
cataccaattccaactttcagg

SEQ ID NO: 3218516 - DNA, 13 bp, Homo sapiens
cataccctccccc

SEQ ID NO: 3218517 - DNA, 18 bp, Homo sapiens
catacctaagtactgtaa

SEQ ID NO: 3218518 - DNA, 17 bp, Homo sapiens
catactaccctttgctg

SEQ ID NO: 3218519 - DNA, 22 bp, Homo sapiens
catactactgaaacagatttca

SEQ ID NO: 3218520 - DNA, 15 bp, Homo sapiens
catactcagcctgct

SEQ ID NO: 3218521 - DNA, 19 bp, Homo sapiens
catactcagcctgctgccc

SEQ ID NO: 3218522 - DNA, 21 bp, Homo sapiens
catactcagcctgctgcccag

SEQ ID NO: 3218523 - DNA, 18 bp, Homo sapiens
catactcatttctaaaag

SEQ ID NO: 3218524 - DNA, 16 bp, Homo sapiens
catactgcatgtaagc

SEQ ID NO: 3218525 - DNA, 13 bp, Homo sapiens
catactggcagga

SEQ ID NO: 3218526 - DNA, 18 bp, Homo sapiens
catactggcctggactgt

SEQ ID NO: 3218527 - DNA, 18 bp, Homo sapiens
catacttcaaaaataatg

SEQ ID NO: 3218528 - DNA, 12 bp, Homo sapiens
catactttatca

SEQ ID NO: 3218529 - DNA, 15 bp, Homo sapiens
catactttctctcta

SEQ ID NO: 3218530 - DNA, 13 bp, Homo sapiens
catagaaaaggcg

SEQ ID NO: 3218531 - DNA, 16 bp, Homo sapiens
catagaaacatgacac

SEQ ID NO: 3218532 - DNA, 20 bp, Homo sapiens
catagaaatggaaattttgc

SEQ ID NO: 3218533 - DNA, 17 bp, Homo sapiens
catagaatagcgacagg

SEQ ID NO: 3218534 - DNA, 17 bp, Homo sapiens
catagagatctattttt

SEQ ID NO: 3218535 - DNA, 19 bp, Homo sapiens
catagagccctggccagcc

SEQ ID NO: 3218536 - DNA, 21 bp, Homo sapiens
catagagccctggccagccct

SEQ ID NO: 3218537 - DNA, 12 bp, Homo sapiens
catagaggcttc

SEQ ID NO: 3218538 - DNA, 19 bp, Homo sapiens
catagaggcttctccgcca

SEQ ID NO: 3218539 - DNA, 20 bp, Homo sapiens
catagaggcttctccgccag

SEQ ID NO: 3218540 - DNA, 22 bp, Homo sapiens
catagaggcttctccgccagcc

SEQ ID NO: 3218541 - DNA, 17 bp, Homo sapiens
catagagtcccccctcc

SEQ ID NO: 3218542 - DNA, 23 bp, Homo sapiens
catagagtgactccaagaacaat

SEQ ID NO: 3218543 - DNA, 18 bp, Homo sapiens
catagagtttaacacaag

SEQ ID NO: 3218544 - DNA, 17 bp, Homo sapiens
catagattaatggcact

SEQ ID NO: 3218545 - DNA, 18 bp, Homo sapiens
catagattaatggcactg

SEQ ID NO: 3218546 - DNA, 20 bp, Homo sapiens
catagattaatggcactgat

SEQ ID NO: 3218547 - DNA, 15 bp, Homo sapiens
catagcaacaggaaa

SEQ ID NO: 3218548 - DNA, 18 bp, Homo sapiens
catagcagaggggccagg

SEQ ID NO: 3218549 - DNA, 21 bp, Homo sapiens
catagcagaggggccaggccc

SEQ ID NO: 3218550 - DNA, 17 bp, Homo sapiens
catagcagattttaatt

SEQ ID NO: 3218551 - DNA, 21 bp, Homo sapiens
catagcatagctagagattgg

SEQ ID NO: 3218552 - DNA, 11 bp, Homo sapiens
catagcattaa

SEQ ID NO: 3218553 - DNA, 16 bp, Homo sapiens
catagcattaactaat

SEQ ID NO: 3218554 - DNA, 15 bp, Homo sapiens
catagccaccccaga

SEQ ID NO: 3218555 - DNA, 11 bp, Homo sapiens
catagcccagt

SEQ ID NO: 3218556 - DNA, 23 bp, Homo sapiens
catagcccatccctgcctggtca

SEQ ID NO: 3218557 - DNA, 16 bp, Homo sapiens
catagcccctgccccg

SEQ ID NO: 3218558 - DNA, 12 bp, Homo sapiens
cccagcctatga

SEQ ID NO: 3218559 - DNA, 11 bp, Homo sapiens
cccagcctcag

SEQ ID NO: 3218560 - DNA, 12 bp, Homo sapiens
cccagcctcagt

SEQ ID NO: 3218561 - DNA, 18 bp, Homo sapiens
cccagcctccaagctcca

SEQ ID NO: 3218562 - DNA, 15 bp, Homo sapiens
cccagcctgacctga

SEQ ID NO: 3218563 - DNA, 16 bp, Homo sapiens
cccagcctgccctcca

SEQ ID NO: 3218564 - DNA, 22 bp, Homo sapiens
cccagcctgctgagagccccca

SEQ ID NO: 3218565 - DNA, 13 bp, Homo sapiens
cccagcctggggc

SEQ ID NO: 3218566 - DNA, 15 bp, Homo sapiens
cccagcgcggccagc

SEQ ID NO: 3218567 - DNA, 16 bp, Homo sapiens
cccagcgcggccagcg

SEQ ID NO: 3218568 - DNA, 17 bp, Homo sapiens
cccagcggccccccgca

SEQ ID NO: 3218569 - DNA, 13 bp, Homo sapiens
cccagcgggcaga

SEQ ID NO: 3218570 - DNA, 22 bp, Homo sapiens
cccagcgggcaggttctgcctg

SEQ ID NO: 3218571 - DNA, 15 bp, Homo sapiens
cccagcgtggcctcc

SEQ ID NO: 3218572 - DNA, 15 bp, Homo sapiens
cccagcgtgtgtatc

SEQ ID NO: 3218573 - DNA, 16 bp, Homo sapiens
cccagcgtgtgtatcc

SEQ ID NO: 3218574 - DNA, 24 bp, Homo sapiens
cccagcgtttagtttctagaggcc

SEQ ID NO: 3218575 - DNA, 21 bp, Homo sapiens
cccagctactcagaagcctga

SEQ ID NO: 3218576 - DNA, 23 bp, Homo sapiens
cccagctactcagaagcctgagg

SEQ ID NO: 3218577 - DNA, 21 bp, Homo sapiens
cccagctactctgtccaggcc

SEQ ID NO: 3218578 - DNA, 22 bp, Homo sapiens
cccagctactctgtccaggcca

SEQ ID NO: 3218579 - DNA, 18 bp, Homo sapiens
cccagctacttgggaagc

SEQ ID NO: 3218580 - DNA, 18 bp, Homo sapiens
cccagctacttgggaggc

SEQ ID NO: 3218581 - DNA, 18 bp, Homo sapiens
cccagctaggaagagcag

SEQ ID NO: 3218582 - DNA, 22 bp, Homo sapiens
cccagctaggaagagcaggact

SEQ ID NO: 3218583 - DNA, 16 bp, Homo sapiens
cccagctagggggcgt

SEQ ID NO: 3218584 - DNA, 18 bp, Homo sapiens
cccagctcaggggcagct

SEQ ID NO: 3218585 - DNA, 14 bp, Homo sapiens
cccagctccagggg

SEQ ID NO: 3218586 - DNA, 18 bp, Homo sapiens
cccagctccaggggccct

SEQ ID NO: 3218587 - DNA, 18 bp, Homo sapiens
cccagctcctttctcctg

SEQ ID NO: 3218588 - DNA, 21 bp, Homo sapiens
cccagctccttttgtccccag

SEQ ID NO: 3218589 - DNA, 15 bp, Homo sapiens
cccagctctggtgag

SEQ ID NO: 3218590 - DNA, 14 bp, Homo sapiens
cccagctgaaggca

SEQ ID NO: 3218591 - DNA, 17 bp, Homo sapiens
cccagctgggaggcaag

SEQ ID NO: 3218592 - DNA, 14 bp, Homo sapiens
cccagctgtagcca

SEQ ID NO: 3218593 - DNA, 15 bp, Homo sapiens
cccagctgtagccat

SEQ ID NO: 3218594 - DNA, 21 bp, Homo sapiens
cccagctgtagccatggctca

SEQ ID NO: 3218595 - DNA, 15 bp, Homo sapiens
cccagctgtgagcct

SEQ ID NO: 3218596 - DNA, 18 bp, Homo sapiens
cccagctgtgagccttgg

SEQ ID NO: 3218597 - DNA, 23 bp, Homo sapiens
cccagctgtgctctggacaggca

SEQ ID NO: 3218598 - DNA, 10 bp, Homo sapiens
cccaggaagc

SEQ ID NO: 3218599 - DNA, 18 bp, Homo sapiens
cccaggaagcccacacta

SEQ ID NO: 3218600 - DNA, 11 bp, Homo sapiens
cccaggaaggc

SEQ ID NO: 3218601 - DNA, 13 bp, Homo sapiens
cccaggaaggcct

SEQ ID NO: 3218602 - DNA, 22 bp, Homo sapiens
cccaggacaccacacccagcct

SEQ ID NO: 3218603 - DNA, 15 bp, Homo sapiens
cccaggaccaagcca

SEQ ID NO: 3218604 - DNA, 15 bp, Homo sapiens
cccaggaccagctgg

SEQ ID NO: 3218605 - DNA, 15 bp, Homo sapiens
cccaggacgcttctg

SEQ ID NO: 3218606 - DNA, 17 bp, Homo sapiens
cccaggacgcttctgaa

SEQ ID NO: 3218607 - DNA, 18 bp, Homo sapiens
cccaggacgcttctgaat

SEQ ID NO: 3218608 - DNA, 16 bp, Homo sapiens
cccaggagacagacca

SEQ ID NO: 3218609 - DNA, 20 bp, Homo sapiens
cccaggaggcagaggttgca

SEQ ID NO: 3218610 - DNA, 14 bp, Homo sapiens
cccaggagggaggg

SEQ ID NO: 3218611 - DNA, 18 bp, Homo sapiens
cccaggagggcatccata

SEQ ID NO: 3218612 - DNA, 23 bp, Homo sapiens
cccaggaggggaactgagtcacg

SEQ ID NO: 3218613 - DNA, 17 bp, Homo sapiens
cccaggagttcaagacc

SEQ ID NO: 3218614 - DNA, 15 bp, Homo sapiens
cccaggatggactct

SEQ ID NO: 3218615 - DNA, 13 bp, Homo sapiens
cccaggcaggtct

SEQ ID NO: 3218616 - DNA, 15 bp, Homo sapiens
cccaggcatctcctt

SEQ ID NO: 3218617 - DNA, 11 bp, Homo sapiens
cccaggccaca

SEQ ID NO: 3218618 - DNA, 20 bp, Homo sapiens
cccaggcccaccatcaccac

SEQ ID NO: 3218619 - DNA, 16 bp, Homo sapiens
cccaggccccctgcat

SEQ ID NO: 3218620 - DNA, 13 bp, Homo sapiens
cccaggcccgaga

SEQ ID NO: 3218621 - DNA, 18 bp, Homo sapiens
cccaggccctccatgggc

SEQ ID NO: 3218622 - DNA, 19 bp, Homo sapiens
cccaggcccttcaggaact

SEQ ID NO: 3218623 - DNA, 14 bp, Homo sapiens
cccaggccgcagct

SEQ ID NO: 3218624 - DNA, 18 bp, Homo sapiens
cccaggccgcagctcttg

SEQ ID NO: 3218625 - DNA, 14 bp, Homo sapiens
cccaggccgttccc

SEQ ID NO: 3218626 - DNA, 21 bp, Homo sapiens
cccaggccgttccccttggct

SEQ ID NO: 3218627 - DNA, 15 bp, Homo sapiens
cccaggcctgcctgt

SEQ ID NO: 3218628 - DNA, 21 bp, Homo sapiens
cccaggcctgtccaccctgcc

SEQ ID NO: 3218629 - DNA, 23 bp, Homo sapiens
cccaggcgggagcggtggccctg

SEQ ID NO: 3218630 - DNA, 18 bp, Homo sapiens
cccaggctccgcccttag

SEQ ID NO: 3218631 - DNA, 18 bp, Homo sapiens
cccaggctgcactgcagt

SEQ ID NO: 3218632 - DNA, 17 bp, Homo sapiens
cccaggctggcgtgcag

SEQ ID NO: 3218633 - DNA, 18 bp, Homo sapiens
cccaggctggcgtgcagt

SEQ ID NO: 3218634 - DNA, 21 bp, Homo sapiens
cccaggctggcgtgcagtggt

SEQ ID NO: 3218635 - DNA, 14 bp, Homo sapiens
cccagggaaggaaa

SEQ ID NO: 3218636 - DNA, 23 bp, Homo sapiens
cccagggaaggtggggccctgcc

SEQ ID NO: 3218637 - DNA, 15 bp, Homo sapiens
cccagggaatcaggg

SEQ ID NO: 3218638 - DNA, 23 bp, Homo sapiens
cccagggaatcagggaccagctt

SEQ ID NO: 3218639 - DNA, 15 bp, Homo sapiens
cccagggccagggcc

SEQ ID NO: 3218640 - DNA, 18 bp, Homo sapiens
cccagggccagggccctg

SEQ ID NO: 3218641 - DNA, 22 bp, Homo sapiens
cccagggccagggccctgcaga

SEQ ID NO: 3218642 - DNA, 11 bp, Homo sapiens
cccagggcccc

SEQ ID NO: 3218643 - DNA, 21 bp, Homo sapiens
cccagggcccctccctctgcc

SEQ ID NO: 3218644 - DNA, 14 bp, Homo sapiens
cccagggcctgggg

SEQ ID NO: 3218645 - DNA, 20 bp, Homo sapiens
cccagggcctgggggcagtg

SEQ ID NO: 3218646 - DNA, 13 bp, Homo sapiens
cccagggctccct

SEQ ID NO: 3218647 - DNA, 15 bp, Homo sapiens
cccagggctccctta

SEQ ID NO: 3218648 - DNA, 12 bp, Homo sapiens
cccagggctggc

SEQ ID NO: 3218649 - DNA, 15 bp, Homo sapiens
cccagggctggctct

SEQ ID NO: 3218650 - DNA, 16 bp, Homo sapiens
cccagggctggctctg

SEQ ID NO: 3218651 - DNA, 18 bp, Homo sapiens
cccagggctggctctgca

SEQ ID NO: 3218652 - DNA, 16 bp, Homo sapiens
cccaggggacaaggga

SEQ ID NO: 3218653 - DNA, 18 bp, Homo sapiens
cccaggggacaagggatt

SEQ ID NO: 3218654 - DNA, 16 bp, Homo sapiens
cccaggggcaggactg

SEQ ID NO: 3218655 - DNA, 17 bp, Homo sapiens
cccaggggcaggactga

SEQ ID NO: 3218656 - DNA, 23 bp, Homo sapiens
cccaggggcgagttcctcgctct

SEQ ID NO: 3218657 - DNA, 17 bp, Homo sapiens
cccaggggggcctcctc

SEQ ID NO: 3218658 - DNA, 15 bp, Homo sapiens
cccaggggtcccagc

SEQ ID NO: 3218659 - DNA, 18 bp, Homo sapiens
cccaggggtcccagccac

SEQ ID NO: 3218660 - DNA, 19 bp, Homo sapiens
cccaggggtcccagccacc

SEQ ID NO: 3218661 - DNA, 20 bp, Homo sapiens
cccaggggtcccagccaccc

SEQ ID NO: 3218662 - DNA, 14 bp, Homo sapiens
cccaggggtctccc

SEQ ID NO: 3218663 - DNA, 21 bp, Homo sapiens
cccaggggtctccctggctcc

SEQ ID NO: 3218664 - DNA, 23 bp, Homo sapiens
cccaggggtgccccctcctctcc

SEQ ID NO: 3218665 - DNA, 18 bp, Homo sapiens
cccagggtcttccctacc

SEQ ID NO: 3218666 - DNA, 21 bp, Homo sapiens
cccaggtaccacccttcagac

SEQ ID NO: 3218667 - DNA, 19 bp, Homo sapiens
cccaggtaccagctgcgct

SEQ ID NO: 3218668 - DNA, 17 bp, Homo sapiens
cccaggtccagctctgg

SEQ ID NO: 3218669 - DNA, 15 bp, Homo sapiens
cccaggtcttccaga

SEQ ID NO: 3218670 - DNA, 16 bp, Homo sapiens
cccaggtcttccagac

SEQ ID NO: 3218671 - DNA, 19 bp, Homo sapiens
cccattttcaactgctttg

SEQ ID NO: 3218672 - DNA, 19 bp, Homo sapiens
cccattttccccttcctca

SEQ ID NO: 3218673 - DNA, 19 bp, Homo sapiens
cccattttgcaaaatttcc

SEQ ID NO: 3218674 - DNA, 22 bp, Homo sapiens
cccattttgcaaaatttccagt

SEQ ID NO: 3218675 - DNA, 23 bp, Homo sapiens
ccccagggcccctccctctgccc

SEQ ID NO: 3218676 - DNA, 14 bp, Homo sapiens
ccccagggcctggg

SEQ ID NO: 3218677 - DNA, 17 bp, Homo sapiens
ccccagggcctgggggc

SEQ ID NO: 3218678 - DNA, 17 bp, Homo sapiens
ccccaggggtcccagcc

SEQ ID NO: 3218679 - DNA, 19 bp, Homo sapiens
ccccaggggtcccagccac

SEQ ID NO: 3218680 - DNA, 16 bp, Homo sapiens
ccccagggtcttccct

SEQ ID NO: 3218681 - DNA, 13 bp, Homo sapiens
ccccagtcttcct

SEQ ID NO: 3218682 - DNA, 14 bp, Homo sapiens
ccccagtcttcctt

SEQ ID NO: 3218683 - DNA, 15 bp, Homo sapiens
ccccagtcttccttg

SEQ ID NO: 3218684 - DNA, 17 bp, Homo sapiens
ccccagttctgctcctc

SEQ ID NO: 3218685 - DNA, 14 bp, Homo sapiens
ccccatagccaccc

SEQ ID NO: 3218686 - DNA, 12 bp, Homo sapiens
ccccatccccac

SEQ ID NO: 3218687 - DNA, 12 bp, Homo sapiens
ccccatccctcg

SEQ ID NO: 3218688 - DNA, 14 bp, Homo sapiens
ccccatccctcggg

SEQ ID NO: 3218689 - DNA, 14 bp, Homo sapiens
ccccatcctcatcc

SEQ ID NO: 3218690 - DNA, 19 bp, Homo sapiens
ccccatcctcatccctgac

SEQ ID NO: 3218691 - DNA, 18 bp, Homo sapiens
ccccatcctccagcttct

SEQ ID NO: 3218692 - DNA, 14 bp, Homo sapiens
ccccatctccccag

SEQ ID NO: 3218693 - DNA, 17 bp, Homo sapiens
ccccatctccccaggcc

SEQ ID NO: 3218694 - DNA, 18 bp, Homo sapiens
ccccatctccccaggcct

SEQ ID NO: 3218695 - DNA, 12 bp, Homo sapiens
ccccatctctcc

SEQ ID NO: 3218696 - DNA, 19 bp, Homo sapiens
ccccatctctccctcccct

SEQ ID NO: 3218697 - DNA, 14 bp, Homo sapiens
ccccatctgggtcc

SEQ ID NO: 3218698 - DNA, 13 bp, Homo sapiens
ccccatgccaaag

SEQ ID NO: 3218699 - DNA, 22 bp, Homo sapiens
ccccatgccaaagctagggtgg

SEQ ID NO: 3218700 - DNA, 19 bp, Homo sapiens
ccccatgcctgtccagcct

SEQ ID NO: 3218701 - DNA, 20 bp, Homo sapiens
ccccatgcctgtccagcctg

SEQ ID NO: 3218702 - DNA, 22 bp, Homo sapiens
ccccatgcctgtccagcctggg

SEQ ID NO: 3218703 - DNA, 24 bp, Homo sapiens
ccccatgcctgtccagcctgggca

SEQ ID NO: 3218704 - DNA, 13 bp, Homo sapiens
ccccatgctctgc

SEQ ID NO: 3218705 - DNA, 14 bp, Homo sapiens
ccccatgctctgcc

SEQ ID NO: 3218706 - DNA, 20 bp, Homo sapiens
ccccatggccccaggcccac

SEQ ID NO: 3218707 - DNA, 17 bp, Homo sapiens
ccccatgggcttggact

SEQ ID NO: 3218708 - DNA, 14 bp, Homo sapiens
ccccatgtgcctgc

SEQ ID NO: 3218709 - DNA, 18 bp, Homo sapiens
ccccatgtgcctgcacca

SEQ ID NO: 3218710 - DNA, 13 bp, Homo sapiens
ccccatgtgcctt

SEQ ID NO: 3218711 - DNA, 22 bp, Homo sapiens
ccccatgttgtaatgctgcact

SEQ ID NO: 3218712 - DNA, 23 bp, Homo sapiens
ccccatgttgtaatgctgcactt

SEQ ID NO: 3218713 - DNA, 22 bp, Homo sapiens
ccccattaaattcactttcaat

SEQ ID NO: 3218714 - DNA, 21 bp, Homo sapiens
ccccattctttgcttgaacac

SEQ ID NO: 3218715 - DNA, 17 bp, Homo sapiens
ccccatttcccatctgc

SEQ ID NO: 3218716 - DNA, 19 bp, Homo sapiens
ccccatttcccatctgcac

SEQ ID NO: 3218717 - DNA, 12 bp, Homo sapiens
ccccatttcctg

SEQ ID NO: 3218718 - DNA, 22 bp, Homo sapiens
cccccaaacatagcccctgccc

SEQ ID NO: 3218719 - DNA, 14 bp, Homo sapiens
cccccaacactcca

SEQ ID NO: 3218720 - DNA, 17 bp, Homo sapiens
cccccaacactccaggc

SEQ ID NO: 3218721 - DNA, 19 bp, Homo sapiens
cccccaacactccaggccc

SEQ ID NO: 3218722 - DNA, 20 bp, Homo sapiens
cccccaacactgtgccctgg

SEQ ID NO: 3218723 - DNA, 21 bp, Homo sapiens
cccccaacactgtgccctggt

SEQ ID NO: 3218724 - DNA, 22 bp, Homo sapiens
cccccaacccacctctggccct

SEQ ID NO: 3218725 - DNA, 14 bp, Homo sapiens
cccccaaccccagc

SEQ ID NO: 3218726 - DNA, 15 bp, Homo sapiens
cccccaacctcaggg

SEQ ID NO: 3218727 - DNA, 15 bp, Homo sapiens
cccccaataaaggca

SEQ ID NO: 3218728 - DNA, 16 bp, Homo sapiens
cccccaataaaggcag

SEQ ID NO: 3218729 - DNA, 19 bp, Homo sapiens
cccccaataaaggcagctg

SEQ ID NO: 3218730 - DNA, 20 bp, Homo sapiens
cccccacaagctgtccctgc

SEQ ID NO: 3218731 - DNA, 23 bp, Homo sapiens
cccccacaagctgtccctgcagg

SEQ ID NO: 3218732 - DNA, 11 bp, Homo sapiens
cccccacccac

SEQ ID NO: 3218733 - DNA, 13 bp, Homo sapiens
cccccacccacct

SEQ ID NO: 3218734 - DNA, 15 bp, Homo sapiens
cccccacccccagct

SEQ ID NO: 3218735 - DNA, 20 bp, Homo sapiens
cccccaccccttccccaggc

SEQ ID NO: 3218736 - DNA, 19 bp, Homo sapiens
cccccaccggtccagctgg

SEQ ID NO: 3218737 - DNA, 13 bp, Homo sapiens
cccccacctctgg

SEQ ID NO: 3218738 - DNA, 13 bp, Homo sapiens
cccccacctgaca

SEQ ID NO: 3218739 - DNA, 22 bp, Homo sapiens
cccccacctgacaatggcagct

SEQ ID NO: 3218740 - DNA, 23 bp, Homo sapiens
cccccagagcacccccaagcctg

SEQ ID NO: 3218741 - DNA, 12 bp, Homo sapiens
cccccagcactt

SEQ ID NO: 3218742 - DNA, 15 bp, Homo sapiens
cccccagccaaactg

SEQ ID NO: 3218743 - DNA, 13 bp, Homo sapiens
cccccagcccagg

SEQ ID NO: 3218744 - DNA, 13 bp, Homo sapiens
cccccagccccgg

SEQ ID NO: 3218745 - DNA, 13 bp, Homo sapiens
cccccagcctatg

SEQ ID NO: 3218746 - DNA, 15 bp, Homo sapiens
cccccagcctctggc

SEQ ID NO: 3218747 - DNA, 12 bp, Homo sapiens
cccccagcctgg

SEQ ID NO: 3218748 - DNA, 14 bp, Homo sapiens
cccccagctcaggg

SEQ ID NO: 3218749 - DNA, 18 bp, Homo sapiens
cccccagctttgcccaac

SEQ ID NO: 3218750 - DNA, 23 bp, Homo sapiens
cccccagctttgctaccaaagca

SEQ ID NO: 3218751 - DNA, 11 bp, Homo sapiens
cccccagtgtg

SEQ ID NO: 3218752 - DNA, 17 bp, Homo sapiens
cccccatctccccaggc

SEQ ID NO: 3218753 - DNA, 20 bp, Homo sapiens
cccccatctccccaggcctc

SEQ ID NO: 3218754 - DNA, 17 bp, Homo sapiens
cccccatcttccacctg

SEQ ID NO: 3218755 - DNA, 12 bp, Homo sapiens
ccccccactctc

SEQ ID NO: 3218756 - DNA, 12 bp, Homo sapiens
ccccccagcact

SEQ ID NO: 3218757 - DNA, 11 bp, Homo sapiens
cccccccagcc

SEQ ID NO: 3218758 - DNA, 12 bp, Homo sapiens
cccccctcctgc

SEQ ID NO: 3218759 - DNA, 23 bp, Homo sapiens
cccccgacactgctgcaccagag

SEQ ID NO: 3218760 - DNA, 19 bp, Homo sapiens
cccccgagctcttggcctt

SEQ ID NO: 3218761 - DNA, 14 bp, Homo sapiens
cccccgccacctca

SEQ ID NO: 3218762 - DNA, 18 bp, Homo sapiens
cccccgcgctcgcccagc

SEQ ID NO: 3218763 - DNA, 19 bp, Homo sapiens
ccccctcaaacctcctctt

SEQ ID NO: 3218764 - DNA, 12 bp, Homo sapiens
ccccctccacac

SEQ ID NO: 3218765 - DNA, 14 bp, Homo sapiens
ccccctcctctccc

SEQ ID NO: 3218766 - DNA, 22 bp, Homo sapiens
ccccctcctctcccatccccct

SEQ ID NO: 3218767 - DNA, 17 bp, Homo sapiens
ccccctcctgctcctcc

SEQ ID NO: 3218768 - DNA, 18 bp, Homo sapiens
ccccctcctgctcctccc

SEQ ID NO: 3218769 - DNA, 12 bp, Homo sapiens
ccccctcctggc

SEQ ID NO: 3218770 - DNA, 13 bp, Homo sapiens
ccccctctgccgc

SEQ ID NO: 3218771 - DNA, 22 bp, Homo sapiens
ccccctctgccggtcgggcagc

SEQ ID NO: 3218772 - DNA, 20 bp, Homo sapiens
ccccctgcaacttccgctga

SEQ ID NO: 3218773 - DNA, 16 bp, Homo sapiens
ccccctgccctcgtgg

SEQ ID NO: 3218774 - DNA, 23 bp, Homo sapiens
ccccctggatgggcattgggctg

SEQ ID NO: 3218775 - DNA, 15 bp, Homo sapiens
ccccctggccctgcc

SEQ ID NO: 3218776 - DNA, 20 bp, Homo sapiens
ccccctggggcttctcctga

SEQ ID NO: 3218777 - DNA, 21 bp, Homo sapiens
ccccctggggcttctcctgac

SEQ ID NO: 3218778 - DNA, 18 bp, Homo sapiens
ccccctgtagactagtgc

SEQ ID NO: 3218779 - DNA, 19 bp, Homo sapiens
ccccctgtcccctcagctc

SEQ ID NO: 3218780 - DNA, 16 bp, Homo sapiens
cccccttccccttctg

SEQ ID NO: 3218781 - DNA, 15 bp, Homo sapiens
cccccttctctgctc

SEQ ID NO: 3218782 - DNA, 22 bp, Homo sapiens
cccccttctctgctccaccaca

SEQ ID NO: 3218783 - DNA, 12 bp, Homo sapiens
cccccttctggg

SEQ ID NO: 3218784 - DNA, 23 bp, Homo sapiens
cccccttctgggcatctgttctg

SEQ ID NO: 3218785 - DNA, 23 bp, Homo sapiens
cccccttgaggattgtggaaaac

SEQ ID NO: 3218786 - DNA, 14 bp, Homo sapiens
cccccttgagtggg

SEQ ID NO: 3218787 - DNA, 17 bp, Homo sapiens
ccccctttcagatgtct

SEQ ID NO: 3218788 - DNA, 20 bp, Homo sapiens
ccccctttcctggacactca

SEQ ID NO: 3218789 - DNA, 14 bp, Homo sapiens
ccccgaactgtgcc

SEQ ID NO: 3218790 - DNA, 12 bp, Homo sapiens
ccccgacactgc

SEQ ID NO: 3218791 - DNA, 14 bp, Homo sapiens
ccccgacactgctg

SEQ ID NO: 3218792 - DNA, 22 bp, Homo sapiens
ccccgagctcttggcctttgca

SEQ ID NO: 3218793 - DNA, 23 bp, Homo sapiens
ccccgaggccttctctgaaggac

SEQ ID NO: 3218794 - DNA, 19 bp, Homo sapiens
ccccgatgtcccctgcggg

SEQ ID NO: 3218795 - DNA, 15 bp, Homo sapiens
ccccgcacccggctc

SEQ ID NO: 3218796 - DNA, 12 bp, Homo sapiens
ccccgcagacct

SEQ ID NO: 3218797 - DNA, 19 bp, Homo sapiens
ccccgcagacctccccagc

SEQ ID NO: 3218798 - DNA, 15 bp, Homo sapiens
ccccgcagtccccag

SEQ ID NO: 3218799 - DNA, 13 bp, Homo sapiens
ccccgccagggct

SEQ ID NO: 3218800 - DNA, 12 bp, Homo sapiens
ccccgcccacac

SEQ ID NO: 3218801 - DNA, 15 bp, Homo sapiens
ccccgcccacaccct

SEQ ID NO: 3218802 - DNA, 19 bp, Homo sapiens
tttgtcagtatttttgccg

SEQ ID NO: 3218803 - DNA, 14 bp, Homo sapiens
tttgtcagttcttg

SEQ ID NO: 3218804 - DNA, 16 bp, Homo sapiens
tttgtccatttgtaaa

SEQ ID NO: 3218805 - DNA, 17 bp, Homo sapiens
tttgtctacgtttagtt

SEQ ID NO: 3218806 - DNA, 21 bp, Homo sapiens
tttgtctacgtttagtttccg

SEQ ID NO: 3218807 - DNA, 21 bp, Homo sapiens
tttgtctatgaagttgctgtt

SEQ ID NO: 3218808 - DNA, 22 bp, Homo sapiens
tttgtctcagaagtgaaaatct

SEQ ID NO: 3218809 - DNA, 18 bp, Homo sapiens
tttgtctcagttggaaat

SEQ ID NO: 3218810 - DNA, 13 bp, Homo sapiens
tttgtctctcctt

SEQ ID NO: 3218811 - DNA, 13 bp, Homo sapiens
tttgtctgtgttg

SEQ ID NO: 3218812 - DNA, 14 bp, Homo sapiens
tttgtcttatatat

SEQ ID NO: 3218813 - DNA, 17 bp, Homo sapiens
tttgtcttattcttaag

SEQ ID NO: 3218814 - DNA, 13 bp, Homo sapiens
tttgtcttgtact

SEQ ID NO: 3218815 - DNA, 16 bp, Homo sapiens
tttgtcttgtacttct

SEQ ID NO: 3218816 - DNA, 14 bp, Homo sapiens
tttgtctttaaaca

SEQ ID NO: 3218817 - DNA, 15 bp, Homo sapiens
tttgtctttaaacag

SEQ ID NO: 3218818 - DNA, 15 bp, Homo sapiens
tttgtgaactggaag

SEQ ID NO: 3218819 - DNA, 21 bp, Homo sapiens
tttgtgaactggaagaaagca

SEQ ID NO: 3218820 - DNA, 23 bp, Homo sapiens
tttgtgaatggattggattattt

SEQ ID NO: 3218821 - DNA, 21 bp, Homo sapiens
tttgtgactagaaattcttaa

SEQ ID NO: 3218822 - DNA, 12 bp, Homo sapiens
tttgtgagagcg

SEQ ID NO: 3218823 - DNA, 22 bp, Homo sapiens
tttgtgagcatgggtgtgccct

SEQ ID NO: 3218824 - DNA, 14 bp, Homo sapiens
tttgtgatgatgct

SEQ ID NO: 3218825 - DNA, 20 bp, Homo sapiens
tttgtgattcaatctgtaaa

SEQ ID NO: 3218826 - DNA, 21 bp, Homo sapiens
tttgtgcaaaagcttcaaatt

SEQ ID NO: 3218827 - DNA, 15 bp, Homo sapiens
tttgtgcaaagccaa

SEQ ID NO: 3218828 - DNA, 11 bp, Homo sapiens
tttgtgcattc

SEQ ID NO: 3218829 - DNA, 13 bp, Homo sapiens
tttgtgcattctt

SEQ ID NO: 3218830 - DNA, 13 bp, Homo sapiens
tttgtgccagagg

SEQ ID NO: 3218831 - DNA, 13 bp, Homo sapiens
tttgtgccagccg

SEQ ID NO: 3218832 - DNA, 14 bp, Homo sapiens
tttgtgctagaaat

SEQ ID NO: 3218833 - DNA, 14 bp, Homo sapiens
tttgtgctcattta

SEQ ID NO: 3218834 - DNA, 16 bp, Homo sapiens
tttgtgctccattttt

SEQ ID NO: 3218835 - DNA, 22 bp, Homo sapiens
tttgtgctgtgggcagcaccct

SEQ ID NO: 3218836 - DNA, 14 bp, Homo sapiens
tttgtggatgtctt

SEQ ID NO: 3218837 - DNA, 14 bp, Homo sapiens
tttgtggccttccc

SEQ ID NO: 3218838 - DNA, 15 bp, Homo sapiens
tttgtggttctattt

SEQ ID NO: 3218839 - DNA, 12 bp, Homo sapiens
tttggaaaataa

SEQ ID NO: 3218840 - DNA, 14 bp, Homo sapiens
tttggaaccttgtt

SEQ ID NO: 3218841 - DNA, 22 bp, Homo sapiens
tttggaagaaaaaaatcttctc

SEQ ID NO: 3218842 - DNA, 22 bp, Homo sapiens
tttggaatcttctctttgacaa

SEQ ID NO: 3218843 - DNA, 11 bp, Homo sapiens
tttggaatgtg

SEQ ID NO: 3218844 - DNA, 16 bp, Homo sapiens
tttggacagtttacca

SEQ ID NO: 3218845 - DNA, 20 bp, Homo sapiens
tttggaccaatagcccacag

SEQ ID NO: 3218846 - DNA, 20 bp, Homo sapiens
tttggagcacaaaattcaaa

SEQ ID NO: 3218847 - DNA, 18 bp, Homo sapiens
tttggagcactctgagtt

SEQ ID NO: 3218848 - DNA, 14 bp, Homo sapiens
tttggatatattat

SEQ ID NO: 3218849 - DNA, 21 bp, Homo sapiens
tttggatcatttttaactgat

SEQ ID NO: 3218850 - DNA, 21 bp, Homo sapiens
tttggatgggccttttagaaa

SEQ ID NO: 3218851 - DNA, 15 bp, Homo sapiens
tttggattcctcaca

SEQ ID NO: 3218852 - DNA, 20 bp, Homo sapiens
tttggatttaaaagcctgct

SEQ ID NO: 3218853 - DNA, 19 bp, Homo sapiens
tttggcaaacgctaaagag

SEQ ID NO: 3218854 - DNA, 19 bp, Homo sapiens
tttggcaagaacttgttta

SEQ ID NO: 3218855 - DNA, 21 bp, Homo sapiens
tttggcaagaacttgtttaca

SEQ ID NO: 3218856 - DNA, 17 bp, Homo sapiens
tttggcgctattacaaa

SEQ ID NO: 3218857 - DNA, 15 bp, Homo sapiens
tttggctctttcaga

SEQ ID NO: 3218858 - DNA, 20 bp, Homo sapiens
tttggctgaaattctcctgg

SEQ ID NO: 3218859 - DNA, 22 bp, Homo sapiens
tttggctgaaattctcctggag

SEQ ID NO: 3218860 - DNA, 16 bp, Homo sapiens
tttggcttaaatatag

SEQ ID NO: 3218861 - DNA, 23 bp, Homo sapiens
tttgggaaagcccagactttagt

SEQ ID NO: 3218862 - DNA, 16 bp, Homo sapiens
tttgggacttgggagc

SEQ ID NO: 3218863 - DNA, 17 bp, Homo sapiens
tttgggaggccaaggca

SEQ ID NO: 3218864 - DNA, 12 bp, Homo sapiens
tttgggatgtct

SEQ ID NO: 3218865 - DNA, 15 bp, Homo sapiens
tttgggatgtcttat

SEQ ID NO: 3218866 - DNA, 23 bp, Homo sapiens
tttgggccgaatcccccagggaa

SEQ ID NO: 3218867 - DNA, 14 bp, Homo sapiens
tttgggctgccctg

SEQ ID NO: 3218868 - DNA, 20 bp, Homo sapiens
tttggggagcagagacacta

SEQ ID NO: 3218869 - DNA, 13 bp, Homo sapiens
tttcttcagaatt

SEQ ID NO: 3218870 - DNA, 13 bp, Homo sapiens
tttcttcatccaa

SEQ ID NO: 3218871 - DNA, 16 bp, Homo sapiens
tttcttcatgcaatga

SEQ ID NO: 3218872 - DNA, 15 bp, Homo sapiens
tttcttcctcagctg

SEQ ID NO: 3218873 - DNA, 13 bp, Homo sapiens
tttcttcctctgc

SEQ ID NO: 3218874 - DNA, 14 bp, Homo sapiens
tttcttcctctgct

SEQ ID NO: 3218875 - DNA, 18 bp, Homo sapiens
tttcttcctgttaatgta

SEQ ID NO: 3218876 - DNA, 13 bp, Homo sapiens
tttcttctacttt

SEQ ID NO: 3218877 - DNA, 11 bp, Homo sapiens
tttcttctgcc

SEQ ID NO: 3218878 - DNA, 12 bp, Homo sapiens
tttcttcttccc

SEQ ID NO: 3218879 - DNA, 19 bp, Homo sapiens
tttcttgctcccttcagcc

SEQ ID NO: 3218880 - DNA, 21 bp, Homo sapiens
tttcttgctggttgtcatttt

SEQ ID NO: 3218881 - DNA, 19 bp, Homo sapiens
tttcttggcaaaagccttg

SEQ ID NO: 3218882 - DNA, 19 bp, Homo sapiens
tttcttgtaatttaaacag

SEQ ID NO: 3218883 - DNA, 14 bp, Homo sapiens
tttctttaaagatg

SEQ ID NO: 3218884 - DNA, 13 bp, Homo sapiens
tttctttaatgct

SEQ ID NO: 3218885 - DNA, 18 bp, Homo sapiens
tttctttaatgcttttat

SEQ ID NO: 3218886 - DNA, 18 bp, Homo sapiens
tttctttatcattgctaa

SEQ ID NO: 3218887 - DNA, 19 bp, Homo sapiens
tttctttcaacttgcatcc

SEQ ID NO: 3218888 - DNA, 16 bp, Homo sapiens
tttctttcagatgttt

SEQ ID NO: 3218889 - DNA, 14 bp, Homo sapiens
tttctttccaaaac

SEQ ID NO: 3218890 - DNA, 22 bp, Homo sapiens
tttctttgaatgctttttgaat

SEQ ID NO: 3218891 - DNA, 18 bp, Homo sapiens
tttctttgcaccaaagac

SEQ ID NO: 3218892 - DNA, 20 bp, Homo sapiens
tttctttgcaccaaagacat

SEQ ID NO: 3218893 - DNA, 16 bp, Homo sapiens
tttcttttctctggta

SEQ ID NO: 3218894 - DNA, 22 bp, Homo sapiens
tttcttttctggaatgtaatca

SEQ ID NO: 3218895 - DNA, 17 bp, Homo sapiens
tttcttttggtccaggg

SEQ ID NO: 3218896 - DNA, 17 bp, Homo sapiens
tttcttttgttactgtt

SEQ ID NO: 3218897 - DNA, 20 bp, Homo sapiens
tttcttttgttactgttctt

SEQ ID NO: 3218898 - DNA, 20 bp, Homo sapiens
tttctttttaagtaatgtgg

SEQ ID NO: 3218899 - DNA, 13 bp, Homo sapiens
tttctttttaatt

SEQ ID NO: 3218900 - DNA, 19 bp, Homo sapiens
tttctttttcttcttccct

SEQ ID NO: 3218901 - DNA, 17 bp, Homo sapiens
tttcttttttattacca

SEQ ID NO: 3218902 - DNA, 14 bp, Homo sapiens
tttctttttttcct

SEQ ID NO: 3218903 - DNA, 21 bp, Homo sapiens
tttcttttttttttctgttga

SEQ ID NO: 3218904 - DNA, 17 bp, Homo sapiens
tttgaaaaagttccata

SEQ ID NO: 3218905 - DNA, 13 bp, Homo sapiens
tttgaaaaatata

SEQ ID NO: 3218906 - DNA, 17 bp, Homo sapiens
tttgaaaacatgtttat

SEQ ID NO: 3218907 - DNA, 23 bp, Homo sapiens
tttgaaaagcaatattgtatatt

SEQ ID NO: 3218908 - DNA, 18 bp, Homo sapiens
tttgaaaagctattagcc

SEQ ID NO: 3218909 - DNA, 19 bp, Homo sapiens
tttgaaaagctattagcca

SEQ ID NO: 3218910 - DNA, 13 bp, Homo sapiens
tttgaaaagcttc

SEQ ID NO: 3218911 - DNA, 11 bp, Homo sapiens
tttgaaaatgg

SEQ ID NO: 3218912 - DNA, 17 bp, Homo sapiens
tttgaaacacaatacct

SEQ ID NO: 3218913 - DNA, 18 bp, Homo sapiens
tttgaaacacaataccta

SEQ ID NO: 3218914 - DNA, 14 bp, Homo sapiens
tttgaaagaaaaat

SEQ ID NO: 3218915 - DNA, 18 bp, Homo sapiens
tttgaaagaagcaagaca

SEQ ID NO: 3218916 - DNA, 21 bp, Homo sapiens
tttgaaaggagatgtcttgga

SEQ ID NO: 3218917 - DNA, 15 bp, Homo sapiens
tttgaaatacctcat

SEQ ID NO: 3218918 - DNA, 15 bp, Homo sapiens
tttgaaatactaaaa

SEQ ID NO: 3218919 - DNA, 14 bp, Homo sapiens
tttgaaatgaaatt

SEQ ID NO: 3218920 - DNA, 15 bp, Homo sapiens
tttgaaatgaaattt

SEQ ID NO: 3218921 - DNA, 16 bp, Homo sapiens
tttgaaatgaaattta

SEQ ID NO: 3218922 - DNA, 22 bp, Homo sapiens
tttgaaatgaaatttaaacatt

SEQ ID NO: 3218923 - DNA, 22 bp, Homo sapiens
tttgaacaactaggcttcagca

SEQ ID NO: 3218924 - DNA, 21 bp, Homo sapiens
tttgaacacgaaagaaatgta

SEQ ID NO: 3218925 - DNA, 12 bp, Homo sapiens
tttgaacactgg

SEQ ID NO: 3218926 - DNA, 23 bp, Homo sapiens
tttgaacctttttttttgaaaca

SEQ ID NO: 3218927 - DNA, 22 bp, Homo sapiens
tttgaactaagaaacttttgta

SEQ ID NO: 3218928 - DNA, 22 bp, Homo sapiens
tttgaactggcaattgtctatt

SEQ ID NO: 3218929 - DNA, 19 bp, Homo sapiens
tttgaactgttagatgctg

SEQ ID NO: 3218930 - DNA, 20 bp, Homo sapiens
tttgaactgttagatgctga

SEQ ID NO: 3218931 - DNA, 21 bp, Homo sapiens
tttgaactgttagatgctgaa

SEQ ID NO: 3218932 - DNA, 20 bp, Homo sapiens
tttgaagcagtcttgctctg

SEQ ID NO: 3218933 - DNA, 16 bp, Homo sapiens
tttgaagcagttgtgt

SEQ ID NO: 3218934 - DNA, 18 bp, Homo sapiens
tttgaagcagttgtgtca

SEQ ID NO: 3218935 - DNA, 17 bp, Homo sapiens
tttgaagccttttgttt

SEQ ID NO: 3218936 - DNA, 18 bp, Homo sapiens
tttgaagctactgtgtgt

SEQ ID NO: 3218937 - DNA, 20 bp, Homo sapiens
tttgaaggaaacagttaata

SEQ ID NO: 3218938 - DNA, 20 bp, Homo sapiens
tttgaagggagaagacactg

SEQ ID NO: 3218939 - DNA, 23 bp, Homo sapiens
tttgaagggagaagacactgcag

SEQ ID NO: 3218940 - DNA, 22 bp, Homo sapiens
tttgaagtaatcccgccaccta

SEQ ID NO: 3218941 - DNA, 23 bp, Homo sapiens
tttgaagtagtttgtataacttc

SEQ ID NO: 3218942 - DNA, 12 bp, Homo sapiens
tttgaagtatta

SEQ ID NO: 3218943 - DNA, 20 bp, Homo sapiens
tttgaagtgctgtttattaa

SEQ ID NO: 3218944 - DNA, 10 bp, Homo sapiens
tttgaagtgt

SEQ ID NO: 3218945 - DNA, 16 bp, Homo sapiens
tttgaataccattaaa

SEQ ID NO: 3218946 - DNA, 22 bp, Homo sapiens
tttgaataccattaaaactgct

SEQ ID NO: 3218947 - DNA, 23 bp, Homo sapiens
tttgaataccattaaaactgctt

SEQ ID NO: 3218948 - DNA, 13 bp, Homo sapiens
tttgaatatcatt

SEQ ID NO: 3218949 - DNA, 23 bp, Homo sapiens
tttgaatgaaaaatttaagcatt

SEQ ID NO: 3218950 - DNA, 14 bp, Homo sapiens
tttgaatgaaaaca

SEQ ID NO: 3218951 - DNA, 16 bp, Homo sapiens
tttgaatgcttcctga

SEQ ID NO: 3218952 - DNA, 23 bp, Homo sapiens
tttgaatgttaagaattgaccat

SEQ ID NO: 3218953 - DNA, 14 bp, Homo sapiens
tttgaattcagtaa

SEQ ID NO: 3218954 - DNA, 17 bp, Homo sapiens
tttgaattttgttttta

SEQ ID NO: 3218955 - DNA, 13 bp, Homo sapiens
tttgacaattact

SEQ ID NO: 3218956 - DNA, 18 bp, Homo sapiens
tttgacactctgcagact

SEQ ID NO: 3218957 - DNA, 18 bp, Homo sapiens
tttgacagttattttgat

SEQ ID NO: 3218958 - DNA, 17 bp, Homo sapiens
tttgacatgaacagaaa

SEQ ID NO: 3218959 - DNA, 13 bp, Homo sapiens
tttgacatgtgga

SEQ ID NO: 3218960 - DNA, 14 bp, Homo sapiens
tttgacatttaatt

SEQ ID NO: 3218961 - DNA, 20 bp, Homo sapiens
tttgacatttccttctttgt

SEQ ID NO: 3218962 - DNA, 16 bp, Homo sapiens
tttgaccccgatatat

SEQ ID NO: 3218963 - DNA, 19 bp, Homo sapiens
tttgaccttttatgtagta

SEQ ID NO: 3218964 - DNA, 17 bp, Homo sapiens
tttgactaaagctatgt

SEQ ID NO: 3218965 - DNA, 14 bp, Homo sapiens
tttgactaatttta

SEQ ID NO: 3218966 - DNA, 16 bp, Homo sapiens
tttgactaattttaca

SEQ ID NO: 3218967 - DNA, 21 bp, Homo sapiens
tttgactaattttacatgttt

SEQ ID NO: 3218968 - DNA, 16 bp, Homo sapiens
tttgactattctgtat

SEQ ID NO: 3218969 - DNA, 21 bp, Homo sapiens
tttgactctggcaaagctttt

SEQ ID NO: 3218970 - DNA, 13 bp, Homo sapiens
tttgacttcagct

SEQ ID NO: 3218971 - DNA, 19 bp, Homo sapiens
tttgacttcagctgcctga

SEQ ID NO: 3218972 - DNA, 14 bp, Homo sapiens
tttgacttcttgct

SEQ ID NO: 3218973 - DNA, 13 bp, Homo sapiens
tttgagacaggag

SEQ ID NO: 3218974 - DNA, 20 bp, Homo sapiens
tttgagacagtttcttagct

SEQ ID NO: 3218975 - DNA, 21 bp, Homo sapiens
tttgagagaaatatgaagaac

SEQ ID NO: 3218976 - DNA, 13 bp, Homo sapiens
tttgagagttcta

SEQ ID NO: 3218977 - DNA, 14 bp, Homo sapiens
tttgagagttctaa

SEQ ID NO: 3218978 - DNA, 20 bp, Homo sapiens
tttgagattgccccaggtct

SEQ ID NO: 3218979 - DNA, 22 bp, Homo sapiens
tttgagcaaagaaacttgtgct

SEQ ID NO: 3218980 - DNA, 15 bp, Homo sapiens
tttgagcaattttcg

SEQ ID NO: 3218981 - DNA, 12 bp, Homo sapiens
tttgagctgcct

SEQ ID NO: 3218982 - DNA, 20 bp, Homo sapiens
tttgaggaagtggctgtccc

SEQ ID NO: 3218983 - DNA, 15 bp, Homo sapiens
tttgaggatatattt

SEQ ID NO: 3218984 - DNA, 17 bp, Homo sapiens
tttgagggcatgaagct

SEQ ID NO: 3218985 - DNA, 23 bp, Homo sapiens
tttgaggggaggagttccacaga

SEQ ID NO: 3218986 - DNA, 11 bp, Homo sapiens
tttgaggggct

SEQ ID NO: 3218987 - DNA, 19 bp, Homo sapiens
tttgagtagatattacttt

SEQ ID NO: 3218988 - DNA, 23 bp, Homo sapiens
tttgagtcattgacttcatttta

SEQ ID NO: 3218989 - DNA, 14 bp, Homo sapiens
tttgagttatagtt

SEQ ID NO: 3218990 - DNA, 19 bp, Homo sapiens
tttgagttattttaattat

SEQ ID NO: 3218991 - DNA, 18 bp, Homo sapiens
tttgataagcacattaaa

SEQ ID NO: 3218992 - DNA, 17 bp, Homo sapiens
tttgataatgttaaatt

SEQ ID NO: 3218993 - DNA, 16 bp, Homo sapiens
tttgatacccctgggg

SEQ ID NO: 3218994 - DNA, 13 bp, Homo sapiens
tttgatacttata

SEQ ID NO: 3218995 - DNA, 18 bp, Homo sapiens
tttgatatgagtatacaa

SEQ ID NO: 3218996 - DNA, 15 bp, Homo sapiens
tttgatcatcccttt

SEQ ID NO: 3218997 - DNA, 14 bp, Homo sapiens
tttgatccaagctg

SEQ ID NO: 3218998 - DNA, 14 bp, Homo sapiens
tttcctttctcacc

SEQ ID NO: 3218999 - DNA, 22 bp, Homo sapiens
tttcctttcttaattttgtctt

SEQ ID NO: 3219000 - DNA, 12 bp, Homo sapiens
tttccttttgga

SEQ ID NO: 3219001 - DNA, 13 bp, Homo sapiens
tttcctttttaat

SEQ ID NO: 3219002 - DNA, 19 bp, Homo sapiens
tttccttttttgtctatga

SEQ ID NO: 3219003 - DNA, 20 bp, Homo sapiens
tttccttttttgtctatgaa

SEQ ID NO: 3219004 - DNA, 20 bp, Homo sapiens
tttcgacgcttaacctttcc

SEQ ID NO: 3219005 - DNA, 14 bp, Homo sapiens
tttcgactggtcca

SEQ ID NO: 3219006 - DNA, 14 bp, Homo sapiens
tttattttactatt

SEQ ID NO: 3219007 - DNA, 17 bp, Homo sapiens
tttattttactattgga

SEQ ID NO: 3219008 - DNA, 16 bp, Homo sapiens
tttattttaggcactg

SEQ ID NO: 3219009 - DNA, 23 bp, Homo sapiens
tttatttttacaagaagtttatt

SEQ ID NO: 3219010 - DNA, 17 bp, Homo sapiens
tttatttttcttgtctt

SEQ ID NO: 3219011 - DNA, 17 bp, Homo sapiens
tttattttttaagtatt

SEQ ID NO: 3219012 - DNA, 15 bp, Homo sapiens
tttattttttacatt

SEQ ID NO: 3219013 - DNA, 17 bp, Homo sapiens
tttattttttttggcct

SEQ ID NO: 3219014 - DNA, 21 bp, Homo sapiens
tttcaaaaatataacttaaaa

SEQ ID NO: 3219015 - DNA, 23 bp, Homo sapiens
tttcaaaacacatctttcctgtc

SEQ ID NO: 3219016 - DNA, 12 bp, Homo sapiens
tttcaaaagaca

SEQ ID NO: 3219017 - DNA, 18 bp, Homo sapiens
tttcaaaagacatgttgt

SEQ ID NO: 3219018 - DNA, 17 bp, Homo sapiens
tttcaaaaggtaatggt

SEQ ID NO: 3219019 - DNA, 21 bp, Homo sapiens
tttcaaaaggtattatacatg

SEQ ID NO: 3219020 - DNA, 22 bp, Homo sapiens
tttcaaaatatattttcagtac

SEQ ID NO: 3219021 - DNA, 21 bp, Homo sapiens
tttcaaaatcagtttttcata

SEQ ID NO: 3219022 - DNA, 19 bp, Homo sapiens
tttcaaacttactattttg

SEQ ID NO: 3219023 - DNA, 14 bp, Homo sapiens
tttcaaagacaatc

SEQ ID NO: 3219024 - DNA, 14 bp, Homo sapiens
tttcaaagatgctg

SEQ ID NO: 3219025 - DNA, 20 bp, Homo sapiens
tttcaaagtaaaggcctcct

SEQ ID NO: 3219026 - DNA, 23 bp, Homo sapiens
tttcaaagtaaaggcctcctccc

SEQ ID NO: 3219027 - DNA, 20 bp, Homo sapiens
tttcaaagttttgttgtact

SEQ ID NO: 3219028 - DNA, 21 bp, Homo sapiens
tttcaaagttttgttgtactt

SEQ ID NO: 3219029 - DNA, 10 bp, Homo sapiens
tttcaaatgt

SEQ ID NO: 3219030 - DNA, 13 bp, Homo sapiens
tttcaaatgttag

SEQ ID NO: 3219031 - DNA, 14 bp, Homo sapiens
tttcaaatttcaca

SEQ ID NO: 3219032 - DNA, 23 bp, Homo sapiens
tttcaacggaaagtgctgtctta

SEQ ID NO: 3219033 - DNA, 23 bp, Homo sapiens
tttcaactcaggaactatggcaa

SEQ ID NO: 3219034 - DNA, 21 bp, Homo sapiens
tttcaagaaaaaataaatgga

SEQ ID NO: 3219035 - DNA, 13 bp, Homo sapiens
tttcaagaaaatc

SEQ ID NO: 3219036 - DNA, 14 bp, Homo sapiens
tttcaagaaaatct

SEQ ID NO: 3219037 - DNA, 19 bp, Homo sapiens
tttcaagaaactgaggaat

SEQ ID NO: 3219038 - DNA, 18 bp, Homo sapiens
tttcaagacccctgtctt

SEQ ID NO: 3219039 - DNA, 20 bp, Homo sapiens
tttcaaggaaggttcatgta

SEQ ID NO: 3219040 - DNA, 15 bp, Homo sapiens
tttcaaggaatggaa

SEQ ID NO: 3219041 - DNA, 23 bp, Homo sapiens
tttcaaggaatggaatcttctcc

SEQ ID NO: 3219042 - DNA, 19 bp, Homo sapiens
tttcaaggcactctagatt

SEQ ID NO: 3219043 - DNA, 22 bp, Homo sapiens
tttcaaggcactctagattcca

SEQ ID NO: 3219044 - DNA, 13 bp, Homo sapiens
tttcaaggttcta

SEQ ID NO: 3219045 - DNA, 14 bp, Homo sapiens
tttcaaggttctaa

SEQ ID NO: 3219046 - DNA, 23 bp, Homo sapiens
tttcaagtcaaattaataatctt

SEQ ID NO: 3219047 - DNA, 12 bp, Homo sapiens
tttcaagtgcct

SEQ ID NO: 3219048 - DNA, 23 bp, Homo sapiens
tttcaagtgcctttctgcagttt

SEQ ID NO: 3219049 - DNA, 14 bp, Homo sapiens
tttcaagttattca

SEQ ID NO: 3219050 - DNA, 17 bp, Homo sapiens
tttcaagttattcaaat

SEQ ID NO: 3219051 - DNA, 22 bp, Homo sapiens
tttcaagttccaagttgctaat

SEQ ID NO: 3219052 - DNA, 11 bp, Homo sapiens
tttcaagttta

SEQ ID NO: 3219053 - DNA, 18 bp, Homo sapiens
tttcaagttttaaagttc

SEQ ID NO: 3219054 - DNA, 13 bp, Homo sapiens
tttcaatatgcaa

SEQ ID NO: 3219055 - DNA, 13 bp, Homo sapiens
tttcaatcaactt

SEQ ID NO: 3219056 - DNA, 18 bp, Homo sapiens
tttcaatcaactttactg

SEQ ID NO: 3219057 - DNA, 19 bp, Homo sapiens
tttcaatcaactttactgt

SEQ ID NO: 3219058 - DNA, 14 bp, Homo sapiens
tttcaatcattgaa

SEQ ID NO: 3219059 - DNA, 14 bp, Homo sapiens
tttcaatgtgtata

SEQ ID NO: 3219060 - DNA, 15 bp, Homo sapiens
tttcaattctcaaaa

SEQ ID NO: 3219061 - DNA, 22 bp, Homo sapiens
tttcacaaccttctgtggctca

SEQ ID NO: 3219062 - DNA, 17 bp, Homo sapiens
tttcacaggtcaataaa

SEQ ID NO: 3219063 - DNA, 15 bp, Homo sapiens
tttcacagtttttcc

SEQ ID NO: 3219064 - DNA, 14 bp, Homo sapiens
tttcacatagatgt

SEQ ID NO: 3219065 - DNA, 19 bp, Homo sapiens
tttcacattgtttgctgct

SEQ ID NO: 3219066 - DNA, 14 bp, Homo sapiens
tttcacattttcct

SEQ ID NO: 3219067 - DNA, 20 bp, Homo sapiens
tttcaccaaaatttctacac

SEQ ID NO: 3219068 - DNA, 17 bp, Homo sapiens
tttcaccctcatgaaaa

SEQ ID NO: 3219069 - DNA, 16 bp, Homo sapiens
tttcacctactttgta

SEQ ID NO: 3219070 - DNA, 17 bp, Homo sapiens
tttcacctactttgtaa

SEQ ID NO: 3219071 - DNA, 13 bp, Homo sapiens
tttcacctgtaaa

SEQ ID NO: 3219072 - DNA, 18 bp, Homo sapiens
tttcacctgtaaacctga

SEQ ID NO: 3219073 - DNA, 23 bp, Homo sapiens
tttcacctgtttttaagctgttt

SEQ ID NO: 3219074 - DNA, 18 bp, Homo sapiens
tttcaccttttcaggaaa

SEQ ID NO: 3219075 - DNA, 20 bp, Homo sapiens
tttcacgtcttggtgccttt

SEQ ID NO: 3219076 - DNA, 19 bp, Homo sapiens
tttcactatttttatttat

SEQ ID NO: 3219077 - DNA, 17 bp, Homo sapiens
tttcactccctccatca

SEQ ID NO: 3219078 - DNA, 22 bp, Homo sapiens
tttcactgataccacgaggaaa

SEQ ID NO: 3219079 - DNA, 14 bp, Homo sapiens
tttcactgctggct

SEQ ID NO: 3219080 - DNA, 17 bp, Homo sapiens
tttcactgctggctgcc

SEQ ID NO: 3219081 - DNA, 20 bp, Homo sapiens
tttcactgctggctgcctta

SEQ ID NO: 3219082 - DNA, 22 bp, Homo sapiens
tttcactgctggctgccttaga

SEQ ID NO: 3219083 - DNA, 21 bp, Homo sapiens
tttcactgtctttaattctgt

SEQ ID NO: 3219084 - DNA, 12 bp, Homo sapiens
tttcacttctgt

SEQ ID NO: 3219085 - DNA, 18 bp, Homo sapiens
tttcacttgtattgactt

SEQ ID NO: 3219086 - DNA, 21 bp, Homo sapiens
tttcacttgtattgactttat

SEQ ID NO: 3219087 - DNA, 13 bp, Homo sapiens
tttcactttgaaa

SEQ ID NO: 3219088 - DNA, 13 bp, Homo sapiens
tttcagaaatata

SEQ ID NO: 3219089 - DNA, 20 bp, Homo sapiens
tttcagaaatataacacatt

SEQ ID NO: 3219090 - DNA, 12 bp, Homo sapiens
tttcagaaatct

SEQ ID NO: 3219091 - DNA, 18 bp, Homo sapiens
tttcagaacctcttcccc

SEQ ID NO: 3219092 - DNA, 19 bp, Homo sapiens
tttcagaacctcttcccca

SEQ ID NO: 3219093 - DNA, 21 bp, Homo sapiens
tttcagaagaaataaatatac

SEQ ID NO: 3219094 - DNA, 11 bp, Homo sapiens
tttcagaatct

SEQ ID NO: 3219095 - DNA, 20 bp, Homo sapiens
tttcagaatctgaatgtaat

SEQ ID NO: 3219096 - DNA, 23 bp, Homo sapiens
tttcagaatctgaatgtaatttg

SEQ ID NO: 3219097 - DNA, 13 bp, Homo sapiens
tttcagagccagt

SEQ ID NO: 3219098 - DNA, 19 bp, Homo sapiens
tttcagagccagtgaagga

SEQ ID NO: 3219099 - DNA, 19 bp, Homo sapiens
tttcagagcccccagccct

SEQ ID NO: 3219100 - DNA, 22 bp, Homo sapiens
tttcagagcccccagccctggg

SEQ ID NO: 3219101 - DNA, 16 bp, Homo sapiens
tttcagatatatatca

SEQ ID NO: 3219102 - DNA, 15 bp, Homo sapiens
tttcagatatcaaaa

SEQ ID NO: 3219103 - DNA, 17 bp, Homo sapiens
tttcagatatcaaaatt

SEQ ID NO: 3219104 - DNA, 16 bp, Homo sapiens
tttcagatgcttctgg

SEQ ID NO: 3219105 - DNA, 15 bp, Homo sapiens
tttcagatgtcttct

SEQ ID NO: 3219106 - DNA, 17 bp, Homo sapiens
tttcagatgtcttctgc

SEQ ID NO: 3219107 - DNA, 18 bp, Homo sapiens
tttcagcacccccaccca

SEQ ID NO: 3219108 - DNA, 18 bp, Homo sapiens
tttcagcattaagctgtt

SEQ ID NO: 3219109 - DNA, 14 bp, Homo sapiens
tttcagcttctctg

SEQ ID NO: 3219110 - DNA, 16 bp, Homo sapiens
tttcaggaccttttga

SEQ ID NO: 3219111 - DNA, 13 bp, Homo sapiens
tttcaggatactc

SEQ ID NO: 3219112 - DNA, 21 bp, Homo sapiens
tttcaggatactctgtcagat

SEQ ID NO: 3219113 - DNA, 15 bp, Homo sapiens
tttcaggtgacatgt

SEQ ID NO: 3219114 - DNA, 22 bp, Homo sapiens
tttcaggtgacatgtgaaacct

SEQ ID NO: 3219115 - DNA, 19 bp, Homo sapiens
tttcaggtttccattctgc

SEQ ID NO: 3219116 - DNA, 14 bp, Homo sapiens
tttcaggtttgtca

SEQ ID NO: 3219117 - DNA, 19 bp, Homo sapiens
tttcagtacttttttaaat

SEQ ID NO: 3219118 - DNA, 15 bp, Homo sapiens
tttcagtatactgtg

SEQ ID NO: 3219119 - DNA, 18 bp, Homo sapiens
tttcagtatactgtgtgg

SEQ ID NO: 3219120 - DNA, 16 bp, Homo sapiens
tttcagtcaaaacttt

SEQ ID NO: 3219121 - DNA, 12 bp, Homo sapiens
tttcagttccaa

SEQ ID NO: 3219122 - DNA, 22 bp, Homo sapiens
tttcagttctttggattctaaa

SEQ ID NO: 3219123 - DNA, 21 bp, Homo sapiens
tttcagttgatcactggcaat

SEQ ID NO: 3219124 - DNA, 14 bp, Homo sapiens
tttcagtttgttgg

SEQ ID NO: 3219125 - DNA, 18 bp, Homo sapiens
tttcagtttttcatttgt

SEQ ID NO: 3219126 - DNA, 15 bp, Homo sapiens
tttcataaaaggaga

SEQ ID NO: 3219127 - DNA, 15 bp, Homo sapiens
tttcataaagggttg

SEQ ID NO: 3219128 - DNA, 15 bp, Homo sapiens
tttcatatgctgtat

SEQ ID NO: 3219129 - DNA, 15 bp, Homo sapiens
tttcatattgtgcca

SEQ ID NO: 3219130 - DNA, 16 bp, Homo sapiens
tttcatcattgtttct

SEQ ID NO: 3219131 - DNA, 22 bp, Homo sapiens
tttcatccagtttgttctccgg

SEQ ID NO: 3219132 - DNA, 22 bp, Homo sapiens
tttacagcattgtctttgctgt

SEQ ID NO: 3219133 - DNA, 20 bp, Homo sapiens
tttacagcctcacttgaatg

SEQ ID NO: 3219134 - DNA, 15 bp, Homo sapiens
tttacagctgcctgc

SEQ ID NO: 3219135 - DNA, 18 bp, Homo sapiens
tttacaggaacttcatca

SEQ ID NO: 3219136 - DNA, 19 bp, Homo sapiens
tttacaggaacttcatcat

SEQ ID NO: 3219137 - DNA, 15 bp, Homo sapiens
tttacaggtttgaat

SEQ ID NO: 3219138 - DNA, 16 bp, Homo sapiens
tttacagtatccaaaa

SEQ ID NO: 3219139 - DNA, 15 bp, Homo sapiens
tttacagtccttcaa

SEQ ID NO: 3219140 - DNA, 22 bp, Homo sapiens
tttacagtctctttcttccttt

SEQ ID NO: 3219141 - DNA, 19 bp, Homo sapiens
tttacagtgaccttttctt

SEQ ID NO: 3219142 - DNA, 20 bp, Homo sapiens
tttacagttagggttttgca

SEQ ID NO: 3219143 - DNA, 19 bp, Homo sapiens
tttacatataaaatgtaat

SEQ ID NO: 3219144 - DNA, 18 bp, Homo sapiens
tttacatgaattgcattt

SEQ ID NO: 3219145 - DNA, 20 bp, Homo sapiens
tttacatgcaatttattaaa

SEQ ID NO: 3219146 - DNA, 20 bp, Homo sapiens
tttacatgtatggttactaa

SEQ ID NO: 3219147 - DNA, 21 bp, Homo sapiens
tttacatgtatggttactaaa

SEQ ID NO: 3219148 - DNA, 12 bp, Homo sapiens
tttacatgtttt

SEQ ID NO: 3219149 - DNA, 15 bp, Homo sapiens
tttacattgtaaata

SEQ ID NO: 3219150 - DNA, 22 bp, Homo sapiens
tttatacagctgtattgtctga

SEQ ID NO: 3219151 - DNA, 18 bp, Homo sapiens
tttatacagtgccttgct

SEQ ID NO: 3219152 - DNA, 19 bp, Homo sapiens
tttatactatatttgtgct

SEQ ID NO: 3219153 - DNA, 16 bp, Homo sapiens
tttatactctttctgt

SEQ ID NO: 3219154 - DNA, 20 bp, Homo sapiens
tttatactgattatgtcttt

SEQ ID NO: 3219155 - DNA, 21 bp, Homo sapiens
tttatactgggtttcaagaaa

SEQ ID NO: 3219156 - DNA, 20 bp, Homo sapiens
tttatactgtatttctaaga

SEQ ID NO: 3219157 - DNA, 19 bp, Homo sapiens
tttatagactgatttagaa

SEQ ID NO: 3219158 - DNA, 18 bp, Homo sapiens
tttatagcaagatattga

SEQ ID NO: 3219159 - DNA, 22 bp, Homo sapiens
tttatagcaagatattgatcaa

SEQ ID NO: 3219160 - DNA, 23 bp, Homo sapiens
tttatagcaagatattgatcaaa

SEQ ID NO: 3219161 - DNA, 22 bp, Homo sapiens
tttataggaaaaaaactgggat

SEQ ID NO: 3219162 - DNA, 23 bp, Homo sapiens
tttataggactgttctttgctgt

SEQ ID NO: 3219163 - DNA, 17 bp, Homo sapiens
tttatagtatgtgactt

SEQ ID NO: 3219164 - DNA, 17 bp, Homo sapiens
tttatagtttgtacatg

SEQ ID NO: 3219165 - DNA, 14 bp, Homo sapiens
tttatatacttttt

SEQ ID NO: 3219166 - DNA, 18 bp, Homo sapiens
tttatatattatgtgaag

SEQ ID NO: 3219167 - DNA, 12 bp, Homo sapiens
tttatatattta

SEQ ID NO: 3219168 - DNA, 15 bp, Homo sapiens
tttatatccacatct

SEQ ID NO: 3219169 - DNA, 17 bp, Homo sapiens
tttatatcccattttta

SEQ ID NO: 3219170 - DNA, 18 bp, Homo sapiens
tttatatggcccagcctt

SEQ ID NO: 3219171 - DNA, 13 bp, Homo sapiens
tttatatgtacat

SEQ ID NO: 3219172 - DNA, 16 bp, Homo sapiens
tttatattcttatgtt

SEQ ID NO: 3219173 - DNA, 19 bp, Homo sapiens
tttatatttaaaaattgtt

SEQ ID NO: 3219174 - DNA, 15 bp, Homo sapiens
tttatcaactttggt

SEQ ID NO: 3219175 - DNA, 16 bp, Homo sapiens
tttatcaatgtgtctt

SEQ ID NO: 3219176 - DNA, 22 bp, Homo sapiens
tttatcacaaccaccgttacaa

SEQ ID NO: 3219177 - DNA, 15 bp, Homo sapiens
tttatcacacttctg

SEQ ID NO: 3219178 - DNA, 14 bp, Homo sapiens
tttatcagaattct

SEQ ID NO: 3219179 - DNA, 17 bp, Homo sapiens
tttatcatgaatgcttt

SEQ ID NO: 3219180 - DNA, 19 bp, Homo sapiens
tttatcatgaatgctttta

SEQ ID NO: 3219181 - DNA, 21 bp, Homo sapiens
tttatcatgaattccctttta

SEQ ID NO: 3219182 - DNA, 22 bp, Homo sapiens
tttatcatgaattcccttttaa

SEQ ID NO: 3219183 - DNA, 22 bp, Homo sapiens
tttatcatgtcgtaggtaaact

SEQ ID NO: 3219184 - DNA, 23 bp, Homo sapiens
tttatcatgtcgtaggtaaacta

SEQ ID NO: 3219185 - DNA, 20 bp, Homo sapiens
tttatccaaaatgtgtattt

SEQ ID NO: 3219186 - DNA, 22 bp, Homo sapiens
tttatccaaaatgtgtatttct

SEQ ID NO: 3219187 - DNA, 15 bp, Homo sapiens
tttatccaaatcttg

SEQ ID NO: 3219188 - DNA, 20 bp, Homo sapiens
tttatccacaggaaagtgtt

SEQ ID NO: 3219189 - DNA, 21 bp, Homo sapiens
tttatccattcaactgaaaat

SEQ ID NO: 3219190 - DNA, 16 bp, Homo sapiens
tttatccatttgtaat

SEQ ID NO: 3219191 - DNA, 21 bp, Homo sapiens
tttatccctttacaatgtgaa

SEQ ID NO: 3219192 - DNA, 22 bp, Homo sapiens
tttatcctagtcattcttccct

SEQ ID NO: 3219193 - DNA, 12 bp, Homo sapiens
tttatctaaatt

SEQ ID NO: 3219194 - DNA, 15 bp, Homo sapiens
tttatctaaattaaa

SEQ ID NO: 3219195 - DNA, 20 bp, Homo sapiens
tttatctataatttacctaa

SEQ ID NO: 3219196 - DNA, 20 bp, Homo sapiens
tttatctatataaaataact

SEQ ID NO: 3219197 - DNA, 17 bp, Homo sapiens
tttatctctatttaata

SEQ ID NO: 3219198 - DNA, 12 bp, Homo sapiens
tttatctgcaga

SEQ ID NO: 3219199 - DNA, 16 bp, Homo sapiens
tttatctgtagtaaac

SEQ ID NO: 3219200 - DNA, 21 bp, Homo sapiens
tttatcttggactgacattta

SEQ ID NO: 3219201 - DNA, 14 bp, Homo sapiens
tttatcttgtctct

SEQ ID NO: 3219202 - DNA, 16 bp, Homo sapiens
tttatctttttacctt

SEQ ID NO: 3219203 - DNA, 16 bp, Homo sapiens
tttatgaaaataaata

SEQ ID NO: 3219204 - DNA, 13 bp, Homo sapiens
tttatgaaggttt

SEQ ID NO: 3219205 - DNA, 20 bp, Homo sapiens
tttatgaatgaaaaaacagt

SEQ ID NO: 3219206 - DNA, 20 bp, Homo sapiens
tttatgagatgctggttttc

SEQ ID NO: 3219207 - DNA, 17 bp, Homo sapiens
tttatgagccagacaaa

SEQ ID NO: 3219208 - DNA, 22 bp, Homo sapiens
tttatgagtaactattattata

SEQ ID NO: 3219209 - DNA, 17 bp, Homo sapiens
tttatgataatagattc

SEQ ID NO: 3219210 - DNA, 18 bp, Homo sapiens
tttatgataatagattct

SEQ ID NO: 3219211 - DNA, 17 bp, Homo sapiens
tttatgatctatttgta

SEQ ID NO: 3219212 - DNA, 19 bp, Homo sapiens
tttatgatctatttgtaga

SEQ ID NO: 3219213 - DNA, 14 bp, Homo sapiens
tttatgatgatgaa

SEQ ID NO: 3219214 - DNA, 14 bp, Homo sapiens
tttatgatgtatat

SEQ ID NO: 3219215 - DNA, 12 bp, Homo sapiens
tttatgatttaa

SEQ ID NO: 3219216 - DNA, 23 bp, Homo sapiens
tttatgcagaagcatattttgct

SEQ ID NO: 3219217 - DNA, 20 bp, Homo sapiens
tttatgctcttttttactca

SEQ ID NO: 3219218 - DNA, 17 bp, Homo sapiens
tttatggatgattaaat

SEQ ID NO: 3219219 - DNA, 23 bp, Homo sapiens
tttatggccaatctattctcaaa

SEQ ID NO: 3219220 - DNA, 13 bp, Homo sapiens
tttatggcctcag

SEQ ID NO: 3219221 - DNA, 22 bp, Homo sapiens
tttatggcctcagctgcctcac

SEQ ID NO: 3219222 - DNA, 12 bp, Homo sapiens
tttatgggagaa

SEQ ID NO: 3219223 - DNA, 13 bp, Homo sapiens
tttatgggccttg

SEQ ID NO: 3219224 - DNA, 21 bp, Homo sapiens
tttatggtttcccccttctac

SEQ ID NO: 3219225 - DNA, 22 bp, Homo sapiens
tttatgtaaactgcattagaaa

SEQ ID NO: 3219226 - DNA, 19 bp, Homo sapiens
tttatgtagtaattgacat

SEQ ID NO: 3219227 - DNA, 19 bp, Homo sapiens
tttatgtgtatatttgtag

SEQ ID NO: 3219228 - DNA, 20 bp, Homo sapiens
tttatgttaagggaagaatt

SEQ ID NO: 3219229 - DNA, 16 bp, Homo sapiens
tttatgttgtatgatt

SEQ ID NO: 3219230 - DNA, 12 bp, Homo sapiens
tttatgttttgt

SEQ ID NO: 3219231 - DNA, 18 bp, Homo sapiens
tttatgttttgtttctga

SEQ ID NO: 3219232 - DNA, 17 bp, Homo sapiens
tttattaaacagatttt

SEQ ID NO: 3219233 - DNA, 15 bp, Homo sapiens
tttattaaacatttt

SEQ ID NO: 3219234 - DNA, 21 bp, Homo sapiens
tttattaaatacaaaacttcc

SEQ ID NO: 3219235 - DNA, 20 bp, Homo sapiens
tttattaaatttgttgacaa

SEQ ID NO: 3219236 - DNA, 21 bp, Homo sapiens
tttattaaatttgttgacaaa

SEQ ID NO: 3219237 - DNA, 12 bp, Homo sapiens
tttattaacaaa

SEQ ID NO: 3219238 - DNA, 18 bp, Homo sapiens
tttattaacaaattatgt

SEQ ID NO: 3219239 - DNA, 22 bp, Homo sapiens
tttattaagatggattctcaga

SEQ ID NO: 3219240 - DNA, 20 bp, Homo sapiens
tttattaagctttttggaat

SEQ ID NO: 3219241 - DNA, 14 bp, Homo sapiens
tttattaagtctgg

SEQ ID NO: 3219242 - DNA, 14 bp, Homo sapiens
tttattacataatt

SEQ ID NO: 3219243 - DNA, 12 bp, Homo sapiens
tttattaccccc

SEQ ID NO: 3219244 - DNA, 17 bp, Homo sapiens
tttattaccccctcctt

SEQ ID NO: 3219245 - DNA, 20 bp, Homo sapiens
tttattacctctgatacctc

SEQ ID NO: 3219246 - DNA, 13 bp, Homo sapiens
tttattactgatt

SEQ ID NO: 3219247 - DNA, 22 bp, Homo sapiens
tttattataaattctactaagt

SEQ ID NO: 3219248 - DNA, 16 bp, Homo sapiens
tttattatttatttat

SEQ ID NO: 3219249 - DNA, 17 bp, Homo sapiens
tttattcaattcctctg

SEQ ID NO: 3219250 - DNA, 11 bp, Homo sapiens
tttattcacat

SEQ ID NO: 3219251 - DNA, 17 bp, Homo sapiens
tttattcagcttcattt

SEQ ID NO: 3219252 - DNA, 21 bp, Homo sapiens
tttattcataatgaattataa

SEQ ID NO: 3219253 - DNA, 19 bp, Homo sapiens
tttattccagaatgctgta

SEQ ID NO: 3219254 - DNA, 22 bp, Homo sapiens
tttattccagaatgctgtacat

SEQ ID NO: 3219255 - DNA, 22 bp, Homo sapiens
tttattccctgcccaaaccctt

SEQ ID NO: 3219256 - DNA, 21 bp, Homo sapiens
tttattctagggtttcttaaa

SEQ ID NO: 3219257 - DNA, 14 bp, Homo sapiens
tttattctcatttg

SEQ ID NO: 3219258 - DNA, 15 bp, Homo sapiens
tttattcttctagag

SEQ ID NO: 3219259 - DNA, 15 bp, Homo sapiens
tttattgacacagaa

SEQ ID NO: 3219260 - DNA, 16 bp, Homo sapiens
tttattggctgagata

SEQ ID NO: 3219261 - DNA, 22 bp, Homo sapiens
tttattgtctgtctacatttct

SEQ ID NO: 3219262 - DNA, 20 bp, Homo sapiens
tttattgttaactcttgtct

SEQ ID NO: 3219263 - DNA, 23 bp, Homo sapiens
tttattgttcacacaaagcctgt

SEQ ID NO: 3219264 - DNA, 19 bp, Homo sapiens
tttatttaattaaatgtat

SEQ ID NO: 3219265 - DNA, 20 bp, Homo sapiens
tttatttacagatgaatgta

SEQ ID NO: 3219266 - DNA, 18 bp, Homo sapiens
tttatttacattttatat

SEQ ID NO: 3219267 - DNA, 20 bp, Homo sapiens
tttaaattataacttaaaat

SEQ ID NO: 3219268 - DNA, 19 bp, Homo sapiens
tttaaattatactgtagct

SEQ ID NO: 3219269 - DNA, 19 bp, Homo sapiens
tttaaattcacaatagaaa

SEQ ID NO: 3219270 - DNA, 17 bp, Homo sapiens
tttaaattctgagacat

SEQ ID NO: 3219271 - DNA, 18 bp, Homo sapiens
tttaaatttgatttccat

SEQ ID NO: 3219272 - DNA, 14 bp, Homo sapiens
tttaaatttgttat

SEQ ID NO: 3219273 - DNA, 22 bp, Homo sapiens
tttaaattttaccctttagact

SEQ ID NO: 3219274 - DNA, 14 bp, Homo sapiens
tttaacaaatctaa

SEQ ID NO: 3219275 - DNA, 15 bp, Homo sapiens
tttaacaaatctaat

SEQ ID NO: 3219276 - DNA, 23 bp, Homo sapiens
tttaacaaatctaatctcttatt

SEQ ID NO: 3219277 - DNA, 18 bp, Homo sapiens
tttaacaataactactgt

SEQ ID NO: 3219278 - DNA, 22 bp, Homo sapiens
tttaacaataactactgtgttc

SEQ ID NO: 3219279 - DNA, 13 bp, Homo sapiens
tttaacactttgt

SEQ ID NO: 3219280 - DNA, 14 bp, Homo sapiens
tttaacactttgta

SEQ ID NO: 3219281 - DNA, 18 bp, Homo sapiens
tttaacagaaactttcaa

SEQ ID NO: 3219282 - DNA, 17 bp, Homo sapiens
tttaacagctgaattat

SEQ ID NO: 3219283 - DNA, 23 bp, Homo sapiens
tttaacatgaacacccttagaaa

SEQ ID NO: 3219284 - DNA, 17 bp, Homo sapiens
tttaacatgatttcaaa

SEQ ID NO: 3219285 - DNA, 17 bp, Homo sapiens
tttaacattttgttctt

SEQ ID NO: 3219286 - DNA, 23 bp, Homo sapiens
tttaacattttgttcttacacat

SEQ ID NO: 3219287 - DNA, 18 bp, Homo sapiens
tttaaccacattaattaa

SEQ ID NO: 3219288 - DNA, 17 bp, Homo sapiens
tttaaccattttaacct

SEQ ID NO: 3219289 - DNA, 21 bp, Homo sapiens
tttaacctagatgtttaacaa

SEQ ID NO: 3219290 - DNA, 23 bp, Homo sapiens
tttaacctagatgtttaacaaat

SEQ ID NO: 3219291 - DNA, 16 bp, Homo sapiens
tttaactgaaaatgta

SEQ ID NO: 3219292 - DNA, 14 bp, Homo sapiens
tttaactgagaaat

SEQ ID NO: 3219293 - DNA, 21 bp, Homo sapiens
tttaactgattcttatgatta

SEQ ID NO: 3219294 - DNA, 17 bp, Homo sapiens
tttaactgtggatattg

SEQ ID NO: 3219295 - DNA, 14 bp, Homo sapiens
tttaactttaagtt

SEQ ID NO: 3219296 - DNA, 13 bp, Homo sapiens
tttaactttttat

SEQ ID NO: 3219297 - DNA, 18 bp, Homo sapiens
tttaactttttatttcta

SEQ ID NO: 3219298 - DNA, 15 bp, Homo sapiens
tttaagaaaagcact

SEQ ID NO: 3219299 - DNA, 12 bp, Homo sapiens
tttaagaaaata

SEQ ID NO: 3219300 - DNA, 13 bp, Homo sapiens
tttaagaaaatac

SEQ ID NO: 3219301 - DNA, 21 bp, Homo sapiens
tttaagagagaaatctgaaaa

SEQ ID NO: 3219302 - DNA, 22 bp, Homo sapiens
tttaagaggaatttataacaaa

SEQ ID NO: 3219303 - DNA, 22 bp, Homo sapiens
tttaagagtgaaataattaaaa

SEQ ID NO: 3219304 - DNA, 15 bp, Homo sapiens
tttaagataatagtt

SEQ ID NO: 3219305 - DNA, 20 bp, Homo sapiens
tttaagataatagtttacat

SEQ ID NO: 3219306 - DNA, 12 bp, Homo sapiens
tttaagattttt

SEQ ID NO: 3219307 - DNA, 16 bp, Homo sapiens
tttaagatttttctca

SEQ ID NO: 3219308 - DNA, 17 bp, Homo sapiens
tttaagatttttctcaa

SEQ ID NO: 3219309 - DNA, 18 bp, Homo sapiens
tttaagatttttctcaaa

SEQ ID NO: 3219310 - DNA, 23 bp, Homo sapiens
tttaagcactacataaactgact

SEQ ID NO: 3219311 - DNA, 14 bp, Homo sapiens
tttaagcattgttt

SEQ ID NO: 3219312 - DNA, 18 bp, Homo sapiens
tttaagccaaagaaacaa

SEQ ID NO: 3219313 - DNA, 22 bp, Homo sapiens
tttaagccttataaaccaatct

SEQ ID NO: 3219314 - DNA, 11 bp, Homo sapiens
tttaagctgtt

SEQ ID NO: 3219315 - DNA, 23 bp, Homo sapiens
tttaaggaacaagaattgctaaa

SEQ ID NO: 3219316 - DNA, 18 bp, Homo sapiens
tttaaggctaaaacttaa

SEQ ID NO: 3219317 - DNA, 17 bp, Homo sapiens
tttaagggtttgtggaa

SEQ ID NO: 3219318 - DNA, 22 bp, Homo sapiens
tttaagtaatgtggaagaaaat

SEQ ID NO: 3219319 - DNA, 23 bp, Homo sapiens
tttaagtaatgtggaagaaaatg

SEQ ID NO: 3219320 - DNA, 15 bp, Homo sapiens
tttaagtattaactt

SEQ ID NO: 3219321 - DNA, 12 bp, Homo sapiens
tttaagtattta

SEQ ID NO: 3219322 - DNA, 13 bp, Homo sapiens
tttaagtatttag

SEQ ID NO: 3219323 - DNA, 18 bp, Homo sapiens
tttaagtatttaggtttt

SEQ ID NO: 3219324 - DNA, 15 bp, Homo sapiens
tttaagtatttatat

SEQ ID NO: 3219325 - DNA, 18 bp, Homo sapiens
tttaagtgctttgtaatg

SEQ ID NO: 3219326 - DNA, 22 bp, Homo sapiens
tttaagtttcaaacttactatt

SEQ ID NO: 3219327 - DNA, 13 bp, Homo sapiens
tttaataaaaagg

SEQ ID NO: 3219328 - DNA, 15 bp, Homo sapiens
tttaataaagatgag

SEQ ID NO: 3219329 - DNA, 14 bp, Homo sapiens
tttaataacaattg

SEQ ID NO: 3219330 - DNA, 18 bp, Homo sapiens
tttaataacattacctta

SEQ ID NO: 3219331 - DNA, 23 bp, Homo sapiens
tttaataacattaccttactgtg

SEQ ID NO: 3219332 - DNA, 19 bp, Homo sapiens
tttaataatgtatgtacag

SEQ ID NO: 3219333 - DNA, 17 bp, Homo sapiens
tttaatagaagttttat

SEQ ID NO: 3219334 - DNA, 16 bp, Homo sapiens
tttaatagtgcttttt

SEQ ID NO: 3219335 - DNA, 22 bp, Homo sapiens
tttaatataaaagatatatata

SEQ ID NO: 3219336 - DNA, 15 bp, Homo sapiens
tttaatataaagcct

SEQ ID NO: 3219337 - DNA, 19 bp, Homo sapiens
tttaatatctggcactgtt

SEQ ID NO: 3219338 - DNA, 13 bp, Homo sapiens
tttaatatcttca

SEQ ID NO: 3219339 - DNA, 21 bp, Homo sapiens
tttaatattactgtctttatt

SEQ ID NO: 3219340 - DNA, 22 bp, Homo sapiens
tttaatattgagaaagaaacta

SEQ ID NO: 3219341 - DNA, 18 bp, Homo sapiens
tttaatattgatgtcagt

SEQ ID NO: 3219342 - DNA, 12 bp, Homo sapiens
tttaatatttaa

SEQ ID NO: 3219343 - DNA, 15 bp, Homo sapiens
tttaatatttaaaca

SEQ ID NO: 3219344 - DNA, 20 bp, Homo sapiens
tttaatcatgaatatgatga

SEQ ID NO: 3219345 - DNA, 21 bp, Homo sapiens
tttaatccagaattgaccttt

SEQ ID NO: 3219346 - DNA, 12 bp, Homo sapiens
tttaatccagtt

SEQ ID NO: 3219347 - DNA, 18 bp, Homo sapiens
tttaatcctgtaccaaat

SEQ ID NO: 3219348 - DNA, 22 bp, Homo sapiens
tttaatcctgtaccaaatctga

SEQ ID NO: 3219349 - DNA, 17 bp, Homo sapiens
tttaatctgaaattcta

SEQ ID NO: 3219350 - DNA, 13 bp, Homo sapiens
tttaatcttcagt

SEQ ID NO: 3219351 - DNA, 17 bp, Homo sapiens
tttaatctttgtgacag

SEQ ID NO: 3219352 - DNA, 16 bp, Homo sapiens
tttaatgaaagactgt

SEQ ID NO: 3219353 - DNA, 23 bp, Homo sapiens
tttaatgaaagactgtacaaagt

SEQ ID NO: 3219354 - DNA, 23 bp, Homo sapiens
tttaatgatctcggatgaccaaa

SEQ ID NO: 3219355 - DNA, 19 bp, Homo sapiens
tttaatgcattaaacctgt

SEQ ID NO: 3219356 - DNA, 14 bp, Homo sapiens
tttaatgctgcctt

SEQ ID NO: 3219357 - DNA, 17 bp, Homo sapiens
tttaatggatatttctc

SEQ ID NO: 3219358 - DNA, 20 bp, Homo sapiens
tttaatgggggtagcagctg

SEQ ID NO: 3219359 - DNA, 19 bp, Homo sapiens
tttaatgtgaacttgtagc

SEQ ID NO: 3219360 - DNA, 17 bp, Homo sapiens
tttaatgtgtattgaag

SEQ ID NO: 3219361 - DNA, 14 bp, Homo sapiens
tttaattaagcaaa

SEQ ID NO: 3219362 - DNA, 11 bp, Homo sapiens
tttaattatta

SEQ ID NO: 3219363 - DNA, 19 bp, Homo sapiens
tttaattattaactacatt

SEQ ID NO: 3219364 - DNA, 20 bp, Homo sapiens
tttaattattttaaaatatt

SEQ ID NO: 3219365 - DNA, 22 bp, Homo sapiens
tttaattctttctattttcaca

SEQ ID NO: 3219366 - DNA, 15 bp, Homo sapiens
tttaattgtaaactg

SEQ ID NO: 3219367 - DNA, 19 bp, Homo sapiens
tttaattgtaaactgtact

SEQ ID NO: 3219368 - DNA, 13 bp, Homo sapiens
tttaattgtagtt

SEQ ID NO: 3219369 - DNA, 22 bp, Homo sapiens
tttaattgtagttctgtgtact

SEQ ID NO: 3219370 - DNA, 21 bp, Homo sapiens
tttaattgtataagtcaagca

SEQ ID NO: 3219371 - DNA, 12 bp, Homo sapiens
tttaattgtcat

SEQ ID NO: 3219372 - DNA, 21 bp, Homo sapiens
tttaattgtcatggttacaaa

SEQ ID NO: 3219373 - DNA, 13 bp, Homo sapiens
tttaatttaacaa

SEQ ID NO: 3219374 - DNA, 17 bp, Homo sapiens
tttaatttaacaaacta

SEQ ID NO: 3219375 - DNA, 20 bp, Homo sapiens
tttaatttaacaaactaaaa

SEQ ID NO: 3219376 - DNA, 20 bp, Homo sapiens
tttaatttatttattaagat

SEQ ID NO: 3219377 - DNA, 13 bp, Homo sapiens
tttaatttcttca

SEQ ID NO: 3219378 - DNA, 22 bp, Homo sapiens
tttaatttgatgaaagctgatt

SEQ ID NO: 3219379 - DNA, 14 bp, Homo sapiens
tttaattttgatat

SEQ ID NO: 3219380 - DNA, 18 bp, Homo sapiens
tttaattttgtgttgcta

SEQ ID NO: 3219381 - DNA, 22 bp, Homo sapiens
tttaatttttgcttttagaaaa

SEQ ID NO: 3219382 - DNA, 14 bp, Homo sapiens
tttaattttttact

SEQ ID NO: 3219383 - DNA, 21 bp, Homo sapiens
tttacaaaagaaataccttga

SEQ ID NO: 3219384 - DNA, 20 bp, Homo sapiens
tttacaaaagaggagcactt

SEQ ID NO: 3219385 - DNA, 13 bp, Homo sapiens
tttacaaaagatg

SEQ ID NO: 3219386 - DNA, 22 bp, Homo sapiens
tttacaagatccatttgccttt

SEQ ID NO: 3219387 - DNA, 15 bp, Homo sapiens
tttacaagtgtatat

SEQ ID NO: 3219388 - DNA, 19 bp, Homo sapiens
tttacaattttttatcatg

SEQ ID NO: 3219389 - DNA, 16 bp, Homo sapiens
tttacacaaatgtgat

SEQ ID NO: 3219390 - DNA, 21 bp, Homo sapiens
tttacacaattaattcatccc

SEQ ID NO: 3219391 - DNA, 15 bp, Homo sapiens
tttacaccacacttt

SEQ ID NO: 3219392 - DNA, 17 bp, Homo sapiens
tttacaccacactttca

SEQ ID NO: 3219393 - DNA, 18 bp, Homo sapiens
tttacaccacactttcaa

SEQ ID NO: 3219394 - DNA, 22 bp, Homo sapiens
tttacagacagaagagaaggaa

SEQ ID NO: 3219395 - DNA, 16 bp, Homo sapiens
ttgttttcacttgtat

SEQ ID NO: 3219396 - DNA, 16 bp, Homo sapiens
ttgttttcagtgtaca

SEQ ID NO: 3219397 - DNA, 11 bp, Homo sapiens
ttgttttctct

SEQ ID NO: 3219398 - DNA, 15 bp, Homo sapiens
ttgttttgaaaataa

SEQ ID NO: 3219399 - DNA, 14 bp, Homo sapiens
ttgttttgcacttt

SEQ ID NO: 3219400 - DNA, 16 bp, Homo sapiens
ttgttttgcacttttt

SEQ ID NO: 3219401 - DNA, 12 bp, Homo sapiens
ttgttttgcttt

SEQ ID NO: 3219402 - DNA, 13 bp, Homo sapiens
ttgttttgctttt

SEQ ID NO: 3219403 - DNA, 17 bp, Homo sapiens
ttgttttggatggcttg

SEQ ID NO: 3219404 - DNA, 10 bp, Homo sapiens
ttgttttgtt

SEQ ID NO: 3219405 - DNA, 14 bp, Homo sapiens
ttgttttgtttgtc

SEQ ID NO: 3219406 - DNA, 13 bp, Homo sapiens
ttgttttgtttta

SEQ ID NO: 3219407 - DNA, 14 bp, Homo sapiens
ttgtttttctttct

SEQ ID NO: 3219408 - DNA, 21 bp, Homo sapiens
ttgtttttgtatttattaatt

SEQ ID NO: 3219409 - DNA, 13 bp, Homo sapiens
ttgttttttaagt

SEQ ID NO: 3219410 - DNA, 18 bp, Homo sapiens
ttgttttttcttgccagg

SEQ ID NO: 3219411 - DNA, 23 bp, Homo sapiens
ttgtttttttcctcatgtaacat

SEQ ID NO: 3219412 - DNA, 22 bp, Homo sapiens
tttaaaaaaaaaagttacagaa

SEQ ID NO: 3219413 - DNA, 16 bp, Homo sapiens
tttaaaaaaacaaata

SEQ ID NO: 3219414 - DNA, 17 bp, Homo sapiens
tttaaaaaaacaaataa

SEQ ID NO: 3219415 - DNA, 19 bp, Homo sapiens
tttaaaaaaacattattgt

SEQ ID NO: 3219416 - DNA, 15 bp, Homo sapiens
tttaaaaaaagaaaa

SEQ ID NO: 3219417 - DNA, 22 bp, Homo sapiens
tttaaaaaaagaaaatgaaaaa

SEQ ID NO: 3219418 - DNA, 22 bp, Homo sapiens
tttaaaaaaatacagtattctg

SEQ ID NO: 3219419 - DNA, 17 bp, Homo sapiens
tttaaaaaaatcacaaa

SEQ ID NO: 3219420 - DNA, 15 bp, Homo sapiens
tttaaaaaagactga

SEQ ID NO: 3219421 - DNA, 19 bp, Homo sapiens
tttaaaaaattatggaata

SEQ ID NO: 3219422 - DNA, 20 bp, Homo sapiens
tttaaaaaattatggaatat

SEQ ID NO: 3219423 - DNA, 22 bp, Homo sapiens
tttaaaaaattatggaatatca

SEQ ID NO: 3219424 - DNA, 18 bp, Homo sapiens
tttaaaaacatagaaaaa

SEQ ID NO: 3219425 - DNA, 16 bp, Homo sapiens
tttaaaaactcttcag

SEQ ID NO: 3219426 - DNA, 14 bp, Homo sapiens
tttaaaaagccagt

SEQ ID NO: 3219427 - DNA, 18 bp, Homo sapiens
tttaaaaaggaaatttgt

SEQ ID NO: 3219428 - DNA, 18 bp, Homo sapiens
tttaaaaagtaagttaat

SEQ ID NO: 3219429 - DNA, 22 bp, Homo sapiens
tttaaaaagtaagttaataatg

SEQ ID NO: 3219430 - DNA, 15 bp, Homo sapiens
tttaaaaagtcttca

SEQ ID NO: 3219431 - DNA, 23 bp, Homo sapiens
tttaaaaatacagatagatatat

SEQ ID NO: 3219432 - DNA, 12 bp, Homo sapiens
tttaaaaatatt

SEQ ID NO: 3219433 - DNA, 12 bp, Homo sapiens
tttaaaaatgat

SEQ ID NO: 3219434 - DNA, 20 bp, Homo sapiens
tttaaaactcagaatataac

SEQ ID NO: 3219435 - DNA, 23 bp, Homo sapiens
tttaaaactcagaatataacatg

SEQ ID NO: 3219436 - DNA, 12 bp, Homo sapiens
tttaaaagaaat

SEQ ID NO: 3219437 - DNA, 13 bp, Homo sapiens
tttaaaagaatga

SEQ ID NO: 3219438 - DNA, 23 bp, Homo sapiens
tttaaaagagagagagagaaaaa

SEQ ID NO: 3219439 - DNA, 20 bp, Homo sapiens
tttaaaagcacaatcactaa

SEQ ID NO: 3219440 - DNA, 13 bp, Homo sapiens
tttaaaagcctgc

SEQ ID NO: 3219441 - DNA, 20 bp, Homo sapiens
tttaaaaggtattttgaata

SEQ ID NO: 3219442 - DNA, 22 bp, Homo sapiens
tttaaaaggtattttgaatacc

SEQ ID NO: 3219443 - DNA, 17 bp, Homo sapiens
tttaaaagttttgttct

SEQ ID NO: 3219444 - DNA, 18 bp, Homo sapiens
tttaaaagttttgttctt

SEQ ID NO: 3219445 - DNA, 19 bp, Homo sapiens
tttaaaataaaatgaaaat

SEQ ID NO: 3219446 - DNA, 14 bp, Homo sapiens
tttaaaatacttgt

SEQ ID NO: 3219447 - DNA, 14 bp, Homo sapiens
tttaaaatatttaa

SEQ ID NO: 3219448 - DNA, 15 bp, Homo sapiens
tttaaaatcaactta

SEQ ID NO: 3219449 - DNA, 13 bp, Homo sapiens
tttaaaatcacta

SEQ ID NO: 3219450 - DNA, 19 bp, Homo sapiens
tttaaaatcactaacatta

SEQ ID NO: 3219451 - DNA, 18 bp, Homo sapiens
tttaaaatgtaatttaaa

SEQ ID NO: 3219452 - DNA, 13 bp, Homo sapiens
tttaaaattcagt

SEQ ID NO: 3219453 - DNA, 23 bp, Homo sapiens
tttaaaattgtcacctctgttaa

SEQ ID NO: 3219454 - DNA, 20 bp, Homo sapiens
tttaaacaaaatagaagctg

SEQ ID NO: 3219455 - DNA, 17 bp, Homo sapiens
tttaaacaaacattgtg

SEQ ID NO: 3219456 - DNA, 21 bp, Homo sapiens
tttaaacacttatcttctgga

SEQ ID NO: 3219457 - DNA, 16 bp, Homo sapiens
tttaaacattaaaaat

SEQ ID NO: 3219458 - DNA, 18 bp, Homo sapiens
tttaaaccttttattata

SEQ ID NO: 3219459 - DNA, 21 bp, Homo sapiens
tttaaactgtgtacataactg

SEQ ID NO: 3219460 - DNA, 14 bp, Homo sapiens
tttaaacttataaa

SEQ ID NO: 3219461 - DNA, 18 bp, Homo sapiens
tttaaagaatatgacttt

SEQ ID NO: 3219462 - DNA, 17 bp, Homo sapiens
tttaaagaccctcctat

SEQ ID NO: 3219463 - DNA, 13 bp, Homo sapiens
tttaaagagtcta

SEQ ID NO: 3219464 - DNA, 15 bp, Homo sapiens
tttaaagagtctaga

SEQ ID NO: 3219465 - DNA, 16 bp, Homo sapiens
tttaaagagtctagat

SEQ ID NO: 3219466 - DNA, 16 bp, Homo sapiens
tttaaagcattgcttt

SEQ ID NO: 3219467 - DNA, 18 bp, Homo sapiens
tttaaagccattctgatt

SEQ ID NO: 3219468 - DNA, 13 bp, Homo sapiens
tttaaaggcagag

SEQ ID NO: 3219469 - DNA, 19 bp, Homo sapiens
tttaaaggcccagccccta

SEQ ID NO: 3219470 - DNA, 22 bp, Homo sapiens
tttaaaggggcagaaaaactct

SEQ ID NO: 3219471 - DNA, 19 bp, Homo sapiens
tttaaagtaaatctctttt

SEQ ID NO: 3219472 - DNA, 16 bp, Homo sapiens
tttaaagtactttctt

SEQ ID NO: 3219473 - DNA, 21 bp, Homo sapiens
tttaaagtatgcattattaaa

SEQ ID NO: 3219474 - DNA, 18 bp, Homo sapiens
tttaaagtctcagtttct

SEQ ID NO: 3219475 - DNA, 14 bp, Homo sapiens
tttaaagtgcaaaa

SEQ ID NO: 3219476 - DNA, 18 bp, Homo sapiens
tttaaagtgtaataatat

SEQ ID NO: 3219477 - DNA, 20 bp, Homo sapiens
tttaaataaactttttttca

SEQ ID NO: 3219478 - DNA, 21 bp, Homo sapiens
tttaaataaactttttttcaa

SEQ ID NO: 3219479 - DNA, 23 bp, Homo sapiens
tttaaataaactttttttcaatg

SEQ ID NO: 3219480 - DNA, 12 bp, Homo sapiens
tttaaataacct

SEQ ID NO: 3219481 - DNA, 20 bp, Homo sapiens
tttaaataacctctggccct

SEQ ID NO: 3219482 - DNA, 14 bp, Homo sapiens
tttaaatataaata

SEQ ID NO: 3219483 - DNA, 14 bp, Homo sapiens
tttaaatattttct

SEQ ID NO: 3219484 - DNA, 22 bp, Homo sapiens
tttaaatcaagtcccaaattca

SEQ ID NO: 3219485 - DNA, 22 bp, Homo sapiens
tttaaatctaaatctatttatt

SEQ ID NO: 3219486 - DNA, 22 bp, Homo sapiens
tttaaatgaattaaatattgaa

SEQ ID NO: 3219487 - DNA, 16 bp, Homo sapiens
tttaaatgtaaaacat

SEQ ID NO: 3219488 - DNA, 15 bp, Homo sapiens
tttaaatgtaaagat

SEQ ID NO: 3219489 - DNA, 17 bp, Homo sapiens
tttaaatgttctaacag

SEQ ID NO: 3219490 - DNA, 13 bp, Homo sapiens
tttaaattacaat

SEQ ID NO: 3219491 - DNA, 14 bp, Homo sapiens
tttaaattagaaaa

SEQ ID NO: 3219492 - DNA, 22 bp, Homo sapiens
tttaaattagaaaatattctct

SEQ ID NO: 3219493 - DNA, 14 bp, Homo sapiens
ttgtgtatatttgt

SEQ ID NO: 3219494 - DNA, 16 bp, Homo sapiens
ttgtgtatatttgtat

SEQ ID NO: 3219495 - DNA, 11 bp, Homo sapiens
ttgtgtatgta

SEQ ID NO: 3219496 - DNA, 13 bp, Homo sapiens
ttgtgtatgtact

SEQ ID NO: 3219497 - DNA, 14 bp, Homo sapiens
ttgtgtatgtactt

SEQ ID NO: 3219498 - DNA, 19 bp, Homo sapiens
ttgtgtatttacgctttga

SEQ ID NO: 3219499 - DNA, 22 bp, Homo sapiens
ttgtgtatttacgctttgattc

SEQ ID NO: 3219500 - DNA, 18 bp, Homo sapiens
ttgtgtcaagacatttct

SEQ ID NO: 3219501 - DNA, 13 bp, Homo sapiens
ttgtgtctgtaca

SEQ ID NO: 3219502 - DNA, 18 bp, Homo sapiens
ttgtgtgaaaaaagaaaa

SEQ ID NO: 3219503 - DNA, 12 bp, Homo sapiens
ttgtgtgaaatt

SEQ ID NO: 3219504 - DNA, 14 bp, Homo sapiens
ttgtgtgaaattgc

SEQ ID NO: 3219505 - DNA, 21 bp, Homo sapiens
ttgtgtgaccaactgtgttgt

SEQ ID NO: 3219506 - DNA, 23 bp, Homo sapiens
ttgtgtgaccaactgtgttgtat

SEQ ID NO: 3219507 - DNA, 13 bp, Homo sapiens
ttgtgtgattgaa

SEQ ID NO: 3219508 - DNA, 13 bp, Homo sapiens
ttgtgtggattct

SEQ ID NO: 3219509 - DNA, 20 bp, Homo sapiens
ttgtgtggcaatgggatttg

SEQ ID NO: 3219510 - DNA, 19 bp, Homo sapiens
ttgtgtgtcttaattatta

SEQ ID NO: 3219511 - DNA, 13 bp, Homo sapiens
ttgtgttctaata

SEQ ID NO: 3219512 - DNA, 20 bp, Homo sapiens
ttgtgttctgtttgttaaaa

SEQ ID NO: 3219513 - DNA, 19 bp, Homo sapiens
ttgtgttcttcttcatatt

SEQ ID NO: 3219514 - DNA, 12 bp, Homo sapiens
ttgtgttgacat

SEQ ID NO: 3219515 - DNA, 13 bp, Homo sapiens
ttgtgttgacatt

SEQ ID NO: 3219516 - DNA, 11 bp, Homo sapiens
ttgtgttgtac

SEQ ID NO: 3219517 - DNA, 18 bp, Homo sapiens
ttgtgttgtcactaaact

SEQ ID NO: 3219518 - DNA, 17 bp, Homo sapiens
ttgtgtttgtgtattta

SEQ ID NO: 3219519 - DNA, 17 bp, Homo sapiens
ttgtgttttactgtcag

SEQ ID NO: 3219520 - DNA, 21 bp, Homo sapiens
ttgtgttttactgtcagatta

SEQ ID NO: 3219521 - DNA, 13 bp, Homo sapiens
ttgtgttttcttg

SEQ ID NO: 3219522 - DNA, 16 bp, Homo sapiens
ttgtgttttcttgtaa

SEQ ID NO: 3219523 - DNA, 22 bp, Homo sapiens
ttgttaaaattatgaatctgat

SEQ ID NO: 3219524 - DNA, 12 bp, Homo sapiens
ttgttaaagctg

SEQ ID NO: 3219525 - DNA, 12 bp, Homo sapiens
ttgttaaatttt

SEQ ID NO: 3219526 - DNA, 22 bp, Homo sapiens
ttgttaactcttgtctattttt

SEQ ID NO: 3219527 - DNA, 22 bp, Homo sapiens
ttgttaagtctaaatatttcct

SEQ ID NO: 3219528 - DNA, 20 bp, Homo sapiens
ttgttaatctctgttatgta

SEQ ID NO: 3219529 - DNA, 17 bp, Homo sapiens
ttgttaatgaaaatgtc

SEQ ID NO: 3219530 - DNA, 18 bp, Homo sapiens
ttgttaatgaaaatgtca

SEQ ID NO: 3219531 - DNA, 22 bp, Homo sapiens
ttgttaatttttcctatattgc

SEQ ID NO: 3219532 - DNA, 22 bp, Homo sapiens
ttgttacacattaagtaatcaa

SEQ ID NO: 3219533 - DNA, 20 bp, Homo sapiens
ttgttaccaaatacacattt

SEQ ID NO: 3219534 - DNA, 12 bp, Homo sapiens
ttgttaccttta

SEQ ID NO: 3219535 - DNA, 10 bp, Homo sapiens
ttgttactgt

SEQ ID NO: 3219536 - DNA, 20 bp, Homo sapiens
ttgttactgttcttgctgct

SEQ ID NO: 3219537 - DNA, 24 bp, Homo sapiens
ttgttactgttcttgctgctagaa

SEQ ID NO: 3219538 - DNA, 14 bp, Homo sapiens
ttgttacttctgag

SEQ ID NO: 3219539 - DNA, 13 bp, Homo sapiens
ttgttagagagaa

SEQ ID NO: 3219540 - DNA, 17 bp, Homo sapiens
ttgttagtttagtgtgt

SEQ ID NO: 3219541 - DNA, 15 bp, Homo sapiens
ttgttatacttcaaa

SEQ ID NO: 3219542 - DNA, 13 bp, Homo sapiens
ttgttatcagtaa

SEQ ID NO: 3219543 - DNA, 15 bp, Homo sapiens
ttgttatgtaaaact

SEQ ID NO: 3219544 - DNA, 18 bp, Homo sapiens
ttgttatgtagataacaa

SEQ ID NO: 3219545 - DNA, 20 bp, Homo sapiens
ttgttatgtctagaaagtaa

SEQ ID NO: 3219546 - DNA, 20 bp, Homo sapiens
ttgttattccatcaataaat

SEQ ID NO: 3219547 - DNA, 21 bp, Homo sapiens
ttgttattccatcaataaatg

SEQ ID NO: 3219548 - DNA, 13 bp, Homo sapiens
ttgttattcctag

SEQ ID NO: 3219549 - DNA, 12 bp, Homo sapiens
ttgttattgtga

SEQ ID NO: 3219550 - DNA, 13 bp, Homo sapiens
ttgttattgtgaa

SEQ ID NO: 3219551 - DNA, 14 bp, Homo sapiens
ttgttattgtggaa

SEQ ID NO: 3219552 - DNA, 15 bp, Homo sapiens
ttgttattttggaaa

SEQ ID NO: 3219553 - DNA, 16 bp, Homo sapiens
ttgttcaaacaatatc

SEQ ID NO: 3219554 - DNA, 17 bp, Homo sapiens
ttgttcaaacaatatca

SEQ ID NO: 3219555 - DNA, 13 bp, Homo sapiens
ttgttcaactatt

SEQ ID NO: 3219556 - DNA, 13 bp, Homo sapiens
ttgttcaagtttt

SEQ ID NO: 3219557 - DNA, 22 bp, Homo sapiens
ttgttcaataataaatattttt

SEQ ID NO: 3219558 - DNA, 16 bp, Homo sapiens
ttgttcaatgttccat

SEQ ID NO: 3219559 - DNA, 22 bp, Homo sapiens
ttgttccaaatgtgtataattt

SEQ ID NO: 3219560 - DNA, 16 bp, Homo sapiens
ttgttccaagacattg

SEQ ID NO: 3219561 - DNA, 21 bp, Homo sapiens
ttgttccacaagttaaataaa

SEQ ID NO: 3219562 - DNA, 12 bp, Homo sapiens
ttgttccagctc

SEQ ID NO: 3219563 - DNA, 17 bp, Homo sapiens
ttgttccattttatgca

SEQ ID NO: 3219564 - DNA, 22 bp, Homo sapiens
ttgttccctgtgtcatttcaaa

SEQ ID NO: 3219565 - DNA, 13 bp, Homo sapiens
ttgttctattttt

SEQ ID NO: 3219566 - DNA, 16 bp, Homo sapiens
ttgttctatttttcaa

SEQ ID NO: 3219567 - DNA, 12 bp, Homo sapiens
ttgttctgcttt

SEQ ID NO: 3219568 - DNA, 19 bp, Homo sapiens
ttgttctgttttgtgagaa

SEQ ID NO: 3219569 - DNA, 15 bp, Homo sapiens
ttgttcttacacata

SEQ ID NO: 3219570 - DNA, 14 bp, Homo sapiens
ttgttcttatgaac

SEQ ID NO: 3219571 - DNA, 14 bp, Homo sapiens
ttgttctttaaagt

SEQ ID NO: 3219572 - DNA, 17 bp, Homo sapiens
ttgttgacagcaaaatg

SEQ ID NO: 3219573 - DNA, 18 bp, Homo sapiens
ttgttgacagttctgaag

SEQ ID NO: 3219574 - DNA, 18 bp, Homo sapiens
ttgttgagctattgctgt

SEQ ID NO: 3219575 - DNA, 22 bp, Homo sapiens
ttgttgaggtggtctgaatgtt

SEQ ID NO: 3219576 - DNA, 21 bp, Homo sapiens
ttgttgatgggcacttgagaa

SEQ ID NO: 3219577 - DNA, 14 bp, Homo sapiens
ttgttgcaaaggtc

SEQ ID NO: 3219578 - DNA, 21 bp, Homo sapiens
ttgttgcatccctcaattgaa

SEQ ID NO: 3219579 - DNA, 17 bp, Homo sapiens
ttgttgcatcttttcta

SEQ ID NO: 3219580 - DNA, 12 bp, Homo sapiens
ttgttgccaact

SEQ ID NO: 3219581 - DNA, 16 bp, Homo sapiens
ttgttgcgttcctttc

SEQ ID NO: 3219582 - DNA, 20 bp, Homo sapiens
ttgttgctcagcaaggggct

SEQ ID NO: 3219583 - DNA, 18 bp, Homo sapiens
ttgttgctccctgtgaca

SEQ ID NO: 3219584 - DNA, 17 bp, Homo sapiens
ttgtatctcttaaagtg

SEQ ID NO: 3219585 - DNA, 22 bp, Homo sapiens
ttgtatgaaagatggctgtgcc

SEQ ID NO: 3219586 - DNA, 14 bp, Homo sapiens
ttgtatgatgtgtt

SEQ ID NO: 3219587 - DNA, 21 bp, Homo sapiens
ttgtatgatgtgttgtgatag

SEQ ID NO: 3219588 - DNA, 12 bp, Homo sapiens
ttgtatgccttt

SEQ ID NO: 3219589 - DNA, 16 bp, Homo sapiens
ttgtatgtcaaagctt

SEQ ID NO: 3219590 - DNA, 12 bp, Homo sapiens
ttgtatgtgaac

SEQ ID NO: 3219591 - DNA, 19 bp, Homo sapiens
ttgtatgttagaataattt

SEQ ID NO: 3219592 - DNA, 15 bp, Homo sapiens
ttgtattaaactctt

SEQ ID NO: 3219593 - DNA, 14 bp, Homo sapiens
ttgtattaacaaaa

SEQ ID NO: 3219594 - DNA, 17 bp, Homo sapiens
ttgtattaataaagcat

SEQ ID NO: 3219595 - DNA, 21 bp, Homo sapiens
ttgtattaataaagcattctt

SEQ ID NO: 3219596 - DNA, 14 bp, Homo sapiens
ttgtattacatcta

SEQ ID NO: 3219597 - DNA, 15 bp, Homo sapiens
ttgtattactttctc

SEQ ID NO: 3219598 - DNA, 18 bp, Homo sapiens
ttgtattactttctctgt

SEQ ID NO: 3219599 - DNA, 17 bp, Homo sapiens
ttgtattatttttgtag

SEQ ID NO: 3219600 - DNA, 13 bp, Homo sapiens
ttgtattgacttt

SEQ ID NO: 3219601 - DNA, 14 bp, Homo sapiens
ttgtattgtggtat

SEQ ID NO: 3219602 - DNA, 18 bp, Homo sapiens
ttgtatttattccatatt

SEQ ID NO: 3219603 - DNA, 23 bp, Homo sapiens
ttgtatttggaatatttgaataa

SEQ ID NO: 3219604 - DNA, 18 bp, Homo sapiens
ttgtattttcatgaaaat

SEQ ID NO: 3219605 - DNA, 23 bp, Homo sapiens
ttgtattttgtgtgaccaactgt

SEQ ID NO: 3219606 - DNA, 15 bp, Homo sapiens
ttgtattttgttaaa

SEQ ID NO: 3219607 - DNA, 19 bp, Homo sapiens
ttgtattttttatttacat

SEQ ID NO: 3219608 - DNA, 19 bp, Homo sapiens
ttgtcaatattaaatacag

SEQ ID NO: 3219609 - DNA, 19 bp, Homo sapiens
ttgtcactgacacaaagga

SEQ ID NO: 3219610 - DNA, 14 bp, Homo sapiens
ttgtcagacataaa

SEQ ID NO: 3219611 - DNA, 19 bp, Homo sapiens
ttgtcagacataaagccat

SEQ ID NO: 3219612 - DNA, 16 bp, Homo sapiens
ttgtcagcctgtgctg

SEQ ID NO: 3219613 - DNA, 17 bp, Homo sapiens
ttgtcagcctgtgctgt

SEQ ID NO: 3219614 - DNA, 22 bp, Homo sapiens
ttgtcattgtaaacaaactctt

SEQ ID NO: 3219615 - DNA, 19 bp, Homo sapiens
ttgtccaattgttgacagt

SEQ ID NO: 3219616 - DNA, 18 bp, Homo sapiens
ttgtcccagcctggggct

SEQ ID NO: 3219617 - DNA, 19 bp, Homo sapiens
ttgtcccatgtggcttgtt

SEQ ID NO: 3219618 - DNA, 13 bp, Homo sapiens
ttgtccctctcac

SEQ ID NO: 3219619 - DNA, 20 bp, Homo sapiens
ttgtccctctcactccccag

SEQ ID NO: 3219620 - DNA, 16 bp, Homo sapiens
ttgtcctcaaggccca

SEQ ID NO: 3219621 - DNA, 13 bp, Homo sapiens
ttgtcctgccagc

SEQ ID NO: 3219622 - DNA, 18 bp, Homo sapiens
ttgtcctgccagctgcct

SEQ ID NO: 3219623 - DNA, 17 bp, Homo sapiens
ttgtcctgggcctgccc

SEQ ID NO: 3219624 - DNA, 17 bp, Homo sapiens
ttgtccttcagagctct

SEQ ID NO: 3219625 - DNA, 15 bp, Homo sapiens
ttgtccttgaaagta

SEQ ID NO: 3219626 - DNA, 22 bp, Homo sapiens
ttgtcgaaaagagtcttccaat

SEQ ID NO: 3219627 - DNA, 23 bp, Homo sapiens
ttgtcgaaaagagtcttccaatt

SEQ ID NO: 3219628 - DNA, 14 bp, Homo sapiens
ttgtcgctcatgtg

SEQ ID NO: 3219629 - DNA, 17 bp, Homo sapiens
ttgtcgtaaagatttgg

SEQ ID NO: 3219630 - DNA, 19 bp, Homo sapiens
ttgtctaactcagaattat

SEQ ID NO: 3219631 - DNA, 15 bp, Homo sapiens
ttgtctatgaagttg

SEQ ID NO: 3219632 - DNA, 12 bp, Homo sapiens
ttgtctatttat

SEQ ID NO: 3219633 - DNA, 12 bp, Homo sapiens
ttgtctatttta

SEQ ID NO: 3219634 - DNA, 18 bp, Homo sapiens
ttgtctcgtgtacagctc

SEQ ID NO: 3219635 - DNA, 18 bp, Homo sapiens
ttgtctctacaaaaaata

SEQ ID NO: 3219636 - DNA, 16 bp, Homo sapiens
ttgtctctccttttct

SEQ ID NO: 3219637 - DNA, 19 bp, Homo sapiens
ttgtctctcttcagactct

SEQ ID NO: 3219638 - DNA, 22 bp, Homo sapiens
ttgtctgatttttaaagtactt

SEQ ID NO: 3219639 - DNA, 16 bp, Homo sapiens
ttgtctgggaattgtg

SEQ ID NO: 3219640 - DNA, 21 bp, Homo sapiens
ttgtctgtaggtgaaagaaca

SEQ ID NO: 3219641 - DNA, 12 bp, Homo sapiens
ttgtctgtctac

SEQ ID NO: 3219642 - DNA, 22 bp, Homo sapiens
ttgtcttggcttcccaccagct

SEQ ID NO: 3219643 - DNA, 14 bp, Homo sapiens
ttgtcttgtacttc

SEQ ID NO: 3219644 - DNA, 19 bp, Homo sapiens
ttgtctttagtgccggctg

SEQ ID NO: 3219645 - DNA, 11 bp, Homo sapiens
ttgtctttatg

SEQ ID NO: 3219646 - DNA, 12 bp, Homo sapiens
ttgtctttcctc

SEQ ID NO: 3219647 - DNA, 12 bp, Homo sapiens
ttgtctttgctg

SEQ ID NO: 3219648 - DNA, 14 bp, Homo sapiens
ttgtctttgctgta

SEQ ID NO: 3219649 - DNA, 14 bp, Homo sapiens
ttgtctttttataa

SEQ ID NO: 3219650 - DNA, 19 bp, Homo sapiens
ttgtgaaaagagtatgtag

SEQ ID NO: 3219651 - DNA, 20 bp, Homo sapiens
ttgtgaaagttttgagtaga

SEQ ID NO: 3219652 - DNA, 14 bp, Homo sapiens
ttgtgaaatgatgg

SEQ ID NO: 3219653 - DNA, 23 bp, Homo sapiens
ttgtgaaatggccaggatcctct

SEQ ID NO: 3219654 - DNA, 11 bp, Homo sapiens
ttgtgaacaga

SEQ ID NO: 3219655 - DNA, 18 bp, Homo sapiens
ttgtgaactggaagaaag

SEQ ID NO: 3219656 - DNA, 16 bp, Homo sapiens
ttgtgaatgcttctca

SEQ ID NO: 3219657 - DNA, 13 bp, Homo sapiens
ttgtgaatggatt

SEQ ID NO: 3219658 - DNA, 15 bp, Homo sapiens
ttgtgaatggattgg

SEQ ID NO: 3219659 - DNA, 21 bp, Homo sapiens
ttgtgaatgtatttttctgtt

SEQ ID NO: 3219660 - DNA, 19 bp, Homo sapiens
ttgtgaattaggctgtaac

SEQ ID NO: 3219661 - DNA, 19 bp, Homo sapiens
ttgtgactatatagagatg

SEQ ID NO: 3219662 - DNA, 21 bp, Homo sapiens
ttgtgactatatagagatgtt

SEQ ID NO: 3219663 - DNA, 15 bp, Homo sapiens
ttgtgagagcgaggc

SEQ ID NO: 3219664 - DNA, 20 bp, Homo sapiens
ttgtgaggcccatggttgag

SEQ ID NO: 3219665 - DNA, 22 bp, Homo sapiens
ttgtgagtttaccttgtatact

SEQ ID NO: 3219666 - DNA, 21 bp, Homo sapiens
ttgtgatgaatcaatgaaaaa

SEQ ID NO: 3219667 - DNA, 17 bp, Homo sapiens
ttggtgttcctggaagc

SEQ ID NO: 3219668 - DNA, 19 bp, Homo sapiens
ttggtgttcctggaagcag

SEQ ID NO: 3219669 - DNA, 18 bp, Homo sapiens
ttggtgttgtcattgtaa

SEQ ID NO: 3219670 - DNA, 21 bp, Homo sapiens
ttggtgttttatctcctgtga

SEQ ID NO: 3219671 - DNA, 20 bp, Homo sapiens
ttggttagaggaaggctgaa

SEQ ID NO: 3219672 - DNA, 20 bp, Homo sapiens
ttggttcagacacctgttca

SEQ ID NO: 3219673 - DNA, 20 bp, Homo sapiens
ttggttcatcagtgttaaaa

SEQ ID NO: 3219674 - DNA, 14 bp, Homo sapiens
ttggttcattaatt

SEQ ID NO: 3219675 - DNA, 20 bp, Homo sapiens
ttggttcattaattctataa

SEQ ID NO: 3219676 - DNA, 15 bp, Homo sapiens
ttggttcctctctgg

SEQ ID NO: 3219677 - DNA, 18 bp, Homo sapiens
ttggttctaaggacctga

SEQ ID NO: 3219678 - DNA, 20 bp, Homo sapiens
ttggttgaaaataaaaagat

SEQ ID NO: 3219679 - DNA, 22 bp, Homo sapiens
ttggttgggaatgaggaaaatt

SEQ ID NO: 3219680 - DNA, 13 bp, Homo sapiens
ttggtttactttc

SEQ ID NO: 3219681 - DNA, 13 bp, Homo sapiens
ttggttttaaaag

SEQ ID NO: 3219682 - DNA, 15 bp, Homo sapiens
ttggttttaaaagca

SEQ ID NO: 3219683 - DNA, 16 bp, Homo sapiens
ttggttttaaaagcac

SEQ ID NO: 3219684 - DNA, 15 bp, Homo sapiens
ttgtaaaaaaaaatg

SEQ ID NO: 3219685 - DNA, 22 bp, Homo sapiens
ttgtaaaaaaaaatgcctttga

SEQ ID NO: 3219686 - DNA, 13 bp, Homo sapiens
ttgtaaaaaaagc

SEQ ID NO: 3219687 - DNA, 14 bp, Homo sapiens
ttgtaaaaaaagca

SEQ ID NO: 3219688 - DNA, 19 bp, Homo sapiens
ttgtaaaaaaagcaaaaat

SEQ ID NO: 3219689 - DNA, 20 bp, Homo sapiens
ttgtaaaaacagcattgctt

SEQ ID NO: 3219690 - DNA, 13 bp, Homo sapiens
ttgtaaaaagaaa

SEQ ID NO: 3219691 - DNA, 15 bp, Homo sapiens
ttgtaaaacaggtag

SEQ ID NO: 3219692 - DNA, 20 bp, Homo sapiens
ttgtaaaacctgtcaatgat

SEQ ID NO: 3219693 - DNA, 23 bp, Homo sapiens
ttgtaaaacctgtcaatgataca

SEQ ID NO: 3219694 - DNA, 21 bp, Homo sapiens
ttgtaaaagaacagtaaacat

SEQ ID NO: 3219695 - DNA, 23 bp, Homo sapiens
ttgtaaaagaacagtaaacattg

SEQ ID NO: 3219696 - DNA, 17 bp, Homo sapiens
ttgtaaaattatttcat

SEQ ID NO: 3219697 - DNA, 12 bp, Homo sapiens
ttgtaaaccatt

SEQ ID NO: 3219698 - DNA, 18 bp, Homo sapiens
ttgtaaaccattgtaact

SEQ ID NO: 3219699 - DNA, 16 bp, Homo sapiens
ttgtaaactcaaaata

SEQ ID NO: 3219700 - DNA, 14 bp, Homo sapiens
ttgtaaactgtact

SEQ ID NO: 3219701 - DNA, 15 bp, Homo sapiens
ttgtaaacttctgaa

SEQ ID NO: 3219702 - DNA, 12 bp, Homo sapiens
ttgtaaagactg

SEQ ID NO: 3219703 - DNA, 13 bp, Homo sapiens
ttgtaaagactgg

SEQ ID NO: 3219704 - DNA, 15 bp, Homo sapiens
ttgtaaataagagat

SEQ ID NO: 3219705 - DNA, 11 bp, Homo sapiens
ttgtaaataca

SEQ ID NO: 3219706 - DNA, 14 bp, Homo sapiens
ttgtaaatacacca

SEQ ID NO: 3219707 - DNA, 15 bp, Homo sapiens
ttgtaaataccagga

SEQ ID NO: 3219708 - DNA, 19 bp, Homo sapiens
ttgtaaatactgcttgacc

SEQ ID NO: 3219709 - DNA, 12 bp, Homo sapiens
ttgtaaatgcct

SEQ ID NO: 3219710 - DNA, 12 bp, Homo sapiens
ttgtaaattgtg

SEQ ID NO: 3219711 - DNA, 16 bp, Homo sapiens
ttgtaacaagaaaaca

SEQ ID NO: 3219712 - DNA, 16 bp, Homo sapiens
ttgtaacctcagctct

SEQ ID NO: 3219713 - DNA, 18 bp, Homo sapiens
ttgtaacctcagctctgg

SEQ ID NO: 3219714 - DNA, 20 bp, Homo sapiens
ttgtaacctcagctctggga

SEQ ID NO: 3219715 - DNA, 11 bp, Homo sapiens
ttgtaactaca

SEQ ID NO: 3219716 - DNA, 21 bp, Homo sapiens
ttgtaactacaaagctttgct

SEQ ID NO: 3219717 - DNA, 21 bp, Homo sapiens
ttgtaagacaaaggttttcct

SEQ ID NO: 3219718 - DNA, 14 bp, Homo sapiens
ttgtaagacatttg

SEQ ID NO: 3219719 - DNA, 15 bp, Homo sapiens
ttgtaagacatttgt

SEQ ID NO: 3219720 - DNA, 20 bp, Homo sapiens
ttgtaagagtggaaccaaca

SEQ ID NO: 3219721 - DNA, 22 bp, Homo sapiens
ttgtaagagtgtagaagcattc

SEQ ID NO: 3219722 - DNA, 13 bp, Homo sapiens
ttgtaagtttcag

SEQ ID NO: 3219723 - DNA, 22 bp, Homo sapiens
ttgtaagtttcaggtgacatgt

SEQ ID NO: 3219724 - DNA, 15 bp, Homo sapiens
ttgtaatctgaataa

SEQ ID NO: 3219725 - DNA, 16 bp, Homo sapiens
ttgtaatgctgcactt

SEQ ID NO: 3219726 - DNA, 23 bp, Homo sapiens
ttgtaattctaaatgaatgttta

SEQ ID NO: 3219727 - DNA, 12 bp, Homo sapiens
ttgtaattgtgt

SEQ ID NO: 3219728 - DNA, 13 bp, Homo sapiens
ttgtaattgtgta

SEQ ID NO: 3219729 - DNA, 14 bp, Homo sapiens
ttgtaattgtgtaa

SEQ ID NO: 3219730 - DNA, 21 bp, Homo sapiens
ttgtaatttaaacaggcccag

SEQ ID NO: 3219731 - DNA, 22 bp, Homo sapiens
ttgtaatttttggggaaaaaag

SEQ ID NO: 3219732 - DNA, 23 bp, Homo sapiens
ttgtaatttttggggaaaaaagc

SEQ ID NO: 3219733 - DNA, 15 bp, Homo sapiens
ttgtacaaatgtatt

SEQ ID NO: 3219734 - DNA, 17 bp, Homo sapiens
ttgtacaaatgtatttt

SEQ ID NO: 3219735 - DNA, 15 bp, Homo sapiens
ttgtacaaggtaatt

SEQ ID NO: 3219736 - DNA, 18 bp, Homo sapiens
ttgtacacgctgatgaga

SEQ ID NO: 3219737 - DNA, 15 bp, Homo sapiens
ttgtacactgctgta

SEQ ID NO: 3219738 - DNA, 17 bp, Homo sapiens
ttgtacagaatatttct

SEQ ID NO: 3219739 - DNA, 21 bp, Homo sapiens
ttgtacagaatatttctattg

SEQ ID NO: 3219740 - DNA, 14 bp, Homo sapiens
ttgtacagactgtt

SEQ ID NO: 3219741 - DNA, 21 bp, Homo sapiens
ttgtacagcgttttaaaagaa

SEQ ID NO: 3219742 - DNA, 16 bp, Homo sapiens
ttggcagtggcagaga

SEQ ID NO: 3219743 - DNA, 14 bp, Homo sapiens
ttggcatttctata

SEQ ID NO: 3219744 - DNA, 15 bp, Homo sapiens
ttggcatttgtgtta

SEQ ID NO: 3219745 - DNA, 21 bp, Homo sapiens
ttggccacctgtagccatctg

SEQ ID NO: 3219746 - DNA, 21 bp, Homo sapiens
ttggccactccgagaggtggg

SEQ ID NO: 3219747 - DNA, 22 bp, Homo sapiens
ttggccagccaactctgggaat

SEQ ID NO: 3219748 - DNA, 20 bp, Homo sapiens
ttggcccaggattattgtca

SEQ ID NO: 3219749 - DNA, 18 bp, Homo sapiens
ttggcctcagggccagga

SEQ ID NO: 3219750 - DNA, 16 bp, Homo sapiens
ttggcctctccttgga

SEQ ID NO: 3219751 - DNA, 12 bp, Homo sapiens
ttggcctgctgt

SEQ ID NO: 3219752 - DNA, 13 bp, Homo sapiens
ttggcctgctgtg

SEQ ID NO: 3219753 - DNA, 18 bp, Homo sapiens
ttggcctggcaaaataaa

SEQ ID NO: 3219754 - DNA, 19 bp, Homo sapiens
ttggcctgtttgatgtatg

SEQ ID NO: 3219755 - DNA, 22 bp, Homo sapiens
ttggccttcagaaccatccata

SEQ ID NO: 3219756 - DNA, 21 bp, Homo sapiens
ttggccttttgtacaaagatt

SEQ ID NO: 3219757 - DNA, 18 bp, Homo sapiens
ttggcgctattacaaata

SEQ ID NO: 3219758 - DNA, 16 bp, Homo sapiens
ttggctatttgaaata

SEQ ID NO: 3219759 - DNA, 17 bp, Homo sapiens
ttggctctggagacagc

SEQ ID NO: 3219760 - DNA, 19 bp, Homo sapiens
ttggctgaaattctcctgg

SEQ ID NO: 3219761 - DNA, 15 bp, Homo sapiens
ttggctgactggggc

SEQ ID NO: 3219762 - DNA, 17 bp, Homo sapiens
ttggctgacttcatctg

SEQ ID NO: 3219763 - DNA, 18 bp, Homo sapiens
ttggctgaggggcttggg

SEQ ID NO: 3219764 - DNA, 13 bp, Homo sapiens
ttggctgcaggga

SEQ ID NO: 3219765 - DNA, 17 bp, Homo sapiens
ttggctgtgaggcccct

SEQ ID NO: 3219766 - DNA, 14 bp, Homo sapiens
ttggcttaaatata

SEQ ID NO: 3219767 - DNA, 17 bp, Homo sapiens
ttggcttactgcagcct

SEQ ID NO: 3219768 - DNA, 13 bp, Homo sapiens
ttggcttcatttc

SEQ ID NO: 3219769 - DNA, 21 bp, Homo sapiens
ttggcttcatttcaatcattg

SEQ ID NO: 3219770 - DNA, 17 bp, Homo sapiens
ttggctttaaacaccct

SEQ ID NO: 3219771 - DNA, 22 bp, Homo sapiens
ttggctttaaacacccttcaca

SEQ ID NO: 3219772 - DNA, 16 bp, Homo sapiens
ttgggaaaacatgtta

SEQ ID NO: 3219773 - DNA, 16 bp, Homo sapiens
ttgggaaagcccagac

SEQ ID NO: 3219774 - DNA, 17 bp, Homo sapiens
ttgggaaagcccagact

SEQ ID NO: 3219775 - DNA, 20 bp, Homo sapiens
ttgggaaagcccagacttta

SEQ ID NO: 3219776 - DNA, 18 bp, Homo sapiens
ttgggaatggatcctgga

SEQ ID NO: 3219777 - DNA, 17 bp, Homo sapiens
ttgggaccctccagtgc

SEQ ID NO: 3219778 - DNA, 23 bp, Homo sapiens
ttgggactgggtttggaccccag

SEQ ID NO: 3219779 - DNA, 13 bp, Homo sapiens
ttgggagaaatca

SEQ ID NO: 3219780 - DNA, 11 bp, Homo sapiens
ttgggagcact

SEQ ID NO: 3219781 - DNA, 15 bp, Homo sapiens
ttgggaggctgaggc

SEQ ID NO: 3219782 - DNA, 18 bp, Homo sapiens
ttgggagttttgaatgtt

SEQ ID NO: 3219783 - DNA, 18 bp, Homo sapiens
ttgggatcccaccctggg

SEQ ID NO: 3219784 - DNA, 11 bp, Homo sapiens
ttgggcagagc

SEQ ID NO: 3219785 - DNA, 23 bp, Homo sapiens
ttgggcagccagaccagcaggct

SEQ ID NO: 3219786 - DNA, 20 bp, Homo sapiens
ttgggcatccacccagtgct

SEQ ID NO: 3219787 - DNA, 16 bp, Homo sapiens
ttgggcccctcagagc

SEQ ID NO: 3219788 - DNA, 18 bp, Homo sapiens
ttgggcccctcagagccc

SEQ ID NO: 3219789 - DNA, 18 bp, Homo sapiens
ttgggccgaatcccccag

SEQ ID NO: 3219790 - DNA, 20 bp, Homo sapiens
ttgggccgaatcccccaggg

SEQ ID NO: 3219791 - DNA, 21 bp, Homo sapiens
ttgggccgaatcccccaggga

SEQ ID NO: 3219792 - DNA, 23 bp, Homo sapiens
ttgggcctcaggctctgcacaga

SEQ ID NO: 3219793 - DNA, 21 bp, Homo sapiens
ttgggcctcccataattgctt

SEQ ID NO: 3219794 - DNA, 20 bp, Homo sapiens
ttgggctaccctaaagggag

SEQ ID NO: 3219795 - DNA, 17 bp, Homo sapiens
ttgggctactggcagct

SEQ ID NO: 3219796 - DNA, 21 bp, Homo sapiens
ttgggctcctggctgccaggc

SEQ ID NO: 3219797 - DNA, 22 bp, Homo sapiens
ttgggctgacacctaccatgct

SEQ ID NO: 3219798 - DNA, 20 bp, Homo sapiens
ttgggctttgcaggctctgg

SEQ ID NO: 3219799 - DNA, 20 bp, Homo sapiens
ttggggaggacaaaacttct

SEQ ID NO: 3219800 - DNA, 11 bp, Homo sapiens
ttggggcctgg

SEQ ID NO: 3219801 - DNA, 14 bp, Homo sapiens
ttggggcctggctt

SEQ ID NO: 3219802 - DNA, 15 bp, Homo sapiens
ttggggcctggcttg

SEQ ID NO: 3219803 - DNA, 19 bp, Homo sapiens
ttgggggacgtttctcatt

SEQ ID NO: 3219804 - DNA, 16 bp, Homo sapiens
ttggggtacaattgta

SEQ ID NO: 3219805 - DNA, 13 bp, Homo sapiens
ttggggtctcttt

SEQ ID NO: 3219806 - DNA, 13 bp, Homo sapiens
ttggggtgacagt

SEQ ID NO: 3219807 - DNA, 15 bp, Homo sapiens
ttggggttgtgttgt

SEQ ID NO: 3219808 - DNA, 23 bp, Homo sapiens
ttgggtagaaagagatacagagg

SEQ ID NO: 3219809 - DNA, 21 bp, Homo sapiens
ttgctaatcaaagccagggtc

SEQ ID NO: 3219810 - DNA, 16 bp, Homo sapiens
ttgctaatcagtgtct

SEQ ID NO: 3219811 - DNA, 15 bp, Homo sapiens
ttgctaattttctca

SEQ ID NO: 3219812 - DNA, 17 bp, Homo sapiens
ttgctaattttctcaaa

SEQ ID NO: 3219813 - DNA, 12 bp, Homo sapiens
ttgctacaaatt

SEQ ID NO: 3219814 - DNA, 22 bp, Homo sapiens
ttgctacaaatttatgcatttc

SEQ ID NO: 3219815 - DNA, 23 bp, Homo sapiens
ttgctaccagtatttagaagcca

SEQ ID NO: 3219816 - DNA, 19 bp, Homo sapiens
ttgctactgttgtaagaat

SEQ ID NO: 3219817 - DNA, 19 bp, Homo sapiens
ttgctagaatgggaagggt

SEQ ID NO: 3219818 - DNA, 20 bp, Homo sapiens
ttgctaggacgcaataaatt

SEQ ID NO: 3219819 - DNA, 21 bp, Homo sapiens
ttgctagtattcgctgtgttc

SEQ ID NO: 3219820 - DNA, 20 bp, Homo sapiens
ttgctatagttatacatcaa

SEQ ID NO: 3219821 - DNA, 14 bp, Homo sapiens
ttgctatgtaaggg

SEQ ID NO: 3219822 - DNA, 15 bp, Homo sapiens
ttgctatgttactat

SEQ ID NO: 3219823 - DNA, 19 bp, Homo sapiens
ttgctatgttactattttc

SEQ ID NO: 3219824 - DNA, 22 bp, Homo sapiens
ttgctattagactgtaggaaga

SEQ ID NO: 3219825 - DNA, 17 bp, Homo sapiens
ttgctattagagcattg

SEQ ID NO: 3219826 - DNA, 18 bp, Homo sapiens
ttgctcaaaaaatgagct

SEQ ID NO: 3219827 - DNA, 23 bp, Homo sapiens
ttgctcagagaaggaaaagactg

SEQ ID NO: 3219828 - DNA, 21 bp, Homo sapiens
ttgctccatacaatgactagt

SEQ ID NO: 3219829 - DNA, 14 bp, Homo sapiens
ttgctcccaaccca

SEQ ID NO: 3219830 - DNA, 17 bp, Homo sapiens
ttgctcccaacccattc

SEQ ID NO: 3219831 - DNA, 15 bp, Homo sapiens
ttgctcccttcagcc

SEQ ID NO: 3219832 - DNA, 19 bp, Homo sapiens
ttgctcctaactccaccgc

SEQ ID NO: 3219833 - DNA, 14 bp, Homo sapiens
ttgctcctagcaga

SEQ ID NO: 3219834 - DNA, 15 bp, Homo sapiens
ttgctcctagcagac

SEQ ID NO: 3219835 - DNA, 17 bp, Homo sapiens
ttgctcctagcagacag

SEQ ID NO: 3219836 - DNA, 21 bp, Homo sapiens
ttgctcctagcagacagaaac

SEQ ID NO: 3219837 - DNA, 12 bp, Homo sapiens
ttgctccttgac

SEQ ID NO: 3219838 - DNA, 14 bp, Homo sapiens
ttgctctaggaaga

SEQ ID NO: 3219839 - DNA, 23 bp, Homo sapiens
ttgctctccctcttctcaagtgc

SEQ ID NO: 3219840 - DNA, 13 bp, Homo sapiens
ttgctctctgggc

SEQ ID NO: 3219841 - DNA, 18 bp, Homo sapiens
ttgctctgtgtatatctc

SEQ ID NO: 3219842 - DNA, 24 bp, Homo sapiens
ttgctctgtgtatatctcttggaa

SEQ ID NO: 3219843 - DNA, 16 bp, Homo sapiens
ttgctcttggaaagct

SEQ ID NO: 3219844 - DNA, 16 bp, Homo sapiens
ttgctctttctactct

SEQ ID NO: 3219845 - DNA, 20 bp, Homo sapiens
ttgctctttgacaactaaaa

SEQ ID NO: 3219846 - DNA, 18 bp, Homo sapiens
ttgctcttttaagcagtc

SEQ ID NO: 3219847 - DNA, 14 bp, Homo sapiens
ttgctgaaagatct

SEQ ID NO: 3219848 - DNA, 11 bp, Homo sapiens
ttgctgaaatt

SEQ ID NO: 3219849 - DNA, 15 bp, Homo sapiens
ttgctgagaagcaaa

SEQ ID NO: 3219850 - DNA, 15 bp, Homo sapiens
ttgctgagcctctgc

SEQ ID NO: 3219851 - DNA, 16 bp, Homo sapiens
ttgctgagttgttcta

SEQ ID NO: 3219852 - DNA, 17 bp, Homo sapiens
ttgctgatttcccctct

SEQ ID NO: 3219853 - DNA, 21 bp, Homo sapiens
ttgctgctaccgccctgggct

SEQ ID NO: 3219854 - DNA, 13 bp, Homo sapiens
ttgctgctagaac

SEQ ID NO: 3219855 - DNA, 15 bp, Homo sapiens
ttgctgctagaactt

SEQ ID NO: 3219856 - DNA, 21 bp, Homo sapiens
ttgctgctatgaaaatgagca

SEQ ID NO: 3219857 - DNA, 14 bp, Homo sapiens
ttgctgctgctgca

SEQ ID NO: 3219858 - DNA, 12 bp, Homo sapiens
ttgctgcttgga

SEQ ID NO: 3219859 - DNA, 21 bp, Homo sapiens
ttgctggaataagttcaaatt

SEQ ID NO: 3219860 - DNA, 17 bp, Homo sapiens
ttgctggccccagccct

SEQ ID NO: 3219861 - DNA, 23 bp, Homo sapiens
ttgctgggcatactttctctcta

SEQ ID NO: 3219862 - DNA, 17 bp, Homo sapiens
ttgctgggccttttgtt

SEQ ID NO: 3219863 - DNA, 12 bp, Homo sapiens
ttgctgggcttt

SEQ ID NO: 3219864 - DNA, 22 bp, Homo sapiens
ttgctggttgctgtgtggtttg

SEQ ID NO: 3219865 - DNA, 20 bp, Homo sapiens
ttgctggttggattaatctt

SEQ ID NO: 3219866 - DNA, 17 bp, Homo sapiens
ttgctgtactcttgctg

SEQ ID NO: 3219867 - DNA, 23 bp, Homo sapiens
ttgctgtcacatagtttttcctg

SEQ ID NO: 3219868 - DNA, 13 bp, Homo sapiens
ttgctgtcactgt

SEQ ID NO: 3219869 - DNA, 17 bp, Homo sapiens
ttgctgtgtttaatttg

SEQ ID NO: 3219870 - DNA, 13 bp, Homo sapiens
ttgctgttaactg

SEQ ID NO: 3219871 - DNA, 19 bp, Homo sapiens
ttgctgtttagagtaaata

SEQ ID NO: 3219872 - DNA, 21 bp, Homo sapiens
ttgctgtttatgatctatttg

SEQ ID NO: 3219873 - DNA, 12 bp, Homo sapiens
ttgctgtttatt

SEQ ID NO: 3219874 - DNA, 14 bp, Homo sapiens
ttgcttaaaagaca

SEQ ID NO: 3219875 - DNA, 18 bp, Homo sapiens
ttgcttaaaccacttaaa

SEQ ID NO: 3219876 - DNA, 18 bp, Homo sapiens
ttgcttacatttttacaa

SEQ ID NO: 3219877 - DNA, 18 bp, Homo sapiens
ttgcttactgatattatc

SEQ ID NO: 3219878 - DNA, 12 bp, Homo sapiens
ttgcttagtaaa

SEQ ID NO: 3219879 - DNA, 23 bp, Homo sapiens
ttgcttattgttccaagacattg

SEQ ID NO: 3219880 - DNA, 13 bp, Homo sapiens
ttgcttattttat

SEQ ID NO: 3219881 - DNA, 17 bp, Homo sapiens
ttgcttcaccatggcct

SEQ ID NO: 3219882 - DNA, 15 bp, Homo sapiens
ttgcttcataaatga

SEQ ID NO: 3219883 - DNA, 15 bp, Homo sapiens
ttgcttccgccactc

SEQ ID NO: 3219884 - DNA, 22 bp, Homo sapiens
ttgcttcctcagtaacatttct

SEQ ID NO: 3219885 - DNA, 17 bp, Homo sapiens
ttgcttcctcctcccca

SEQ ID NO: 3219886 - DNA, 17 bp, Homo sapiens
ttgcttcttgtgtttta

SEQ ID NO: 3219887 - DNA, 17 bp, Homo sapiens
ttgcttctttctagaaa

SEQ ID NO: 3219888 - DNA, 20 bp, Homo sapiens
ttgcttctttctagaaagag

SEQ ID NO: 3219889 - DNA, 13 bp, Homo sapiens
ttgcttgaacaca

SEQ ID NO: 3219890 - DNA, 16 bp, Homo sapiens
ttgcttgaacacagta

SEQ ID NO: 3219891 - DNA, 17 bp, Homo sapiens
ttgcttgaacacagtat

SEQ ID NO: 3219892 - DNA, 13 bp, Homo sapiens
ttgcttgaatgct

SEQ ID NO: 3219893 - DNA, 22 bp, Homo sapiens
ttgcttgccgagcctaatgaaa

SEQ ID NO: 3219894 - DNA, 14 bp, Homo sapiens
ttgcttgtcttctg

SEQ ID NO: 3219895 - DNA, 20 bp, Homo sapiens
ttgctttatgccttcttatt

SEQ ID NO: 3219896 - DNA, 16 bp, Homo sapiens
ttgctttcctgggcct

SEQ ID NO: 3219897 - DNA, 17 bp, Homo sapiens
ttgctttcctgggcctt

SEQ ID NO: 3219898 - DNA, 13 bp, Homo sapiens
ttgctttctgaaa

SEQ ID NO: 3219899 - DNA, 15 bp, Homo sapiens
ttgctttcttttctc

SEQ ID NO: 3219900 - DNA, 21 bp, Homo sapiens
ttgctttgaagtagctctttt

SEQ ID NO: 3219901 - DNA, 19 bp, Homo sapiens
ttgctttgccaaaatacca

SEQ ID NO: 3219902 - DNA, 14 bp, Homo sapiens
ttgcttttagaaaa

SEQ ID NO: 3219903 - DNA, 16 bp, Homo sapiens
ttgcttttcatgtaga

SEQ ID NO: 3219904 - DNA, 21 bp, Homo sapiens
ttgcttttcatgtagaactca

SEQ ID NO: 3219905 - DNA, 15 bp, Homo sapiens
ttgctttttcaccag

SEQ ID NO: 3219906 - DNA, 19 bp, Homo sapiens
ttgcttttttgtattggtt

SEQ ID NO: 3219907 - DNA, 18 bp, Homo sapiens
ttggaaagagaccagcac

SEQ ID NO: 3219908 - DNA, 20 bp, Homo sapiens
ttggaaagcatcacctcagg

SEQ ID NO: 3219909 - DNA, 21 bp, Homo sapiens
ttggaaagccattgaccaccc

SEQ ID NO: 3219910 - DNA, 19 bp, Homo sapiens
ttggaaatcctagtttcct

SEQ ID NO: 3219911 - DNA, 14 bp, Homo sapiens
ttggaaatcctcta

SEQ ID NO: 3219912 - DNA, 18 bp, Homo sapiens
ttggaaattcctgtactg

SEQ ID NO: 3219913 - DNA, 13 bp, Homo sapiens
ttggaacagaatg

SEQ ID NO: 3219914 - DNA, 14 bp, Homo sapiens
ttggaacagaatgt

SEQ ID NO: 3219915 - DNA, 22 bp, Homo sapiens
ttggaacatttctttcttgctg

SEQ ID NO: 3219916 - DNA, 19 bp, Homo sapiens
ttggaaccttgttttggac

SEQ ID NO: 3219917 - DNA, 13 bp, Homo sapiens
ttggaagagaatc

SEQ ID NO: 3219918 - DNA, 15 bp, Homo sapiens
ttggaagagaatcac

SEQ ID NO: 3219919 - DNA, 22 bp, Homo sapiens
ttggaagatggcataacctgtc

SEQ ID NO: 3219920 - DNA, 15 bp, Homo sapiens
ttggaagattcagct

SEQ ID NO: 3219921 - DNA, 19 bp, Homo sapiens
ttggaagattttcagtcta

SEQ ID NO: 3219922 - DNA, 18 bp, Homo sapiens
ttggaagctgtttggaaa

SEQ ID NO: 3219923 - DNA, 13 bp, Homo sapiens
ttggaagtttcat

SEQ ID NO: 3219924 - DNA, 19 bp, Homo sapiens
ttggaagtttgtgttctgt

SEQ ID NO: 3219925 - DNA, 15 bp, Homo sapiens
ttggaataggaataa

SEQ ID NO: 3219926 - DNA, 17 bp, Homo sapiens
ttggaatattaaaaaac

SEQ ID NO: 3219927 - DNA, 23 bp, Homo sapiens
ttggaatattaaaaaacttcatg

SEQ ID NO: 3219928 - DNA, 13 bp, Homo sapiens
ttggaatatttga

SEQ ID NO: 3219929 - DNA, 15 bp, Homo sapiens
ttggaatatttgaat

SEQ ID NO: 3219930 - DNA, 19 bp, Homo sapiens
ttggaatggaactactgta

SEQ ID NO: 3219931 - DNA, 18 bp, Homo sapiens
ttggaattaacctggtgc

SEQ ID NO: 3219932 - DNA, 20 bp, Homo sapiens
ttggaattaacctggtgctg

SEQ ID NO: 3219933 - DNA, 23 bp, Homo sapiens
ttggacaatcatgaaatatgcat

SEQ ID NO: 3219934 - DNA, 19 bp, Homo sapiens
ttggacacctttaggttct

SEQ ID NO: 3219935 - DNA, 22 bp, Homo sapiens
ttggacagctgactgaatgcag

SEQ ID NO: 3219936 - DNA, 17 bp, Homo sapiens
ttggacatagatatttt

SEQ ID NO: 3219937 - DNA, 14 bp, Homo sapiens
ttggacatcctcct

SEQ ID NO: 3219938 - DNA, 12 bp, Homo sapiens
tttttaactgat

SEQ ID NO: 3219939 - DNA, 16 bp, Homo sapiens
tttttaactgattctt

SEQ ID NO: 3219940 - DNA, 16 bp, Homo sapiens
tttttaagatttttct

SEQ ID NO: 3219941 - DNA, 22 bp, Homo sapiens
tttttaatctagacaatataca

SEQ ID NO: 3219942 - DNA, 13 bp, Homo sapiens
tttttaatgatat

SEQ ID NO: 3219943 - DNA, 13 bp, Homo sapiens
tttttaatgctat

SEQ ID NO: 3219944 - DNA, 21 bp, Homo sapiens
tttttaattgaggacagcctg

SEQ ID NO: 3219945 - DNA, 11 bp, Homo sapiens
tttttaattta

SEQ ID NO: 3219946 - DNA, 19 bp, Homo sapiens
tttttaatttaacaaacta

SEQ ID NO: 3219947 - DNA, 16 bp, Homo sapiens
tttttaatttatttat

SEQ ID NO: 3219948 - DNA, 20 bp, Homo sapiens
tttttaatttgatgaaagct

SEQ ID NO: 3219949 - DNA, 19 bp, Homo sapiens
tttttacaagttttaaata

SEQ ID NO: 3219950 - DNA, 13 bp, Homo sapiens
tttttacaataaa

SEQ ID NO: 3219951 - DNA, 19 bp, Homo sapiens
tttttacagctgtgttatt

SEQ ID NO: 3219952 - DNA, 13 bp, Homo sapiens
tttttacatttca

SEQ ID NO: 3219953 - DNA, 22 bp, Homo sapiens
tttttacctaccacagtgtctg

SEQ ID NO: 3219954 - DNA, 19 bp, Homo sapiens
tttttactaagttttcaaa

SEQ ID NO: 3219955 - DNA, 14 bp, Homo sapiens
tttttactgaacaa

SEQ ID NO: 3219956 - DNA, 14 bp, Homo sapiens
tttttagacacctt

SEQ ID NO: 3219957 - DNA, 22 bp, Homo sapiens
tttttagtaagttaatgtatat

SEQ ID NO: 3219958 - DNA, 13 bp, Homo sapiens
tttttagtaatct

SEQ ID NO: 3219959 - DNA, 15 bp, Homo sapiens
tttttagtaatctgt

SEQ ID NO: 3219960 - DNA, 16 bp, Homo sapiens
tttttagtaatctgta

SEQ ID NO: 3219961 - DNA, 20 bp, Homo sapiens
tttttagtaatctgtacatt

SEQ ID NO: 3219962 - DNA, 12 bp, Homo sapiens
tttttagttttt

SEQ ID NO: 3219963 - DNA, 12 bp, Homo sapiens
tttttataaaaa

SEQ ID NO: 3219964 - DNA, 20 bp, Homo sapiens
tttttataaaaataaataga

SEQ ID NO: 3219965 - DNA, 18 bp, Homo sapiens
tttttataattgtacaaa

SEQ ID NO: 3219966 - DNA, 23 bp, Homo sapiens
tttttataattgtacaaaattaa

SEQ ID NO: 3219967 - DNA, 14 bp, Homo sapiens
tttttatattgcct

SEQ ID NO: 3219968 - DNA, 20 bp, Homo sapiens
tttttatgaggcaacctgat

SEQ ID NO: 3219969 - DNA, 14 bp, Homo sapiens
tttttattatgcat

SEQ ID NO: 3219970 - DNA, 13 bp, Homo sapiens
tttttatttaaat

SEQ ID NO: 3219971 - DNA, 13 bp, Homo sapiens
tttttatttaatt

SEQ ID NO: 3219972 - DNA, 14 bp, Homo sapiens
tttttatttctaag

SEQ ID NO: 3219973 - DNA, 12 bp, Homo sapiens
tttttatttctg

SEQ ID NO: 3219974 - DNA, 15 bp, Homo sapiens
tttttcaaaaatgct

SEQ ID NO: 3219975 - DNA, 21 bp, Homo sapiens
tttttcagttccaagaaagat

SEQ ID NO: 3219976 - DNA, 16 bp, Homo sapiens
tttttcagttgttctt

SEQ ID NO: 3219977 - DNA, 15 bp, Homo sapiens
tttttcattattgtg

SEQ ID NO: 3219978 - DNA, 23 bp, Homo sapiens
tttttcattcatcccattaatca

SEQ ID NO: 3219979 - DNA, 22 bp, Homo sapiens
tttttcatttattgtttatgta

SEQ ID NO: 3219980 - DNA, 14 bp, Homo sapiens
tttttccaactgtg

SEQ ID NO: 3219981 - DNA, 21 bp, Homo sapiens
tttttccacaaggaataaatg

SEQ ID NO: 3219982 - DNA, 12 bp, Homo sapiens
tttttccatcat

SEQ ID NO: 3219983 - DNA, 13 bp, Homo sapiens
tttttccatcttt

SEQ ID NO: 3219984 - DNA, 17 bp, Homo sapiens
tttttccctcctgacaa

SEQ ID NO: 3219985 - DNA, 13 bp, Homo sapiens
tttttcctaagtt

SEQ ID NO: 3219986 - DNA, 19 bp, Homo sapiens
tttttcctagcctgtttct

SEQ ID NO: 3219987 - DNA, 20 bp, Homo sapiens
tttttccttaatccagctga

SEQ ID NO: 3219988 - DNA, 12 bp, Homo sapiens
tttttcctttct

SEQ ID NO: 3219989 - DNA, 22 bp, Homo sapiens
tttttcgtgtggatcttgccac

SEQ ID NO: 3219990 - DNA, 15 bp, Homo sapiens
tttttctaaaacatt

SEQ ID NO: 3219991 - DNA, 22 bp, Homo sapiens
tttttctaaacaagaaccattt

SEQ ID NO: 3219992 - DNA, 18 bp, Homo sapiens
tttttctcaaagttttga

SEQ ID NO: 3219993 - DNA, 16 bp, Homo sapiens
tttttctctaatgctt

SEQ ID NO: 3219994 - DNA, 12 bp, Homo sapiens
tttttctcttca

SEQ ID NO: 3219995 - DNA, 14 bp, Homo sapiens
tttttctgtaccag

SEQ ID NO: 3219996 - DNA, 16 bp, Homo sapiens
tttttctgtaccagtt

SEQ ID NO: 3219997 - DNA, 20 bp, Homo sapiens
tttttctgtgataactctgc

SEQ ID NO: 3219998 - DNA, 13 bp, Homo sapiens
tttttcttggggt

SEQ ID NO: 3219999 - DNA, 13 bp, Homo sapiens
tttttcttgtaat

SEQ ID NO: 3220000 - DNA, 20 bp, Homo sapiens
tttttcttttttttttctgt

SEQ ID NO: 3220001 - DNA, 13 bp, Homo sapiens
tttttgaaaacat

SEQ ID NO: 3220002 - DNA, 12 bp, Homo sapiens
tttttgaaacag

SEQ ID NO: 3220003 - DNA, 17 bp, Homo sapiens
tttttgaaacccacagt

SEQ ID NO: 3220004 - DNA, 11 bp, Homo sapiens
tttttgaaatg

SEQ ID NO: 3220005 - DNA, 19 bp, Homo sapiens
ttttaaatgcataaatgca

SEQ ID NO: 3220006 - DNA, 18 bp, Homo sapiens
ttttaaattagaaaatat

SEQ ID NO: 3220007 - DNA, 21 bp, Homo sapiens
ttttaaattataacttaaaat

SEQ ID NO: 3220008 - DNA, 12 bp, Homo sapiens
ttttaaattatg

SEQ ID NO: 3220009 - DNA, 17 bp, Homo sapiens
ttttaaattttcttcag

SEQ ID NO: 3220010 - DNA, 21 bp, Homo sapiens
ttttaacaaaaaacagattct

SEQ ID NO: 3220011 - DNA, 20 bp, Homo sapiens
ttttaacacataactagaaa

SEQ ID NO: 3220012 - DNA, 18 bp, Homo sapiens
ttttaacactttgtatta

SEQ ID NO: 3220013 - DNA, 14 bp, Homo sapiens
ttttaacattttgt

SEQ ID NO: 3220014 - DNA, 22 bp, Homo sapiens
ttttaaccggtaagagtttcag

SEQ ID NO: 3220015 - DNA, 12 bp, Homo sapiens
ttttaactagaa

SEQ ID NO: 3220016 - DNA, 12 bp, Homo sapiens
ttttaactttct

SEQ ID NO: 3220017 - DNA, 12 bp, Homo sapiens
ttttaagaaaca

SEQ ID NO: 3220018 - DNA, 13 bp, Homo sapiens
ttttaagaatatc

SEQ ID NO: 3220019 - DNA, 16 bp, Homo sapiens
ttttaagaatatctgt

SEQ ID NO: 3220020 - DNA, 22 bp, Homo sapiens
ttttaagaattctgtacttcca

SEQ ID NO: 3220021 - DNA, 19 bp, Homo sapiens
ttttaagagaaaactgcag

SEQ ID NO: 3220022 - DNA, 18 bp, Homo sapiens
ttttaagatttttctcaa

SEQ ID NO: 3220023 - DNA, 21 bp, Homo sapiens
ttttaagatttttctcaaagt

SEQ ID NO: 3220024 - DNA, 15 bp, Homo sapiens
ttttaagcaaaatat

SEQ ID NO: 3220025 - DNA, 21 bp, Homo sapiens
ttttaagcactcttaaagcaa

SEQ ID NO: 3220026 - DNA, 21 bp, Homo sapiens
ttttaagcgtaattttgccaa

SEQ ID NO: 3220027 - DNA, 14 bp, Homo sapiens
ttttaagctatcag

SEQ ID NO: 3220028 - DNA, 12 bp, Homo sapiens
ttttaaggaaac

SEQ ID NO: 3220029 - DNA, 16 bp, Homo sapiens
ttttaaggctgtgtga

SEQ ID NO: 3220030 - DNA, 18 bp, Homo sapiens
ttttaaggctgtgtgaat

SEQ ID NO: 3220031 - DNA, 13 bp, Homo sapiens
ttttaaggtcttt

SEQ ID NO: 3220032 - DNA, 17 bp, Homo sapiens
ttttaaggtctttcagt

SEQ ID NO: 3220033 - DNA, 18 bp, Homo sapiens
ttttaaggtctttcagta

SEQ ID NO: 3220034 - DNA, 14 bp, Homo sapiens
ttttaagttgctga

SEQ ID NO: 3220035 - DNA, 23 bp, Homo sapiens
ttttaatagaaataaattcctaa

SEQ ID NO: 3220036 - DNA, 19 bp, Homo sapiens
ttttaatattactgtcttt

SEQ ID NO: 3220037 - DNA, 23 bp, Homo sapiens
ttttaatccctatgtttgtctca

SEQ ID NO: 3220038 - DNA, 21 bp, Homo sapiens
ttttaatcctgtaccaaatct

SEQ ID NO: 3220039 - DNA, 23 bp, Homo sapiens
ttttaatcctgtaccaaatctga

SEQ ID NO: 3220040 - DNA, 17 bp, Homo sapiens
ttttaatctgaaattct

SEQ ID NO: 3220041 - DNA, 23 bp, Homo sapiens
ttttaatgatctcggatgaccaa

SEQ ID NO: 3220042 - DNA, 22 bp, Homo sapiens
ttttaatgggggtagcagctgg

SEQ ID NO: 3220043 - DNA, 23 bp, Homo sapiens
ttttaatgggggtagcagctgga

SEQ ID NO: 3220044 - DNA, 12 bp, Homo sapiens
ttttaatgtgaa

SEQ ID NO: 3220045 - DNA, 20 bp, Homo sapiens
ttttaattattatttatata

SEQ ID NO: 3220046 - DNA, 20 bp, Homo sapiens
ttttaattcaccaaagtatt

SEQ ID NO: 3220047 - DNA, 12 bp, Homo sapiens
ttttaattcatt

SEQ ID NO: 3220048 - DNA, 12 bp, Homo sapiens
ttttaattgtca

SEQ ID NO: 3220049 - DNA, 20 bp, Homo sapiens
ttaggttattttgctttggt

SEQ ID NO: 3220050 - DNA, 22 bp, Homo sapiens
ttaggttccatcctttacgtgt

SEQ ID NO: 3220051 - DNA, 12 bp, Homo sapiens
ttaggttctaaa

SEQ ID NO: 3220052 - DNA, 22 bp, Homo sapiens
ttaggttctaaagttctaagat

SEQ ID NO: 3220053 - DNA, 16 bp, Homo sapiens
ttaggtttttccttat

SEQ ID NO: 3220054 - DNA, 24 bp, Homo sapiens
ttagtaacatgaggggacattttg

SEQ ID NO: 3220055 - DNA, 13 bp, Homo sapiens
ttagtaatctgta

SEQ ID NO: 3220056 - DNA, 17 bp, Homo sapiens
ttagtaatttctttttt

SEQ ID NO: 3220057 - DNA, 21 bp, Homo sapiens
ttagtactgaagccaaatgaa

SEQ ID NO: 3220058 - DNA, 21 bp, Homo sapiens
ttagtagaaattttacaatag

SEQ ID NO: 3220059 - DNA, 17 bp, Homo sapiens
ttagtatctaacatgta

SEQ ID NO: 3220060 - DNA, 23 bp, Homo sapiens
ttagtatctaacatgtatcccaa

SEQ ID NO: 3220061 - DNA, 22 bp, Homo sapiens
ttagtatgacgctgatacataa

SEQ ID NO: 3220062 - DNA, 19 bp, Homo sapiens
ttagtatgtctgtttttgt

SEQ ID NO: 3220063 - DNA, 17 bp, Homo sapiens
ttagtattttaatcctg

SEQ ID NO: 3220064 - DNA, 19 bp, Homo sapiens
ttagtcaatcactgcactg

SEQ ID NO: 3220065 - DNA, 22 bp, Homo sapiens
ttagtcccccaactctgagccc

SEQ ID NO: 3220066 - DNA, 14 bp, Homo sapiens
ttagtcctgtactg

SEQ ID NO: 3220067 - DNA, 18 bp, Homo sapiens
ttagtcttctcatagcat

SEQ ID NO: 3220068 - DNA, 14 bp, Homo sapiens
ttagtgaaaaactg

SEQ ID NO: 3220069 - DNA, 19 bp, Homo sapiens
ttagtgaaaaactgctgta

SEQ ID NO: 3220070 - DNA, 17 bp, Homo sapiens
ttagtgaaaattctgtt

SEQ ID NO: 3220071 - DNA, 14 bp, Homo sapiens
ttagtgaatgggaa

SEQ ID NO: 3220072 - DNA, 18 bp, Homo sapiens
ttagtgattctgatttca

SEQ ID NO: 3220073 - DNA, 21 bp, Homo sapiens
ttagtgattctgatttcagtt

SEQ ID NO: 3220074 - DNA, 18 bp, Homo sapiens
ttagtgccacttaatgta

SEQ ID NO: 3220075 - DNA, 22 bp, Homo sapiens
ttagtgccctgccccctggctg

SEQ ID NO: 3220076 - DNA, 23 bp, Homo sapiens
ttagtgccctgccccctggctga

SEQ ID NO: 3220077 - DNA, 14 bp, Homo sapiens
ttagtgcctgtgtg

SEQ ID NO: 3220078 - DNA, 16 bp, Homo sapiens
ttagtgctttacatgc

SEQ ID NO: 3220079 - DNA, 18 bp, Homo sapiens
ttagtgtatgattactgg

SEQ ID NO: 3220080 - DNA, 14 bp, Homo sapiens
ttagtgtcacttac

SEQ ID NO: 3220081 - DNA, 17 bp, Homo sapiens
ttagtgtgtgtgcagag

SEQ ID NO: 3220082 - DNA, 20 bp, Homo sapiens
ttagttaaattgaagaaagt

SEQ ID NO: 3220083 - DNA, 12 bp, Homo sapiens
ttagttaatctc

SEQ ID NO: 3220084 - DNA, 19 bp, Homo sapiens
ttagttaccttatagttac

SEQ ID NO: 3220085 - DNA, 13 bp, Homo sapiens
ttagttatagttt

SEQ ID NO: 3220086 - DNA, 22 bp, Homo sapiens
ttagttatagtttcagatatat

SEQ ID NO: 3220087 - DNA, 23 bp, Homo sapiens
ttagttccccaaatacaaagtta

SEQ ID NO: 3220088 - DNA, 13 bp, Homo sapiens
ttagttccctgtc

SEQ ID NO: 3220089 - DNA, 21 bp, Homo sapiens
ttagttctcactgttccctct

SEQ ID NO: 3220090 - DNA, 13 bp, Homo sapiens
ttagttgaaaaat

SEQ ID NO: 3220091 - DNA, 22 bp, Homo sapiens
ttagttgattgctgttgagatg

SEQ ID NO: 3220092 - DNA, 22 bp, Homo sapiens
ttagtttatattaatttcggtt

SEQ ID NO: 3220093 - DNA, 22 bp, Homo sapiens
ttagtttcagtagattgcagaa

SEQ ID NO: 3220094 - DNA, 11 bp, Homo sapiens
ttagtttcctt

SEQ ID NO: 3220095 - DNA, 18 bp, Homo sapiens
ttagtttggattcttatg

SEQ ID NO: 3220096 - DNA, 16 bp, Homo sapiens
ttactgtgtaattagt

SEQ ID NO: 3220097 - DNA, 19 bp, Homo sapiens
ttactgttgcatttacttt

SEQ ID NO: 3220098 - DNA, 14 bp, Homo sapiens
ttactgtttctgtc

SEQ ID NO: 3220099 - DNA, 15 bp, Homo sapiens
ttactgtttctgtca

SEQ ID NO: 3220100 - DNA, 16 bp, Homo sapiens
ttactgtttctgtcag

SEQ ID NO: 3220101 - DNA, 11 bp, Homo sapiens
ttacttacaaa

SEQ ID NO: 3220102 - DNA, 12 bp, Homo sapiens
ttacttctgcta

SEQ ID NO: 3220103 - DNA, 19 bp, Homo sapiens
ttacttgcattgaatatat

SEQ ID NO: 3220104 - DNA, 16 bp, Homo sapiens
ttacttgctttcaatt

SEQ ID NO: 3220105 - DNA, 13 bp, Homo sapiens
ttacttgtggtgt

SEQ ID NO: 3220106 - DNA, 17 bp, Homo sapiens
ttactttaaaaggagcc

SEQ ID NO: 3220107 - DNA, 18 bp, Homo sapiens
ttactttaaaaggagcca

SEQ ID NO: 3220108 - DNA, 18 bp, Homo sapiens
ttactttagaagcctgca

SEQ ID NO: 3220109 - DNA, 15 bp, Homo sapiens
ttactttatcacttt

SEQ ID NO: 3220110 - DNA, 21 bp, Homo sapiens
ttactttcctttccccagccc

SEQ ID NO: 3220111 - DNA, 13 bp, Homo sapiens
ttactttctctgt

SEQ ID NO: 3220112 - DNA, 15 bp, Homo sapiens
ttactttctctgtag

SEQ ID NO: 3220113 - DNA, 13 bp, Homo sapiens
ttactttgctgag

SEQ ID NO: 3220114 - DNA, 20 bp, Homo sapiens
ttactttgctgccttaatga

SEQ ID NO: 3220115 - DNA, 10 bp, Homo sapiens
ttactttgta

SEQ ID NO: 3220116 - DNA, 11 bp, Homo sapiens
ttactttgtaa

SEQ ID NO: 3220117 - DNA, 13 bp, Homo sapiens
ttactttgtaatt

SEQ ID NO: 3220118 - DNA, 17 bp, Homo sapiens
ttacttttaaacagtga

SEQ ID NO: 3220119 - DNA, 15 bp, Homo sapiens
ttacttttaaactgt

SEQ ID NO: 3220120 - DNA, 19 bp, Homo sapiens
ttacttttgttctgtattt

SEQ ID NO: 3220121 - DNA, 18 bp, Homo sapiens
ttactttttcttgtattc

SEQ ID NO: 3220122 - DNA, 16 bp, Homo sapiens
ttacttttttatagct

SEQ ID NO: 3220123 - DNA, 15 bp, Homo sapiens
ttagaaaaaaattac

SEQ ID NO: 3220124 - DNA, 21 bp, Homo sapiens
ttagaaaacataatcttctgc

SEQ ID NO: 3220125 - DNA, 14 bp, Homo sapiens
ttagaaaccttaat

SEQ ID NO: 3220126 - DNA, 18 bp, Homo sapiens
ttagaaaccttaatatgt

SEQ ID NO: 3220127 - DNA, 19 bp, Homo sapiens
ttagaaataaatgtacctg

SEQ ID NO: 3220128 - DNA, 15 bp, Homo sapiens
ttagaaatagacagt

SEQ ID NO: 3220129 - DNA, 14 bp, Homo sapiens
ttagaaatataatt

SEQ ID NO: 3220130 - DNA, 15 bp, Homo sapiens
ttagaaatattcaca

SEQ ID NO: 3220131 - DNA, 19 bp, Homo sapiens
ttagaaattacctgtggat

SEQ ID NO: 3220132 - DNA, 23 bp, Homo sapiens
ttagaaattacctgtggatattt

SEQ ID NO: 3220133 - DNA, 12 bp, Homo sapiens
ttagaacactat

SEQ ID NO: 3220134 - DNA, 19 bp, Homo sapiens
ttagaacactattttcaga

SEQ ID NO: 3220135 - DNA, 22 bp, Homo sapiens
ttagaacatttaataatgtatg

SEQ ID NO: 3220136 - DNA, 21 bp, Homo sapiens
ttagaaccaccaaaattatag

SEQ ID NO: 3220137 - DNA, 13 bp, Homo sapiens
ttagaagagagcc

SEQ ID NO: 3220138 - DNA, 13 bp, Homo sapiens
ttagaagcctgca

SEQ ID NO: 3220139 - DNA, 17 bp, Homo sapiens
ttagaagtgcatttctg

SEQ ID NO: 3220140 - DNA, 19 bp, Homo sapiens
ttagaagtgcatttctgaa

SEQ ID NO: 3220141 - DNA, 14 bp, Homo sapiens
ttagaataatttta

SEQ ID NO: 3220142 - DNA, 23 bp, Homo sapiens
ttagaataattttattagaataa

SEQ ID NO: 3220143 - DNA, 23 bp, Homo sapiens
ttagaatgccggttaaattccat

SEQ ID NO: 3220144 - DNA, 18 bp, Homo sapiens
ttagacaactagatttgt

SEQ ID NO: 3220145 - DNA, 21 bp, Homo sapiens
ttagacaactagatttgtcct

SEQ ID NO: 3220146 - DNA, 16 bp, Homo sapiens
ttagacaagagatggg

SEQ ID NO: 3220147 - DNA, 20 bp, Homo sapiens
ttagacagagtctcactgtt

SEQ ID NO: 3220148 - DNA, 20 bp, Homo sapiens
ttagacgccttccaggtcag

SEQ ID NO: 3220149 - DNA, 14 bp, Homo sapiens
ttagactcaaagaa

SEQ ID NO: 3220150 - DNA, 15 bp, Homo sapiens
ttacctggatgttct

SEQ ID NO: 3220151 - DNA, 18 bp, Homo sapiens
ttacctgggcattcttgt

SEQ ID NO: 3220152 - DNA, 20 bp, Homo sapiens
ttacctgtggatatttgtat

SEQ ID NO: 3220153 - DNA, 22 bp, Homo sapiens
ttacctgttttcgcacctacca

SEQ ID NO: 3220154 - DNA, 17 bp, Homo sapiens
ttacctttttgtatgtg

SEQ ID NO: 3220155 - DNA, 15 bp, Homo sapiens
ttacgctttgattca

SEQ ID NO: 3220156 - DNA, 16 bp, Homo sapiens
ttacgctttgattcat

SEQ ID NO: 3220157 - DNA, 15 bp, Homo sapiens
ttacggaggaacaga

SEQ ID NO: 3220158 - DNA, 16 bp, Homo sapiens
ttacggaggaacagat

SEQ ID NO: 3220159 - DNA, 17 bp, Homo sapiens
ttacgtgtttaaaaaaa

SEQ ID NO: 3220160 - DNA, 18 bp, Homo sapiens
ttactaaaaaaaagatga

SEQ ID NO: 3220161 - DNA, 14 bp, Homo sapiens
ttactaaaaagtac

SEQ ID NO: 3220162 - DNA, 16 bp, Homo sapiens
ttactaaacattttgt

SEQ ID NO: 3220163 - DNA, 19 bp, Homo sapiens
ttactaaattgtatacatt

SEQ ID NO: 3220164 - DNA, 21 bp, Homo sapiens
ttactaagcatagcaaacaga

SEQ ID NO: 3220165 - DNA, 17 bp, Homo sapiens
ttactaagccacaagaa

SEQ ID NO: 3220166 - DNA, 18 bp, Homo sapiens
ttactaagccacaagaaa

SEQ ID NO: 3220167 - DNA, 21 bp, Homo sapiens
ttactaagccacaagaaattt

SEQ ID NO: 3220168 - DNA, 23 bp, Homo sapiens
ttactaagttttcaaatttgtaa

SEQ ID NO: 3220169 - DNA, 14 bp, Homo sapiens
ttactaggtaactt

SEQ ID NO: 3220170 - DNA, 17 bp, Homo sapiens
ttactaggtaacttcat

SEQ ID NO: 3220171 - DNA, 20 bp, Homo sapiens
ttactataatttgacttgaa

SEQ ID NO: 3220172 - DNA, 16 bp, Homo sapiens
ttactatgcacaattt

SEQ ID NO: 3220173 - DNA, 18 bp, Homo sapiens
ttactcagggctcctccc

SEQ ID NO: 3220174 - DNA, 20 bp, Homo sapiens
ttactcagggctcctcccag

SEQ ID NO: 3220175 - DNA, 14 bp, Homo sapiens
ttactcagggttca

SEQ ID NO: 3220176 - DNA, 21 bp, Homo sapiens
ttactcagggttcatctgtcc

SEQ ID NO: 3220177 - DNA, 22 bp, Homo sapiens
ttactcagggttcatctgtcca

SEQ ID NO: 3220178 - DNA, 14 bp, Homo sapiens
ttactcattgaaat

SEQ ID NO: 3220179 - DNA, 17 bp, Homo sapiens
ttactcattgaaatgtc

SEQ ID NO: 3220180 - DNA, 21 bp, Homo sapiens
ttactcatttttttaatttat

SEQ ID NO: 3220181 - DNA, 16 bp, Homo sapiens
ttactccataaacaga

SEQ ID NO: 3220182 - DNA, 20 bp, Homo sapiens
ttactcccaagacttcattg

SEQ ID NO: 3220183 - DNA, 18 bp, Homo sapiens
ttactccctacactgatg

SEQ ID NO: 3220184 - DNA, 18 bp, Homo sapiens
ttactcccttcctggcct

SEQ ID NO: 3220185 - DNA, 13 bp, Homo sapiens
ttactctgagccc

SEQ ID NO: 3220186 - DNA, 17 bp, Homo sapiens
ttactctgagcccaggc

SEQ ID NO: 3220187 - DNA, 20 bp, Homo sapiens
ttactctgagcccaggccgt

SEQ ID NO: 3220188 - DNA, 18 bp, Homo sapiens
ttactctgcctacagaac

SEQ ID NO: 3220189 - DNA, 18 bp, Homo sapiens
ttactgaaaaaggtgatt

SEQ ID NO: 3220190 - DNA, 23 bp, Homo sapiens
ttactgaacaatcaaagcacttg

SEQ ID NO: 3220191 - DNA, 17 bp, Homo sapiens
ttactgaagaaatcttt

SEQ ID NO: 3220192 - DNA, 12 bp, Homo sapiens
ttactgaccatg

SEQ ID NO: 3220193 - DNA, 14 bp, Homo sapiens
ttactgagcttctc

SEQ ID NO: 3220194 - DNA, 17 bp, Homo sapiens
ttactgagcttctctgt

SEQ ID NO: 3220195 - DNA, 18 bp, Homo sapiens
ttactgagcttctctgtg

SEQ ID NO: 3220196 - DNA, 19 bp, Homo sapiens
ttactgagcttctctgtga

SEQ ID NO: 3220197 - DNA, 13 bp, Homo sapiens
ttactgatcatgc

SEQ ID NO: 3220198 - DNA, 16 bp, Homo sapiens
ttactgatcatgcatt

SEQ ID NO: 3220199 - DNA, 19 bp, Homo sapiens
ttactgatcatgcattgtt

SEQ ID NO: 3220200 - DNA, 21 bp, Homo sapiens
ttactgccaaagggaaatatc

SEQ ID NO: 3220201 - DNA, 19 bp, Homo sapiens
ttactgccggtttgaaaat

SEQ ID NO: 3220202 - DNA, 22 bp, Homo sapiens
ttactgcctataatcttataca

SEQ ID NO: 3220203 - DNA, 17 bp, Homo sapiens
ttactgctttaatcaga

SEQ ID NO: 3220204 - DNA, 19 bp, Homo sapiens
ttactgctttaatcagaaa

SEQ ID NO: 3220205 - DNA, 18 bp, Homo sapiens
ttactggggcctggggct

SEQ ID NO: 3220206 - DNA, 15 bp, Homo sapiens
ttactggtccaaaag

SEQ ID NO: 3220207 - DNA, 18 bp, Homo sapiens
ttactggtccaaaagatt

SEQ ID NO: 3220208 - DNA, 15 bp, Homo sapiens
ttactggtttcccca

SEQ ID NO: 3220209 - DNA, 14 bp, Homo sapiens
ttactgtatataaa

SEQ ID NO: 3220210 - DNA, 16 bp, Homo sapiens
ttactgtatataaact

SEQ ID NO: 3220211 - DNA, 14 bp, Homo sapiens
ttactgtatatgta

SEQ ID NO: 3220212 - DNA, 17 bp, Homo sapiens
ttactgtatatgtattc

SEQ ID NO: 3220213 - DNA, 13 bp, Homo sapiens
ttactgtcaataa

SEQ ID NO: 3220214 - DNA, 18 bp, Homo sapiens
ttactgtcaataaacagc

SEQ ID NO: 3220215 - DNA, 12 bp, Homo sapiens
ttactgtcagat

SEQ ID NO: 3220216 - DNA, 15 bp, Homo sapiens
ttactgtcagattaa

SEQ ID NO: 3220217 - DNA, 19 bp, Homo sapiens
ttactgtctattaatattc

SEQ ID NO: 3220218 - DNA, 14 bp, Homo sapiens
ttactgtgaaactg

SEQ ID NO: 3220219 - DNA, 18 bp, Homo sapiens
ttactgtggaggaaggat

SEQ ID NO: 3220220 - DNA, 16 bp, Homo sapiens
ttaaagaaaggaaaag

SEQ ID NO: 3220221 - DNA, 11 bp, Homo sapiens
ttaaagaaagt

SEQ ID NO: 3220222 - DNA, 20 bp, Homo sapiens
ttaaagaatatgacttttta

SEQ ID NO: 3220223 - DNA, 10 bp, Homo sapiens
ttaaagacag

SEQ ID NO: 3220224 - DNA, 14 bp, Homo sapiens
ttaaagagaggtta

SEQ ID NO: 3220225 - DNA, 12 bp, Homo sapiens
ttaaagagtcta

SEQ ID NO: 3220226 - DNA, 16 bp, Homo sapiens
ttaaagagtctagatt

SEQ ID NO: 3220227 - DNA, 18 bp, Homo sapiens
ttaaagagtctagattca

SEQ ID NO: 3220228 - DNA, 19 bp, Homo sapiens
ttaaagagtctagattcaa

SEQ ID NO: 3220229 - DNA, 22 bp, Homo sapiens
ttaaagatctgtaagtaacttc

SEQ ID NO: 3220230 - DNA, 17 bp, Homo sapiens
ttaaagatgaactctga

SEQ ID NO: 3220231 - DNA, 14 bp, Homo sapiens
ttaaagattctctt

SEQ ID NO: 3220232 - DNA, 18 bp, Homo sapiens
ttaaagcagacagtcaca

SEQ ID NO: 3220233 - DNA, 14 bp, Homo sapiens
ttaaagcctcctca

SEQ ID NO: 3220234 - DNA, 22 bp, Homo sapiens
ttaaagcctttagtatcagtgt

SEQ ID NO: 3220235 - DNA, 15 bp, Homo sapiens
ttaaagctgcctgta

SEQ ID NO: 3220236 - DNA, 18 bp, Homo sapiens
ttaaagctgcctgtagtt

SEQ ID NO: 3220237 - DNA, 21 bp, Homo sapiens
ttaaaggacaggaggaggaga

SEQ ID NO: 3220238 - DNA, 17 bp, Homo sapiens
ttaaaggatgttggtgt

SEQ ID NO: 3220239 - DNA, 18 bp, Homo sapiens
ttaaaggcaccatctaat

SEQ ID NO: 3220240 - DNA, 19 bp, Homo sapiens
ttaaagggtgtacttatat

SEQ ID NO: 3220241 - DNA, 13 bp, Homo sapiens
ttaaagtatatat

SEQ ID NO: 3220242 - DNA, 23 bp, Homo sapiens
ttaaagtatgttattgcataatt

SEQ ID NO: 3220243 - DNA, 18 bp, Homo sapiens
ttaaagtcaggtccaatt

SEQ ID NO: 3220244 - DNA, 12 bp, Homo sapiens
ttaaagtgatta

SEQ ID NO: 3220245 - DNA, 22 bp, Homo sapiens
ttaaagtgctaaggttctaagg

SEQ ID NO: 3220246 - DNA, 11 bp, Homo sapiens
ttaaagttctg

SEQ ID NO: 3220247 - DNA, 19 bp, Homo sapiens
ttaaagttggaatttacca

SEQ ID NO: 3220248 - DNA, 16 bp, Homo sapiens
ttaaataaaagcacaa

SEQ ID NO: 3220249 - DNA, 21 bp, Homo sapiens
ttaaataaactttttttcaat

SEQ ID NO: 3220250 - DNA, 16 bp, Homo sapiens
ttaaataacctctggc

SEQ ID NO: 3220251 - DNA, 13 bp, Homo sapiens
ttaaataagattc

SEQ ID NO: 3220252 - DNA, 15 bp, Homo sapiens
ttaaatacaaaactt

SEQ ID NO: 3220253 - DNA, 17 bp, Homo sapiens
ttaaatacagacactaa

SEQ ID NO: 3220254 - DNA, 18 bp, Homo sapiens
ttaaatacagacactaag

SEQ ID NO: 3220255 - DNA, 19 bp, Homo sapiens
ttaaatactgtgcagaata

SEQ ID NO: 3220256 - DNA, 13 bp, Homo sapiens
ttaaatataaata

SEQ ID NO: 3220257 - DNA, 13 bp, Homo sapiens
ttaaatataattc

SEQ ID NO: 3220258 - DNA, 14 bp, Homo sapiens
ttaaatatagatta

SEQ ID NO: 3220259 - DNA, 17 bp, Homo sapiens
ttaaatatagattagaa

SEQ ID NO: 3220260 - DNA, 13 bp, Homo sapiens
ttaaatattttct

SEQ ID NO: 3220261 - DNA, 12 bp, Homo sapiens
ttaaatcatgta

SEQ ID NO: 3220262 - DNA, 13 bp, Homo sapiens
ttaaatcatgtat

SEQ ID NO: 3220263 - DNA, 15 bp, Homo sapiens
ttaaatcatttttat

SEQ ID NO: 3220264 - DNA, 14 bp, Homo sapiens
ttaaatccaataaa

SEQ ID NO: 3220265 - DNA, 16 bp, Homo sapiens
ttaaatccttgtgtaa

SEQ ID NO: 3220266 - DNA, 13 bp, Homo sapiens
ttaaatcctttta

SEQ ID NO: 3220267 - DNA, 19 bp, Homo sapiens
ttaaatccttttacctttt

SEQ ID NO: 3220268 - DNA, 18 bp, Homo sapiens
ttaaatctcaaatttatt

SEQ ID NO: 3220269 - DNA, 16 bp, Homo sapiens
ttaaatctcattgctt

SEQ ID NO: 3220270 - DNA, 15 bp, Homo sapiens
ttaaatctttcttca

SEQ ID NO: 3220271 - DNA, 17 bp, Homo sapiens
ttaaatctttcttcaaa

SEQ ID NO: 3220272 - DNA, 16 bp, Homo sapiens
ttaaatgccttgtata

SEQ ID NO: 3220273 - DNA, 11 bp, Homo sapiens
ttaaatgtgaa

SEQ ID NO: 3220274 - DNA, 12 bp, Homo sapiens
ttaaatgtgaat

SEQ ID NO: 3220275 - DNA, 18 bp, Homo sapiens
ttaaatgtttatactgta

SEQ ID NO: 3220276 - DNA, 19 bp, Homo sapiens
ttaaatgtttatactgtat

SEQ ID NO: 3220277 - DNA, 12 bp, Homo sapiens
ttaaattacaat

SEQ ID NO: 3220278 - DNA, 17 bp, Homo sapiens
ttaaattacaattttat

SEQ ID NO: 3220279 - DNA, 14 bp, Homo sapiens
ttaaattacagctt

SEQ ID NO: 3220280 - DNA, 17 bp, Homo sapiens
ttaaattacagctttta

SEQ ID NO: 3220281 - DNA, 14 bp, Homo sapiens
ttaaattagaaaat

SEQ ID NO: 3220282 - DNA, 18 bp, Homo sapiens
ttaaattatatatttatt

SEQ ID NO: 3220283 - DNA, 15 bp, Homo sapiens
ttaaattatgtttta

SEQ ID NO: 3220284 - DNA, 23 bp, Homo sapiens
ttaaattctccagttttttgtta

SEQ ID NO: 3220285 - DNA, 18 bp, Homo sapiens
ttaaattctgagacatgt

SEQ ID NO: 3220286 - DNA, 20 bp, Homo sapiens
ttaaattcttttttaaattt

SEQ ID NO: 3220287 - DNA, 20 bp, Homo sapiens
ttaaatttggtttgttaatt

SEQ ID NO: 3220288 - DNA, 15 bp, Homo sapiens
ttaaatttgtaagtt

SEQ ID NO: 3220289 - DNA, 17 bp, Homo sapiens
ttaaatttgtaagtttc

SEQ ID NO: 3220290 - DNA, 16 bp, Homo sapiens
ttaaattttacccttt

SEQ ID NO: 3220291 - DNA, 19 bp, Homo sapiens
ttaaattttagtacatttt

SEQ ID NO: 3220292 - DNA, 15 bp, Homo sapiens
ttaaattttcttcag

SEQ ID NO: 3220293 - DNA, 15 bp, Homo sapiens
ttaaattttgagttc

SEQ ID NO: 3220294 - DNA, 20 bp, Homo sapiens
ttaaattttgagttctacat

SEQ ID NO: 3220295 - DNA, 22 bp, Homo sapiens
ttaacaaaaaacagattctata

SEQ ID NO: 3220296 - DNA, 15 bp, Homo sapiens
ttaacaaaagcaaga

SEQ ID NO: 3220297 - DNA, 16 bp, Homo sapiens
ttaacaaaagttccct

SEQ ID NO: 3220298 - DNA, 21 bp, Homo sapiens
ttaacaaatatgctaatttgg

SEQ ID NO: 3220299 - DNA, 22 bp, Homo sapiens
ttaacaaatgctctgtcttcaa

SEQ ID NO: 3220300 - DNA, 18 bp, Homo sapiens
ttaagtgttggaaaaaat

SEQ ID NO: 3220301 - DNA, 17 bp, Homo sapiens
ttaagttggcttctgtt

SEQ ID NO: 3220302 - DNA, 23 bp, Homo sapiens
ttaagttttgattaatgtttctt

SEQ ID NO: 3220303 - DNA, 20 bp, Homo sapiens
ttaataaaaaaacaatcatt

SEQ ID NO: 3220304 - DNA, 16 bp, Homo sapiens
ttaataaaactgcaca

SEQ ID NO: 3220305 - DNA, 23 bp, Homo sapiens
ttaataaaactgcacagtgctgt

SEQ ID NO: 3220306 - DNA, 20 bp, Homo sapiens
ttaataaaataattctaaag

SEQ ID NO: 3220307 - DNA, 15 bp, Homo sapiens
ttaataaagatgagt

SEQ ID NO: 3220308 - DNA, 13 bp, Homo sapiens
ttaataaattgct

SEQ ID NO: 3220309 - DNA, 14 bp, Homo sapiens
ttaataacagctcc

SEQ ID NO: 3220310 - DNA, 16 bp, Homo sapiens
ttaataacagctcctt

SEQ ID NO: 3220311 - DNA, 13 bp, Homo sapiens
ttaataataatct

SEQ ID NO: 3220312 - DNA, 16 bp, Homo sapiens
ttaataataatctagg

SEQ ID NO: 3220313 - DNA, 17 bp, Homo sapiens
ttaataatgtatgtaca

SEQ ID NO: 3220314 - DNA, 21 bp, Homo sapiens
ttaataatgtattgtaatctt

SEQ ID NO: 3220315 - DNA, 15 bp, Homo sapiens
ttaatactaccttga

SEQ ID NO: 3220316 - DNA, 19 bp, Homo sapiens
ttaatactataaataatat

SEQ ID NO: 3220317 - DNA, 22 bp, Homo sapiens
ttaatactcaaatgagtaacat

SEQ ID NO: 3220318 - DNA, 14 bp, Homo sapiens
ttaatactctattt

SEQ ID NO: 3220319 - DNA, 17 bp, Homo sapiens
ttaatagatcttagggt

SEQ ID NO: 3220320 - DNA, 13 bp, Homo sapiens
ttaatagcaacag

SEQ ID NO: 3220321 - DNA, 14 bp, Homo sapiens
ttaatagcagcctt

SEQ ID NO: 3220322 - DNA, 22 bp, Homo sapiens
ttaatagcagcctttctctctt

SEQ ID NO: 3220323 - DNA, 14 bp, Homo sapiens
ttaatagtgctttt

SEQ ID NO: 3220324 - DNA, 15 bp, Homo sapiens
ttaatagtttgtcta

SEQ ID NO: 3220325 - DNA, 13 bp, Homo sapiens
ttaatatattaaa

SEQ ID NO: 3220326 - DNA, 18 bp, Homo sapiens
ttaatatattaaaattcc

SEQ ID NO: 3220327 - DNA, 19 bp, Homo sapiens
ttaatatccctacatgtat

SEQ ID NO: 3220328 - DNA, 16 bp, Homo sapiens
ttaatatctggcactg

SEQ ID NO: 3220329 - DNA, 20 bp, Homo sapiens
ttaatatctggcactgttaa

SEQ ID NO: 3220330 - DNA, 12 bp, Homo sapiens
ttaatatgaaaa

SEQ ID NO: 3220331 - DNA, 16 bp, Homo sapiens
ttaatatgaaaactta

SEQ ID NO: 3220332 - DNA, 17 bp, Homo sapiens
ttaatatgaaaacttat

SEQ ID NO: 3220333 - DNA, 12 bp, Homo sapiens
ttaatatgagtt

SEQ ID NO: 3220334 - DNA, 23 bp, Homo sapiens
ttaatatgttaacctcagtgtca

SEQ ID NO: 3220335 - DNA, 15 bp, Homo sapiens
ttaatattactgtct

SEQ ID NO: 3220336 - DNA, 16 bp, Homo sapiens
ttaatattactgtctt

SEQ ID NO: 3220337 - DNA, 15 bp, Homo sapiens
ttaatatttaaacag

SEQ ID NO: 3220338 - DNA, 16 bp, Homo sapiens
ttaatatttaaacagc

SEQ ID NO: 3220339 - DNA, 17 bp, Homo sapiens
ttaatatttaaacagca

SEQ ID NO: 3220340 - DNA, 18 bp, Homo sapiens
ttaatatttaaacagcag

SEQ ID NO: 3220341 - DNA, 12 bp, Homo sapiens
ttaatcaaaggc

SEQ ID NO: 3220342 - DNA, 14 bp, Homo sapiens
ttaatcaaaggcat

SEQ ID NO: 3220343 - DNA, 18 bp, Homo sapiens
ttaatcacagtcatcttt

SEQ ID NO: 3220344 - DNA, 22 bp, Homo sapiens
ttaatcacagtcatctttaaca

SEQ ID NO: 3220345 - DNA, 14 bp, Homo sapiens
ttaatcaccttctt

SEQ ID NO: 3220346 - DNA, 18 bp, Homo sapiens
ttaatcaccttctttgta

SEQ ID NO: 3220347 - DNA, 19 bp, Homo sapiens
ttaatcaccttctttgtaa

SEQ ID NO: 3220348 - DNA, 16 bp, Homo sapiens
ttaatcatatttgaaa

SEQ ID NO: 3220349 - DNA, 23 bp, Homo sapiens
ttaatcatatttgaaaaccatat

SEQ ID NO: 3220350 - DNA, 21 bp, Homo sapiens
ttaatcatctataaagaagaa

SEQ ID NO: 3220351 - DNA, 19 bp, Homo sapiens
ttaatcattttcattccta

SEQ ID NO: 3220352 - DNA, 15 bp, Homo sapiens
ttaatcctgtaccaa

SEQ ID NO: 3220353 - DNA, 15 bp, Homo sapiens
ttaatctgaaattct

SEQ ID NO: 3220354 - DNA, 19 bp, Homo sapiens
ttaatctgaaattctaaag

SEQ ID NO: 3220355 - DNA, 20 bp, Homo sapiens
ttaatctgtgtgtatattga

SEQ ID NO: 3220356 - DNA, 14 bp, Homo sapiens
ttaatcttagtgta

SEQ ID NO: 3220357 - DNA, 23 bp, Homo sapiens
tgttaaggaaactcttatctcag

SEQ ID NO: 3220358 - DNA, 20 bp, Homo sapiens
tgttaaggacttctgcagct

SEQ ID NO: 3220359 - DNA, 20 bp, Homo sapiens
tgttaagggaagaattccag

SEQ ID NO: 3220360 - DNA, 21 bp, Homo sapiens
tgttaaggttgaactttgcca

SEQ ID NO: 3220361 - DNA, 22 bp, Homo sapiens
tgttaaggttgaactttgccaa

SEQ ID NO: 3220362 - DNA, 15 bp, Homo sapiens
tgttaagtatgtgta

SEQ ID NO: 3220363 - DNA, 16 bp, Homo sapiens
tgttaagtatgtgtaa

SEQ ID NO: 3220364 - DNA, 21 bp, Homo sapiens
tgttaagttatagtgaatact

SEQ ID NO: 3220365 - DNA, 14 bp, Homo sapiens
tgttaatacacagt

SEQ ID NO: 3220366 - DNA, 19 bp, Homo sapiens
tgttaatctctgttatgta

SEQ ID NO: 3220367 - DNA, 17 bp, Homo sapiens
tgttaatgaaaatgtca

SEQ ID NO: 3220368 - DNA, 19 bp, Homo sapiens
tgttaatgaaaatgtcaga

SEQ ID NO: 3220369 - DNA, 16 bp, Homo sapiens
tgttaatgctctatgt

SEQ ID NO: 3220370 - DNA, 19 bp, Homo sapiens
tgttaatgtatttgttcat

SEQ ID NO: 3220371 - DNA, 20 bp, Homo sapiens
tgttaattcagcactgattt

SEQ ID NO: 3220372 - DNA, 15 bp, Homo sapiens
tgttaattcttattt

SEQ ID NO: 3220373 - DNA, 20 bp, Homo sapiens
tgttacacagcccaagagga

SEQ ID NO: 3220374 - DNA, 22 bp, Homo sapiens
tgttacataacaagaaaatcaa

SEQ ID NO: 3220375 - DNA, 19 bp, Homo sapiens
tgttacataagataaatgt

SEQ ID NO: 3220376 - DNA, 23 bp, Homo sapiens
tgttaccaaaaataaatatatct

SEQ ID NO: 3220377 - DNA, 15 bp, Homo sapiens
tgttaccattcacaa

SEQ ID NO: 3220378 - DNA, 18 bp, Homo sapiens
tgttactattttctacaa

SEQ ID NO: 3220379 - DNA, 20 bp, Homo sapiens
tgttactctggttctttgtt

SEQ ID NO: 3220380 - DNA, 17 bp, Homo sapiens
tgttactggtgtccagc

SEQ ID NO: 3220381 - DNA, 9 bp, Homo sapiens
tgttactgt

SEQ ID NO: 3220382 - DNA, 14 bp, Homo sapiens
tgttactgtaattc

SEQ ID NO: 3220383 - DNA, 14 bp, Homo sapiens
tgttactgttcttg

SEQ ID NO: 3220384 - DNA, 22 bp, Homo sapiens
tgttactgttcttgctgctaga

SEQ ID NO: 3220385 - DNA, 14 bp, Homo sapiens
tgttacttacctaa

SEQ ID NO: 3220386 - DNA, 14 bp, Homo sapiens
tgttacttgcagca

SEQ ID NO: 3220387 - DNA, 13 bp, Homo sapiens
tgttagaacacta

SEQ ID NO: 3220388 - DNA, 17 bp, Homo sapiens
tgttagaacactatttt

SEQ ID NO: 3220389 - DNA, 21 bp, Homo sapiens
tgttagaacactattttcaga

SEQ ID NO: 3220390 - DNA, 12 bp, Homo sapiens
tgttagcaaaga

SEQ ID NO: 3220391 - DNA, 15 bp, Homo sapiens
tgttagcactgttga

SEQ ID NO: 3220392 - DNA, 16 bp, Homo sapiens
tgttagcactgttgat

SEQ ID NO: 3220393 - DNA, 20 bp, Homo sapiens
tgttagcactgttgatgtat

SEQ ID NO: 3220394 - DNA, 16 bp, Homo sapiens
tgttagctacacagtg

SEQ ID NO: 3220395 - DNA, 20 bp, Homo sapiens
tgttagctttttaaaacatt

SEQ ID NO: 3220396 - DNA, 21 bp, Homo sapiens
tgttaggattttcacattctt

SEQ ID NO: 3220397 - DNA, 13 bp, Homo sapiens
tgttagggtcagc

SEQ ID NO: 3220398 - DNA, 17 bp, Homo sapiens
tgttagggtcagccatt

SEQ ID NO: 3220399 - DNA, 21 bp, Homo sapiens
tgttagggtcagccattttta

SEQ ID NO: 3220400 - DNA, 14 bp, Homo sapiens
tgttagtagaaatt

SEQ ID NO: 3220401 - DNA, 18 bp, Homo sapiens
tgttagtattttaatcct

SEQ ID NO: 3220402 - DNA, 17 bp, Homo sapiens
tgttataactctgcact

SEQ ID NO: 3220403 - DNA, 23 bp, Homo sapiens
tgttataactctgcactactcct

SEQ ID NO: 3220404 - DNA, 19 bp, Homo sapiens
tgttatatcccctgctacc

SEQ ID NO: 3220405 - DNA, 23 bp, Homo sapiens
tgttatatttaatgcattaaacc

SEQ ID NO: 3220406 - DNA, 20 bp, Homo sapiens
tgttatcttctcaagttcta

SEQ ID NO: 3220407 - DNA, 23 bp, Homo sapiens
tgttatcttctcaagttctaaga

SEQ ID NO: 3220408 - DNA, 13 bp, Homo sapiens
tgttatgaacatg

SEQ ID NO: 3220409 - DNA, 21 bp, Homo sapiens
tgttatgatattgtttaaaat

SEQ ID NO: 3220410 - DNA, 20 bp, Homo sapiens
tgttatgggatgtaaacaat

SEQ ID NO: 3220411 - DNA, 15 bp, Homo sapiens
tgttatgtaaaactc

SEQ ID NO: 3220412 - DNA, 18 bp, Homo sapiens
tgttatgtaaaactcgct

SEQ ID NO: 3220413 - DNA, 15 bp, Homo sapiens
tgttatgtactgtac

SEQ ID NO: 3220414 - DNA, 15 bp, Homo sapiens
tgttatgtatgaagg

SEQ ID NO: 3220415 - DNA, 22 bp, Homo sapiens
tgttattattacttatttttga

SEQ ID NO: 3220416 - DNA, 14 bp, Homo sapiens
tgttattccatcaa

SEQ ID NO: 3220417 - DNA, 18 bp, Homo sapiens
tgttattccatcaataaa

SEQ ID NO: 3220418 - DNA, 23 bp, Homo sapiens
tgttattcctagtggatgactgt

SEQ ID NO: 3220419 - DNA, 21 bp, Homo sapiens
tgttattcgaaccactgagag

SEQ ID NO: 3220420 - DNA, 12 bp, Homo sapiens
tgttattgtgaa

SEQ ID NO: 3220421 - DNA, 13 bp, Homo sapiens
tgttattgttgaa

SEQ ID NO: 3220422 - DNA, 14 bp, Homo sapiens
tgttattgttgaac

SEQ ID NO: 3220423 - DNA, 18 bp, Homo sapiens
tgttatttattctttatt

SEQ ID NO: 3220424 - DNA, 14 bp, Homo sapiens
tgttattttcagta

SEQ ID NO: 3220425 - DNA, 19 bp, Homo sapiens
tgttatttttcaaggaagg

SEQ ID NO: 3220426 - DNA, 20 bp, Homo sapiens
tgttcaaacaatatcatatc

SEQ ID NO: 3220427 - DNA, 17 bp, Homo sapiens
tgttcaaacacaatgga

SEQ ID NO: 3220428 - DNA, 22 bp, Homo sapiens
tgttcaaagccacattatttct

SEQ ID NO: 3220429 - DNA, 18 bp, Homo sapiens
tgttcaagaaataaaaat

SEQ ID NO: 3220430 - DNA, 23 bp, Homo sapiens
tgttcaatgattatttgtattta

SEQ ID NO: 3220431 - DNA, 21 bp, Homo sapiens
tgttcaatggttctgaaataa

SEQ ID NO: 3220432 - DNA, 15 bp, Homo sapiens
tgttcactgaagacg

SEQ ID NO: 3220433 - DNA, 18 bp, Homo sapiens
tgttcactggacacttca

SEQ ID NO: 3220434 - DNA, 19 bp, Homo sapiens
tgttcacttttcctccctc

SEQ ID NO: 3220435 - DNA, 18 bp, Homo sapiens
tgttcagaaggttgctct

SEQ ID NO: 3220436 - DNA, 15 bp, Homo sapiens
tgttcagcactgtcc

SEQ ID NO: 3220437 - DNA, 15 bp, Homo sapiens
tgttcagctccagct

SEQ ID NO: 3220438 - DNA, 20 bp, Homo sapiens
tgttcagctccagctcacca

SEQ ID NO: 3220439 - DNA, 14 bp, Homo sapiens
tgttcagcttcaga

SEQ ID NO: 3220440 - DNA, 23 bp, Homo sapiens
tgttcaggaaaaggttgaataat

SEQ ID NO: 3220441 - DNA, 12 bp, Homo sapiens
tgttcaggcagg

SEQ ID NO: 3220442 - DNA, 15 bp, Homo sapiens
tgttcatagcccagt

SEQ ID NO: 3220443 - DNA, 20 bp, Homo sapiens
tgttcatagcccagtagacc

SEQ ID NO: 3220444 - DNA, 17 bp, Homo sapiens
tgttcattataatctca

SEQ ID NO: 3220445 - DNA, 19 bp, Homo sapiens
tgttcattataatctcaaa

SEQ ID NO: 3220446 - DNA, 18 bp, Homo sapiens
tgttcattcaagctattt

SEQ ID NO: 3220447 - DNA, 22 bp, Homo sapiens
tgttcattcaagctatttaata

SEQ ID NO: 3220448 - DNA, 12 bp, Homo sapiens
tgttcattgtaa

SEQ ID NO: 3220449 - DNA, 14 bp, Homo sapiens
tgttcattgtaatg

SEQ ID NO: 3220450 - DNA, 16 bp, Homo sapiens
tgttcattgtaatgtt

SEQ ID NO: 3220451 - DNA, 11 bp, Homo sapiens
tgttcatttag

SEQ ID NO: 3220452 - DNA, 19 bp, Homo sapiens
tgttcatttagataatttg

SEQ ID NO: 3220453 - DNA, 20 bp, Homo sapiens
tgttcatttagataatttga

SEQ ID NO: 3220454 - DNA, 19 bp, Homo sapiens
tgttcatttcacacagtga

SEQ ID NO: 3220455 - DNA, 15 bp, Homo sapiens
tgttccaaagccagt

SEQ ID NO: 3220456 - DNA, 12 bp, Homo sapiens
tgttccaaatgt

SEQ ID NO: 3220457 - DNA, 14 bp, Homo sapiens
tgttccaaatgtgt

SEQ ID NO: 3220458 - DNA, 18 bp, Homo sapiens
tgttccaaattcagtttc

SEQ ID NO: 3220459 - DNA, 14 bp, Homo sapiens
tgttccaactgccc

SEQ ID NO: 3220460 - DNA, 17 bp, Homo sapiens
tgttccaagtttccaaa

SEQ ID NO: 3220461 - DNA, 19 bp, Homo sapiens
tgttccacaagttaaataa

SEQ ID NO: 3220462 - DNA, 21 bp, Homo sapiens
tgttccactgcaaataaagcc

SEQ ID NO: 3220463 - DNA, 23 bp, Homo sapiens
tgttccagattcctatgatggat

SEQ ID NO: 3220464 - DNA, 18 bp, Homo sapiens
tgttccagctgaggcagg

SEQ ID NO: 3220465 - DNA, 18 bp, Homo sapiens
tgttccaggccctccagt

SEQ ID NO: 3220466 - DNA, 21 bp, Homo sapiens
tgttccattgaagccgactct

SEQ ID NO: 3220467 - DNA, 14 bp, Homo sapiens
tgttcccagaggca

SEQ ID NO: 3220468 - DNA, 15 bp, Homo sapiens
tgttcccaggctgcc

SEQ ID NO: 3220469 - DNA, 22 bp, Homo sapiens
tgttcccagtgacacttcagag

SEQ ID NO: 3220470 - DNA, 16 bp, Homo sapiens
tgttcccatttcagct

SEQ ID NO: 3220471 - DNA, 17 bp, Homo sapiens
tgttccccctgccgcag

SEQ ID NO: 3220472 - DNA, 15 bp, Homo sapiens
tgttcccctaagtgg

SEQ ID NO: 3220473 - DNA, 15 bp, Homo sapiens
tgttcccctcactgg

SEQ ID NO: 3220474 - DNA, 14 bp, Homo sapiens
tgttcccctgtcct

SEQ ID NO: 3220475 - DNA, 23 bp, Homo sapiens
tgttcccgattcacgtttttctg

SEQ ID NO: 3220476 - DNA, 19 bp, Homo sapiens
tgttccctctgctcctgga

SEQ ID NO: 3220477 - DNA, 12 bp, Homo sapiens
tgttccctgcac

SEQ ID NO: 3220478 - DNA, 17 bp, Homo sapiens
tgttccctgcaccctgg

SEQ ID NO: 3220479 - DNA, 14 bp, Homo sapiens
tgttcctcctgctg

SEQ ID NO: 3220480 - DNA, 16 bp, Homo sapiens
tgttcctcctgctgta

SEQ ID NO: 3220481 - DNA, 23 bp, Homo sapiens
tgttcctgcagccccagaagaaa

SEQ ID NO: 3220482 - DNA, 10 bp, Homo sapiens
tgttcctgga

SEQ ID NO: 3220483 - DNA, 11 bp, Homo sapiens
tgttcctggaa

SEQ ID NO: 3220484 - DNA, 17 bp, Homo sapiens
tgttccttgtactctta

SEQ ID NO: 3220485 - DNA, 19 bp, Homo sapiens
tgttccttgtactcttagg

SEQ ID NO: 3220486 - DNA, 15 bp, Homo sapiens
tgtgtcccctcactc

SEQ ID NO: 3220487 - DNA, 17 bp, Homo sapiens
tgtgtccctggacacag

SEQ ID NO: 3220488 - DNA, 22 bp, Homo sapiens
tgtgtccctggacacagctctt

SEQ ID NO: 3220489 - DNA, 14 bp, Homo sapiens
tgtgtcctcaggga

SEQ ID NO: 3220490 - DNA, 16 bp, Homo sapiens
tgtgtccttccctgca

SEQ ID NO: 3220491 - DNA, 17 bp, Homo sapiens
tgtgtccttccctgcat

SEQ ID NO: 3220492 - DNA, 19 bp, Homo sapiens
tgtgtctaaatttgaatgt

SEQ ID NO: 3220493 - DNA, 22 bp, Homo sapiens
tgtgtctaaatttgaatgttaa

SEQ ID NO: 3220494 - DNA, 16 bp, Homo sapiens
tgtgtctaagattcta

SEQ ID NO: 3220495 - DNA, 14 bp, Homo sapiens
tgtgtctcttttct

SEQ ID NO: 3220496 - DNA, 20 bp, Homo sapiens
tgtgtctgaaaatatctctt

SEQ ID NO: 3220497 - DNA, 13 bp, Homo sapiens
tgtgtctgactca

SEQ ID NO: 3220498 - DNA, 19 bp, Homo sapiens
tgtgtctgactcaggcgcc

SEQ ID NO: 3220499 - DNA, 20 bp, Homo sapiens
tgtgtctgcattgttattgt

SEQ ID NO: 3220500 - DNA, 16 bp, Homo sapiens
tgtgtctgctaatgta

SEQ ID NO: 3220501 - DNA, 20 bp, Homo sapiens
tgtgtctgctaatgtaaact

SEQ ID NO: 3220502 - DNA, 14 bp, Homo sapiens
tgtgtctgtacacg

SEQ ID NO: 3220503 - DNA, 14 bp, Homo sapiens
tgtgtcttaattat

SEQ ID NO: 3220504 - DNA, 16 bp, Homo sapiens
tgtgtcttaattatta

SEQ ID NO: 3220505 - DNA, 18 bp, Homo sapiens
tgtgtctttcacagctcc

SEQ ID NO: 3220506 - DNA, 22 bp, Homo sapiens
tgtgtctttcacagctcctccc

SEQ ID NO: 3220507 - DNA, 12 bp, Homo sapiens
tgtgtctttcta

SEQ ID NO: 3220508 - DNA, 14 bp, Homo sapiens
tgtgtctttctctc

SEQ ID NO: 3220509 - DNA, 22 bp, Homo sapiens
tgtgtgaaacaatgttgtccaa

SEQ ID NO: 3220510 - DNA, 17 bp, Homo sapiens
tgtgtgaaactttcatt

SEQ ID NO: 3220511 - DNA, 22 bp, Homo sapiens
tgtgtgaaaggaagctccactg

SEQ ID NO: 3220512 - DNA, 12 bp, Homo sapiens
tgtgtgaatgaa

SEQ ID NO: 3220513 - DNA, 18 bp, Homo sapiens
tgtgtgaatgaacactct

SEQ ID NO: 3220514 - DNA, 18 bp, Homo sapiens
tgtgtgaattctgcaact

SEQ ID NO: 3220515 - DNA, 19 bp, Homo sapiens
tgtgtgaatttttctaaac

SEQ ID NO: 3220516 - DNA, 17 bp, Homo sapiens
tgtgtgaccaactgtgt

SEQ ID NO: 3220517 - DNA, 19 bp, Homo sapiens
tgtgtgaccaactgtgttg

SEQ ID NO: 3220518 - DNA, 15 bp, Homo sapiens
tgtgtgagctttttt

SEQ ID NO: 3220519 - DNA, 21 bp, Homo sapiens
tgtgtgagtggagttgaggtg

SEQ ID NO: 3220520 - DNA, 20 bp, Homo sapiens
tgtgtgatttcctaaacata

SEQ ID NO: 3220521 - DNA, 21 bp, Homo sapiens
tgtgtgatttcctaaacataa

SEQ ID NO: 3220522 - DNA, 22 bp, Homo sapiens
tgtgtgatttcctaaacataat

SEQ ID NO: 3220523 - DNA, 17 bp, Homo sapiens
tgtgtgcaccttaccaa

SEQ ID NO: 3220524 - DNA, 21 bp, Homo sapiens
tgtgtgccatagagtttaaca

SEQ ID NO: 3220525 - DNA, 23 bp, Homo sapiens
tgtgtgccatagagtttaacaca

SEQ ID NO: 3220526 - DNA, 24 bp, Homo sapiens
tgtgtgccatagagtttaacacaa

SEQ ID NO: 3220527 - DNA, 17 bp, Homo sapiens
tgtgtgcctgtggcaga

SEQ ID NO: 3220528 - DNA, 14 bp, Homo sapiens
tgtgtgctttccca

SEQ ID NO: 3220529 - DNA, 20 bp, Homo sapiens
tgtgtggcaaattaaacaat

SEQ ID NO: 3220530 - DNA, 21 bp, Homo sapiens
tgtgtggcaaattaaacaata

SEQ ID NO: 3220531 - DNA, 15 bp, Homo sapiens
tgtgtggcagggggc

SEQ ID NO: 3220532 - DNA, 19 bp, Homo sapiens
tgtgtggcagggggccccg

SEQ ID NO: 3220533 - DNA, 16 bp, Homo sapiens
tgtgtgggactgtaca

SEQ ID NO: 3220534 - DNA, 20 bp, Homo sapiens
tgtgtgggtaaatgctttta

SEQ ID NO: 3220535 - DNA, 16 bp, Homo sapiens
tgtgtggtggcctcag

SEQ ID NO: 3220536 - DNA, 17 bp, Homo sapiens
tgtgtggttcagctact

SEQ ID NO: 3220537 - DNA, 15 bp, Homo sapiens
tgtgtgtatatatgt

SEQ ID NO: 3220538 - DNA, 14 bp, Homo sapiens
tgtgtgtatgctga

SEQ ID NO: 3220539 - DNA, 19 bp, Homo sapiens
tgtgtgtccaaaactgcct

SEQ ID NO: 3220540 - DNA, 14 bp, Homo sapiens
tgtgtgtctgtcct

SEQ ID NO: 3220541 - DNA, 13 bp, Homo sapiens
tgtgtgtgtgaat

SEQ ID NO: 3220542 - DNA, 12 bp, Homo sapiens
tgtgtgtgtgtg

SEQ ID NO: 3220543 - DNA, 14 bp, Homo sapiens
tgtgtgtgtgtttg

SEQ ID NO: 3220544 - DNA, 12 bp, Homo sapiens
tgtgtgtgttct

SEQ ID NO: 3220545 - DNA, 19 bp, Homo sapiens
tgtgtgttccaagtttcca

SEQ ID NO: 3220546 - DNA, 23 bp, Homo sapiens
tgtgtgttctgtaatggaactga

SEQ ID NO: 3220547 - DNA, 18 bp, Homo sapiens
tgtgtgttgtcagcctgt

SEQ ID NO: 3220548 - DNA, 16 bp, Homo sapiens
tgtgttaaacatgcta

SEQ ID NO: 3220549 - DNA, 20 bp, Homo sapiens
tgtgttaaacatgctaaata

SEQ ID NO: 3220550 - DNA, 19 bp, Homo sapiens
tgtgttaagtatgtgtaaa

SEQ ID NO: 3220551 - DNA, 14 bp, Homo sapiens
tgtgttcatgctga

SEQ ID NO: 3220552 - DNA, 16 bp, Homo sapiens
tgtgttcattcaagct

SEQ ID NO: 3220553 - DNA, 22 bp, Homo sapiens
tgtgttcatttggtgttcctgg

SEQ ID NO: 3220554 - DNA, 15 bp, Homo sapiens
tgtgttcccagaggc

SEQ ID NO: 3220555 - DNA, 16 bp, Homo sapiens
tgtgttcccatttcag

SEQ ID NO: 3220556 - DNA, 19 bp, Homo sapiens
tgtgttcccatttcagctg

SEQ ID NO: 3220557 - DNA, 16 bp, Homo sapiens
tgtgttcctcctgctg

SEQ ID NO: 3220558 - DNA, 15 bp, Homo sapiens
tgtgttcctggcaat

SEQ ID NO: 3220559 - DNA, 24 bp, Homo sapiens
tgtgttcctggcaatagtgtgttc

SEQ ID NO: 3220560 - DNA, 22 bp, Homo sapiens
tgtgttcctggcccactctgta

SEQ ID NO: 3220561 - DNA, 23 bp, Homo sapiens
tgtgttctaatccaagggccagt

SEQ ID NO: 3220562 - DNA, 15 bp, Homo sapiens
tgtgttgactttata

SEQ ID NO: 3220563 - DNA, 18 bp, Homo sapiens
tgtgttgccatgtgtgct

SEQ ID NO: 3220564 - DNA, 15 bp, Homo sapiens
tgtgttgctatcctg

SEQ ID NO: 3220565 - DNA, 15 bp, Homo sapiens
tgtgttgtcagcctg

SEQ ID NO: 3220566 - DNA, 18 bp, Homo sapiens
tgtgttgtcttgaaagat

SEQ ID NO: 3220567 - DNA, 13 bp, Homo sapiens
tgtgttgtgaatg

SEQ ID NO: 3220568 - DNA, 20 bp, Homo sapiens
tgtgttgttttttgttcaat

SEQ ID NO: 3220569 - DNA, 12 bp, Homo sapiens
tgtgtttatatg

SEQ ID NO: 3220570 - DNA, 16 bp, Homo sapiens
tgtgtttgcagcctgc

SEQ ID NO: 3220571 - DNA, 18 bp, Homo sapiens
tgtgtttggcttggcctt

SEQ ID NO: 3220572 - DNA, 16 bp, Homo sapiens
tgtgttttggttaata

SEQ ID NO: 3220573 - DNA, 15 bp, Homo sapiens
tgtgtttttaacatg

SEQ ID NO: 3220574 - DNA, 14 bp, Homo sapiens
tgtgtttttattgt

SEQ ID NO: 3220575 - DNA, 16 bp, Homo sapiens
tgtgtttttctccagt

SEQ ID NO: 3220576 - DNA, 18 bp, Homo sapiens
tgtgtttttctccagtgc

SEQ ID NO: 3220577 - DNA, 14 bp, Homo sapiens
tgtgtttttctttt

SEQ ID NO: 3220578 - DNA, 18 bp, Homo sapiens
tgtgtttttctttttcca

SEQ ID NO: 3220579 - DNA, 18 bp, Homo sapiens
tgtgtttttgggatgtct

SEQ ID NO: 3220580 - DNA, 14 bp, Homo sapiens
tgtgttttttaaga

SEQ ID NO: 3220581 - DNA, 23 bp, Homo sapiens
tgttaaaaaaaaaatccatttta

SEQ ID NO: 3220582 - DNA, 19 bp, Homo sapiens
tgttaaaaaatttttgaaa

SEQ ID NO: 3220583 - DNA, 21 bp, Homo sapiens
tgttaaaaatattttctgaat

SEQ ID NO: 3220584 - DNA, 14 bp, Homo sapiens
tgttaaaaatgtca

SEQ ID NO: 3220585 - DNA, 12 bp, Homo sapiens
tgttaaaatcta

SEQ ID NO: 3220586 - DNA, 21 bp, Homo sapiens
tgttaaaattatcaatatcta

SEQ ID NO: 3220587 - DNA, 17 bp, Homo sapiens
tgttaaaattatgaatc

SEQ ID NO: 3220588 - DNA, 20 bp, Homo sapiens
tgttaaaattatgaatctga

SEQ ID NO: 3220589 - DNA, 20 bp, Homo sapiens
tgttaaacagtagttgtatt

SEQ ID NO: 3220590 - DNA, 12 bp, Homo sapiens
tgttaaactgtt

SEQ ID NO: 3220591 - DNA, 19 bp, Homo sapiens
tgttaaactgttagcactg

SEQ ID NO: 3220592 - DNA, 22 bp, Homo sapiens
tgttaaactgttagcactgttg

SEQ ID NO: 3220593 - DNA, 12 bp, Homo sapiens
tgttaaagagaa

SEQ ID NO: 3220594 - DNA, 21 bp, Homo sapiens
tgttaaagctggaacatttga

SEQ ID NO: 3220595 - DNA, 13 bp, Homo sapiens
tgttaaagtttaa

SEQ ID NO: 3220596 - DNA, 14 bp, Homo sapiens
tgttaaatactgtg

SEQ ID NO: 3220597 - DNA, 16 bp, Homo sapiens
tgttaaatactgtgca

SEQ ID NO: 3220598 - DNA, 18 bp, Homo sapiens
tgttaaatactgtgcaga

SEQ ID NO: 3220599 - DNA, 16 bp, Homo sapiens
tgttaaatttgtaagt

SEQ ID NO: 3220600 - DNA, 17 bp, Homo sapiens
tgttaaatttgtaagtt

SEQ ID NO: 3220601 - DNA, 18 bp, Homo sapiens
tgttaaatttgtaagttt

SEQ ID NO: 3220602 - DNA, 16 bp, Homo sapiens
tgttaacattccaaga

SEQ ID NO: 3220603 - DNA, 15 bp, Homo sapiens
tgttaacctcagtgt

SEQ ID NO: 3220604 - DNA, 19 bp, Homo sapiens
tgttaactacatattgtct

SEQ ID NO: 3220605 - DNA, 17 bp, Homo sapiens
tgttaactatgacagat

SEQ ID NO: 3220606 - DNA, 22 bp, Homo sapiens
tgttaactatgacagatatatt

SEQ ID NO: 3220607 - DNA, 17 bp, Homo sapiens
tgttaactcttgtctat

SEQ ID NO: 3220608 - DNA, 19 bp, Homo sapiens
tgttaactgttaactatga

SEQ ID NO: 3220609 - DNA, 19 bp, Homo sapiens
tgttaactttattacaatt

SEQ ID NO: 3220610 - DNA, 23 bp, Homo sapiens
tgttaagataacttactgtatat

SEQ ID NO: 3220611 - DNA, 23 bp, Homo sapiens
tgttaagcagatggaatgctgtg

SEQ ID NO: 3220612 - DNA, 15 bp, Homo sapiens
tgttaaggaaactct

SEQ ID NO: 3220613 - DNA, 16 bp, Homo sapiens
tgttaaggaaactctt

SEQ ID NO: 3220614 - DNA, 22 bp, Homo sapiens
tgttaaggaaactcttatctca

SEQ ID NO: 3220615 - DNA, 12 bp, Homo sapiens
tgtcctactctg

SEQ ID NO: 3220616 - DNA, 17 bp, Homo sapiens
tgtcctactctgtgtca

SEQ ID NO: 3220617 - DNA, 19 bp, Homo sapiens
tgtcctatctatcttccaa

SEQ ID NO: 3220618 - DNA, 19 bp, Homo sapiens
tgtcctcactgctccctga

SEQ ID NO: 3220619 - DNA, 13 bp, Homo sapiens
tgtcctcatcctt

SEQ ID NO: 3220620 - DNA, 18 bp, Homo sapiens
tgtcctcccatcccctgg

SEQ ID NO: 3220621 - DNA, 19 bp, Homo sapiens
tgtcctcccatcccctgga

SEQ ID NO: 3220622 - DNA, 17 bp, Homo sapiens
tgtacagtgtctgtgcc

SEQ ID NO: 3220623 - DNA, 16 bp, Homo sapiens
tgtacagtttgctgta

SEQ ID NO: 3220624 - DNA, 13 bp, Homo sapiens
tgtacataaaatt

SEQ ID NO: 3220625 - DNA, 18 bp, Homo sapiens
tgtacataaaattttcta

SEQ ID NO: 3220626 - DNA, 19 bp, Homo sapiens
tgtacataaactgtcactc

SEQ ID NO: 3220627 - DNA, 23 bp, Homo sapiens
tgtacataaattgcataaagcat

SEQ ID NO: 3220628 - DNA, 23 bp, Homo sapiens
tgtacataactctgtaaaaacac

SEQ ID NO: 3220629 - DNA, 14 bp, Homo sapiens
tgtacatagattta

SEQ ID NO: 3220630 - DNA, 16 bp, Homo sapiens
tgtacatagcctatat

SEQ ID NO: 3220631 - DNA, 16 bp, Homo sapiens
tgtacatagtgtaatg

SEQ ID NO: 3220632 - DNA, 20 bp, Homo sapiens
tgtacatatgtgctggaatt

SEQ ID NO: 3220633 - DNA, 20 bp, Homo sapiens
tgtacatatttgagactagt

SEQ ID NO: 3220634 - DNA, 18 bp, Homo sapiens
tgtacatctattttggat

SEQ ID NO: 3220635 - DNA, 23 bp, Homo sapiens
tgtacatctattttggattgtat

SEQ ID NO: 3220636 - DNA, 17 bp, Homo sapiens
tgtacatctggcttatt

SEQ ID NO: 3220637 - DNA, 22 bp, Homo sapiens
tgtacatgaagaagctaaatcc

SEQ ID NO: 3220638 - DNA, 21 bp, Homo sapiens
tgtacattctgcctagagtgt

SEQ ID NO: 3220639 - DNA, 14 bp, Homo sapiens
tgtacatttattca

SEQ ID NO: 3220640 - DNA, 20 bp, Homo sapiens
tgtacattttaaaggataat

SEQ ID NO: 3220641 - DNA, 16 bp, Homo sapiens
tgtacattttgttgta

SEQ ID NO: 3220642 - DNA, 17 bp, Homo sapiens
tgtacattttgttgtaa

SEQ ID NO: 3220643 - DNA, 19 bp, Homo sapiens
tgtacattttgttgtaaaa

SEQ ID NO: 3220644 - DNA, 17 bp, Homo sapiens
tgtaccaaaattttaaa

SEQ ID NO: 3220645 - DNA, 12 bp, Homo sapiens
tgtaccagttaa

SEQ ID NO: 3220646 - DNA, 21 bp, Homo sapiens
tgtaccatgaaacaaagctgc

SEQ ID NO: 3220647 - DNA, 23 bp, Homo sapiens
tgtaccatgtacctaatccaaat

SEQ ID NO: 3220648 - DNA, 23 bp, Homo sapiens
tgtaccctttaagatatccatct

SEQ ID NO: 3220649 - DNA, 16 bp, Homo sapiens
tgtacctcaaatgaat

SEQ ID NO: 3220650 - DNA, 21 bp, Homo sapiens
tgtacctcaaatgaattcttt

SEQ ID NO: 3220651 - DNA, 15 bp, Homo sapiens
tgtacctcagtggat

SEQ ID NO: 3220652 - DNA, 19 bp, Homo sapiens
tgtacctcctctcagtgtt

SEQ ID NO: 3220653 - DNA, 16 bp, Homo sapiens
tgtacctgtgtacata

SEQ ID NO: 3220654 - DNA, 21 bp, Homo sapiens
tgtaccttccttaagccagga

SEQ ID NO: 3220655 - DNA, 15 bp, Homo sapiens
tgtaccttgaccatc

SEQ ID NO: 3220656 - DNA, 22 bp, Homo sapiens
tgtaccttttgaggagccccag

SEQ ID NO: 3220657 - DNA, 18 bp, Homo sapiens
tgtacgcgtttgtctcgt

SEQ ID NO: 3220658 - DNA, 18 bp, Homo sapiens
tgtacggattttcagtta

SEQ ID NO: 3220659 - DNA, 15 bp, Homo sapiens
tgtacgtctgacagg

SEQ ID NO: 3220660 - DNA, 16 bp, Homo sapiens
tgtacgtctgacaggc

SEQ ID NO: 3220661 - DNA, 17 bp, Homo sapiens
tgtactacctgtgtata

SEQ ID NO: 3220662 - DNA, 21 bp, Homo sapiens
tgtactacgtgccagctctag

SEQ ID NO: 3220663 - DNA, 14 bp, Homo sapiens
tgtactcagagcag

SEQ ID NO: 3220664 - DNA, 19 bp, Homo sapiens
tgtactcagagcagagcaa

SEQ ID NO: 3220665 - DNA, 14 bp, Homo sapiens
tgtactctgtgtgt

SEQ ID NO: 3220666 - DNA, 16 bp, Homo sapiens
tgtactcttgctgatg

SEQ ID NO: 3220667 - DNA, 20 bp, Homo sapiens
tgtactgaaaaatggtaatt

SEQ ID NO: 3220668 - DNA, 19 bp, Homo sapiens
tgtactgagccttgtaatt

SEQ ID NO: 3220669 - DNA, 12 bp, Homo sapiens
tgtactgataaa

SEQ ID NO: 3220670 - DNA, 16 bp, Homo sapiens
tgtactgtagtttttc

SEQ ID NO: 3220671 - DNA, 24 bp, Homo sapiens
tgtactgtatggaaacactgattt

SEQ ID NO: 3220672 - DNA, 15 bp, Homo sapiens
tgtactgttctgtgt

SEQ ID NO: 3220673 - DNA, 20 bp, Homo sapiens
tgtacttagccagttcaaag

SEQ ID NO: 3220674 - DNA, 18 bp, Homo sapiens
tgtacttagctgtactat

SEQ ID NO: 3220675 - DNA, 17 bp, Homo sapiens
tgtacttcaaccagcct

SEQ ID NO: 3220676 - DNA, 14 bp, Homo sapiens
tgtacttcaagtta

SEQ ID NO: 3220677 - DNA, 11 bp, Homo sapiens
tgtacttcctg

SEQ ID NO: 3220678 - DNA, 16 bp, Homo sapiens
tgtacttcttattgca

SEQ ID NO: 3220679 - DNA, 16 bp, Homo sapiens
tgtacttcttgaatat

SEQ ID NO: 3220680 - DNA, 14 bp, Homo sapiens
tgtacttgatactg

SEQ ID NO: 3220681 - DNA, 17 bp, Homo sapiens
tgtacttgatactgaat

SEQ ID NO: 3220682 - DNA, 21 bp, Homo sapiens
tgtacttgatactgaatgcat

SEQ ID NO: 3220683 - DNA, 13 bp, Homo sapiens
tgtactttgccat

SEQ ID NO: 3220684 - DNA, 15 bp, Homo sapiens
tgtactttgccattt

SEQ ID NO: 3220685 - DNA, 12 bp, Homo sapiens
tgtacttttcat

SEQ ID NO: 3220686 - DNA, 22 bp, Homo sapiens
tgtagaaaaatactgattttaa

SEQ ID NO: 3220687 - DNA, 21 bp, Homo sapiens
tgtagaaacacagttttgaaa

SEQ ID NO: 3220688 - DNA, 23 bp, Homo sapiens
tgtagaaacacagttttgaaaga

SEQ ID NO: 3220689 - DNA, 15 bp, Homo sapiens
tgtagaaacatttag

SEQ ID NO: 3220690 - DNA, 21 bp, Homo sapiens
tgtagaaatgatgatgtggaa

SEQ ID NO: 3220691 - DNA, 14 bp, Homo sapiens
tgtagaacactaat

SEQ ID NO: 3220692 - DNA, 19 bp, Homo sapiens
tgtagaactcactctgggc

SEQ ID NO: 3220693 - DNA, 15 bp, Homo sapiens
tgtagaagcattcct

SEQ ID NO: 3220694 - DNA, 18 bp, Homo sapiens
tgtagaatgatttcatgc

SEQ ID NO: 3220695 - DNA, 15 bp, Homo sapiens
tgtagaattgtatat

SEQ ID NO: 3220696 - DNA, 12 bp, Homo sapiens
tgtagactatat

SEQ ID NO: 3220697 - DNA, 17 bp, Homo sapiens
tgtagactatatacatg

SEQ ID NO: 3220698 - DNA, 20 bp, Homo sapiens
tgtagactatatacatgtgt

SEQ ID NO: 3220699 - DNA, 22 bp, Homo sapiens
tgtagactatatacatgtgtgt

SEQ ID NO: 3220700 - DNA, 14 bp, Homo sapiens
tgtagactgatgtt

SEQ ID NO: 3220701 - DNA, 14 bp, Homo sapiens
tgtagactgtggct

SEQ ID NO: 3220702 - DNA, 12 bp, Homo sapiens
tgtagagccagg

SEQ ID NO: 3220703 - DNA, 15 bp, Homo sapiens
tgtagagccagggtc

SEQ ID NO: 3220704 - DNA, 15 bp, Homo sapiens
tgtagagttaagaag

SEQ ID NO: 3220705 - DNA, 17 bp, Homo sapiens
tgtagagttaagaagct

SEQ ID NO: 3220706 - DNA, 19 bp, Homo sapiens
tgtagagttaagaagctgt

SEQ ID NO: 3220707 - DNA, 14 bp, Homo sapiens
tgtagagttgctga

SEQ ID NO: 3220708 - DNA, 18 bp, Homo sapiens
tgtagatatgtattcttt

SEQ ID NO: 3220709 - DNA, 14 bp, Homo sapiens
tgtagatatttggc

SEQ ID NO: 3220710 - DNA, 15 bp, Homo sapiens
tgtagatatttggct

SEQ ID NO: 3220711 - DNA, 22 bp, Homo sapiens
tgtagatatttggcttaaatat

SEQ ID NO: 3220712 - DNA, 13 bp, Homo sapiens
tgtagatcccaag

SEQ ID NO: 3220713 - DNA, 17 bp, Homo sapiens
tgtagatgttctaggat

SEQ ID NO: 3220714 - DNA, 20 bp, Homo sapiens
tgtagcaaaacgcatggagt

SEQ ID NO: 3220715 - DNA, 11 bp, Homo sapiens
tgtagcagtga

SEQ ID NO: 3220716 - DNA, 15 bp, Homo sapiens
tgtagcatataggtg

SEQ ID NO: 3220717 - DNA, 22 bp, Homo sapiens
tgtagcatgtgaagaatgtctg

SEQ ID NO: 3220718 - DNA, 20 bp, Homo sapiens
tgtagccaggtatggctctg

SEQ ID NO: 3220719 - DNA, 21 bp, Homo sapiens
tgtagccaggtatggctctgc

SEQ ID NO: 3220720 - DNA, 16 bp, Homo sapiens
tgtagccatggctcag

SEQ ID NO: 3220721 - DNA, 16 bp, Homo sapiens
tgtagcccacacttga

SEQ ID NO: 3220722 - DNA, 16 bp, Homo sapiens
tgtagcctaaagggca

SEQ ID NO: 3220723 - DNA, 21 bp, Homo sapiens
tgtagcctaaagggcagggcc

SEQ ID NO: 3220724 - DNA, 14 bp, Homo sapiens
tgtagcctcctttg

SEQ ID NO: 3220725 - DNA, 23 bp, Homo sapiens
tgtggaaatgggacggaggtcct

SEQ ID NO: 3220726 - DNA, 20 bp, Homo sapiens
tgtggaagaaaatggtttat

SEQ ID NO: 3220727 - DNA, 16 bp, Homo sapiens
tgtggaatgagtgtgc

SEQ ID NO: 3220728 - DNA, 18 bp, Homo sapiens
tgtggaatgagtgtgcat

SEQ ID NO: 3220729 - DNA, 15 bp, Homo sapiens
tgtggaccaattatt

SEQ ID NO: 3220730 - DNA, 17 bp, Homo sapiens
tgtggaccactgcatga

SEQ ID NO: 3220731 - DNA, 12 bp, Homo sapiens
tgtggactctgg

SEQ ID NO: 3220732 - DNA, 22 bp, Homo sapiens
tgtggactctggtgcctccaga

SEQ ID NO: 3220733 - DNA, 23 bp, Homo sapiens
tgtggactctggtgcctccagag

SEQ ID NO: 3220734 - DNA, 20 bp, Homo sapiens
tgtggagccgaggcctaccc

SEQ ID NO: 3220735 - DNA, 17 bp, Homo sapiens
tgtggaggaaggattgt

SEQ ID NO: 3220736 - DNA, 20 bp, Homo sapiens
tgtggaggaaggattgtaaa

SEQ ID NO: 3220737 - DNA, 13 bp, Homo sapiens
tgtggaggcctga

SEQ ID NO: 3220738 - DNA, 12 bp, Homo sapiens
tgtggaggggcc

SEQ ID NO: 3220739 - DNA, 20 bp, Homo sapiens
tgtggatcaaccatcgcttt

SEQ ID NO: 3220740 - DNA, 21 bp, Homo sapiens
tgtggatcttgccacatttct

SEQ ID NO: 3220741 - DNA, 16 bp, Homo sapiens
tgtggatcttttcatt

SEQ ID NO: 3220742 - DNA, 21 bp, Homo sapiens
tgtggatgcctgtggaagagt

SEQ ID NO: 3220743 - DNA, 13 bp, Homo sapiens
tgtggatgtgttc

SEQ ID NO: 3220744 - DNA, 19 bp, Homo sapiens
tgtggattataaaaaatgt

SEQ ID NO: 3220745 - DNA, 14 bp, Homo sapiens
tgtggattctttaa

SEQ ID NO: 3220746 - DNA, 20 bp, Homo sapiens
tgtggcaaagtgctgtaccc

SEQ ID NO: 3220747 - DNA, 17 bp, Homo sapiens
tgtggcaatctgtgggc

SEQ ID NO: 3220748 - DNA, 22 bp, Homo sapiens
tgtggcacagacttctggaagg

SEQ ID NO: 3220749 - DNA, 12 bp, Homo sapiens
tgtggcagtggt

SEQ ID NO: 3220750 - DNA, 22 bp, Homo sapiens
tgtggcatagacatggatgcga

SEQ ID NO: 3220751 - DNA, 21 bp, Homo sapiens
tgtggcatctttgccttgggc

SEQ ID NO: 3220752 - DNA, 15 bp, Homo sapiens
tgtggcattgaaatg

SEQ ID NO: 3220753 - DNA, 13 bp, Homo sapiens
tgtggccagagct

SEQ ID NO: 3220754 - DNA, 23 bp, Homo sapiens
tgtggccccaccctgggccctgg

SEQ ID NO: 3220755 - DNA, 19 bp, Homo sapiens
tgtggccccttttactttt

SEQ ID NO: 3220756 - DNA, 23 bp, Homo sapiens
tgtggccccttttacttttttat

SEQ ID NO: 3220757 - DNA, 18 bp, Homo sapiens
tgtggccgttatctggaa

SEQ ID NO: 3220758 - DNA, 10 bp, Homo sapiens
tgtggcctca

SEQ ID NO: 3220759 - DNA, 13 bp, Homo sapiens
tgtggcctcagaa

SEQ ID NO: 3220760 - DNA, 15 bp, Homo sapiens
tgtggcctcagccct

SEQ ID NO: 3220761 - DNA, 16 bp, Homo sapiens
tgtggcctcagccctc

SEQ ID NO: 3220762 - DNA, 16 bp, Homo sapiens
tgtggcctgtggcctg

SEQ ID NO: 3220763 - DNA, 23 bp, Homo sapiens
tgtggcctgtgtccagcagctgc

SEQ ID NO: 3220764 - DNA, 16 bp, Homo sapiens
tgtggcgggcagtggg

SEQ ID NO: 3220765 - DNA, 23 bp, Homo sapiens
tgtggctccaagctcaggtgcct

SEQ ID NO: 3220766 - DNA, 17 bp, Homo sapiens
tgtggctcctatctgtg

SEQ ID NO: 3220767 - DNA, 19 bp, Homo sapiens
tgtggctcctatctgtgtt

SEQ ID NO: 3220768 - DNA, 19 bp, Homo sapiens
tgtggctgaaaatgcaaag

SEQ ID NO: 3220769 - DNA, 15 bp, Homo sapiens
tgtggctgggggcag

SEQ ID NO: 3220770 - DNA, 18 bp, Homo sapiens
tgtggctgggggcaggag

SEQ ID NO: 3220771 - DNA, 17 bp, Homo sapiens
tgtggctttctttcttt

SEQ ID NO: 3220772 - DNA, 21 bp, Homo sapiens
tgtgggaaaaaaatgaatgag

SEQ ID NO: 3220773 - DNA, 15 bp, Homo sapiens
tgtgggactgtacac

SEQ ID NO: 3220774 - DNA, 16 bp, Homo sapiens
tgtgggactgtacaca

SEQ ID NO: 3220775 - DNA, 22 bp, Homo sapiens
tgtgggatacttagtggtatgt

SEQ ID NO: 3220776 - DNA, 19 bp, Homo sapiens
tgtgggatgttcagcactg

SEQ ID NO: 3220777 - DNA, 16 bp, Homo sapiens
tgtgggcactggccca

SEQ ID NO: 3220778 - DNA, 19 bp, Homo sapiens
tgtgggcaggcaagccctt

SEQ ID NO: 3220779 - DNA, 13 bp, Homo sapiens
tgtgggctgtgag

SEQ ID NO: 3220780 - DNA, 12 bp, Homo sapiens
tgtggggtgggg

SEQ ID NO: 3220781 - DNA, 16 bp, Homo sapiens
tgtgggtaaatgcttt

SEQ ID NO: 3220782 - DNA, 16 bp, Homo sapiens
tgtgggtagtcattct

SEQ ID NO: 3220783 - DNA, 21 bp, Homo sapiens
tgtgggtgaatgtgtgttcat

SEQ ID NO: 3220784 - DNA, 14 bp, Homo sapiens
tgtgggtggaaggg

SEQ ID NO: 3220785 - DNA, 13 bp, Homo sapiens
tgtgggtgggaga

SEQ ID NO: 3220786 - DNA, 22 bp, Homo sapiens
tgtggtaggccttttaacattt

SEQ ID NO: 3220787 - DNA, 23 bp, Homo sapiens
tgtggtaggccttttaacatttt

SEQ ID NO: 3220788 - DNA, 13 bp, Homo sapiens
tgtggtctcagga

SEQ ID NO: 3220789 - DNA, 14 bp, Homo sapiens
tgtggtctcaggat

SEQ ID NO: 3220790 - DNA, 14 bp, Homo sapiens
tgtggtggcctcag

SEQ ID NO: 3220791 - DNA, 19 bp, Homo sapiens
tgtggtgtcgtctgtgaat

SEQ ID NO: 3220792 - DNA, 21 bp, Homo sapiens
tgtggttacagtgcagacagg

SEQ ID NO: 3220793 - DNA, 13 bp, Homo sapiens
tgtggttctattt

SEQ ID NO: 3220794 - DNA, 14 bp, Homo sapiens
tgtggttctatttt

SEQ ID NO: 3220795 - DNA, 19 bp, Homo sapiens
tgtggttgaggggcctgga

SEQ ID NO: 3220796 - DNA, 22 bp, Homo sapiens
tgtggtttcagttctgtgtaca

SEQ ID NO: 3220797 - DNA, 13 bp, Homo sapiens
tgtggtttggaat

SEQ ID NO: 3220798 - DNA, 18 bp, Homo sapiens
tgtggtttggaatattaa

SEQ ID NO: 3220799 - DNA, 16 bp, Homo sapiens
tgtgtaaaaaatggaa

SEQ ID NO: 3220800 - DNA, 20 bp, Homo sapiens
tgtgtaaatatgtacatttg

SEQ ID NO: 3220801 - DNA, 22 bp, Homo sapiens
tgtgtaaatatgtacatttgtc

SEQ ID NO: 3220802 - DNA, 20 bp, Homo sapiens
tgtgtaacactgtgtacacc

SEQ ID NO: 3220803 - DNA, 13 bp, Homo sapiens
tgtgtaacatatt

SEQ ID NO: 3220804 - DNA, 18 bp, Homo sapiens
tgtgtaataaagtgtttt

SEQ ID NO: 3220805 - DNA, 20 bp, Homo sapiens
tgtgtaataaagtgttttca

SEQ ID NO: 3220806 - DNA, 21 bp, Homo sapiens
tgtgtaataaagtgttttcag

SEQ ID NO: 3220807 - DNA, 23 bp, Homo sapiens
tgtgtaataaagtgttttcagag

SEQ ID NO: 3220808 - DNA, 14 bp, Homo sapiens
tgtgtacagtgaat

SEQ ID NO: 3220809 - DNA, 20 bp, Homo sapiens
tgtgtacagtgaattgtctt

SEQ ID NO: 3220810 - DNA, 21 bp, Homo sapiens
tgtgtacagtgaattgtcttt

SEQ ID NO: 3220811 - DNA, 22 bp, Homo sapiens
tgtgtacagtgaattgtctttt

SEQ ID NO: 3220812 - DNA, 15 bp, Homo sapiens
tgtgtacataactga

SEQ ID NO: 3220813 - DNA, 13 bp, Homo sapiens
tgtgtacatttta

SEQ ID NO: 3220814 - DNA, 12 bp, Homo sapiens
tgtgtactctgt

SEQ ID NO: 3220815 - DNA, 10 bp, Homo sapiens
tgtgtactgt

SEQ ID NO: 3220816 - DNA, 17 bp, Homo sapiens
tgtgtagaaaaaaaaac

SEQ ID NO: 3220817 - DNA, 16 bp, Homo sapiens
tgtgtagagttaagaa

SEQ ID NO: 3220818 - DNA, 23 bp, Homo sapiens
tgtgtagcaattgacagagaata

SEQ ID NO: 3220819 - DNA, 14 bp, Homo sapiens
tgtgtagcctatgt

SEQ ID NO: 3220820 - DNA, 14 bp, Homo sapiens
tgtgtagcctgtgc

SEQ ID NO: 3220821 - DNA, 12 bp, Homo sapiens
tgtgtagccttt

SEQ ID NO: 3220822 - DNA, 21 bp, Homo sapiens
tgtgtatagatgcaagatatt

SEQ ID NO: 3220823 - DNA, 16 bp, Homo sapiens
tgtgtatatatacata

SEQ ID NO: 3220824 - DNA, 18 bp, Homo sapiens
tgtgtatatatgtgtata

SEQ ID NO: 3220825 - DNA, 16 bp, Homo sapiens
tgtgtatatctcttgg

SEQ ID NO: 3220826 - DNA, 15 bp, Homo sapiens
tgtgtatattatttg

SEQ ID NO: 3220827 - DNA, 17 bp, Homo sapiens
tgtgtatattatttggc

SEQ ID NO: 3220828 - DNA, 14 bp, Homo sapiens
tgtgtatatttgta

SEQ ID NO: 3220829 - DNA, 16 bp, Homo sapiens
tgtgtatatttgtaga

SEQ ID NO: 3220830 - DNA, 21 bp, Homo sapiens
tgtgtatcagtttccatgaaa

SEQ ID NO: 3220831 - DNA, 17 bp, Homo sapiens
tgtgtatccgactctaa

SEQ ID NO: 3220832 - DNA, 22 bp, Homo sapiens
tgtgtatccgactctaagctgt

SEQ ID NO: 3220833 - DNA, 17 bp, Homo sapiens
tgtgtatctctttcaca

SEQ ID NO: 3220834 - DNA, 19 bp, Homo sapiens
tgtgtatgctgatgatcaa

SEQ ID NO: 3220835 - DNA, 23 bp, Homo sapiens
tgtgtatgtacttagctgtacta

SEQ ID NO: 3220836 - DNA, 12 bp, Homo sapiens
tgtgtatgtgta

SEQ ID NO: 3220837 - DNA, 14 bp, Homo sapiens
tgtgtattccaaga

SEQ ID NO: 3220838 - DNA, 14 bp, Homo sapiens
tgtgtattgaagaa

SEQ ID NO: 3220839 - DNA, 20 bp, Homo sapiens
tgtgtatttaattgtaaact

SEQ ID NO: 3220840 - DNA, 15 bp, Homo sapiens
tgtgtatttacgctt

SEQ ID NO: 3220841 - DNA, 14 bp, Homo sapiens
tgtgtatttgtatt

SEQ ID NO: 3220842 - DNA, 14 bp, Homo sapiens
tgtgtcaaaataaa

SEQ ID NO: 3220843 - DNA, 18 bp, Homo sapiens
tgtgtcaatgtaaagcca

SEQ ID NO: 3220844 - DNA, 18 bp, Homo sapiens
tgtgtcacccagactgga

SEQ ID NO: 3220845 - DNA, 16 bp, Homo sapiens
tgtgtcacttgtgctt

SEQ ID NO: 3220846 - DNA, 12 bp, Homo sapiens
tgtgtcagagtg

SEQ ID NO: 3220847 - DNA, 13 bp, Homo sapiens
tgtgtcagagtgt

SEQ ID NO: 3220848 - DNA, 19 bp, Homo sapiens
tgtgtcaggtggggcagct

SEQ ID NO: 3220849 - DNA, 20 bp, Homo sapiens
tgtgtcaggtggggcagctt

SEQ ID NO: 3220850 - DNA, 19 bp, Homo sapiens
tgtgtccacctgtgggtgt

SEQ ID NO: 3220851 - DNA, 19 bp, Homo sapiens
tgtgtcccatgatccctgt

SEQ ID NO: 3220852 - DNA, 20 bp, Homo sapiens
tgtgtcccatgatccctgtg

SEQ ID NO: 3220853 - DNA, 14 bp, Homo sapiens
tgtgtcccctcact

SEQ ID NO: 3220854 - DNA, 15 bp, Homo sapiens
tggcctggccctgcc

SEQ ID NO: 3220855 - DNA, 16 bp, Homo sapiens
tggcctggccctgccc

SEQ ID NO: 3220856 - DNA, 16 bp, Homo sapiens
tggcctggccggcaac

SEQ ID NO: 3220857 - DNA, 14 bp, Homo sapiens
tggcctggcctggc

SEQ ID NO: 3220858 - DNA, 16 bp, Homo sapiens
tggcctggcctggccc

SEQ ID NO: 3220859 - DNA, 19 bp, Homo sapiens
tggcctggcctggccctgc

SEQ ID NO: 3220860 - DNA, 20 bp, Homo sapiens
tggcctgtctcatccccagg

SEQ ID NO: 3220861 - DNA, 14 bp, Homo sapiens
tggcctgtgtccag

SEQ ID NO: 3220862 - DNA, 15 bp, Homo sapiens
tggcctgtgtccagc

SEQ ID NO: 3220863 - DNA, 20 bp, Homo sapiens
tggcctgtttgatgtatgtg

SEQ ID NO: 3220864 - DNA, 23 bp, Homo sapiens
tggccttaaaaggggcccaagcc

SEQ ID NO: 3220865 - DNA, 21 bp, Homo sapiens
tggccttccccttttgcctgg

SEQ ID NO: 3220866 - DNA, 16 bp, Homo sapiens
tggccttcctgcccta

SEQ ID NO: 3220867 - DNA, 23 bp, Homo sapiens
tggccttgaaacagttccattta

SEQ ID NO: 3220868 - DNA, 18 bp, Homo sapiens
tggccttgaaaccacctt

SEQ ID NO: 3220869 - DNA, 13 bp, Homo sapiens
tggccttggcatg

SEQ ID NO: 3220870 - DNA, 20 bp, Homo sapiens
tggccttggcatgggcgcag

SEQ ID NO: 3220871 - DNA, 18 bp, Homo sapiens
tggccttgtaagaccctt

SEQ ID NO: 3220872 - DNA, 21 bp, Homo sapiens
tggcctttgcttatgaatatt

SEQ ID NO: 3220873 - DNA, 18 bp, Homo sapiens
tggcgaatctcaaaatta

SEQ ID NO: 3220874 - DNA, 16 bp, Homo sapiens
tggcgcaatctcggct

SEQ ID NO: 3220875 - DNA, 12 bp, Homo sapiens
tggcgcagccaa

SEQ ID NO: 3220876 - DNA, 13 bp, Homo sapiens
tggcgcagccaag

SEQ ID NO: 3220877 - DNA, 16 bp, Homo sapiens
tggcgcagccaaggcc

SEQ ID NO: 3220878 - DNA, 18 bp, Homo sapiens
tggcgccgtctccagggg

SEQ ID NO: 3220879 - DNA, 18 bp, Homo sapiens
tggcgcgggaggcaccag

SEQ ID NO: 3220880 - DNA, 19 bp, Homo sapiens
tggcgcgggaggcaccagc

SEQ ID NO: 3220881 - DNA, 17 bp, Homo sapiens
tggcgctattacaaata

SEQ ID NO: 3220882 - DNA, 18 bp, Homo sapiens
tggcggcagggccaggct

SEQ ID NO: 3220883 - DNA, 20 bp, Homo sapiens
tggcggcagggccaggctgg

SEQ ID NO: 3220884 - DNA, 14 bp, Homo sapiens
tggcggtggctgcc

SEQ ID NO: 3220885 - DNA, 21 bp, Homo sapiens
tggcgtaagatgatggatttg

SEQ ID NO: 3220886 - DNA, 15 bp, Homo sapiens
tggcgtaatgggcct

SEQ ID NO: 3220887 - DNA, 21 bp, Homo sapiens
tggcgtgacggtaaccccata

SEQ ID NO: 3220888 - DNA, 22 bp, Homo sapiens
tggcgtgcagtggtgcgatctg

SEQ ID NO: 3220889 - DNA, 15 bp, Homo sapiens
tggcgtggagcaggc

SEQ ID NO: 3220890 - DNA, 22 bp, Homo sapiens
tggcgttcacctccctgctcag

SEQ ID NO: 3220891 - DNA, 18 bp, Homo sapiens
tggcgttttgtctgtgtt

SEQ ID NO: 3220892 - DNA, 19 bp, Homo sapiens
tggcgttttgtctgtgttg

SEQ ID NO: 3220893 - DNA, 12 bp, Homo sapiens
tggctaaagata

SEQ ID NO: 3220894 - DNA, 18 bp, Homo sapiens
tggctaaagataattgct

SEQ ID NO: 3220895 - DNA, 21 bp, Homo sapiens
tggctaactatatttgctttt

SEQ ID NO: 3220896 - DNA, 19 bp, Homo sapiens
tggctaatgtactgcatat

SEQ ID NO: 3220897 - DNA, 19 bp, Homo sapiens
tggctaattttttgtactt

SEQ ID NO: 3220898 - DNA, 15 bp, Homo sapiens
tggctacatcccagc

SEQ ID NO: 3220899 - DNA, 21 bp, Homo sapiens
tggctagaggccagccccacc

SEQ ID NO: 3220900 - DNA, 22 bp, Homo sapiens
tggctagaggccagccccaccc

SEQ ID NO: 3220901 - DNA, 15 bp, Homo sapiens
tggctagagtcctca

SEQ ID NO: 3220902 - DNA, 16 bp, Homo sapiens
tggctagagtcctcac

SEQ ID NO: 3220903 - DNA, 21 bp, Homo sapiens
tggctagagtcctcactccca

SEQ ID NO: 3220904 - DNA, 15 bp, Homo sapiens
tggctagagtttcca

SEQ ID NO: 3220905 - DNA, 17 bp, Homo sapiens
tggctagcgcaagacca

SEQ ID NO: 3220906 - DNA, 16 bp, Homo sapiens
tggctagtactgtatt

SEQ ID NO: 3220907 - DNA, 13 bp, Homo sapiens
tggctataaatat

SEQ ID NO: 3220908 - DNA, 18 bp, Homo sapiens
tggctataacatgtcttt

SEQ ID NO: 3220909 - DNA, 14 bp, Homo sapiens
tggctcacagtaca

SEQ ID NO: 3220910 - DNA, 22 bp, Homo sapiens
tggctcacagtacagcatgtgc

SEQ ID NO: 3220911 - DNA, 18 bp, Homo sapiens
tggctcagacatgttttc

SEQ ID NO: 3220912 - DNA, 18 bp, Homo sapiens
tggctcagagcttgaaga

SEQ ID NO: 3220913 - DNA, 22 bp, Homo sapiens
tggctcagatcggccacagggc

SEQ ID NO: 3220914 - DNA, 14 bp, Homo sapiens
tggctcaggcaagc

SEQ ID NO: 3220915 - DNA, 16 bp, Homo sapiens
tggctcaggcaagccc

SEQ ID NO: 3220916 - DNA, 19 bp, Homo sapiens
tggctcaggcaagcccctc

SEQ ID NO: 3220917 - DNA, 20 bp, Homo sapiens
tggctcccacaggcccttcc

SEQ ID NO: 3220918 - DNA, 14 bp, Homo sapiens
tggctcccatgacc

SEQ ID NO: 3220919 - DNA, 19 bp, Homo sapiens
tggctccccacgagtcacc

SEQ ID NO: 3220920 - DNA, 16 bp, Homo sapiens
tggctcctatctgtgt

SEQ ID NO: 3220921 - DNA, 22 bp, Homo sapiens
tggctcctcaaacagtaggttg

SEQ ID NO: 3220922 - DNA, 14 bp, Homo sapiens
tggctcctcccggt

SEQ ID NO: 3220923 - DNA, 21 bp, Homo sapiens
tggctcctgaggggcatctgc

SEQ ID NO: 3220924 - DNA, 18 bp, Homo sapiens
tggctcctttacaaaaga

SEQ ID NO: 3220925 - DNA, 23 bp, Homo sapiens
tggctcgctccctgtagctctgc

SEQ ID NO: 3220926 - DNA, 23 bp, Homo sapiens
tggctctccaagtgccagaggtg

SEQ ID NO: 3220927 - DNA, 17 bp, Homo sapiens
tggctctcccatttcct

SEQ ID NO: 3220928 - DNA, 19 bp, Homo sapiens
tggctctgagcgcctccat

SEQ ID NO: 3220929 - DNA, 14 bp, Homo sapiens
tggctctgcaatgg

SEQ ID NO: 3220930 - DNA, 23 bp, Homo sapiens
tggctctgcaatgggcactggga

SEQ ID NO: 3220931 - DNA, 16 bp, Homo sapiens
tggctctgccagtgga

SEQ ID NO: 3220932 - DNA, 19 bp, Homo sapiens
tggctctgctgtccccttg

SEQ ID NO: 3220933 - DNA, 15 bp, Homo sapiens
tggctctggactcta

SEQ ID NO: 3220934 - DNA, 21 bp, Homo sapiens
tggctctggagacagccccag

SEQ ID NO: 3220935 - DNA, 12 bp, Homo sapiens
tggctctgggac

SEQ ID NO: 3220936 - DNA, 13 bp, Homo sapiens
tggctctgggact

SEQ ID NO: 3220937 - DNA, 19 bp, Homo sapiens
tggctcttatttctgaatt

SEQ ID NO: 3220938 - DNA, 18 bp, Homo sapiens
tggctgaaattctcctgg

SEQ ID NO: 3220939 - DNA, 18 bp, Homo sapiens
tggctgaaccctgtgctg

SEQ ID NO: 3220940 - DNA, 20 bp, Homo sapiens
tggctgaaccctgtgctggt

SEQ ID NO: 3220941 - DNA, 23 bp, Homo sapiens
tggctgaaccctgtgctggtgtc

SEQ ID NO: 3220942 - DNA, 13 bp, Homo sapiens
tggctgaagacat

SEQ ID NO: 3220943 - DNA, 16 bp, Homo sapiens
tggctgactggccagt

SEQ ID NO: 3220944 - DNA, 13 bp, Homo sapiens
tggctgactgggg

SEQ ID NO: 3220945 - DNA, 14 bp, Homo sapiens
tggctgagggcagc

SEQ ID NO: 3220946 - DNA, 17 bp, Homo sapiens
tggctgaggggcttggg

SEQ ID NO: 3220947 - DNA, 17 bp, Homo sapiens
tggctgaggttcctctg

SEQ ID NO: 3220948 - DNA, 23 bp, Homo sapiens
tggctgaggttcctctgcctgcc

SEQ ID NO: 3220949 - DNA, 22 bp, Homo sapiens
tggctgagtggaatgcagggaa

SEQ ID NO: 3220950 - DNA, 23 bp, Homo sapiens
tggctgcaaagggtatcaggtgc

SEQ ID NO: 3220951 - DNA, 14 bp, Homo sapiens
tggctgcagggagt

SEQ ID NO: 3220952 - DNA, 23 bp, Homo sapiens
tggctgcccagacccctctggcc

SEQ ID NO: 3220953 - DNA, 17 bp, Homo sapiens
tggctgccctggccctg

SEQ ID NO: 3220954 - DNA, 17 bp, Homo sapiens
tggctgctagattttaa

SEQ ID NO: 3220955 - DNA, 23 bp, Homo sapiens
tggctgctagattttaatttatt

SEQ ID NO: 3220956 - DNA, 13 bp, Homo sapiens
tggctggaagggg

SEQ ID NO: 3220957 - DNA, 23 bp, Homo sapiens
tggctggcagctgagagccctgc

SEQ ID NO: 3220958 - DNA, 17 bp, Homo sapiens
tggctggcccgtcatgt

SEQ ID NO: 3220959 - DNA, 15 bp, Homo sapiens
tggctggcctcaccc

SEQ ID NO: 3220960 - DNA, 23 bp, Homo sapiens
tggctggcttgtttgatttcaac

SEQ ID NO: 3220961 - DNA, 10 bp, Homo sapiens
tggctgggca

SEQ ID NO: 3220962 - DNA, 12 bp, Homo sapiens
tggctgggcatg

SEQ ID NO: 3220963 - DNA, 20 bp, Homo sapiens
tggctggggcagaggggcag

SEQ ID NO: 3220964 - DNA, 16 bp, Homo sapiens
tggctgggggcaggag

SEQ ID NO: 3220965 - DNA, 14 bp, Homo sapiens
tggctgggggcctc

SEQ ID NO: 3220966 - DNA, 17 bp, Homo sapiens
tggctgggggcctcagt

SEQ ID NO: 3220967 - DNA, 21 bp, Homo sapiens
tggctgggggcctcagtgcca

SEQ ID NO: 3220968 - DNA, 14 bp, Homo sapiens
tggctgggtcaggg

SEQ ID NO: 3220969 - DNA, 16 bp, Homo sapiens
tggctggtgggaaggc

SEQ ID NO: 3220970 - DNA, 15 bp, Homo sapiens
tggctgtaaggctct

SEQ ID NO: 3220971 - DNA, 13 bp, Homo sapiens
tggctgtaatcat

SEQ ID NO: 3220972 - DNA, 22 bp, Homo sapiens
tggctgtaatcatttgtttaca

SEQ ID NO: 3220973 - DNA, 22 bp, Homo sapiens
tggctgtatggaaatgcaccct

SEQ ID NO: 3220974 - DNA, 15 bp, Homo sapiens
tggctgtgaggcccc

SEQ ID NO: 3220975 - DNA, 19 bp, Homo sapiens
tggctgtgcctctgcctgt

SEQ ID NO: 3220976 - DNA, 16 bp, Homo sapiens
tggctgtggaggcctg

SEQ ID NO: 3220977 - DNA, 20 bp, Homo sapiens
tggctgtggaggcctgatgc

SEQ ID NO: 3220978 - DNA, 21 bp, Homo sapiens
tggctgtgtttgcagcctgct

SEQ ID NO: 3220979 - DNA, 13 bp, Homo sapiens
tggcttaaatata

SEQ ID NO: 3220980 - DNA, 15 bp, Homo sapiens
tggcttaatcatttt

SEQ ID NO: 3220981 - DNA, 14 bp, Homo sapiens
tggcttaatgttta

SEQ ID NO: 3220982 - DNA, 19 bp, Homo sapiens
tggcttacctgacctcttg

SEQ ID NO: 3220983 - DNA, 16 bp, Homo sapiens
tggcctatgtggtcta

SEQ ID NO: 3220984 - DNA, 18 bp, Homo sapiens
tggcctcaaaacagaagc

SEQ ID NO: 3220985 - DNA, 23 bp, Homo sapiens
tggcctcaaaacagaagcagctt

SEQ ID NO: 3220986 - DNA, 20 bp, Homo sapiens
tggcctcaagagcacacaga

SEQ ID NO: 3220987 - DNA, 13 bp, Homo sapiens
tggcctcagccct

SEQ ID NO: 3220988 - DNA, 17 bp, Homo sapiens
tggcctcagccctcaga

SEQ ID NO: 3220989 - DNA, 13 bp, Homo sapiens
tggcctcagctgc

SEQ ID NO: 3220990 - DNA, 16 bp, Homo sapiens
tggcctcagctgcctc

SEQ ID NO: 3220991 - DNA, 17 bp, Homo sapiens
tggcctcagctgcctca

SEQ ID NO: 3220992 - DNA, 15 bp, Homo sapiens
tggcctcagctggct

SEQ ID NO: 3220993 - DNA, 19 bp, Homo sapiens
tggcctcagggccaggaag

SEQ ID NO: 3220994 - DNA, 20 bp, Homo sapiens
tggcctcagggccaggaagg

SEQ ID NO: 3220995 - DNA, 18 bp, Homo sapiens
tggcctcagttcccagct

SEQ ID NO: 3220996 - DNA, 20 bp, Homo sapiens
tggcctcatgtggctggaag

SEQ ID NO: 3220997 - DNA, 19 bp, Homo sapiens
tggcctcccctgccaccag

SEQ ID NO: 3220998 - DNA, 14 bp, Homo sapiens
tggcctccctgctg

SEQ ID NO: 3220999 - DNA, 19 bp, Homo sapiens
tggcctccctgctgtgcca

SEQ ID NO: 3221000 - DNA, 13 bp, Homo sapiens
tggcctcgcctcc

SEQ ID NO: 3221001 - DNA, 13 bp, Homo sapiens
tggcctctctagc

SEQ ID NO: 3221002 - DNA, 20 bp, Homo sapiens
tggcctcttgagcagtggct

SEQ ID NO: 3221003 - DNA, 20 bp, Homo sapiens
tggcctctttcctcagcctt

SEQ ID NO: 3221004 - DNA, 18 bp, Homo sapiens
tggcctgaactgaggaga

SEQ ID NO: 3221005 - DNA, 15 bp, Homo sapiens
tggcctgagagggga

SEQ ID NO: 3221006 - DNA, 19 bp, Homo sapiens
tggcctgagtcctggtccc

SEQ ID NO: 3221007 - DNA, 22 bp, Homo sapiens
tggcctgagtcctggtccctct

SEQ ID NO: 3221008 - DNA, 23 bp, Homo sapiens
tggcctgagtcctggtccctctg

SEQ ID NO: 3221009 - DNA, 15 bp, Homo sapiens
tggcctgctgggaac

SEQ ID NO: 3221010 - DNA, 11 bp, Homo sapiens
tggcctgctgt

SEQ ID NO: 3221011 - DNA, 12 bp, Homo sapiens
tggcctgctgtg

SEQ ID NO: 3221012 - DNA, 12 bp, Homo sapiens
tggcctggcaca

SEQ ID NO: 3221013 - DNA, 18 bp, Homo sapiens
tggcctggcacacatcag

SEQ ID NO: 3221014 - DNA, 12 bp, Homo sapiens
tggcctggccag

SEQ ID NO: 3221015 - DNA, 15 bp, Homo sapiens
tggcctggccaggag

SEQ ID NO: 3221016 - DNA, 16 bp, Homo sapiens
tggcctggccaggagc

SEQ ID NO: 3221017 - DNA, 18 bp, Homo sapiens
tggcctggccaggagctc

SEQ ID NO: 3221018 - DNA, 21 bp, Homo sapiens
tggcctggccaggagctcttc

SEQ ID NO: 3221019 - DNA, 14 bp, Homo sapiens
tggcctggccctgc

SEQ ID NO: 3221020 - DNA, 19 bp, Homo sapiens
tgggcattgggttctaaag

SEQ ID NO: 3221021 - DNA, 16 bp, Homo sapiens
tgggcatttggtgaga

SEQ ID NO: 3221022 - DNA, 17 bp, Homo sapiens
tgggcatttggtgagag

SEQ ID NO: 3221023 - DNA, 15 bp, Homo sapiens
tgggcatttgtgagg

SEQ ID NO: 3221024 - DNA, 16 bp, Homo sapiens
tgggccaactcacctg

SEQ ID NO: 3221025 - DNA, 19 bp, Homo sapiens
tgggccaccatgtctggct

SEQ ID NO: 3221026 - DNA, 14 bp, Homo sapiens
tgggccactgggga

SEQ ID NO: 3221027 - DNA, 15 bp, Homo sapiens
tgggccactggggac

SEQ ID NO: 3221028 - DNA, 15 bp, Homo sapiens
tgggccactgtggtg

SEQ ID NO: 3221029 - DNA, 18 bp, Homo sapiens
tgggccagccctgcagcc

SEQ ID NO: 3221030 - DNA, 21 bp, Homo sapiens
tgggccagccctgcagcccaa

SEQ ID NO: 3221031 - DNA, 13 bp, Homo sapiens
tgggccagcctag

SEQ ID NO: 3221032 - DNA, 20 bp, Homo sapiens
tgggccagggctgccctgag

SEQ ID NO: 3221033 - DNA, 14 bp, Homo sapiens
tgggccagggtctg

SEQ ID NO: 3221034 - DNA, 16 bp, Homo sapiens
tgggccagtctgtgga

SEQ ID NO: 3221035 - DNA, 14 bp, Homo sapiens
tgggccatgtccaa

SEQ ID NO: 3221036 - DNA, 19 bp, Homo sapiens
tgggccatgtccaaagagg

SEQ ID NO: 3221037 - DNA, 22 bp, Homo sapiens
tgggcccaagacagatgcccca

SEQ ID NO: 3221038 - DNA, 14 bp, Homo sapiens
tgggcccagaactg

SEQ ID NO: 3221039 - DNA, 14 bp, Homo sapiens
tgggcccagatctg

SEQ ID NO: 3221040 - DNA, 15 bp, Homo sapiens
tgggcccaggaccag

SEQ ID NO: 3221041 - DNA, 17 bp, Homo sapiens
tgggcccaggaccagct

SEQ ID NO: 3221042 - DNA, 21 bp, Homo sapiens
tgggcccaggaccagctgggg

SEQ ID NO: 3221043 - DNA, 14 bp, Homo sapiens
tgggccccatgctc

SEQ ID NO: 3221044 - DNA, 18 bp, Homo sapiens
tgggccccgggctggaga

SEQ ID NO: 3221045 - DNA, 19 bp, Homo sapiens
tgggccccgggctggagaa

SEQ ID NO: 3221046 - DNA, 23 bp, Homo sapiens
tgggccccgggctggagaaagag

SEQ ID NO: 3221047 - DNA, 15 bp, Homo sapiens
tgggcccctcaacag

SEQ ID NO: 3221048 - DNA, 17 bp, Homo sapiens
tgggcccctccacgcct

SEQ ID NO: 3221049 - DNA, 19 bp, Homo sapiens
tgggccctctttccctgcg

SEQ ID NO: 3221050 - DNA, 17 bp, Homo sapiens
tgggccgaatcccccag

SEQ ID NO: 3221051 - DNA, 13 bp, Homo sapiens
tgggccgctgcca

SEQ ID NO: 3221052 - DNA, 19 bp, Homo sapiens
tgggcctcaggctctgcac

SEQ ID NO: 3221053 - DNA, 14 bp, Homo sapiens
tgggcctcctgtgt

SEQ ID NO: 3221054 - DNA, 17 bp, Homo sapiens
tgggcctccttcccatg

SEQ ID NO: 3221055 - DNA, 24 bp, Homo sapiens
tgggcctccttcccatgcctgtct

SEQ ID NO: 3221056 - DNA, 20 bp, Homo sapiens
tgggcctctgcttctctcac

SEQ ID NO: 3221057 - DNA, 12 bp, Homo sapiens
tgggcctgccca

SEQ ID NO: 3221058 - DNA, 18 bp, Homo sapiens
tgggcctggcctgagctg

SEQ ID NO: 3221059 - DNA, 17 bp, Homo sapiens
tgggcctgtcgtgccag

SEQ ID NO: 3221060 - DNA, 12 bp, Homo sapiens
tgggcctgtgca

SEQ ID NO: 3221061 - DNA, 22 bp, Homo sapiens
tgggcctgtgcagcagcccagc

SEQ ID NO: 3221062 - DNA, 16 bp, Homo sapiens
tgggccttagtgggcc

SEQ ID NO: 3221063 - DNA, 17 bp, Homo sapiens
tgggccttgctgctgct

SEQ ID NO: 3221064 - DNA, 23 bp, Homo sapiens
tgggcggaagtacttccctcagg

SEQ ID NO: 3221065 - DNA, 20 bp, Homo sapiens
tgggcggacggctgtggacc

SEQ ID NO: 3221066 - DNA, 20 bp, Homo sapiens
tgggcgtggtcactgctgtc

SEQ ID NO: 3221067 - DNA, 17 bp, Homo sapiens
tgggctaattaaataaa

SEQ ID NO: 3221068 - DNA, 19 bp, Homo sapiens
tgggctacatgctggggtc

SEQ ID NO: 3221069 - DNA, 18 bp, Homo sapiens
tgggctactggcagctcc

SEQ ID NO: 3221070 - DNA, 14 bp, Homo sapiens
tgggctcacaggcc

SEQ ID NO: 3221071 - DNA, 23 bp, Homo sapiens
tgggctcagcctgagcctctgct

SEQ ID NO: 3221072 - DNA, 14 bp, Homo sapiens
tgggctcagggctg

SEQ ID NO: 3221073 - DNA, 15 bp, Homo sapiens
tgggctcctggctgc

SEQ ID NO: 3221074 - DNA, 16 bp, Homo sapiens
tgggctcctggctgcc

SEQ ID NO: 3221075 - DNA, 17 bp, Homo sapiens
tgggctcctggctgcca

SEQ ID NO: 3221076 - DNA, 21 bp, Homo sapiens
tgggctcctggctgccaggcg

SEQ ID NO: 3221077 - DNA, 20 bp, Homo sapiens
tgggctctgcaattcccctc

SEQ ID NO: 3221078 - DNA, 22 bp, Homo sapiens
tgggctctgcaattcccctctg

SEQ ID NO: 3221079 - DNA, 17 bp, Homo sapiens
tgggctctgccccagct

SEQ ID NO: 3221080 - DNA, 20 bp, Homo sapiens
tgggctctgccccagctctg

SEQ ID NO: 3221081 - DNA, 21 bp, Homo sapiens
tgggctctgccccagctctgg

SEQ ID NO: 3221082 - DNA, 12 bp, Homo sapiens
tgggctctgtgc

SEQ ID NO: 3221083 - DNA, 19 bp, Homo sapiens
tgggctgacacctaccatg

SEQ ID NO: 3221084 - DNA, 21 bp, Homo sapiens
tgggctgacacctaccatgct

SEQ ID NO: 3221085 - DNA, 22 bp, Homo sapiens
tgggctgacacctaccatgctg

SEQ ID NO: 3221086 - DNA, 14 bp, Homo sapiens
tgggctgacccagc

SEQ ID NO: 3221087 - DNA, 15 bp, Homo sapiens
tgggctgacccagca

SEQ ID NO: 3221088 - DNA, 12 bp, Homo sapiens
tgggctgagccc

SEQ ID NO: 3221089 - DNA, 15 bp, Homo sapiens
tgggctgagccctgg

SEQ ID NO: 3221090 - DNA, 14 bp, Homo sapiens
tgggctgatttaca

SEQ ID NO: 3221091 - DNA, 19 bp, Homo sapiens
tgggctgatttacatgtat

SEQ ID NO: 3221092 - DNA, 16 bp, Homo sapiens
tgggctgccatgtgaa

SEQ ID NO: 3221093 - DNA, 15 bp, Homo sapiens
tgggctgccctggtg

SEQ ID NO: 3221094 - DNA, 20 bp, Homo sapiens
tgggctgcgggaggccctgg

SEQ ID NO: 3221095 - DNA, 23 bp, Homo sapiens
tgggctgcgggaggccctggccc

SEQ ID NO: 3221096 - DNA, 23 bp, Homo sapiens
tgggctggacttctacctgccct

SEQ ID NO: 3221097 - DNA, 16 bp, Homo sapiens
tgggctgggacttctt

SEQ ID NO: 3221098 - DNA, 19 bp, Homo sapiens
tgggctgggacttcttacc

SEQ ID NO: 3221099 - DNA, 20 bp, Homo sapiens
tgggctggggctgctcccct

SEQ ID NO: 3221100 - DNA, 14 bp, Homo sapiens
tgggctggtatctc

SEQ ID NO: 3221101 - DNA, 18 bp, Homo sapiens
tgggctggtgccccacag

SEQ ID NO: 3221102 - DNA, 14 bp, Homo sapiens
tgggctgtctgtca

SEQ ID NO: 3221103 - DNA, 12 bp, Homo sapiens
tgggctgtgagt

SEQ ID NO: 3221104 - DNA, 14 bp, Homo sapiens
tgggcttaagaaat

SEQ ID NO: 3221105 - DNA, 17 bp, Homo sapiens
tgggcttcactgtataa

SEQ ID NO: 3221106 - DNA, 23 bp, Homo sapiens
tgggcttcactgtataaatagga

SEQ ID NO: 3221107 - DNA, 15 bp, Homo sapiens
tgggcttcagtggca

SEQ ID NO: 3221108 - DNA, 19 bp, Homo sapiens
tgggcttcagtggcagctg

SEQ ID NO: 3221109 - DNA, 20 bp, Homo sapiens
tgggcttcagtggcagctgc

SEQ ID NO: 3221110 - DNA, 20 bp, Homo sapiens
tgggcttctgaaacttcata

SEQ ID NO: 3221111 - DNA, 14 bp, Homo sapiens
tgggcttgaccagg

SEQ ID NO: 3221112 - DNA, 13 bp, Homo sapiens
tgggcttgattct

SEQ ID NO: 3221113 - DNA, 14 bp, Homo sapiens
tgggcttgattctg

SEQ ID NO: 3221114 - DNA, 22 bp, Homo sapiens
tgggcttggacttcctggggcc

SEQ ID NO: 3221115 - DNA, 17 bp, Homo sapiens
tgggcttggcctgctgt

SEQ ID NO: 3221116 - DNA, 18 bp, Homo sapiens
tgggcttggcctgctgtg

SEQ ID NO: 3221117 - DNA, 19 bp, Homo sapiens
tgggcttggcctgctgtga

SEQ ID NO: 3221118 - DNA, 20 bp, Homo sapiens
tgggctttgcaggctctggg

SEQ ID NO: 3221119 - DNA, 21 bp, Homo sapiens
tgggctttgcaggctctgggc

SEQ ID NO: 3221120 - DNA, 22 bp, Homo sapiens
tgggcttttggggagccagaag

SEQ ID NO: 3221121 - DNA, 23 bp, Homo sapiens
tgggcttttggtttgggggcgcc

SEQ ID NO: 3221122 - DNA, 22 bp, Homo sapiens
tgggctttttttttctctttct

SEQ ID NO: 3221123 - DNA, 20 bp, Homo sapiens
tggggaaaggggttggggtg

SEQ ID NO: 3221124 - DNA, 20 bp, Homo sapiens
tggggaagaggggctggggc

SEQ ID NO: 3221125 - DNA, 16 bp, Homo sapiens
tggggaaggagccagt

SEQ ID NO: 3221126 - DNA, 16 bp, Homo sapiens
tggggaaggtggagca

SEQ ID NO: 3221127 - DNA, 23 bp, Homo sapiens
tggggacagttggcagagaaggc

SEQ ID NO: 3221128 - DNA, 21 bp, Homo sapiens
tggggacccaggctccgccct

SEQ ID NO: 3221129 - DNA, 11 bp, Homo sapiens
tggggaccccc

SEQ ID NO: 3221130 - DNA, 14 bp, Homo sapiens
tggggactgttcca

SEQ ID NO: 3221131 - DNA, 20 bp, Homo sapiens
tggggactgttccaaagcca

SEQ ID NO: 3221132 - DNA, 21 bp, Homo sapiens
tggggactgttccaaagccag

SEQ ID NO: 3221133 - DNA, 20 bp, Homo sapiens
tggggagaggaactccttgg

SEQ ID NO: 3221134 - DNA, 18 bp, Homo sapiens
tggggagcaggaggccaa

SEQ ID NO: 3221135 - DNA, 12 bp, Homo sapiens
tggggaggccct

SEQ ID NO: 3221136 - DNA, 15 bp, Homo sapiens
tggggagggacaagg

SEQ ID NO: 3221137 - DNA, 21 bp, Homo sapiens
tggggagggatgaagggcgag

SEQ ID NO: 3221138 - DNA, 22 bp, Homo sapiens
tggggagggattctggttccag

SEQ ID NO: 3221139 - DNA, 22 bp, Homo sapiens
tggggagggggaagagaaattt

SEQ ID NO: 3221140 - DNA, 19 bp, Homo sapiens
tggggagtaggacatacca

SEQ ID NO: 3221141 - DNA, 17 bp, Homo sapiens
tggggataaaggagaag

SEQ ID NO: 3221142 - DNA, 23 bp, Homo sapiens
tggggatagaggaaagggatggt

SEQ ID NO: 3221143 - DNA, 21 bp, Homo sapiens
tggggatcacagagacattcc

SEQ ID NO: 3221144 - DNA, 18 bp, Homo sapiens
tggggatccccgcctggc

SEQ ID NO: 3221145 - DNA, 14 bp, Homo sapiens
tgggtcctgaagaa

SEQ ID NO: 3221146 - DNA, 15 bp, Homo sapiens
tgggtcggccctgcc

SEQ ID NO: 3221147 - DNA, 16 bp, Homo sapiens
tgggtcggccctgccc

SEQ ID NO: 3221148 - DNA, 18 bp, Homo sapiens
tgggtcggccctgcccaa

SEQ ID NO: 3221149 - DNA, 19 bp, Homo sapiens
tgggtctgatattaatcaa

SEQ ID NO: 3221150 - DNA, 21 bp, Homo sapiens
tgggtctgatattaatcaaaa

SEQ ID NO: 3221151 - DNA, 23 bp, Homo sapiens
tgggtctgggatatggctgccca

SEQ ID NO: 3221152 - DNA, 14 bp, Homo sapiens
tgggtctgtgtctc

SEQ ID NO: 3221153 - DNA, 15 bp, Homo sapiens
tgggtctgttttcct

SEQ ID NO: 3221154 - DNA, 19 bp, Homo sapiens
tgggtctgttttcctttct

SEQ ID NO: 3221155 - DNA, 21 bp, Homo sapiens
tgggtctgttttcctttctca

SEQ ID NO: 3221156 - DNA, 20 bp, Homo sapiens
tgggtcttttataggaaaaa

SEQ ID NO: 3221157 - DNA, 21 bp, Homo sapiens
tgggtcttttataggaaaaaa

SEQ ID NO: 3221158 - DNA, 15 bp, Homo sapiens
tgggtgaagggagag

SEQ ID NO: 3221159 - DNA, 14 bp, Homo sapiens
tgggtgaatcttga

SEQ ID NO: 3221160 - DNA, 18 bp, Homo sapiens
tgggtgagatgctggaga

SEQ ID NO: 3221161 - DNA, 21 bp, Homo sapiens
tgggtgagatgctggagaaga

SEQ ID NO: 3221162 - DNA, 17 bp, Homo sapiens
tgggtgccattcccagc

SEQ ID NO: 3221163 - DNA, 22 bp, Homo sapiens
tgggtgctcagaataaggcagg

SEQ ID NO: 3221164 - DNA, 14 bp, Homo sapiens
tgggtgctgccctg

SEQ ID NO: 3221165 - DNA, 14 bp, Homo sapiens
tgggtggatgcctg

SEQ ID NO: 3221166 - DNA, 14 bp, Homo sapiens
tgggtgggacagcc

SEQ ID NO: 3221167 - DNA, 15 bp, Homo sapiens
tgggtgggctctgtg

SEQ ID NO: 3221168 - DNA, 16 bp, Homo sapiens
tgggtgggctctgtgc

SEQ ID NO: 3221169 - DNA, 13 bp, Homo sapiens
tgggtggggacag

SEQ ID NO: 3221170 - DNA, 21 bp, Homo sapiens
tgggtgggggctcctggtggc

SEQ ID NO: 3221171 - DNA, 20 bp, Homo sapiens
tgggtggggggcattgagta

SEQ ID NO: 3221172 - DNA, 18 bp, Homo sapiens
tgggtgtccaaaggaaga

SEQ ID NO: 3221173 - DNA, 14 bp, Homo sapiens
tgggttaatggcta

SEQ ID NO: 3221174 - DNA, 16 bp, Homo sapiens
tgggttcattattgga

SEQ ID NO: 3221175 - DNA, 13 bp, Homo sapiens
tgggttcctcttc

SEQ ID NO: 3221176 - DNA, 17 bp, Homo sapiens
tgggttctgatattgcc

SEQ ID NO: 3221177 - DNA, 21 bp, Homo sapiens
tgggttgaatatagcctgcct

SEQ ID NO: 3221178 - DNA, 19 bp, Homo sapiens
tgggttgcgtcctgacggc

SEQ ID NO: 3221179 - DNA, 15 bp, Homo sapiens
tgggttggtgcacag

SEQ ID NO: 3221180 - DNA, 16 bp, Homo sapiens
tgggttggtgcttcta

SEQ ID NO: 3221181 - DNA, 17 bp, Homo sapiens
tgggtttcctgcaggca

SEQ ID NO: 3221182 - DNA, 14 bp, Homo sapiens
tgggtttggacccc

SEQ ID NO: 3221183 - DNA, 19 bp, Homo sapiens
tgggtttggaccccagctg

SEQ ID NO: 3221184 - DNA, 19 bp, Homo sapiens
tgggttttattgtccttca

SEQ ID NO: 3221185 - DNA, 19 bp, Homo sapiens
tgggttttctatttgaaca

SEQ ID NO: 3221186 - DNA, 14 bp, Homo sapiens
tgggtttttccctg

SEQ ID NO: 3221187 - DNA, 22 bp, Homo sapiens
tgggtttttgttacctttatgg

SEQ ID NO: 3221188 - DNA, 16 bp, Homo sapiens
tggtaaaaatgctgct

SEQ ID NO: 3221189 - DNA, 18 bp, Homo sapiens
tggtaaaaatgctgctct

SEQ ID NO: 3221190 - DNA, 15 bp, Homo sapiens
tggtaaaactcactg

SEQ ID NO: 3221191 - DNA, 17 bp, Homo sapiens
tggtaaagttacacttt

SEQ ID NO: 3221192 - DNA, 13 bp, Homo sapiens
tggtaacagctct

SEQ ID NO: 3221193 - DNA, 21 bp, Homo sapiens
tggtaacagctctcttcttac

SEQ ID NO: 3221194 - DNA, 18 bp, Homo sapiens
tggtaacagttcatgttt

SEQ ID NO: 3221195 - DNA, 15 bp, Homo sapiens
tggtaaccaaatatt

SEQ ID NO: 3221196 - DNA, 21 bp, Homo sapiens
tggtaactgattacctgccaa

SEQ ID NO: 3221197 - DNA, 22 bp, Homo sapiens
tggtaactgattacctgccaat

SEQ ID NO: 3221198 - DNA, 21 bp, Homo sapiens
tggtaactggaaggccttcca

SEQ ID NO: 3221199 - DNA, 16 bp, Homo sapiens
tggtaacttttgtgaa

SEQ ID NO: 3221200 - DNA, 24 bp, Homo sapiens
tggtaacttttgtgaattaggctg

SEQ ID NO: 3221201 - DNA, 22 bp, Homo sapiens
tggtaagagacagaatgtatct

SEQ ID NO: 3221202 - DNA, 18 bp, Homo sapiens
tggtaagcaacatggctt

SEQ ID NO: 3221203 - DNA, 19 bp, Homo sapiens
tggtacagttgcaggagcg

SEQ ID NO: 3221204 - DNA, 18 bp, Homo sapiens
tggtacatggtgtttgtg

SEQ ID NO: 3221205 - DNA, 17 bp, Homo sapiens
tggtacatgtcttccat

SEQ ID NO: 3221206 - DNA, 16 bp, Homo sapiens
tggtaccagccctggg

SEQ ID NO: 3221207 - DNA, 19 bp, Homo sapiens
tggtaccagccctggggct

SEQ ID NO: 3221208 - DNA, 21 bp, Homo sapiens
tggtaccagccctggggctgg

SEQ ID NO: 3221209 - DNA, 21 bp, Homo sapiens
tggtacccagccatctgccca

SEQ ID NO: 3221210 - DNA, 16 bp, Homo sapiens
tggtaccctcctggct

SEQ ID NO: 3221211 - DNA, 21 bp, Homo sapiens
tggtaccctcctggctcttga

SEQ ID NO: 3221212 - DNA, 16 bp, Homo sapiens
tggtactctgaaacac

SEQ ID NO: 3221213 - DNA, 15 bp, Homo sapiens
tggtactgctgtctt

SEQ ID NO: 3221214 - DNA, 21 bp, Homo sapiens
tggtactttattcttgctggg

SEQ ID NO: 3221215 - DNA, 23 bp, Homo sapiens
tggtacttttatgatgtatattt

SEQ ID NO: 3221216 - DNA, 17 bp, Homo sapiens
tggtagaccaaaataaa

SEQ ID NO: 3221217 - DNA, 19 bp, Homo sapiens
tggtagagacccccaggcc

SEQ ID NO: 3221218 - DNA, 15 bp, Homo sapiens
tggtagaggcctggg

SEQ ID NO: 3221219 - DNA, 19 bp, Homo sapiens
tggtagaggcctggggccg

SEQ ID NO: 3221220 - DNA, 20 bp, Homo sapiens
tggtagattaaatatagatt

SEQ ID NO: 3221221 - DNA, 15 bp, Homo sapiens
tggtagcataaataa

SEQ ID NO: 3221222 - DNA, 20 bp, Homo sapiens
tggtagctgggaaagcataa

SEQ ID NO: 3221223 - DNA, 20 bp, Homo sapiens
tggtagcttttcccttcttt

SEQ ID NO: 3221224 - DNA, 22 bp, Homo sapiens
tggtaggaccaagcatcttggg

SEQ ID NO: 3221225 - DNA, 18 bp, Homo sapiens
tggtaggccttttaacat

SEQ ID NO: 3221226 - DNA, 17 bp, Homo sapiens
tggtagggacttaaaaa

SEQ ID NO: 3221227 - DNA, 18 bp, Homo sapiens
tggtaggtagcacagtgg

SEQ ID NO: 3221228 - DNA, 20 bp, Homo sapiens
tggtagttagtagcatgttg

SEQ ID NO: 3221229 - DNA, 18 bp, Homo sapiens
tggtataatgtttaaatc

SEQ ID NO: 3221230 - DNA, 16 bp, Homo sapiens
tggtatatccaaaagc

SEQ ID NO: 3221231 - DNA, 14 bp, Homo sapiens
tggtatcaaaatta

SEQ ID NO: 3221232 - DNA, 19 bp, Homo sapiens
tggtatctgggtaagaaga

SEQ ID NO: 3221233 - DNA, 20 bp, Homo sapiens
tggtatcttgttagagagct

SEQ ID NO: 3221234 - DNA, 17 bp, Homo sapiens
tggtatgaataattgca

SEQ ID NO: 3221235 - DNA, 19 bp, Homo sapiens
tggtatgctggccagcacc

SEQ ID NO: 3221236 - DNA, 20 bp, Homo sapiens
tggtattacactgtatttgt

SEQ ID NO: 3221237 - DNA, 19 bp, Homo sapiens
tggtattcaggattacatg

SEQ ID NO: 3221238 - DNA, 18 bp, Homo sapiens
tggtattttaagagaaaa

SEQ ID NO: 3221239 - DNA, 14 bp, Homo sapiens
tggtattttatttt

SEQ ID NO: 3221240 - DNA, 15 bp, Homo sapiens
tggtcaagattttga

SEQ ID NO: 3221241 - DNA, 23 bp, Homo sapiens
tggtcaatacacataagaccgtg

SEQ ID NO: 3221242 - DNA, 21 bp, Homo sapiens
tggtcacagcggaggtgtgga

SEQ ID NO: 3221243 - DNA, 19 bp, Homo sapiens
tggtcacaggactctgcct

SEQ ID NO: 3221244 - DNA, 18 bp, Homo sapiens
tggtcaccaaatcagctg

SEQ ID NO: 3221245 - DNA, 21 bp, Homo sapiens
tggtcactaaccaacaaggtt

SEQ ID NO: 3221246 - DNA, 16 bp, Homo sapiens
tggtcagagacggcag

SEQ ID NO: 3221247 - DNA, 15 bp, Homo sapiens
tggtcagagccactc

SEQ ID NO: 3221248 - DNA, 12 bp, Homo sapiens
tggtcagagtgc

SEQ ID NO: 3221249 - DNA, 15 bp, Homo sapiens
tggtcagagtgccac

SEQ ID NO: 3221250 - DNA, 17 bp, Homo sapiens
tggtcagagtgccactg

SEQ ID NO: 3221251 - DNA, 19 bp, Homo sapiens
tggtcagctcccttctctg

SEQ ID NO: 3221252 - DNA, 15 bp, Homo sapiens
tggtcagcttttgtt

SEQ ID NO: 3221253 - DNA, 23 bp, Homo sapiens
tggtcatgaatagaaaaaaaaca

SEQ ID NO: 3221254 - DNA, 18 bp, Homo sapiens
tggtcattttatgttaag

SEQ ID NO: 3221255 - DNA, 20 bp, Homo sapiens
tggtccaaaaaaaggaaaaa

SEQ ID NO: 3221256 - DNA, 21 bp, Homo sapiens
tggtccaaaaaaaggaaaaat

SEQ ID NO: 3221257 - DNA, 21 bp, Homo sapiens
tggtccaaaagattgctgaaa

SEQ ID NO: 3221258 - DNA, 19 bp, Homo sapiens
tggtccaattagtttcctt

SEQ ID NO: 3221259 - DNA, 21 bp, Homo sapiens
tggtccaattagtttcctttt

SEQ ID NO: 3221260 - DNA, 15 bp, Homo sapiens
tggtccagctctgac

SEQ ID NO: 3221261 - DNA, 20 bp, Homo sapiens
tggtccagctctgacatccc

SEQ ID NO: 3221262 - DNA, 22 bp, Homo sapiens
tggtccagctctgacatccctt

SEQ ID NO: 3221263 - DNA, 21 bp, Homo sapiens
tggtccagggctagtgacttg

SEQ ID NO: 3221264 - DNA, 18 bp, Homo sapiens
tggtcccaagacagtgag

SEQ ID NO: 3221265 - DNA, 17 bp, Homo sapiens
tggtcccatccaggcag

SEQ ID NO: 3221266 - DNA, 13 bp, Homo sapiens
tggtccccgagac

SEQ ID NO: 3221267 - DNA, 17 bp, Homo sapiens
tggtccccgttccaccc

SEQ ID NO: 3221268 - DNA, 14 bp, Homo sapiens
tggtcccctcctca

SEQ ID NO: 3221269 - DNA, 14 bp, Homo sapiens
tggtccctcgtcca

SEQ ID NO: 3221270 - DNA, 22 bp, Homo sapiens
tgtagcctgtgcatgtatgtct

SEQ ID NO: 3221271 - DNA, 16 bp, Homo sapiens
tgtagccttgcccgga

SEQ ID NO: 3221272 - DNA, 17 bp, Homo sapiens
tgtagcgtgtttacatg

SEQ ID NO: 3221273 - DNA, 18 bp, Homo sapiens
tgtagctacaagggaagc

SEQ ID NO: 3221274 - DNA, 15 bp, Homo sapiens
tgtagctatttttct

SEQ ID NO: 3221275 - DNA, 14 bp, Homo sapiens
tgtagctctgcctc

SEQ ID NO: 3221276 - DNA, 13 bp, Homo sapiens
tgtagctgatgaa

SEQ ID NO: 3221277 - DNA, 14 bp, Homo sapiens
tgtagctggtttcc

SEQ ID NO: 3221278 - DNA, 12 bp, Homo sapiens
tgtagctgtaaa

SEQ ID NO: 3221279 - DNA, 14 bp, Homo sapiens
tgtagctgtaaaac

SEQ ID NO: 3221280 - DNA, 17 bp, Homo sapiens
tgtagctgtaaaacgct

SEQ ID NO: 3221281 - DNA, 17 bp, Homo sapiens
tgtagctgtaagggcag

SEQ ID NO: 3221282 - DNA, 18 bp, Homo sapiens
tgtagctgtaagggcagt

SEQ ID NO: 3221283 - DNA, 18 bp, Homo sapiens
tgtaggaaggttaatgtt

SEQ ID NO: 3221284 - DNA, 14 bp, Homo sapiens
tgtaggactgtata

SEQ ID NO: 3221285 - DNA, 12 bp, Homo sapiens
tgtaggctgggg

SEQ ID NO: 3221286 - DNA, 17 bp, Homo sapiens
tgtaggcttagtttgtg

SEQ ID NO: 3221287 - DNA, 15 bp, Homo sapiens
tgtagggctggacct

SEQ ID NO: 3221288 - DNA, 16 bp, Homo sapiens
tgtagggctggaccta

SEQ ID NO: 3221289 - DNA, 17 bp, Homo sapiens
tgtaggggccacctcct

SEQ ID NO: 3221290 - DNA, 19 bp, Homo sapiens
tgtaggtaaaatgtatttt

SEQ ID NO: 3221291 - DNA, 17 bp, Homo sapiens
tgtaggtatgaataagt

SEQ ID NO: 3221292 - DNA, 12 bp, Homo sapiens
tgtatgtgaaag

SEQ ID NO: 3221293 - DNA, 11 bp, Homo sapiens
tgtatgtgaac

SEQ ID NO: 3221294 - DNA, 16 bp, Homo sapiens
tgtatgtgcactgtca

SEQ ID NO: 3221295 - DNA, 17 bp, Homo sapiens
tgtatgtgcactgtcac

SEQ ID NO: 3221296 - DNA, 19 bp, Homo sapiens
tgtatgtgcactgtcactt

SEQ ID NO: 3221297 - DNA, 16 bp, Homo sapiens
tgtatgtgccatttat

SEQ ID NO: 3221298 - DNA, 21 bp, Homo sapiens
tgtatgtgtctgctaatgtaa

SEQ ID NO: 3221299 - DNA, 18 bp, Homo sapiens
tgtatgtgtgaaacaatg

SEQ ID NO: 3221300 - DNA, 15 bp, Homo sapiens
tgtatgttaaagaga

SEQ ID NO: 3221301 - DNA, 15 bp, Homo sapiens
tgtatgttatgaaca

SEQ ID NO: 3221302 - DNA, 12 bp, Homo sapiens
tgtatgttgtac

SEQ ID NO: 3221303 - DNA, 20 bp, Homo sapiens
tgtatgttgtacaatcaaaa

SEQ ID NO: 3221304 - DNA, 15 bp, Homo sapiens
tgtatgtttacatat

SEQ ID NO: 3221305 - DNA, 14 bp, Homo sapiens
tgtatgtttgcaca

SEQ ID NO: 3221306 - DNA, 19 bp, Homo sapiens
tgtattaacaaaagttccc

SEQ ID NO: 3221307 - DNA, 11 bp, Homo sapiens
tgtattaataa

SEQ ID NO: 3221308 - DNA, 17 bp, Homo sapiens
tgtattaataaagcatt

SEQ ID NO: 3221309 - DNA, 18 bp, Homo sapiens
tgtattaataaagcattc

SEQ ID NO: 3221310 - DNA, 19 bp, Homo sapiens
tgtattaataaagcattct

SEQ ID NO: 3221311 - DNA, 14 bp, Homo sapiens
tgtattactttaat

SEQ ID NO: 3221312 - DNA, 16 bp, Homo sapiens
tgtattactttctctg

SEQ ID NO: 3221313 - DNA, 17 bp, Homo sapiens
tgtattactttctctgt

SEQ ID NO: 3221314 - DNA, 21 bp, Homo sapiens
tgtattaggtgtcatttccat

SEQ ID NO: 3221315 - DNA, 16 bp, Homo sapiens
tgtattatttggagtt

SEQ ID NO: 3221316 - DNA, 23 bp, Homo sapiens
tgtattcacgtgcagcagcaaca

SEQ ID NO: 3221317 - DNA, 15 bp, Homo sapiens
tgtattcccttgtat

SEQ ID NO: 3221318 - DNA, 13 bp, Homo sapiens
tgtattcctgaaa

SEQ ID NO: 3221319 - DNA, 15 bp, Homo sapiens
tgtattcttctgtat

SEQ ID NO: 3221320 - DNA, 13 bp, Homo sapiens
tgtattgacttta

SEQ ID NO: 3221321 - DNA, 22 bp, Homo sapiens
tgtattgactttatgttgtatg

SEQ ID NO: 3221322 - DNA, 15 bp, Homo sapiens
tgtattgagatttct

SEQ ID NO: 3221323 - DNA, 15 bp, Homo sapiens
tgtattgcacattgt

SEQ ID NO: 3221324 - DNA, 17 bp, Homo sapiens
tgtattggctctgtgaa

SEQ ID NO: 3221325 - DNA, 19 bp, Homo sapiens
tgtattgtaaacatgtgtt

SEQ ID NO: 3221326 - DNA, 21 bp, Homo sapiens
tgtatttaaagaaaataaaca

SEQ ID NO: 3221327 - DNA, 13 bp, Homo sapiens
tgtatttaattgt

SEQ ID NO: 3221328 - DNA, 23 bp, Homo sapiens
tgtatttaattgtaaactgtact

SEQ ID NO: 3221329 - DNA, 21 bp, Homo sapiens
tgtatttatattttgtgctat

SEQ ID NO: 3221330 - DNA, 16 bp, Homo sapiens
tgtatttatgtgtata

SEQ ID NO: 3221331 - DNA, 13 bp, Homo sapiens
tgtatttattaat

SEQ ID NO: 3221332 - DNA, 15 bp, Homo sapiens
tgtatttattatttg

SEQ ID NO: 3221333 - DNA, 15 bp, Homo sapiens
tgtatttccagtgca

SEQ ID NO: 3221334 - DNA, 18 bp, Homo sapiens
tgtatttcttatacgctt

SEQ ID NO: 3221335 - DNA, 15 bp, Homo sapiens
tgtatttgagcatat

SEQ ID NO: 3221336 - DNA, 19 bp, Homo sapiens
tgtatttgttcatgtttgg

SEQ ID NO: 3221337 - DNA, 20 bp, Homo sapiens
tgtattttaacactttgtat

SEQ ID NO: 3221338 - DNA, 13 bp, Homo sapiens
tgtattttacaca

SEQ ID NO: 3221339 - DNA, 18 bp, Homo sapiens
tgtattttatttagacaa

SEQ ID NO: 3221340 - DNA, 14 bp, Homo sapiens
tgtattttcagctc

SEQ ID NO: 3221341 - DNA, 12 bp, Homo sapiens
tgtattttcatg

SEQ ID NO: 3221342 - DNA, 16 bp, Homo sapiens
tgtattttcatgaaaa

SEQ ID NO: 3221343 - DNA, 15 bp, Homo sapiens
tgtattttgaagaat

SEQ ID NO: 3221344 - DNA, 14 bp, Homo sapiens
tgtattttgttaaa

SEQ ID NO: 3221345 - DNA, 18 bp, Homo sapiens
tgtattttgttaaagctg

SEQ ID NO: 3221346 - DNA, 13 bp, Homo sapiens
tgtatttttagta

SEQ ID NO: 3221347 - DNA, 23 bp, Homo sapiens
tgtatttttgattgttatgtaaa

SEQ ID NO: 3221348 - DNA, 21 bp, Homo sapiens
tgtattttttaaaattgattt

SEQ ID NO: 3221349 - DNA, 17 bp, Homo sapiens
tgtattttttatttaca

SEQ ID NO: 3221350 - DNA, 20 bp, Homo sapiens
tgtattttttatttacattt

SEQ ID NO: 3221351 - DNA, 21 bp, Homo sapiens
tgtatttttttttctaagaga

SEQ ID NO: 3221352 - DNA, 14 bp, Homo sapiens
tgtcaaaacactgt

SEQ ID NO: 3221353 - DNA, 17 bp, Homo sapiens
tgtcaaaagttggacta

SEQ ID NO: 3221354 - DNA, 20 bp, Homo sapiens
tgtcaaaagttggactaaat

SEQ ID NO: 3221355 - DNA, 18 bp, Homo sapiens
tgtcaaactgtagaaatg

SEQ ID NO: 3221356 - DNA, 14 bp, Homo sapiens
tgtcaaagatgccc

SEQ ID NO: 3221357 - DNA, 16 bp, Homo sapiens
tgtcaaataaagcaaa

SEQ ID NO: 3221358 - DNA, 22 bp, Homo sapiens
tgtcaacacccctgtgtggatg

SEQ ID NO: 3221359 - DNA, 20 bp, Homo sapiens
tgtcaacttctggctcctca

SEQ ID NO: 3221360 - DNA, 14 bp, Homo sapiens
tgtcaagacatttc

SEQ ID NO: 3221361 - DNA, 15 bp, Homo sapiens
tgtcaagccataatt

SEQ ID NO: 3221362 - DNA, 19 bp, Homo sapiens
tgtcaagctgaccttgctg

SEQ ID NO: 3221363 - DNA, 19 bp, Homo sapiens
tgtcaagtacaagcaagac

SEQ ID NO: 3221364 - DNA, 18 bp, Homo sapiens
tgtcaagtctctgctggc

SEQ ID NO: 3221365 - DNA, 18 bp, Homo sapiens
tgtcaagttaacaaggaa

SEQ ID NO: 3221366 - DNA, 15 bp, Homo sapiens
tgtcaagttgtgctt

SEQ ID NO: 3221367 - DNA, 16 bp, Homo sapiens
tgtcaataaacagctt

SEQ ID NO: 3221368 - DNA, 21 bp, Homo sapiens
tgtcaatattaaatacagaca

SEQ ID NO: 3221369 - DNA, 17 bp, Homo sapiens
tgtcaatgattattttc

SEQ ID NO: 3221370 - DNA, 15 bp, Homo sapiens
tgtcacaaattgatc

SEQ ID NO: 3221371 - DNA, 21 bp, Homo sapiens
tgtcacaaattgatcaagata

SEQ ID NO: 3221372 - DNA, 17 bp, Homo sapiens
tgtcacaacctctctga

SEQ ID NO: 3221373 - DNA, 19 bp, Homo sapiens
tgtcacaatcctaacacat

SEQ ID NO: 3221374 - DNA, 13 bp, Homo sapiens
tgtcacactaaaa

SEQ ID NO: 3221375 - DNA, 13 bp, Homo sapiens
tgtcacacttgtg

SEQ ID NO: 3221376 - DNA, 17 bp, Homo sapiens
tgtcacaggcaggtcca

SEQ ID NO: 3221377 - DNA, 16 bp, Homo sapiens
tgtcacagtaaaaata

SEQ ID NO: 3221378 - DNA, 23 bp, Homo sapiens
tgtcacagtaaaaataaaatact

SEQ ID NO: 3221379 - DNA, 15 bp, Homo sapiens
tgtcacatcagataa

SEQ ID NO: 3221380 - DNA, 14 bp, Homo sapiens
tgtcacattctatt

SEQ ID NO: 3221381 - DNA, 23 bp, Homo sapiens
tgtcaccaaggaaacgctacctc

SEQ ID NO: 3221382 - DNA, 14 bp, Homo sapiens
tgtcaccagttaaa

SEQ ID NO: 3221383 - DNA, 16 bp, Homo sapiens
tgtcaccgtgagcagc

SEQ ID NO: 3221384 - DNA, 22 bp, Homo sapiens
tgtcaccgtgagcagctttgga

SEQ ID NO: 3221385 - DNA, 21 bp, Homo sapiens
tgtcacctctctcagagcatc

SEQ ID NO: 3221386 - DNA, 15 bp, Homo sapiens
tgtcacgtactgtct

SEQ ID NO: 3221387 - DNA, 20 bp, Homo sapiens
tgtcactgacacaaaggaag

SEQ ID NO: 3221388 - DNA, 19 bp, Homo sapiens
tgtcactggctggctccta

SEQ ID NO: 3221389 - DNA, 20 bp, Homo sapiens
tgtcactggctggctcctag

SEQ ID NO: 3221390 - DNA, 21 bp, Homo sapiens
tgtcactggctggctcctagg

SEQ ID NO: 3221391 - DNA, 18 bp, Homo sapiens
tgtcactgtttctctgct

SEQ ID NO: 3221392 - DNA, 18 bp, Homo sapiens
tgtcacttgtgctttgct

SEQ ID NO: 3221393 - DNA, 15 bp, Homo sapiens
tgtcactttgctctg

SEQ ID NO: 3221394 - DNA, 17 bp, Homo sapiens
tgtcactttgctctggg

SEQ ID NO: 3221395 - DNA, 18 bp, Homo sapiens
tgtcactttgctctgggt

SEQ ID NO: 3221396 - DNA, 22 bp, Homo sapiens
tgtcactttttaaaccactgta

SEQ ID NO: 3221397 - DNA, 16 bp, Homo sapiens
tgtcactttttctgat

SEQ ID NO: 3221398 - DNA, 16 bp, Homo sapiens
tgtcagaaacatgaaa

SEQ ID NO: 3221399 - DNA, 21 bp, Homo sapiens
tgtcagaaaccagttatgtga

SEQ ID NO: 3221400 - DNA, 15 bp, Homo sapiens
tgtcagaagcctcca

SEQ ID NO: 3221401 - DNA, 22 bp, Homo sapiens
tgtcagaatgctattgaaaatg

SEQ ID NO: 3221402 - DNA, 21 bp, Homo sapiens
tgtcagacagaacttgaatgt

SEQ ID NO: 3221403 - DNA, 14 bp, Homo sapiens
tgtcagactttaaa

SEQ ID NO: 3221404 - DNA, 18 bp, Homo sapiens
tgtaaagtatgtaaacag

SEQ ID NO: 3221405 - DNA, 16 bp, Homo sapiens
tgtaaagtgtaaatcc

SEQ ID NO: 3221406 - DNA, 14 bp, Homo sapiens
tgtaaataaaaaga

SEQ ID NO: 3221407 - DNA, 20 bp, Homo sapiens
tgtaaataaaatgtgtacag

SEQ ID NO: 3221408 - DNA, 15 bp, Homo sapiens
tgtaaataagagatt

SEQ ID NO: 3221409 - DNA, 16 bp, Homo sapiens
tgtaaatacaggaaga

SEQ ID NO: 3221410 - DNA, 11 bp, Homo sapiens
tgtaaatacca

SEQ ID NO: 3221411 - DNA, 15 bp, Homo sapiens
tgtaaataccaggat

SEQ ID NO: 3221412 - DNA, 15 bp, Homo sapiens
tgtaaatagctcagg

SEQ ID NO: 3221413 - DNA, 16 bp, Homo sapiens
tgtaaatagtatttga

SEQ ID NO: 3221414 - DNA, 15 bp, Homo sapiens
tgtaaatattctata

SEQ ID NO: 3221415 - DNA, 20 bp, Homo sapiens
tgtaaatattctatatgaat

SEQ ID NO: 3221416 - DNA, 13 bp, Homo sapiens
tgtaaatatttat

SEQ ID NO: 3221417 - DNA, 20 bp, Homo sapiens
tgtaaatcctagacttgaaa

SEQ ID NO: 3221418 - DNA, 16 bp, Homo sapiens
tgtaaatcctgccatt

SEQ ID NO: 3221419 - DNA, 22 bp, Homo sapiens
tgtaaatcctttttctttataa

SEQ ID NO: 3221420 - DNA, 15 bp, Homo sapiens
tgtaaatctgccaca

SEQ ID NO: 3221421 - DNA, 18 bp, Homo sapiens
tgtaaatgcctcttaaat

SEQ ID NO: 3221422 - DNA, 16 bp, Homo sapiens
tgtaaatggttttgtt

SEQ ID NO: 3221423 - DNA, 13 bp, Homo sapiens
tgtaaatgtttct

SEQ ID NO: 3221424 - DNA, 23 bp, Homo sapiens
tgtaaattaggaggctcaacaat

SEQ ID NO: 3221425 - DNA, 17 bp, Homo sapiens
tgtaaattgaacttccc

SEQ ID NO: 3221426 - DNA, 19 bp, Homo sapiens
tgtaacaattgtgtagcct

SEQ ID NO: 3221427 - DNA, 20 bp, Homo sapiens
tgtaacaattgtgtagcctt

SEQ ID NO: 3221428 - DNA, 13 bp, Homo sapiens
tgtaacactgtgt

SEQ ID NO: 3221429 - DNA, 22 bp, Homo sapiens
tgtaacatcactatccatgcac

SEQ ID NO: 3221430 - DNA, 17 bp, Homo sapiens
tgtaaccagtgcagaaa

SEQ ID NO: 3221431 - DNA, 22 bp, Homo sapiens
tgtaaccagtgcagaaatgaaa

SEQ ID NO: 3221432 - DNA, 19 bp, Homo sapiens
tgtaacctgttgctgtgtt

SEQ ID NO: 3221433 - DNA, 18 bp, Homo sapiens
tgtaactacaaagctttg

SEQ ID NO: 3221434 - DNA, 17 bp, Homo sapiens
tgtaactactttataac

SEQ ID NO: 3221435 - DNA, 13 bp, Homo sapiens
tgtaacttatgta

SEQ ID NO: 3221436 - DNA, 22 bp, Homo sapiens
tgtaacttatgtagatatttgg

SEQ ID NO: 3221437 - DNA, 17 bp, Homo sapiens
tgtaacttttaatccct

SEQ ID NO: 3221438 - DNA, 15 bp, Homo sapiens
tgtaacttttgtaag

SEQ ID NO: 3221439 - DNA, 15 bp, Homo sapiens
tgtaagaaaacaaaa

SEQ ID NO: 3221440 - DNA, 20 bp, Homo sapiens
tgtaagacaaaggttttcct

SEQ ID NO: 3221441 - DNA, 15 bp, Homo sapiens
tgtaagacatttgta

SEQ ID NO: 3221442 - DNA, 22 bp, Homo sapiens
tgtaagacccttattgctgtcc

SEQ ID NO: 3221443 - DNA, 19 bp, Homo sapiens
tgtaagagcaccttcctca

SEQ ID NO: 3221444 - DNA, 22 bp, Homo sapiens
tgtaagagcaccttcctcactt

SEQ ID NO: 3221445 - DNA, 20 bp, Homo sapiens
tgtaagagtgtagaagcatt

SEQ ID NO: 3221446 - DNA, 21 bp, Homo sapiens
tgtaagagtgtagaagcattc

SEQ ID NO: 3221447 - DNA, 14 bp, Homo sapiens
tgtaagatgctggg

SEQ ID NO: 3221448 - DNA, 19 bp, Homo sapiens
tgtaagattatagattcta

SEQ ID NO: 3221449 - DNA, 20 bp, Homo sapiens
tgtaagattatagattctaa

SEQ ID NO: 3221450 - DNA, 22 bp, Homo sapiens
tgtaagattatagattctaaag

SEQ ID NO: 3221451 - DNA, 20 bp, Homo sapiens
tgtaagcatactttgtaaat

SEQ ID NO: 3221452 - DNA, 20 bp, Homo sapiens
tgtaagccaaagaaatgaac

SEQ ID NO: 3221453 - DNA, 19 bp, Homo sapiens
tgtaagctctttgaaacaa

SEQ ID NO: 3221454 - DNA, 14 bp, Homo sapiens
tgtaagctgtttat

SEQ ID NO: 3221455 - DNA, 15 bp, Homo sapiens
tgtaagctgtttatt

SEQ ID NO: 3221456 - DNA, 21 bp, Homo sapiens
tgtaaggatccggaaagaaga

SEQ ID NO: 3221457 - DNA, 15 bp, Homo sapiens
tgtaaggctctagat

SEQ ID NO: 3221458 - DNA, 12 bp, Homo sapiens
tgtaagggcagt

SEQ ID NO: 3221459 - DNA, 15 bp, Homo sapiens
tgtaagggcagtgcc

SEQ ID NO: 3221460 - DNA, 21 bp, Homo sapiens
tgtaagtaaattgcctgattt

SEQ ID NO: 3221461 - DNA, 21 bp, Homo sapiens
tgtaagtaacttcacattaaa

SEQ ID NO: 3221462 - DNA, 14 bp, Homo sapiens
tgtaagtaattatc

SEQ ID NO: 3221463 - DNA, 22 bp, Homo sapiens
tgtaagtcatctacttaataaa

SEQ ID NO: 3221464 - DNA, 19 bp, Homo sapiens
tgtaagtgaagtaaaactt

SEQ ID NO: 3221465 - DNA, 12 bp, Homo sapiens
tgtaagtgtgag

SEQ ID NO: 3221466 - DNA, 15 bp, Homo sapiens
tgtaagtgtgtgtgt

SEQ ID NO: 3221467 - DNA, 21 bp, Homo sapiens
tgtaagttgtacaaatgtatt

SEQ ID NO: 3221468 - DNA, 14 bp, Homo sapiens
tgtaagtttcaggt

SEQ ID NO: 3221469 - DNA, 13 bp, Homo sapiens
tgtaataaacttt

SEQ ID NO: 3221470 - DNA, 15 bp, Homo sapiens
tgtaataaactttaa

SEQ ID NO: 3221471 - DNA, 17 bp, Homo sapiens
tgtaataaactttaata

SEQ ID NO: 3221472 - DNA, 16 bp, Homo sapiens
tgtaataaagtatata

SEQ ID NO: 3221473 - DNA, 19 bp, Homo sapiens
tgtaataaagtatataatt

SEQ ID NO: 3221474 - DNA, 19 bp, Homo sapiens
tgtaataaagtgttttcag

SEQ ID NO: 3221475 - DNA, 12 bp, Homo sapiens
tgtaataaattc

SEQ ID NO: 3221476 - DNA, 13 bp, Homo sapiens
tgtaataaattca

SEQ ID NO: 3221477 - DNA, 12 bp, Homo sapiens
tgtaataagaca

SEQ ID NO: 3221478 - DNA, 14 bp, Homo sapiens
tgtaataagacata

SEQ ID NO: 3221479 - DNA, 15 bp, Homo sapiens
tgtaataagacataa

SEQ ID NO: 3221480 - DNA, 18 bp, Homo sapiens
tgtaataagacataacgt

SEQ ID NO: 3221481 - DNA, 13 bp, Homo sapiens
tgtaataatacct

SEQ ID NO: 3221482 - DNA, 16 bp, Homo sapiens
tgtaataatacctcaa

SEQ ID NO: 3221483 - DNA, 17 bp, Homo sapiens
tgtaataatacctcaat

SEQ ID NO: 3221484 - DNA, 21 bp, Homo sapiens
tgtaataatacctcaatgttt

SEQ ID NO: 3221485 - DNA, 14 bp, Homo sapiens
tgtaataattgctc

SEQ ID NO: 3221486 - DNA, 14 bp, Homo sapiens
tgtaatagttcagt

SEQ ID NO: 3221487 - DNA, 22 bp, Homo sapiens
tgtaatagttcagtagaattac

SEQ ID NO: 3221488 - DNA, 17 bp, Homo sapiens
tgtaatataaagtattc

SEQ ID NO: 3221489 - DNA, 16 bp, Homo sapiens
tgtaatatattgtaca

SEQ ID NO: 3221490 - DNA, 20 bp, Homo sapiens
tgtaatcaatgtttcttcta

SEQ ID NO: 3221491 - DNA, 16 bp, Homo sapiens
tgtaatcagctctcct

SEQ ID NO: 3221492 - DNA, 18 bp, Homo sapiens
tgtaatcagctctcctgg

SEQ ID NO: 3221493 - DNA, 19 bp, Homo sapiens
tgtaatcagctctcctggc

SEQ ID NO: 3221494 - DNA, 22 bp, Homo sapiens
tgtaatcccagcactttgggag

SEQ ID NO: 3221495 - DNA, 23 bp, Homo sapiens
tgtaatcccagcactttgggagg

SEQ ID NO: 3221496 - DNA, 17 bp, Homo sapiens
tgtaatcccagctactt

SEQ ID NO: 3221497 - DNA, 20 bp, Homo sapiens
tgtaatctttcatccaaaat

SEQ ID NO: 3221498 - DNA, 21 bp, Homo sapiens
tgtaatctttcatccaaaata

SEQ ID NO: 3221499 - DNA, 21 bp, Homo sapiens
tgtaatgaaaatgaatatcta

SEQ ID NO: 3221500 - DNA, 15 bp, Homo sapiens
tgtaatgaagtaaag

SEQ ID NO: 3221501 - DNA, 16 bp, Homo sapiens
tgtaatgcactgtttt

SEQ ID NO: 3221502 - DNA, 19 bp, Homo sapiens
tgtaatgcactgtttttaa

SEQ ID NO: 3221503 - DNA, 13 bp, Homo sapiens
tgtaatgctgcac

SEQ ID NO: 3221504 - DNA, 17 bp, Homo sapiens
tgtaatggaactgaccc

SEQ ID NO: 3221505 - DNA, 23 bp, Homo sapiens
tgtaatgtgtgaaaaagatgcca

SEQ ID NO: 3221506 - DNA, 20 bp, Homo sapiens
tgtaatgtgtggtggcctca

SEQ ID NO: 3221507 - DNA, 22 bp, Homo sapiens
tgtaatgttactgatcatgcat

SEQ ID NO: 3221508 - DNA, 18 bp, Homo sapiens
tgtaattaaattatggta

SEQ ID NO: 3221509 - DNA, 20 bp, Homo sapiens
tgtaattaagtaaaccaaaa

SEQ ID NO: 3221510 - DNA, 21 bp, Homo sapiens
tgtaattaagtactatgtatc

SEQ ID NO: 3221511 - DNA, 23 bp, Homo sapiens
tgtaattaagtactatgtatcaa

SEQ ID NO: 3221512 - DNA, 12 bp, Homo sapiens
tgtaattacagg

SEQ ID NO: 3221513 - DNA, 20 bp, Homo sapiens
tgtaattacaggagggaaca

SEQ ID NO: 3221514 - DNA, 14 bp, Homo sapiens
tgtaattgcttaca

SEQ ID NO: 3221515 - DNA, 16 bp, Homo sapiens
tgtaattgcttacatt

SEQ ID NO: 3221516 - DNA, 10 bp, Homo sapiens
tgtaattgtg

SEQ ID NO: 3221517 - DNA, 19 bp, Homo sapiens
tgtaatttaaacaggccca

SEQ ID NO: 3221518 - DNA, 23 bp, Homo sapiens
tgtaatttaaacaggcccagcat

SEQ ID NO: 3221519 - DNA, 15 bp, Homo sapiens
tgtaatttaaatgaa

SEQ ID NO: 3221520 - DNA, 16 bp, Homo sapiens
tgtaatttaaatgaaa

SEQ ID NO: 3221521 - DNA, 17 bp, Homo sapiens
tgtaatttaaatgaaag

SEQ ID NO: 3221522 - DNA, 15 bp, Homo sapiens
tgtaatttataaaat

SEQ ID NO: 3221523 - DNA, 13 bp, Homo sapiens
tgtaatttgtgta

SEQ ID NO: 3221524 - DNA, 20 bp, Homo sapiens
tgtaatttgtgtaataaagt

SEQ ID NO: 3221525 - DNA, 16 bp, Homo sapiens
tgtaattttatatgaa

SEQ ID NO: 3221526 - DNA, 23 bp, Homo sapiens
tgtaattttattttaaaatttca

SEQ ID NO: 3221527 - DNA, 16 bp, Homo sapiens
tgtacaaaattaagca

SEQ ID NO: 3221528 - DNA, 21 bp, Homo sapiens
tgtacaaagttttcctttgta

SEQ ID NO: 3221529 - DNA, 22 bp, Homo sapiens
tgtacaaagttttcctttgtaa

SEQ ID NO: 3221530 - DNA, 17 bp, Homo sapiens
tgtacaaatgtaagcaa

SEQ ID NO: 3221531 - DNA, 20 bp, Homo sapiens
tgtacaaattgtcgttttta

SEQ ID NO: 3221532 - DNA, 20 bp, Homo sapiens
tgtacaagagtccctttgaa

SEQ ID NO: 3221533 - DNA, 19 bp, Homo sapiens
tgcttgcggcaaaaggaaa

SEQ ID NO: 3221534 - DNA, 18 bp, Homo sapiens
tgcttgctcatatgcatg

SEQ ID NO: 3221535 - DNA, 19 bp, Homo sapiens
tgcttgcttacaatcttta

SEQ ID NO: 3221536 - DNA, 15 bp, Homo sapiens
tgcttgggctccacg

SEQ ID NO: 3221537 - DNA, 12 bp, Homo sapiens
tgcttgggctga

SEQ ID NO: 3221538 - DNA, 13 bp, Homo sapiens
tgcttgggctgac

SEQ ID NO: 3221539 - DNA, 12 bp, Homo sapiens
tgcttggggcta

SEQ ID NO: 3221540 - DNA, 14 bp, Homo sapiens
tgcctgggcctgtg

SEQ ID NO: 3221541 - DNA, 17 bp, Homo sapiens
tgcctgggcctgtgcag

SEQ ID NO: 3221542 - DNA, 20 bp, Homo sapiens
tgcctgggcctgtgcagcag

SEQ ID NO: 3221543 - DNA, 23 bp, Homo sapiens
tgcctgggcctgtgcagcagccc

SEQ ID NO: 3221544 - DNA, 16 bp, Homo sapiens
tgcctgggctgttggc

SEQ ID NO: 3221545 - DNA, 14 bp, Homo sapiens
tgcctgggggagtt

SEQ ID NO: 3221546 - DNA, 19 bp, Homo sapiens
tgcctgggggagttttcct

SEQ ID NO: 3221547 - DNA, 20 bp, Homo sapiens
tgcctgggggagttttcctc

SEQ ID NO: 3221548 - DNA, 21 bp, Homo sapiens
tgcctgggggagttttcctct

SEQ ID NO: 3221549 - DNA, 17 bp, Homo sapiens
tgcctggggtctgagca

SEQ ID NO: 3221550 - DNA, 15 bp, Homo sapiens
tgcctgggtgggaca

SEQ ID NO: 3221551 - DNA, 20 bp, Homo sapiens
tgcctgggtgggacagcctc

SEQ ID NO: 3221552 - DNA, 22 bp, Homo sapiens
tgcctgggttccaatcctggct

SEQ ID NO: 3221553 - DNA, 20 bp, Homo sapiens
tgcctggtatatccaaaagc

SEQ ID NO: 3221554 - DNA, 16 bp, Homo sapiens
tgcctggtcacagggc

SEQ ID NO: 3221555 - DNA, 22 bp, Homo sapiens
tgcctggtcacagggcatgccc

SEQ ID NO: 3221556 - DNA, 19 bp, Homo sapiens
tgcctggtcccagagtggc

SEQ ID NO: 3221557 - DNA, 13 bp, Homo sapiens
tgcggggcagggc

SEQ ID NO: 3221558 - DNA, 24 bp, Homo sapiens
tgcggtcaggctgggcagccccag

SEQ ID NO: 3221559 - DNA, 14 bp, Homo sapiens
tgcggtccacccag

SEQ ID NO: 3221560 - DNA, 16 bp, Homo sapiens
tgcggttaattttgaa

SEQ ID NO: 3221561 - DNA, 14 bp, Homo sapiens
tgcgtcccagctga

SEQ ID NO: 3221562 - DNA, 18 bp, Homo sapiens
tgcgtcccagctgaaggc

SEQ ID NO: 3221563 - DNA, 14 bp, Homo sapiens
tgcgtccccactcc

SEQ ID NO: 3221564 - DNA, 16 bp, Homo sapiens
tgcgtcctcctcacct

SEQ ID NO: 3221565 - DNA, 14 bp, Homo sapiens
tgcgtcctgcagag

SEQ ID NO: 3221566 - DNA, 18 bp, Homo sapiens
tgctccaagattctagat

SEQ ID NO: 3221567 - DNA, 19 bp, Homo sapiens
tgctccaagattctagatg

SEQ ID NO: 3221568 - DNA, 14 bp, Homo sapiens
tgctccaccacatc

SEQ ID NO: 3221569 - DNA, 20 bp, Homo sapiens
tgctccacgaagccttaagc

SEQ ID NO: 3221570 - DNA, 21 bp, Homo sapiens
tgctccacgaagccttaagcc

SEQ ID NO: 3221571 - DNA, 13 bp, Homo sapiens
tgctccaggcctg

SEQ ID NO: 3221572 - DNA, 20 bp, Homo sapiens
tgctccaggcctgcagcagg

SEQ ID NO: 3221573 - DNA, 14 bp, Homo sapiens
tgctccagggtctt

SEQ ID NO: 3221574 - DNA, 19 bp, Homo sapiens
tgctccagggtcttgggct

SEQ ID NO: 3221575 - DNA, 20 bp, Homo sapiens
tgctccatgactggctgtct

SEQ ID NO: 3221576 - DNA, 15 bp, Homo sapiens
tgctcccagcagccc

SEQ ID NO: 3221577 - DNA, 17 bp, Homo sapiens
tgctcccagcagcccta

SEQ ID NO: 3221578 - DNA, 17 bp, Homo sapiens
tgctcccagcctgctga

SEQ ID NO: 3221579 - DNA, 22 bp, Homo sapiens
tgctcccagcctgctgagagcc

SEQ ID NO: 3221580 - DNA, 17 bp, Homo sapiens
tgctcccagctgtgctg

SEQ ID NO: 3221581 - DNA, 19 bp, Homo sapiens
tgctcccattcctccctcc

SEQ ID NO: 3221582 - DNA, 20 bp, Homo sapiens
tgctcccattcctccctccg

SEQ ID NO: 3221583 - DNA, 13 bp, Homo sapiens
tgctccccacagc

SEQ ID NO: 3221584 - DNA, 19 bp, Homo sapiens
tgctccccacagcgtccct

SEQ ID NO: 3221585 - DNA, 23 bp, Homo sapiens
tgctccccacagcgtccctggcg

SEQ ID NO: 3221586 - DNA, 13 bp, Homo sapiens
tgctcccctaacc

SEQ ID NO: 3221587 - DNA, 21 bp, Homo sapiens
tgctccctcagcctcagagga

SEQ ID NO: 3221588 - DNA, 13 bp, Homo sapiens
tgctccctcccct

SEQ ID NO: 3221589 - DNA, 19 bp, Homo sapiens
tgctccctgaagccagcct

SEQ ID NO: 3221590 - DNA, 23 bp, Homo sapiens
tgctccctgctttggctgagggg

SEQ ID NO: 3221591 - DNA, 23 bp, Homo sapiens
tgctccctgtgtccacctgtggg

SEQ ID NO: 3221592 - DNA, 15 bp, Homo sapiens
tgctcccttcagccc

SEQ ID NO: 3221593 - DNA, 23 bp, Homo sapiens
tgctccgcccgctcctgccgcag

SEQ ID NO: 3221594 - DNA, 15 bp, Homo sapiens
tgctccgctcccacc

SEQ ID NO: 3221595 - DNA, 16 bp, Homo sapiens
tgctccgctcccaccg

SEQ ID NO: 3221596 - DNA, 17 bp, Homo sapiens
tgctccgctcccaccgc

SEQ ID NO: 3221597 - DNA, 18 bp, Homo sapiens
tgctccgctcccaccgcc

SEQ ID NO: 3221598 - DNA, 18 bp, Homo sapiens
tgctccgctgctccttgg

SEQ ID NO: 3221599 - DNA, 13 bp, Homo sapiens
tgctccgtgcctc

SEQ ID NO: 3221600 - DNA, 17 bp, Homo sapiens
tgctccgtgcctccacc

SEQ ID NO: 3221601 - DNA, 21 bp, Homo sapiens
tgctcctaaaccattgagcta

SEQ ID NO: 3221602 - DNA, 18 bp, Homo sapiens
tgctcctaactccaccgc

SEQ ID NO: 3221603 - DNA, 13 bp, Homo sapiens
tgctcctagcaga

SEQ ID NO: 3221604 - DNA, 20 bp, Homo sapiens
tgctcctagtttgacctcac

SEQ ID NO: 3221605 - DNA, 14 bp, Homo sapiens
tgctcctcacctgt

SEQ ID NO: 3221606 - DNA, 22 bp, Homo sapiens
tgctcctcactggaggagcagc

SEQ ID NO: 3221607 - DNA, 22 bp, Homo sapiens
tgctcctccctggctgccctgg

SEQ ID NO: 3221608 - DNA, 23 bp, Homo sapiens
tgctcctccctggctgccctggc

SEQ ID NO: 3221609 - DNA, 13 bp, Homo sapiens
tgctcctcctgcc

SEQ ID NO: 3221610 - DNA, 16 bp, Homo sapiens
tgctcctcctgccctg

SEQ ID NO: 3221611 - DNA, 13 bp, Homo sapiens
tgctcctctccag

SEQ ID NO: 3221612 - DNA, 15 bp, Homo sapiens
tgctcctctccaggc

SEQ ID NO: 3221613 - DNA, 16 bp, Homo sapiens
tgctcctctccaggca

SEQ ID NO: 3221614 - DNA, 14 bp, Homo sapiens
tgctcctctcccca

SEQ ID NO: 3221615 - DNA, 15 bp, Homo sapiens
tgctcctgcagcatg

SEQ ID NO: 3221616 - DNA, 14 bp, Homo sapiens
tgctcctggagcct

SEQ ID NO: 3221617 - DNA, 20 bp, Homo sapiens
tgctcctggagcctttgaat

SEQ ID NO: 3221618 - DNA, 12 bp, Homo sapiens
tgctccttggct

SEQ ID NO: 3221619 - DNA, 19 bp, Homo sapiens
tgctccttttgtatcttcc

SEQ ID NO: 3221620 - DNA, 21 bp, Homo sapiens
tgctccttttgtatcttcctt

SEQ ID NO: 3221621 - DNA, 14 bp, Homo sapiens
tgctcgcccaggaa

SEQ ID NO: 3221622 - DNA, 19 bp, Homo sapiens
tgctcgcccaggaaggcct

SEQ ID NO: 3221623 - DNA, 15 bp, Homo sapiens
tgctctaacagccct

SEQ ID NO: 3221624 - DNA, 12 bp, Homo sapiens
tgctctagccag

SEQ ID NO: 3221625 - DNA, 23 bp, Homo sapiens
tgctctagccaggagtctgtgct

SEQ ID NO: 3221626 - DNA, 13 bp, Homo sapiens
tgctctagctggc

SEQ ID NO: 3221627 - DNA, 15 bp, Homo sapiens
tgctctagctggcag

SEQ ID NO: 3221628 - DNA, 18 bp, Homo sapiens
tgctctagctggcaggac

SEQ ID NO: 3221629 - DNA, 19 bp, Homo sapiens
tgctctagctggcaggaca

SEQ ID NO: 3221630 - DNA, 19 bp, Homo sapiens
tgctctaggaagacatttt

SEQ ID NO: 3221631 - DNA, 14 bp, Homo sapiens
tgctctagggaatc

SEQ ID NO: 3221632 - DNA, 20 bp, Homo sapiens
tgctctagggaatctggatt

SEQ ID NO: 3221633 - DNA, 17 bp, Homo sapiens
tgctctatctctcaaaa

SEQ ID NO: 3221634 - DNA, 12 bp, Homo sapiens
tgctctattgta

SEQ ID NO: 3221635 - DNA, 15 bp, Homo sapiens
tgctctcaattaaag

SEQ ID NO: 3221636 - DNA, 14 bp, Homo sapiens
tgctctcactgttt

SEQ ID NO: 3221637 - DNA, 22 bp, Homo sapiens
tgctctcactgtttgtttttat

SEQ ID NO: 3221638 - DNA, 15 bp, Homo sapiens
tgctctcagcctccc

SEQ ID NO: 3221639 - DNA, 15 bp, Homo sapiens
tgctctcccctccca

SEQ ID NO: 3221640 - DNA, 13 bp, Homo sapiens
tgctctcccctgc

SEQ ID NO: 3221641 - DNA, 14 bp, Homo sapiens
tgctctcccctgcc

SEQ ID NO: 3221642 - DNA, 16 bp, Homo sapiens
tgctctcccctgccct

SEQ ID NO: 3221643 - DNA, 22 bp, Homo sapiens
tgctctccctcttctcaagtgc

SEQ ID NO: 3221644 - DNA, 12 bp, Homo sapiens
tgctctcctctt

SEQ ID NO: 3221645 - DNA, 14 bp, Homo sapiens
tgctctcctcttgc

SEQ ID NO: 3221646 - DNA, 18 bp, Homo sapiens
tgctctcctcttgccact

SEQ ID NO: 3221647 - DNA, 22 bp, Homo sapiens
tgctctcctcttgccactgcct

SEQ ID NO: 3221648 - DNA, 20 bp, Homo sapiens
tgctctctcatcttgttctt

SEQ ID NO: 3221649 - DNA, 23 bp, Homo sapiens
tgctctgagaagaggagccctca

SEQ ID NO: 3221650 - DNA, 13 bp, Homo sapiens
tgctctgcccctt

SEQ ID NO: 3221651 - DNA, 14 bp, Homo sapiens
tgctctgccccttg

SEQ ID NO: 3221652 - DNA, 16 bp, Homo sapiens
tgctctgctgacagac

SEQ ID NO: 3221653 - DNA, 16 bp, Homo sapiens
tgctctggaagagagg

SEQ ID NO: 3221654 - DNA, 12 bp, Homo sapiens
tgctctggaata

SEQ ID NO: 3221655 - DNA, 16 bp, Homo sapiens
tgctctggcggcttcc

SEQ ID NO: 3221656 - DNA, 18 bp, Homo sapiens
tgctctggcggcttcctg

SEQ ID NO: 3221657 - DNA, 22 bp, Homo sapiens
tgctctggcggcttcctgtcca

SEQ ID NO: 3221658 - DNA, 23 bp, Homo sapiens
tgctctggcggcttcctgtccac

SEQ ID NO: 3221659 - DNA, 23 bp, Homo sapiens
tgctctgtgtatatctcttggaa

SEQ ID NO: 3221660 - DNA, 21 bp, Homo sapiens
tgctcttagtgcccgcctagg

SEQ ID NO: 3221661 - DNA, 12 bp, Homo sapiens
tgctcttggaaa

SEQ ID NO: 3221662 - DNA, 17 bp, Homo sapiens
tgctcttggaaagctga

SEQ ID NO: 3221663 - DNA, 18 bp, Homo sapiens
tgctcttggaaagctgat

SEQ ID NO: 3221664 - DNA, 21 bp, Homo sapiens
tgctcttgtcccacgtgtctt

SEQ ID NO: 3221665 - DNA, 22 bp, Homo sapiens
tgctcttgtcccacgtgtcttc

SEQ ID NO: 3221666 - DNA, 23 bp, Homo sapiens
tgctcttgtcccacgtgtcttcc

SEQ ID NO: 3221667 - DNA, 16 bp, Homo sapiens
tgctctttcccttttc

SEQ ID NO: 3221668 - DNA, 21 bp, Homo sapiens
tgctctttcccttttctgttt

SEQ ID NO: 3221669 - DNA, 13 bp, Homo sapiens
tgctctttctctg

SEQ ID NO: 3221670 - DNA, 18 bp, Homo sapiens
tgctctttgacaactaaa

SEQ ID NO: 3221671 - DNA, 16 bp, Homo sapiens
tgctcttttaagcagt

SEQ ID NO: 3221672 - DNA, 23 bp, Homo sapiens
tgctcttttaagcagtctcactg

SEQ ID NO: 3221673 - DNA, 13 bp, Homo sapiens
tgctcttttctcc

SEQ ID NO: 3221674 - DNA, 22 bp, Homo sapiens
tgctcttttggtggggagcact

SEQ ID NO: 3221675 - DNA, 15 bp, Homo sapiens
tgctcttttttactc

SEQ ID NO: 3221676 - DNA, 17 bp, Homo sapiens
tgctcttttttactcat

SEQ ID NO: 3221677 - DNA, 20 bp, Homo sapiens
tgctgaaaaccatctggcct

SEQ ID NO: 3221678 - DNA, 15 bp, Homo sapiens
tgctgaacaaaaaat

SEQ ID NO: 3221679 - DNA, 16 bp, Homo sapiens
tgctgaacgcagaaga

SEQ ID NO: 3221680 - DNA, 18 bp, Homo sapiens
tgctgaagggcattcttt

SEQ ID NO: 3221681 - DNA, 15 bp, Homo sapiens
tgctgaatccacctc

SEQ ID NO: 3221682 - DNA, 18 bp, Homo sapiens
tgctgaatgtaaaagaaa

SEQ ID NO: 3221683 - DNA, 19 bp, Homo sapiens
tgctgacagacacaggccc

SEQ ID NO: 3221684 - DNA, 14 bp, Homo sapiens
tgctgacagctctt

SEQ ID NO: 3221685 - DNA, 23 bp, Homo sapiens
tgctgactccacgatcctgccac

SEQ ID NO: 3221686 - DNA, 16 bp, Homo sapiens
tgctgactgtactcct

SEQ ID NO: 3221687 - DNA, 19 bp, Homo sapiens
tgctgactgtactcctccc

SEQ ID NO: 3221688 - DNA, 23 bp, Homo sapiens
tgctgagagaaatatggaactta

SEQ ID NO: 3221689 - DNA, 14 bp, Homo sapiens
tgctgagagccccc

SEQ ID NO: 3221690 - DNA, 13 bp, Homo sapiens
tgcccttgctgcc

SEQ ID NO: 3221691 - DNA, 11 bp, Homo sapiens
tgcccttgggg

SEQ ID NO: 3221692 - DNA, 13 bp, Homo sapiens
tgcccttgtctga

SEQ ID NO: 3221693 - DNA, 12 bp, Homo sapiens
tgccctttccat

SEQ ID NO: 3221694 - DNA, 17 bp, Homo sapiens
tgccctttccatattta

SEQ ID NO: 3221695 - DNA, 14 bp, Homo sapiens
tgccctttcctagg

SEQ ID NO: 3221696 - DNA, 14 bp, Homo sapiens
tgccctttggggtc

SEQ ID NO: 3221697 - DNA, 14 bp, Homo sapiens
tgccgaggagccag

SEQ ID NO: 3221698 - DNA, 17 bp, Homo sapiens
tgccgaggagccaggca

SEQ ID NO: 3221699 - DNA, 20 bp, Homo sapiens
tgccgcaagtctgcagcccg

SEQ ID NO: 3221700 - DNA, 18 bp, Homo sapiens
tgccgcagacgggcacag

SEQ ID NO: 3221701 - DNA, 21 bp, Homo sapiens
tgccgcagacgggcacagaca

SEQ ID NO: 3221702 - DNA, 17 bp, Homo sapiens
tgccgccccctcctgaa

SEQ ID NO: 3221703 - DNA, 14 bp, Homo sapiens
tgccgcctgctcct

SEQ ID NO: 3221704 - DNA, 12 bp, Homo sapiens
tgccgctgcacc

SEQ ID NO: 3221705 - DNA, 14 bp, Homo sapiens
tgccgctgcaccac

SEQ ID NO: 3221706 - DNA, 18 bp, Homo sapiens
tgccgctgccgctgcacc

SEQ ID NO: 3221707 - DNA, 16 bp, Homo sapiens
tgccggatacaaactg

SEQ ID NO: 3221708 - DNA, 17 bp, Homo sapiens
tgccggctgtggagcaa

SEQ ID NO: 3221709 - DNA, 16 bp, Homo sapiens
tgccggtcgggcagcc

SEQ ID NO: 3221710 - DNA, 19 bp, Homo sapiens
tgccggtcgggcagccagc

SEQ ID NO: 3221711 - DNA, 16 bp, Homo sapiens
tgccggtgggaccctg

SEQ ID NO: 3221712 - DNA, 23 bp, Homo sapiens
tgccgtagggagtacctgctgcc

SEQ ID NO: 3221713 - DNA, 20 bp, Homo sapiens
tgcagcccggcgccaccatc

SEQ ID NO: 3221714 - DNA, 16 bp, Homo sapiens
tgcagcccttcctccc

SEQ ID NO: 3221715 - DNA, 16 bp, Homo sapiens
tgcagcccttgggcag

SEQ ID NO: 3221716 - DNA, 15 bp, Homo sapiens
tgcagccgccttcct

SEQ ID NO: 3221717 - DNA, 19 bp, Homo sapiens
tgcagccggcacagggtct

SEQ ID NO: 3221718 - DNA, 18 bp, Homo sapiens
tgcagcctcaacctcctg

SEQ ID NO: 3221719 - DNA, 20 bp, Homo sapiens
tgcagcctcaacctcctggg

SEQ ID NO: 3221720 - DNA, 23 bp, Homo sapiens
tgcagcctcaacctcctgggcta

SEQ ID NO: 3221721 - DNA, 12 bp, Homo sapiens
tgcagcctgctc

SEQ ID NO: 3221722 - DNA, 14 bp, Homo sapiens
tgcagcctgctctt

SEQ ID NO: 3221723 - DNA, 15 bp, Homo sapiens
tgcagccttggggca

SEQ ID NO: 3221724 - DNA, 23 bp, Homo sapiens
tgcagcctttgcctccccggctc

SEQ ID NO: 3221725 - DNA, 13 bp, Homo sapiens
tgcagctcctcag

SEQ ID NO: 3221726 - DNA, 14 bp, Homo sapiens
tgcagctcctcagc

SEQ ID NO: 3221727 - DNA, 15 bp, Homo sapiens
tgcagctcctcagcg

SEQ ID NO: 3221728 - DNA, 20 bp, Homo sapiens
tgcagctcctcagcggctcc

SEQ ID NO: 3221729 - DNA, 18 bp, Homo sapiens
tgcagctgattttaacaa

SEQ ID NO: 3221730 - DNA, 19 bp, Homo sapiens
tgcagctgattttaacaat

SEQ ID NO: 3221731 - DNA, 18 bp, Homo sapiens
tgcagctgggccccatgc

SEQ ID NO: 3221732 - DNA, 23 bp, Homo sapiens
tgcagctgggccccatgctctgc

SEQ ID NO: 3221733 - DNA, 18 bp, Homo sapiens
tgcaggaacgagcactgg

SEQ ID NO: 3221734 - DNA, 23 bp, Homo sapiens
tgcaggaacgagcactggccaga

SEQ ID NO: 3221735 - DNA, 13 bp, Homo sapiens
tgcaggaaggaaa

SEQ ID NO: 3221736 - DNA, 16 bp, Homo sapiens
tgcaggaaggaaaact

SEQ ID NO: 3221737 - DNA, 17 bp, Homo sapiens
tgcaggaataaggcctt

SEQ ID NO: 3221738 - DNA, 12 bp, Homo sapiens
tgcaggacagga

SEQ ID NO: 3221739 - DNA, 15 bp, Homo sapiens
tgcaggacaggaggc

SEQ ID NO: 3221740 - DNA, 13 bp, Homo sapiens
tgcaggacttgag

SEQ ID NO: 3221741 - DNA, 16 bp, Homo sapiens
tgcaggagacattttc

SEQ ID NO: 3221742 - DNA, 21 bp, Homo sapiens
tgcaggagcgtgaaggactta

SEQ ID NO: 3221743 - DNA, 23 bp, Homo sapiens
tgcaggagttaaaaagggcaggg

SEQ ID NO: 3221744 - DNA, 20 bp, Homo sapiens
tgcaggcacttattgtaaat

SEQ ID NO: 3221745 - DNA, 14 bp, Homo sapiens
tgcaggcaggaaca

SEQ ID NO: 3221746 - DNA, 12 bp, Homo sapiens
tgcaggccctgg

SEQ ID NO: 3221747 - DNA, 16 bp, Homo sapiens
tgcaggccctggcctc

SEQ ID NO: 3221748 - DNA, 22 bp, Homo sapiens
tgcaggcctaggtgcagctcct

SEQ ID NO: 3221749 - DNA, 11 bp, Homo sapiens
tgcaggctctg

SEQ ID NO: 3221750 - DNA, 13 bp, Homo sapiens
tgcaggctctggg

SEQ ID NO: 3221751 - DNA, 23 bp, Homo sapiens
tgcaggctctgggctcagggctg

SEQ ID NO: 3221752 - DNA, 14 bp, Homo sapiens
tgcagggagctcaa

SEQ ID NO: 3221753 - DNA, 13 bp, Homo sapiens
tgcagggagggga

SEQ ID NO: 3221754 - DNA, 16 bp, Homo sapiens
tgcagggaggggaggc

SEQ ID NO: 3221755 - DNA, 12 bp, Homo sapiens
tgcagggccagg

SEQ ID NO: 3221756 - DNA, 18 bp, Homo sapiens
tgcagggcgcccctggga

SEQ ID NO: 3221757 - DNA, 13 bp, Homo sapiens
tgcagggctccca

SEQ ID NO: 3221758 - DNA, 14 bp, Homo sapiens
tgcagggctcccat

SEQ ID NO: 3221759 - DNA, 22 bp, Homo sapiens
tgcaggggattgaagccctcca

SEQ ID NO: 3221760 - DNA, 14 bp, Homo sapiens
tgcaggggctctgg

SEQ ID NO: 3221761 - DNA, 14 bp, Homo sapiens
tgcaggggtgacgg

SEQ ID NO: 3221762 - DNA, 22 bp, Homo sapiens
tgcaggggtgacggccctcatc

SEQ ID NO: 3221763 - DNA, 14 bp, Homo sapiens
tgcattctgcctct

SEQ ID NO: 3221764 - DNA, 15 bp, Homo sapiens
tgcattctgcctctc

SEQ ID NO: 3221765 - DNA, 16 bp, Homo sapiens
tgcattcttctctgtt

SEQ ID NO: 3221766 - DNA, 13 bp, Homo sapiens
tgcattctttggt

SEQ ID NO: 3221767 - DNA, 15 bp, Homo sapiens
tgcattctttggtaa

SEQ ID NO: 3221768 - DNA, 20 bp, Homo sapiens
tgcattcttttggcagttct

SEQ ID NO: 3221769 - DNA, 15 bp, Homo sapiens
tgcattgaacacaaa

SEQ ID NO: 3221770 - DNA, 17 bp, Homo sapiens
tgcattgaggaaatatt

SEQ ID NO: 3221771 - DNA, 15 bp, Homo sapiens
tgcattgttggctat

SEQ ID NO: 3221772 - DNA, 17 bp, Homo sapiens
tgcattgttggctattt

SEQ ID NO: 3221773 - DNA, 17 bp, Homo sapiens
tgcatttaaaacagaca

SEQ ID NO: 3221774 - DNA, 20 bp, Homo sapiens
tgcatttaaaacagacactg

SEQ ID NO: 3221775 - DNA, 22 bp, Homo sapiens
tgcatttaaaacagacactggc

SEQ ID NO: 3221776 - DNA, 16 bp, Homo sapiens
tgcatttaaatcaagt

SEQ ID NO: 3221777 - DNA, 14 bp, Homo sapiens
tgcatttaataaag

SEQ ID NO: 3221778 - DNA, 22 bp, Homo sapiens
tgcatttaataaagatgagttg

SEQ ID NO: 3221779 - DNA, 23 bp, Homo sapiens
tgcatttaataaagatgagttgg

SEQ ID NO: 3221780 - DNA, 21 bp, Homo sapiens
tgcatttagaactttctgctt

SEQ ID NO: 3221781 - DNA, 14 bp, Homo sapiens
tgcatttagcacaa

SEQ ID NO: 3221782 - DNA, 22 bp, Homo sapiens
tgcatttatttatacagtgcct

SEQ ID NO: 3221783 - DNA, 19 bp, Homo sapiens
tgcatttcaaggaatggaa

SEQ ID NO: 3221784 - DNA, 15 bp, Homo sapiens
tgcatttcacctgtg

SEQ ID NO: 3221785 - DNA, 21 bp, Homo sapiens
tgcatttcattcaaatcagtg

SEQ ID NO: 3221786 - DNA, 14 bp, Homo sapiens
tgcatttcctgaca

SEQ ID NO: 3221787 - DNA, 14 bp, Homo sapiens
tgcatttctcttct

SEQ ID NO: 3221788 - DNA, 22 bp, Homo sapiens
tgcatttctcttctcagctctt

SEQ ID NO: 3221789 - DNA, 14 bp, Homo sapiens
tgcatttttgtgaa

SEQ ID NO: 3221790 - DNA, 17 bp, Homo sapiens
tgcatttttgtgaaatg

SEQ ID NO: 3221791 - DNA, 17 bp, Homo sapiens
tgccaaaaaaaaaagaa

SEQ ID NO: 3221792 - DNA, 19 bp, Homo sapiens
tgccaaaataccagagcct

SEQ ID NO: 3221793 - DNA, 21 bp, Homo sapiens
tgccaaaataccagagccttc

SEQ ID NO: 3221794 - DNA, 22 bp, Homo sapiens
tgccaaagctagggtggccctt

SEQ ID NO: 3221795 - DNA, 16 bp, Homo sapiens
tgccaaatatgtcctg

SEQ ID NO: 3221796 - DNA, 23 bp, Homo sapiens
tgccaaattttggccaaagtgtt

SEQ ID NO: 3221797 - DNA, 21 bp, Homo sapiens
tgccaacaccacagaaatggg

SEQ ID NO: 3221798 - DNA, 16 bp, Homo sapiens
tgccaacctctggagc

SEQ ID NO: 3221799 - DNA, 13 bp, Homo sapiens
tgccaactaagcc

SEQ ID NO: 3221800 - DNA, 16 bp, Homo sapiens
tgccaagaaaatgaag

SEQ ID NO: 3221801 - DNA, 12 bp, Homo sapiens
tgccaagacaaa

SEQ ID NO: 3221802 - DNA, 17 bp, Homo sapiens
tgccaagacaaatcaac

SEQ ID NO: 3221803 - DNA, 12 bp, Homo sapiens
tgccaagagagg

SEQ ID NO: 3221804 - DNA, 17 bp, Homo sapiens
tgccaagagtgaaggga

SEQ ID NO: 3221805 - DNA, 19 bp, Homo sapiens
tgccaagattctactcttg

SEQ ID NO: 3221806 - DNA, 12 bp, Homo sapiens
tgccaagccaga

SEQ ID NO: 3221807 - DNA, 22 bp, Homo sapiens
tgccaagccagattctcttgaa

SEQ ID NO: 3221808 - DNA, 16 bp, Homo sapiens
tgccaagctccaagcc

SEQ ID NO: 3221809 - DNA, 22 bp, Homo sapiens
tgccaaggccagagtggcctgg

SEQ ID NO: 3221810 - DNA, 18 bp, Homo sapiens
tgccaagtctcagaagag

SEQ ID NO: 3221811 - DNA, 18 bp, Homo sapiens
tgccaagttgctgtcact

SEQ ID NO: 3221812 - DNA, 21 bp, Homo sapiens
tgccaagttgctgtcactgtt

SEQ ID NO: 3221813 - DNA, 12 bp, Homo sapiens
tgccaataaagc

SEQ ID NO: 3221814 - DNA, 17 bp, Homo sapiens
tgccaataaagcttttg

SEQ ID NO: 3221815 - DNA, 18 bp, Homo sapiens
tgccaatactagtcaccc

SEQ ID NO: 3221816 - DNA, 19 bp, Homo sapiens
tgccaatattaaatctgct

SEQ ID NO: 3221817 - DNA, 15 bp, Homo sapiens
tgccaattagcaatt

SEQ ID NO: 3221818 - DNA, 23 bp, Homo sapiens
tgccacacagagtggtctttctg

SEQ ID NO: 3221819 - DNA, 22 bp, Homo sapiens
tgccacaccctcccccgccact

SEQ ID NO: 3221820 - DNA, 17 bp, Homo sapiens
tgccacacctggcctta

SEQ ID NO: 3221821 - DNA, 13 bp, Homo sapiens
tgccacacttcag

SEQ ID NO: 3221822 - DNA, 14 bp, Homo sapiens
tgccacacttcagg

SEQ ID NO: 3221823 - DNA, 16 bp, Homo sapiens
tgccacacttcaggct

SEQ ID NO: 3221824 - DNA, 23 bp, Homo sapiens
tgccacagagaagtttgtagcca

SEQ ID NO: 3221825 - DNA, 11 bp, Homo sapiens
tgccacagctt

SEQ ID NO: 3221826 - DNA, 17 bp, Homo sapiens
tgccacagcttttgcaa

SEQ ID NO: 3221827 - DNA, 18 bp, Homo sapiens
tgccacaggcctccctgt

SEQ ID NO: 3221828 - DNA, 22 bp, Homo sapiens
tgccacaggcctccctgtttga

SEQ ID NO: 3221829 - DNA, 23 bp, Homo sapiens
tgccacaggcctccctgtttgaa

SEQ ID NO: 3221830 - DNA, 22 bp, Homo sapiens
tgccacagtagaactgtctgtg

SEQ ID NO: 3221831 - DNA, 13 bp, Homo sapiens
tgccacatacagg

SEQ ID NO: 3221832 - DNA, 13 bp, Homo sapiens
tgccacatttctg

SEQ ID NO: 3221833 - DNA, 21 bp, Homo sapiens
tgccacatttctgatcagagg

SEQ ID NO: 3221834 - DNA, 15 bp, Homo sapiens
tgccaccacctctgt

SEQ ID NO: 3221835 - DNA, 22 bp, Homo sapiens
tgccaccacctctgtggcattg

SEQ ID NO: 3221836 - DNA, 19 bp, Homo sapiens
tgccaccacgtctgccagg

SEQ ID NO: 3221837 - DNA, 20 bp, Homo sapiens
tgccaccacgtctgccaggc

SEQ ID NO: 3221838 - DNA, 22 bp, Homo sapiens
tgccaccacgtctgccaggccc

SEQ ID NO: 3221839 - DNA, 13 bp, Homo sapiens
tgccaccagagac

SEQ ID NO: 3221840 - DNA, 19 bp, Homo sapiens
tgccaccagagaccgtcct

SEQ ID NO: 3221841 - DNA, 23 bp, Homo sapiens
tgccaccagagaccgtcctcacc

SEQ ID NO: 3221842 - DNA, 15 bp, Homo sapiens
tgccaccagcatcca

SEQ ID NO: 3221843 - DNA, 12 bp, Homo sapiens
tgccaccaggag

SEQ ID NO: 3221844 - DNA, 13 bp, Homo sapiens
tgccaccaggaga

SEQ ID NO: 3221845 - DNA, 14 bp, Homo sapiens
tgccaccaggagaa

SEQ ID NO: 3221846 - DNA, 17 bp, Homo sapiens
tgccaccaggagaacca

SEQ ID NO: 3221847 - DNA, 20 bp, Homo sapiens
tgccacccactcaggattgg

SEQ ID NO: 3221848 - DNA, 17 bp, Homo sapiens
tgccacctccccccaca

SEQ ID NO: 3221849 - DNA, 14 bp, Homo sapiens
tgccacgctttgct

SEQ ID NO: 3221850 - DNA, 15 bp, Homo sapiens
tgccacgtggtcact

SEQ ID NO: 3221851 - DNA, 17 bp, Homo sapiens
tgccacgtggtcactgt

SEQ ID NO: 3221852 - DNA, 21 bp, Homo sapiens
tgccacgtggtcactgtgcac

SEQ ID NO: 3221853 - DNA, 13 bp, Homo sapiens
tgccactcactag

SEQ ID NO: 3221854 - DNA, 14 bp, Homo sapiens
tgccactcactagg

SEQ ID NO: 3221855 - DNA, 14 bp, Homo sapiens
tgccactccctgag

SEQ ID NO: 3221856 - DNA, 12 bp, Homo sapiens
tgccactgccag

SEQ ID NO: 3221857 - DNA, 17 bp, Homo sapiens
tgccactgccaggcacc

SEQ ID NO: 3221858 - DNA, 18 bp, Homo sapiens
tgccactgccaggcacct

SEQ ID NO: 3221859 - DNA, 21 bp, Homo sapiens
tgccactgccaggcacctggc

SEQ ID NO: 3221860 - DNA, 19 bp, Homo sapiens
tgccactgcccgagctggt

SEQ ID NO: 3221861 - DNA, 19 bp, Homo sapiens
tgccactgccttcgcttct

SEQ ID NO: 3221862 - DNA, 22 bp, Homo sapiens
tgccactgccttcgcttcttgc

SEQ ID NO: 3221863 - DNA, 23 bp, Homo sapiens
tgccactgcgggagctctgtatg

SEQ ID NO: 3221864 - DNA, 20 bp, Homo sapiens
tgccactggcaaatgtaact

SEQ ID NO: 3221865 - DNA, 12 bp, Homo sapiens
tgccacttccca

SEQ ID NO: 3221866 - DNA, 20 bp, Homo sapiens
tgccacttcttaaaggcctg

SEQ ID NO: 3221867 - DNA, 22 bp, Homo sapiens
tgccacttcttaaaggcctgga

SEQ ID NO: 3221868 - DNA, 23 bp, Homo sapiens
tgccacttcttaaaggcctggaa

SEQ ID NO: 3221869 - DNA, 16 bp, Homo sapiens
tgccactttgactcag

SEQ ID NO: 3221870 - DNA, 23 bp, Homo sapiens
tgccagaaacagtgggagccctg

SEQ ID NO: 3221871 - DNA, 17 bp, Homo sapiens
tgccagaattttaggaa

SEQ ID NO: 3221872 - DNA, 19 bp, Homo sapiens
tgccagactctaggttata

SEQ ID NO: 3221873 - DNA, 22 bp, Homo sapiens
tgccagactctaggttatacaa

SEQ ID NO: 3221874 - DNA, 23 bp, Homo sapiens
tgccagagctttgttttatatat

SEQ ID NO: 3221875 - DNA, 21 bp, Homo sapiens
tgccagaggaatcctggcagc

SEQ ID NO: 3221876 - DNA, 18 bp, Homo sapiens
tgccagaggtgggcaggt

SEQ ID NO: 3221877 - DNA, 16 bp, Homo sapiens
tgccagcagcagcagg

SEQ ID NO: 3221878 - DNA, 19 bp, Homo sapiens
tgccagcatacattttctg

SEQ ID NO: 3221879 - DNA, 20 bp, Homo sapiens
tgccagcatacattttctgg

SEQ ID NO: 3221880 - DNA, 18 bp, Homo sapiens
tgccagcattccagactt

SEQ ID NO: 3221881 - DNA, 21 bp, Homo sapiens
tgccagcattccagacttcaa

SEQ ID NO: 3221882 - DNA, 16 bp, Homo sapiens
tgccagcccagaacac

SEQ ID NO: 3221883 - DNA, 17 bp, Homo sapiens
tgccagccccacacagc

SEQ ID NO: 3221884 - DNA, 18 bp, Homo sapiens
tgccagccccacacagct

SEQ ID NO: 3221885 - DNA, 23 bp, Homo sapiens
tgccagccccctaaaagcactcc

SEQ ID NO: 3221886 - DNA, 16 bp, Homo sapiens
tgccagcccctgcctg

SEQ ID NO: 3221887 - DNA, 17 bp, Homo sapiens
tgccagcccctgcctgg

SEQ ID NO: 3221888 - DNA, 20 bp, Homo sapiens
tgccagccgtgatgctcagg

SEQ ID NO: 3221889 - DNA, 20 bp, Homo sapiens
tgccagcctggcttctggag

SEQ ID NO: 3221890 - DNA, 22 bp, Homo sapiens
tgccagcctggcttctggagcc

SEQ ID NO: 3221891 - DNA, 23 bp, Homo sapiens
tgccagcctggcttctggagccc

SEQ ID NO: 3221892 - DNA, 17 bp, Homo sapiens
tgccagccttgagccct

SEQ ID NO: 3221893 - DNA, 23 bp, Homo sapiens
tgccagccttgagccctggctgt

SEQ ID NO: 3221894 - DNA, 14 bp, Homo sapiens
tgccagctgccttc

SEQ ID NO: 3221895 - DNA, 17 bp, Homo sapiens
tgccagctgccttcctc

SEQ ID NO: 3221896 - DNA, 14 bp, Homo sapiens
tgccaggcacctgg

SEQ ID NO: 3221897 - DNA, 17 bp, Homo sapiens
tgccaggcacctggcct

SEQ ID NO: 3221898 - DNA, 19 bp, Homo sapiens
tgccaggcacctggcctgc

SEQ ID NO: 3221899 - DNA, 16 bp, Homo sapiens
tgccaggcaggggtgg

SEQ ID NO: 3221900 - DNA, 15 bp, Homo sapiens
tgccaggccagcctc

SEQ ID NO: 3221901 - DNA, 18 bp, Homo sapiens
tgccaggccagcctccga

SEQ ID NO: 3221902 - DNA, 19 bp, Homo sapiens
tgccaggcgttggtgccac

SEQ ID NO: 3221903 - DNA, 14 bp, Homo sapiens
tgccaggctccctt

SEQ ID NO: 3221904 - DNA, 11 bp, Homo sapiens
tgccagggagc

SEQ ID NO: 3221905 - DNA, 17 bp, Homo sapiens
tgccagggcaatgatga

SEQ ID NO: 3221906 - DNA, 19 bp, Homo sapiens
tgccagggcagtgctagtg

SEQ ID NO: 3221907 - DNA, 19 bp, Homo sapiens
tgccaggttttctgggtgt

SEQ ID NO: 3221908 - DNA, 22 bp, Homo sapiens
tgccaggtttttggtctgaccc

SEQ ID NO: 3221909 - DNA, 24 bp, Homo sapiens
tgccaggtttttggtctgacccac

SEQ ID NO: 3221910 - DNA, 13 bp, Homo sapiens
tgccagtattttt

SEQ ID NO: 3221911 - DNA, 20 bp, Homo sapiens
tgccagtccccctgccccag

SEQ ID NO: 3221912 - DNA, 23 bp, Homo sapiens
tgccagtctcactgtgggaaggc

SEQ ID NO: 3221913 - DNA, 16 bp, Homo sapiens
tgccagtgacagacag

SEQ ID NO: 3221914 - DNA, 22 bp, Homo sapiens
tgccagtgacagacaggctctt

SEQ ID NO: 3221915 - DNA, 17 bp, Homo sapiens
tgccagtggatcccctg

SEQ ID NO: 3221916 - DNA, 21 bp, Homo sapiens
tgccagtggatcccctgcggt

SEQ ID NO: 3221917 - DNA, 23 bp, Homo sapiens
tgccagttgaaaatggattttta

SEQ ID NO: 3221918 - DNA, 13 bp, Homo sapiens
tgccatagagttt

SEQ ID NO: 3221919 - DNA, 14 bp, Homo sapiens
tgccatagccccat

SEQ ID NO: 3221920 - DNA, 15 bp, Homo sapiens
tgccatagtttgtga

SEQ ID NO: 3221921 - DNA, 21 bp, Homo sapiens
tgccatatataacagatacat

SEQ ID NO: 3221922 - DNA, 17 bp, Homo sapiens
tgccatcaccgctgggt

SEQ ID NO: 3221923 - DNA, 16 bp, Homo sapiens
tgccatctagccagcc

SEQ ID NO: 3221924 - DNA, 17 bp, Homo sapiens
tgccatctagccagccc

SEQ ID NO: 3221925 - DNA, 16 bp, Homo sapiens
tgccatctatctagtt

SEQ ID NO: 3221926 - DNA, 14 bp, Homo sapiens
tgccatctgtacat

SEQ ID NO: 3221927 - DNA, 15 bp, Homo sapiens
tgccatgatagctgg

SEQ ID NO: 3221928 - DNA, 19 bp, Homo sapiens
tgccatgccactgccaggc

SEQ ID NO: 3221929 - DNA, 22 bp, Homo sapiens
tgccatgccactgccaggcacc

SEQ ID NO: 3221930 - DNA, 13 bp, Homo sapiens
tgccatgctgggc

SEQ ID NO: 3221931 - DNA, 23 bp, Homo sapiens
tgccatgctgggccactggggac

SEQ ID NO: 3221932 - DNA, 18 bp, Homo sapiens
tgccatgggccagcctag

SEQ ID NO: 3221933 - DNA, 22 bp, Homo sapiens
tgccatgggcttcactgtataa

SEQ ID NO: 3221934 - DNA, 18 bp, Homo sapiens
tgccatgtaaatccccac

SEQ ID NO: 3221935 - DNA, 20 bp, Homo sapiens
tgccatgtaaatccccactg

SEQ ID NO: 3221936 - DNA, 15 bp, Homo sapiens
tgccatgtccatagc

SEQ ID NO: 3221937 - DNA, 14 bp, Homo sapiens
tgccatgtgccagg

SEQ ID NO: 3221938 - DNA, 15 bp, Homo sapiens
tgccatgtgccaggt

SEQ ID NO: 3221939 - DNA, 18 bp, Homo sapiens
tgccattattttctgtca

SEQ ID NO: 3221940 - DNA, 20 bp, Homo sapiens
tgccattattttctgtcaga

SEQ ID NO: 3221941 - DNA, 21 bp, Homo sapiens
tgccattattttctgtcagat

SEQ ID NO: 3221942 - DNA, 14 bp, Homo sapiens
tgccattcccagcg

SEQ ID NO: 3221943 - DNA, 18 bp, Homo sapiens
tgccattcttctggtgct

SEQ ID NO: 3221944 - DNA, 14 bp, Homo sapiens
tgccattgtcttta

SEQ ID NO: 3221945 - DNA, 17 bp, Homo sapiens
tgccatttaaaaagttg

SEQ ID NO: 3221946 - DNA, 18 bp, Homo sapiens
tgccatttcagtggcttc

SEQ ID NO: 3221947 - DNA, 13 bp, Homo sapiens
tgccatttgatac

SEQ ID NO: 3221948 - DNA, 17 bp, Homo sapiens
tgccatttgatacccct

SEQ ID NO: 3221949 - DNA, 16 bp, Homo sapiens
tgccatttgcaccctc

SEQ ID NO: 3221950 - DNA, 22 bp, Homo sapiens
tgccatttgcaccctccgcctt

SEQ ID NO: 3221951 - DNA, 23 bp, Homo sapiens
tgccatttggtgtggattttcta

SEQ ID NO: 3221952 - DNA, 13 bp, Homo sapiens
tgcccaaaccctt

SEQ ID NO: 3221953 - DNA, 16 bp, Homo sapiens
tgcccaaagagcacaa

SEQ ID NO: 3221954 - DNA, 14 bp, Homo sapiens
tgcccaacaccagc

SEQ ID NO: 3221955 - DNA, 16 bp, Homo sapiens
tgcccaacaccagccc

SEQ ID NO: 3221956 - DNA, 17 bp, Homo sapiens
tgcccaacaccagcccc

SEQ ID NO: 3221957 - DNA, 22 bp, Homo sapiens
tgcccaacctgctctcctcttg

SEQ ID NO: 3221958 - DNA, 24 bp, Homo sapiens
tgcccaacctgctctcctcttgcc

SEQ ID NO: 3221959 - DNA, 22 bp, Homo sapiens
tgcccaagccagaggctgggtt

SEQ ID NO: 3221960 - DNA, 16 bp, Homo sapiens
tgcccaagccctgaga

SEQ ID NO: 3221961 - DNA, 22 bp, Homo sapiens
tgcccaagggcctcccaccaga

SEQ ID NO: 3221962 - DNA, 15 bp, Homo sapiens
tgcccaatgaataat

SEQ ID NO: 3221963 - DNA, 21 bp, Homo sapiens
tgcccaatgagactctagggt

SEQ ID NO: 3221964 - DNA, 14 bp, Homo sapiens
tgcccacaggatca

SEQ ID NO: 3221965 - DNA, 23 bp, Homo sapiens
tgcccacatcccaggcttcaccc

SEQ ID NO: 3221966 - DNA, 14 bp, Homo sapiens
tgcccaccccctca

SEQ ID NO: 3221967 - DNA, 13 bp, Homo sapiens
tgcccaccccctg

SEQ ID NO: 3221968 - DNA, 14 bp, Homo sapiens
tgcccaccccctgc

SEQ ID NO: 3221969 - DNA, 15 bp, Homo sapiens
tgcccaccccctgcc

SEQ ID NO: 3221970 - DNA, 20 bp, Homo sapiens
tgcccaccccctgccctgca

SEQ ID NO: 3221971 - DNA, 22 bp, Homo sapiens
tgcccaccctgggagacagacc

SEQ ID NO: 3221972 - DNA, 14 bp, Homo sapiens
tgcccacctgccca

SEQ ID NO: 3221973 - DNA, 22 bp, Homo sapiens
tgcccacgatcccctcccccaa

SEQ ID NO: 3221974 - DNA, 15 bp, Homo sapiens
tgcccacgcagagga

SEQ ID NO: 3221975 - DNA, 19 bp, Homo sapiens
tgcccacgcagaggacgca

SEQ ID NO: 3221976 - DNA, 22 bp, Homo sapiens
tgcccactgctgcagtagggga

SEQ ID NO: 3221977 - DNA, 11 bp, Homo sapiens
tgcccagaact

SEQ ID NO: 3221978 - DNA, 16 bp, Homo sapiens
tgcccagaacttccct

SEQ ID NO: 3221979 - DNA, 22 bp, Homo sapiens
tgcccagacacagactggcaat

SEQ ID NO: 3221980 - DNA, 21 bp, Homo sapiens
tgcccagaggactcccaaccc

SEQ ID NO: 3221981 - DNA, 20 bp, Homo sapiens
tgcccagagggcccaggcag

SEQ ID NO: 3221982 - DNA, 12 bp, Homo sapiens
tgcccaggcagg

SEQ ID NO: 3221983 - DNA, 16 bp, Homo sapiens
tgcccaggcaggtctt

SEQ ID NO: 3221984 - DNA, 11 bp, Homo sapiens
tgcccaggccc

SEQ ID NO: 3221985 - DNA, 15 bp, Homo sapiens
tgcccaggcctgcct

SEQ ID NO: 3221986 - DNA, 17 bp, Homo sapiens
tgcccaggcctgcctgt

SEQ ID NO: 3221987 - DNA, 20 bp, Homo sapiens
tgcccaggctggagtgcagt

SEQ ID NO: 3221988 - DNA, 13 bp, Homo sapiens
tgcccaggctggc

SEQ ID NO: 3221989 - DNA, 17 bp, Homo sapiens
tgcccaggctggtctca

SEQ ID NO: 3221990 - DNA, 20 bp, Homo sapiens
tgcccaggtaccacccttca

SEQ ID NO: 3221991 - DNA, 19 bp, Homo sapiens
tgcccagtacatttaaatt

SEQ ID NO: 3221992 - DNA, 22 bp, Homo sapiens
tgcccagtcccccaaccccagc

SEQ ID NO: 3221993 - DNA, 21 bp, Homo sapiens
tgcccagtgttgtttgtaaat

SEQ ID NO: 3221994 - DNA, 18 bp, Homo sapiens
tgcccatcatgtggcccc

SEQ ID NO: 3221995 - DNA, 23 bp, Homo sapiens
tgcccatggcttctggtcatgaa

SEQ ID NO: 3221996 - DNA, 18 bp, Homo sapiens
tgcccatgtgtcccctca

SEQ ID NO: 3221997 - DNA, 14 bp, Homo sapiens
tgccccaaacaaat

SEQ ID NO: 3221998 - DNA, 20 bp, Homo sapiens
tgccccaaataacttcagtc

SEQ ID NO: 3221999 - DNA, 17 bp, Homo sapiens
tgccccaagcagccagc

SEQ ID NO: 3222000 - DNA, 19 bp, Homo sapiens
tgccccaagcagccagcca

SEQ ID NO: 3222001 - DNA, 15 bp, Homo sapiens
tgccccacacggact

SEQ ID NO: 3222002 - DNA, 16 bp, Homo sapiens
tgccccacacggactc

SEQ ID NO: 3222003 - DNA, 20 bp, Homo sapiens
tgccccacagttgtgttcat

SEQ ID NO: 3222004 - DNA, 17 bp, Homo sapiens
tgccccagagctgttta

SEQ ID NO: 3222005 - DNA, 16 bp, Homo sapiens
tgccccagctctggct

SEQ ID NO: 3222006 - DNA, 19 bp, Homo sapiens
tgccccagctgactgtggc

SEQ ID NO: 3222007 - DNA, 24 bp, Homo sapiens
tgccccagtcggccccatctctca

SEQ ID NO: 3222008 - DNA, 14 bp, Homo sapiens
tgcccccaacactc

SEQ ID NO: 3222009 - DNA, 20 bp, Homo sapiens
tgcccccaacactccaggcc

SEQ ID NO: 3222010 - DNA, 22 bp, Homo sapiens
tgcccccaacactccaggccct

SEQ ID NO: 3222011 - DNA, 13 bp, Homo sapiens
tgcccccacctct

SEQ ID NO: 3222012 - DNA, 14 bp, Homo sapiens
tgcccccagcccaa

SEQ ID NO: 3222013 - DNA, 20 bp, Homo sapiens
tgcccccagccccggggtga

SEQ ID NO: 3222014 - DNA, 20 bp, Homo sapiens
tgcccccatctccccaggcc

SEQ ID NO: 3222015 - DNA, 14 bp, Homo sapiens
tgccccccagcctc

SEQ ID NO: 3222016 - DNA, 19 bp, Homo sapiens
tgccccccagcctctggca

SEQ ID NO: 3222017 - DNA, 23 bp, Homo sapiens
tgccccccatgaggaaggaacag

SEQ ID NO: 3222018 - DNA, 19 bp, Homo sapiens
tgccccccctaagagacac

SEQ ID NO: 3222019 - DNA, 20 bp, Homo sapiens
tgccccccctaagagacaca

SEQ ID NO: 3222020 - DNA, 20 bp, Homo sapiens
tgcccccctcaaacctcctc

SEQ ID NO: 3222021 - DNA, 22 bp, Homo sapiens
tgcccccctcaaacctcctctt

SEQ ID NO: 3222022 - DNA, 14 bp, Homo sapiens
tgcccccgcctgcc

SEQ ID NO: 3222023 - DNA, 17 bp, Homo sapiens
tgcccccgcctgccacc

SEQ ID NO: 3222024 - DNA, 13 bp, Homo sapiens
tgccccctccagg

SEQ ID NO: 3222025 - DNA, 23 bp, Homo sapiens
tgccccctccaggagagagccag

SEQ ID NO: 3222026 - DNA, 23 bp, Homo sapiens
tgccccctcccactcttgaagag

SEQ ID NO: 3222027 - DNA, 14 bp, Homo sapiens
tgccccctggctga

SEQ ID NO: 3222028 - DNA, 22 bp, Homo sapiens
tgccccctggctgactggccag

SEQ ID NO: 3222029 - DNA, 18 bp, Homo sapiens
tgccccctttcagatgtc

SEQ ID NO: 3222030 - DNA, 22 bp, Homo sapiens
tgccccctttcagatgtcttct

SEQ ID NO: 3222031 - DNA, 23 bp, Homo sapiens
tgccccctttcagatgtcttctg

SEQ ID NO: 3222032 - DNA, 14 bp, Homo sapiens
tgccccggccacct

SEQ ID NO: 3222033 - DNA, 21 bp, Homo sapiens
tgccccggccccggccccagc

SEQ ID NO: 3222034 - DNA, 23 bp, Homo sapiens
tgccccggccccggccccagcca

SEQ ID NO: 3222035 - DNA, 17 bp, Homo sapiens
tgcccctaccctggact

SEQ ID NO: 3222036 - DNA, 12 bp, Homo sapiens
tgcccctccccc

SEQ ID NO: 3222037 - DNA, 17 bp, Homo sapiens
tgcccctcccccaaccc

SEQ ID NO: 3222038 - DNA, 23 bp, Homo sapiens
tgcccctcccccaacccccaccc

SEQ ID NO: 3222039 - DNA, 15 bp, Homo sapiens
tgcccctcccttcaa

SEQ ID NO: 3222040 - DNA, 18 bp, Homo sapiens
tgcccctcgccagcttct

SEQ ID NO: 3222041 - DNA, 19 bp, Homo sapiens
tgcccctcgccagcttctc

SEQ ID NO: 3222042 - DNA, 12 bp, Homo sapiens
tgcccctctcac

SEQ ID NO: 3222043 - DNA, 14 bp, Homo sapiens
tgcccctctcacca

SEQ ID NO: 3222044 - DNA, 17 bp, Homo sapiens
tgcccctgatcactccc

SEQ ID NO: 3222045 - DNA, 15 bp, Homo sapiens
tgcccctgcaaagac

SEQ ID NO: 3222046 - DNA, 16 bp, Homo sapiens
tgcccctgcgtggcct

SEQ ID NO: 3222047 - DNA, 19 bp, Homo sapiens
tgcccctgcgtggcctgag

SEQ ID NO: 3222048 - DNA, 20 bp, Homo sapiens
tgcccctgcgtggcctgagt

SEQ ID NO: 3222049 - DNA, 18 bp, Homo sapiens
tgcccctgctgtgctgct

SEQ ID NO: 3222050 - DNA, 21 bp, Homo sapiens
tgcccctgctgtgctgctcaa

SEQ ID NO: 3222051 - DNA, 13 bp, Homo sapiens
tgcccctggccca

SEQ ID NO: 3222052 - DNA, 21 bp, Homo sapiens
tgcccctggcccatctcagcc

SEQ ID NO: 3222053 - DNA, 22 bp, Homo sapiens
tgcccctggcccatctcagcct

SEQ ID NO: 3222054 - DNA, 19 bp, Homo sapiens
tgcccctggtgccctgaga

SEQ ID NO: 3222055 - DNA, 12 bp, Homo sapiens
tgccccttggct

SEQ ID NO: 3222056 - DNA, 13 bp, Homo sapiens
tgcccgagctggt

SEQ ID NO: 3222057 - DNA, 14 bp, Homo sapiens
tgcccgagctggtg

SEQ ID NO: 3222058 - DNA, 16 bp, Homo sapiens
tgcccgcacaccctca

SEQ ID NO: 3222059 - DNA, 14 bp, Homo sapiens
tgcccgcacagcag

SEQ ID NO: 3222060 - DNA, 20 bp, Homo sapiens
tgcccgcacagcagcctgct

SEQ ID NO: 3222061 - DNA, 18 bp, Homo sapiens
tgcccgcctaggagttga

SEQ ID NO: 3222062 - DNA, 13 bp, Homo sapiens
tgcccgctcctcg

SEQ ID NO: 3222063 - DNA, 21 bp, Homo sapiens
tgcccggagattggacggcct

SEQ ID NO: 3222064 - DNA, 23 bp, Homo sapiens
tgcccggagattggacggcctga

SEQ ID NO: 3222065 - DNA, 18 bp, Homo sapiens
tgcccggattctgggagg

SEQ ID NO: 3222066 - DNA, 16 bp, Homo sapiens
tgcccggcgccgggca

SEQ ID NO: 3222067 - DNA, 20 bp, Homo sapiens
tgcccggctaatttttgtaa

SEQ ID NO: 3222068 - DNA, 20 bp, Homo sapiens
tgcccggtggtttgccatgt

SEQ ID NO: 3222069 - DNA, 21 bp, Homo sapiens
tgcccggtggtttgccatgtc

SEQ ID NO: 3222070 - DNA, 17 bp, Homo sapiens
tgcccgtgcccgcagga

SEQ ID NO: 3222071 - DNA, 17 bp, Homo sapiens
tgccctagcccagactc

SEQ ID NO: 3222072 - DNA, 18 bp, Homo sapiens
tgccctcaagtaaaagaa

SEQ ID NO: 3222073 - DNA, 12 bp, Homo sapiens
tgccctcagggg

SEQ ID NO: 3222074 - DNA, 18 bp, Homo sapiens
tgccctcattactgggcc

SEQ ID NO: 3222075 - DNA, 18 bp, Homo sapiens
tgccctccacagccgcag

SEQ ID NO: 3222076 - DNA, 17 bp, Homo sapiens
tgccctcgtggccagcc

SEQ ID NO: 3222077 - DNA, 20 bp, Homo sapiens
tgccctcgtggccagcccgg

SEQ ID NO: 3222078 - DNA, 17 bp, Homo sapiens
tgccctctccttcctta

SEQ ID NO: 3222079 - DNA, 21 bp, Homo sapiens
tgccctctccttccttaccca

SEQ ID NO: 3222080 - DNA, 17 bp, Homo sapiens
tgccctgacctcccagc

SEQ ID NO: 3222081 - DNA, 18 bp, Homo sapiens
tgccctgacctcccagcc

SEQ ID NO: 3222082 - DNA, 22 bp, Homo sapiens
tgccctgacctcccagccctat

SEQ ID NO: 3222083 - DNA, 22 bp, Homo sapiens
tgccctgcacgtcatgggaggg

SEQ ID NO: 3222084 - DNA, 16 bp, Homo sapiens
tgccctgcccccacga

SEQ ID NO: 3222085 - DNA, 14 bp, Homo sapiens
tgccctgccccctg

SEQ ID NO: 3222086 - DNA, 22 bp, Homo sapiens
tgccctgccccctggctgactg

SEQ ID NO: 3222087 - DNA, 13 bp, Homo sapiens
tgccctgcctgcc

SEQ ID NO: 3222088 - DNA, 15 bp, Homo sapiens
tgccctgcctgccca

SEQ ID NO: 3222089 - DNA, 18 bp, Homo sapiens
tgccctgcctgcccactt

SEQ ID NO: 3222090 - DNA, 19 bp, Homo sapiens
tgccctgccttgtccctct

SEQ ID NO: 3222091 - DNA, 14 bp, Homo sapiens
tgccctggccctga

SEQ ID NO: 3222092 - DNA, 16 bp, Homo sapiens
tgccctggccctgagg

SEQ ID NO: 3222093 - DNA, 18 bp, Homo sapiens
tgccctggccctgaggtg

SEQ ID NO: 3222094 - DNA, 17 bp, Homo sapiens
tgccctggctgctgccc

SEQ ID NO: 3222095 - DNA, 13 bp, Homo sapiens
tgccctgggccac

SEQ ID NO: 3222096 - DNA, 18 bp, Homo sapiens
tgccctggtgctgccaca

SEQ ID NO: 3222097 - DNA, 22 bp, Homo sapiens
tgccctggtggagaaagcactg

SEQ ID NO: 3222098 - DNA, 15 bp, Homo sapiens
tgccctggtttcact

SEQ ID NO: 3222099 - DNA, 19 bp, Homo sapiens
tgccctgttgtgtatagat

SEQ ID NO: 3222100 - DNA, 17 bp, Homo sapiens
tgcccttccctgtccct

SEQ ID NO: 3222101 - DNA, 15 bp, Homo sapiens
tgcccttgccctgac

SEQ ID NO: 3222102 - DNA, 18 bp, Homo sapiens
tgcccttgccctgacctc

SEQ ID NO: 3222103 - DNA, 20 bp, Homo sapiens
tgcaccactgcactccagcc

SEQ ID NO: 3222104 - DNA, 22 bp, Homo sapiens
tgcaccactgcactccagcctg

SEQ ID NO: 3222105 - DNA, 23 bp, Homo sapiens
tgcaccagagcaacctctcactc

SEQ ID NO: 3222106 - DNA, 12 bp, Homo sapiens
tgcaccagagtg

SEQ ID NO: 3222107 - DNA, 23 bp, Homo sapiens
tgcaccagagtgaaagggctatg

SEQ ID NO: 3222108 - DNA, 12 bp, Homo sapiens
tgcaccaggaga

SEQ ID NO: 3222109 - DNA, 14 bp, Homo sapiens
tgcaccaggagaca

SEQ ID NO: 3222110 - DNA, 15 bp, Homo sapiens
tgcaccaggagacag

SEQ ID NO: 3222111 - DNA, 15 bp, Homo sapiens
tgcaccatctgcttg

SEQ ID NO: 3222112 - DNA, 21 bp, Homo sapiens
tgcacccaactactgagctga

SEQ ID NO: 3222113 - DNA, 20 bp, Homo sapiens
tgcacccactcaccagggtc

SEQ ID NO: 3222114 - DNA, 15 bp, Homo sapiens
tgcaccccttctctc

SEQ ID NO: 3222115 - DNA, 19 bp, Homo sapiens
tgcaccccttctctcctcc

SEQ ID NO: 3222116 - DNA, 14 bp, Homo sapiens
tgcacccgcctctc

SEQ ID NO: 3222117 - DNA, 14 bp, Homo sapiens
tgcaccctccaccc

SEQ ID NO: 3222118 - DNA, 14 bp, Homo sapiens
tgcaccctccgcct

SEQ ID NO: 3222119 - DNA, 16 bp, Homo sapiens
tgcaccctccgccttc

SEQ ID NO: 3222120 - DNA, 13 bp, Homo sapiens
tgcaccggacagt

SEQ ID NO: 3222121 - DNA, 15 bp, Homo sapiens
tgcaccgggccacag

SEQ ID NO: 3222122 - DNA, 13 bp, Homo sapiens
tgcaccgtcctca

SEQ ID NO: 3222123 - DNA, 17 bp, Homo sapiens
tgcacctctgttcattt

SEQ ID NO: 3222124 - DNA, 18 bp, Homo sapiens
tgcacctgccagcctggc

SEQ ID NO: 3222125 - DNA, 12 bp, Homo sapiens
tgcacctgctgc

SEQ ID NO: 3222126 - DNA, 21 bp, Homo sapiens
tgcacctgtccccaccctcca

SEQ ID NO: 3222127 - DNA, 13 bp, Homo sapiens
tgcaccttaccaa

SEQ ID NO: 3222128 - DNA, 22 bp, Homo sapiens
tgcacctttttgcatgatatct

SEQ ID NO: 3222129 - DNA, 17 bp, Homo sapiens
tgcacgaactggactgt

SEQ ID NO: 3222130 - DNA, 19 bp, Homo sapiens
tgcacgtacacacacatac

SEQ ID NO: 3222131 - DNA, 15 bp, Homo sapiens
tgcacgtcatgggag

SEQ ID NO: 3222132 - DNA, 23 bp, Homo sapiens
tgcacgtggcatgtggcctgtgg

SEQ ID NO: 3222133 - DNA, 19 bp, Homo sapiens
tgcacgtggcctcttgagc

SEQ ID NO: 3222134 - DNA, 22 bp, Homo sapiens
tgcacgtggcctcttgagcagt

SEQ ID NO: 3222135 - DNA, 16 bp, Homo sapiens
tgcacgtttggtttgc

SEQ ID NO: 3222136 - DNA, 17 bp, Homo sapiens
tgcactaaagccagcct

SEQ ID NO: 3222137 - DNA, 20 bp, Homo sapiens
tgcactaaagccagcctgac

SEQ ID NO: 3222138 - DNA, 18 bp, Homo sapiens
tgcactaaagtatgtaaa

SEQ ID NO: 3222139 - DNA, 13 bp, Homo sapiens
tgcactaaatatg

SEQ ID NO: 3222140 - DNA, 18 bp, Homo sapiens
tgcactacattatggaat

SEQ ID NO: 3222141 - DNA, 16 bp, Homo sapiens
tgcactactcctctgc

SEQ ID NO: 3222142 - DNA, 19 bp, Homo sapiens
tgcactactcctctgcagt

SEQ ID NO: 3222143 - DNA, 18 bp, Homo sapiens
tgcactactgacatgtgg

SEQ ID NO: 3222144 - DNA, 21 bp, Homo sapiens
tgcactatatgtttacacaat

SEQ ID NO: 3222145 - DNA, 15 bp, Homo sapiens
tgcactatgaggaat

SEQ ID NO: 3222146 - DNA, 13 bp, Homo sapiens
tgcactccagcct

SEQ ID NO: 3222147 - DNA, 17 bp, Homo sapiens
tgcactccagcctgggc

SEQ ID NO: 3222148 - DNA, 18 bp, Homo sapiens
tgcactccagcctgggca

SEQ ID NO: 3222149 - DNA, 19 bp, Homo sapiens
tgcactccagcctgggcga

SEQ ID NO: 3222150 - DNA, 15 bp, Homo sapiens
tgcactcccacctga

SEQ ID NO: 3222151 - DNA, 17 bp, Homo sapiens
tgcactcccacctgaca

SEQ ID NO: 3222152 - DNA, 21 bp, Homo sapiens
tgcactctaaaaggttcaggg

SEQ ID NO: 3222153 - DNA, 21 bp, Homo sapiens
tgcactgaaaacttagccaga

SEQ ID NO: 3222154 - DNA, 14 bp, Homo sapiens
tgcactgaagtttt

SEQ ID NO: 3222155 - DNA, 15 bp, Homo sapiens
tgcactgaagttttt

SEQ ID NO: 3222156 - DNA, 19 bp, Homo sapiens
tgcactgaagtttttgaaa

SEQ ID NO: 3222157 - DNA, 18 bp, Homo sapiens
tgaggtcagagcctgcag

SEQ ID NO: 3222158 - DNA, 14 bp, Homo sapiens
tgaggtcagggagt

SEQ ID NO: 3222159 - DNA, 17 bp, Homo sapiens
tgaggtccaccggcccc

SEQ ID NO: 3222160 - DNA, 15 bp, Homo sapiens
tgaggtcccaggaag

SEQ ID NO: 3222161 - DNA, 16 bp, Homo sapiens
tgaggtctgtttctct

SEQ ID NO: 3222162 - DNA, 21 bp, Homo sapiens
tgaggtcttttgacatgtgga

SEQ ID NO: 3222163 - DNA, 16 bp, Homo sapiens
tgaggtggcacttttt

SEQ ID NO: 3222164 - DNA, 22 bp, Homo sapiens
tgaggtgggaggtggaagaagg

SEQ ID NO: 3222165 - DNA, 11 bp, Homo sapiens
tgaggtgggcc

SEQ ID NO: 3222166 - DNA, 15 bp, Homo sapiens
tgaggtgggcccagg

SEQ ID NO: 3222167 - DNA, 16 bp, Homo sapiens
tgaggtgggcccagga

SEQ ID NO: 3222168 - DNA, 17 bp, Homo sapiens
tgaggtgggctggggct

SEQ ID NO: 3222169 - DNA, 20 bp, Homo sapiens
tgaggtgtcagagaaaatga

SEQ ID NO: 3222170 - DNA, 15 bp, Homo sapiens
tgaggtgtgggggct

SEQ ID NO: 3222171 - DNA, 18 bp, Homo sapiens
tgaggttcctctgcctgc

SEQ ID NO: 3222172 - DNA, 19 bp, Homo sapiens
tgaggttcctctgcctgcc

SEQ ID NO: 3222173 - DNA, 16 bp, Homo sapiens
tgaggttctgagacca

SEQ ID NO: 3222174 - DNA, 15 bp, Homo sapiens
tgaggttggatttgc

SEQ ID NO: 3222175 - DNA, 15 bp, Homo sapiens
tgaggtttcaccctt

SEQ ID NO: 3222176 - DNA, 23 bp, Homo sapiens
tgagtaaaaaggtggtatgtaat

SEQ ID NO: 3222177 - DNA, 15 bp, Homo sapiens
tgagtaacatttgct

SEQ ID NO: 3222178 - DNA, 19 bp, Homo sapiens
tgagtaacatttgctgttt

SEQ ID NO: 3222179 - DNA, 15 bp, Homo sapiens
tgagtaactattatt

SEQ ID NO: 3222180 - DNA, 16 bp, Homo sapiens
tgagtaagagctggtg

SEQ ID NO: 3222181 - DNA, 23 bp, Homo sapiens
tgagtaagagctggtgtctgatt

SEQ ID NO: 3222182 - DNA, 18 bp, Homo sapiens
tgagtaatggtgtagaac

SEQ ID NO: 3222183 - DNA, 17 bp, Homo sapiens
tgagtaattttggattt

SEQ ID NO: 3222184 - DNA, 16 bp, Homo sapiens
tgagtacagtgaggag

SEQ ID NO: 3222185 - DNA, 14 bp, Homo sapiens
tgagtaccaggggc

SEQ ID NO: 3222186 - DNA, 17 bp, Homo sapiens
tgagtaccaggggctgg

SEQ ID NO: 3222187 - DNA, 14 bp, Homo sapiens
tgagtagatattac

SEQ ID NO: 3222188 - DNA, 15 bp, Homo sapiens
tgagtagatattact

SEQ ID NO: 3222189 - DNA, 18 bp, Homo sapiens
tgagtagatattacttta

SEQ ID NO: 3222190 - DNA, 19 bp, Homo sapiens
tgagtagatattactttat

SEQ ID NO: 3222191 - DNA, 18 bp, Homo sapiens
tgagtatacaatatataa

SEQ ID NO: 3222192 - DNA, 20 bp, Homo sapiens
tgagtatggagcagcctgga

SEQ ID NO: 3222193 - DNA, 19 bp, Homo sapiens
tgagtattgtttaaaatgt

SEQ ID NO: 3222194 - DNA, 23 bp, Homo sapiens
tgagtattgtttaaaatgtaatt

SEQ ID NO: 3222195 - DNA, 12 bp, Homo sapiens
tgagtatttggt

SEQ ID NO: 3222196 - DNA, 17 bp, Homo sapiens
tgagtcaccaagcccag

SEQ ID NO: 3222197 - DNA, 18 bp, Homo sapiens
tgagtcaccaagcccagt

SEQ ID NO: 3222198 - DNA, 16 bp, Homo sapiens
tgagtcagggcccaga

SEQ ID NO: 3222199 - DNA, 17 bp, Homo sapiens
tgagtcagggcccagag

SEQ ID NO: 3222200 - DNA, 12 bp, Homo sapiens
tgagtcattgac

SEQ ID NO: 3222201 - DNA, 15 bp, Homo sapiens
tgagtcattgacttc

SEQ ID NO: 3222202 - DNA, 22 bp, Homo sapiens
tgagtccattctcccaggtacc

SEQ ID NO: 3222203 - DNA, 14 bp, Homo sapiens
tgagtcccctactc

SEQ ID NO: 3222204 - DNA, 16 bp, Homo sapiens
tgagtcccctccagga

SEQ ID NO: 3222205 - DNA, 16 bp, Homo sapiens
tgagtcctgtctctgc

SEQ ID NO: 3222206 - DNA, 14 bp, Homo sapiens
tgagtcctttgcta

SEQ ID NO: 3222207 - DNA, 14 bp, Homo sapiens
tgagtcgaggacag

SEQ ID NO: 3222208 - DNA, 19 bp, Homo sapiens
tgagtcggccccacatggg

SEQ ID NO: 3222209 - DNA, 19 bp, Homo sapiens
tgagtcgtacagaaagctg

SEQ ID NO: 3222210 - DNA, 15 bp, Homo sapiens
tgagtctagatgttt

SEQ ID NO: 3222211 - DNA, 13 bp, Homo sapiens
tgagtctctgaat

SEQ ID NO: 3222212 - DNA, 22 bp, Homo sapiens
tgagtctctggggcaggctgct

SEQ ID NO: 3222213 - DNA, 15 bp, Homo sapiens
tgagtctgagtcctg

SEQ ID NO: 3222214 - DNA, 18 bp, Homo sapiens
tgagtcttggcggcagca

SEQ ID NO: 3222215 - DNA, 23 bp, Homo sapiens
tgagtcttggcggcagcagccat

SEQ ID NO: 3222216 - DNA, 17 bp, Homo sapiens
tgagtgaacctgtataa

SEQ ID NO: 3222217 - DNA, 14 bp, Homo sapiens
tgaaatttaaacat

SEQ ID NO: 3222218 - DNA, 22 bp, Homo sapiens
tgaaatttattagttaatatat

SEQ ID NO: 3222219 - DNA, 21 bp, Homo sapiens
tgaaatttattcacatatatc

SEQ ID NO: 3222220 - DNA, 21 bp, Homo sapiens
tgaaatttgttatacttcaaa

SEQ ID NO: 3222221 - DNA, 16 bp, Homo sapiens
tgaaattttatatgct

SEQ ID NO: 3222222 - DNA, 18 bp, Homo sapiens
tgaaattttctagacttt

SEQ ID NO: 3222223 - DNA, 20 bp, Homo sapiens
tgaaattttctagactttct

SEQ ID NO: 3222224 - DNA, 18 bp, Homo sapiens
tgaaattttgcaaatata

SEQ ID NO: 3222225 - DNA, 19 bp, Homo sapiens
tgaaatttttattaaatta

SEQ ID NO: 3222226 - DNA, 18 bp, Homo sapiens
tgaacaaatcaaattgct

SEQ ID NO: 3222227 - DNA, 20 bp, Homo sapiens
tgaacaaatcaaattgctta

SEQ ID NO: 3222228 - DNA, 11 bp, Homo sapiens
tgaacaagaat

SEQ ID NO: 3222229 - DNA, 18 bp, Homo sapiens
tgaacaagaattggaagc

SEQ ID NO: 3222230 - DNA, 18 bp, Homo sapiens
tgaacaagttttaatgta

SEQ ID NO: 3222231 - DNA, 16 bp, Homo sapiens
tgaacaatcaaagcac

SEQ ID NO: 3222232 - DNA, 19 bp, Homo sapiens
tgaacacaaactgtaaata

SEQ ID NO: 3222233 - DNA, 13 bp, Homo sapiens
tgaacacaggcag

SEQ ID NO: 3222234 - DNA, 22 bp, Homo sapiens
tgaacacgaaagaaatgtacct

SEQ ID NO: 3222235 - DNA, 18 bp, Homo sapiens
tgaacactggcaacaaca

SEQ ID NO: 3222236 - DNA, 14 bp, Homo sapiens
tgaacacttagtga

SEQ ID NO: 3222237 - DNA, 13 bp, Homo sapiens
tgaacacttataa

SEQ ID NO: 3222238 - DNA, 15 bp, Homo sapiens
tgaacagctctgaga

SEQ ID NO: 3222239 - DNA, 19 bp, Homo sapiens
tgaacagctctgagatcct

SEQ ID NO: 3222240 - DNA, 19 bp, Homo sapiens
tgaacatacttcaaaaata

SEQ ID NO: 3222241 - DNA, 23 bp, Homo sapiens
tgaacatacttcaaaaataatgt

SEQ ID NO: 3222242 - DNA, 18 bp, Homo sapiens
tgaacatgggagctcttg

SEQ ID NO: 3222243 - DNA, 18 bp, Homo sapiens
tgaacatgtgccttttct

SEQ ID NO: 3222244 - DNA, 15 bp, Homo sapiens
tgaacatgtttacag

SEQ ID NO: 3222245 - DNA, 11 bp, Homo sapiens
tgaacattcca

SEQ ID NO: 3222246 - DNA, 12 bp, Homo sapiens
tgaacattccaa

SEQ ID NO: 3222247 - DNA, 11 bp, Homo sapiens
tgaaccaaatt

SEQ ID NO: 3222248 - DNA, 18 bp, Homo sapiens
tgaaccaaattgcactga

SEQ ID NO: 3222249 - DNA, 15 bp, Homo sapiens
tgaaccacaactttg

SEQ ID NO: 3222250 - DNA, 16 bp, Homo sapiens
tgaaccacaggtttta

SEQ ID NO: 3222251 - DNA, 19 bp, Homo sapiens
tgaaccacatcttgctctg

SEQ ID NO: 3222252 - DNA, 20 bp, Homo sapiens
tgaaccacatcttgctctgc

SEQ ID NO: 3222253 - DNA, 21 bp, Homo sapiens
tgaaccacatcttgctctgct

SEQ ID NO: 3222254 - DNA, 22 bp, Homo sapiens
tgaaccacatcttgctctgctg

SEQ ID NO: 3222255 - DNA, 20 bp, Homo sapiens
tgaaccaccacacccagccc

SEQ ID NO: 3222256 - DNA, 22 bp, Homo sapiens
tgaaccaccacacccagcccac

SEQ ID NO: 3222257 - DNA, 16 bp, Homo sapiens
tgaaccacgcgggggc

SEQ ID NO: 3222258 - DNA, 15 bp, Homo sapiens
tgaaccacttcattc

SEQ ID NO: 3222259 - DNA, 16 bp, Homo sapiens
tgaaccagctcatctc

SEQ ID NO: 3222260 - DNA, 16 bp, Homo sapiens
tgaaccataaattcaa

SEQ ID NO: 3222261 - DNA, 22 bp, Homo sapiens
tgaaccataaattcaactttgt

SEQ ID NO: 3222262 - DNA, 13 bp, Homo sapiens
tgaaccccatggg

SEQ ID NO: 3222263 - DNA, 13 bp, Homo sapiens
tgaacccctgtgt

SEQ ID NO: 3222264 - DNA, 13 bp, Homo sapiens
tgaaccctccagg

SEQ ID NO: 3222265 - DNA, 17 bp, Homo sapiens
tgaaccctttgtttctt

SEQ ID NO: 3222266 - DNA, 20 bp, Homo sapiens
tgaacctaccttcatttcag

SEQ ID NO: 3222267 - DNA, 14 bp, Homo sapiens
tgaacctatccttc

SEQ ID NO: 3222268 - DNA, 15 bp, Homo sapiens
tgaacctattttcat

SEQ ID NO: 3222269 - DNA, 17 bp, Homo sapiens
tgaacctattttcattt

SEQ ID NO: 3222270 - DNA, 21 bp, Homo sapiens
tgaacctttttttttgaaaca

SEQ ID NO: 3222271 - DNA, 22 bp, Homo sapiens
tgaactaagaaacttttgtaaa

SEQ ID NO: 3222272 - DNA, 19 bp, Homo sapiens
tgaactcaccctgggagcc

SEQ ID NO: 3222273 - DNA, 18 bp, Homo sapiens
tgaactcactttcctcct

SEQ ID NO: 3222274 - DNA, 23 bp, Homo sapiens
tgaactctcaaaagtctattttt

SEQ ID NO: 3222275 - DNA, 16 bp, Homo sapiens
tgaactctgaactttg

SEQ ID NO: 3222276 - DNA, 17 bp, Homo sapiens
tgaactctgttccccca

SEQ ID NO: 3222277 - DNA, 19 bp, Homo sapiens
tgaactcttagaaatgaag

SEQ ID NO: 3222278 - DNA, 19 bp, Homo sapiens
tgaactcttctgcaaaaat

SEQ ID NO: 3222279 - DNA, 13 bp, Homo sapiens
tgaactgaacacc

SEQ ID NO: 3222280 - DNA, 23 bp, Homo sapiens
tgaactgcaggataaaatggtac

SEQ ID NO: 3222281 - DNA, 12 bp, Homo sapiens
tgaactgcccac

SEQ ID NO: 3222282 - DNA, 13 bp, Homo sapiens
tgaactgcccact

SEQ ID NO: 3222283 - DNA, 16 bp, Homo sapiens
tgaactgctttcaagt

SEQ ID NO: 3222284 - DNA, 15 bp, Homo sapiens
tgaactgcttttcct

SEQ ID NO: 3222285 - DNA, 16 bp, Homo sapiens
tgaactgcttttcctc

SEQ ID NO: 3222286 - DNA, 15 bp, Homo sapiens
tgaactggaagaaag

SEQ ID NO: 3222287 - DNA, 23 bp, Homo sapiens
tgaactgggtacttgtggacaca

SEQ ID NO: 3222288 - DNA, 22 bp, Homo sapiens
tgaactgttacaacttgtattt

SEQ ID NO: 3222289 - DNA, 18 bp, Homo sapiens
tgaactgttagatgctga

SEQ ID NO: 3222290 - DNA, 23 bp, Homo sapiens
tgaacttcccacacgattagctt

SEQ ID NO: 3222291 - DNA, 15 bp, Homo sapiens
tgaacttctctcaga

SEQ ID NO: 3222292 - DNA, 22 bp, Homo sapiens
tgaacttctctcagacttactt

SEQ ID NO: 3222293 - DNA, 14 bp, Homo sapiens
tgaacttgttactt

SEQ ID NO: 3222294 - DNA, 22 bp, Homo sapiens
tgaactttctcttcatactttt

SEQ ID NO: 3222295 - DNA, 14 bp, Homo sapiens
tgaactttggagag

SEQ ID NO: 3222296 - DNA, 14 bp, Homo sapiens
tgaagaaaaaatca

SEQ ID NO: 3222297 - DNA, 20 bp, Homo sapiens
tgaagaaaaaatcagaacta

SEQ ID NO: 3222298 - DNA, 17 bp, Homo sapiens
tgaagaaattgtggggg

SEQ ID NO: 3222299 - DNA, 17 bp, Homo sapiens
tgaagaaatttatgaag

SEQ ID NO: 3222300 - DNA, 22 bp, Homo sapiens
tgaagaaatttatgaagcagat

SEQ ID NO: 3222301 - DNA, 18 bp, Homo sapiens
tgaagaacacagcatgtg

SEQ ID NO: 3222302 - DNA, 22 bp, Homo sapiens
tgaagaacacagcatgtgccaa

SEQ ID NO: 3222303 - DNA, 21 bp, Homo sapiens
tgaagaacaggcttggcaaag

SEQ ID NO: 3222304 - DNA, 14 bp, Homo sapiens
tgaagaacatgtga

SEQ ID NO: 3222305 - DNA, 19 bp, Homo sapiens
tgaagaactgaggaggaaa

SEQ ID NO: 3222306 - DNA, 15 bp, Homo sapiens
tgaagaactgcaggc

SEQ ID NO: 3222307 - DNA, 17 bp, Homo sapiens
tgaagaactgcaggccc

SEQ ID NO: 3222308 - DNA, 20 bp, Homo sapiens
tgaagaactgcaggccctgg

SEQ ID NO: 3222309 - DNA, 23 bp, Homo sapiens
tgaagaactgcaggccctggcct

SEQ ID NO: 3222310 - DNA, 14 bp, Homo sapiens
tgaagaagcctttg

SEQ ID NO: 3222311 - DNA, 19 bp, Homo sapiens
tgaagaaggaaagaaccga

SEQ ID NO: 3222312 - DNA, 14 bp, Homo sapiens
tgaagaatacagtt

SEQ ID NO: 3222313 - DNA, 15 bp, Homo sapiens
tgaagaatacagtta

SEQ ID NO: 3222314 - DNA, 14 bp, Homo sapiens
tgaagaatatttaa

SEQ ID NO: 3222315 - DNA, 23 bp, Homo sapiens
tgaagaatatttaagaaaagcac

SEQ ID NO: 3222316 - DNA, 17 bp, Homo sapiens
tgaagaatgcattcaaa

SEQ ID NO: 3222317 - DNA, 14 bp, Homo sapiens
tgaagaatgtctgt

SEQ ID NO: 3222318 - DNA, 13 bp, Homo sapiens
tgaagaattgaaa

SEQ ID NO: 3222319 - DNA, 13 bp, Homo sapiens
tgaagaatttaga

SEQ ID NO: 3222320 - DNA, 13 bp, Homo sapiens
tgaagacccagga

SEQ ID NO: 3222321 - DNA, 19 bp, Homo sapiens
tgaagactcattcttctgt

SEQ ID NO: 3222322 - DNA, 16 bp, Homo sapiens
tgaagactgagaactt

SEQ ID NO: 3222323 - DNA, 15 bp, Homo sapiens
tgaagactggaagct

SEQ ID NO: 3222324 - DNA, 23 bp, Homo sapiens
tgaagagacagttatttatagtc

SEQ ID NO: 3222325 - DNA, 23 bp, Homo sapiens
tgaagagagggacaggcactcca

SEQ ID NO: 3222326 - DNA, 17 bp, Homo sapiens
tgaagagatttcaacat

SEQ ID NO: 3222327 - DNA, 14 bp, Homo sapiens
tgaagagcttgctt

SEQ ID NO: 3222328 - DNA, 17 bp, Homo sapiens
tgaagagcttgctttga

SEQ ID NO: 3222329 - DNA, 19 bp, Homo sapiens
tgaagagcttgctttgatt

SEQ ID NO: 3222330 - DNA, 18 bp, Homo sapiens
tgaagaggaggccgcctc

SEQ ID NO: 3222331 - DNA, 21 bp, Homo sapiens
tgaagaggatattcttctctt

SEQ ID NO: 3222332 - DNA, 17 bp, Homo sapiens
tgaagaggcgggccagc

SEQ ID NO: 3222333 - DNA, 19 bp, Homo sapiens
tgaagaggcgggccagcca

SEQ ID NO: 3222334 - DNA, 23 bp, Homo sapiens
tgaagaggcgggccagccaggcg

SEQ ID NO: 3222335 - DNA, 13 bp, Homo sapiens
tgaagaggcttct

SEQ ID NO: 3222336 - DNA, 15 bp, Homo sapiens
tgaagaggggcagcc

SEQ ID NO: 3222337 - DNA, 16 bp, Homo sapiens
tgaagaggggcagccc

SEQ ID NO: 3222338 - DNA, 17 bp, Homo sapiens
tgaagaggggcagccct

SEQ ID NO: 3222339 - DNA, 19 bp, Homo sapiens
tgaagagtatccttccttc

SEQ ID NO: 3222340 - DNA, 16 bp, Homo sapiens
tgaagagtgagagggc

SEQ ID NO: 3222341 - DNA, 17 bp, Homo sapiens
tgaagataatttgcata

SEQ ID NO: 3222342 - DNA, 20 bp, Homo sapiens
tgaagatatatttcactttt

SEQ ID NO: 3222343 - DNA, 11 bp, Homo sapiens
tgaagatattt

SEQ ID NO: 3222344 - DNA, 19 bp, Homo sapiens
tgaagatctgagatttttt

SEQ ID NO: 3222345 - DNA, 20 bp, Homo sapiens
tgaagattaggagaaacaca

SEQ ID NO: 3222346 - DNA, 15 bp, Homo sapiens
tgaagcaaatcagaa

SEQ ID NO: 3222347 - DNA, 23 bp, Homo sapiens
tgaagcacctactatgtgctggg

SEQ ID NO: 3222348 - DNA, 20 bp, Homo sapiens
tgaagcagcctctccccagg

SEQ ID NO: 3222349 - DNA, 19 bp, Homo sapiens
tgaagcagtgcctcgaggc

SEQ ID NO: 3222350 - DNA, 22 bp, Homo sapiens
tgaagcatagataatattgttt

SEQ ID NO: 3222351 - DNA, 12 bp, Homo sapiens
tgaagcatgctt

SEQ ID NO: 3222352 - DNA, 19 bp, Homo sapiens
tgaagcatgtttcatgttt

SEQ ID NO: 3222353 - DNA, 18 bp, Homo sapiens
tgaagcattctccccagt

SEQ ID NO: 3222354 - DNA, 14 bp, Homo sapiens
tgaagccaaagaaa

SEQ ID NO: 3222355 - DNA, 15 bp, Homo sapiens
tgaagccaaatgaaa

SEQ ID NO: 3222356 - DNA, 19 bp, Homo sapiens
tgaagccaaatgaaactca

SEQ ID NO: 3222357 - DNA, 20 bp, Homo sapiens
tgaagccactgaagctggga

SEQ ID NO: 3222358 - DNA, 16 bp, Homo sapiens
tgaagccagccttctt

SEQ ID NO: 3222359 - DNA, 19 bp, Homo sapiens
tgaagcccaataaacctct

SEQ ID NO: 3222360 - DNA, 17 bp, Homo sapiens
tgaagcccatttctccg

SEQ ID NO: 3222361 - DNA, 17 bp, Homo sapiens
tgaagccgactctggcc

SEQ ID NO: 3222362 - DNA, 18 bp, Homo sapiens
tgaagccgactctggccc

SEQ ID NO: 3222363 - DNA, 14 bp, Homo sapiens
tgaagccttttgtt

SEQ ID NO: 3222364 - DNA, 21 bp, Homo sapiens
tgaagcgaaacacagagaagc

SEQ ID NO: 3222365 - DNA, 14 bp, Homo sapiens
tgaagctactgtgt

SEQ ID NO: 3222366 - DNA, 22 bp, Homo sapiens
tgaagctactgtgtgtgtgaat

SEQ ID NO: 3222367 - DNA, 15 bp, Homo sapiens
tgaagctgaaaatat

SEQ ID NO: 3222368 - DNA, 15 bp, Homo sapiens
tgaagcttgactccc

SEQ ID NO: 3222369 - DNA, 13 bp, Homo sapiens
tgaagctttgtag

SEQ ID NO: 3222370 - DNA, 23 bp, Homo sapiens
tgaaggaaaaacacaagcaaaaa

SEQ ID NO: 3222371 - DNA, 14 bp, Homo sapiens
tgaaggaagagaag

SEQ ID NO: 3222372 - DNA, 23 bp, Homo sapiens
tgaaggaagccaaatttatcaaa

SEQ ID NO: 3222373 - DNA, 20 bp, Homo sapiens
tgaaggaataaattgctcct

SEQ ID NO: 3222374 - DNA, 21 bp, Homo sapiens
tgaaggaatagccagagagga

SEQ ID NO: 3222375 - DNA, 20 bp, Homo sapiens
tgaaggaatcattccagtgc

SEQ ID NO: 3222376 - DNA, 19 bp, Homo sapiens
tgaaggaattagaaatgaa

SEQ ID NO: 3222377 - DNA, 20 bp, Homo sapiens
tgaaggacattgcggacagc

SEQ ID NO: 3222378 - DNA, 22 bp, Homo sapiens
tgaaggagaggcaacatccaaa

SEQ ID NO: 3222379 - DNA, 22 bp, Homo sapiens
tgaaggattatggaaaaataaa

SEQ ID NO: 3222380 - DNA, 19 bp, Homo sapiens
tgaaggcccaagagcagag

SEQ ID NO: 3222381 - DNA, 22 bp, Homo sapiens
tgaaggcccaagagcagagtct

SEQ ID NO: 3222382 - DNA, 23 bp, Homo sapiens
tgaaggcccaagagcagagtctg

SEQ ID NO: 3222383 - DNA, 16 bp, Homo sapiens
tgaaggcctggctgga

SEQ ID NO: 3222384 - DNA, 18 bp, Homo sapiens
tgaagggaaacaaagaag

SEQ ID NO: 3222385 - DNA, 18 bp, Homo sapiens
tgaagggaaaggatattt

SEQ ID NO: 3222386 - DNA, 21 bp, Homo sapiens
tgaagggaaaggatattttct

SEQ ID NO: 3222387 - DNA, 15 bp, Homo sapiens
tgaagggaagagaca

SEQ ID NO: 3222388 - DNA, 19 bp, Homo sapiens
tgaagggagagccagctcc

SEQ ID NO: 3222389 - DNA, 14 bp, Homo sapiens
tgaagggcccagga

SEQ ID NO: 3222390 - DNA, 15 bp, Homo sapiens
tgaaggttaggattt

SEQ ID NO: 3222391 - DNA, 14 bp, Homo sapiens
tgaagtaaaactta

SEQ ID NO: 3222392 - DNA, 23 bp, Homo sapiens
tgaagtaacatgcatactttatt

SEQ ID NO: 3222393 - DNA, 14 bp, Homo sapiens
tgaagtaatgaatt

SEQ ID NO: 3222394 - DNA, 14 bp, Homo sapiens
tgaagtagtttgta

SEQ ID NO: 3222395 - DNA, 14 bp, Homo sapiens
tgaagtatattctt

SEQ ID NO: 3222396 - DNA, 22 bp, Homo sapiens
tgaagtatattcttattggaaa

SEQ ID NO: 3222397 - DNA, 19 bp, Homo sapiens
tgaagtattagacttctaa

SEQ ID NO: 3222398 - DNA, 22 bp, Homo sapiens
tgaagtattagacttctaaata

SEQ ID NO: 3222399 - DNA, 14 bp, Homo sapiens
tgaagtcacacagt

SEQ ID NO: 3222400 - DNA, 16 bp, Homo sapiens
tgaagtgactgttgta

SEQ ID NO: 3222401 - DNA, 20 bp, Homo sapiens
tgaagtgactgttgtaccat

SEQ ID NO: 3222402 - DNA, 14 bp, Homo sapiens
tgaagtgagtttta

SEQ ID NO: 3222403 - DNA, 22 bp, Homo sapiens
tgaagtgctgtttattaatctt

SEQ ID NO: 3222404 - DNA, 21 bp, Homo sapiens
tgaagtggttgcattctacta

SEQ ID NO: 3222405 - DNA, 20 bp, Homo sapiens
tgaagtgttttgttctttct

SEQ ID NO: 3222406 - DNA, 16 bp, Homo sapiens
tgaagttagtggaaat

SEQ ID NO: 3222407 - DNA, 21 bp, Homo sapiens
tgaagttagtggaaatctgaa

SEQ ID NO: 3222408 - DNA, 14 bp, Homo sapiens
tgaagttggcacat

SEQ ID NO: 3222409 - DNA, 21 bp, Homo sapiens
tgaagtttcaagttttaaagt

SEQ ID NO: 3222410 - DNA, 22 bp, Homo sapiens
tgaagtttcaagttttaaagtt

SEQ ID NO: 3222411 - DNA, 14 bp, Homo sapiens
tgaagtttgtgggg

SEQ ID NO: 3222412 - DNA, 20 bp, Homo sapiens
tgaagtttttgaaatacctt

SEQ ID NO: 3222413 - DNA, 22 bp, Homo sapiens
tgaagtttttttgctgctgcct

SEQ ID NO: 3222414 - DNA, 14 bp, Homo sapiens
tgaataaaaatgca

SEQ ID NO: 3222415 - DNA, 15 bp, Homo sapiens
tgaataaaaatgcac

SEQ ID NO: 3222416 - DNA, 16 bp, Homo sapiens
tgaataaaacactcat

SEQ ID NO: 3222417 - DNA, 19 bp, Homo sapiens
tgaataaaacactcatccc

SEQ ID NO: 3222418 - DNA, 13 bp, Homo sapiens
tgaataaactgaa

SEQ ID NO: 3222419 - DNA, 16 bp, Homo sapiens
tgaataaataaatgta

SEQ ID NO: 3222420 - DNA, 13 bp, Homo sapiens
tgaataaatgtct

SEQ ID NO: 3222421 - DNA, 21 bp, Homo sapiens
tgaataaattctataggaaca

SEQ ID NO: 3222422 - DNA, 20 bp, Homo sapiens
tgaataagctttctctcaga

SEQ ID NO: 3222423 - DNA, 15 bp, Homo sapiens
tgaataatttcccaa

SEQ ID NO: 3222424 - DNA, 12 bp, Homo sapiens
tgaatacaatta

SEQ ID NO: 3222425 - DNA, 20 bp, Homo sapiens
tgaatacaattaaaggtcct

SEQ ID NO: 3222426 - DNA, 18 bp, Homo sapiens
tgaataccacttacctca

SEQ ID NO: 3222427 - DNA, 17 bp, Homo sapiens
tgaataccattaaaact

SEQ ID NO: 3222428 - DNA, 14 bp, Homo sapiens
tgaatacctgctca

SEQ ID NO: 3222429 - DNA, 21 bp, Homo sapiens
tgaatataagaaaatgcttga

SEQ ID NO: 3222430 - DNA, 19 bp, Homo sapiens
tgaatatagcctgcctcag

SEQ ID NO: 3222431 - DNA, 15 bp, Homo sapiens
tgaatatatagaatt

SEQ ID NO: 3222432 - DNA, 23 bp, Homo sapiens
tgaatatatagaattcagaaaat

SEQ ID NO: 3222433 - DNA, 19 bp, Homo sapiens
tgaatattactcctatttt

SEQ ID NO: 3222434 - DNA, 13 bp, Homo sapiens
tgaatattactct

SEQ ID NO: 3222435 - DNA, 15 bp, Homo sapiens
tgaatattttgataa

SEQ ID NO: 3222436 - DNA, 14 bp, Homo sapiens
tgaatattttggaa

SEQ ID NO: 3222437 - DNA, 18 bp, Homo sapiens
tgaatattttggaaactg

SEQ ID NO: 3222438 - DNA, 19 bp, Homo sapiens
tgaatattttggaaactgc

SEQ ID NO: 3222439 - DNA, 20 bp, Homo sapiens
tgaatattttggaaactgct

SEQ ID NO: 3222440 - DNA, 23 bp, Homo sapiens
tgaatattttggaaactgctaaa

SEQ ID NO: 3222441 - DNA, 21 bp, Homo sapiens
tgaatattttttatttctaag

SEQ ID NO: 3222442 - DNA, 13 bp, Homo sapiens
tgaatcaatgaaa

SEQ ID NO: 3222443 - DNA, 21 bp, Homo sapiens
tgaatcaatgaaaaatgtaat

SEQ ID NO: 3222444 - DNA, 14 bp, Homo sapiens
tgaatcactgtttt

SEQ ID NO: 3222445 - DNA, 19 bp, Homo sapiens
tgaatcactgtttttagac

SEQ ID NO: 3222446 - DNA, 19 bp, Homo sapiens
tgaatcagtataaacaaag

SEQ ID NO: 3222447 - DNA, 21 bp, Homo sapiens
tgaatcagtataaacaaagtt

SEQ ID NO: 3222448 - DNA, 22 bp, Homo sapiens
tgaatcagtataaacaaagtta

SEQ ID NO: 3222449 - DNA, 12 bp, Homo sapiens
tgaatctataaa

SEQ ID NO: 3222450 - DNA, 19 bp, Homo sapiens
tgaatctttccaataaacc

SEQ ID NO: 3222451 - DNA, 18 bp, Homo sapiens
tgaatgaaaaatttaagc

SEQ ID NO: 3222452 - DNA, 11 bp, Homo sapiens
tgaatgaaaac

SEQ ID NO: 3222453 - DNA, 16 bp, Homo sapiens
tgaatgaaaacatttt

SEQ ID NO: 3222454 - DNA, 15 bp, Homo sapiens
tgaatgaaaataact

SEQ ID NO: 3222455 - DNA, 17 bp, Homo sapiens
tgaatgacaacagaagc

SEQ ID NO: 3222456 - DNA, 18 bp, Homo sapiens
tgaatgatctctctgaat

SEQ ID NO: 3222457 - DNA, 21 bp, Homo sapiens
tgaatgccactgccttcgctt

SEQ ID NO: 3222458 - DNA, 22 bp, Homo sapiens
tgaatgccactgccttcgcttc

SEQ ID NO: 3222459 - DNA, 18 bp, Homo sapiens
tgaatgcctcctgtgggg

SEQ ID NO: 3222460 - DNA, 18 bp, Homo sapiens
tgaatgcctcgctccctt

SEQ ID NO: 3222461 - DNA, 11 bp, Homo sapiens
tgaatgctaag

SEQ ID NO: 3222462 - DNA, 13 bp, Homo sapiens
tgaatgctgggac

SEQ ID NO: 3222463 - DNA, 14 bp, Homo sapiens
tgaatgctgggact

SEQ ID NO: 3222464 - DNA, 19 bp, Homo sapiens
tgaatgctgggactcagcc

SEQ ID NO: 3222465 - DNA, 23 bp, Homo sapiens
tgaatgctttttgaatgttattt

SEQ ID NO: 3222466 - DNA, 14 bp, Homo sapiens
tgaatggattggat

SEQ ID NO: 3222467 - DNA, 17 bp, Homo sapiens
tgaatggattggattat

SEQ ID NO: 3222468 - DNA, 21 bp, Homo sapiens
tgaatggattggattatttaa

SEQ ID NO: 3222469 - DNA, 12 bp, Homo sapiens
tgaatggcctgc

SEQ ID NO: 3222470 - DNA, 21 bp, Homo sapiens
tgaatggcctgccttgaagcc

SEQ ID NO: 3222471 - DNA, 13 bp, Homo sapiens
tgaatggtcagcg

SEQ ID NO: 3222472 - DNA, 21 bp, Homo sapiens
tgaatggtcagcgttgcatgt

SEQ ID NO: 3222473 - DNA, 23 bp, Homo sapiens
tgaatggttccatgcctgagggt

SEQ ID NO: 3222474 - DNA, 20 bp, Homo sapiens
tgaatggttttcaaaataaa

SEQ ID NO: 3222475 - DNA, 15 bp, Homo sapiens
tgaatgtatcaggaa

SEQ ID NO: 3222476 - DNA, 23 bp, Homo sapiens
tgaatgtcttttgaatattccca

SEQ ID NO: 3222477 - DNA, 18 bp, Homo sapiens
tgaatgtgtctggacctc

SEQ ID NO: 3222478 - DNA, 12 bp, Homo sapiens
tgaatgttctga

SEQ ID NO: 3222479 - DNA, 14 bp, Homo sapiens
tgaatgttctgaca

SEQ ID NO: 3222480 - DNA, 19 bp, Homo sapiens
tgaatgtttacactctttg

SEQ ID NO: 3222481 - DNA, 17 bp, Homo sapiens
tgaatgtttacatgtca

SEQ ID NO: 3222482 - DNA, 21 bp, Homo sapiens
tgaatgtttccaacctggagt

SEQ ID NO: 3222483 - DNA, 11 bp, Homo sapiens
tgaattaaaac

SEQ ID NO: 3222484 - DNA, 23 bp, Homo sapiens
tgaattaatatccctacatgtat

SEQ ID NO: 3222485 - DNA, 23 bp, Homo sapiens
tgaattaatcatctataaagaag

SEQ ID NO: 3222486 - DNA, 13 bp, Homo sapiens
tgaattacagtga

SEQ ID NO: 3222487 - DNA, 15 bp, Homo sapiens
tgaattacagtgaaa

SEQ ID NO: 3222488 - DNA, 18 bp, Homo sapiens
tgaattacagtgaaattt

SEQ ID NO: 3222489 - DNA, 17 bp, Homo sapiens
tgaattaggctgtaact

SEQ ID NO: 3222490 - DNA, 21 bp, Homo sapiens
tgaattaggctgtaactactt

SEQ ID NO: 3222491 - DNA, 15 bp, Homo sapiens
tgaattataacagtt

SEQ ID NO: 3222492 - DNA, 18 bp, Homo sapiens
tgaattataacagttata

SEQ ID NO: 3222493 - DNA, 18 bp, Homo sapiens
tgaattatcagcaaagaa

SEQ ID NO: 3222494 - DNA, 19 bp, Homo sapiens
tgaattatcagcaaagaaa

SEQ ID NO: 3222495 - DNA, 15 bp, Homo sapiens
tgaattattctgatt

SEQ ID NO: 3222496 - DNA, 15 bp, Homo sapiens
tgaattcaaagcttg

SEQ ID NO: 3222497 - DNA, 12 bp, Homo sapiens
tgaattcagtaa

SEQ ID NO: 3222498 - DNA, 18 bp, Homo sapiens
tgaattctcggaatggca

SEQ ID NO: 3222499 - DNA, 17 bp, Homo sapiens
tgaattcttatgcttat

SEQ ID NO: 3222500 - DNA, 16 bp, Homo sapiens
tgaattctttaaggag

SEQ ID NO: 3222501 - DNA, 17 bp, Homo sapiens
tgaattgaagtttcaag

SEQ ID NO: 3222502 - DNA, 13 bp, Homo sapiens
tgaattgactacc

SEQ ID NO: 3222503 - DNA, 13 bp, Homo sapiens
tgaattgtacaga

SEQ ID NO: 3222504 - DNA, 17 bp, Homo sapiens
tgaattgttttctttaa

SEQ ID NO: 3222505 - DNA, 14 bp, Homo sapiens
tgaatttaaatata

SEQ ID NO: 3222506 - DNA, 16 bp, Homo sapiens
tgaatttaaatataat

SEQ ID NO: 3222507 - DNA, 21 bp, Homo sapiens
tgaatttatacctacctgtgt

SEQ ID NO: 3222508 - DNA, 13 bp, Homo sapiens
tgaatttctaaat

SEQ ID NO: 3222509 - DNA, 20 bp, Homo sapiens
tgaatttcttctaattattt

SEQ ID NO: 3222510 - DNA, 13 bp, Homo sapiens
tgaatttgaatga

SEQ ID NO: 3222511 - DNA, 22 bp, Homo sapiens
tgaattttctaaaagctttcat

SEQ ID NO: 3222512 - DNA, 16 bp, Homo sapiens
tgaattttgttgctgt

SEQ ID NO: 3222513 - DNA, 16 bp, Homo sapiens
tgaatttttttttcct

SEQ ID NO: 3222514 - DNA, 18 bp, Homo sapiens
tgacaaaaaatgttttaa

SEQ ID NO: 3222515 - DNA, 10 bp, Homo sapiens
tgacaaaatt

SEQ ID NO: 3222516 - DNA, 14 bp, Homo sapiens
tgacaaagttactg

SEQ ID NO: 3222517 - DNA, 17 bp, Homo sapiens
tgacaaatattttcatg

SEQ ID NO: 3222518 - DNA, 15 bp, Homo sapiens
tgacaaatctgtgta

SEQ ID NO: 3222519 - DNA, 16 bp, Homo sapiens
tgacaaatgtgtatgt

SEQ ID NO: 3222520 - DNA, 12 bp, Homo sapiens
tgacaacagaaa

SEQ ID NO: 3222521 - DNA, 14 bp, Homo sapiens
tgacaacagaagct

SEQ ID NO: 3222522 - DNA, 22 bp, Homo sapiens
tgacaacagaagcttcagaagt

SEQ ID NO: 3222523 - DNA, 21 bp, Homo sapiens
tgacaaccattaaagtcagaa

SEQ ID NO: 3222524 - DNA, 14 bp, Homo sapiens
tgacaactgtgact

SEQ ID NO: 3222525 - DNA, 15 bp, Homo sapiens
tgacaactgtgactg

SEQ ID NO: 3222526 - DNA, 22 bp, Homo sapiens
tgacaagctcctggtcttgaga

SEQ ID NO: 3222527 - DNA, 15 bp, Homo sapiens
tgacaagctgacttg

SEQ ID NO: 3222528 - DNA, 18 bp, Homo sapiens
tgacaagctgacttggca

SEQ ID NO: 3222529 - DNA, 22 bp, Homo sapiens
tgacaataatattgttgtataa

SEQ ID NO: 3222530 - DNA, 13 bp, Homo sapiens
tgacaatgatgat

SEQ ID NO: 3222531 - DNA, 18 bp, Homo sapiens
tgacaattactcaggttt

SEQ ID NO: 3222532 - DNA, 14 bp, Homo sapiens
tgacacaaaggtgg

SEQ ID NO: 3222533 - DNA, 16 bp, Homo sapiens
tgacacaaaggtggaa

SEQ ID NO: 3222534 - DNA, 13 bp, Homo sapiens
tgacacacagaaa

SEQ ID NO: 3222535 - DNA, 19 bp, Homo sapiens
tgacacacagaaatgtgtc

SEQ ID NO: 3222536 - DNA, 14 bp, Homo sapiens
tgacacacagctct

SEQ ID NO: 3222537 - DNA, 19 bp, Homo sapiens
tgacacacagctctgtcct

SEQ ID NO: 3222538 - DNA, 21 bp, Homo sapiens
tgacacacagctctgtcctgg

SEQ ID NO: 3222539 - DNA, 16 bp, Homo sapiens
tgacacaccaggcgct

SEQ ID NO: 3222540 - DNA, 22 bp, Homo sapiens
tgacacaccaggcgctaattca

SEQ ID NO: 3222541 - DNA, 18 bp, Homo sapiens
tgacacagaaaatgttga

SEQ ID NO: 3222542 - DNA, 19 bp, Homo sapiens
tgacacagaaaatgttgag

SEQ ID NO: 3222543 - DNA, 16 bp, Homo sapiens
tgacacagcagcttca

SEQ ID NO: 3222544 - DNA, 16 bp, Homo sapiens
tgacacagtcagcatg

SEQ ID NO: 3222545 - DNA, 17 bp, Homo sapiens
tgacacagtcagcatgc

SEQ ID NO: 3222546 - DNA, 22 bp, Homo sapiens
tgacacatatgcaccttgtgtc

SEQ ID NO: 3222547 - DNA, 20 bp, Homo sapiens
tgacaccaaagccacctctg

SEQ ID NO: 3222548 - DNA, 17 bp, Homo sapiens
tgacaccattctcctgc

SEQ ID NO: 3222549 - DNA, 18 bp, Homo sapiens
tgacaccattctcctgcc

SEQ ID NO: 3222550 - DNA, 21 bp, Homo sapiens
tgacacccacaatcccaccta

SEQ ID NO: 3222551 - DNA, 15 bp, Homo sapiens
tgacaccctggcctg

SEQ ID NO: 3222552 - DNA, 16 bp, Homo sapiens
tgacaccctggcctga

SEQ ID NO: 3222553 - DNA, 18 bp, Homo sapiens
tgacactaaccagagtca

SEQ ID NO: 3222554 - DNA, 16 bp, Homo sapiens
tgacactgcagcagaa

SEQ ID NO: 3222555 - DNA, 15 bp, Homo sapiens
tgacactgctctaac

SEQ ID NO: 3222556 - DNA, 21 bp, Homo sapiens
tgacactgctctaacagccct

SEQ ID NO: 3222557 - DNA, 16 bp, Homo sapiens
tgacacttcagagagc

SEQ ID NO: 3222558 - DNA, 18 bp, Homo sapiens
tgacacttcagagagctg

SEQ ID NO: 3222559 - DNA, 20 bp, Homo sapiens
tgacactttgccagaaagca

SEQ ID NO: 3222560 - DNA, 22 bp, Homo sapiens
tgacagaatggctatcaaaaga

SEQ ID NO: 3222561 - DNA, 13 bp, Homo sapiens
tgacagacacagg

SEQ ID NO: 3222562 - DNA, 18 bp, Homo sapiens
tgacagacacaggcccgg

SEQ ID NO: 3222563 - DNA, 19 bp, Homo sapiens
tgacagacaggctcttagc

SEQ ID NO: 3222564 - DNA, 22 bp, Homo sapiens
tgacagaccacatctttatctg

SEQ ID NO: 3222565 - DNA, 13 bp, Homo sapiens
tgacagaggcagc

SEQ ID NO: 3222566 - DNA, 17 bp, Homo sapiens
tgacagaggcagcccca

SEQ ID NO: 3222567 - DNA, 14 bp, Homo sapiens
tgacagagtgagac

SEQ ID NO: 3222568 - DNA, 15 bp, Homo sapiens
tgacagagttcacta

SEQ ID NO: 3222569 - DNA, 21 bp, Homo sapiens
tgacagatatatttaagcctt

SEQ ID NO: 3222570 - DNA, 22 bp, Homo sapiens
tgacagatgtcagccgagccgg

SEQ ID NO: 3222571 - DNA, 11 bp, Homo sapiens
tgacagcctcc

SEQ ID NO: 3222572 - DNA, 18 bp, Homo sapiens
tgacaggaaagccctccc

SEQ ID NO: 3222573 - DNA, 21 bp, Homo sapiens
tgacaggaaagccctccccct

SEQ ID NO: 3222574 - DNA, 18 bp, Homo sapiens
tgacagggccagtggggc

SEQ ID NO: 3222575 - DNA, 23 bp, Homo sapiens
tgacagggccagtggggcctgtg

SEQ ID NO: 3222576 - DNA, 15 bp, Homo sapiens
tgacaggtaaactat

SEQ ID NO: 3222577 - DNA, 14 bp, Homo sapiens
tgacagtcatcatc

SEQ ID NO: 3222578 - DNA, 15 bp, Homo sapiens
tgacagtcttgtgct

SEQ ID NO: 3222579 - DNA, 23 bp, Homo sapiens
tgacagtcttgtgcttttcctat

SEQ ID NO: 3222580 - DNA, 16 bp, Homo sapiens
tgacagttctgaagaa

SEQ ID NO: 3222581 - DNA, 15 bp, Homo sapiens
tgacatattatgcct

SEQ ID NO: 3222582 - DNA, 17 bp, Homo sapiens
tgacatattatgcctga

SEQ ID NO: 3222583 - DNA, 17 bp, Homo sapiens
tgacatcaaagcctggc

SEQ ID NO: 3222584 - DNA, 19 bp, Homo sapiens
tgacatcaaagcctggcct

SEQ ID NO: 3222585 - DNA, 15 bp, Homo sapiens
tgacatcacagcagc

SEQ ID NO: 3222586 - DNA, 16 bp, Homo sapiens
tgacatcacagcagcc

SEQ ID NO: 3222587 - DNA, 13 bp, Homo sapiens
tgacatcacttgt

SEQ ID NO: 3222588 - DNA, 18 bp, Homo sapiens
tgacatcacttgtacaaa

SEQ ID NO: 3222589 - DNA, 21 bp, Homo sapiens
tgacatcacttgtacaaaata

SEQ ID NO: 3222590 - DNA, 23 bp, Homo sapiens
tgacatcagttcctttgtgtgta

SEQ ID NO: 3222591 - DNA, 15 bp, Homo sapiens
tgacatccaaatcta

SEQ ID NO: 3222592 - DNA, 13 bp, Homo sapiens
tgacatcccttcc

SEQ ID NO: 3222593 - DNA, 14 bp, Homo sapiens
tgacatcccttcct

SEQ ID NO: 3222594 - DNA, 22 bp, Homo sapiens
tgacatcccttcctggaaacag

SEQ ID NO: 3222595 - DNA, 14 bp, Homo sapiens
tgacatctggaatc

SEQ ID NO: 3222596 - DNA, 21 bp, Homo sapiens
tgacatgattagcagaagaaa

SEQ ID NO: 3222597 - DNA, 13 bp, Homo sapiens
tgacatgcactga

SEQ ID NO: 3222598 - DNA, 15 bp, Homo sapiens
tgacatggaaatgaa

SEQ ID NO: 3222599 - DNA, 21 bp, Homo sapiens
tgacatgtggaaagtgaattt

SEQ ID NO: 3222600 - DNA, 19 bp, Homo sapiens
tgacatgtggggccaggtc

SEQ ID NO: 3222601 - DNA, 20 bp, Homo sapiens
tgacatgtggggccaggtca

SEQ ID NO: 3222602 - DNA, 18 bp, Homo sapiens
tgacatgttatatatttt

SEQ ID NO: 3222603 - DNA, 17 bp, Homo sapiens
tgacattaacagttttc

SEQ ID NO: 3222604 - DNA, 22 bp, Homo sapiens
tgacattaacagttttccatga

SEQ ID NO: 3222605 - DNA, 15 bp, Homo sapiens
tgacattaagaatgt

SEQ ID NO: 3222606 - DNA, 15 bp, Homo sapiens
tgacattgcgtttga

SEQ ID NO: 3222607 - DNA, 12 bp, Homo sapiens
tgacattgtctc

SEQ ID NO: 3222608 - DNA, 21 bp, Homo sapiens
tgacattgttggccaaagcca

SEQ ID NO: 3222609 - DNA, 16 bp, Homo sapiens
tgacatttaatttagt

SEQ ID NO: 3222610 - DNA, 16 bp, Homo sapiens
tgacatttcccaagtc

SEQ ID NO: 3222611 - DNA, 22 bp, Homo sapiens
tgacatttcccaagtcagacag

SEQ ID NO: 3222612 - DNA, 23 bp, Homo sapiens
tgacatttgggagacatgtgaca

SEQ ID NO: 3222613 - DNA, 24 bp, Homo sapiens
tgacatttgggagacatgtgacat

SEQ ID NO: 3222614 - DNA, 15 bp, Homo sapiens
tgacatttggtggta

SEQ ID NO: 3222615 - DNA, 22 bp, Homo sapiens
tgaccaaaccagccttcggagc

SEQ ID NO: 3222616 - DNA, 16 bp, Homo sapiens
tgaccaactagacatt

SEQ ID NO: 3222617 - DNA, 16 bp, Homo sapiens
tgaccaagaactgcat

SEQ ID NO: 3222618 - DNA, 20 bp, Homo sapiens
tgaccaaggtgcttttcttc

SEQ ID NO: 3222619 - DNA, 16 bp, Homo sapiens
tgaccaagttataaat

SEQ ID NO: 3222620 - DNA, 19 bp, Homo sapiens
tgaccaatgggatgaggtc

SEQ ID NO: 3222621 - DNA, 13 bp, Homo sapiens
tgaccacccacca

SEQ ID NO: 3222622 - DNA, 12 bp, Homo sapiens
tgaccaccctcc

SEQ ID NO: 3222623 - DNA, 19 bp, Homo sapiens
tgaccaccctcccctctct

SEQ ID NO: 3222624 - DNA, 21 bp, Homo sapiens
tgaccaccttctgtccccagc

SEQ ID NO: 3222625 - DNA, 22 bp, Homo sapiens
tgaccaccttctgtccccagcc

SEQ ID NO: 3222626 - DNA, 21 bp, Homo sapiens
tgaccacgctttctagctgtt

SEQ ID NO: 3222627 - DNA, 20 bp, Homo sapiens
tgaccacggacgtttccatc

SEQ ID NO: 3222628 - DNA, 21 bp, Homo sapiens
tgaccacggacgtttccatca

SEQ ID NO: 3222629 - DNA, 15 bp, Homo sapiens
tgaccactctgtctt

SEQ ID NO: 3222630 - DNA, 16 bp, Homo sapiens
tgaccactctgtcttg

SEQ ID NO: 3222631 - DNA, 18 bp, Homo sapiens
tgaccacttattctgtat

SEQ ID NO: 3222632 - DNA, 19 bp, Homo sapiens
tgaccagcaacttgtcttt

SEQ ID NO: 3222633 - DNA, 21 bp, Homo sapiens
tgaccagcctccatgctgcct

SEQ ID NO: 3222634 - DNA, 23 bp, Homo sapiens
tgaccagcctccatgctgcctcc

SEQ ID NO: 3222635 - DNA, 22 bp, Homo sapiens
tgaccaggatcccaagcctcct

SEQ ID NO: 3222636 - DNA, 19 bp, Homo sapiens
tgaccataattttttttaa

SEQ ID NO: 3222637 - DNA, 16 bp, Homo sapiens
tgaccatactgaggga

SEQ ID NO: 3222638 - DNA, 22 bp, Homo sapiens
tgaccatccactctaccctccc

SEQ ID NO: 3222639 - DNA, 19 bp, Homo sapiens
tgaccatcgtccttcctct

SEQ ID NO: 3222640 - DNA, 15 bp, Homo sapiens
tgaccatctgctttt

SEQ ID NO: 3222641 - DNA, 16 bp, Homo sapiens
tgaccatgctcatctg

SEQ ID NO: 3222642 - DNA, 18 bp, Homo sapiens
tgaccatgttcattataa

SEQ ID NO: 3222643 - DNA, 14 bp, Homo sapiens
tgaccatttataat

SEQ ID NO: 3222644 - DNA, 16 bp, Homo sapiens
tgacccaccagtgcct

SEQ ID NO: 3222645 - DNA, 15 bp, Homo sapiens
tgacccacccctgtg

SEQ ID NO: 3222646 - DNA, 16 bp, Homo sapiens
tgacccacccctgtgc

SEQ ID NO: 3222647 - DNA, 19 bp, Homo sapiens
tgacccagccccttgagaa

SEQ ID NO: 3222648 - DNA, 23 bp, Homo sapiens
tgacccagccccttgagaaacct

SEQ ID NO: 3222649 - DNA, 12 bp, Homo sapiens
tgacccaggccg

SEQ ID NO: 3222650 - DNA, 13 bp, Homo sapiens
tgacccaggccgc

SEQ ID NO: 3222651 - DNA, 21 bp, Homo sapiens
tgaccccagtggaaaacaaag

SEQ ID NO: 3222652 - DNA, 22 bp, Homo sapiens
tgacccccaaccaagtggctcc

SEQ ID NO: 3222653 - DNA, 13 bp, Homo sapiens
tgacccctcctca

SEQ ID NO: 3222654 - DNA, 20 bp, Homo sapiens
tgacccctcctcactggcca

SEQ ID NO: 3222655 - DNA, 21 bp, Homo sapiens
tgacccctcctcactggccat

SEQ ID NO: 3222656 - DNA, 15 bp, Homo sapiens
tgaccccttccctgt

SEQ ID NO: 3222657 - DNA, 15 bp, Homo sapiens
tgaccctgatgaaaa

SEQ ID NO: 3222658 - DNA, 22 bp, Homo sapiens
tgaccctgcgaaggggccctgg

SEQ ID NO: 3222659 - DNA, 23 bp, Homo sapiens
tgaccctgcgaaggggccctggt

SEQ ID NO: 3222660 - DNA, 16 bp, Homo sapiens
tgacccttcagggcca

SEQ ID NO: 3222661 - DNA, 20 bp, Homo sapiens
tgacccttcagggccagaag

SEQ ID NO: 3222662 - DNA, 21 bp, Homo sapiens
tgacccttccagacatacgaa

SEQ ID NO: 3222663 - DNA, 23 bp, Homo sapiens
tgacccttcccaatcagcactga

SEQ ID NO: 3222664 - DNA, 16 bp, Homo sapiens
tgaccggacttttctg

SEQ ID NO: 3222665 - DNA, 19 bp, Homo sapiens
tgaccgggacttcaaagcc

SEQ ID NO: 3222666 - DNA, 15 bp, Homo sapiens
tgaccgtactctcac

SEQ ID NO: 3222667 - DNA, 17 bp, Homo sapiens
tgacctaaattatttac

SEQ ID NO: 3222668 - DNA, 17 bp, Homo sapiens
tgacctagttttccatg

SEQ ID NO: 3222669 - DNA, 22 bp, Homo sapiens
tgacctagttttccatgcgtgt

SEQ ID NO: 3222670 - DNA, 18 bp, Homo sapiens
tgacctattcaccctcca

SEQ ID NO: 3222671 - DNA, 20 bp, Homo sapiens
tgacctcaagtgatctgccc

SEQ ID NO: 3222672 - DNA, 22 bp, Homo sapiens
tgacctcaggtgatccacccac

SEQ ID NO: 3222673 - DNA, 21 bp, Homo sapiens
tgacctctcagggcctggcag

SEQ ID NO: 3222674 - DNA, 12 bp, Homo sapiens
tgacctctgcct

SEQ ID NO: 3222675 - DNA, 13 bp, Homo sapiens
tgacctctgcctg

SEQ ID NO: 3222676 - DNA, 14 bp, Homo sapiens
tgacctctgcctga

SEQ ID NO: 3222677 - DNA, 18 bp, Homo sapiens
tgacctcttgctgtctct

SEQ ID NO: 3222678 - DNA, 21 bp, Homo sapiens
tgacctcttgctgtctctgct

SEQ ID NO: 3222679 - DNA, 22 bp, Homo sapiens
tgacctcttgctgtctctgctc

SEQ ID NO: 3222680 - DNA, 11 bp, Homo sapiens
tgacctgcagg

SEQ ID NO: 3222681 - DNA, 13 bp, Homo sapiens
tgacctgccccgc

SEQ ID NO: 3222682 - DNA, 20 bp, Homo sapiens
tgacctgcctctcacacaca

SEQ ID NO: 3222683 - DNA, 22 bp, Homo sapiens
tgacctggcatctaattctgat

SEQ ID NO: 3222684 - DNA, 19 bp, Homo sapiens
tgacctgtcatgcccccct

SEQ ID NO: 3222685 - DNA, 21 bp, Homo sapiens
tgacctgtcatgcccccctca

SEQ ID NO: 3222686 - DNA, 18 bp, Homo sapiens
tgacctgtgaccagcact

SEQ ID NO: 3222687 - DNA, 21 bp, Homo sapiens
tgaccttcctctggggctcta

SEQ ID NO: 3222688 - DNA, 23 bp, Homo sapiens
tgaccttcctctggggctctagg

SEQ ID NO: 3222689 - DNA, 24 bp, Homo sapiens
tgaccttcctctggggctctaggg

SEQ ID NO: 3222690 - DNA, 20 bp, Homo sapiens
tgaccttggagagacacagc

SEQ ID NO: 3222691 - DNA, 17 bp, Homo sapiens
tgaccttttatgtagta

SEQ ID NO: 3222692 - DNA, 18 bp, Homo sapiens
tgaccttttcttcatttt

SEQ ID NO: 3222693 - DNA, 15 bp, Homo sapiens
tgacgacaagtgctg

SEQ ID NO: 3222694 - DNA, 21 bp, Homo sapiens
tgacgacatacatgctacttt

SEQ ID NO: 3222695 - DNA, 14 bp, Homo sapiens
tgacgatgatgtac

SEQ ID NO: 3222696 - DNA, 16 bp, Homo sapiens
tgacgattccttctct

SEQ ID NO: 3222697 - DNA, 22 bp, Homo sapiens
tgacgccctgcgttggagccac

SEQ ID NO: 3222698 - DNA, 19 bp, Homo sapiens
tgacgcctgccctccccag

SEQ ID NO: 3222699 - DNA, 14 bp, Homo sapiens
tgacggaagaacat

SEQ ID NO: 3222700 - DNA, 18 bp, Homo sapiens
tgacggaagaacatagaa

SEQ ID NO: 3222701 - DNA, 14 bp, Homo sapiens
tgacggccctcatc

SEQ ID NO: 3222702 - DNA, 15 bp, Homo sapiens
tgacggcgcccccag

SEQ ID NO: 3222703 - DNA, 14 bp, Homo sapiens
tgacgggaggcccc

SEQ ID NO: 3222704 - DNA, 18 bp, Homo sapiens
tgacgggaggccccagct

SEQ ID NO: 3222705 - DNA, 23 bp, Homo sapiens
tgacgggaggccccagctctgag

SEQ ID NO: 3222706 - DNA, 20 bp, Homo sapiens
tgacggggcagtcagatttt

SEQ ID NO: 3222707 - DNA, 17 bp, Homo sapiens
tgacgtgaccggacttt

SEQ ID NO: 3222708 - DNA, 18 bp, Homo sapiens
tgacgtgccttttgcacc

SEQ ID NO: 3222709 - DNA, 22 bp, Homo sapiens
tgacgtgccttttgcacccctc

SEQ ID NO: 3222710 - DNA, 12 bp, Homo sapiens
tgacgtttacat

SEQ ID NO: 3222711 - DNA, 19 bp, Homo sapiens
tgactaaactttttttctg

SEQ ID NO: 3222712 - DNA, 16 bp, Homo sapiens
tgactaaagagagaat

SEQ ID NO: 3222713 - DNA, 17 bp, Homo sapiens
tgactaaagctatgtta

SEQ ID NO: 3222714 - DNA, 16 bp, Homo sapiens
tgactaacaagatttg

SEQ ID NO: 3222715 - DNA, 17 bp, Homo sapiens
tgactaacaggccaaag

SEQ ID NO: 3222716 - DNA, 23 bp, Homo sapiens
tgactaactagacaccaaagttc

SEQ ID NO: 3222717 - DNA, 15 bp, Homo sapiens
tgactaactcaaata

SEQ ID NO: 3222718 - DNA, 23 bp, Homo sapiens
tgactaactcaaatacacatttg

SEQ ID NO: 3222719 - DNA, 17 bp, Homo sapiens
tgactagaggcagggag

SEQ ID NO: 3222720 - DNA, 21 bp, Homo sapiens
tgactagaggcagggagggga

SEQ ID NO: 3222721 - DNA, 18 bp, Homo sapiens
tgactagggattcaggct

SEQ ID NO: 3222722 - DNA, 20 bp, Homo sapiens
tgactagggattcaggctgc

SEQ ID NO: 3222723 - DNA, 16 bp, Homo sapiens
tgactagtagatttct

SEQ ID NO: 3222724 - DNA, 14 bp, Homo sapiens
tgactagtcacctg

SEQ ID NO: 3222725 - DNA, 17 bp, Homo sapiens
tgactagtcacctgggg

SEQ ID NO: 3222726 - DNA, 21 bp, Homo sapiens
tgactataaacattaaaagaa

SEQ ID NO: 3222727 - DNA, 18 bp, Homo sapiens
tgactatataatttattt

SEQ ID NO: 3222728 - DNA, 18 bp, Homo sapiens
tgactattctgtatcttt

SEQ ID NO: 3222729 - DNA, 20 bp, Homo sapiens
tgactattctgtatctttca

SEQ ID NO: 3222730 - DNA, 16 bp, Homo sapiens
tgactcaaatctccag

SEQ ID NO: 3222731 - DNA, 15 bp, Homo sapiens
tgactcaacatgtta

SEQ ID NO: 3222732 - DNA, 12 bp, Homo sapiens
tgactcaagaag

SEQ ID NO: 3222733 - DNA, 13 bp, Homo sapiens
tgactcacaggcc

SEQ ID NO: 3222734 - DNA, 14 bp, Homo sapiens
tgactcagaggctg

SEQ ID NO: 3222735 - DNA, 17 bp, Homo sapiens
tgactcagaggctggga

SEQ ID NO: 3222736 - DNA, 19 bp, Homo sapiens
tgactcagaggctgggagc

SEQ ID NO: 3222737 - DNA, 20 bp, Homo sapiens
tgactcagaggctgggagca

SEQ ID NO: 3222738 - DNA, 15 bp, Homo sapiens
tgactccagagtctg

SEQ ID NO: 3222739 - DNA, 20 bp, Homo sapiens
tgactccagagtctgagccc

SEQ ID NO: 3222740 - DNA, 13 bp, Homo sapiens
tgactccctgtgg

SEQ ID NO: 3222741 - DNA, 22 bp, Homo sapiens
tgactcctacctgccctggaac

SEQ ID NO: 3222742 - DNA, 15 bp, Homo sapiens
tgactcggtttctcc

SEQ ID NO: 3222743 - DNA, 20 bp, Homo sapiens
tgactctaatatgattatac

SEQ ID NO: 3222744 - DNA, 22 bp, Homo sapiens
tgactctaatatgattatacaa

SEQ ID NO: 3222745 - DNA, 11 bp, Homo sapiens
tgactctccac

SEQ ID NO: 3222746 - DNA, 15 bp, Homo sapiens
tgactctctgtgacc

SEQ ID NO: 3222747 - DNA, 22 bp, Homo sapiens
tgactctgaaatctgaagacct

SEQ ID NO: 3222748 - DNA, 20 bp, Homo sapiens
tgactctgagtccactgctc

SEQ ID NO: 3222749 - DNA, 22 bp, Homo sapiens
tgactctttttagggccaggca

SEQ ID NO: 3222750 - DNA, 23 bp, Homo sapiens
tgactgaaaaaaaaaaagaagaa

SEQ ID NO: 3222751 - DNA, 14 bp, Homo sapiens
tgactgaaggaaaa

SEQ ID NO: 3222752 - DNA, 13 bp, Homo sapiens
tgactgaatgcag

SEQ ID NO: 3222753 - DNA, 19 bp, Homo sapiens
tgactgagcaagaccctgt

SEQ ID NO: 3222754 - DNA, 20 bp, Homo sapiens
tgactgccaagccagattct

SEQ ID NO: 3222755 - DNA, 20 bp, Homo sapiens
tgactgctccccagccctgg

SEQ ID NO: 3222756 - DNA, 23 bp, Homo sapiens
tgactgctccccagccctggctc

SEQ ID NO: 3222757 - DNA, 21 bp, Homo sapiens
tgactggcaagaggcctcatg

SEQ ID NO: 3222758 - DNA, 12 bp, Homo sapiens
tgactggcaggt

SEQ ID NO: 3222759 - DNA, 14 bp, Homo sapiens
tgactggcaggtgc

SEQ ID NO: 3222760 - DNA, 16 bp, Homo sapiens
tgactggcaggtgcag

SEQ ID NO: 3222761 - DNA, 22 bp, Homo sapiens
tgactggccagttgcccagagc

SEQ ID NO: 3222762 - DNA, 14 bp, Homo sapiens
tgactgggcctccc

SEQ ID NO: 3222763 - DNA, 17 bp, Homo sapiens
tgactgggtgagaccca

SEQ ID NO: 3222764 - DNA, 14 bp, Homo sapiens
tgactggttgttca

SEQ ID NO: 3222765 - DNA, 14 bp, Homo sapiens
tgactgtaatattt

SEQ ID NO: 3222766 - DNA, 14 bp, Homo sapiens
tgactgtaattaat

SEQ ID NO: 3222767 - DNA, 13 bp, Homo sapiens
tgactgtcactgt

SEQ ID NO: 3222768 - DNA, 15 bp, Homo sapiens
tgactgtgaccacct

SEQ ID NO: 3222769 - DNA, 17 bp, Homo sapiens
tgactgtgaccaccttc

SEQ ID NO: 3222770 - DNA, 12 bp, Homo sapiens
tgactgttgtac

SEQ ID NO: 3222771 - DNA, 17 bp, Homo sapiens
tgactgtttttgtagtg

SEQ ID NO: 3222772 - DNA, 19 bp, Homo sapiens
tgacttaagcaaaagaaaa

SEQ ID NO: 3222773 - DNA, 21 bp, Homo sapiens
tgacttagaggcaacaggatt

SEQ ID NO: 3222774 - DNA, 14 bp, Homo sapiens
tgacttatttctgc

SEQ ID NO: 3222775 - DNA, 18 bp, Homo sapiens
tgacttatttctgctctg

SEQ ID NO: 3222776 - DNA, 17 bp, Homo sapiens
tgacttattttgtctta

SEQ ID NO: 3222777 - DNA, 21 bp, Homo sapiens
tgacttattttgtcttattct

SEQ ID NO: 3222778 - DNA, 17 bp, Homo sapiens
tgacttcaatgatagta

SEQ ID NO: 3222779 - DNA, 16 bp, Homo sapiens
tgacttctccaggtct

SEQ ID NO: 3222780 - DNA, 16 bp, Homo sapiens
tgacttcttgcttcag

SEQ ID NO: 3222781 - DNA, 22 bp, Homo sapiens
tgacttgcaaagacctacctcc

SEQ ID NO: 3222782 - DNA, 24 bp, Homo sapiens
tgacttgcaaagacctacctccag

SEQ ID NO: 3222783 - DNA, 16 bp, Homo sapiens
tgacttgcatgaagag

SEQ ID NO: 3222784 - DNA, 23 bp, Homo sapiens
tgacttgcatgaagagaagcaat

SEQ ID NO: 3222785 - DNA, 12 bp, Homo sapiens
tgacttgcttta

SEQ ID NO: 3222786 - DNA, 13 bp, Homo sapiens
tgacttggcactt

SEQ ID NO: 3222787 - DNA, 20 bp, Homo sapiens
tgacttggcacttaagtgca

SEQ ID NO: 3222788 - DNA, 15 bp, Homo sapiens
tgacttgtttgtctt

SEQ ID NO: 3222789 - DNA, 18 bp, Homo sapiens
tgacttgtttgtcttcca

SEQ ID NO: 3222790 - DNA, 23 bp, Homo sapiens
tgacttgtttgtgcatcctgtga

SEQ ID NO: 3222791 - DNA, 13 bp, Homo sapiens
tgactttaaaaga

SEQ ID NO: 3222792 - DNA, 16 bp, Homo sapiens
tgactttaaaagaaaa

SEQ ID NO: 3222793 - DNA, 20 bp, Homo sapiens
tgactttacttgtggtgtga

SEQ ID NO: 3222794 - DNA, 12 bp, Homo sapiens
tgactttataaa

SEQ ID NO: 3222795 - DNA, 14 bp, Homo sapiens
tgactttataaatt

SEQ ID NO: 3222796 - DNA, 15 bp, Homo sapiens
tgactttatgttgta

SEQ ID NO: 3222797 - DNA, 18 bp, Homo sapiens
tgactttatgttgtatga

SEQ ID NO: 3222798 - DNA, 19 bp, Homo sapiens
tgactttatgttgtatgat

SEQ ID NO: 3222799 - DNA, 23 bp, Homo sapiens
tgactttatgttgtatgattcca

SEQ ID NO: 3222800 - DNA, 16 bp, Homo sapiens
tgactttgcttgcttt

SEQ ID NO: 3222801 - DNA, 17 bp, Homo sapiens
tgactttgcttgctttg

SEQ ID NO: 3222802 - DNA, 14 bp, Homo sapiens
tgacttttctgatt

SEQ ID NO: 3222803 - DNA, 15 bp, Homo sapiens
tgacttttctgatta

SEQ ID NO: 3222804 - DNA, 17 bp, Homo sapiens
tgactttttagccagtg

SEQ ID NO: 3222805 - DNA, 18 bp, Homo sapiens
tgagaaaaaggaaaaaaa

SEQ ID NO: 3222806 - DNA, 16 bp, Homo sapiens
tgagaaaatgcctcaa

SEQ ID NO: 3222807 - DNA, 20 bp, Homo sapiens
tgagaaacagctcagccagt

SEQ ID NO: 3222808 - DNA, 21 bp, Homo sapiens
tgagaaacagctcagccagtg

SEQ ID NO: 3222809 - DNA, 11 bp, Homo sapiens
tgagaaaggtg

SEQ ID NO: 3222810 - DNA, 15 bp, Homo sapiens
tgagaaaggtgagga

SEQ ID NO: 3222811 - DNA, 17 bp, Homo sapiens
tgagaaatatggacact

SEQ ID NO: 3222812 - DNA, 20 bp, Homo sapiens
tgagaaatgaataatttccc

SEQ ID NO: 3222813 - DNA, 12 bp, Homo sapiens
tgagaacaaagc

SEQ ID NO: 3222814 - DNA, 16 bp, Homo sapiens
tgagaacaaagctgtt

SEQ ID NO: 3222815 - DNA, 18 bp, Homo sapiens
tgagaacaagtcacagct

SEQ ID NO: 3222816 - DNA, 23 bp, Homo sapiens
tgagaacaagtcacagctgcagc

SEQ ID NO: 3222817 - DNA, 15 bp, Homo sapiens
tgagaactcctgact

SEQ ID NO: 3222818 - DNA, 13 bp, Homo sapiens
tgagaactgactt

SEQ ID NO: 3222819 - DNA, 14 bp, Homo sapiens
tgagaactgacttt

SEQ ID NO: 3222820 - DNA, 15 bp, Homo sapiens
tgagaacttgacaag

SEQ ID NO: 3222821 - DNA, 15 bp, Homo sapiens
tgagaagaatgaaaa

SEQ ID NO: 3222822 - DNA, 17 bp, Homo sapiens
tgagaagagggcctgtg

SEQ ID NO: 3222823 - DNA, 22 bp, Homo sapiens
tgagaagccatgtactcaagta

SEQ ID NO: 3222824 - DNA, 14 bp, Homo sapiens
tgagaagccttcag

SEQ ID NO: 3222825 - DNA, 15 bp, Homo sapiens
tgagaagccttcagc

SEQ ID NO: 3222826 - DNA, 14 bp, Homo sapiens
tgagaagcggtcat

SEQ ID NO: 3222827 - DNA, 20 bp, Homo sapiens
tgagaagcggtcatgagcac

SEQ ID NO: 3222828 - DNA, 21 bp, Homo sapiens
tgagaagctgctccaggcctg

SEQ ID NO: 3222829 - DNA, 22 bp, Homo sapiens
tgagaaggagtcagaaactgtt

SEQ ID NO: 3222830 - DNA, 11 bp, Homo sapiens
tgagaagtact

SEQ ID NO: 3222831 - DNA, 22 bp, Homo sapiens
tgagaagtcaaacatttcaaag

SEQ ID NO: 3222832 - DNA, 22 bp, Homo sapiens
tgagaagtgaatgctgggactc

SEQ ID NO: 3222833 - DNA, 16 bp, Homo sapiens
tgagaatcacggtggt

SEQ ID NO: 3222834 - DNA, 19 bp, Homo sapiens
tgagaatcatttagcatgt

SEQ ID NO: 3222835 - DNA, 20 bp, Homo sapiens
tgagaatcccaaatttgatt

SEQ ID NO: 3222836 - DNA, 21 bp, Homo sapiens
tgagaatcccaaatttgattg

SEQ ID NO: 3222837 - DNA, 23 bp, Homo sapiens
tgagaattttaaattataactta

SEQ ID NO: 3222838 - DNA, 9 bp, Homo sapiens
tgagacaaa

SEQ ID NO: 3222839 - DNA, 16 bp, Homo sapiens
tgagacaagccctggc

SEQ ID NO: 3222840 - DNA, 14 bp, Homo sapiens
tgagacacgatgcc

SEQ ID NO: 3222841 - DNA, 21 bp, Homo sapiens
tgagacaggaggattgcctga

SEQ ID NO: 3222842 - DNA, 14 bp, Homo sapiens
tgagacagtgaatt

SEQ ID NO: 3222843 - DNA, 17 bp, Homo sapiens
tgagacagtgaatttgg

SEQ ID NO: 3222844 - DNA, 17 bp, Homo sapiens
tgagacccccacacctc

SEQ ID NO: 3222845 - DNA, 16 bp, Homo sapiens
tgagaccctgggagag

SEQ ID NO: 3222846 - DNA, 15 bp, Homo sapiens
tgagaccctgtctct

SEQ ID NO: 3222847 - DNA, 19 bp, Homo sapiens
tgagactacaagtgtgtgc

SEQ ID NO: 3222848 - DNA, 14 bp, Homo sapiens
tgagactctgtctc

SEQ ID NO: 3222849 - DNA, 18 bp, Homo sapiens
tgagactctttagagcag

SEQ ID NO: 3222850 - DNA, 19 bp, Homo sapiens
tgagactctttagagcagc

SEQ ID NO: 3222851 - DNA, 22 bp, Homo sapiens
tgagactgcgggatggtcctgg

SEQ ID NO: 3222852 - DNA, 18 bp, Homo sapiens
tgagactgggtctcgctt

SEQ ID NO: 3222853 - DNA, 21 bp, Homo sapiens
tgagactgtcggagaggctgt

SEQ ID NO: 3222854 - DNA, 15 bp, Homo sapiens
tgagacttactgggt

SEQ ID NO: 3222855 - DNA, 21 bp, Homo sapiens
tgagactttccgactgctttt

SEQ ID NO: 3222856 - DNA, 20 bp, Homo sapiens
tgagagaaaaagtgcccctt

SEQ ID NO: 3222857 - DNA, 21 bp, Homo sapiens
tgagagaaagagagaagccag

SEQ ID NO: 3222858 - DNA, 22 bp, Homo sapiens
tgagagaaagagagaagccagc

SEQ ID NO: 3222859 - DNA, 22 bp, Homo sapiens
tgagagaaatatggaacttaca

SEQ ID NO: 3222860 - DNA, 24 bp, Homo sapiens
tctgagaagctctgaagaactctc

SEQ ID NO: 3222861 - DNA, 12 bp, Homo sapiens
tctgagaccagt

SEQ ID NO: 3222862 - DNA, 18 bp, Homo sapiens
tctgagaggacttttctt

SEQ ID NO: 3222863 - DNA, 16 bp, Homo sapiens
tctgagagtctagatt

SEQ ID NO: 3222864 - DNA, 21 bp, Homo sapiens
tctgagagtctagattctctg

SEQ ID NO: 3222865 - DNA, 21 bp, Homo sapiens
tctgagagtgaaaccatgact

SEQ ID NO: 3222866 - DNA, 23 bp, Homo sapiens
tctgagatttttttgtgtatgtt

SEQ ID NO: 3222867 - DNA, 22 bp, Homo sapiens
tctgagcagtcagggtgggaag

SEQ ID NO: 3222868 - DNA, 16 bp, Homo sapiens
tgagccagattacagg

SEQ ID NO: 3222869 - DNA, 14 bp, Homo sapiens
tgagccaggcctgg

SEQ ID NO: 3222870 - DNA, 13 bp, Homo sapiens
tgagccatcacta

SEQ ID NO: 3222871 - DNA, 15 bp, Homo sapiens
tgagccatcactaga

SEQ ID NO: 3222872 - DNA, 15 bp, Homo sapiens
tgagcccacaaagcc

SEQ ID NO: 3222873 - DNA, 20 bp, Homo sapiens
tgagcccactgcccaccccc

SEQ ID NO: 3222874 - DNA, 23 bp, Homo sapiens
tgagcccactgcccaccccctca

SEQ ID NO: 3222875 - DNA, 16 bp, Homo sapiens
tgagcccagagaacag

SEQ ID NO: 3222876 - DNA, 17 bp, Homo sapiens
tgagcccagagaacagc

SEQ ID NO: 3222877 - DNA, 19 bp, Homo sapiens
tgagcccagctgcctggag

SEQ ID NO: 3222878 - DNA, 12 bp, Homo sapiens
tgagcccaggcc

SEQ ID NO: 3222879 - DNA, 21 bp, Homo sapiens
tgagcccatgttctgccccca

SEQ ID NO: 3222880 - DNA, 23 bp, Homo sapiens
tgagcccatgttctgcccccagc

SEQ ID NO: 3222881 - DNA, 14 bp, Homo sapiens
tgagccccaagtcc

SEQ ID NO: 3222882 - DNA, 21 bp, Homo sapiens
tgagccccaagtcctgaagag

SEQ ID NO: 3222883 - DNA, 21 bp, Homo sapiens
tgagccccaggggggcctcct

SEQ ID NO: 3222884 - DNA, 19 bp, Homo sapiens
tgagccccagggtgcccag

SEQ ID NO: 3222885 - DNA, 20 bp, Homo sapiens
tgagccccagggtgcccaga

SEQ ID NO: 3222886 - DNA, 17 bp, Homo sapiens
tgagccccgcagacctc

SEQ ID NO: 3222887 - DNA, 15 bp, Homo sapiens
tgagcccctggaggc

SEQ ID NO: 3222888 - DNA, 17 bp, Homo sapiens
tgagcccggatgcttct

SEQ ID NO: 3222889 - DNA, 13 bp, Homo sapiens
tgagcccgggctg

SEQ ID NO: 3222890 - DNA, 13 bp, Homo sapiens
tgagccctggctg

SEQ ID NO: 3222891 - DNA, 19 bp, Homo sapiens
tgagccgggcccctgggct

SEQ ID NO: 3222892 - DNA, 17 bp, Homo sapiens
tgagcctcagcatcctg

SEQ ID NO: 3222893 - DNA, 21 bp, Homo sapiens
tgagcctgcccgctgcaatgc

SEQ ID NO: 3222894 - DNA, 22 bp, Homo sapiens
tgagcctggcccatagaaacat

SEQ ID NO: 3222895 - DNA, 18 bp, Homo sapiens
tgagcctggctcttgtgc

SEQ ID NO: 3222896 - DNA, 15 bp, Homo sapiens
tgagcctggtcctgg

SEQ ID NO: 3222897 - DNA, 18 bp, Homo sapiens
tgagccttagctcccagc

SEQ ID NO: 3222898 - DNA, 20 bp, Homo sapiens
tgagccttagctcccagcta

SEQ ID NO: 3222899 - DNA, 15 bp, Homo sapiens
tgagccttgagagaa

SEQ ID NO: 3222900 - DNA, 16 bp, Homo sapiens
tgagccttttccctct

SEQ ID NO: 3222901 - DNA, 20 bp, Homo sapiens
tgagcgcctccatccaaggc

SEQ ID NO: 3222902 - DNA, 18 bp, Homo sapiens
tgagcgcctgtgcacaca

SEQ ID NO: 3222903 - DNA, 13 bp, Homo sapiens
tgagcgccttggt

SEQ ID NO: 3222904 - DNA, 20 bp, Homo sapiens
tgagcggccgcagagactgg

SEQ ID NO: 3222905 - DNA, 20 bp, Homo sapiens
tgagctatgattatgccact

SEQ ID NO: 3222906 - DNA, 15 bp, Homo sapiens
tgagctcctgctgcg

SEQ ID NO: 3222907 - DNA, 12 bp, Homo sapiens
tgagctctctgt

SEQ ID NO: 3222908 - DNA, 14 bp, Homo sapiens
tgagctgagtggcc

SEQ ID NO: 3222909 - DNA, 21 bp, Homo sapiens
tgagctggcctctctagcaca

SEQ ID NO: 3222910 - DNA, 12 bp, Homo sapiens
tgagctgggccc

SEQ ID NO: 3222911 - DNA, 15 bp, Homo sapiens
tgagctgggcccagc

SEQ ID NO: 3222912 - DNA, 18 bp, Homo sapiens
tgagctgggcccagcccc

SEQ ID NO: 3222913 - DNA, 17 bp, Homo sapiens
tgagctggggactcagg

SEQ ID NO: 3222914 - DNA, 21 bp, Homo sapiens
tgagctggggactcagggacc

SEQ ID NO: 3222915 - DNA, 15 bp, Homo sapiens
tgagctgtgttcttg

SEQ ID NO: 3222916 - DNA, 21 bp, Homo sapiens
tgagcttagccttgtgccctg

SEQ ID NO: 3222917 - DNA, 19 bp, Homo sapiens
tgagcttcggttctccaga

SEQ ID NO: 3222918 - DNA, 21 bp, Homo sapiens
tgagcttcggttctccagaat

SEQ ID NO: 3222919 - DNA, 18 bp, Homo sapiens
tgagcttttcatggaagt

SEQ ID NO: 3222920 - DNA, 12 bp, Homo sapiens
tgaggaaatatt

SEQ ID NO: 3222921 - DNA, 16 bp, Homo sapiens
tgaggaaatattaatt

SEQ ID NO: 3222922 - DNA, 19 bp, Homo sapiens
tgagtgagcctggctcttg

SEQ ID NO: 3222923 - DNA, 15 bp, Homo sapiens
tgagtgatcctccaa

SEQ ID NO: 3222924 - DNA, 14 bp, Homo sapiens
tgagtgcgtctgag

SEQ ID NO: 3222925 - DNA, 17 bp, Homo sapiens
tgagtggaatgcaggga

SEQ ID NO: 3222926 - DNA, 18 bp, Homo sapiens
tgagtggaatgcagggaa

SEQ ID NO: 3222927 - DNA, 15 bp, Homo sapiens
tgagtggcagccatg

SEQ ID NO: 3222928 - DNA, 15 bp, Homo sapiens
tgagtggggagcagt

SEQ ID NO: 3222929 - DNA, 15 bp, Homo sapiens
tgagtggtggttcct

SEQ ID NO: 3222930 - DNA, 14 bp, Homo sapiens
tgagtgtaaataat

SEQ ID NO: 3222931 - DNA, 23 bp, Homo sapiens
tgagtgtaaataattttaaataa

SEQ ID NO: 3222932 - DNA, 15 bp, Homo sapiens
tgagtgtaagtgtga

SEQ ID NO: 3222933 - DNA, 14 bp, Homo sapiens
tgagtgtatgagta

SEQ ID NO: 3222934 - DNA, 12 bp, Homo sapiens
tgagtgtgacag

SEQ ID NO: 3222935 - DNA, 15 bp, Homo sapiens
tgagtgtgacagggc

SEQ ID NO: 3222936 - DNA, 17 bp, Homo sapiens
tgagtgtgacagggcca

SEQ ID NO: 3222937 - DNA, 12 bp, Homo sapiens
tgagtgtggaag

SEQ ID NO: 3222938 - DNA, 12 bp, Homo sapiens
tgagtgttcatt

SEQ ID NO: 3222939 - DNA, 14 bp, Homo sapiens
tgagtgttcatttt

SEQ ID NO: 3222940 - DNA, 23 bp, Homo sapiens
tgagtgttcattttagtgactgt

SEQ ID NO: 3222941 - DNA, 22 bp, Homo sapiens
tgagtgtttttactacagttgt

SEQ ID NO: 3222942 - DNA, 15 bp, Homo sapiens
tgagttacttcctat

SEQ ID NO: 3222943 - DNA, 22 bp, Homo sapiens
tgagttacttgtctgaggcctc

SEQ ID NO: 3222944 - DNA, 16 bp, Homo sapiens
tgagttatcatgaatt

SEQ ID NO: 3222945 - DNA, 21 bp, Homo sapiens
tgagttatcatgaattttaaa

SEQ ID NO: 3222946 - DNA, 16 bp, Homo sapiens
tgagttatgttaaaat

SEQ ID NO: 3222947 - DNA, 19 bp, Homo sapiens
tgagttattcataaagaga

SEQ ID NO: 3222948 - DNA, 23 bp, Homo sapiens
tgagttattccttgatcattttg

SEQ ID NO: 3222949 - DNA, 15 bp, Homo sapiens
tgagttcaactacat

SEQ ID NO: 3222950 - DNA, 20 bp, Homo sapiens
tgagttcaagggctgtaggt

SEQ ID NO: 3222951 - DNA, 17 bp, Homo sapiens
tgagttcaccatctctt

SEQ ID NO: 3222952 - DNA, 16 bp, Homo sapiens
tgagttccagttgaag

SEQ ID NO: 3222953 - DNA, 15 bp, Homo sapiens
tgagttctacataag

SEQ ID NO: 3222954 - DNA, 20 bp, Homo sapiens
tgagttctacataagtaatt

SEQ ID NO: 3222955 - DNA, 17 bp, Homo sapiens
tgagttctcagggctcc

SEQ ID NO: 3222956 - DNA, 19 bp, Homo sapiens
tgagttctcagggctcctg

SEQ ID NO: 3222957 - DNA, 22 bp, Homo sapiens
tgagttctcagggctcctgcct

SEQ ID NO: 3222958 - DNA, 19 bp, Homo sapiens
tgagttgccaagacaaatc

SEQ ID NO: 3222959 - DNA, 17 bp, Homo sapiens
tgagttggacttcagtc

SEQ ID NO: 3222960 - DNA, 18 bp, Homo sapiens
tgagttgtgaaagttttg

SEQ ID NO: 3222961 - DNA, 13 bp, Homo sapiens
tgagttgttctaa

SEQ ID NO: 3222962 - DNA, 18 bp, Homo sapiens
tgagtttaccatttgtaa

SEQ ID NO: 3222963 - DNA, 19 bp, Homo sapiens
tgagtttaccatttgtaat

SEQ ID NO: 3222964 - DNA, 18 bp, Homo sapiens
tgagtttcattctcctgc

SEQ ID NO: 3222965 - DNA, 16 bp, Homo sapiens
tgagtttgagctgcct

SEQ ID NO: 3222966 - DNA, 19 bp, Homo sapiens
tgagtttgctggttgtaaa

SEQ ID NO: 3222967 - DNA, 22 bp, Homo sapiens
tgagtttgcttatgtaatctca

SEQ ID NO: 3222968 - DNA, 16 bp, Homo sapiens
tgagtttgtaggtaaa

SEQ ID NO: 3222969 - DNA, 21 bp, Homo sapiens
tgagtttgtaggtaaaatgta

SEQ ID NO: 3222970 - DNA, 19 bp, Homo sapiens
tgagtttgtcgctcatgtg

SEQ ID NO: 3222971 - DNA, 13 bp, Homo sapiens
tgagtttttgata

SEQ ID NO: 3222972 - DNA, 18 bp, Homo sapiens
tgataaaagggcaaatct

SEQ ID NO: 3222973 - DNA, 12 bp, Homo sapiens
tgataaaatatg

SEQ ID NO: 3222974 - DNA, 13 bp, Homo sapiens
tgataaagcctca

SEQ ID NO: 3222975 - DNA, 18 bp, Homo sapiens
tgataacacttaaaattg

SEQ ID NO: 3222976 - DNA, 18 bp, Homo sapiens
tgataagggaaaagataa

SEQ ID NO: 3222977 - DNA, 19 bp, Homo sapiens
tgataagggaaaagataaa

SEQ ID NO: 3222978 - DNA, 12 bp, Homo sapiens
tgataagtggaa

SEQ ID NO: 3222979 - DNA, 14 bp, Homo sapiens
tgataagtggaaaa

SEQ ID NO: 3222980 - DNA, 14 bp, Homo sapiens
tgataataaattga

SEQ ID NO: 3222981 - DNA, 18 bp, Homo sapiens
tgataataaattgaaatt

SEQ ID NO: 3222982 - DNA, 16 bp, Homo sapiens
tgataataatattgtt

SEQ ID NO: 3222983 - DNA, 22 bp, Homo sapiens
tgataatattagtgattctgat

SEQ ID NO: 3222984 - DNA, 12 bp, Homo sapiens
tgataatcttca

SEQ ID NO: 3222985 - DNA, 14 bp, Homo sapiens
tgataatcttcagg

SEQ ID NO: 3222986 - DNA, 15 bp, Homo sapiens
tgataatgttaaatt

SEQ ID NO: 3222987 - DNA, 16 bp, Homo sapiens
tgataatgttaaattt

SEQ ID NO: 3222988 - DNA, 17 bp, Homo sapiens
tgataatgttaaatttg

SEQ ID NO: 3222989 - DNA, 21 bp, Homo sapiens
tgataatgttaaatttgtaag

SEQ ID NO: 3222990 - DNA, 13 bp, Homo sapiens
tgataatttaaga

SEQ ID NO: 3222991 - DNA, 18 bp, Homo sapiens
tgataatttaagagctaa

SEQ ID NO: 3222992 - DNA, 23 bp, Homo sapiens
tgataattttatttataaactag

SEQ ID NO: 3222993 - DNA, 16 bp, Homo sapiens
tgatacaagattagaa

SEQ ID NO: 3222994 - DNA, 16 bp, Homo sapiens
tgatacaatgaacact

SEQ ID NO: 3222995 - DNA, 16 bp, Homo sapiens
tgatacagtattgaaa

SEQ ID NO: 3222996 - DNA, 17 bp, Homo sapiens
tgataccacctttactg

SEQ ID NO: 3222997 - DNA, 18 bp, Homo sapiens
tgatacccatagcttcca

SEQ ID NO: 3222998 - DNA, 21 bp, Homo sapiens
tgatacccatagcttccatga

SEQ ID NO: 3222999 - DNA, 15 bp, Homo sapiens
tgatacccccctctg

SEQ ID NO: 3223000 - DNA, 19 bp, Homo sapiens
tgatacccccctctgtctt

SEQ ID NO: 3223001 - DNA, 22 bp, Homo sapiens
tgatacccctggggaacatttc

SEQ ID NO: 3223002 - DNA, 20 bp, Homo sapiens
tgatacgatagttacataat

SEQ ID NO: 3223003 - DNA, 19 bp, Homo sapiens
tgatacgcaacataattaa

SEQ ID NO: 3223004 - DNA, 13 bp, Homo sapiens
tgatactgaatgc

SEQ ID NO: 3223005 - DNA, 15 bp, Homo sapiens
tgatactgaatgcat

SEQ ID NO: 3223006 - DNA, 22 bp, Homo sapiens
tgatacttatattttcgtatga

SEQ ID NO: 3223007 - DNA, 16 bp, Homo sapiens
tgatacttcatttaaa

SEQ ID NO: 3223008 - DNA, 12 bp, Homo sapiens
tgatacttccaa

SEQ ID NO: 3223009 - DNA, 13 bp, Homo sapiens
tgatagcactttc

SEQ ID NO: 3223010 - DNA, 15 bp, Homo sapiens
tgatagcactttcta

SEQ ID NO: 3223011 - DNA, 23 bp, Homo sapiens
tgatagcccagaacaaaaagaaa

SEQ ID NO: 3223012 - DNA, 11 bp, Homo sapiens
tgatagcttta

SEQ ID NO: 3223013 - DNA, 18 bp, Homo sapiens
tgataggaactgtctcaa

SEQ ID NO: 3223014 - DNA, 17 bp, Homo sapiens
tgatagttgaatgttgc

SEQ ID NO: 3223015 - DNA, 13 bp, Homo sapiens
tgatatacattgt

SEQ ID NO: 3223016 - DNA, 14 bp, Homo sapiens
tgatatacattgtg

SEQ ID NO: 3223017 - DNA, 19 bp, Homo sapiens
tgatatacattgtgtgaaa

SEQ ID NO: 3223018 - DNA, 18 bp, Homo sapiens
tgatatataagtgtacat

SEQ ID NO: 3223019 - DNA, 20 bp, Homo sapiens
tgatatatgagactttatgt

SEQ ID NO: 3223020 - DNA, 19 bp, Homo sapiens
tgatatatttaaaaatatt

SEQ ID NO: 3223021 - DNA, 13 bp, Homo sapiens
tgatatattttac

SEQ ID NO: 3223022 - DNA, 17 bp, Homo sapiens
tgatatgagtatacaat

SEQ ID NO: 3223023 - DNA, 16 bp, Homo sapiens
tgatatgcatttcctg

SEQ ID NO: 3223024 - DNA, 19 bp, Homo sapiens
tgatatgcatttcctgctg

SEQ ID NO: 3223025 - DNA, 16 bp, Homo sapiens
tgatatggcagaagac

SEQ ID NO: 3223026 - DNA, 21 bp, Homo sapiens
tgatatgtaaacataattctt

SEQ ID NO: 3223027 - DNA, 20 bp, Homo sapiens
tgatatgtaagtacttccac

SEQ ID NO: 3223028 - DNA, 14 bp, Homo sapiens
tgatattaatcaaa

SEQ ID NO: 3223029 - DNA, 18 bp, Homo sapiens
tgatattccccatttcct

SEQ ID NO: 3223030 - DNA, 16 bp, Homo sapiens
tgatattgtttaaaat

SEQ ID NO: 3223031 - DNA, 15 bp, Homo sapiens
tgatatttcttgctt

SEQ ID NO: 3223032 - DNA, 14 bp, Homo sapiens
tgatatttgcattg

SEQ ID NO: 3223033 - DNA, 17 bp, Homo sapiens
tgatatttgcattgagg

SEQ ID NO: 3223034 - DNA, 11 bp, Homo sapiens
tgatatttggt

SEQ ID NO: 3223035 - DNA, 12 bp, Homo sapiens
tgatatttggtt

SEQ ID NO: 3223036 - DNA, 19 bp, Homo sapiens
tgatattttcaacgcagcc

SEQ ID NO: 3223037 - DNA, 23 bp, Homo sapiens
tgatattttcaacgcagccctgc

SEQ ID NO: 3223038 - DNA, 17 bp, Homo sapiens
tgatattttctgtgcct

SEQ ID NO: 3223039 - DNA, 14 bp, Homo sapiens
tgatatttttccat

SEQ ID NO: 3223040 - DNA, 18 bp, Homo sapiens
tgatatttttccatttat

SEQ ID NO: 3223041 - DNA, 23 bp, Homo sapiens
tgatcaaaacctgtgccaggctg

SEQ ID NO: 3223042 - DNA, 15 bp, Homo sapiens
tgatcaaattcattt

SEQ ID NO: 3223043 - DNA, 15 bp, Homo sapiens
tgatcaactcttcga

SEQ ID NO: 3223044 - DNA, 21 bp, Homo sapiens
tgatcaataaaatgtgatttt

SEQ ID NO: 3223045 - DNA, 16 bp, Homo sapiens
tgatcaatatttttat

SEQ ID NO: 3223046 - DNA, 21 bp, Homo sapiens
tgatcaatatttttatatcat

SEQ ID NO: 3223047 - DNA, 14 bp, Homo sapiens
tgatcaattaaatg

SEQ ID NO: 3223048 - DNA, 17 bp, Homo sapiens
tgatcaattaaatgtag

SEQ ID NO: 3223049 - DNA, 15 bp, Homo sapiens
tgatcacggctcact

SEQ ID NO: 3223050 - DNA, 15 bp, Homo sapiens
tgatcactagcctgt

SEQ ID NO: 3223051 - DNA, 16 bp, Homo sapiens
tgatcactagcctgtc

SEQ ID NO: 3223052 - DNA, 17 bp, Homo sapiens
tactctggttctttgtt

SEQ ID NO: 3223053 - DNA, 13 bp, Homo sapiens
tactctgtccagg

SEQ ID NO: 3223054 - DNA, 12 bp, Homo sapiens
tactctgtgtca

SEQ ID NO: 3223055 - DNA, 21 bp, Homo sapiens
tactctgtgtcaggtggggca

SEQ ID NO: 3223056 - DNA, 11 bp, Homo sapiens
tactctgtgtg

SEQ ID NO: 3223057 - DNA, 11 bp, Homo sapiens
tactcttagga

SEQ ID NO: 3223058 - DNA, 18 bp, Homo sapiens
tactcttaggaagagaaa

SEQ ID NO: 3223059 - DNA, 14 bp, Homo sapiens
tactctttctgtat

SEQ ID NO: 3223060 - DNA, 15 bp, Homo sapiens
tactctttctgtata

SEQ ID NO: 3223061 - DNA, 16 bp, Homo sapiens
tactctttctgtatat

SEQ ID NO: 3223062 - DNA, 19 bp, Homo sapiens
tactctttgtctttttaag

SEQ ID NO: 3223063 - DNA, 14 bp, Homo sapiens
tactctttttgttt

SEQ ID NO: 3223064 - DNA, 18 bp, Homo sapiens
tactgaaaaaggtgatta

SEQ ID NO: 3223065 - DNA, 13 bp, Homo sapiens
tactgaaagcctt

SEQ ID NO: 3223066 - DNA, 22 bp, Homo sapiens
tactgaacaatcaaagcacttg

SEQ ID NO: 3223067 - DNA, 14 bp, Homo sapiens
tactgaaggaaaaa

SEQ ID NO: 3223068 - DNA, 21 bp, Homo sapiens
tactgaatgaagcagtatttt

SEQ ID NO: 3223069 - DNA, 20 bp, Homo sapiens
tactgacatgtggggccagg

SEQ ID NO: 3223070 - DNA, 22 bp, Homo sapiens
tactgacatgtggggccaggtc

SEQ ID NO: 3223071 - DNA, 22 bp, Homo sapiens
tactgactttgcttgctttgaa

SEQ ID NO: 3223072 - DNA, 17 bp, Homo sapiens
tactgagcttctctgtg

SEQ ID NO: 3223073 - DNA, 16 bp, Homo sapiens
tactgataaagaaaga

SEQ ID NO: 3223074 - DNA, 16 bp, Homo sapiens
tactgatcatgcattg

SEQ ID NO: 3223075 - DNA, 16 bp, Homo sapiens
tactgattatgaaatg

SEQ ID NO: 3223076 - DNA, 17 bp, Homo sapiens
tactgattatgaaatgt

SEQ ID NO: 3223077 - DNA, 18 bp, Homo sapiens
tactgatttcagtaagtc

SEQ ID NO: 3223078 - DNA, 19 bp, Homo sapiens
tactgcaaattgattgtct

SEQ ID NO: 3223079 - DNA, 20 bp, Homo sapiens
tactgcaatatttggattgt

SEQ ID NO: 3223080 - DNA, 16 bp, Homo sapiens
tactgcactccagcct

SEQ ID NO: 3223081 - DNA, 20 bp, Homo sapiens
tactgcactccagcctgggg

SEQ ID NO: 3223082 - DNA, 15 bp, Homo sapiens
tactgcagcacctcc

SEQ ID NO: 3223083 - DNA, 20 bp, Homo sapiens
tactgcagcctttgcctccc

SEQ ID NO: 3223084 - DNA, 15 bp, Homo sapiens
tactgcagctttaca

SEQ ID NO: 3223085 - DNA, 19 bp, Homo sapiens
tactgcagggccaggactg

SEQ ID NO: 3223086 - DNA, 15 bp, Homo sapiens
tactgcatacttttt

SEQ ID NO: 3223087 - DNA, 18 bp, Homo sapiens
tactgcatactttttaaa

SEQ ID NO: 3223088 - DNA, 21 bp, Homo sapiens
tactgcatactttttaaatgt

SEQ ID NO: 3223089 - DNA, 18 bp, Homo sapiens
tactgcattctctcccat

SEQ ID NO: 3223090 - DNA, 22 bp, Homo sapiens
tactgcattctctcccatcctg

SEQ ID NO: 3223091 - DNA, 20 bp, Homo sapiens
tactgcccaggcctgcctgt

SEQ ID NO: 3223092 - DNA, 22 bp, Homo sapiens
tactgcctataatcttatacaa

SEQ ID NO: 3223093 - DNA, 21 bp, Homo sapiens
tactgcctctacagttaatag

SEQ ID NO: 3223094 - DNA, 12 bp, Homo sapiens
tactgcgacttt

SEQ ID NO: 3223095 - DNA, 16 bp, Homo sapiens
tactgcgactttctgc

SEQ ID NO: 3223096 - DNA, 22 bp, Homo sapiens
tactgcgactttctgcctggag

SEQ ID NO: 3223097 - DNA, 15 bp, Homo sapiens
tactgctactgtaat

SEQ ID NO: 3223098 - DNA, 17 bp, Homo sapiens
tactgctgtcttccaag

SEQ ID NO: 3223099 - DNA, 16 bp, Homo sapiens
tactggataaattgtt

SEQ ID NO: 3223100 - DNA, 14 bp, Homo sapiens
tactggcagctcct

SEQ ID NO: 3223101 - DNA, 17 bp, Homo sapiens
tactgggttaatggcta

SEQ ID NO: 3223102 - DNA, 17 bp, Homo sapiens
tactggtatctgtcact

SEQ ID NO: 3223103 - DNA, 23 bp, Homo sapiens
tactggtccaaaagattgctgaa

SEQ ID NO: 3223104 - DNA, 19 bp, Homo sapiens
tactggtgcagtcattatg

SEQ ID NO: 3223105 - DNA, 20 bp, Homo sapiens
tactgtaaagagacctacct

SEQ ID NO: 3223106 - DNA, 19 bp, Homo sapiens
tactgtaacctgttgctgt

SEQ ID NO: 3223107 - DNA, 18 bp, Homo sapiens
tactgtaataatacctca

SEQ ID NO: 3223108 - DNA, 16 bp, Homo sapiens
tactgtaattcctcaa

SEQ ID NO: 3223109 - DNA, 14 bp, Homo sapiens
tactgtaattttat

SEQ ID NO: 3223110 - DNA, 21 bp, Homo sapiens
tactgtacataaacaatgatg

SEQ ID NO: 3223111 - DNA, 21 bp, Homo sapiens
tactgtactaattcttacact

SEQ ID NO: 3223112 - DNA, 18 bp, Homo sapiens
tactgtactttgccattt

SEQ ID NO: 3223113 - DNA, 20 bp, Homo sapiens
tactgtactttgccattttt

SEQ ID NO: 3223114 - DNA, 13 bp, Homo sapiens
tactgtagttttt

SEQ ID NO: 3223115 - DNA, 15 bp, Homo sapiens
tactgtagtttttct

SEQ ID NO: 3223116 - DNA, 13 bp, Homo sapiens
tactgtatatgta

SEQ ID NO: 3223117 - DNA, 17 bp, Homo sapiens
tactgtatggaaacact

SEQ ID NO: 3223118 - DNA, 17 bp, Homo sapiens
tactgtatttctaagaa

SEQ ID NO: 3223119 - DNA, 11 bp, Homo sapiens
tactgtcaata

SEQ ID NO: 3223120 - DNA, 16 bp, Homo sapiens
tactgtcaataaacag

SEQ ID NO: 3223121 - DNA, 16 bp, Homo sapiens
tactgtcctacccacc

SEQ ID NO: 3223122 - DNA, 19 bp, Homo sapiens
tactgtctattaatattca

SEQ ID NO: 3223123 - DNA, 21 bp, Homo sapiens
tactgtctgctgatataatat

SEQ ID NO: 3223124 - DNA, 18 bp, Homo sapiens
tactgtgacctttgtcta

SEQ ID NO: 3223125 - DNA, 13 bp, Homo sapiens
tactgtgcagaat

SEQ ID NO: 3223126 - DNA, 15 bp, Homo sapiens
tactgtgcagaataa

SEQ ID NO: 3223127 - DNA, 17 bp, Homo sapiens
tactgtgcagaataatg

SEQ ID NO: 3223128 - DNA, 16 bp, Homo sapiens
tactgtggaggaagga

SEQ ID NO: 3223129 - DNA, 22 bp, Homo sapiens
tactgtggaggaaggattgtaa

SEQ ID NO: 3223130 - DNA, 13 bp, Homo sapiens
tactgtgtaatta

SEQ ID NO: 3223131 - DNA, 14 bp, Homo sapiens
tactgtgtaattag

SEQ ID NO: 3223132 - DNA, 14 bp, Homo sapiens
tactgtgtgtgtga

SEQ ID NO: 3223133 - DNA, 17 bp, Homo sapiens
tactgtgtgtgtgaatg

SEQ ID NO: 3223134 - DNA, 21 bp, Homo sapiens
tactgtgtgtgtgaatgaaca

SEQ ID NO: 3223135 - DNA, 13 bp, Homo sapiens
tactgtgttcctg

SEQ ID NO: 3223136 - DNA, 16 bp, Homo sapiens
tactgtgttcctggca

SEQ ID NO: 3223137 - DNA, 18 bp, Homo sapiens
tactgttcctttcagatg

SEQ ID NO: 3223138 - DNA, 17 bp, Homo sapiens
tactgttctaaagctct

SEQ ID NO: 3223139 - DNA, 21 bp, Homo sapiens
tactgttctaaagctctgaca

SEQ ID NO: 3223140 - DNA, 14 bp, Homo sapiens
tactgttcttgctg

SEQ ID NO: 3223141 - DNA, 21 bp, Homo sapiens
tactgttcttgctgctagaac

SEQ ID NO: 3223142 - DNA, 23 bp, Homo sapiens
tactgttcttgctgctagaactt

SEQ ID NO: 3223143 - DNA, 21 bp, Homo sapiens
tactgttgcatttacttttaa

SEQ ID NO: 3223144 - DNA, 13 bp, Homo sapiens
tactgtttctgtc

SEQ ID NO: 3223145 - DNA, 18 bp, Homo sapiens
tacttaaatgaaagcatg

SEQ ID NO: 3223146 - DNA, 14 bp, Homo sapiens
tacttaaatggtaa

SEQ ID NO: 3223147 - DNA, 23 bp, Homo sapiens
tacttaaatggtaataagcactg

SEQ ID NO: 3223148 - DNA, 24 bp, Homo sapiens
tacttaaatggtaataagcactgt

SEQ ID NO: 3223149 - DNA, 21 bp, Homo sapiens
tacttaaatttggtttgttaa

SEQ ID NO: 3223150 - DNA, 22 bp, Homo sapiens
tacttaaatttggtttgttaat

SEQ ID NO: 3223151 - DNA, 23 bp, Homo sapiens
tacttaaatttggtttgttaatt

SEQ ID NO: 3223152 - DNA, 18 bp, Homo sapiens
tacttaagagaaatggca

SEQ ID NO: 3223153 - DNA, 19 bp, Homo sapiens
tacttaagagaaatggcaa

SEQ ID NO: 3223154 - DNA, 13 bp, Homo sapiens
tacttaataaatt

SEQ ID NO: 3223155 - DNA, 16 bp, Homo sapiens
tacttacctaaacaga

SEQ ID NO: 3223156 - DNA, 18 bp, Homo sapiens
tacttagctgtactataa

SEQ ID NO: 3223157 - DNA, 21 bp, Homo sapiens
tacttaggttattttgctttg

SEQ ID NO: 3223158 - DNA, 21 bp, Homo sapiens
tacttatatttccctaaaata

SEQ ID NO: 3223159 - DNA, 20 bp, Homo sapiens
tacttatattttcgtatgaa

SEQ ID NO: 3223160 - DNA, 23 bp, Homo sapiens
tacttatattttcgtatgaaaat

SEQ ID NO: 3223161 - DNA, 18 bp, Homo sapiens
tacttatttgtatatggt

SEQ ID NO: 3223162 - DNA, 19 bp, Homo sapiens
tacttatttttgacagtgt

SEQ ID NO: 3223163 - DNA, 21 bp, Homo sapiens
tacttcaaaagccataacttg

SEQ ID NO: 3223164 - DNA, 21 bp, Homo sapiens
tacttcaagttaaagtgaata

SEQ ID NO: 3223165 - DNA, 19 bp, Homo sapiens
tacttcaggggcacttcat

SEQ ID NO: 3223166 - DNA, 22 bp, Homo sapiens
tacttccacctcgggcacattt

SEQ ID NO: 3223167 - DNA, 16 bp, Homo sapiens
tacttcctcctgatgg

SEQ ID NO: 3223168 - DNA, 15 bp, Homo sapiens
tacttcctgagtggc

SEQ ID NO: 3223169 - DNA, 13 bp, Homo sapiens
tacttctccaccc

SEQ ID NO: 3223170 - DNA, 16 bp, Homo sapiens
tacttctgtaattgtg

SEQ ID NO: 3223171 - DNA, 14 bp, Homo sapiens
tacttctgtgttca

SEQ ID NO: 3223172 - DNA, 15 bp, Homo sapiens
tacttctgtgttcat

SEQ ID NO: 3223173 - DNA, 16 bp, Homo sapiens
tacttctgtgttcatt

SEQ ID NO: 3223174 - DNA, 12 bp, Homo sapiens
tacttctgtttg

SEQ ID NO: 3223175 - DNA, 18 bp, Homo sapiens
tacttctgtttgggagac

SEQ ID NO: 3223176 - DNA, 14 bp, Homo sapiens
tacttcttatacat

SEQ ID NO: 3223177 - DNA, 15 bp, Homo sapiens
tacttcttatacatt

SEQ ID NO: 3223178 - DNA, 18 bp, Homo sapiens
tacacatatacctataat

SEQ ID NO: 3223179 - DNA, 18 bp, Homo sapiens
tacacatccccagaatcc

SEQ ID NO: 3223180 - DNA, 17 bp, Homo sapiens
tacacatctcagaccct

SEQ ID NO: 3223181 - DNA, 13 bp, Homo sapiens
tacacattagatt

SEQ ID NO: 3223182 - DNA, 15 bp, Homo sapiens
tacacattagatttt

SEQ ID NO: 3223183 - DNA, 23 bp, Homo sapiens
tacacattagattttattttact

SEQ ID NO: 3223184 - DNA, 13 bp, Homo sapiens
tacacatttgtac

SEQ ID NO: 3223185 - DNA, 20 bp, Homo sapiens
tacaccaactcctaatttta

SEQ ID NO: 3223186 - DNA, 22 bp, Homo sapiens
tacaccaatttggtaaaaatgc

SEQ ID NO: 3223187 - DNA, 15 bp, Homo sapiens
tacaccacactttca

SEQ ID NO: 3223188 - DNA, 13 bp, Homo sapiens
tacaccagtttga

SEQ ID NO: 3223189 - DNA, 18 bp, Homo sapiens
tacaccatagtttacaat

SEQ ID NO: 3223190 - DNA, 20 bp, Homo sapiens
tacaccatagtttacaatat

SEQ ID NO: 3223191 - DNA, 19 bp, Homo sapiens
tacaccattatcttggaaa

SEQ ID NO: 3223192 - DNA, 17 bp, Homo sapiens
tacaccgactagccagg

SEQ ID NO: 3223193 - DNA, 15 bp, Homo sapiens
tacaccgggcctgga

SEQ ID NO: 3223194 - DNA, 17 bp, Homo sapiens
tacaccgggcctggaga

SEQ ID NO: 3223195 - DNA, 23 bp, Homo sapiens
tacacctaaaggtgtatttaaac

SEQ ID NO: 3223196 - DNA, 16 bp, Homo sapiens
tacacctcaaatacca

SEQ ID NO: 3223197 - DNA, 13 bp, Homo sapiens
tacacctggctga

SEQ ID NO: 3223198 - DNA, 14 bp, Homo sapiens
tacacctggctgag

SEQ ID NO: 3223199 - DNA, 17 bp, Homo sapiens
tacacgtctggaccccg

SEQ ID NO: 3223200 - DNA, 14 bp, Homo sapiens
tacactaacatttc

SEQ ID NO: 3223201 - DNA, 23 bp, Homo sapiens
tacactctgctgtttgacacctc

SEQ ID NO: 3223202 - DNA, 17 bp, Homo sapiens
tacactgaatatttata

SEQ ID NO: 3223203 - DNA, 18 bp, Homo sapiens
tacactgaatatttatat

SEQ ID NO: 3223204 - DNA, 15 bp, Homo sapiens
tacactgatgcaagg

SEQ ID NO: 3223205 - DNA, 16 bp, Homo sapiens
tacactgatgcaagga

SEQ ID NO: 3223206 - DNA, 15 bp, Homo sapiens
tacactgcctgtata

SEQ ID NO: 3223207 - DNA, 19 bp, Homo sapiens
tacactgcctgtatacttt

SEQ ID NO: 3223208 - DNA, 17 bp, Homo sapiens
tacactgctgtacccag

SEQ ID NO: 3223209 - DNA, 21 bp, Homo sapiens
tacactgctgtacccagatgc

SEQ ID NO: 3223210 - DNA, 17 bp, Homo sapiens
tacactgttagaacact

SEQ ID NO: 3223211 - DNA, 20 bp, Homo sapiens
tacactgttagaacactatt

SEQ ID NO: 3223212 - DNA, 23 bp, Homo sapiens
tacactgttagaacactattttc

SEQ ID NO: 3223213 - DNA, 17 bp, Homo sapiens
tacacttaattacagtt

SEQ ID NO: 3223214 - DNA, 16 bp, Homo sapiens
tacacttacactttat

SEQ ID NO: 3223215 - DNA, 16 bp, Homo sapiens
tacacttggtgtactg

SEQ ID NO: 3223216 - DNA, 17 bp, Homo sapiens
tacacttggtgtactgg

SEQ ID NO: 3223217 - DNA, 20 bp, Homo sapiens
tacacttgtataaatgtata

SEQ ID NO: 3223218 - DNA, 21 bp, Homo sapiens
tacacttgtataaatgtatat

SEQ ID NO: 3223219 - DNA, 23 bp, Homo sapiens
tacagaaaaaccccgtttccctg

SEQ ID NO: 3223220 - DNA, 15 bp, Homo sapiens
tacagaaaaatcttg

SEQ ID NO: 3223221 - DNA, 21 bp, Homo sapiens
tacagaaagatggatgtgctt

SEQ ID NO: 3223222 - DNA, 19 bp, Homo sapiens
tacagaaatactataacat

SEQ ID NO: 3223223 - DNA, 15 bp, Homo sapiens
tacagaaatgcaaaa

SEQ ID NO: 3223224 - DNA, 22 bp, Homo sapiens
tacagaagccaagctccctgga

SEQ ID NO: 3223225 - DNA, 14 bp, Homo sapiens
tacagacaaggagg

SEQ ID NO: 3223226 - DNA, 18 bp, Homo sapiens
tacagacactaagttata

SEQ ID NO: 3223227 - DNA, 16 bp, Homo sapiens
tacagacagaagagaa

SEQ ID NO: 3223228 - DNA, 14 bp, Homo sapiens
tacagacctgcttt

SEQ ID NO: 3223229 - DNA, 15 bp, Homo sapiens
tacagacctgctttt

SEQ ID NO: 3223230 - DNA, 23 bp, Homo sapiens
tacagacctgctttttgaaatga

SEQ ID NO: 3223231 - DNA, 14 bp, Homo sapiens
tacagactgtttta

SEQ ID NO: 3223232 - DNA, 16 bp, Homo sapiens
tacagagaggagaaac

SEQ ID NO: 3223233 - DNA, 17 bp, Homo sapiens
tacagagaggagaaaca

SEQ ID NO: 3223234 - DNA, 21 bp, Homo sapiens
tacagagaggagaaacacatc

SEQ ID NO: 3223235 - DNA, 12 bp, Homo sapiens
tacagagcacat

SEQ ID NO: 3223236 - DNA, 15 bp, Homo sapiens
tacagagcacatttg

SEQ ID NO: 3223237 - DNA, 13 bp, Homo sapiens
tacagagtgggcc

SEQ ID NO: 3223238 - DNA, 18 bp, Homo sapiens
tacagataattcatttgt

SEQ ID NO: 3223239 - DNA, 19 bp, Homo sapiens
tacagatagagagttgttg

SEQ ID NO: 3223240 - DNA, 22 bp, Homo sapiens
tacagatcaggcagtgtttaaa

SEQ ID NO: 3223241 - DNA, 19 bp, Homo sapiens
tacagatcctttttccatc

SEQ ID NO: 3223242 - DNA, 13 bp, Homo sapiens
tacagatgaaaat

SEQ ID NO: 3223243 - DNA, 18 bp, Homo sapiens
tacagatgaatgtattta

SEQ ID NO: 3223244 - DNA, 20 bp, Homo sapiens
tacagcaacaatttatgaat

SEQ ID NO: 3223245 - DNA, 22 bp, Homo sapiens
tacagcaacaatttatgaattg

SEQ ID NO: 3223246 - DNA, 15 bp, Homo sapiens
tacagcactactctg

SEQ ID NO: 3223247 - DNA, 19 bp, Homo sapiens
tacagcactactctgtgcc

SEQ ID NO: 3223248 - DNA, 14 bp, Homo sapiens
tacagcattgtctt

SEQ ID NO: 3223249 - DNA, 20 bp, Homo sapiens
tacagcattgtctttgctgt

SEQ ID NO: 3223250 - DNA, 16 bp, Homo sapiens
tacagcgcggaggagg

SEQ ID NO: 3223251 - DNA, 13 bp, Homo sapiens
tacagctgcctgc

SEQ ID NO: 3223252 - DNA, 19 bp, Homo sapiens
tacagctgtattgtctgaa

SEQ ID NO: 3223253 - DNA, 14 bp, Homo sapiens
tacagctgtttaag

SEQ ID NO: 3223254 - DNA, 14 bp, Homo sapiens
tacagcttcaccct

SEQ ID NO: 3223255 - DNA, 21 bp, Homo sapiens
tacagctttacacacacagat

SEQ ID NO: 3223256 - DNA, 19 bp, Homo sapiens
tacagctttgatccctgac

SEQ ID NO: 3223257 - DNA, 18 bp, Homo sapiens
tacagcttttatggatga

SEQ ID NO: 3223258 - DNA, 19 bp, Homo sapiens
tacagcttttatggatgat

SEQ ID NO: 3223259 - DNA, 22 bp, Homo sapiens
tacagcttttatggatgattaa

SEQ ID NO: 3223260 - DNA, 22 bp, Homo sapiens
tacaggaaaaaaaattctgttg

SEQ ID NO: 3223261 - DNA, 23 bp, Homo sapiens
tacaggaaaaaaaattctgttgt

SEQ ID NO: 3223262 - DNA, 17 bp, Homo sapiens
tacaggaaaagctgctg

SEQ ID NO: 3223263 - DNA, 18 bp, Homo sapiens
tacaggaaaagctgctga

SEQ ID NO: 3223264 - DNA, 15 bp, Homo sapiens
tacaggaatgaagaa

SEQ ID NO: 3223265 - DNA, 14 bp, Homo sapiens
tacaggagaggcag

SEQ ID NO: 3223266 - DNA, 20 bp, Homo sapiens
tacaggagggaacatttccg

SEQ ID NO: 3223267 - DNA, 14 bp, Homo sapiens
tacaggcaattccg

SEQ ID NO: 3223268 - DNA, 14 bp, Homo sapiens
tacaggccctgctc

SEQ ID NO: 3223269 - DNA, 16 bp, Homo sapiens
tacaggccctgctcct

SEQ ID NO: 3223270 - DNA, 19 bp, Homo sapiens
tacaggccctgctcctgca

SEQ ID NO: 3223271 - DNA, 15 bp, Homo sapiens
tacaggcgcctgcca

SEQ ID NO: 3223272 - DNA, 22 bp, Homo sapiens
tacagggagaaaatccaggtca

SEQ ID NO: 3223273 - DNA, 15 bp, Homo sapiens
tacagggagcctcct

SEQ ID NO: 3223274 - DNA, 17 bp, Homo sapiens
tacagggagcctcctgc

SEQ ID NO: 3223275 - DNA, 18 bp, Homo sapiens
tacagggagcctcctgcc

SEQ ID NO: 3223276 - DNA, 16 bp, Homo sapiens
tacagggagctgggac

SEQ ID NO: 3223277 - DNA, 20 bp, Homo sapiens
tacaggggtagtttgtttta

SEQ ID NO: 3223278 - DNA, 13 bp, Homo sapiens
tacagggtgactc

SEQ ID NO: 3223279 - DNA, 16 bp, Homo sapiens
tacagtaactttatgt

SEQ ID NO: 3223280 - DNA, 14 bp, Homo sapiens
tacagtaagctgct

SEQ ID NO: 3223281 - DNA, 13 bp, Homo sapiens
taccagaagggaa

SEQ ID NO: 3223282 - DNA, 21 bp, Homo sapiens
taccagagccttcaagtgcca

SEQ ID NO: 3223283 - DNA, 14 bp, Homo sapiens
taccagagctagtt

SEQ ID NO: 3223284 - DNA, 17 bp, Homo sapiens
taccagccctggggctg

SEQ ID NO: 3223285 - DNA, 19 bp, Homo sapiens
taccagccctggggctggg

SEQ ID NO: 3223286 - DNA, 21 bp, Homo sapiens
taccagcgccaaatgttcatc

SEQ ID NO: 3223287 - DNA, 14 bp, Homo sapiens
taccaggatttttt

SEQ ID NO: 3223288 - DNA, 15 bp, Homo sapiens
taccaggttgaaaga

SEQ ID NO: 3223289 - DNA, 12 bp, Homo sapiens
taccagtattta

SEQ ID NO: 3223290 - DNA, 15 bp, Homo sapiens
taccagtatttagaa

SEQ ID NO: 3223291 - DNA, 20 bp, Homo sapiens
taccagtatttagaagccaa

SEQ ID NO: 3223292 - DNA, 21 bp, Homo sapiens
taccagtctttaaaggcccag

SEQ ID NO: 3223293 - DNA, 18 bp, Homo sapiens
taccagttaatttttcca

SEQ ID NO: 3223294 - DNA, 19 bp, Homo sapiens
taccagttaatttttccaa

SEQ ID NO: 3223295 - DNA, 12 bp, Homo sapiens
taccagttgcct

SEQ ID NO: 3223296 - DNA, 14 bp, Homo sapiens
taccagttgccttt

SEQ ID NO: 3223297 - DNA, 19 bp, Homo sapiens
taccagttgccttttatcc

SEQ ID NO: 3223298 - DNA, 18 bp, Homo sapiens
taccatcagggacaggat

SEQ ID NO: 3223299 - DNA, 15 bp, Homo sapiens
taccatgaaacaaag

SEQ ID NO: 3223300 - DNA, 14 bp, Homo sapiens
taccatgaacagaa

SEQ ID NO: 3223301 - DNA, 20 bp, Homo sapiens
taccatgaacagaaaacatt

SEQ ID NO: 3223302 - DNA, 22 bp, Homo sapiens
taccatgagaagagggcctgtg

SEQ ID NO: 3223303 - DNA, 18 bp, Homo sapiens
taccatgcttcacaatgt

SEQ ID NO: 3223304 - DNA, 20 bp, Homo sapiens
taccattaaaactgcttttt

SEQ ID NO: 3223305 - DNA, 14 bp, Homo sapiens
taccattaattaca

SEQ ID NO: 3223306 - DNA, 20 bp, Homo sapiens
taccattagcataattttgt

SEQ ID NO: 3223307 - DNA, 17 bp, Homo sapiens
taccattcacaataaaa

SEQ ID NO: 3223308 - DNA, 23 bp, Homo sapiens
taccattcagtgattactgtcaa

SEQ ID NO: 3223309 - DNA, 22 bp, Homo sapiens
taatttcatactatttagattt

SEQ ID NO: 3223310 - DNA, 14 bp, Homo sapiens
taatttcggttata

SEQ ID NO: 3223311 - DNA, 13 bp, Homo sapiens
taatttctcctcc

SEQ ID NO: 3223312 - DNA, 17 bp, Homo sapiens
taatttcttttttcctc

SEQ ID NO: 3223313 - DNA, 20 bp, Homo sapiens
taatttgaatgtggttactt

SEQ ID NO: 3223314 - DNA, 22 bp, Homo sapiens
taatttgaggacaaccattcca

SEQ ID NO: 3223315 - DNA, 16 bp, Homo sapiens
taatttgatgaaagct

SEQ ID NO: 3223316 - DNA, 21 bp, Homo sapiens
taatttgatggtatttctttc

SEQ ID NO: 3223317 - DNA, 22 bp, Homo sapiens
taatttgatggtatttctttct

SEQ ID NO: 3223318 - DNA, 14 bp, Homo sapiens
taatttgattaaca

SEQ ID NO: 3223319 - DNA, 16 bp, Homo sapiens
taatttgattaacaaa

SEQ ID NO: 3223320 - DNA, 12 bp, Homo sapiens
taatttgcatta

SEQ ID NO: 3223321 - DNA, 18 bp, Homo sapiens
taatttgtaaacttctga

SEQ ID NO: 3223322 - DNA, 14 bp, Homo sapiens
taatttgtgtaata

SEQ ID NO: 3223323 - DNA, 16 bp, Homo sapiens
taatttgtttccagca

SEQ ID NO: 3223324 - DNA, 15 bp, Homo sapiens
taattttaaaagtct

SEQ ID NO: 3223325 - DNA, 16 bp, Homo sapiens
taattttaaagtaatt

SEQ ID NO: 3223326 - DNA, 23 bp, Homo sapiens
taattttaaagtaatttctaaag

SEQ ID NO: 3223327 - DNA, 14 bp, Homo sapiens
taattttaaagtgc

SEQ ID NO: 3223328 - DNA, 13 bp, Homo sapiens
taattttaaataa

SEQ ID NO: 3223329 - DNA, 13 bp, Homo sapiens
taattttaagaaa

SEQ ID NO: 3223330 - DNA, 22 bp, Homo sapiens
taattttacatgtttataaatc

SEQ ID NO: 3223331 - DNA, 18 bp, Homo sapiens
taattttatttataaact

SEQ ID NO: 3223332 - DNA, 19 bp, Homo sapiens
taattttctcaaaagcatt

SEQ ID NO: 3223333 - DNA, 12 bp, Homo sapiens
taattttctgaa

SEQ ID NO: 3223334 - DNA, 14 bp, Homo sapiens
taattttcttcatg

SEQ ID NO: 3223335 - DNA, 22 bp, Homo sapiens
taattttgaagtgctgtttatt

SEQ ID NO: 3223336 - DNA, 21 bp, Homo sapiens
taattttgatatacattgtgt

SEQ ID NO: 3223337 - DNA, 19 bp, Homo sapiens
taattttgcatactgaaaa

SEQ ID NO: 3223338 - DNA, 21 bp, Homo sapiens
taattttgcatactgaaaatc

SEQ ID NO: 3223339 - DNA, 18 bp, Homo sapiens
taattttgtgcattcttt

SEQ ID NO: 3223340 - DNA, 19 bp, Homo sapiens
taattttgtgcattctttg

SEQ ID NO: 3223341 - DNA, 22 bp, Homo sapiens
taattttgtgcattctttggta

SEQ ID NO: 3223342 - DNA, 17 bp, Homo sapiens
taatttttatttcttcc

SEQ ID NO: 3223343 - DNA, 22 bp, Homo sapiens
taatttttcagctctctgtata

SEQ ID NO: 3223344 - DNA, 13 bp, Homo sapiens
taatttttccaac

SEQ ID NO: 3223345 - DNA, 19 bp, Homo sapiens
taatttttggggaaaaaag

SEQ ID NO: 3223346 - DNA, 22 bp, Homo sapiens
taatttttggggaaaaaagcac

SEQ ID NO: 3223347 - DNA, 17 bp, Homo sapiens
taatttttttatgtttt

SEQ ID NO: 3223348 - DNA, 22 bp, Homo sapiens
taattttttttttccttttaaa

SEQ ID NO: 3223349 - DNA, 18 bp, Homo sapiens
tacaaaactgtaaataaa

SEQ ID NO: 3223350 - DNA, 16 bp, Homo sapiens
tacaaaagagcatgga

SEQ ID NO: 3223351 - DNA, 13 bp, Homo sapiens
tacaaaagatgta

SEQ ID NO: 3223352 - DNA, 13 bp, Homo sapiens
tacaaaataaaaa

SEQ ID NO: 3223353 - DNA, 15 bp, Homo sapiens
tacaaaataaaaaca

SEQ ID NO: 3223354 - DNA, 19 bp, Homo sapiens
tacaaaataaacaaataac

SEQ ID NO: 3223355 - DNA, 14 bp, Homo sapiens
tacaaaattaagca

SEQ ID NO: 3223356 - DNA, 19 bp, Homo sapiens
tacaaaatttgaaatttag

SEQ ID NO: 3223357 - DNA, 22 bp, Homo sapiens
tacaaacaagtggatgttttta

SEQ ID NO: 3223358 - DNA, 13 bp, Homo sapiens
tacaaacctacca

SEQ ID NO: 3223359 - DNA, 11 bp, Homo sapiens
tacaaactgca

SEQ ID NO: 3223360 - DNA, 12 bp, Homo sapiens
tacaaactgcaa

SEQ ID NO: 3223361 - DNA, 16 bp, Homo sapiens
tacaaactggtattct

SEQ ID NO: 3223362 - DNA, 21 bp, Homo sapiens
tacaaagaggtgtacaggtac

SEQ ID NO: 3223363 - DNA, 18 bp, Homo sapiens
tacaaagcactagagaat

SEQ ID NO: 3223364 - DNA, 23 bp, Homo sapiens
tacaaagcactagagaatgcaca

SEQ ID NO: 3223365 - DNA, 16 bp, Homo sapiens
tacaaagcgtgcacaa

SEQ ID NO: 3223366 - DNA, 18 bp, Homo sapiens
tacaaagctttgctacaa

SEQ ID NO: 3223367 - DNA, 21 bp, Homo sapiens
tacaaagctttgctacaaatt

SEQ ID NO: 3223368 - DNA, 13 bp, Homo sapiens
tacaaagtaaata

SEQ ID NO: 3223369 - DNA, 22 bp, Homo sapiens
tacaaagtaaatacaagactgt

SEQ ID NO: 3223370 - DNA, 16 bp, Homo sapiens
tacaaagtaatttctt

SEQ ID NO: 3223371 - DNA, 18 bp, Homo sapiens
tacaaagtagaagtctta

SEQ ID NO: 3223372 - DNA, 14 bp, Homo sapiens
tacaaagtgtacca

SEQ ID NO: 3223373 - DNA, 13 bp, Homo sapiens
tacaaagttttcc

SEQ ID NO: 3223374 - DNA, 16 bp, Homo sapiens
tacaaagttttccttt

SEQ ID NO: 3223375 - DNA, 23 bp, Homo sapiens
tacaaatactcttaggaagagaa

SEQ ID NO: 3223376 - DNA, 17 bp, Homo sapiens
tacaaatataagatttt

SEQ ID NO: 3223377 - DNA, 13 bp, Homo sapiens
tacaaatatattg

SEQ ID NO: 3223378 - DNA, 14 bp, Homo sapiens
tacaaatatattgt

SEQ ID NO: 3223379 - DNA, 15 bp, Homo sapiens
tacaaatatattgtt

SEQ ID NO: 3223380 - DNA, 17 bp, Homo sapiens
tacaaatatattgttaa

SEQ ID NO: 3223381 - DNA, 13 bp, Homo sapiens
tacaaatgtattt

SEQ ID NO: 3223382 - DNA, 16 bp, Homo sapiens
tacaaatgtattttga

SEQ ID NO: 3223383 - DNA, 23 bp, Homo sapiens
tacaaatgtattttgaagaatat

SEQ ID NO: 3223384 - DNA, 16 bp, Homo sapiens
tacaaattaaaaagat

SEQ ID NO: 3223385 - DNA, 13 bp, Homo sapiens
tacaaattagaaa

SEQ ID NO: 3223386 - DNA, 14 bp, Homo sapiens
tacaaattagaaaa

SEQ ID NO: 3223387 - DNA, 15 bp, Homo sapiens
tacaaattgtcgttt

SEQ ID NO: 3223388 - DNA, 16 bp, Homo sapiens
tacaaatttatgcatt

SEQ ID NO: 3223389 - DNA, 17 bp, Homo sapiens
tacaaatttatgcattt

SEQ ID NO: 3223390 - DNA, 18 bp, Homo sapiens
tacaaccatccctgccac

SEQ ID NO: 3223391 - DNA, 17 bp, Homo sapiens
tacaacctccctcttgt

SEQ ID NO: 3223392 - DNA, 21 bp, Homo sapiens
tacaacctccctcttgttttg

SEQ ID NO: 3223393 - DNA, 20 bp, Homo sapiens
tacaactaacgcaaccaagt

SEQ ID NO: 3223394 - DNA, 23 bp, Homo sapiens
tacaactgcctcgaaacacagaa

SEQ ID NO: 3223395 - DNA, 18 bp, Homo sapiens
tacaacttaaataataaa

SEQ ID NO: 3223396 - DNA, 20 bp, Homo sapiens
tacaagagcagcctgtggca

SEQ ID NO: 3223397 - DNA, 16 bp, Homo sapiens
tacaagcctgcacaat

SEQ ID NO: 3223398 - DNA, 16 bp, Homo sapiens
tacaagcgtgagccac

SEQ ID NO: 3223399 - DNA, 18 bp, Homo sapiens
tacaagcgtgagccactg

SEQ ID NO: 3223400 - DNA, 16 bp, Homo sapiens
tacaaggtaattgttt

SEQ ID NO: 3223401 - DNA, 17 bp, Homo sapiens
tacaaggtaattgtttt

SEQ ID NO: 3223402 - DNA, 21 bp, Homo sapiens
tacaagtaaatagtttgaatt

SEQ ID NO: 3223403 - DNA, 17 bp, Homo sapiens
tacaagtatatgtgaaa

SEQ ID NO: 3223404 - DNA, 13 bp, Homo sapiens
tacaagtgtatat

SEQ ID NO: 3223405 - DNA, 15 bp, Homo sapiens
tacaagtgtatatca

SEQ ID NO: 3223406 - DNA, 20 bp, Homo sapiens
tacaagttgttattgttgaa

SEQ ID NO: 3223407 - DNA, 17 bp, Homo sapiens
tacaagtttcagacagg

SEQ ID NO: 3223408 - DNA, 18 bp, Homo sapiens
tacaagtttcagacaggg

SEQ ID NO: 3223409 - DNA, 13 bp, Homo sapiens
tacaagttttgta

SEQ ID NO: 3223410 - DNA, 14 bp, Homo sapiens
tacaagttttgtat

SEQ ID NO: 3223411 - DNA, 11 bp, Homo sapiens
tacaataaact

SEQ ID NO: 3223412 - DNA, 13 bp, Homo sapiens
tacaataaactat

SEQ ID NO: 3223413 - DNA, 15 bp, Homo sapiens
tacaataaactggta

SEQ ID NO: 3223414 - DNA, 13 bp, Homo sapiens
tacaataaataat

SEQ ID NO: 3223415 - DNA, 16 bp, Homo sapiens
tacaataaataatctg

SEQ ID NO: 3223416 - DNA, 14 bp, Homo sapiens
gctccaagattcta

SEQ ID NO: 3223417 - DNA, 16 bp, Homo sapiens
gctccaagccccatct

SEQ ID NO: 3223418 - DNA, 20 bp, Homo sapiens
gctccaagggaccctttgcc

SEQ ID NO: 3223419 - DNA, 13 bp, Homo sapiens
gctccaccagcag

SEQ ID NO: 3223420 - DNA, 13 bp, Homo sapiens
gctccacccttgg

SEQ ID NO: 3223421 - DNA, 14 bp, Homo sapiens
gctccacccttggc

SEQ ID NO: 3223422 - DNA, 15 bp, Homo sapiens
gctccacgaagcctt

SEQ ID NO: 3223423 - DNA, 15 bp, Homo sapiens
gctccacgggcaggg

SEQ ID NO: 3223424 - DNA, 17 bp, Homo sapiens
gctccacgggcaggggt

SEQ ID NO: 3223425 - DNA, 23 bp, Homo sapiens
gctccacggtgcgtggctgtggc

SEQ ID NO: 3223426 - DNA, 12 bp, Homo sapiens
gctccactgtca

SEQ ID NO: 3223427 - DNA, 19 bp, Homo sapiens
gctccacttggtctgtgag

SEQ ID NO: 3223428 - DNA, 14 bp, Homo sapiens
taatgcttcagata

SEQ ID NO: 3223429 - DNA, 15 bp, Homo sapiens
taatgctttggaaaa

SEQ ID NO: 3223430 - DNA, 24 bp, Homo sapiens
taatgctttggaaaaatgggtctt

SEQ ID NO: 3223431 - DNA, 21 bp, Homo sapiens
taatggaaaatgccatgaatt

SEQ ID NO: 3223432 - DNA, 18 bp, Homo sapiens
taatggaaacattacagt

SEQ ID NO: 3223433 - DNA, 12 bp, Homo sapiens
taatggagaaga

SEQ ID NO: 3223434 - DNA, 13 bp, Homo sapiens
taatggcactgat

SEQ ID NO: 3223435 - DNA, 15 bp, Homo sapiens
taatggggattaatt

SEQ ID NO: 3223436 - DNA, 20 bp, Homo sapiens
taatgggggtagcagctgga

SEQ ID NO: 3223437 - DNA, 21 bp, Homo sapiens
taatgggggtagcagctggac

SEQ ID NO: 3223438 - DNA, 23 bp, Homo sapiens
taatggtactgactttgcttgct

SEQ ID NO: 3223439 - DNA, 14 bp, Homo sapiens
taatggtcccatcc

SEQ ID NO: 3223440 - DNA, 16 bp, Homo sapiens
taatggtcccatccag

SEQ ID NO: 3223441 - DNA, 18 bp, Homo sapiens
taatggtcccatccaggc

SEQ ID NO: 3223442 - DNA, 21 bp, Homo sapiens
taatggtctaaaaataaacca

SEQ ID NO: 3223443 - DNA, 15 bp, Homo sapiens
taatggtgaacattt

SEQ ID NO: 3223444 - DNA, 13 bp, Homo sapiens
taatggtgtagaa

SEQ ID NO: 3223445 - DNA, 19 bp, Homo sapiens
taatggtttttatttctcg

SEQ ID NO: 3223446 - DNA, 14 bp, Homo sapiens
taatgtaaaatgtt

SEQ ID NO: 3223447 - DNA, 17 bp, Homo sapiens
taatgtaagctctactg

SEQ ID NO: 3223448 - DNA, 19 bp, Homo sapiens
taatgtaatcggcttgaat

SEQ ID NO: 3223449 - DNA, 15 bp, Homo sapiens
taatgtacatctggc

SEQ ID NO: 3223450 - DNA, 23 bp, Homo sapiens
taatgtagcgtgtttacatgtgt

SEQ ID NO: 3223451 - DNA, 15 bp, Homo sapiens
taatgtatataaaaa

SEQ ID NO: 3223452 - DNA, 21 bp, Homo sapiens
taatgtatttgttcatgtttg

SEQ ID NO: 3223453 - DNA, 18 bp, Homo sapiens
taatgtccctttcagaga

SEQ ID NO: 3223454 - DNA, 19 bp, Homo sapiens
taatgtctcactgttctgc

SEQ ID NO: 3223455 - DNA, 15 bp, Homo sapiens
taatgtcttcataaa

SEQ ID NO: 3223456 - DNA, 15 bp, Homo sapiens
taatgtgaaaatcat

SEQ ID NO: 3223457 - DNA, 22 bp, Homo sapiens
taatgtgaaatatgatgagatt

SEQ ID NO: 3223458 - DNA, 18 bp, Homo sapiens
taatgtgaagacattttt

SEQ ID NO: 3223459 - DNA, 20 bp, Homo sapiens
taatgtgatgatgtaattga

SEQ ID NO: 3223460 - DNA, 21 bp, Homo sapiens
taatgtgatgatgtaattgac

SEQ ID NO: 3223461 - DNA, 22 bp, Homo sapiens
taatgtgatggatggcacaatg

SEQ ID NO: 3223462 - DNA, 23 bp, Homo sapiens
taatgtgatggatggcacaatga

SEQ ID NO: 3223463 - DNA, 16 bp, Homo sapiens
taatgtggaagaaaat

SEQ ID NO: 3223464 - DNA, 22 bp, Homo sapiens
taatgtggaagaaaatggttta

SEQ ID NO: 3223465 - DNA, 20 bp, Homo sapiens
taatgtgtatttactgtact

SEQ ID NO: 3223466 - DNA, 15 bp, Homo sapiens
taatgtgtcccctga

SEQ ID NO: 3223467 - DNA, 18 bp, Homo sapiens
taatgtgtggtggcctca

SEQ ID NO: 3223468 - DNA, 16 bp, Homo sapiens
taatgttaaatttgta

SEQ ID NO: 3223469 - DNA, 15 bp, Homo sapiens
taatgttaattcagc

SEQ ID NO: 3223470 - DNA, 21 bp, Homo sapiens
taatgttactgatcatgcatt

SEQ ID NO: 3223471 - DNA, 16 bp, Homo sapiens
taatgttctttaatgt

SEQ ID NO: 3223472 - DNA, 21 bp, Homo sapiens
taatgttgggtagaaagagat

SEQ ID NO: 3223473 - DNA, 11 bp, Homo sapiens
taatgtttaaa

SEQ ID NO: 3223474 - DNA, 20 bp, Homo sapiens
taatgtttaaatcatgtatg

SEQ ID NO: 3223475 - DNA, 17 bp, Homo sapiens
taatgtttatgagccag

SEQ ID NO: 3223476 - DNA, 13 bp, Homo sapiens
taatgtttgctat

SEQ ID NO: 3223477 - DNA, 15 bp, Homo sapiens
taatgttttgtacaa

SEQ ID NO: 3223478 - DNA, 19 bp, Homo sapiens
taatgttttgtatatacag

SEQ ID NO: 3223479 - DNA, 22 bp, Homo sapiens
taatgttttgtatatacagtta

SEQ ID NO: 3223480 - DNA, 17 bp, Homo sapiens
taatgtttttcctttct

SEQ ID NO: 3223481 - DNA, 15 bp, Homo sapiens
taattaaaataagaa

SEQ ID NO: 3223482 - DNA, 16 bp, Homo sapiens
taattaaaattgtgca

SEQ ID NO: 3223483 - DNA, 12 bp, Homo sapiens
taattaaagtag

SEQ ID NO: 3223484 - DNA, 15 bp, Homo sapiens
taattaaagtagatt

SEQ ID NO: 3223485 - DNA, 13 bp, Homo sapiens
taattaaatgtat

SEQ ID NO: 3223486 - DNA, 14 bp, Homo sapiens
taattaaatgtatt

SEQ ID NO: 3223487 - DNA, 19 bp, Homo sapiens
taattaaattatggtatta

SEQ ID NO: 3223488 - DNA, 18 bp, Homo sapiens
taattaagactgaaaata

SEQ ID NO: 3223489 - DNA, 17 bp, Homo sapiens
taattaagtactatgta

SEQ ID NO: 3223490 - DNA, 20 bp, Homo sapiens
taattaagtactatgtatca

SEQ ID NO: 3223491 - DNA, 17 bp, Homo sapiens
taattaatatattaaaa

SEQ ID NO: 3223492 - DNA, 13 bp, Homo sapiens
taattaattaaag

SEQ ID NO: 3223493 - DNA, 14 bp, Homo sapiens
taattaattgtaat

SEQ ID NO: 3223494 - DNA, 13 bp, Homo sapiens
taattaatttgat

SEQ ID NO: 3223495 - DNA, 16 bp, Homo sapiens
taattaatttgattaa

SEQ ID NO: 3223496 - DNA, 19 bp, Homo sapiens
taattaatttgattaacaa

SEQ ID NO: 3223497 - DNA, 21 bp, Homo sapiens
taattacaggagggaacattt

SEQ ID NO: 3223498 - DNA, 20 bp, Homo sapiens
taattagctctggggggcag

SEQ ID NO: 3223499 - DNA, 21 bp, Homo sapiens
taattagtgccacttaatgta

SEQ ID NO: 3223500 - DNA, 18 bp, Homo sapiens
taattatcggaagcagtg

SEQ ID NO: 3223501 - DNA, 19 bp, Homo sapiens
taattatcgggaacagtgt

SEQ ID NO: 3223502 - DNA, 21 bp, Homo sapiens
taattatctcctaattgtatg

SEQ ID NO: 3223503 - DNA, 17 bp, Homo sapiens
taattatgtgcatatta

SEQ ID NO: 3223504 - DNA, 14 bp, Homo sapiens
taattatgttttca

SEQ ID NO: 3223505 - DNA, 20 bp, Homo sapiens
taattattaactacatttat

SEQ ID NO: 3223506 - DNA, 16 bp, Homo sapiens
taattattataaaaat

SEQ ID NO: 3223507 - DNA, 19 bp, Homo sapiens
taattattataaaaatatt

SEQ ID NO: 3223508 - DNA, 22 bp, Homo sapiens
taattattatttatatatgtat

SEQ ID NO: 3223509 - DNA, 17 bp, Homo sapiens
taattattatttccagt

SEQ ID NO: 3223510 - DNA, 17 bp, Homo sapiens
taattatttattacata

SEQ ID NO: 3223511 - DNA, 13 bp, Homo sapiens
taattattttggt

SEQ ID NO: 3223512 - DNA, 16 bp, Homo sapiens
taattcacctatgtta

SEQ ID NO: 3223513 - DNA, 12 bp, Homo sapiens
taattcactcaa

SEQ ID NO: 3223514 - DNA, 21 bp, Homo sapiens
taattcactcaagcactgata

SEQ ID NO: 3223515 - DNA, 12 bp, Homo sapiens
taattcagcact

SEQ ID NO: 3223516 - DNA, 18 bp, Homo sapiens
taattcagtatgatttat

SEQ ID NO: 3223517 - DNA, 16 bp, Homo sapiens
taattcatttgtattg

SEQ ID NO: 3223518 - DNA, 19 bp, Homo sapiens
taattcatttgtattgctt

SEQ ID NO: 3223519 - DNA, 20 bp, Homo sapiens
taattccaatatgatgactc

SEQ ID NO: 3223520 - DNA, 17 bp, Homo sapiens
taattcccattttgcaa

SEQ ID NO: 3223521 - DNA, 18 bp, Homo sapiens
taattcccattttgcaaa

SEQ ID NO: 3223522 - DNA, 21 bp, Homo sapiens
taattcccattttgcaaaatt

SEQ ID NO: 3223523 - DNA, 23 bp, Homo sapiens
taattcccattttgcaaaatttc

SEQ ID NO: 3223524 - DNA, 21 bp, Homo sapiens
taattcctatatcctgtgact

SEQ ID NO: 3223525 - DNA, 11 bp, Homo sapiens
taattctaaat

SEQ ID NO: 3223526 - DNA, 21 bp, Homo sapiens
taattctaagttatttacttt

SEQ ID NO: 3223527 - DNA, 15 bp, Homo sapiens
taattctgtaaatgt

SEQ ID NO: 3223528 - DNA, 21 bp, Homo sapiens
taattctgtacatagcctata

SEQ ID NO: 3223529 - DNA, 17 bp, Homo sapiens
taattcttcacctgtta

SEQ ID NO: 3223530 - DNA, 18 bp, Homo sapiens
taattctttctattttca

SEQ ID NO: 3223531 - DNA, 19 bp, Homo sapiens
taattctttctattttcac

SEQ ID NO: 3223532 - DNA, 22 bp, Homo sapiens
taattgacaggattattggaaa

SEQ ID NO: 3223533 - DNA, 23 bp, Homo sapiens
taattgacggttttttattattg

SEQ ID NO: 3223534 - DNA, 20 bp, Homo sapiens
taattgacttgcaaagacct

SEQ ID NO: 3223535 - DNA, 21 bp, Homo sapiens
taattgacttgcaaagaccta

SEQ ID NO: 3223536 - DNA, 19 bp, Homo sapiens
taattgatttcaagacctt

SEQ ID NO: 3223537 - DNA, 23 bp, Homo sapiens
taattgcttattgttttattgta

SEQ ID NO: 3223538 - DNA, 16 bp, Homo sapiens
taattggtgctatttg

SEQ ID NO: 3223539 - DNA, 14 bp, Homo sapiens
taattgtaaactgt

SEQ ID NO: 3223540 - DNA, 22 bp, Homo sapiens
taattgtagttctgtgtacttt

SEQ ID NO: 3223541 - DNA, 12 bp, Homo sapiens
taattgtataag

SEQ ID NO: 3223542 - DNA, 13 bp, Homo sapiens
taattgtataagt

SEQ ID NO: 3223543 - DNA, 12 bp, Homo sapiens
taattgtcatta

SEQ ID NO: 3223544 - DNA, 14 bp, Homo sapiens
taattgtgtggatt

SEQ ID NO: 3223545 - DNA, 22 bp, Homo sapiens
taattgttgaaattttgcaaat

SEQ ID NO: 3223546 - DNA, 16 bp, Homo sapiens
taattgttgctaatct

SEQ ID NO: 3223547 - DNA, 14 bp, Homo sapiens
taattgttgtttct

SEQ ID NO: 3223548 - DNA, 16 bp, Homo sapiens
taattgttgtttcttt

SEQ ID NO: 3223549 - DNA, 18 bp, Homo sapiens
taattgtttccaacttgt

SEQ ID NO: 3223550 - DNA, 20 bp, Homo sapiens
taattgtttccaacttgtct

SEQ ID NO: 3223551 - DNA, 18 bp, Homo sapiens
taattgttttgcactttt

SEQ ID NO: 3223552 - DNA, 17 bp, Homo sapiens
taatttaaacaggccca

SEQ ID NO: 3223553 - DNA, 14 bp, Homo sapiens
taatttaaagagac

SEQ ID NO: 3223554 - DNA, 13 bp, Homo sapiens
taatttaaatgaa

SEQ ID NO: 3223555 - DNA, 19 bp, Homo sapiens
tagaactttaagcaacaag

SEQ ID NO: 3223556 - DNA, 16 bp, Homo sapiens
tagaacttttttaaat

SEQ ID NO: 3223557 - DNA, 18 bp, Homo sapiens
tagaacttttttaaataa

SEQ ID NO: 3223558 - DNA, 18 bp, Homo sapiens
tagaagaacatccaagga

SEQ ID NO: 3223559 - DNA, 19 bp, Homo sapiens
tagaagatggactctgaaa

SEQ ID NO: 3223560 - DNA, 22 bp, Homo sapiens
tagaagcactacaccttgcctt

SEQ ID NO: 3223561 - DNA, 22 bp, Homo sapiens
tagaagcattccttctttgata

SEQ ID NO: 3223562 - DNA, 23 bp, Homo sapiens
tagaagcattccttctttgataa

SEQ ID NO: 3223563 - DNA, 15 bp, Homo sapiens
tagaagccaagggaa

SEQ ID NO: 3223564 - DNA, 12 bp, Homo sapiens
tagaagcctgca

SEQ ID NO: 3223565 - DNA, 15 bp, Homo sapiens
tagaaggaatttgta

SEQ ID NO: 3223566 - DNA, 18 bp, Homo sapiens
tagaaggaatttgtactt

SEQ ID NO: 3223567 - DNA, 15 bp, Homo sapiens
tagaaggagccttgt

SEQ ID NO: 3223568 - DNA, 15 bp, Homo sapiens
tagaagtcacacagt

SEQ ID NO: 3223569 - DNA, 20 bp, Homo sapiens
tagaagtcttagatgtatat

SEQ ID NO: 3223570 - DNA, 20 bp, Homo sapiens
tagaagtgagcaaaaaagag

SEQ ID NO: 3223571 - DNA, 15 bp, Homo sapiens
tagaagtgcatttct

SEQ ID NO: 3223572 - DNA, 16 bp, Homo sapiens
tagaagtttcccttcc

SEQ ID NO: 3223573 - DNA, 19 bp, Homo sapiens
tagaataaaggcagttttc

SEQ ID NO: 3223574 - DNA, 22 bp, Homo sapiens
tagaataaaggcagttttctaa

SEQ ID NO: 3223575 - DNA, 22 bp, Homo sapiens
tagaataaggaggaggagggag

SEQ ID NO: 3223576 - DNA, 23 bp, Homo sapiens
tagaataaggaggaggagggaga

SEQ ID NO: 3223577 - DNA, 23 bp, Homo sapiens
tagaatagtgttctgcaaaaata

SEQ ID NO: 3223578 - DNA, 21 bp, Homo sapiens
tagaatataggtctcttctcc

SEQ ID NO: 3223579 - DNA, 15 bp, Homo sapiens
tagaatatatttcct

SEQ ID NO: 3223580 - DNA, 12 bp, Homo sapiens
tagaatatttat

SEQ ID NO: 3223581 - DNA, 20 bp, Homo sapiens
tagaatatttattacctctg

SEQ ID NO: 3223582 - DNA, 15 bp, Homo sapiens
tagaatcaatcagta

SEQ ID NO: 3223583 - DNA, 14 bp, Homo sapiens
tagaatcaatttaa

SEQ ID NO: 3223584 - DNA, 23 bp, Homo sapiens
tagaatccaaacttggatttttg

SEQ ID NO: 3223585 - DNA, 22 bp, Homo sapiens
tagaatctgcaattcaaaagtt

SEQ ID NO: 3223586 - DNA, 20 bp, Homo sapiens
tagaatctttattcaaactt

SEQ ID NO: 3223587 - DNA, 17 bp, Homo sapiens
tagaatgatctattgct

SEQ ID NO: 3223588 - DNA, 22 bp, Homo sapiens
tagaattatctaatttataaaa

SEQ ID NO: 3223589 - DNA, 13 bp, Homo sapiens
tagaattgtatat

SEQ ID NO: 3223590 - DNA, 14 bp, Homo sapiens
tagaattgttatag

SEQ ID NO: 3223591 - DNA, 16 bp, Homo sapiens
tagaatttgtattttg

SEQ ID NO: 3223592 - DNA, 15 bp, Homo sapiens
tagaattttctccct

SEQ ID NO: 3223593 - DNA, 15 bp, Homo sapiens
tagacaaaaagtata

SEQ ID NO: 3223594 - DNA, 16 bp, Homo sapiens
tagacaaaaagtatat

SEQ ID NO: 3223595 - DNA, 20 bp, Homo sapiens
tagacaaaaagtatattaaa

SEQ ID NO: 3223596 - DNA, 12 bp, Homo sapiens
tagacaaagtac

SEQ ID NO: 3223597 - DNA, 19 bp, Homo sapiens
tagacaacctgaaatttat

SEQ ID NO: 3223598 - DNA, 13 bp, Homo sapiens
tagagttaagaag

SEQ ID NO: 3223599 - DNA, 19 bp, Homo sapiens
tagagttaagaagctgttg

SEQ ID NO: 3223600 - DNA, 23 bp, Homo sapiens
tagagttaagaagctgttgtaca

SEQ ID NO: 3223601 - DNA, 14 bp, Homo sapiens
tagagttcatccca

SEQ ID NO: 3223602 - DNA, 16 bp, Homo sapiens
tagagttgctgagagg

SEQ ID NO: 3223603 - DNA, 23 bp, Homo sapiens
tagataacaagacctcagtgcct

SEQ ID NO: 3223604 - DNA, 17 bp, Homo sapiens
tagataatatttctgaa

SEQ ID NO: 3223605 - DNA, 21 bp, Homo sapiens
tagatagaaataaatagctat

SEQ ID NO: 3223606 - DNA, 14 bp, Homo sapiens
tagatataactgta

SEQ ID NO: 3223607 - DNA, 17 bp, Homo sapiens
tagatattactttatca

SEQ ID NO: 3223608 - DNA, 12 bp, Homo sapiens
tagatattgcta

SEQ ID NO: 3223609 - DNA, 12 bp, Homo sapiens
tagatatttggc

SEQ ID NO: 3223610 - DNA, 18 bp, Homo sapiens
tagatatttggcttaaat

SEQ ID NO: 3223611 - DNA, 16 bp, Homo sapiens
tagatcactgtgctta

SEQ ID NO: 3223612 - DNA, 21 bp, Homo sapiens
tagatcataaggcttcaaaat

SEQ ID NO: 3223613 - DNA, 20 bp, Homo sapiens
tagatccagatccagactgt

SEQ ID NO: 3223614 - DNA, 15 bp, Homo sapiens
tagatccatttccat

SEQ ID NO: 3223615 - DNA, 22 bp, Homo sapiens
tagatcgatgatatgaccagaa

SEQ ID NO: 3223616 - DNA, 17 bp, Homo sapiens
tagatcttatattggtt

SEQ ID NO: 3223617 - DNA, 18 bp, Homo sapiens
tagatcttatattggttt

SEQ ID NO: 3223618 - DNA, 15 bp, Homo sapiens
tagatcttctgaaat

SEQ ID NO: 3223619 - DNA, 16 bp, Homo sapiens
tagatgaagttttaca

SEQ ID NO: 3223620 - DNA, 16 bp, Homo sapiens
tagatgactttgcaga

SEQ ID NO: 3223621 - DNA, 20 bp, Homo sapiens
tagatgactttgcagatgga

SEQ ID NO: 3223622 - DNA, 19 bp, Homo sapiens
tagatgattaaataagatt

SEQ ID NO: 3223623 - DNA, 20 bp, Homo sapiens
tagatgattaaataagattc

SEQ ID NO: 3223624 - DNA, 14 bp, Homo sapiens
tagatgattatata

SEQ ID NO: 3223625 - DNA, 17 bp, Homo sapiens
tagatgcatcactgggt

SEQ ID NO: 3223626 - DNA, 16 bp, Homo sapiens
tagatgctgaatatct

SEQ ID NO: 3223627 - DNA, 18 bp, Homo sapiens
tagatgctgaatatctgt

SEQ ID NO: 3223628 - DNA, 20 bp, Homo sapiens
tagatgctgatgatttgttt

SEQ ID NO: 3223629 - DNA, 14 bp, Homo sapiens
tagatgggtggggg

SEQ ID NO: 3223630 - DNA, 22 bp, Homo sapiens
tagatgggtgggggctcctggt

SEQ ID NO: 3223631 - DNA, 23 bp, Homo sapiens
tagatgggtgggggctcctggtg

SEQ ID NO: 3223632 - DNA, 17 bp, Homo sapiens
tagatggttacactgtt

SEQ ID NO: 3223633 - DNA, 20 bp, Homo sapiens
tagatggttacactgttaga

SEQ ID NO: 3223634 - DNA, 15 bp, Homo sapiens
tagatgtagtatttt

SEQ ID NO: 3223635 - DNA, 12 bp, Homo sapiens
tagatgtatata

SEQ ID NO: 3223636 - DNA, 21 bp, Homo sapiens
tagatgtccctttcttggcca

SEQ ID NO: 3223637 - DNA, 23 bp, Homo sapiens
tagatgtccctttcttggccagt

SEQ ID NO: 3223638 - DNA, 20 bp, Homo sapiens
tagatgtggtttttaatttt

SEQ ID NO: 3223639 - DNA, 16 bp, Homo sapiens
tagatgttttggtaga

SEQ ID NO: 3223640 - DNA, 13 bp, Homo sapiens
tagattaaatata

SEQ ID NO: 3223641 - DNA, 20 bp, Homo sapiens
tagattaaatatagattaga

SEQ ID NO: 3223642 - DNA, 17 bp, Homo sapiens
tagattaatggcactga

SEQ ID NO: 3223643 - DNA, 17 bp, Homo sapiens
tagattaggattaaaat

SEQ ID NO: 3223644 - DNA, 17 bp, Homo sapiens
tagattatggagctttt

SEQ ID NO: 3223645 - DNA, 15 bp, Homo sapiens
tagattcaaaggttc

SEQ ID NO: 3223646 - DNA, 20 bp, Homo sapiens
tagattccattggtccaaga

SEQ ID NO: 3223647 - DNA, 22 bp, Homo sapiens
tagggatgcggatcctgctggg

SEQ ID NO: 3223648 - DNA, 15 bp, Homo sapiens
tagggattcaggctg

SEQ ID NO: 3223649 - DNA, 16 bp, Homo sapiens
tagggattcaggctgc

SEQ ID NO: 3223650 - DNA, 15 bp, Homo sapiens
tagggcaccaggggt

SEQ ID NO: 3223651 - DNA, 14 bp, Homo sapiens
tagggcactgggct

SEQ ID NO: 3223652 - DNA, 16 bp, Homo sapiens
tagggcactgggctgt

SEQ ID NO: 3223653 - DNA, 15 bp, Homo sapiens
tagggccaggcaggt

SEQ ID NO: 3223654 - DNA, 21 bp, Homo sapiens
tagggccaggcaggtgcctgg

SEQ ID NO: 3223655 - DNA, 21 bp, Homo sapiens
tagggcctggtccctgggagg

SEQ ID NO: 3223656 - DNA, 14 bp, Homo sapiens
tagggctgtaaaat

SEQ ID NO: 3223657 - DNA, 17 bp, Homo sapiens
taggggatggtccagga

SEQ ID NO: 3223658 - DNA, 17 bp, Homo sapiens
taggggccacctcctcc

SEQ ID NO: 3223659 - DNA, 21 bp, Homo sapiens
taggggccacctcctccccct

SEQ ID NO: 3223660 - DNA, 14 bp, Homo sapiens
taggggtcactgta

SEQ ID NO: 3223661 - DNA, 14 bp, Homo sapiens
taggggtgaaggag

SEQ ID NO: 3223662 - DNA, 19 bp, Homo sapiens
taggggttaaagcagacag

SEQ ID NO: 3223663 - DNA, 13 bp, Homo sapiens
taggggttgctaa

SEQ ID NO: 3223664 - DNA, 13 bp, Homo sapiens
tagggtaaaaatt

SEQ ID NO: 3223665 - DNA, 13 bp, Homo sapiens
tagggtaaatcag

SEQ ID NO: 3223666 - DNA, 14 bp, Homo sapiens
tagggtactaaatt

SEQ ID NO: 3223667 - DNA, 20 bp, Homo sapiens
taggtaatcaatgaatattg

SEQ ID NO: 3223668 - DNA, 13 bp, Homo sapiens
taggtaatgtttt

SEQ ID NO: 3223669 - DNA, 20 bp, Homo sapiens
taggtagaagtgagcaaaaa

SEQ ID NO: 3223670 - DNA, 19 bp, Homo sapiens
taggtagtttggatatttt

SEQ ID NO: 3223671 - DNA, 15 bp, Homo sapiens
taggtatgaataagt

SEQ ID NO: 3223672 - DNA, 22 bp, Homo sapiens
taggtccaagccccccacacct

SEQ ID NO: 3223673 - DNA, 15 bp, Homo sapiens
taggtccaagggcca

SEQ ID NO: 3223674 - DNA, 19 bp, Homo sapiens
taggtcctcacttggggga

SEQ ID NO: 3223675 - DNA, 17 bp, Homo sapiens
taggtctcatctcttca

SEQ ID NO: 3223676 - DNA, 18 bp, Homo sapiens
taggtctcatctcttcag

SEQ ID NO: 3223677 - DNA, 20 bp, Homo sapiens
taggtctcctcagggtgggg

SEQ ID NO: 3223678 - DNA, 17 bp, Homo sapiens
taggtctcttctcccag

SEQ ID NO: 3223679 - DNA, 19 bp, Homo sapiens
taggtctcttctcccagaa

SEQ ID NO: 3223680 - DNA, 12 bp, Homo sapiens
taggtctttctc

SEQ ID NO: 3223681 - DNA, 14 bp, Homo sapiens
taggtctttctctc

SEQ ID NO: 3223682 - DNA, 20 bp, Homo sapiens
taggtggctctgggaatggg

SEQ ID NO: 3223683 - DNA, 22 bp, Homo sapiens
taggtggtaaaacctgttctcc

SEQ ID NO: 3223684 - DNA, 22 bp, Homo sapiens
taggtgttaggcatgtcccacc

SEQ ID NO: 3223685 - DNA, 12 bp, Homo sapiens
taggttatacaa

SEQ ID NO: 3223686 - DNA, 15 bp, Homo sapiens
taggttatttaaaat

SEQ ID NO: 3223687 - DNA, 14 bp, Homo sapiens
taggttcagccaag

SEQ ID NO: 3223688 - DNA, 21 bp, Homo sapiens
taggttccctgttcttcctcc

SEQ ID NO: 3223689 - DNA, 13 bp, Homo sapiens
taggttctaaagt

SEQ ID NO: 3223690 - DNA, 18 bp, Homo sapiens
taggttctaaagttctaa

SEQ ID NO: 3223691 - DNA, 16 bp, Homo sapiens
taggttggacagcccc

SEQ ID NO: 3223692 - DNA, 13 bp, Homo sapiens
taggttgggacac

SEQ ID NO: 3223693 - DNA, 15 bp, Homo sapiens
taggtttttgtttgt

SEQ ID NO: 3223694 - DNA, 17 bp, Homo sapiens
tagtaaaagtcataaat

SEQ ID NO: 3223695 - DNA, 13 bp, Homo sapiens
tagtaaattttgt

SEQ ID NO: 3223696 - DNA, 23 bp, Homo sapiens
tagtaaattttgtgatgaataaa

SEQ ID NO: 3223697 - DNA, 19 bp, Homo sapiens
tagtaacttcttatggaat

SEQ ID NO: 3223698 - DNA, 11 bp, Homo sapiens
tagtaagaata

SEQ ID NO: 3223699 - DNA, 16 bp, Homo sapiens
tagtaagatgcactga

SEQ ID NO: 3223700 - DNA, 15 bp, Homo sapiens
tagtaagcatagaaa

SEQ ID NO: 3223701 - DNA, 16 bp, Homo sapiens
tagtaagtaattatgc

SEQ ID NO: 3223702 - DNA, 23 bp, Homo sapiens
tagtaagttaatgtatataaaaa

SEQ ID NO: 3223703 - DNA, 15 bp, Homo sapiens
tagtaatgttttata

SEQ ID NO: 3223704 - DNA, 21 bp, Homo sapiens
tagtaatttattgtctgtcta

SEQ ID NO: 3223705 - DNA, 16 bp, Homo sapiens
tagtacaaattataaa

SEQ ID NO: 3223706 - DNA, 20 bp, Homo sapiens
tagtaccatttatacaaatt

SEQ ID NO: 3223707 - DNA, 16 bp, Homo sapiens
tagtacctgaaaagta

SEQ ID NO: 3223708 - DNA, 18 bp, Homo sapiens
tagtacctgaaaagtaac

SEQ ID NO: 3223709 - DNA, 17 bp, Homo sapiens
tagtactccttaagaac

SEQ ID NO: 3223710 - DNA, 17 bp, Homo sapiens
tagtactctctgctcta

SEQ ID NO: 3223711 - DNA, 13 bp, Homo sapiens
tagtactgctctt

SEQ ID NO: 3223712 - DNA, 22 bp, Homo sapiens
tagtacttgaaatctaggatta

SEQ ID NO: 3223713 - DNA, 15 bp, Homo sapiens
tagtagaaattttac

SEQ ID NO: 3223714 - DNA, 12 bp, Homo sapiens
tagtagatttct

SEQ ID NO: 3223715 - DNA, 14 bp, Homo sapiens
tagtagtttttaca

SEQ ID NO: 3223716 - DNA, 22 bp, Homo sapiens
tagtatcagtgttttaaattct

SEQ ID NO: 3223717 - DNA, 15 bp, Homo sapiens
tagtatctaacatgt

SEQ ID NO: 3223718 - DNA, 11 bp, Homo sapiens
tagtatctgta

SEQ ID NO: 3223719 - DNA, 19 bp, Homo sapiens
tagtatgacgctgatacat

SEQ ID NO: 3223720 - DNA, 23 bp, Homo sapiens
tagtatgtctgtttttgtatctt

SEQ ID NO: 3223721 - DNA, 16 bp, Homo sapiens
tagtattaaaagttgc

SEQ ID NO: 3223722 - DNA, 19 bp, Homo sapiens
tagtattaaaagttgcatt

SEQ ID NO: 3223723 - DNA, 23 bp, Homo sapiens
tagtattatcttgttcaggaaaa

SEQ ID NO: 3223724 - DNA, 12 bp, Homo sapiens
tagtatttctcc

SEQ ID NO: 3223725 - DNA, 14 bp, Homo sapiens
tagtatttctcctt

SEQ ID NO: 3223726 - DNA, 19 bp, Homo sapiens
tagtatttctcctttgcaa

SEQ ID NO: 3223727 - DNA, 19 bp, Homo sapiens
tagtcaaaactatttttgt

SEQ ID NO: 3223728 - DNA, 14 bp, Homo sapiens
tagtcaatcactgc

SEQ ID NO: 3223729 - DNA, 13 bp, Homo sapiens
tagtcatctccta

SEQ ID NO: 3223730 - DNA, 18 bp, Homo sapiens
tagtcatttactaaacat

SEQ ID NO: 3223731 - DNA, 19 bp, Homo sapiens
tagtcatttactaaacata

SEQ ID NO: 3223732 - DNA, 22 bp, Homo sapiens
tagtccaaattatttttacgta

SEQ ID NO: 3223733 - DNA, 21 bp, Homo sapiens
tagtcccccaactctgagccc

SEQ ID NO: 3223734 - DNA, 18 bp, Homo sapiens
tagtccctcatgcaaatc

SEQ ID NO: 3223735 - DNA, 15 bp, Homo sapiens
tagtcccttcccctc

SEQ ID NO: 3223736 - DNA, 16 bp, Homo sapiens
tagtcccttcccctcc

SEQ ID NO: 3223737 - DNA, 23 bp, Homo sapiens
tagtcccttcccctccctggctc

SEQ ID NO: 3223738 - DNA, 16 bp, Homo sapiens
tagtcctatggaaaaa

SEQ ID NO: 3223739 - DNA, 17 bp, Homo sapiens
tagtcctatggaaaaaa

SEQ ID NO: 3223740 - DNA, 15 bp, Homo sapiens
tagtcctttctgcct

SEQ ID NO: 3223741 - DNA, 23 bp, Homo sapiens
tagtcctttctgccttggcctcg

SEQ ID NO: 3223742 - DNA, 13 bp, Homo sapiens
tagtctaagacta

SEQ ID NO: 3223743 - DNA, 17 bp, Homo sapiens
tagtctcctttgcactg

SEQ ID NO: 3223744 - DNA, 22 bp, Homo sapiens
tagtctcctttgcactgagggc

SEQ ID NO: 3223745 - DNA, 18 bp, Homo sapiens
tagtctgtgtgaaggtga

SEQ ID NO: 3223746 - DNA, 23 bp, Homo sapiens
tagtctgtgtgggactgtacaca

SEQ ID NO: 3223747 - DNA, 19 bp, Homo sapiens
tagtcttccagtttaatga

SEQ ID NO: 3223748 - DNA, 11 bp, Homo sapiens
tagtcttggaa

SEQ ID NO: 3223749 - DNA, 21 bp, Homo sapiens
tagtcttttgcttttggcaaa

SEQ ID NO: 3223750 - DNA, 19 bp, Homo sapiens
tagtgaaaaactgctgtaa

SEQ ID NO: 3223751 - DNA, 16 bp, Homo sapiens
tagtgaagatggtttc

SEQ ID NO: 3223752 - DNA, 18 bp, Homo sapiens
tagtgaatttctgaaaga

SEQ ID NO: 3223753 - DNA, 17 bp, Homo sapiens
tagtgacaagtgaagaa

SEQ ID NO: 3223754 - DNA, 18 bp, Homo sapiens
tagtgagcagtgagcaga

SEQ ID NO: 3223755 - DNA, 23 bp, Homo sapiens
tagtgagccactcagtctcttcc

SEQ ID NO: 3223756 - DNA, 18 bp, Homo sapiens
tagtgatcatttaaaaag

SEQ ID NO: 3223757 - DNA, 18 bp, Homo sapiens
tagtgattctgatttcag

SEQ ID NO: 3223758 - DNA, 17 bp, Homo sapiens
tagtgccctccacagcc

SEQ ID NO: 3223759 - DNA, 23 bp, Homo sapiens
tagtgcctaaaattgtatgaaaa

SEQ ID NO: 3223760 - DNA, 19 bp, Homo sapiens
tagtgcggacaagttttaa

SEQ ID NO: 3223761 - DNA, 21 bp, Homo sapiens
tagtgctatatatataaatat

SEQ ID NO: 3223762 - DNA, 21 bp, Homo sapiens
tagtgcttaaaaatcattgat

SEQ ID NO: 3223763 - DNA, 19 bp, Homo sapiens
tagtggaagagcagcctga

SEQ ID NO: 3223764 - DNA, 21 bp, Homo sapiens
tagtggaagagcagcctgatg

SEQ ID NO: 3223765 - DNA, 14 bp, Homo sapiens
tagtggatgactgt

SEQ ID NO: 3223766 - DNA, 15 bp, Homo sapiens
tagtggcaataagtt

SEQ ID NO: 3223767 - DNA, 17 bp, Homo sapiens
tagtggggcctgggagg

SEQ ID NO: 3223768 - DNA, 15 bp, Homo sapiens
tagtggtatgtctct

SEQ ID NO: 3223769 - DNA, 13 bp, Homo sapiens
tagtggtctttgt

SEQ ID NO: 3223770 - DNA, 15 bp, Homo sapiens
tagtggtctttgtaa

SEQ ID NO: 3223771 - DNA, 16 bp, Homo sapiens
tagtggtctttgtaag

SEQ ID NO: 3223772 - DNA, 19 bp, Homo sapiens
tagtggtctttgtaagagt

SEQ ID NO: 3223773 - DNA, 11 bp, Homo sapiens
tagtgtaaaat

SEQ ID NO: 3223774 - DNA, 19 bp, Homo sapiens
tagtgtaaaataagaatga

SEQ ID NO: 3223775 - DNA, 21 bp, Homo sapiens
tagtgtacctcctctcagtgt

SEQ ID NO: 3223776 - DNA, 14 bp, Homo sapiens
tcacaggatgccag

SEQ ID NO: 3223777 - DNA, 19 bp, Homo sapiens
tcacaggatgccagcccct

SEQ ID NO: 3223778 - DNA, 23 bp, Homo sapiens
tcacaggatgccagcccctgcct

SEQ ID NO: 3223779 - DNA, 11 bp, Homo sapiens
tcacaggcagg

SEQ ID NO: 3223780 - DNA, 17 bp, Homo sapiens
tcacaggcaggtccagg

SEQ ID NO: 3223781 - DNA, 14 bp, Homo sapiens
tcacaggcccagaa

SEQ ID NO: 3223782 - DNA, 15 bp, Homo sapiens
tcacaggcccagaag

SEQ ID NO: 3223783 - DNA, 19 bp, Homo sapiens
tcacaggccccaggaaagg

SEQ ID NO: 3223784 - DNA, 12 bp, Homo sapiens
tcacaggcctct

SEQ ID NO: 3223785 - DNA, 14 bp, Homo sapiens
tcacagggccaact

SEQ ID NO: 3223786 - DNA, 15 bp, Homo sapiens
tcacaggggcggggc

SEQ ID NO: 3223787 - DNA, 17 bp, Homo sapiens
tcacaggggcggggcag

SEQ ID NO: 3223788 - DNA, 19 bp, Homo sapiens
tcacaggggcggggcagga

SEQ ID NO: 3223789 - DNA, 17 bp, Homo sapiens
tcacagggttgggccca

SEQ ID NO: 3223790 - DNA, 23 bp, Homo sapiens
tcacagggttgggcccagatctg

SEQ ID NO: 3223791 - DNA, 20 bp, Homo sapiens
tcacaggttggaagagaatc

SEQ ID NO: 3223792 - DNA, 21 bp, Homo sapiens
tcacagtaaaaataaaatact

SEQ ID NO: 3223793 - DNA, 18 bp, Homo sapiens
tcacagtgacccttccca

SEQ ID NO: 3223794 - DNA, 22 bp, Homo sapiens
tcacagttggctggatgaaatt

SEQ ID NO: 3223795 - DNA, 15 bp, Homo sapiens
tcacatagatgtccc

SEQ ID NO: 3223796 - DNA, 17 bp, Homo sapiens
tcacatagctacccaaa

SEQ ID NO: 3223797 - DNA, 16 bp, Homo sapiens
tcacatagtttttcct

SEQ ID NO: 3223798 - DNA, 15 bp, Homo sapiens
tcacatatctgtcat

SEQ ID NO: 3223799 - DNA, 16 bp, Homo sapiens
tcacatcagataagac

SEQ ID NO: 3223800 - DNA, 21 bp, Homo sapiens
tcacatcgcttctgtgtatct

SEQ ID NO: 3223801 - DNA, 20 bp, Homo sapiens
tcacatgacctgatcactag

SEQ ID NO: 3223802 - DNA, 19 bp, Homo sapiens
tcacatggggcctggccca

SEQ ID NO: 3223803 - DNA, 19 bp, Homo sapiens
tcacatgtggcaaaatatg

SEQ ID NO: 3223804 - DNA, 14 bp, Homo sapiens
tcacatgttctaat

SEQ ID NO: 3223805 - DNA, 22 bp, Homo sapiens
tcacattaaaaaatgaaatatt

SEQ ID NO: 3223806 - DNA, 19 bp, Homo sapiens
tcacattaatggtctaaaa

SEQ ID NO: 3223807 - DNA, 13 bp, Homo sapiens
tcacattagaatt

SEQ ID NO: 3223808 - DNA, 19 bp, Homo sapiens
tcacattatttattaaaaa

SEQ ID NO: 3223809 - DNA, 20 bp, Homo sapiens
tcacattatttattaaaaat

SEQ ID NO: 3223810 - DNA, 15 bp, Homo sapiens
tcacattatttgcat

SEQ ID NO: 3223811 - DNA, 14 bp, Homo sapiens
tcacattcttggct

SEQ ID NO: 3223812 - DNA, 20 bp, Homo sapiens
tcacattgagctgatataaa

SEQ ID NO: 3223813 - DNA, 11 bp, Homo sapiens
tcacattgttt

SEQ ID NO: 3223814 - DNA, 19 bp, Homo sapiens
tcacatttagaaaagtgaa

SEQ ID NO: 3223815 - DNA, 14 bp, Homo sapiens
tcacatttattctg

SEQ ID NO: 3223816 - DNA, 18 bp, Homo sapiens
tcacattttccttttcaa

SEQ ID NO: 3223817 - DNA, 15 bp, Homo sapiens
tcacattttctcagt

SEQ ID NO: 3223818 - DNA, 15 bp, Homo sapiens
tcacatttttttcta

SEQ ID NO: 3223819 - DNA, 23 bp, Homo sapiens
tcaccaaaaccaaacttgttcat

SEQ ID NO: 3223820 - DNA, 15 bp, Homo sapiens
tcaccaacacagttg

SEQ ID NO: 3223821 - DNA, 12 bp, Homo sapiens
tcaccaaggaaa

SEQ ID NO: 3223822 - DNA, 21 bp, Homo sapiens
tcaccacagtttattgatttc

SEQ ID NO: 3223823 - DNA, 20 bp, Homo sapiens
tcaccacgactggccagggc

SEQ ID NO: 3223824 - DNA, 16 bp, Homo sapiens
tcaccacgtggggctc

SEQ ID NO: 3223825 - DNA, 16 bp, Homo sapiens
tcaccactccattccc

SEQ ID NO: 3223826 - DNA, 21 bp, Homo sapiens
tcaccacttcaatagatcaaa

SEQ ID NO: 3223827 - DNA, 22 bp, Homo sapiens
tcaccagccccactgccagcag

SEQ ID NO: 3223828 - DNA, 13 bp, Homo sapiens
tcaccagccccag

SEQ ID NO: 3223829 - DNA, 16 bp, Homo sapiens
tcaccagccccagtgc

SEQ ID NO: 3223830 - DNA, 17 bp, Homo sapiens
tcaccagctatctgtca

SEQ ID NO: 3223831 - DNA, 17 bp, Homo sapiens
tcaccaggacttggggt

SEQ ID NO: 3223832 - DNA, 23 bp, Homo sapiens
tcaccagggtccgcaccagctgc

SEQ ID NO: 3223833 - DNA, 17 bp, Homo sapiens
tcaccagtgtcccctcc

SEQ ID NO: 3223834 - DNA, 21 bp, Homo sapiens
tcaccagtgtcccctccactg

SEQ ID NO: 3223835 - DNA, 18 bp, Homo sapiens
tcaccatgtgagctcttc

SEQ ID NO: 3223836 - DNA, 19 bp, Homo sapiens
tcacccagactggaatgca

SEQ ID NO: 3223837 - DNA, 17 bp, Homo sapiens
tcacccagctaatctgt

SEQ ID NO: 3223838 - DNA, 19 bp, Homo sapiens
tcacccaggctggagtgca

SEQ ID NO: 3223839 - DNA, 23 bp, Homo sapiens
tcaccccaagtagtctgctcaca

SEQ ID NO: 3223840 - DNA, 12 bp, Homo sapiens
tcaccccaccct

SEQ ID NO: 3223841 - DNA, 18 bp, Homo sapiens
tcacccccagctttgcta

SEQ ID NO: 3223842 - DNA, 13 bp, Homo sapiens
tcaccccccactc

SEQ ID NO: 3223843 - DNA, 13 bp, Homo sapiens
tcaccccctcctg

SEQ ID NO: 3223844 - DNA, 14 bp, Homo sapiens
tcaccccctcctgg

SEQ ID NO: 3223845 - DNA, 15 bp, Homo sapiens
tcaccccctcctggc

SEQ ID NO: 3223846 - DNA, 17 bp, Homo sapiens
tcaccccctcctggcaa

SEQ ID NO: 3223847 - DNA, 20 bp, Homo sapiens
tcaccccctttgctgtgagg

SEQ ID NO: 3223848 - DNA, 21 bp, Homo sapiens
tcaccccggcaggccctgcag

SEQ ID NO: 3223849 - DNA, 22 bp, Homo sapiens
tcaccccggcaggccctgcagt

SEQ ID NO: 3223850 - DNA, 20 bp, Homo sapiens
tcacccctcgccacctttca

SEQ ID NO: 3223851 - DNA, 12 bp, Homo sapiens
tcacccctgggc

SEQ ID NO: 3223852 - DNA, 13 bp, Homo sapiens
tcacccctgggca

SEQ ID NO: 3223853 - DNA, 15 bp, Homo sapiens
tcacccctgggcagg

SEQ ID NO: 3223854 - DNA, 16 bp, Homo sapiens
tcacccctgtcctcac

SEQ ID NO: 3223855 - DNA, 20 bp, Homo sapiens
tcacccctgtcctcactgct

SEQ ID NO: 3223856 - DNA, 13 bp, Homo sapiens
tcaccctccacct

SEQ ID NO: 3223857 - DNA, 20 bp, Homo sapiens
tcaccctccacctcttcacc

SEQ ID NO: 3223858 - DNA, 14 bp, Homo sapiens
tcaccctccacttc

SEQ ID NO: 3223859 - DNA, 15 bp, Homo sapiens
tcaccctccacttcc

SEQ ID NO: 3223860 - DNA, 23 bp, Homo sapiens
tcaccctttccggcacactgcca

SEQ ID NO: 3223861 - DNA, 19 bp, Homo sapiens
tcaccgcagtcgtcgcaca

SEQ ID NO: 3223862 - DNA, 13 bp, Homo sapiens
tcaccgcccatca

SEQ ID NO: 3223863 - DNA, 13 bp, Homo sapiens
tcaccgctgggtg

SEQ ID NO: 3223864 - DNA, 23 bp, Homo sapiens
tcaccggagctttcaaagaagga

SEQ ID NO: 3223865 - DNA, 21 bp, Homo sapiens
tcaccgtgctgtcttctggtc

SEQ ID NO: 3223866 - DNA, 18 bp, Homo sapiens
tcaccgtgttagccagga

SEQ ID NO: 3223867 - DNA, 23 bp, Homo sapiens
tcacctactcaatgcctggagac

SEQ ID NO: 3223868 - DNA, 15 bp, Homo sapiens
tcacctactttgtaa

SEQ ID NO: 3223869 - DNA, 15 bp, Homo sapiens
tcacctagaaattga

SEQ ID NO: 3223870 - DNA, 18 bp, Homo sapiens
tcacctagagccagacca

SEQ ID NO: 3223871 - DNA, 20 bp, Homo sapiens
tcacctatttccattcaaca

SEQ ID NO: 3223872 - DNA, 13 bp, Homo sapiens
tcacctcatgccc

SEQ ID NO: 3223873 - DNA, 20 bp, Homo sapiens
tcacctcatgcccaccccct

SEQ ID NO: 3223874 - DNA, 23 bp, Homo sapiens
tcacctcatgcccaccccctgcc

SEQ ID NO: 3223875 - DNA, 13 bp, Homo sapiens
tcacctccctgct

SEQ ID NO: 3223876 - DNA, 20 bp, Homo sapiens
tcacctccctgctcagtgct

SEQ ID NO: 3223877 - DNA, 22 bp, Homo sapiens
tcacctcctctaaggttgggca

SEQ ID NO: 3223878 - DNA, 22 bp, Homo sapiens
tcacctcggagggatggagaaa

SEQ ID NO: 3223879 - DNA, 18 bp, Homo sapiens
tcacctctacccaaaccc

SEQ ID NO: 3223880 - DNA, 15 bp, Homo sapiens
tcacctctagcctta

SEQ ID NO: 3223881 - DNA, 14 bp, Homo sapiens
tcacctctgttaag

SEQ ID NO: 3223882 - DNA, 23 bp, Homo sapiens
tcacctcttatgcacacctccca

SEQ ID NO: 3223883 - DNA, 23 bp, Homo sapiens
tcacctgaagactcattcttctg

SEQ ID NO: 3223884 - DNA, 15 bp, Homo sapiens
tcacctgatcatata

SEQ ID NO: 3223885 - DNA, 21 bp, Homo sapiens
tcacctgcaagccccagggcc

SEQ ID NO: 3223886 - DNA, 22 bp, Homo sapiens
tcacctgcaagccccagggcct

SEQ ID NO: 3223887 - DNA, 13 bp, Homo sapiens
tcacctgcactaa

SEQ ID NO: 3223888 - DNA, 23 bp, Homo sapiens
tcaccttagggtggctttaattg

SEQ ID NO: 3223889 - DNA, 21 bp, Homo sapiens
tcaccttccaggacccctggg

SEQ ID NO: 3223890 - DNA, 20 bp, Homo sapiens
tcaccttctagtcttggcca

SEQ ID NO: 3223891 - DNA, 12 bp, Homo sapiens
tcaccttctttg

SEQ ID NO: 3223892 - DNA, 14 bp, Homo sapiens
tcaccttctttgta

SEQ ID NO: 3223893 - DNA, 13 bp, Homo sapiens
tcaatactacctc

SEQ ID NO: 3223894 - DNA, 14 bp, Homo sapiens
tcaatactacctct

SEQ ID NO: 3223895 - DNA, 17 bp, Homo sapiens
tcaatactacctctgaa

SEQ ID NO: 3223896 - DNA, 20 bp, Homo sapiens
tcaatactgtatgccttctg

SEQ ID NO: 3223897 - DNA, 23 bp, Homo sapiens
tcaatactgtatgccttctgtat

SEQ ID NO: 3223898 - DNA, 22 bp, Homo sapiens
tcaatactgtcccacttctcat

SEQ ID NO: 3223899 - DNA, 16 bp, Homo sapiens
tcaatagatctccagc

SEQ ID NO: 3223900 - DNA, 15 bp, Homo sapiens
tcaatatctaatata

SEQ ID NO: 3223901 - DNA, 21 bp, Homo sapiens
tcaatatctaatatatatgaa

SEQ ID NO: 3223902 - DNA, 12 bp, Homo sapiens
tcaatatgcaag

SEQ ID NO: 3223903 - DNA, 17 bp, Homo sapiens
tcaatatgcaagcagct

SEQ ID NO: 3223904 - DNA, 20 bp, Homo sapiens
tcaatatgcaagcagctttt

SEQ ID NO: 3223905 - DNA, 19 bp, Homo sapiens
tcaatattaaatacagaca

SEQ ID NO: 3223906 - DNA, 20 bp, Homo sapiens
tcaatatttattattttcac

SEQ ID NO: 3223907 - DNA, 16 bp, Homo sapiens
tcaatatttttagata

SEQ ID NO: 3223908 - DNA, 14 bp, Homo sapiens
tcaatatttttcta

SEQ ID NO: 3223909 - DNA, 14 bp, Homo sapiens
tcaatcacactaca

SEQ ID NO: 3223910 - DNA, 21 bp, Homo sapiens
tcaatcactgcactgcatgca

SEQ ID NO: 3223911 - DNA, 16 bp, Homo sapiens
tcaatcattgaagtat

SEQ ID NO: 3223912 - DNA, 16 bp, Homo sapiens
tcaatcccaaaagtca

SEQ ID NO: 3223913 - DNA, 15 bp, Homo sapiens
tcaatcccaattctg

SEQ ID NO: 3223914 - DNA, 13 bp, Homo sapiens
tcaatcccagcct

SEQ ID NO: 3223915 - DNA, 21 bp, Homo sapiens
tcaatcctaatttctcctccc

SEQ ID NO: 3223916 - DNA, 15 bp, Homo sapiens
tcaatcctacctgtt

SEQ ID NO: 3223917 - DNA, 14 bp, Homo sapiens
tcaatctctgacta

SEQ ID NO: 3223918 - DNA, 14 bp, Homo sapiens
tcaatctgtaaact

SEQ ID NO: 3223919 - DNA, 16 bp, Homo sapiens
tcaatctgtaaactgt

SEQ ID NO: 3223920 - DNA, 18 bp, Homo sapiens
tcaatctgtgtaagaaaa

SEQ ID NO: 3223921 - DNA, 12 bp, Homo sapiens
tcaatgaaaaat

SEQ ID NO: 3223922 - DNA, 18 bp, Homo sapiens
tcaatgaaaaatgtaatt

SEQ ID NO: 3223923 - DNA, 16 bp, Homo sapiens
tcaatgaaccataaat

SEQ ID NO: 3223924 - DNA, 15 bp, Homo sapiens
tcaatgaagccagct

SEQ ID NO: 3223925 - DNA, 21 bp, Homo sapiens
tcaatgaagccagctcacagt

SEQ ID NO: 3223926 - DNA, 21 bp, Homo sapiens
tcaatgaattttataatctgc

SEQ ID NO: 3223927 - DNA, 18 bp, Homo sapiens
tcaatgcactgacattgt

SEQ ID NO: 3223928 - DNA, 16 bp, Homo sapiens
tcaatgcattgtcttg

SEQ ID NO: 3223929 - DNA, 21 bp, Homo sapiens
tcaatggagtatgtctgatgg

SEQ ID NO: 3223930 - DNA, 14 bp, Homo sapiens
tcaatgggcaatga

SEQ ID NO: 3223931 - DNA, 17 bp, Homo sapiens
tcaatgggcaatgacag

SEQ ID NO: 3223932 - DNA, 15 bp, Homo sapiens
tcaatgtgattctaa

SEQ ID NO: 3223933 - DNA, 16 bp, Homo sapiens
tcaatgtgattctaat

SEQ ID NO: 3223934 - DNA, 16 bp, Homo sapiens
tcaatgtgtataaatt

SEQ ID NO: 3223935 - DNA, 22 bp, Homo sapiens
tcaatgtgtataaattgtcttt

SEQ ID NO: 3223936 - DNA, 22 bp, Homo sapiens
tcaatgtgtcatttccggctgc

SEQ ID NO: 3223937 - DNA, 17 bp, Homo sapiens
tcaatgtgtctttctaa

SEQ ID NO: 3223938 - DNA, 16 bp, Homo sapiens
tcaatgttcattgtaa

SEQ ID NO: 3223939 - DNA, 21 bp, Homo sapiens
tcaattaaagtctattcaaaa

SEQ ID NO: 3223940 - DNA, 13 bp, Homo sapiens
tcaattaaatgta

SEQ ID NO: 3223941 - DNA, 15 bp, Homo sapiens
tcaattcaatttgga

SEQ ID NO: 3223942 - DNA, 16 bp, Homo sapiens
tcaattcccattgcat

SEQ ID NO: 3223943 - DNA, 14 bp, Homo sapiens
tcaattcctctggg

SEQ ID NO: 3223944 - DNA, 15 bp, Homo sapiens
tcaattcctctggga

SEQ ID NO: 3223945 - DNA, 17 bp, Homo sapiens
tcaattcctgggcccca

SEQ ID NO: 3223946 - DNA, 14 bp, Homo sapiens
tcaattgacaaatg

SEQ ID NO: 3223947 - DNA, 16 bp, Homo sapiens
tcaattggcagtgact

SEQ ID NO: 3223948 - DNA, 19 bp, Homo sapiens
tcaattggcagtgactttg

SEQ ID NO: 3223949 - DNA, 14 bp, Homo sapiens
tcaattgtaaattg

SEQ ID NO: 3223950 - DNA, 12 bp, Homo sapiens
tcaatttccctc

SEQ ID NO: 3223951 - DNA, 19 bp, Homo sapiens
tcaatttccctcaggttct

SEQ ID NO: 3223952 - DNA, 23 bp, Homo sapiens
tcaatttctgtgttgccaagctc

SEQ ID NO: 3223953 - DNA, 19 bp, Homo sapiens
tcaatttttgtctcagaag

SEQ ID NO: 3223954 - DNA, 21 bp, Homo sapiens
tcacaaaaatttgaacactgg

SEQ ID NO: 3223955 - DNA, 17 bp, Homo sapiens
tcacaaagtggaacgaa

SEQ ID NO: 3223956 - DNA, 16 bp, Homo sapiens
tcacaaattgatcaag

SEQ ID NO: 3223957 - DNA, 16 bp, Homo sapiens
tcacaacaacctggtc

SEQ ID NO: 3223958 - DNA, 12 bp, Homo sapiens
tcacaacagatc

SEQ ID NO: 3223959 - DNA, 14 bp, Homo sapiens
tcacaaccttctgt

SEQ ID NO: 3223960 - DNA, 16 bp, Homo sapiens
tcacaacttgggttct

SEQ ID NO: 3223961 - DNA, 17 bp, Homo sapiens
tcacaagagcccagcag

SEQ ID NO: 3223962 - DNA, 23 bp, Homo sapiens
tcacaagatggaatttatcaaac

SEQ ID NO: 3223963 - DNA, 16 bp, Homo sapiens
tcacaagcctcctgta

SEQ ID NO: 3223964 - DNA, 22 bp, Homo sapiens
tcacaagcgctcccagcctgcc

SEQ ID NO: 3223965 - DNA, 22 bp, Homo sapiens
tcacaagggcaaactttttcct

SEQ ID NO: 3223966 - DNA, 19 bp, Homo sapiens
tcacaagggctctcaaagt

SEQ ID NO: 3223967 - DNA, 17 bp, Homo sapiens
tcacaaggtataataag

SEQ ID NO: 3223968 - DNA, 13 bp, Homo sapiens
tcacaatacagat

SEQ ID NO: 3223969 - DNA, 15 bp, Homo sapiens
tcacaatacagataa

SEQ ID NO: 3223970 - DNA, 14 bp, Homo sapiens
tcacaatagaaact

SEQ ID NO: 3223971 - DNA, 13 bp, Homo sapiens
tcacaatataaag

SEQ ID NO: 3223972 - DNA, 17 bp, Homo sapiens
tcacaatataaagttct

SEQ ID NO: 3223973 - DNA, 15 bp, Homo sapiens
tcacacaccctgagg

SEQ ID NO: 3223974 - DNA, 21 bp, Homo sapiens
tcacacagtattacttctgct

SEQ ID NO: 3223975 - DNA, 22 bp, Homo sapiens
tcacacagtattacttctgcta

SEQ ID NO: 3223976 - DNA, 23 bp, Homo sapiens
tcacacagtgagtcgaggacagg

SEQ ID NO: 3223977 - DNA, 22 bp, Homo sapiens
tcacacatccagacatcatgaa

SEQ ID NO: 3223978 - DNA, 11 bp, Homo sapiens
tcacacattca

SEQ ID NO: 3223979 - DNA, 16 bp, Homo sapiens
tcacaccaaggaagct

SEQ ID NO: 3223980 - DNA, 11 bp, Homo sapiens
tcacacccacc

SEQ ID NO: 3223981 - DNA, 13 bp, Homo sapiens
tcacaccccaggc

SEQ ID NO: 3223982 - DNA, 20 bp, Homo sapiens
tcacaccccaggcccttcag

SEQ ID NO: 3223983 - DNA, 15 bp, Homo sapiens
tcacaccctgcaagg

SEQ ID NO: 3223984 - DNA, 17 bp, Homo sapiens
tcacaccctgcaaggcc

SEQ ID NO: 3223985 - DNA, 20 bp, Homo sapiens
tcacacctgactctgaaatc

SEQ ID NO: 3223986 - DNA, 18 bp, Homo sapiens
tcacacctgcaatcccag

SEQ ID NO: 3223987 - DNA, 18 bp, Homo sapiens
tcacactaaaatttaatt

SEQ ID NO: 3223988 - DNA, 14 bp, Homo sapiens
tcacactcagaaag

SEQ ID NO: 3223989 - DNA, 23 bp, Homo sapiens
tcacactcttcagtgactcctgc

SEQ ID NO: 3223990 - DNA, 22 bp, Homo sapiens
tcacacttctgtgagaccccca

SEQ ID NO: 3223991 - DNA, 24 bp, Homo sapiens
tcacacttgtaatcccagcaattt

SEQ ID NO: 3223992 - DNA, 14 bp, Homo sapiens
tcacagaaaaagca

SEQ ID NO: 3223993 - DNA, 19 bp, Homo sapiens
tcacagaaaaagcatgatg

SEQ ID NO: 3223994 - DNA, 23 bp, Homo sapiens
tcacagaaaaagcatgatgggaa

SEQ ID NO: 3223995 - DNA, 16 bp, Homo sapiens
tcacagaaatcagagg

SEQ ID NO: 3223996 - DNA, 14 bp, Homo sapiens
tcacagacctggag

SEQ ID NO: 3223997 - DNA, 21 bp, Homo sapiens
tcacagagacattcctccgag

SEQ ID NO: 3223998 - DNA, 15 bp, Homo sapiens
tcacagagcagagtc

SEQ ID NO: 3223999 - DNA, 16 bp, Homo sapiens
tcacagcaatatttaa

SEQ ID NO: 3224000 - DNA, 20 bp, Homo sapiens
tcacagcacatgctggccag

SEQ ID NO: 3224001 - DNA, 17 bp, Homo sapiens
tcacagcagcctccaac

SEQ ID NO: 3224002 - DNA, 17 bp, Homo sapiens
tcacagcatggaggagg

SEQ ID NO: 3224003 - DNA, 21 bp, Homo sapiens
tcacagcatggaggaggaggg

SEQ ID NO: 3224004 - DNA, 13 bp, Homo sapiens
tatttttaaaata

SEQ ID NO: 3224005 - DNA, 15 bp, Homo sapiens
tatttttaaaatatt

SEQ ID NO: 3224006 - DNA, 19 bp, Homo sapiens
tatttttagactcatcaat

SEQ ID NO: 3224007 - DNA, 17 bp, Homo sapiens
tatttttatacaaacct

SEQ ID NO: 3224008 - DNA, 12 bp, Homo sapiens
tatttttatcca

SEQ ID NO: 3224009 - DNA, 15 bp, Homo sapiens
tatttttcaaggaag

SEQ ID NO: 3224010 - DNA, 18 bp, Homo sapiens
tatttttcaataaagcat

SEQ ID NO: 3224011 - DNA, 13 bp, Homo sapiens
tatttttcagaga

SEQ ID NO: 3224012 - DNA, 21 bp, Homo sapiens
tatttttcagagatttatata

SEQ ID NO: 3224013 - DNA, 17 bp, Homo sapiens
tatttttcagttccaag

SEQ ID NO: 3224014 - DNA, 11 bp, Homo sapiens
tatttttgccg

SEQ ID NO: 3224015 - DNA, 20 bp, Homo sapiens
tatttttggcagtctgaatt

SEQ ID NO: 3224016 - DNA, 19 bp, Homo sapiens
tatttttggggcatcctgg

SEQ ID NO: 3224017 - DNA, 20 bp, Homo sapiens
tatttttggggcatcctgga

SEQ ID NO: 3224018 - DNA, 13 bp, Homo sapiens
tatttttgtaaac

SEQ ID NO: 3224019 - DNA, 16 bp, Homo sapiens
tatttttgtaatgtga

SEQ ID NO: 3224020 - DNA, 23 bp, Homo sapiens
tatttttgtaatgtgaaaagtat

SEQ ID NO: 3224021 - DNA, 14 bp, Homo sapiens
tatttttgtagtga

SEQ ID NO: 3224022 - DNA, 23 bp, Homo sapiens
tatttttgtagtgacctgtttat

SEQ ID NO: 3224023 - DNA, 16 bp, Homo sapiens
tatttttgtgtttgaa

SEQ ID NO: 3224024 - DNA, 21 bp, Homo sapiens
tatttttgtgttttcttgtaa

SEQ ID NO: 3224025 - DNA, 20 bp, Homo sapiens
tatttttgtttcttccaaag

SEQ ID NO: 3224026 - DNA, 17 bp, Homo sapiens
tattttttaaaacacta

SEQ ID NO: 3224027 - DNA, 14 bp, Homo sapiens
tattttttaaaata

SEQ ID NO: 3224028 - DNA, 15 bp, Homo sapiens
tattttttaagtatt

SEQ ID NO: 3224029 - DNA, 12 bp, Homo sapiens
tattttttaatt

SEQ ID NO: 3224030 - DNA, 16 bp, Homo sapiens
tattttttaatttgat

SEQ ID NO: 3224031 - DNA, 13 bp, Homo sapiens
tattttttattgt

SEQ ID NO: 3224032 - DNA, 11 bp, Homo sapiens
tattttttcct

SEQ ID NO: 3224033 - DNA, 14 bp, Homo sapiens
tattttttcctttt

SEQ ID NO: 3224034 - DNA, 15 bp, Homo sapiens
tattttttcttttgt

SEQ ID NO: 3224035 - DNA, 23 bp, Homo sapiens
tcaaatgttctaagtttctaaga

SEQ ID NO: 3224036 - DNA, 12 bp, Homo sapiens
tcaaattaataa

SEQ ID NO: 3224037 - DNA, 23 bp, Homo sapiens
tcaaattaatctttctttacctg

SEQ ID NO: 3224038 - DNA, 19 bp, Homo sapiens
tcaaattcaaggccttcca

SEQ ID NO: 3224039 - DNA, 15 bp, Homo sapiens
tcaaattcaatgatt

SEQ ID NO: 3224040 - DNA, 17 bp, Homo sapiens
tcaaattcaatgattct

SEQ ID NO: 3224041 - DNA, 20 bp, Homo sapiens
tcaaattcatttttttcact

SEQ ID NO: 3224042 - DNA, 14 bp, Homo sapiens
tcaaattgtatcta

SEQ ID NO: 3224043 - DNA, 14 bp, Homo sapiens
tcaaatttacattt

SEQ ID NO: 3224044 - DNA, 12 bp, Homo sapiens
tcaaatttcaca

SEQ ID NO: 3224045 - DNA, 12 bp, Homo sapiens
tcaaatttgtac

SEQ ID NO: 3224046 - DNA, 13 bp, Homo sapiens
tcaaatttgtaca

SEQ ID NO: 3224047 - DNA, 22 bp, Homo sapiens
tcaaatttgtacaggactgtaa

SEQ ID NO: 3224048 - DNA, 14 bp, Homo sapiens
tcaacaaagaaaca

SEQ ID NO: 3224049 - DNA, 22 bp, Homo sapiens
tcaacaaatattcactggcccc

SEQ ID NO: 3224050 - DNA, 22 bp, Homo sapiens
tcaacaagatttccttgtgcaa

SEQ ID NO: 3224051 - DNA, 22 bp, Homo sapiens
tcaacaagggagagacctcatc

SEQ ID NO: 3224052 - DNA, 21 bp, Homo sapiens
tcaacagaagcatttgtattt

SEQ ID NO: 3224053 - DNA, 18 bp, Homo sapiens
tcaacagccaagtgtgac

SEQ ID NO: 3224054 - DNA, 16 bp, Homo sapiens
tcaacagctatgctgg

SEQ ID NO: 3224055 - DNA, 14 bp, Homo sapiens
tcaacaggcccagg

SEQ ID NO: 3224056 - DNA, 16 bp, Homo sapiens
tcaacaggcccaggga

SEQ ID NO: 3224057 - DNA, 20 bp, Homo sapiens
tcaacaggcccagggaggga

SEQ ID NO: 3224058 - DNA, 21 bp, Homo sapiens
tcaacaggtcacttgatcatg

SEQ ID NO: 3224059 - DNA, 16 bp, Homo sapiens
tcaacatcaatgttca

SEQ ID NO: 3224060 - DNA, 20 bp, Homo sapiens
tcaacatcaatgttcattgt

SEQ ID NO: 3224061 - DNA, 21 bp, Homo sapiens
tcaacatcaatgttcattgta

SEQ ID NO: 3224062 - DNA, 14 bp, Homo sapiens
tcaacatcctgcca

SEQ ID NO: 3224063 - DNA, 17 bp, Homo sapiens
tcaacatcctgccagcc

SEQ ID NO: 3224064 - DNA, 22 bp, Homo sapiens
tcaacatgttactgaccagcaa

SEQ ID NO: 3224065 - DNA, 22 bp, Homo sapiens
tcaaccactaaagtatagagaa

SEQ ID NO: 3224066 - DNA, 19 bp, Homo sapiens
tcaacccctcccctccatc

SEQ ID NO: 3224067 - DNA, 21 bp, Homo sapiens
tcaacccctcccctccatccc

SEQ ID NO: 3224068 - DNA, 18 bp, Homo sapiens
tcaaccccttcgctcctg

SEQ ID NO: 3224069 - DNA, 23 bp, Homo sapiens
tcaaccccttcgctcctgtgtct

SEQ ID NO: 3224070 - DNA, 15 bp, Homo sapiens
tcaaccctctcctgt

SEQ ID NO: 3224071 - DNA, 15 bp, Homo sapiens
tcaacctcctgggct

SEQ ID NO: 3224072 - DNA, 19 bp, Homo sapiens
tcaacctggtggcaccaga

SEQ ID NO: 3224073 - DNA, 23 bp, Homo sapiens
tcaaccttaagacctactgttct

SEQ ID NO: 3224074 - DNA, 21 bp, Homo sapiens
tcaacggaaagtgctgtctta

SEQ ID NO: 3224075 - DNA, 19 bp, Homo sapiens
tcaactacggttgggagaa

SEQ ID NO: 3224076 - DNA, 13 bp, Homo sapiens
tcaactattctgt

SEQ ID NO: 3224077 - DNA, 17 bp, Homo sapiens
tcaactctacccctgct

SEQ ID NO: 3224078 - DNA, 14 bp, Homo sapiens
tcaactctttgtta

SEQ ID NO: 3224079 - DNA, 14 bp, Homo sapiens
tcaactgcctactc

SEQ ID NO: 3224080 - DNA, 14 bp, Homo sapiens
tcaactgctgtaaa

SEQ ID NO: 3224081 - DNA, 19 bp, Homo sapiens
tcaactggttgtatatttt

SEQ ID NO: 3224082 - DNA, 22 bp, Homo sapiens
tcaactgtattgggccttttgg

SEQ ID NO: 3224083 - DNA, 18 bp, Homo sapiens
tcaacttcagtactcaaa

SEQ ID NO: 3224084 - DNA, 20 bp, Homo sapiens
tcaactttactgtaatataa

SEQ ID NO: 3224085 - DNA, 12 bp, Homo sapiens
tcaactttcaga

SEQ ID NO: 3224086 - DNA, 16 bp, Homo sapiens
tcaactttgtaaaaat

SEQ ID NO: 3224087 - DNA, 13 bp, Homo sapiens
tcaacttttctaa

SEQ ID NO: 3224088 - DNA, 18 bp, Homo sapiens
tcaagaaaaaataaatgg

SEQ ID NO: 3224089 - DNA, 21 bp, Homo sapiens
tcaagaaaatctttgttgaag

SEQ ID NO: 3224090 - DNA, 12 bp, Homo sapiens
tcaagaaacagc

SEQ ID NO: 3224091 - DNA, 15 bp, Homo sapiens
tcaagaaacagccag

SEQ ID NO: 3224092 - DNA, 16 bp, Homo sapiens
tcaagaaacagccagc

SEQ ID NO: 3224093 - DNA, 17 bp, Homo sapiens
tcaagaaacagccagca

SEQ ID NO: 3224094 - DNA, 17 bp, Homo sapiens
tcaagaaactgaggaat

SEQ ID NO: 3224095 - DNA, 18 bp, Homo sapiens
tcaagaaactgaggaatt

SEQ ID NO: 3224096 - DNA, 22 bp, Homo sapiens
tcaagaaactgaggaattttct

SEQ ID NO: 3224097 - DNA, 23 bp, Homo sapiens
tcaagaaactgaggaattttctt

SEQ ID NO: 3224098 - DNA, 15 bp, Homo sapiens
tcaagaaattttcaa

SEQ ID NO: 3224099 - DNA, 11 bp, Homo sapiens
tcaagaagaat

SEQ ID NO: 3224100 - DNA, 22 bp, Homo sapiens
tcaagaatggggatcacagaga

SEQ ID NO: 3224101 - DNA, 13 bp, Homo sapiens
tcaagacatttct

SEQ ID NO: 3224102 - DNA, 20 bp, Homo sapiens
tcaagaccagcctgggcaac

SEQ ID NO: 3224103 - DNA, 16 bp, Homo sapiens
tcaagacgaggggcag

SEQ ID NO: 3224104 - DNA, 21 bp, Homo sapiens
tcaagagggcactggtggccc

SEQ ID NO: 3224105 - DNA, 17 bp, Homo sapiens
tcaagagggtctgagga

SEQ ID NO: 3224106 - DNA, 19 bp, Homo sapiens
tcaagaggtgggagggccc

SEQ ID NO: 3224107 - DNA, 17 bp, Homo sapiens
tcaagatgtcagactgg

SEQ ID NO: 3224108 - DNA, 22 bp, Homo sapiens
tcaagattttagggcttttatt

SEQ ID NO: 3224109 - DNA, 13 bp, Homo sapiens
tcaagattttgaa

SEQ ID NO: 3224110 - DNA, 16 bp, Homo sapiens
tcaagattttgaatgc

SEQ ID NO: 3224111 - DNA, 16 bp, Homo sapiens
tcaagcaataattgtt

SEQ ID NO: 3224112 - DNA, 17 bp, Homo sapiens
tcaagcaataattgttt

SEQ ID NO: 3224113 - DNA, 13 bp, Homo sapiens
tcaagcacatgta

SEQ ID NO: 3224114 - DNA, 12 bp, Homo sapiens
tcaagcactgat

SEQ ID NO: 3224115 - DNA, 23 bp, Homo sapiens
tcaagcagcgaccgccccctcct

SEQ ID NO: 3224116 - DNA, 16 bp, Homo sapiens
tcaagccagctctagg

SEQ ID NO: 3224117 - DNA, 17 bp, Homo sapiens
tcaagccagctctaggc

SEQ ID NO: 3224118 - DNA, 16 bp, Homo sapiens
tcaagccctgaggggc

SEQ ID NO: 3224119 - DNA, 13 bp, Homo sapiens
tcaagcctgtggg

SEQ ID NO: 3224120 - DNA, 20 bp, Homo sapiens
tcaagcctgtgggagtagaa

SEQ ID NO: 3224121 - DNA, 16 bp, Homo sapiens
tcaagcgattcttctg

SEQ ID NO: 3224122 - DNA, 21 bp, Homo sapiens
tcaagcgccagaaagagctgt

SEQ ID NO: 3224123 - DNA, 21 bp, Homo sapiens
tcaaggaatttcttaacttct

SEQ ID NO: 3224124 - DNA, 19 bp, Homo sapiens
tcaaggatatactgcagct

SEQ ID NO: 3224125 - DNA, 19 bp, Homo sapiens
tcaaggcagttgcttgtgt

SEQ ID NO: 3224126 - DNA, 18 bp, Homo sapiens
tcaaggctaattggaaaa

SEQ ID NO: 3224127 - DNA, 22 bp, Homo sapiens
tcaaggctaattggaaaagagt

SEQ ID NO: 3224128 - DNA, 14 bp, Homo sapiens
tcaaggcttccact

SEQ ID NO: 3224129 - DNA, 17 bp, Homo sapiens
tcaagggagaatataga

SEQ ID NO: 3224130 - DNA, 14 bp, Homo sapiens
tcaagggctgtagg

SEQ ID NO: 3224131 - DNA, 16 bp, Homo sapiens
tcaagggggactgtct

SEQ ID NO: 3224132 - DNA, 13 bp, Homo sapiens
tcaaggttttagg

SEQ ID NO: 3224133 - DNA, 15 bp, Homo sapiens
tcaagtaattgtgaa

SEQ ID NO: 3224134 - DNA, 16 bp, Homo sapiens
tcaagtaattgtgaaa

SEQ ID NO: 3224135 - DNA, 18 bp, Homo sapiens
tcaagtattgagaacctg

SEQ ID NO: 3224136 - DNA, 22 bp, Homo sapiens
tcaagtgattctcctgcctcag

SEQ ID NO: 3224137 - DNA, 16 bp, Homo sapiens
tcaagtggggctcgcc

SEQ ID NO: 3224138 - DNA, 16 bp, Homo sapiens
tcaagttaacaaggaa

SEQ ID NO: 3224139 - DNA, 17 bp, Homo sapiens
tcaagttattgtacagc

SEQ ID NO: 3224140 - DNA, 14 bp, Homo sapiens
tcaagttctaagat

SEQ ID NO: 3224141 - DNA, 20 bp, Homo sapiens
tatttgaaaacatgtttatt

SEQ ID NO: 3224142 - DNA, 20 bp, Homo sapiens
tatttgaaatactaaaagca

SEQ ID NO: 3224143 - DNA, 21 bp, Homo sapiens
tatttgaaatactaaaagcaa

SEQ ID NO: 3224144 - DNA, 17 bp, Homo sapiens
tatttgaagaaaaaaat

SEQ ID NO: 3224145 - DNA, 20 bp, Homo sapiens
tatttgaagaaaaaaatgta

SEQ ID NO: 3224146 - DNA, 19 bp, Homo sapiens
tatttgaagcgagtcattt

SEQ ID NO: 3224147 - DNA, 19 bp, Homo sapiens
tatttgaaggttttaagtg

SEQ ID NO: 3224148 - DNA, 19 bp, Homo sapiens
tatttgaatgaaaacattt

SEQ ID NO: 3224149 - DNA, 13 bp, Homo sapiens
tatttgaatgact

SEQ ID NO: 3224150 - DNA, 17 bp, Homo sapiens
tatttgaattatttctg

SEQ ID NO: 3224151 - DNA, 12 bp, Homo sapiens
tatttgaatttt

SEQ ID NO: 3224152 - DNA, 22 bp, Homo sapiens
tatttgacttgcatgaagagaa

SEQ ID NO: 3224153 - DNA, 16 bp, Homo sapiens
tatttgagagttctaa

SEQ ID NO: 3224154 - DNA, 18 bp, Homo sapiens
tatttgagagttctaaat

SEQ ID NO: 3224155 - DNA, 17 bp, Homo sapiens
tatttgcaacatttaca

SEQ ID NO: 3224156 - DNA, 20 bp, Homo sapiens
tatttgcactatttccacat

SEQ ID NO: 3224157 - DNA, 13 bp, Homo sapiens
tatttgcacttat

SEQ ID NO: 3224158 - DNA, 14 bp, Homo sapiens
tatttgcattgagg

SEQ ID NO: 3224159 - DNA, 16 bp, Homo sapiens
tatttgccatgggctt

SEQ ID NO: 3224160 - DNA, 15 bp, Homo sapiens
tatttgcttcattgt

SEQ ID NO: 3224161 - DNA, 17 bp, Homo sapiens
tatttggaaataaagtc

SEQ ID NO: 3224162 - DNA, 19 bp, Homo sapiens
tatttggaaataaagtcag

SEQ ID NO: 3224163 - DNA, 18 bp, Homo sapiens
tatttggaatatttgaat

SEQ ID NO: 3224164 - DNA, 19 bp, Homo sapiens
tatttggaatatttgaata

SEQ ID NO: 3224165 - DNA, 13 bp, Homo sapiens
tatttggtttcta

SEQ ID NO: 3224166 - DNA, 15 bp, Homo sapiens
tatttgtaaaccatt

SEQ ID NO: 3224167 - DNA, 11 bp, Homo sapiens
tatttgtatta

SEQ ID NO: 3224168 - DNA, 21 bp, Homo sapiens
tatttgtattaataaagcatt

SEQ ID NO: 3224169 - DNA, 15 bp, Homo sapiens
tatttgtctttcagg

SEQ ID NO: 3224170 - DNA, 18 bp, Homo sapiens
tatttgtgatagcacttt

SEQ ID NO: 3224171 - DNA, 12 bp, Homo sapiens
tatttgtggaat

SEQ ID NO: 3224172 - DNA, 18 bp, Homo sapiens
tatttgtggcccgtgcag

SEQ ID NO: 3224173 - DNA, 14 bp, Homo sapiens
tatttgtgtaatag

SEQ ID NO: 3224174 - DNA, 22 bp, Homo sapiens
tatttgtgtattttcctggatt

SEQ ID NO: 3224175 - DNA, 13 bp, Homo sapiens
tatttgtttccct

SEQ ID NO: 3224176 - DNA, 12 bp, Homo sapiens
tattttaaaagc

SEQ ID NO: 3224177 - DNA, 23 bp, Homo sapiens
tattttaaaagccacatagagtg

SEQ ID NO: 3224178 - DNA, 14 bp, Homo sapiens
tattttaaaatatt

SEQ ID NO: 3224179 - DNA, 15 bp, Homo sapiens
tattttaaaatattt

SEQ ID NO: 3224180 - DNA, 12 bp, Homo sapiens
tattttaaacaa

SEQ ID NO: 3224181 - DNA, 16 bp, Homo sapiens
tattttaaatataaat

SEQ ID NO: 3224182 - DNA, 23 bp, Homo sapiens
tattttaaatataaatagctaat

SEQ ID NO: 3224183 - DNA, 23 bp, Homo sapiens
tattttaatcctgtaccaaatct

SEQ ID NO: 3224184 - DNA, 14 bp, Homo sapiens
tattttaatgtgat

SEQ ID NO: 3224185 - DNA, 19 bp, Homo sapiens
tattttaatttatgagttt

SEQ ID NO: 3224186 - DNA, 12 bp, Homo sapiens
tattttactatt

SEQ ID NO: 3224187 - DNA, 14 bp, Homo sapiens
tattttactttgta

SEQ ID NO: 3224188 - DNA, 14 bp, Homo sapiens
tattttaggcactg

SEQ ID NO: 3224189 - DNA, 13 bp, Homo sapiens
tattttatataaa

SEQ ID NO: 3224190 - DNA, 23 bp, Homo sapiens
tattttatatttaaaaattgttt

SEQ ID NO: 3224191 - DNA, 20 bp, Homo sapiens
tattttattatcctagatta

SEQ ID NO: 3224192 - DNA, 13 bp, Homo sapiens
tattttattatga

SEQ ID NO: 3224193 - DNA, 20 bp, Homo sapiens
tattttatttagacaagaga

SEQ ID NO: 3224194 - DNA, 20 bp, Homo sapiens
tattttatttccatcatgtc

SEQ ID NO: 3224195 - DNA, 15 bp, Homo sapiens
tattttcaaagagat

SEQ ID NO: 3224196 - DNA, 21 bp, Homo sapiens
tattttcaacgcagccctgct

SEQ ID NO: 3224197 - DNA, 13 bp, Homo sapiens
tattttcaagaaa

SEQ ID NO: 3224198 - DNA, 14 bp, Homo sapiens
tattttcacaatgt

SEQ ID NO: 3224199 - DNA, 23 bp, Homo sapiens
tattttcagaatctgaatgtaat

SEQ ID NO: 3224200 - DNA, 21 bp, Homo sapiens
tattttcagtcaaaactttaa

SEQ ID NO: 3224201 - DNA, 19 bp, Homo sapiens
tattttcagtgcatcatta

SEQ ID NO: 3224202 - DNA, 19 bp, Homo sapiens
tattttcatgtattttaca

SEQ ID NO: 3224203 - DNA, 14 bp, Homo sapiens
tattttcatttgta

SEQ ID NO: 3224204 - DNA, 18 bp, Homo sapiens
tattttcatttgtacaag

SEQ ID NO: 3224205 - DNA, 23 bp, Homo sapiens
tattttcccaatagcactttcat

SEQ ID NO: 3224206 - DNA, 12 bp, Homo sapiens
tattttcctaaa

SEQ ID NO: 3224207 - DNA, 18 bp, Homo sapiens
tattttcctggatttata

SEQ ID NO: 3224208 - DNA, 14 bp, Homo sapiens
tattttctacagtg

SEQ ID NO: 3224209 - DNA, 15 bp, Homo sapiens
tattttctacagtgg

SEQ ID NO: 3224210 - DNA, 22 bp, Homo sapiens
tattttctgtcagatgagaaca

SEQ ID NO: 3224211 - DNA, 14 bp, Homo sapiens
tattttctgttcta

SEQ ID NO: 3224212 - DNA, 12 bp, Homo sapiens
tattttcttcat

SEQ ID NO: 3224213 - DNA, 19 bp, Homo sapiens
tattttcttcatccaactt

SEQ ID NO: 3224214 - DNA, 14 bp, Homo sapiens
tattttctttgaaa

SEQ ID NO: 3224215 - DNA, 14 bp, Homo sapiens
tattttgaagaata

SEQ ID NO: 3224216 - DNA, 17 bp, Homo sapiens
tattttgaagaatattt

SEQ ID NO: 3224217 - DNA, 23 bp, Homo sapiens
tattttgaagaatatttaagaaa

SEQ ID NO: 3224218 - DNA, 17 bp, Homo sapiens
tattttgaatgtcacaa

SEQ ID NO: 3224219 - DNA, 16 bp, Homo sapiens
tattttgaatgtgaag

SEQ ID NO: 3224220 - DNA, 15 bp, Homo sapiens
tattttgataataaa

SEQ ID NO: 3224221 - DNA, 18 bp, Homo sapiens
tattttgataataaattg

SEQ ID NO: 3224222 - DNA, 20 bp, Homo sapiens
tattttgataataaattgaa

SEQ ID NO: 3224223 - DNA, 18 bp, Homo sapiens
tattttgataataatatt

SEQ ID NO: 3224224 - DNA, 22 bp, Homo sapiens
tattttgatgagatattaaatt

SEQ ID NO: 3224225 - DNA, 14 bp, Homo sapiens
tattttgctggaat

SEQ ID NO: 3224226 - DNA, 15 bp, Homo sapiens
tattttggaaactgc

SEQ ID NO: 3224227 - DNA, 20 bp, Homo sapiens
tattttggcttcatttcaat

SEQ ID NO: 3224228 - DNA, 21 bp, Homo sapiens
tattttggttcttagttctca

SEQ ID NO: 3224229 - DNA, 13 bp, Homo sapiens
tattttgtaaact

SEQ ID NO: 3224230 - DNA, 21 bp, Homo sapiens
tattttgtaaactcaaaatat

SEQ ID NO: 3224231 - DNA, 20 bp, Homo sapiens
tattttgtcttattcttaag

SEQ ID NO: 3224232 - DNA, 23 bp, Homo sapiens
tattttgtggttctattttactt

SEQ ID NO: 3224233 - DNA, 15 bp, Homo sapiens
tattttgtgtgacca

SEQ ID NO: 3224234 - DNA, 16 bp, Homo sapiens
tattttgttaaagctg

SEQ ID NO: 3224235 - DNA, 14 bp, Homo sapiens
tattttgtttcaat

SEQ ID NO: 3224236 - DNA, 20 bp, Homo sapiens
tattttgtttcaatctctga

SEQ ID NO: 3224237 - DNA, 15 bp, Homo sapiens
tatttttaaaaagaa

SEQ ID NO: 3224238 - DNA, 16 bp, Homo sapiens
tatgtgtggtttcagt

SEQ ID NO: 3224239 - DNA, 14 bp, Homo sapiens
tatgtgtgtagaca

SEQ ID NO: 3224240 - DNA, 13 bp, Homo sapiens
tatgtgtgtaggt

SEQ ID NO: 3224241 - DNA, 19 bp, Homo sapiens
tatgtgtgtaggttatctt

SEQ ID NO: 3224242 - DNA, 20 bp, Homo sapiens
tatgtgtgtaggttatcttt

SEQ ID NO: 3224243 - DNA, 15 bp, Homo sapiens
tatgtgttacttcaa

SEQ ID NO: 3224244 - DNA, 14 bp, Homo sapiens
tatgtgtttttctc

SEQ ID NO: 3224245 - DNA, 21 bp, Homo sapiens
tatgtgtttttctcatatttg

SEQ ID NO: 3224246 - DNA, 12 bp, Homo sapiens
tatgttaaatac

SEQ ID NO: 3224247 - DNA, 19 bp, Homo sapiens
tatgttaaatactgtgcag

SEQ ID NO: 3224248 - DNA, 21 bp, Homo sapiens
tatgttaaatactgtgcagaa

SEQ ID NO: 3224249 - DNA, 18 bp, Homo sapiens
tatgttaagctctttatg

SEQ ID NO: 3224250 - DNA, 19 bp, Homo sapiens
tatgttaagctctttatga

SEQ ID NO: 3224251 - DNA, 22 bp, Homo sapiens
tatgttacatctgttttaaatt

SEQ ID NO: 3224252 - DNA, 14 bp, Homo sapiens
tatgttatatcaac

SEQ ID NO: 3224253 - DNA, 21 bp, Homo sapiens
tatgttatcaccttccaaaca

SEQ ID NO: 3224254 - DNA, 12 bp, Homo sapiens
tatgttcctaag

SEQ ID NO: 3224255 - DNA, 23 bp, Homo sapiens
tatgttctcccctacattagtaa

SEQ ID NO: 3224256 - DNA, 17 bp, Homo sapiens
tatgttgagtgttcatt

SEQ ID NO: 3224257 - DNA, 13 bp, Homo sapiens
tatgttgcccagg

SEQ ID NO: 3224258 - DNA, 14 bp, Homo sapiens
tatgttgcctttat

SEQ ID NO: 3224259 - DNA, 18 bp, Homo sapiens
tatgttgcctttatggtt

SEQ ID NO: 3224260 - DNA, 15 bp, Homo sapiens
tatgttggaaaaaag

SEQ ID NO: 3224261 - DNA, 19 bp, Homo sapiens
tatgttgtatgattccaat

SEQ ID NO: 3224262 - DNA, 18 bp, Homo sapiens
tatgtttaaaaaaacatt

SEQ ID NO: 3224263 - DNA, 13 bp, Homo sapiens
tatgtttaaaata

SEQ ID NO: 3224264 - DNA, 17 bp, Homo sapiens
tatgtttattacaattt

SEQ ID NO: 3224265 - DNA, 18 bp, Homo sapiens
tatgtttatttactaatt

SEQ ID NO: 3224266 - DNA, 17 bp, Homo sapiens
tatgtttgtatttggaa

SEQ ID NO: 3224267 - DNA, 15 bp, Homo sapiens
tatgttttataattc

SEQ ID NO: 3224268 - DNA, 16 bp, Homo sapiens
tatgtttttataaaaa

SEQ ID NO: 3224269 - DNA, 21 bp, Homo sapiens
tatgtttttgactcttttgag

SEQ ID NO: 3224270 - DNA, 16 bp, Homo sapiens
tattaaaaatgttctc

SEQ ID NO: 3224271 - DNA, 22 bp, Homo sapiens
tattaaaatatggctataaata

SEQ ID NO: 3224272 - DNA, 19 bp, Homo sapiens
tattaaaatgattgtaaaa

SEQ ID NO: 3224273 - DNA, 15 bp, Homo sapiens
tattaaaattacaga

SEQ ID NO: 3224274 - DNA, 17 bp, Homo sapiens
tattaaaattacagatg

SEQ ID NO: 3224275 - DNA, 18 bp, Homo sapiens
tattaaaattacagatgt

SEQ ID NO: 3224276 - DNA, 16 bp, Homo sapiens
tattaaaattgccatt

SEQ ID NO: 3224277 - DNA, 12 bp, Homo sapiens
tattaaacaaag

SEQ ID NO: 3224278 - DNA, 19 bp, Homo sapiens
tattaaacaaagtttcaga

SEQ ID NO: 3224279 - DNA, 12 bp, Homo sapiens
tattaaagacag

SEQ ID NO: 3224280 - DNA, 22 bp, Homo sapiens
tattaaagtgctaaggttctaa

SEQ ID NO: 3224281 - DNA, 18 bp, Homo sapiens
tattaaatacaaaacttc

SEQ ID NO: 3224282 - DNA, 18 bp, Homo sapiens
tatcaagtggcatgtgct

SEQ ID NO: 3224283 - DNA, 16 bp, Homo sapiens
tatcacgtctgacaaa

SEQ ID NO: 3224284 - DNA, 19 bp, Homo sapiens
tatcactctaaaaaacatt

SEQ ID NO: 3224285 - DNA, 20 bp, Homo sapiens
tatcacttccatgacataag

SEQ ID NO: 3224286 - DNA, 18 bp, Homo sapiens
tatcactttttgaactaa

SEQ ID NO: 3224287 - DNA, 15 bp, Homo sapiens
tatcagacaagcact

SEQ ID NO: 3224288 - DNA, 16 bp, Homo sapiens
tatcagacaagcacta

SEQ ID NO: 3224289 - DNA, 17 bp, Homo sapiens
tatcagaggcctataat

SEQ ID NO: 3224290 - DNA, 22 bp, Homo sapiens
tatcagaggtctatttttacct

SEQ ID NO: 3224291 - DNA, 18 bp, Homo sapiens
tatcagatacatcactgc

SEQ ID NO: 3224292 - DNA, 15 bp, Homo sapiens
tatcagcaatactca

SEQ ID NO: 3224293 - DNA, 18 bp, Homo sapiens
tatcagctacttaagaga

SEQ ID NO: 3224294 - DNA, 20 bp, Homo sapiens
tatcagctacttaagagaaa

SEQ ID NO: 3224295 - DNA, 15 bp, Homo sapiens
tatcaggaatataaa

SEQ ID NO: 3224296 - DNA, 14 bp, Homo sapiens
tatcaggtcaggga

SEQ ID NO: 3224297 - DNA, 21 bp, Homo sapiens
tatcagtaacccccttaaatt

SEQ ID NO: 3224298 - DNA, 21 bp, Homo sapiens
tatcagtcaatatttttagat

SEQ ID NO: 3224299 - DNA, 15 bp, Homo sapiens
tatcagttatccttt

SEQ ID NO: 3224300 - DNA, 14 bp, Homo sapiens
tatcatagaaatgt

SEQ ID NO: 3224301 - DNA, 15 bp, Homo sapiens
tatcatataaacatt

SEQ ID NO: 3224302 - DNA, 16 bp, Homo sapiens
tatcatatccttgccc

SEQ ID NO: 3224303 - DNA, 15 bp, Homo sapiens
tatcatattggtatt

SEQ ID NO: 3224304 - DNA, 22 bp, Homo sapiens
tatcatcaagcaggaattatgt

SEQ ID NO: 3224305 - DNA, 23 bp, Homo sapiens
tatcatctccatcatatgcctga

SEQ ID NO: 3224306 - DNA, 12 bp, Homo sapiens
tatcatgaattt

SEQ ID NO: 3224307 - DNA, 15 bp, Homo sapiens
tatcatgaattttaa

SEQ ID NO: 3224308 - DNA, 16 bp, Homo sapiens
tatcatgaattttaaa

SEQ ID NO: 3224309 - DNA, 24 bp, Homo sapiens
tatcatgaattttaaagtatgcat

SEQ ID NO: 3224310 - DNA, 13 bp, Homo sapiens
tatcatgcaaaat

SEQ ID NO: 3224311 - DNA, 11 bp, Homo sapiens
tatcatgcttg

SEQ ID NO: 3224312 - DNA, 19 bp, Homo sapiens
tatcattctacagaataat

SEQ ID NO: 3224313 - DNA, 19 bp, Homo sapiens
tatcattgcttcctcctcc

SEQ ID NO: 3224314 - DNA, 14 bp, Homo sapiens
tatcattttaaaaa

SEQ ID NO: 3224315 - DNA, 21 bp, Homo sapiens
tatcattttaaaaactttatt

SEQ ID NO: 3224316 - DNA, 15 bp, Homo sapiens
tatcatttttgtaca

SEQ ID NO: 3224317 - DNA, 22 bp, Homo sapiens
tatcatttttgtacagtttgct

SEQ ID NO: 3224318 - DNA, 23 bp, Homo sapiens
tatccaaagaacttgatttgcat

SEQ ID NO: 3224319 - DNA, 21 bp, Homo sapiens
tatccaaagactgtactggcc

SEQ ID NO: 3224320 - DNA, 20 bp, Homo sapiens
tatccaaatctgaagattgc

SEQ ID NO: 3224321 - DNA, 18 bp, Homo sapiens
tatccaaccaacttggtt

SEQ ID NO: 3224322 - DNA, 23 bp, Homo sapiens
tatccacagagagtcccactgcc

SEQ ID NO: 3224323 - DNA, 15 bp, Homo sapiens
tatccaccacctccc

SEQ ID NO: 3224324 - DNA, 18 bp, Homo sapiens
tatccactttgcacagct

SEQ ID NO: 3224325 - DNA, 19 bp, Homo sapiens
tatccaggttccctcccag

SEQ ID NO: 3224326 - DNA, 17 bp, Homo sapiens
tatccatattgagtcaa

SEQ ID NO: 3224327 - DNA, 22 bp, Homo sapiens
tatccatgtactgtagtttttc

SEQ ID NO: 3224328 - DNA, 23 bp, Homo sapiens
tatccccaatcagctccttttcc

SEQ ID NO: 3224329 - DNA, 21 bp, Homo sapiens
tatccccatctccctgcctgg

SEQ ID NO: 3224330 - DNA, 20 bp, Homo sapiens
tatccccccatcttgcttcc

SEQ ID NO: 3224331 - DNA, 15 bp, Homo sapiens
tatcccccccagcct

SEQ ID NO: 3224332 - DNA, 21 bp, Homo sapiens
tatcccccccctgtatagtta

SEQ ID NO: 3224333 - DNA, 19 bp, Homo sapiens
tatcccgagtctgggacac

SEQ ID NO: 3224334 - DNA, 15 bp, Homo sapiens
tatccctacatgtat

SEQ ID NO: 3224335 - DNA, 14 bp, Homo sapiens
tatcccttcctttt

SEQ ID NO: 3224336 - DNA, 18 bp, Homo sapiens
tatccctttacaatgtga

SEQ ID NO: 3224337 - DNA, 20 bp, Homo sapiens
tatccgactctaagctgtgt

SEQ ID NO: 3224338 - DNA, 15 bp, Homo sapiens
tatcctacaacaaga

SEQ ID NO: 3224339 - DNA, 13 bp, Homo sapiens
tatcctcacataa

SEQ ID NO: 3224340 - DNA, 22 bp, Homo sapiens
tatcctgggggacccaatgtag

SEQ ID NO: 3224341 - DNA, 13 bp, Homo sapiens
tatcctgtgactg

SEQ ID NO: 3224342 - DNA, 13 bp, Homo sapiens
tatccttccttca

SEQ ID NO: 3224343 - DNA, 14 bp, Homo sapiens
tatccttccttcag

SEQ ID NO: 3224344 - DNA, 14 bp, Homo sapiens
tatcgaaataacaa

SEQ ID NO: 3224345 - DNA, 15 bp, Homo sapiens
tatcgaaataacaat

SEQ ID NO: 3224346 - DNA, 16 bp, Homo sapiens
tatcgaaataacaatg

SEQ ID NO: 3224347 - DNA, 18 bp, Homo sapiens
tatcgaaataacaatgtt

SEQ ID NO: 3224348 - DNA, 19 bp, Homo sapiens
tatcgaaataacaatgtta

SEQ ID NO: 3224349 - DNA, 21 bp, Homo sapiens
tatcgaaataacaatgttaag

SEQ ID NO: 3224350 - DNA, 23 bp, Homo sapiens
tatcgacttgtttttgcacatgt

SEQ ID NO: 3224351 - DNA, 14 bp, Homo sapiens
tatcgagtttgcaa

SEQ ID NO: 3224352 - DNA, 15 bp, Homo sapiens
tatcgggagcagtgt

SEQ ID NO: 3224353 - DNA, 12 bp, Homo sapiens
tatctaaattaa

SEQ ID NO: 3224354 - DNA, 13 bp, Homo sapiens
tatctaagaataa

SEQ ID NO: 3224355 - DNA, 19 bp, Homo sapiens
tatctaagaataataaaat

SEQ ID NO: 3224356 - DNA, 20 bp, Homo sapiens
tatctaatacctctgtgtgc

SEQ ID NO: 3224357 - DNA, 18 bp, Homo sapiens
tatctaatatatatgaat

SEQ ID NO: 3224358 - DNA, 16 bp, Homo sapiens
tatcttcacattgtgt

SEQ ID NO: 3224359 - DNA, 17 bp, Homo sapiens
tatcttccatatttgga

SEQ ID NO: 3224360 - DNA, 18 bp, Homo sapiens
tatcttcctttcttgtct

SEQ ID NO: 3224361 - DNA, 15 bp, Homo sapiens
tatcttctcaagttc

SEQ ID NO: 3224362 - DNA, 18 bp, Homo sapiens
tatcttctcaagttctaa

SEQ ID NO: 3224363 - DNA, 17 bp, Homo sapiens
tatcttggactgacatt

SEQ ID NO: 3224364 - DNA, 11 bp, Homo sapiens
tatcttggcct

SEQ ID NO: 3224365 - DNA, 16 bp, Homo sapiens
tatcttgtgttgtcct

SEQ ID NO: 3224366 - DNA, 22 bp, Homo sapiens
tatcttgttagagagcttttca

SEQ ID NO: 3224367 - DNA, 17 bp, Homo sapiens
tatcttgttcaggaaaa

SEQ ID NO: 3224368 - DNA, 15 bp, Homo sapiens
tatcttgtttggcct

SEQ ID NO: 3224369 - DNA, 17 bp, Homo sapiens
tatctttatacagattt

SEQ ID NO: 3224370 - DNA, 23 bp, Homo sapiens
tatctttatacagattttctaga

SEQ ID NO: 3224371 - DNA, 15 bp, Homo sapiens
tatctttatgctgta

SEQ ID NO: 3224372 - DNA, 23 bp, Homo sapiens
tatctttattcaccttttcttca

SEQ ID NO: 3224373 - DNA, 16 bp, Homo sapiens
tatctttcacctttct

SEQ ID NO: 3224374 - DNA, 13 bp, Homo sapiens
tatctttccctct

SEQ ID NO: 3224375 - DNA, 15 bp, Homo sapiens
tatctttctttccat

SEQ ID NO: 3224376 - DNA, 12 bp, Homo sapiens
tatcttttcata

SEQ ID NO: 3224377 - DNA, 14 bp, Homo sapiens
tatcttttctttca

SEQ ID NO: 3224378 - DNA, 19 bp, Homo sapiens
tatctttttaaaaactctt

SEQ ID NO: 3224379 - DNA, 15 bp, Homo sapiens
tatctttttcattat

SEQ ID NO: 3224380 - DNA, 15 bp, Homo sapiens
tatcttttttcaaaa

SEQ ID NO: 3224381 - DNA, 19 bp, Homo sapiens
tatgaaaaaaatggcatca

SEQ ID NO: 3224382 - DNA, 13 bp, Homo sapiens
tatgaaaaaatat

SEQ ID NO: 3224383 - DNA, 19 bp, Homo sapiens
tatgaaaaattggggagga

SEQ ID NO: 3224384 - DNA, 13 bp, Homo sapiens
tatgaaaacttat

SEQ ID NO: 3224385 - DNA, 15 bp, Homo sapiens
tatgaaagaggcagc

SEQ ID NO: 3224386 - DNA, 14 bp, Homo sapiens
tatgaaagattgtg

SEQ ID NO: 3224387 - DNA, 23 bp, Homo sapiens
tatgaaatgtcccctcaaactca

SEQ ID NO: 3224388 - DNA, 21 bp, Homo sapiens
tatgaacatagactagagaaa

SEQ ID NO: 3224389 - DNA, 18 bp, Homo sapiens
tatgaaccctttgtttct

SEQ ID NO: 3224390 - DNA, 21 bp, Homo sapiens
tatgaacctattttcatttgt

SEQ ID NO: 3224391 - DNA, 23 bp, Homo sapiens
tatgaactacaggtgtttgactt

SEQ ID NO: 3224392 - DNA, 20 bp, Homo sapiens
tatgaactttatagttgttt

SEQ ID NO: 3224393 - DNA, 17 bp, Homo sapiens
tatgaaggaatcattcc

SEQ ID NO: 3224394 - DNA, 19 bp, Homo sapiens
tatgaagtgcgtgaatgta

SEQ ID NO: 3224395 - DNA, 13 bp, Homo sapiens
tatgaagttgctg

SEQ ID NO: 3224396 - DNA, 14 bp, Homo sapiens
tatgaagttgctgt

SEQ ID NO: 3224397 - DNA, 17 bp, Homo sapiens
tatgaagttgctgttta

SEQ ID NO: 3224398 - DNA, 23 bp, Homo sapiens
tatgaatctgctcactttaaacc

SEQ ID NO: 3224399 - DNA, 13 bp, Homo sapiens
tatgaattgtaca

SEQ ID NO: 3224400 - DNA, 23 bp, Homo sapiens
tatgacagaatggctatcaaaag

SEQ ID NO: 3224401 - DNA, 16 bp, Homo sapiens
tatgacagatatattt

SEQ ID NO: 3224402 - DNA, 14 bp, Homo sapiens
tatgacagccattt

SEQ ID NO: 3224403 - DNA, 15 bp, Homo sapiens
tatgacagttatact

SEQ ID NO: 3224404 - DNA, 23 bp, Homo sapiens
tatgacatcacttgtacaaaata

SEQ ID NO: 3224405 - DNA, 17 bp, Homo sapiens
tatgacgctgatacata

SEQ ID NO: 3224406 - DNA, 12 bp, Homo sapiens
tatgactaaaga

SEQ ID NO: 3224407 - DNA, 18 bp, Homo sapiens
tatgactgctccccagcc

SEQ ID NO: 3224408 - DNA, 22 bp, Homo sapiens
tatgactgctccccagccctgg

SEQ ID NO: 3224409 - DNA, 22 bp, Homo sapiens
tatgagaacaagtcacagctgc

SEQ ID NO: 3224410 - DNA, 15 bp, Homo sapiens
tatgagactttatgt

SEQ ID NO: 3224411 - DNA, 15 bp, Homo sapiens
tatgagaggcaatga

SEQ ID NO: 3224412 - DNA, 20 bp, Homo sapiens
tatgagatggttaaaaaggc

SEQ ID NO: 3224413 - DNA, 13 bp, Homo sapiens
tatgagcatcctg

SEQ ID NO: 3224414 - DNA, 19 bp, Homo sapiens
tatgagccagacaaatgga

SEQ ID NO: 3224415 - DNA, 21 bp, Homo sapiens
tatgagccgtgaactgtgcat

SEQ ID NO: 3224416 - DNA, 15 bp, Homo sapiens
tatgagctaaaaata

SEQ ID NO: 3224417 - DNA, 18 bp, Homo sapiens
tatgagctacaacaaaag

SEQ ID NO: 3224418 - DNA, 16 bp, Homo sapiens
tatgagctttctttgc

SEQ ID NO: 3224419 - DNA, 13 bp, Homo sapiens
tatgaggaaaggt

SEQ ID NO: 3224420 - DNA, 17 bp, Homo sapiens
tatgaggaataattatt

SEQ ID NO: 3224421 - DNA, 19 bp, Homo sapiens
tatgaggcaacctgattgt

SEQ ID NO: 3224422 - DNA, 13 bp, Homo sapiens
tatgagggccttg

SEQ ID NO: 3224423 - DNA, 14 bp, Homo sapiens
tatgagtagccagg

SEQ ID NO: 3224424 - DNA, 21 bp, Homo sapiens
tatgagtcccatttgccttgc

SEQ ID NO: 3224425 - DNA, 15 bp, Homo sapiens
tatgagttactgaag

SEQ ID NO: 3224426 - DNA, 21 bp, Homo sapiens
tatgagtttttgatagcttta

SEQ ID NO: 3224427 - DNA, 22 bp, Homo sapiens
tatgagtttttgatagctttat

SEQ ID NO: 3224428 - DNA, 15 bp, Homo sapiens
tatgatatcatgctt

SEQ ID NO: 3224429 - DNA, 15 bp, Homo sapiens
tatgatattgtttaa

SEQ ID NO: 3224430 - DNA, 15 bp, Homo sapiens
tatgatattttctgt

SEQ ID NO: 3224431 - DNA, 23 bp, Homo sapiens
tatgatcacggctcactgcagcc

SEQ ID NO: 3224432 - DNA, 13 bp, Homo sapiens
tatgatcagtgtt

SEQ ID NO: 3224433 - DNA, 17 bp, Homo sapiens
tatgatcagtgttactg

SEQ ID NO: 3224434 - DNA, 14 bp, Homo sapiens
tatgatccagagca

SEQ ID NO: 3224435 - DNA, 20 bp, Homo sapiens
tatgatccagagcagagttt

SEQ ID NO: 3224436 - DNA, 16 bp, Homo sapiens
tatgatctatttgtag

SEQ ID NO: 3224437 - DNA, 21 bp, Homo sapiens
tatgatgactcccttaaaata

SEQ ID NO: 3224438 - DNA, 19 bp, Homo sapiens
tatgatgagattcacttag

SEQ ID NO: 3224439 - DNA, 22 bp, Homo sapiens
tatgatgcatacagttttctag

SEQ ID NO: 3224440 - DNA, 15 bp, Homo sapiens
tatgatgggggaaaa

SEQ ID NO: 3224441 - DNA, 13 bp, Homo sapiens
tatgattatacaa

SEQ ID NO: 3224442 - DNA, 21 bp, Homo sapiens
tatgattcactatttaaacta

SEQ ID NO: 3224443 - DNA, 21 bp, Homo sapiens
tatgattcagattgttatcta

SEQ ID NO: 3224444 - DNA, 17 bp, Homo sapiens
tatgatttaataaaata

SEQ ID NO: 3224445 - DNA, 18 bp, Homo sapiens
tatgatttaataaaataa

SEQ ID NO: 3224446 - DNA, 15 bp, Homo sapiens
tatgatttatagttt

SEQ ID NO: 3224447 - DNA, 21 bp, Homo sapiens
tatgatttcactagaaaagct

SEQ ID NO: 3224448 - DNA, 21 bp, Homo sapiens
tatgattttttaaaagaaatt

SEQ ID NO: 3224449 - DNA, 17 bp, Homo sapiens
tatgcaaacctcatctt

SEQ ID NO: 3224450 - DNA, 17 bp, Homo sapiens
tatgcaagtctgtgagt

SEQ ID NO: 3224451 - DNA, 13 bp, Homo sapiens
tatgcacatatgg

SEQ ID NO: 3224452 - DNA, 20 bp, Homo sapiens
tatgcaccttgtgtctgtac

SEQ ID NO: 3224453 - DNA, 22 bp, Homo sapiens
tatgcaccttgtgtctgtacac

SEQ ID NO: 3224454 - DNA, 18 bp, Homo sapiens
tatgcagaaatagacaaa

SEQ ID NO: 3224455 - DNA, 21 bp, Homo sapiens
tatgcagaaatagacaaaaag

SEQ ID NO: 3224456 - DNA, 14 bp, Homo sapiens
tatgcagaatgttt

SEQ ID NO: 3224457 - DNA, 12 bp, Homo sapiens
tatgcagcctgc

SEQ ID NO: 3224458 - DNA, 22 bp, Homo sapiens
tatgcagtgatatggcagaaga

SEQ ID NO: 3224459 - DNA, 20 bp, Homo sapiens
tatgcatggaaacctgaaaa

SEQ ID NO: 3224460 - DNA, 12 bp, Homo sapiens
tatgcattcaca

SEQ ID NO: 3224461 - DNA, 17 bp, Homo sapiens
tatgcatttcattcaaa

SEQ ID NO: 3224462 - DNA, 22 bp, Homo sapiens
tatgccacgggaagtttagaga

SEQ ID NO: 3224463 - DNA, 13 bp, Homo sapiens
tatgccatagaaa

SEQ ID NO: 3224464 - DNA, 19 bp, Homo sapiens
tatgccattggggtagttg

SEQ ID NO: 3224465 - DNA, 15 bp, Homo sapiens
tatgccccaaatata

SEQ ID NO: 3224466 - DNA, 20 bp, Homo sapiens
tatgccccttcttgggcccc

SEQ ID NO: 3224467 - DNA, 13 bp, Homo sapiens
tatgccttctgta

SEQ ID NO: 3224468 - DNA, 14 bp, Homo sapiens
tatgccttctgtat

SEQ ID NO: 3224469 - DNA, 14 bp, Homo sapiens
tatgcctttagtca

SEQ ID NO: 3224470 - DNA, 14 bp, Homo sapiens
tatgcctttctctc

SEQ ID NO: 3224471 - DNA, 13 bp, Homo sapiens
tatgctaatcagg

SEQ ID NO: 3224472 - DNA, 21 bp, Homo sapiens
tatgctagtttattggaagtg

SEQ ID NO: 3224473 - DNA, 22 bp, Homo sapiens
tatgctccatcccattcacttc

SEQ ID NO: 3224474 - DNA, 19 bp, Homo sapiens
tatgctctcgcacctttcc

SEQ ID NO: 3224475 - DNA, 20 bp, Homo sapiens
tatgctcttttttactcatt

SEQ ID NO: 3224476 - DNA, 13 bp, Homo sapiens
tatgctggccagc

SEQ ID NO: 3224477 - DNA, 13 bp, Homo sapiens
tatgctgtatttt

SEQ ID NO: 3224478 - DNA, 19 bp, Homo sapiens
tatgctgtattttaacact

SEQ ID NO: 3224479 - DNA, 15 bp, Homo sapiens
tatgcttatacactt

SEQ ID NO: 3224480 - DNA, 22 bp, Homo sapiens
tatgcttatacacttacacttt

SEQ ID NO: 3224481 - DNA, 16 bp, Homo sapiens
tatggaaaatcagctg

SEQ ID NO: 3224482 - DNA, 16 bp, Homo sapiens
tatggaaacactgatt

SEQ ID NO: 3224483 - DNA, 12 bp, Homo sapiens
tatggaaatata

SEQ ID NO: 3224484 - DNA, 18 bp, Homo sapiens
tagccagagaggagcacc

SEQ ID NO: 3224485 - DNA, 19 bp, Homo sapiens
tagccagagaggagcacct

SEQ ID NO: 3224486 - DNA, 20 bp, Homo sapiens
tagccagagaggagcacctg

SEQ ID NO: 3224487 - DNA, 24 bp, Homo sapiens
tagccagagcccttcactgccatg

SEQ ID NO: 3224488 - DNA, 20 bp, Homo sapiens
tagccagagggtgggagcct

SEQ ID NO: 3224489 - DNA, 18 bp, Homo sapiens
tagccagcccctcttccc

SEQ ID NO: 3224490 - DNA, 21 bp, Homo sapiens
tagccaggagtctgtgctctt

SEQ ID NO: 3224491 - DNA, 20 bp, Homo sapiens
tagccaggatcatggtgtaa

SEQ ID NO: 3224492 - DNA, 22 bp, Homo sapiens
tagccaggatcatggtgtaata

SEQ ID NO: 3224493 - DNA, 16 bp, Homo sapiens
tagccaggtactgcat

SEQ ID NO: 3224494 - DNA, 12 bp, Homo sapiens
tagccataattc

SEQ ID NO: 3224495 - DNA, 11 bp, Homo sapiens
tagccatctgc

SEQ ID NO: 3224496 - DNA, 12 bp, Homo sapiens
tagccatctgca

SEQ ID NO: 3224497 - DNA, 13 bp, Homo sapiens
tagccatctgcac

SEQ ID NO: 3224498 - DNA, 21 bp, Homo sapiens
tagccatgatttgtcccagcc

SEQ ID NO: 3224499 - DNA, 22 bp, Homo sapiens
tagccatgatttgtcccagcct

SEQ ID NO: 3224500 - DNA, 14 bp, Homo sapiens
tagccatggctcag

SEQ ID NO: 3224501 - DNA, 23 bp, Homo sapiens
tagcccacacttgagaggatgaa

SEQ ID NO: 3224502 - DNA, 13 bp, Homo sapiens
tagcccaccctgc

SEQ ID NO: 3224503 - DNA, 19 bp, Homo sapiens
tagcccagaacaaaaagaa

SEQ ID NO: 3224504 - DNA, 15 bp, Homo sapiens
tagcccagactctga

SEQ ID NO: 3224505 - DNA, 18 bp, Homo sapiens
tagcccagcgctctgcct

SEQ ID NO: 3224506 - DNA, 17 bp, Homo sapiens
tagcccaggagagagaa

SEQ ID NO: 3224507 - DNA, 13 bp, Homo sapiens
tagccccagagat

SEQ ID NO: 3224508 - DNA, 13 bp, Homo sapiens
tagccccataatt

SEQ ID NO: 3224509 - DNA, 17 bp, Homo sapiens
tagccccctggcctctg

SEQ ID NO: 3224510 - DNA, 16 bp, Homo sapiens
tagccctccccctcaa

SEQ ID NO: 3224511 - DNA, 13 bp, Homo sapiens
tagccgcaccctg

SEQ ID NO: 3224512 - DNA, 15 bp, Homo sapiens
tagccgtccatggca

SEQ ID NO: 3224513 - DNA, 16 bp, Homo sapiens
tagccgtccatggcac

SEQ ID NO: 3224514 - DNA, 20 bp, Homo sapiens
tagccgtccatggcaccagc

SEQ ID NO: 3224515 - DNA, 21 bp, Homo sapiens
tagcctaaagggcagggccca

SEQ ID NO: 3224516 - DNA, 22 bp, Homo sapiens
tagcctccgtttatgggccttg

SEQ ID NO: 3224517 - DNA, 15 bp, Homo sapiens
tagcctgcaaagctg

SEQ ID NO: 3224518 - DNA, 14 bp, Homo sapiens
tagcctgcctcagt

SEQ ID NO: 3224519 - DNA, 16 bp, Homo sapiens
tagcctgggccagaga

SEQ ID NO: 3224520 - DNA, 18 bp, Homo sapiens
tagcctgtgcctctggga

SEQ ID NO: 3224521 - DNA, 14 bp, Homo sapiens
tagcctgtggcagt

SEQ ID NO: 3224522 - DNA, 20 bp, Homo sapiens
tagccttagaagtcacacag

SEQ ID NO: 3224523 - DNA, 23 bp, Homo sapiens
tagccttgatttgttcttacagt

SEQ ID NO: 3224524 - DNA, 22 bp, Homo sapiens
tagccttgcccggattctggga

SEQ ID NO: 3224525 - DNA, 13 bp, Homo sapiens
tagccttgcttgt

SEQ ID NO: 3224526 - DNA, 14 bp, Homo sapiens
tagccttgcttgtt

SEQ ID NO: 3224527 - DNA, 17 bp, Homo sapiens
tagccttgtgccctgcc

SEQ ID NO: 3224528 - DNA, 17 bp, Homo sapiens
tagcctttgccctgtca

SEQ ID NO: 3224529 - DNA, 20 bp, Homo sapiens
tagcgaaaggcgagtccagg

SEQ ID NO: 3224530 - DNA, 17 bp, Homo sapiens
tagcgcccagttgggtg

SEQ ID NO: 3224531 - DNA, 13 bp, Homo sapiens
tagcgctgttttt

SEQ ID NO: 3224532 - DNA, 19 bp, Homo sapiens
tagcgtgcccgtgtgcatg

SEQ ID NO: 3224533 - DNA, 18 bp, Homo sapiens
tagcgttcccaacaacat

SEQ ID NO: 3224534 - DNA, 18 bp, Homo sapiens
tagctaaacggattccaa

SEQ ID NO: 3224535 - DNA, 20 bp, Homo sapiens
tagctaagtatcaggggaaa

SEQ ID NO: 3224536 - DNA, 23 bp, Homo sapiens
tagctacaggaagcaccccatgc

SEQ ID NO: 3224537 - DNA, 14 bp, Homo sapiens
tacctcttattgca

SEQ ID NO: 3224538 - DNA, 19 bp, Homo sapiens
tacctcttcccatgactgc

SEQ ID NO: 3224539 - DNA, 13 bp, Homo sapiens
tacctgaggccag

SEQ ID NO: 3224540 - DNA, 23 bp, Homo sapiens
tacctgatggaagtaaagcctca

SEQ ID NO: 3224541 - DNA, 14 bp, Homo sapiens
tacctgattgtatt

SEQ ID NO: 3224542 - DNA, 14 bp, Homo sapiens
tacctgctggacag

SEQ ID NO: 3224543 - DNA, 15 bp, Homo sapiens
tacctgctggacagc

SEQ ID NO: 3224544 - DNA, 17 bp, Homo sapiens
tacctgctggacagcct

SEQ ID NO: 3224545 - DNA, 19 bp, Homo sapiens
tacctgctggacagcctcc

SEQ ID NO: 3224546 - DNA, 15 bp, Homo sapiens
tacctggatgttctt

SEQ ID NO: 3224547 - DNA, 19 bp, Homo sapiens
tacctggatgttcttttta

SEQ ID NO: 3224548 - DNA, 18 bp, Homo sapiens
tacctgggaaaggaccca

SEQ ID NO: 3224549 - DNA, 12 bp, Homo sapiens
tacctgtggata

SEQ ID NO: 3224550 - DNA, 14 bp, Homo sapiens
tacctgtgtacata

SEQ ID NO: 3224551 - DNA, 19 bp, Homo sapiens
taccttagataatatttct

SEQ ID NO: 3224552 - DNA, 16 bp, Homo sapiens
taccttatagttactg

SEQ ID NO: 3224553 - DNA, 18 bp, Homo sapiens
taccttatagttactgtg

SEQ ID NO: 3224554 - DNA, 15 bp, Homo sapiens
taccttattggatat

SEQ ID NO: 3224555 - DNA, 14 bp, Homo sapiens
taccttcaaacttt

SEQ ID NO: 3224556 - DNA, 16 bp, Homo sapiens
taccttcaaactttag

SEQ ID NO: 3224557 - DNA, 14 bp, Homo sapiens
taccttcatttcag

SEQ ID NO: 3224558 - DNA, 22 bp, Homo sapiens
taccttgaaaataagaatagaa

SEQ ID NO: 3224559 - DNA, 20 bp, Homo sapiens
taccttgaccatcgtccttc

SEQ ID NO: 3224560 - DNA, 18 bp, Homo sapiens
tacctttctctctctaag

SEQ ID NO: 3224561 - DNA, 14 bp, Homo sapiens
tacctttgtagtta

SEQ ID NO: 3224562 - DNA, 14 bp, Homo sapiens
taccttttaagaca

SEQ ID NO: 3224563 - DNA, 16 bp, Homo sapiens
taccttttttttttct

SEQ ID NO: 3224564 - DNA, 20 bp, Homo sapiens
taccttttttttttcttggt

SEQ ID NO: 3224565 - DNA, 15 bp, Homo sapiens
tacgaaacacaaacc

SEQ ID NO: 3224566 - DNA, 15 bp, Homo sapiens
tacgactttattttc

SEQ ID NO: 3224567 - DNA, 21 bp, Homo sapiens
tatatagcagcaaaaatataa

SEQ ID NO: 3224568 - DNA, 22 bp, Homo sapiens
tatataggaaactaagcattgt

SEQ ID NO: 3224569 - DNA, 15 bp, Homo sapiens
tatatagtgctatat

SEQ ID NO: 3224570 - DNA, 17 bp, Homo sapiens
tatatagtgctatatat

SEQ ID NO: 3224571 - DNA, 14 bp, Homo sapiens
tatatataaagata

SEQ ID NO: 3224572 - DNA, 15 bp, Homo sapiens
tatatataaatgtat

SEQ ID NO: 3224573 - DNA, 19 bp, Homo sapiens
tatatataattctgtacat

SEQ ID NO: 3224574 - DNA, 14 bp, Homo sapiens
tatatatacatatg

SEQ ID NO: 3224575 - DNA, 16 bp, Homo sapiens
tatatatacatatgta

SEQ ID NO: 3224576 - DNA, 13 bp, Homo sapiens
tatatatagaatc

SEQ ID NO: 3224577 - DNA, 11 bp, Homo sapiens
tatatatataa

SEQ ID NO: 3224578 - DNA, 13 bp, Homo sapiens
tatatatatataa

SEQ ID NO: 3224579 - DNA, 15 bp, Homo sapiens
tatatatgccttttt

SEQ ID NO: 3224580 - DNA, 16 bp, Homo sapiens
tatatatgtgtatata

SEQ ID NO: 3224581 - DNA, 20 bp, Homo sapiens
tatatatgtgtatatataca

SEQ ID NO: 3224582 - DNA, 21 bp, Homo sapiens
tatatatgtgtatatatacat

SEQ ID NO: 3224583 - DNA, 14 bp, Homo sapiens
tatatatgtgtgtg

SEQ ID NO: 3224584 - DNA, 13 bp, Homo sapiens
tatatatttataa

SEQ ID NO: 3224585 - DNA, 15 bp, Homo sapiens
tatatatttataact

SEQ ID NO: 3224586 - DNA, 20 bp, Homo sapiens
tatatatttattttattcta

SEQ ID NO: 3224587 - DNA, 13 bp, Homo sapiens
tatatatttctaa

SEQ ID NO: 3224588 - DNA, 16 bp, Homo sapiens
tatatattttgtgtga

SEQ ID NO: 3224589 - DNA, 20 bp, Homo sapiens
tatatatttttggttgtcaa

SEQ ID NO: 3224590 - DNA, 11 bp, Homo sapiens
tatatcagcct

SEQ ID NO: 3224591 - DNA, 15 bp, Homo sapiens
tatatcagcctgagt

SEQ ID NO: 3224592 - DNA, 14 bp, Homo sapiens
tatatcatgcaaaa

SEQ ID NO: 3224593 - DNA, 14 bp, Homo sapiens
tatatcccctgcta

SEQ ID NO: 3224594 - DNA, 18 bp, Homo sapiens
tatatcctgtgactgtct

SEQ ID NO: 3224595 - DNA, 16 bp, Homo sapiens
tatatcctttctaaca

SEQ ID NO: 3224596 - DNA, 17 bp, Homo sapiens
tatatcctttctaacaa

SEQ ID NO: 3224597 - DNA, 20 bp, Homo sapiens
tatatcctttctaacaaaaa

SEQ ID NO: 3224598 - DNA, 23 bp, Homo sapiens
tatatctcttggaaaataagaca

SEQ ID NO: 3224599 - DNA, 16 bp, Homo sapiens
tatatctgcttcagtg

SEQ ID NO: 3224600 - DNA, 17 bp, Homo sapiens
tatatctgcttcagtgg

SEQ ID NO: 3224601 - DNA, 14 bp, Homo sapiens
tatatctgtaatga

SEQ ID NO: 3224602 - DNA, 16 bp, Homo sapiens
tatatctgtaatgata

SEQ ID NO: 3224603 - DNA, 14 bp, Homo sapiens
tatatctttattca

SEQ ID NO: 3224604 - DNA, 14 bp, Homo sapiens
tatatcttttggtt

SEQ ID NO: 3224605 - DNA, 20 bp, Homo sapiens
tatatcttttggttattcta

SEQ ID NO: 3224606 - DNA, 18 bp, Homo sapiens
tatatgaagaaaatcact

SEQ ID NO: 3224607 - DNA, 16 bp, Homo sapiens
tatatgaataaagtgt

SEQ ID NO: 3224608 - DNA, 21 bp, Homo sapiens
tatatgaccatatttactctt

SEQ ID NO: 3224609 - DNA, 13 bp, Homo sapiens
tatatgatggggg

SEQ ID NO: 3224610 - DNA, 15 bp, Homo sapiens
tatatgatttatagt

SEQ ID NO: 3224611 - DNA, 16 bp, Homo sapiens
tatatgatttatagtt

SEQ ID NO: 3224612 - DNA, 18 bp, Homo sapiens
tatatgccaagctaattt

SEQ ID NO: 3224613 - DNA, 16 bp, Homo sapiens
tatatgccatgatgga

SEQ ID NO: 3224614 - DNA, 17 bp, Homo sapiens
tatatgcctttttccta

SEQ ID NO: 3224615 - DNA, 21 bp, Homo sapiens
tatatgctctgcatgttacat

SEQ ID NO: 3224616 - DNA, 14 bp, Homo sapiens
tatatgcttactga

SEQ ID NO: 3224617 - DNA, 16 bp, Homo sapiens
tatatgcttactgata

SEQ ID NO: 3224618 - DNA, 20 bp, Homo sapiens
tatatggcgttttgtctgtg

SEQ ID NO: 3224619 - DNA, 22 bp, Homo sapiens
tatatgggtcttcactctgact

SEQ ID NO: 3224620 - DNA, 14 bp, Homo sapiens
tatatgtattccct

SEQ ID NO: 3224621 - DNA, 19 bp, Homo sapiens
tatatgtattcccttgtat

SEQ ID NO: 3224622 - DNA, 20 bp, Homo sapiens
tatatgtattcccttgtatt

SEQ ID NO: 3224623 - DNA, 12 bp, Homo sapiens
tatatgtccttg

SEQ ID NO: 3224624 - DNA, 19 bp, Homo sapiens
tatatgtgaaaaaaatgag

SEQ ID NO: 3224625 - DNA, 14 bp, Homo sapiens
tatatgtgtatata

SEQ ID NO: 3224626 - DNA, 20 bp, Homo sapiens
tatatgtgtatatatacata

SEQ ID NO: 3224627 - DNA, 19 bp, Homo sapiens
tatatgtgtgtgtatgttt

SEQ ID NO: 3224628 - DNA, 14 bp, Homo sapiens
tatatgttgtaata

SEQ ID NO: 3224629 - DNA, 15 bp, Homo sapiens
tatatgttgtaataa

SEQ ID NO: 3224630 - DNA, 14 bp, Homo sapiens
tatatgtttacaca

SEQ ID NO: 3224631 - DNA, 19 bp, Homo sapiens
tatatgttttaagaggcag

SEQ ID NO: 3224632 - DNA, 15 bp, Homo sapiens
tatattaaaataagc

SEQ ID NO: 3224633 - DNA, 22 bp, Homo sapiens
tatattaaaattccaaattcat

SEQ ID NO: 3224634 - DNA, 17 bp, Homo sapiens
tatattaatgtacttgt

SEQ ID NO: 3224635 - DNA, 17 bp, Homo sapiens
tatattacacatttgta

SEQ ID NO: 3224636 - DNA, 17 bp, Homo sapiens
tatattacagatatttg

SEQ ID NO: 3224637 - DNA, 13 bp, Homo sapiens
tatattacctcaa

SEQ ID NO: 3224638 - DNA, 19 bp, Homo sapiens
tatattacctcaaattcct

SEQ ID NO: 3224639 - DNA, 15 bp, Homo sapiens
tatattagtgaagat

SEQ ID NO: 3224640 - DNA, 18 bp, Homo sapiens
tccgtgatccatccatct

SEQ ID NO: 3224641 - DNA, 19 bp, Homo sapiens
tccgtgatccatccatctc

SEQ ID NO: 3224642 - DNA, 23 bp, Homo sapiens
tccgtgatccatccatctccagg

SEQ ID NO: 3224643 - DNA, 16 bp, Homo sapiens
tccgtgcctccaccac

SEQ ID NO: 3224644 - DNA, 21 bp, Homo sapiens
tccgtggccccgccctcaggc

SEQ ID NO: 3224645 - DNA, 16 bp, Homo sapiens
tccgtgggacggtgcc

SEQ ID NO: 3224646 - DNA, 21 bp, Homo sapiens
tccgtggtagaggcctggggc

SEQ ID NO: 3224647 - DNA, 16 bp, Homo sapiens
tccgttagctcctgtg

SEQ ID NO: 3224648 - DNA, 19 bp, Homo sapiens
tccgttagctcctgtggcc

SEQ ID NO: 3224649 - DNA, 18 bp, Homo sapiens
tccgttctgttctgctgg

SEQ ID NO: 3224650 - DNA, 18 bp, Homo sapiens
tccgtttatgggccttgc

SEQ ID NO: 3224651 - DNA, 14 bp, Homo sapiens
tccgttttgcctgt

SEQ ID NO: 3224652 - DNA, 21 bp, Homo sapiens
tcctaaagccatcatgccttg

SEQ ID NO: 3224653 - DNA, 15 bp, Homo sapiens
tcctaaatatccaaa

SEQ ID NO: 3224654 - DNA, 17 bp, Homo sapiens
tcctaaatgtcagctgt

SEQ ID NO: 3224655 - DNA, 16 bp, Homo sapiens
tcctaacaggatgaaa

SEQ ID NO: 3224656 - DNA, 19 bp, Homo sapiens
tcctaactagaattagtat

SEQ ID NO: 3224657 - DNA, 17 bp, Homo sapiens
tcctaactgaagagaca

SEQ ID NO: 3224658 - DNA, 14 bp, Homo sapiens
tcctaacttttcaa

SEQ ID NO: 3224659 - DNA, 13 bp, Homo sapiens
tcctaagaagctt

SEQ ID NO: 3224660 - DNA, 19 bp, Homo sapiens
tcctaagaagcttctaata

SEQ ID NO: 3224661 - DNA, 22 bp, Homo sapiens
tcctaagaagcttctaataaat

SEQ ID NO: 3224662 - DNA, 20 bp, Homo sapiens
tcctaagctattcagtaata

SEQ ID NO: 3224663 - DNA, 12 bp, Homo sapiens
tcctaaggacac

SEQ ID NO: 3224664 - DNA, 16 bp, Homo sapiens
tcctaaggacacacta

SEQ ID NO: 3224665 - DNA, 21 bp, Homo sapiens
tcctaagggtcgaaagctcta

SEQ ID NO: 3224666 - DNA, 22 bp, Homo sapiens
tcctaagtctgtcatcctctgg

SEQ ID NO: 3224667 - DNA, 15 bp, Homo sapiens
tcctaatactgtcat

SEQ ID NO: 3224668 - DNA, 18 bp, Homo sapiens
tcctaatttcccttcttg

SEQ ID NO: 3224669 - DNA, 15 bp, Homo sapiens
tcctaattttaaata

SEQ ID NO: 3224670 - DNA, 14 bp, Homo sapiens
tcctacaacttaat

SEQ ID NO: 3224671 - DNA, 19 bp, Homo sapiens
tcctacaagagcagcctgt

SEQ ID NO: 3224672 - DNA, 22 bp, Homo sapiens
tcctacaagagcagcctgtggc

SEQ ID NO: 3224673 - DNA, 18 bp, Homo sapiens
tcctacaagatttagaaa

SEQ ID NO: 3224674 - DNA, 20 bp, Homo sapiens
tcctacaagatttagaaaaa

SEQ ID NO: 3224675 - DNA, 17 bp, Homo sapiens
tcctacaatattttatt

SEQ ID NO: 3224676 - DNA, 13 bp, Homo sapiens
tcctacagtacaa

SEQ ID NO: 3224677 - DNA, 14 bp, Homo sapiens
tcctacagtacaat

SEQ ID NO: 3224678 - DNA, 16 bp, Homo sapiens
tcctacagtacaatca

SEQ ID NO: 3224679 - DNA, 15 bp, Homo sapiens
tcctacccaaccact

SEQ ID NO: 3224680 - DNA, 18 bp, Homo sapiens
tcctacccaccctccttt

SEQ ID NO: 3224681 - DNA, 17 bp, Homo sapiens
tcctaccctccttccac

SEQ ID NO: 3224682 - DNA, 15 bp, Homo sapiens
tcctacctgccctgg

SEQ ID NO: 3224683 - DNA, 16 bp, Homo sapiens
tcctacctgccctgga

SEQ ID NO: 3224684 - DNA, 12 bp, Homo sapiens
tcctactcctga

SEQ ID NO: 3224685 - DNA, 15 bp, Homo sapiens
tcctactctgtgtca

SEQ ID NO: 3224686 - DNA, 13 bp, Homo sapiens
tcctactgtcctc

SEQ ID NO: 3224687 - DNA, 16 bp, Homo sapiens
tcctactgtcctcaga

SEQ ID NO: 3224688 - DNA, 18 bp, Homo sapiens
tcctacttctgactttac

SEQ ID NO: 3224689 - DNA, 17 bp, Homo sapiens
tcctagaattcgaaggc

SEQ ID NO: 3224690 - DNA, 12 bp, Homo sapiens
tcctagacccag

SEQ ID NO: 3224691 - DNA, 16 bp, Homo sapiens
tcctagacttgaaagt

SEQ ID NO: 3224692 - DNA, 18 bp, Homo sapiens
tcctagagacagaagcag

SEQ ID NO: 3224693 - DNA, 15 bp, Homo sapiens
tcctagaggtgggca

SEQ ID NO: 3224694 - DNA, 21 bp, Homo sapiens
tcctagaggtgggcagctggg

SEQ ID NO: 3224695 - DNA, 22 bp, Homo sapiens
tcctagaggtgggcagctgggc

SEQ ID NO: 3224696 - DNA, 16 bp, Homo sapiens
tcctagataaaaagat

SEQ ID NO: 3224697 - DNA, 13 bp, Homo sapiens
tcctagatcctaa

SEQ ID NO: 3224698 - DNA, 20 bp, Homo sapiens
tcctagattatatcaaagta

SEQ ID NO: 3224699 - DNA, 14 bp, Homo sapiens
tcctaggagagcca

SEQ ID NO: 3224700 - DNA, 16 bp, Homo sapiens
tcctaggcccaggcct

SEQ ID NO: 3224701 - DNA, 17 bp, Homo sapiens
tcctaggcccaggcctg

SEQ ID NO: 3224702 - DNA, 19 bp, Homo sapiens
tcctaggggaacagaccag

SEQ ID NO: 3224703 - DNA, 20 bp, Homo sapiens
tcctaggggaacagaccagt

SEQ ID NO: 3224704 - DNA, 21 bp, Homo sapiens
tcctaggtcatgcctcctccc

SEQ ID NO: 3224705 - DNA, 23 bp, Homo sapiens
tcctagtgagtgtgctgactttt

SEQ ID NO: 3224706 - DNA, 22 bp, Homo sapiens
tcctagtggatgactgttgatg

SEQ ID NO: 3224707 - DNA, 23 bp, Homo sapiens
tcctagtttgacctcacagtgac

SEQ ID NO: 3224708 - DNA, 20 bp, Homo sapiens
tcctagttttctcctcccag

SEQ ID NO: 3224709 - DNA, 14 bp, Homo sapiens
tcctataaggagag

SEQ ID NO: 3224710 - DNA, 20 bp, Homo sapiens
tcctataatataataaatat

SEQ ID NO: 3224711 - DNA, 15 bp, Homo sapiens
tcctataatctgtca

SEQ ID NO: 3224712 - DNA, 15 bp, Homo sapiens
tcctatatatttcta

SEQ ID NO: 3224713 - DNA, 15 bp, Homo sapiens
tcctatccactgggc

SEQ ID NO: 3224714 - DNA, 17 bp, Homo sapiens
tcctatccactgggcac

SEQ ID NO: 3224715 - DNA, 14 bp, Homo sapiens
tcctatctccccca

SEQ ID NO: 3224716 - DNA, 18 bp, Homo sapiens
tcctatctcccccaaccc

SEQ ID NO: 3224717 - DNA, 15 bp, Homo sapiens
tcctatctggggagc

SEQ ID NO: 3224718 - DNA, 17 bp, Homo sapiens
tcctatctgtgttttga

SEQ ID NO: 3224719 - DNA, 20 bp, Homo sapiens
tcctatgatggatggcagac

SEQ ID NO: 3224720 - DNA, 16 bp, Homo sapiens
tcctatgcccaggtac

SEQ ID NO: 3224721 - DNA, 13 bp, Homo sapiens
tcctatggaaaaa

SEQ ID NO: 3224722 - DNA, 18 bp, Homo sapiens
tcctatggacaacttatt

SEQ ID NO: 3224723 - DNA, 21 bp, Homo sapiens
tcctatggacaacttatttaa

SEQ ID NO: 3224724 - DNA, 17 bp, Homo sapiens
tcctatttgcagttact

SEQ ID NO: 3224725 - DNA, 14 bp, Homo sapiens
tcctatttgttttc

SEQ ID NO: 3224726 - DNA, 17 bp, Homo sapiens
tcctatttgttttcatg

SEQ ID NO: 3224727 - DNA, 23 bp, Homo sapiens
tcctcaactcacctaatgtttat

SEQ ID NO: 3224728 - DNA, 16 bp, Homo sapiens
tcctcaagcaataatt

SEQ ID NO: 3224729 - DNA, 19 bp, Homo sapiens
tcctcaagcaataattgtt

SEQ ID NO: 3224730 - DNA, 18 bp, Homo sapiens
tcctcaaggcccagccat

SEQ ID NO: 3224731 - DNA, 22 bp, Homo sapiens
tcctcaaggcccagccataaaa

SEQ ID NO: 3224732 - DNA, 12 bp, Homo sapiens
tcctcacatagc

SEQ ID NO: 3224733 - DNA, 13 bp, Homo sapiens
tcctcacccctgt

SEQ ID NO: 3224734 - DNA, 14 bp, Homo sapiens
tcctcacccctgtc

SEQ ID NO: 3224735 - DNA, 15 bp, Homo sapiens
tcctcacccctgtcc

SEQ ID NO: 3224736 - DNA, 19 bp, Homo sapiens
tcctcacccctgtcctcac

SEQ ID NO: 3224737 - DNA, 20 bp, Homo sapiens
tcctcacccctgtcctcact

SEQ ID NO: 3224738 - DNA, 16 bp, Homo sapiens
tcctcacctcatgccc

SEQ ID NO: 3224739 - DNA, 12 bp, Homo sapiens
tcctcacctctg

SEQ ID NO: 3224740 - DNA, 15 bp, Homo sapiens
tcctcacctctggac

SEQ ID NO: 3224741 - DNA, 23 bp, Homo sapiens
tcctcacctctggactggctaga

SEQ ID NO: 3224742 - DNA, 19 bp, Homo sapiens
tcctcactctgtccctgtc

SEQ ID NO: 3224743 - DNA, 22 bp, Homo sapiens
tcctcactctgtccctgtcctt

SEQ ID NO: 3224744 - DNA, 19 bp, Homo sapiens
tcctcactgccctccccag

SEQ ID NO: 3224745 - DNA, 20 bp, Homo sapiens
tcctcactgctccctgaagc

SEQ ID NO: 3224746 - DNA, 14 bp, Homo sapiens
tcctcactgggtgg

SEQ ID NO: 3224747 - DNA, 22 bp, Homo sapiens
tcctcactgggtggggtgagga

SEQ ID NO: 3224748 - DNA, 17 bp, Homo sapiens
tcctcagagaatttcta

SEQ ID NO: 3224749 - DNA, 12 bp, Homo sapiens
tcctcagccccc

SEQ ID NO: 3224750 - DNA, 19 bp, Homo sapiens
tcctcagcccccaggccag

SEQ ID NO: 3224751 - DNA, 14 bp, Homo sapiens
tcctcagcttatct

SEQ ID NO: 3224752 - DNA, 15 bp, Homo sapiens
tcctcaggaattcca

SEQ ID NO: 3224753 - DNA, 17 bp, Homo sapiens
tcctcagggtggggggt

SEQ ID NO: 3224754 - DNA, 22 bp, Homo sapiens
tcctcagtaacatttctgttct

SEQ ID NO: 3224755 - DNA, 17 bp, Homo sapiens
tcctcagttggaatcat

SEQ ID NO: 3224756 - DNA, 22 bp, Homo sapiens
tcctcatagtatggtggctggg

SEQ ID NO: 3224757 - DNA, 17 bp, Homo sapiens
tcctcatccaccccatc

SEQ ID NO: 3224758 - DNA, 14 bp, Homo sapiens
tcctcatcccgtgt

SEQ ID NO: 3224759 - DNA, 22 bp, Homo sapiens
tcctcatggcagcctactctcc

SEQ ID NO: 3224760 - DNA, 20 bp, Homo sapiens
tcctcatggtgcatataaat

SEQ ID NO: 3224761 - DNA, 20 bp, Homo sapiens
tcctcatgtaacattggtga

SEQ ID NO: 3224762 - DNA, 18 bp, Homo sapiens
tcctcatgttactcagtg

SEQ ID NO: 3224763 - DNA, 16 bp, Homo sapiens
tcctcattataaaatg

SEQ ID NO: 3224764 - DNA, 15 bp, Homo sapiens
tcctcattgcctcct

SEQ ID NO: 3224765 - DNA, 14 bp, Homo sapiens
tctccttgactgcc

SEQ ID NO: 3224766 - DNA, 13 bp, Homo sapiens
tctccttgcccta

SEQ ID NO: 3224767 - DNA, 22 bp, Homo sapiens
tctccttgggctcctggctgcc

SEQ ID NO: 3224768 - DNA, 23 bp, Homo sapiens
tctccttgggctcctggctgcca

SEQ ID NO: 3224769 - DNA, 17 bp, Homo sapiens
tctcctttgcaatagca

SEQ ID NO: 3224770 - DNA, 19 bp, Homo sapiens
tctcctttgcaatagcagt

SEQ ID NO: 3224771 - DNA, 21 bp, Homo sapiens
tctcctttgcaatagcagtta

SEQ ID NO: 3224772 - DNA, 21 bp, Homo sapiens
tctcctttgcactgagggcca

SEQ ID NO: 3224773 - DNA, 23 bp, Homo sapiens
tctcctttgcactgagggccaca

SEQ ID NO: 3224774 - DNA, 17 bp, Homo sapiens
tctcctttgctcttgcc

SEQ ID NO: 3224775 - DNA, 22 bp, Homo sapiens
tctccttttacttcacttcaaa

SEQ ID NO: 3224776 - DNA, 17 bp, Homo sapiens
tctccttttcctctctc

SEQ ID NO: 3224777 - DNA, 19 bp, Homo sapiens
tctccttttcctctctccc

SEQ ID NO: 3224778 - DNA, 22 bp, Homo sapiens
tctccttttcttttgttactgt

SEQ ID NO: 3224779 - DNA, 23 bp, Homo sapiens
tctccttttcttttgttactgtt

SEQ ID NO: 3224780 - DNA, 15 bp, Homo sapiens
tctccttttgactcc

SEQ ID NO: 3224781 - DNA, 23 bp, Homo sapiens
tctccttttgaggcttctccttc

SEQ ID NO: 3224782 - DNA, 20 bp, Homo sapiens
tctcttagctactgtatgca

SEQ ID NO: 3224783 - DNA, 22 bp, Homo sapiens
tctcttagctactgtatgcaaa

SEQ ID NO: 3224784 - DNA, 17 bp, Homo sapiens
tctcttatagaatattt

SEQ ID NO: 3224785 - DNA, 18 bp, Homo sapiens
tctcttatagaatattta

SEQ ID NO: 3224786 - DNA, 14 bp, Homo sapiens
tctcttcaggttct

SEQ ID NO: 3224787 - DNA, 14 bp, Homo sapiens
tctcttcatacttt

SEQ ID NO: 3224788 - DNA, 16 bp, Homo sapiens
tctcttcattcaaact

SEQ ID NO: 3224789 - DNA, 12 bp, Homo sapiens
tctcttcccttt

SEQ ID NO: 3224790 - DNA, 22 bp, Homo sapiens
tctcttccttcggtcttttgta

SEQ ID NO: 3224791 - DNA, 15 bp, Homo sapiens
tctcttctccactgg

SEQ ID NO: 3224792 - DNA, 16 bp, Homo sapiens
tctcttctccactgga

SEQ ID NO: 3224793 - DNA, 16 bp, Homo sapiens
tctcttctctccagct

SEQ ID NO: 3224794 - DNA, 21 bp, Homo sapiens
tctcttctgagctatttcatc

SEQ ID NO: 3224795 - DNA, 14 bp, Homo sapiens
tctcttctgctcca

SEQ ID NO: 3224796 - DNA, 16 bp, Homo sapiens
tctcttctgctccacc

SEQ ID NO: 3224797 - DNA, 17 bp, Homo sapiens
tctcttctgctccaccc

SEQ ID NO: 3224798 - DNA, 21 bp, Homo sapiens
tctcttcttactcattactgc

SEQ ID NO: 3224799 - DNA, 22 bp, Homo sapiens
tctcttcttactcattactgca

SEQ ID NO: 3224800 - DNA, 12 bp, Homo sapiens
tctcttcttgtt

SEQ ID NO: 3224801 - DNA, 16 bp, Homo sapiens
tctcttcttttggctt

SEQ ID NO: 3224802 - DNA, 14 bp, Homo sapiens
tctcttgagctggc

SEQ ID NO: 3224803 - DNA, 17 bp, Homo sapiens
tctcttgagctggcctc

SEQ ID NO: 3224804 - DNA, 12 bp, Homo sapiens
tctcttgcaccc

SEQ ID NO: 3224805 - DNA, 22 bp, Homo sapiens
tctcttgccgaggagccaggca

SEQ ID NO: 3224806 - DNA, 15 bp, Homo sapiens
tctcttgcttgtcat

SEQ ID NO: 3224807 - DNA, 13 bp, Homo sapiens
tctcttgtagaag

SEQ ID NO: 3224808 - DNA, 21 bp, Homo sapiens
tctctttaagggcatgccttg

SEQ ID NO: 3224809 - DNA, 23 bp, Homo sapiens
tctctttagtataattgacctac

SEQ ID NO: 3224810 - DNA, 16 bp, Homo sapiens
tctctttatacagctg

SEQ ID NO: 3224811 - DNA, 14 bp, Homo sapiens
tctctttctctcct

SEQ ID NO: 3224812 - DNA, 17 bp, Homo sapiens
tctctttctctcttccc

SEQ ID NO: 3224813 - DNA, 19 bp, Homo sapiens
tctctttctctcttccctc

SEQ ID NO: 3224814 - DNA, 15 bp, Homo sapiens
tctctttcttccttt

SEQ ID NO: 3224815 - DNA, 15 bp, Homo sapiens
tctctttgtctgcct

SEQ ID NO: 3224816 - DNA, 16 bp, Homo sapiens
tctctttgtggggctt

SEQ ID NO: 3224817 - DNA, 15 bp, Homo sapiens
tctcttttcaaaaca

SEQ ID NO: 3224818 - DNA, 11 bp, Homo sapiens
tctcttttcat

SEQ ID NO: 3224819 - DNA, 12 bp, Homo sapiens
tctcttttcatt

SEQ ID NO: 3224820 - DNA, 13 bp, Homo sapiens
tctcttttccccg

SEQ ID NO: 3224821 - DNA, 19 bp, Homo sapiens
tctcttttccccgcctgca

SEQ ID NO: 3224822 - DNA, 12 bp, Homo sapiens
tctcttttctct

SEQ ID NO: 3224823 - DNA, 16 bp, Homo sapiens
tctcttttctctttct

SEQ ID NO: 3224824 - DNA, 19 bp, Homo sapiens
tctcttttctttagagcat

SEQ ID NO: 3224825 - DNA, 20 bp, Homo sapiens
tctcttttgaggtccctgta

SEQ ID NO: 3224826 - DNA, 18 bp, Homo sapiens
tctcttttgctttctgtt

SEQ ID NO: 3224827 - DNA, 13 bp, Homo sapiens
tctctttttggag

SEQ ID NO: 3224828 - DNA, 23 bp, Homo sapiens
tctgaaaaattcctttgtgtttc

SEQ ID NO: 3224829 - DNA, 21 bp, Homo sapiens
tctgaaaagcaattgccctgt

SEQ ID NO: 3224830 - DNA, 13 bp, Homo sapiens
tctgaaaatgtga

SEQ ID NO: 3224831 - DNA, 22 bp, Homo sapiens
tctgaaaattccagaaaggata

SEQ ID NO: 3224832 - DNA, 20 bp, Homo sapiens
tctgaaacacactgaaagct

SEQ ID NO: 3224833 - DNA, 14 bp, Homo sapiens
tctgaaatctcctt

SEQ ID NO: 3224834 - DNA, 16 bp, Homo sapiens
tctgaaatctgaagac

SEQ ID NO: 3224835 - DNA, 14 bp, Homo sapiens
tctgaaattctaaa

SEQ ID NO: 3224836 - DNA, 13 bp, Homo sapiens
tctgaactctcaa

SEQ ID NO: 3224837 - DNA, 18 bp, Homo sapiens
tctgaacttgcattgtga

SEQ ID NO: 3224838 - DNA, 12 bp, Homo sapiens
tctgaacttgcc

SEQ ID NO: 3224839 - DNA, 22 bp, Homo sapiens
tctgaagacctcgagcagatga

SEQ ID NO: 3224840 - DNA, 17 bp, Homo sapiens
tctgaagaggcttctcc

SEQ ID NO: 3224841 - DNA, 15 bp, Homo sapiens
tctgaagatatattt

SEQ ID NO: 3224842 - DNA, 18 bp, Homo sapiens
tctgaagatatatttcac

SEQ ID NO: 3224843 - DNA, 20 bp, Homo sapiens
tctgaagatatatttcactt

SEQ ID NO: 3224844 - DNA, 22 bp, Homo sapiens
tctgaagatatatttcactttt

SEQ ID NO: 3224845 - DNA, 19 bp, Homo sapiens
tctgaagatcagaacattc

SEQ ID NO: 3224846 - DNA, 23 bp, Homo sapiens
tctgaagatcagaacattcagct

SEQ ID NO: 3224847 - DNA, 14 bp, Homo sapiens
tctgaagcatgttt

SEQ ID NO: 3224848 - DNA, 18 bp, Homo sapiens
tctgaagccctcccaggt

SEQ ID NO: 3224849 - DNA, 17 bp, Homo sapiens
tctgaagcttgactccc

SEQ ID NO: 3224850 - DNA, 13 bp, Homo sapiens
tctgaaggaagag

SEQ ID NO: 3224851 - DNA, 15 bp, Homo sapiens
tctgaaggaagagaa

SEQ ID NO: 3224852 - DNA, 16 bp, Homo sapiens
tctgaaggaagagaag

SEQ ID NO: 3224853 - DNA, 19 bp, Homo sapiens
tctgaaggaagagaagaca

SEQ ID NO: 3224854 - DNA, 18 bp, Homo sapiens
tctgaataaagtgtaaca

SEQ ID NO: 3224855 - DNA, 13 bp, Homo sapiens
tctgaataacttg

SEQ ID NO: 3224856 - DNA, 13 bp, Homo sapiens
tctgaatcctaag

SEQ ID NO: 3224857 - DNA, 18 bp, Homo sapiens
tctgaatgaaaataactg

SEQ ID NO: 3224858 - DNA, 22 bp, Homo sapiens
tctgaatgaaaataactgaacc

SEQ ID NO: 3224859 - DNA, 13 bp, Homo sapiens
tctgaatgctgcc

SEQ ID NO: 3224860 - DNA, 13 bp, Homo sapiens
tctgaatgctgct

SEQ ID NO: 3224861 - DNA, 14 bp, Homo sapiens
tctgaatgttctga

SEQ ID NO: 3224862 - DNA, 17 bp, Homo sapiens
tctgaatgttctgacat

SEQ ID NO: 3224863 - DNA, 19 bp, Homo sapiens
tctgaatgttctgacatta

SEQ ID NO: 3224864 - DNA, 16 bp, Homo sapiens
tctgaattcaaagctt

SEQ ID NO: 3224865 - DNA, 20 bp, Homo sapiens
tctgaattcaaagcttgtga

SEQ ID NO: 3224866 - DNA, 22 bp, Homo sapiens
tctgaattcaaagcttgtgaaa

SEQ ID NO: 3224867 - DNA, 20 bp, Homo sapiens
tctgacaagggctgacctgc

SEQ ID NO: 3224868 - DNA, 13 bp, Homo sapiens
tctgacacaaaaa

SEQ ID NO: 3224869 - DNA, 13 bp, Homo sapiens
tctgacacacagc

SEQ ID NO: 3224870 - DNA, 16 bp, Homo sapiens
tctgacacacagctct

SEQ ID NO: 3224871 - DNA, 19 bp, Homo sapiens
tctgacatcccttcctgga

SEQ ID NO: 3224872 - DNA, 17 bp, Homo sapiens
tctgacatgcattgttg

SEQ ID NO: 3224873 - DNA, 21 bp, Homo sapiens
tctgacattaacagttttcca

SEQ ID NO: 3224874 - DNA, 22 bp, Homo sapiens
tctgacattaacagttttccat

SEQ ID NO: 3224875 - DNA, 15 bp, Homo sapiens
tctgacatttatatt

SEQ ID NO: 3224876 - DNA, 15 bp, Homo sapiens
tctgacccagtgaga

SEQ ID NO: 3224877 - DNA, 19 bp, Homo sapiens
tctgaccctgcttcaaata

SEQ ID NO: 3224878 - DNA, 23 bp, Homo sapiens
tctgacccttgggcctgggcctc

SEQ ID NO: 3224879 - DNA, 17 bp, Homo sapiens
tctgacctgcaggccaa

SEQ ID NO: 3224880 - DNA, 20 bp, Homo sapiens
tctgacgaaggtcctaaggg

SEQ ID NO: 3224881 - DNA, 14 bp, Homo sapiens
tctgacggccctgc

SEQ ID NO: 3224882 - DNA, 15 bp, Homo sapiens
tctgacggccctgca

SEQ ID NO: 3224883 - DNA, 17 bp, Homo sapiens
tctgacggccctgcaat

SEQ ID NO: 3224884 - DNA, 23 bp, Homo sapiens
tctgactagattattatttgggg

SEQ ID NO: 3224885 - DNA, 23 bp, Homo sapiens
tctgactcaggcgcctggcacat

SEQ ID NO: 3224886 - DNA, 16 bp, Homo sapiens
tctgactccagagtct

SEQ ID NO: 3224887 - DNA, 17 bp, Homo sapiens
tctgactccagagtctg

SEQ ID NO: 3224888 - DNA, 19 bp, Homo sapiens
tctgactccagagtctgag

SEQ ID NO: 3224889 - DNA, 20 bp, Homo sapiens
tctgactccagagtctgagc

SEQ ID NO: 3224890 - DNA, 22 bp, Homo sapiens
tctgactccagagtctgagccc

SEQ ID NO: 3224891 - DNA, 13 bp, Homo sapiens
tctgactctgagt

SEQ ID NO: 3224892 - DNA, 23 bp, Homo sapiens
tctgactgccaagccagattctc

SEQ ID NO: 3224893 - DNA, 14 bp, Homo sapiens
tctgacttcctctg

SEQ ID NO: 3224894 - DNA, 14 bp, Homo sapiens
tctgacttctgcct

SEQ ID NO: 3224895 - DNA, 15 bp, Homo sapiens
tctgacttctgtggt

SEQ ID NO: 3224896 - DNA, 16 bp, Homo sapiens
tctgagaactgacttt

SEQ ID NO: 3224897 - DNA, 11 bp, Homo sapiens
tctgagaagac

SEQ ID NO: 3224898 - DNA, 15 bp, Homo sapiens
tctgagaagaggagc

SEQ ID NO: 3224899 - DNA, 16 bp, Homo sapiens
tctgagaagctctgaa

SEQ ID NO: 3224900 - DNA, 17 bp, Homo sapiens
tcctgctcctccctgcc

SEQ ID NO: 3224901 - DNA, 19 bp, Homo sapiens
tcctgctcctccctgcccc

SEQ ID NO: 3224902 - DNA, 20 bp, Homo sapiens
tcctgctcctccctgccccc

SEQ ID NO: 3224903 - DNA, 21 bp, Homo sapiens
tcctgctgctgtaactgctga

SEQ ID NO: 3224904 - DNA, 23 bp, Homo sapiens
tcctgctgctgtaactgctgagc

SEQ ID NO: 3224905 - DNA, 10 bp, Homo sapiens
tcctgctggg

SEQ ID NO: 3224906 - DNA, 23 bp, Homo sapiens
tcctgctggtacctgccctctat

SEQ ID NO: 3224907 - DNA, 19 bp, Homo sapiens
tcctgctgtagtcctttct

SEQ ID NO: 3224908 - DNA, 13 bp, Homo sapiens
tcctggaaacagc

SEQ ID NO: 3224909 - DNA, 14 bp, Homo sapiens
tcctggaaacagca

SEQ ID NO: 3224910 - DNA, 23 bp, Homo sapiens
tcctggaaagactgattgtttta

SEQ ID NO: 3224911 - DNA, 19 bp, Homo sapiens
tcctggaaaggctcagtct

SEQ ID NO: 3224912 - DNA, 19 bp, Homo sapiens
tcctggaaccttgctgtcc

SEQ ID NO: 3224913 - DNA, 22 bp, Homo sapiens
tcctggaaccttgctgtcctga

SEQ ID NO: 3224914 - DNA, 18 bp, Homo sapiens
tcctggaagcaggtgcta

SEQ ID NO: 3224915 - DNA, 20 bp, Homo sapiens
tcctggaagcaggtgctaca

SEQ ID NO: 3224916 - DNA, 15 bp, Homo sapiens
tcctggacatcacca

SEQ ID NO: 3224917 - DNA, 21 bp, Homo sapiens
tcctggacatcctcttctgct

SEQ ID NO: 3224918 - DNA, 23 bp, Homo sapiens
tcctggagtgatatgatccagag

SEQ ID NO: 3224919 - DNA, 22 bp, Homo sapiens
tcctggcaatagtgtgttctga

SEQ ID NO: 3224920 - DNA, 14 bp, Homo sapiens
tcctggcacccggc

SEQ ID NO: 3224921 - DNA, 16 bp, Homo sapiens
tcctggcacccggccc

SEQ ID NO: 3224922 - DNA, 19 bp, Homo sapiens
tcctggcacccggcccctg

SEQ ID NO: 3224923 - DNA, 21 bp, Homo sapiens
tcctggcacccggcccctgct

SEQ ID NO: 3224924 - DNA, 19 bp, Homo sapiens
tcctggcagcccagagact

SEQ ID NO: 3224925 - DNA, 18 bp, Homo sapiens
tcctggccagacgctgcc

SEQ ID NO: 3224926 - DNA, 16 bp, Homo sapiens
tcctggccctccactc

SEQ ID NO: 3224927 - DNA, 18 bp, Homo sapiens
tcctggcctatccgctgc

SEQ ID NO: 3224928 - DNA, 23 bp, Homo sapiens
tcctggcctatccgctgccagcc

SEQ ID NO: 3224929 - DNA, 22 bp, Homo sapiens
tcctggcctcaagtgatctgcc

SEQ ID NO: 3224930 - DNA, 18 bp, Homo sapiens
tcctggctacatcccagc

SEQ ID NO: 3224931 - DNA, 16 bp, Homo sapiens
tcctggctcctgaggg

SEQ ID NO: 3224932 - DNA, 23 bp, Homo sapiens
tcctggctcttgatacccccctc

SEQ ID NO: 3224933 - DNA, 13 bp, Homo sapiens
tcctggctgccag

SEQ ID NO: 3224934 - DNA, 15 bp, Homo sapiens
tcctggctgccaggc

SEQ ID NO: 3224935 - DNA, 19 bp, Homo sapiens
tcctgggagaacctcaggc

SEQ ID NO: 3224936 - DNA, 19 bp, Homo sapiens
tcctgggaggacaggcagg

SEQ ID NO: 3224937 - DNA, 18 bp, Homo sapiens
tcctgggagtgagctggt

SEQ ID NO: 3224938 - DNA, 14 bp, Homo sapiens
tcctgggcctgccc

SEQ ID NO: 3224939 - DNA, 15 bp, Homo sapiens
tcctgggcctgtccc

SEQ ID NO: 3224940 - DNA, 13 bp, Homo sapiens
tcctgggcctttg

SEQ ID NO: 3224941 - DNA, 13 bp, Homo sapiens
tcctgggctcagg

SEQ ID NO: 3224942 - DNA, 23 bp, Homo sapiens
tcctggggaccccactccctgct

SEQ ID NO: 3224943 - DNA, 20 bp, Homo sapiens
tcctggggcagcactcccca

SEQ ID NO: 3224944 - DNA, 18 bp, Homo sapiens
tcctggggccccgctggg

SEQ ID NO: 3224945 - DNA, 20 bp, Homo sapiens
tcctggggccccgctgggat

SEQ ID NO: 3224946 - DNA, 21 bp, Homo sapiens
tcctggggccccgctgggatt

SEQ ID NO: 3224947 - DNA, 15 bp, Homo sapiens
tcctggggctctgtg

SEQ ID NO: 3224948 - DNA, 21 bp, Homo sapiens
tcctgggggttctttcttcct

SEQ ID NO: 3224949 - DNA, 20 bp, Homo sapiens
tcgcaggatccgctgccacc

SEQ ID NO: 3224950 - DNA, 19 bp, Homo sapiens
tcgcatggtcacacactga

SEQ ID NO: 3224951 - DNA, 12 bp, Homo sapiens
tcgccagcttct

SEQ ID NO: 3224952 - DNA, 15 bp, Homo sapiens
tcgccagcttctcct

SEQ ID NO: 3224953 - DNA, 17 bp, Homo sapiens
tcgccagcttctcctgc

SEQ ID NO: 3224954 - DNA, 18 bp, Homo sapiens
tcgccagcttctcctgcg

SEQ ID NO: 3224955 - DNA, 11 bp, Homo sapiens
tcgcccagcag

SEQ ID NO: 3224956 - DNA, 14 bp, Homo sapiens
tcgcccagcaggag

SEQ ID NO: 3224957 - DNA, 13 bp, Homo sapiens
tcgcccaggaagg

SEQ ID NO: 3224958 - DNA, 13 bp, Homo sapiens
tcgccccacctcc

SEQ ID NO: 3224959 - DNA, 23 bp, Homo sapiens
tcgccccacctccacctgtgaga

SEQ ID NO: 3224960 - DNA, 18 bp, Homo sapiens
tcgccccagatcaccagc

SEQ ID NO: 3224961 - DNA, 20 bp, Homo sapiens
tcgccccaggccctccctga

SEQ ID NO: 3224962 - DNA, 18 bp, Homo sapiens
tcgcctccccaccctcct

SEQ ID NO: 3224963 - DNA, 11 bp, Homo sapiens
tcgcctgacaa

SEQ ID NO: 3224964 - DNA, 15 bp, Homo sapiens
tcgcctgagcccagg

SEQ ID NO: 3224965 - DNA, 20 bp, Homo sapiens
tcgcctgtggagctcagccc

SEQ ID NO: 3224966 - DNA, 20 bp, Homo sapiens
tcgcctttgtcttgtacttc

SEQ ID NO: 3224967 - DNA, 23 bp, Homo sapiens
tcgcctttgtcttgtacttctgt

SEQ ID NO: 3224968 - DNA, 19 bp, Homo sapiens
tcgcgagcacatgttcata

SEQ ID NO: 3224969 - DNA, 20 bp, Homo sapiens
tcgcgccccccgcgcccctc

SEQ ID NO: 3224970 - DNA, 19 bp, Homo sapiens
tcgcgcccgcccctgcagc

SEQ ID NO: 3224971 - DNA, 18 bp, Homo sapiens
tcgctcaatcaagaaaat

SEQ ID NO: 3224972 - DNA, 21 bp, Homo sapiens
tcgctccctgtagctctgcct

SEQ ID NO: 3224973 - DNA, 14 bp, Homo sapiens
tcgctcctgcccac

SEQ ID NO: 3224974 - DNA, 15 bp, Homo sapiens
tcgctctgctggcct

SEQ ID NO: 3224975 - DNA, 20 bp, Homo sapiens
tcgctctgctggcctggccg

SEQ ID NO: 3224976 - DNA, 14 bp, Homo sapiens
tcgctctgggatgc

SEQ ID NO: 3224977 - DNA, 11 bp, Homo sapiens
tcgctgaaagc

SEQ ID NO: 3224978 - DNA, 16 bp, Homo sapiens
tcgctgacttcatgga

SEQ ID NO: 3224979 - DNA, 19 bp, Homo sapiens
tcgctgccatcaccgctgg

SEQ ID NO: 3224980 - DNA, 18 bp, Homo sapiens
tcgctgtcactggctggc

SEQ ID NO: 3224981 - DNA, 19 bp, Homo sapiens
tcgctgtcactggctggct

SEQ ID NO: 3224982 - DNA, 18 bp, Homo sapiens
tcgctgttggagcaaacc

SEQ ID NO: 3224983 - DNA, 16 bp, Homo sapiens
tcgcttatatgtcctt

SEQ ID NO: 3224984 - DNA, 20 bp, Homo sapiens
tcgcttatatgtccttgggt

SEQ ID NO: 3224985 - DNA, 14 bp, Homo sapiens
tcgcttcccccata

SEQ ID NO: 3224986 - DNA, 14 bp, Homo sapiens
tcgcttcttgcctc

SEQ ID NO: 3224987 - DNA, 21 bp, Homo sapiens
tcgcttcttgcctctgtgctg

SEQ ID NO: 3224988 - DNA, 13 bp, Homo sapiens
tcgcttgagccca

SEQ ID NO: 3224989 - DNA, 17 bp, Homo sapiens
tcgcttgtaaataccag

SEQ ID NO: 3224990 - DNA, 19 bp, Homo sapiens
tcgctttattggctgagat

SEQ ID NO: 3224991 - DNA, 23 bp, Homo sapiens
tcgcttttattttaatattgatg

SEQ ID NO: 3224992 - DNA, 15 bp, Homo sapiens
tcggaaatcttaaac

SEQ ID NO: 3224993 - DNA, 17 bp, Homo sapiens
tcggaaccgctcaccta

SEQ ID NO: 3224994 - DNA, 22 bp, Homo sapiens
tcggaaccgctcacctagagcc

SEQ ID NO: 3224995 - DNA, 13 bp, Homo sapiens
tcggaagcagtgc

SEQ ID NO: 3224996 - DNA, 15 bp, Homo sapiens
tcggaagcagtgcct

SEQ ID NO: 3224997 - DNA, 22 bp, Homo sapiens
tcggaagcagtgccttccataa

SEQ ID NO: 3224998 - DNA, 23 bp, Homo sapiens
tcggaagcagtgccttccataat

SEQ ID NO: 3224999 - DNA, 20 bp, Homo sapiens
tcggaagccgtctgactcca

SEQ ID NO: 3225000 - DNA, 21 bp, Homo sapiens
tcggacaagacccccagcact

SEQ ID NO: 3225001 - DNA, 18 bp, Homo sapiens
tcggacagtgcccatgca

SEQ ID NO: 3225002 - DNA, 18 bp, Homo sapiens
tcggagaaattctcttta

SEQ ID NO: 3225003 - DNA, 21 bp, Homo sapiens
tcggagacagtgatctccata

SEQ ID NO: 3225004 - DNA, 18 bp, Homo sapiens
tcggagactatggcctcg

SEQ ID NO: 3225005 - DNA, 20 bp, Homo sapiens
tcggagaggctgtctggggc

SEQ ID NO: 3225006 - DNA, 20 bp, Homo sapiens
tcggagcgttctctgtccta

SEQ ID NO: 3225007 - DNA, 12 bp, Homo sapiens
tcggaggcccca

SEQ ID NO: 3225008 - DNA, 20 bp, Homo sapiens
tcggaggccccaaaggaaaa

SEQ ID NO: 3225009 - DNA, 17 bp, Homo sapiens
tcggaggccccactgat

SEQ ID NO: 3225010 - DNA, 13 bp, Homo sapiens
tcggaggctgggc

SEQ ID NO: 3225011 - DNA, 15 bp, Homo sapiens
tcggaggctgggccc

SEQ ID NO: 3225012 - DNA, 18 bp, Homo sapiens
tcggaggctgggcccctg

SEQ ID NO: 3225013 - DNA, 13 bp, Homo sapiens
tcggatgaccaaa

SEQ ID NO: 3225014 - DNA, 23 bp, Homo sapiens
tcggatgaccaaaccagccttcg

SEQ ID NO: 3225015 - DNA, 12 bp, Homo sapiens
tcggatggggca

SEQ ID NO: 3225016 - DNA, 18 bp, Homo sapiens
tcggcaggaaggagcggc

SEQ ID NO: 3225017 - DNA, 19 bp, Homo sapiens
tcggcaggaaggagcggcg

SEQ ID NO: 3225018 - DNA, 13 bp, Homo sapiens
tcggccctgccca

SEQ ID NO: 3225019 - DNA, 20 bp, Homo sapiens
tcggcgggcttttctggggc

SEQ ID NO: 3225020 - DNA, 20 bp, Homo sapiens
tcggctcaggctctgctggt

SEQ ID NO: 3225021 - DNA, 19 bp, Homo sapiens
tcggctccccatgtgtcct

SEQ ID NO: 3225022 - DNA, 19 bp, Homo sapiens
tcggctggggactgctacc

SEQ ID NO: 3225023 - DNA, 16 bp, Homo sapiens
tcggcttgtgggctgg

SEQ ID NO: 3225024 - DNA, 17 bp, Homo sapiens
tcggcttgtgggctggt

SEQ ID NO: 3225025 - DNA, 15 bp, Homo sapiens
tcgggaacagtgttt

SEQ ID NO: 3225026 - DNA, 21 bp, Homo sapiens
tcgggagacagcatcagggtt

SEQ ID NO: 3225027 - DNA, 16 bp, Homo sapiens
tcgggagcacccagag

SEQ ID NO: 3225028 - DNA, 18 bp, Homo sapiens
tcgggagcacccagagca

SEQ ID NO: 3225029 - DNA, 16 bp, Homo sapiens
tcgggagcagtgtctt

SEQ ID NO: 3225030 - DNA, 14 bp, Homo sapiens
tcgggcccacctgg

SEQ ID NO: 3225031 - DNA, 13 bp, Homo sapiens
tcgggctgtgccc

SEQ ID NO: 3225032 - DNA, 16 bp, Homo sapiens
tcggggcatgctgggg

SEQ ID NO: 3225033 - DNA, 12 bp, Homo sapiens
tcggggccctgt

SEQ ID NO: 3225034 - DNA, 19 bp, Homo sapiens
tcggggggtcacaggccca

SEQ ID NO: 3225035 - DNA, 16 bp, Homo sapiens
tcggtagcagaggccc

SEQ ID NO: 3225036 - DNA, 16 bp, Homo sapiens
tcggtcttttgtattt

SEQ ID NO: 3225037 - DNA, 13 bp, Homo sapiens
tcgtaaagatttg

SEQ ID NO: 3225038 - DNA, 19 bp, Homo sapiens
tctaattttggataatatt

SEQ ID NO: 3225039 - DNA, 15 bp, Homo sapiens
tctaattttggatgg

SEQ ID NO: 3225040 - DNA, 14 bp, Homo sapiens
tctaatttttaaga

SEQ ID NO: 3225041 - DNA, 16 bp, Homo sapiens
tctaatttttaagcaa

SEQ ID NO: 3225042 - DNA, 21 bp, Homo sapiens
tctacaaaaaggtataaataa

SEQ ID NO: 3225043 - DNA, 17 bp, Homo sapiens
tctacaagtatatgtga

SEQ ID NO: 3225044 - DNA, 19 bp, Homo sapiens
tctacaagtatatgtgaaa

SEQ ID NO: 3225045 - DNA, 21 bp, Homo sapiens
tctacaagtatatgtgaaaaa

SEQ ID NO: 3225046 - DNA, 16 bp, Homo sapiens
tctacaatgacacaca

SEQ ID NO: 3225047 - DNA, 23 bp, Homo sapiens
tctacacacaccagtggcagctg

SEQ ID NO: 3225048 - DNA, 17 bp, Homo sapiens
tctacagaataatccag

SEQ ID NO: 3225049 - DNA, 23 bp, Homo sapiens
tctacagaataatccagtattgc

SEQ ID NO: 3225050 - DNA, 22 bp, Homo sapiens
tctacagatcctttttccatca

SEQ ID NO: 3225051 - DNA, 22 bp, Homo sapiens
tctacagtggttttatactgaa

SEQ ID NO: 3225052 - DNA, 20 bp, Homo sapiens
tctacataagtaattcaaga

SEQ ID NO: 3225053 - DNA, 22 bp, Homo sapiens
tctacattaacttgaaaatttt

SEQ ID NO: 3225054 - DNA, 11 bp, Homo sapiens
tctacatttaa

SEQ ID NO: 3225055 - DNA, 19 bp, Homo sapiens
tctacatttaaacaagtat

SEQ ID NO: 3225056 - DNA, 11 bp, Homo sapiens
tctacatttca

SEQ ID NO: 3225057 - DNA, 22 bp, Homo sapiens
tctacatttcacattattctgg

SEQ ID NO: 3225058 - DNA, 20 bp, Homo sapiens
tctacatttctgcagatctt

SEQ ID NO: 3225059 - DNA, 14 bp, Homo sapiens
tctacatttcttag

SEQ ID NO: 3225060 - DNA, 16 bp, Homo sapiens
tctacatttgagggcc

SEQ ID NO: 3225061 - DNA, 18 bp, Homo sapiens
tctacatttgagggccca

SEQ ID NO: 3225062 - DNA, 17 bp, Homo sapiens
tctaccaaataatttca

SEQ ID NO: 3225063 - DNA, 14 bp, Homo sapiens
tctaccatttcaga

SEQ ID NO: 3225064 - DNA, 14 bp, Homo sapiens
tctacccaaaccct

SEQ ID NO: 3225065 - DNA, 22 bp, Homo sapiens
tctacccaaaccctaggttccc

SEQ ID NO: 3225066 - DNA, 21 bp, Homo sapiens
tctacccagtgctccagtttc

SEQ ID NO: 3225067 - DNA, 15 bp, Homo sapiens
tctacccatattaca

SEQ ID NO: 3225068 - DNA, 18 bp, Homo sapiens
tctaccccagactagatg

SEQ ID NO: 3225069 - DNA, 14 bp, Homo sapiens
tctacccctttctt

SEQ ID NO: 3225070 - DNA, 18 bp, Homo sapiens
tctacccctttcttctcg

SEQ ID NO: 3225071 - DNA, 17 bp, Homo sapiens
tctaccctgctccctgc

SEQ ID NO: 3225072 - DNA, 14 bp, Homo sapiens
tctaccctggcact

SEQ ID NO: 3225073 - DNA, 19 bp, Homo sapiens
tctaccctggcactataat

SEQ ID NO: 3225074 - DNA, 21 bp, Homo sapiens
tctaccctggcactataatgt

SEQ ID NO: 3225075 - DNA, 15 bp, Homo sapiens
tctacctcaggcagc

SEQ ID NO: 3225076 - DNA, 19 bp, Homo sapiens
tctacctcaggcagctcaa

SEQ ID NO: 3225077 - DNA, 17 bp, Homo sapiens
tctacctccttagcttt

SEQ ID NO: 3225078 - DNA, 13 bp, Homo sapiens
tctacctctgact

SEQ ID NO: 3225079 - DNA, 17 bp, Homo sapiens
tctacctgctggacagc

SEQ ID NO: 3225080 - DNA, 23 bp, Homo sapiens
tctacctgctggacagcctccgc

SEQ ID NO: 3225081 - DNA, 16 bp, Homo sapiens
tctaccttgaggtctt

SEQ ID NO: 3225082 - DNA, 15 bp, Homo sapiens
tctactaagttattt

SEQ ID NO: 3225083 - DNA, 20 bp, Homo sapiens
tctactaagttattttatga

SEQ ID NO: 3225084 - DNA, 21 bp, Homo sapiens
tctactcagaaatttttattt

SEQ ID NO: 3225085 - DNA, 19 bp, Homo sapiens
tctactctgtcttaaatga

SEQ ID NO: 3225086 - DNA, 15 bp, Homo sapiens
tctactctttttgtt

SEQ ID NO: 3225087 - DNA, 18 bp, Homo sapiens
tctactgaggtgctatgt

SEQ ID NO: 3225088 - DNA, 19 bp, Homo sapiens
tctactgaggtgctatgtt

SEQ ID NO: 3225089 - DNA, 22 bp, Homo sapiens
tctactgaggtgctatgttctt

SEQ ID NO: 3225090 - DNA, 18 bp, Homo sapiens
tctactggagtggaaggt

SEQ ID NO: 3225091 - DNA, 20 bp, Homo sapiens
tctactgtaagaagagccat

SEQ ID NO: 3225092 - DNA, 15 bp, Homo sapiens
tctactgtacttttt

SEQ ID NO: 3225093 - DNA, 13 bp, Homo sapiens
tctacttaataaa

SEQ ID NO: 3225094 - DNA, 21 bp, Homo sapiens
tctacttaatccaatgggttt

SEQ ID NO: 3225095 - DNA, 14 bp, Homo sapiens
tctacttggtggtt

SEQ ID NO: 3225096 - DNA, 21 bp, Homo sapiens
tctactttattaattgttttg

SEQ ID NO: 3225097 - DNA, 20 bp, Homo sapiens
tctagaaccacttcctgcta

SEQ ID NO: 3225098 - DNA, 21 bp, Homo sapiens
tctagaaccttctagaacctg

SEQ ID NO: 3225099 - DNA, 18 bp, Homo sapiens
tctagaacttgaccccct

SEQ ID NO: 3225100 - DNA, 20 bp, Homo sapiens
tctagaagactgtcagcttc

SEQ ID NO: 3225101 - DNA, 21 bp, Homo sapiens
tctagaagactgtcagcttcc

SEQ ID NO: 3225102 - DNA, 13 bp, Homo sapiens
tctagaagataac

SEQ ID NO: 3225103 - DNA, 18 bp, Homo sapiens
tctagaagataacatttt

SEQ ID NO: 3225104 - DNA, 17 bp, Homo sapiens
tctagaagccaagggaa

SEQ ID NO: 3225105 - DNA, 21 bp, Homo sapiens
tctagaagccaagggaaaggg

SEQ ID NO: 3225106 - DNA, 20 bp, Homo sapiens
tctagaagtttcccttcctc

SEQ ID NO: 3225107 - DNA, 17 bp, Homo sapiens
tctagaattataagtca

SEQ ID NO: 3225108 - DNA, 20 bp, Homo sapiens
tctagacatggaggttctaa

SEQ ID NO: 3225109 - DNA, 16 bp, Homo sapiens
tctagactataaatgt

SEQ ID NO: 3225110 - DNA, 13 bp, Homo sapiens
tctagactttctg

SEQ ID NO: 3225111 - DNA, 16 bp, Homo sapiens
tctagagatatatata

SEQ ID NO: 3225112 - DNA, 18 bp, Homo sapiens
tctagagatatatatact

SEQ ID NO: 3225113 - DNA, 14 bp, Homo sapiens
tctagaggcctcag

SEQ ID NO: 3225114 - DNA, 15 bp, Homo sapiens
tctagaggcctcagt

SEQ ID NO: 3225115 - DNA, 16 bp, Homo sapiens
tctagaggcctcagtt

SEQ ID NO: 3225116 - DNA, 15 bp, Homo sapiens
tctagagtcatgtga

SEQ ID NO: 3225117 - DNA, 21 bp, Homo sapiens
tctagagtcatgtgagcctcg

SEQ ID NO: 3225118 - DNA, 14 bp, Homo sapiens
tctagagttcagag

SEQ ID NO: 3225119 - DNA, 18 bp, Homo sapiens
tctagagttcagagtcct

SEQ ID NO: 3225120 - DNA, 15 bp, Homo sapiens
tctagatatcgactt

SEQ ID NO: 3225121 - DNA, 15 bp, Homo sapiens
tctagatcactgtgc

SEQ ID NO: 3225122 - DNA, 20 bp, Homo sapiens
tctagatcactgtgcttatt

SEQ ID NO: 3225123 - DNA, 14 bp, Homo sapiens
tctagatcataagg

SEQ ID NO: 3225124 - DNA, 20 bp, Homo sapiens
tctagatgaagttttacatt

SEQ ID NO: 3225125 - DNA, 21 bp, Homo sapiens
tctagatgaagttttacattg

SEQ ID NO: 3225126 - DNA, 20 bp, Homo sapiens
tctagattaatactctattt

SEQ ID NO: 3225127 - DNA, 21 bp, Homo sapiens
tctagattaccccctcattgt

SEQ ID NO: 3225128 - DNA, 13 bp, Homo sapiens
tctagattcaaag

SEQ ID NO: 3225129 - DNA, 17 bp, Homo sapiens
tctagattcaaaggttc

SEQ ID NO: 3225130 - DNA, 22 bp, Homo sapiens
tctagattcaaaggttctaggt

SEQ ID NO: 3225131 - DNA, 23 bp, Homo sapiens
tctagattcaaaggttctaggtt

SEQ ID NO: 3225132 - DNA, 19 bp, Homo sapiens
tctagattccattggtcca

SEQ ID NO: 3225133 - DNA, 22 bp, Homo sapiens
tctagattccattggtccaaga

SEQ ID NO: 3225134 - DNA, 21 bp, Homo sapiens
tctagattctctggctgtaag

SEQ ID NO: 3225135 - DNA, 17 bp, Homo sapiens
tctagcactcattttct

SEQ ID NO: 3225136 - DNA, 18 bp, Homo sapiens
tctagcactcattttcta

SEQ ID NO: 3225137 - DNA, 16 bp, Homo sapiens
tctagcagcacctcct

SEQ ID NO: 3225138 - DNA, 21 bp, Homo sapiens
tctagccaggagtctgtgctc

SEQ ID NO: 3225139 - DNA, 16 bp, Homo sapiens
tctagccgatggaaaa

SEQ ID NO: 3225140 - DNA, 17 bp, Homo sapiens
tctagccgatggaaaat

SEQ ID NO: 3225141 - DNA, 21 bp, Homo sapiens
tctagctgcagatgcctctgc

SEQ ID NO: 3225142 - DNA, 19 bp, Homo sapiens
tctagctgtatgatttgtt

SEQ ID NO: 3225143 - DNA, 17 bp, Homo sapiens
tctagcttagtttcaga

SEQ ID NO: 3225144 - DNA, 14 bp, Homo sapiens
tctaggaaatctag

SEQ ID NO: 3225145 - DNA, 21 bp, Homo sapiens
tctaggacacagttcctggga

SEQ ID NO: 3225146 - DNA, 14 bp, Homo sapiens
tctaggatagctaa

SEQ ID NO: 3225147 - DNA, 15 bp, Homo sapiens
tctaggcaagcagga

SEQ ID NO: 3225148 - DNA, 20 bp, Homo sapiens
tctaggcaagcaggacctgg

SEQ ID NO: 3225149 - DNA, 16 bp, Homo sapiens
tctaggcacaaggttg

SEQ ID NO: 3225150 - DNA, 21 bp, Homo sapiens
tctaggcactgtagttctaag

SEQ ID NO: 3225151 - DNA, 22 bp, Homo sapiens
tctaggcactgtagttctaaga

SEQ ID NO: 3225152 - DNA, 22 bp, Homo sapiens
tctagggacatgaaatttacaa

SEQ ID NO: 3225153 - DNA, 20 bp, Homo sapiens
tctaggggagaagagccctg

SEQ ID NO: 3225154 - DNA, 16 bp, Homo sapiens
tctaggtctcctcagg

SEQ ID NO: 3225155 - DNA, 18 bp, Homo sapiens
tctaggtctcctcagggt

SEQ ID NO: 3225156 - DNA, 13 bp, Homo sapiens
tctaggttataca

SEQ ID NO: 3225157 - DNA, 14 bp, Homo sapiens
tctaggttatacaa

SEQ ID NO: 3225158 - DNA, 16 bp, Homo sapiens
tctaggttatacaata

SEQ ID NO: 3225159 - DNA, 23 bp, Homo sapiens
tctaggttatacaataacccagt

SEQ ID NO: 3225160 - DNA, 14 bp, Homo sapiens
tctaggttctaaaa

SEQ ID NO: 3225161 - DNA, 23 bp, Homo sapiens
tctaggttctaaaaattgtgatc

SEQ ID NO: 3225162 - DNA, 17 bp, Homo sapiens
tctaggtttcaaagatg

SEQ ID NO: 3225163 - DNA, 18 bp, Homo sapiens
tctcactccccagcccca

SEQ ID NO: 3225164 - DNA, 13 bp, Homo sapiens
tctcactccccat

SEQ ID NO: 3225165 - DNA, 15 bp, Homo sapiens
tctcactccccatgc

SEQ ID NO: 3225166 - DNA, 16 bp, Homo sapiens
tctcactcctacctgg

SEQ ID NO: 3225167 - DNA, 15 bp, Homo sapiens
tctcactcctaggag

SEQ ID NO: 3225168 - DNA, 15 bp, Homo sapiens
tctcactcctgcctc

SEQ ID NO: 3225169 - DNA, 20 bp, Homo sapiens
tctcactccttttggtgtgt

SEQ ID NO: 3225170 - DNA, 16 bp, Homo sapiens
tctcactctgtcgccc

SEQ ID NO: 3225171 - DNA, 18 bp, Homo sapiens
tctcactctgtcgcccag

SEQ ID NO: 3225172 - DNA, 23 bp, Homo sapiens
tctcactctgtcgcccagtctgg

SEQ ID NO: 3225173 - DNA, 14 bp, Homo sapiens
tctcactgcttgaa

SEQ ID NO: 3225174 - DNA, 16 bp, Homo sapiens
tctcactgttctgcaa

SEQ ID NO: 3225175 - DNA, 19 bp, Homo sapiens
tctcactgttgcccaggct

SEQ ID NO: 3225176 - DNA, 21 bp, Homo sapiens
tctcactgttgcccaggctgg

SEQ ID NO: 3225177 - DNA, 15 bp, Homo sapiens
tctcactgtttgttt

SEQ ID NO: 3225178 - DNA, 16 bp, Homo sapiens
tctcacttcaattaat

SEQ ID NO: 3225179 - DNA, 21 bp, Homo sapiens
tctcagaaagtgcctgacaca

SEQ ID NO: 3225180 - DNA, 19 bp, Homo sapiens
tctcagaatctaaacgtgg

SEQ ID NO: 3225181 - DNA, 16 bp, Homo sapiens
tctcagactgcatgta

SEQ ID NO: 3225182 - DNA, 20 bp, Homo sapiens
tctcagacttttgtacatct

SEQ ID NO: 3225183 - DNA, 18 bp, Homo sapiens
tctcagagcatctggctg

SEQ ID NO: 3225184 - DNA, 13 bp, Homo sapiens
tctcagagccaag

SEQ ID NO: 3225185 - DNA, 14 bp, Homo sapiens
tctcagagccaagt

SEQ ID NO: 3225186 - DNA, 15 bp, Homo sapiens
tctcagagccaagtc

SEQ ID NO: 3225187 - DNA, 21 bp, Homo sapiens
tctcagaggcctgctgccagt

SEQ ID NO: 3225188 - DNA, 15 bp, Homo sapiens
tctcagagtccactg

SEQ ID NO: 3225189 - DNA, 20 bp, Homo sapiens
tctcagatatttatattttt

SEQ ID NO: 3225190 - DNA, 23 bp, Homo sapiens
tctcagatatttatatttttatt

SEQ ID NO: 3225191 - DNA, 21 bp, Homo sapiens
tctcagatgttgaaactttga

SEQ ID NO: 3225192 - DNA, 13 bp, Homo sapiens
tctcagcagaaac

SEQ ID NO: 3225193 - DNA, 16 bp, Homo sapiens
tctcagcccagaagaa

SEQ ID NO: 3225194 - DNA, 18 bp, Homo sapiens
tctcagcccagaagaaaa

SEQ ID NO: 3225195 - DNA, 12 bp, Homo sapiens
tctcagcctccc

SEQ ID NO: 3225196 - DNA, 15 bp, Homo sapiens
tctcagcctcccaca

SEQ ID NO: 3225197 - DNA, 12 bp, Homo sapiens
tctcagcctcct

SEQ ID NO: 3225198 - DNA, 17 bp, Homo sapiens
tctcagcctcctgagcc

SEQ ID NO: 3225199 - DNA, 20 bp, Homo sapiens
tctcagcctcctgagcctgt

SEQ ID NO: 3225200 - DNA, 16 bp, Homo sapiens
tctcagctccaggtgg

SEQ ID NO: 3225201 - DNA, 19 bp, Homo sapiens
tctcagctccccctgtccc

SEQ ID NO: 3225202 - DNA, 13 bp, Homo sapiens
tctcagctttgag

SEQ ID NO: 3225203 - DNA, 19 bp, Homo sapiens
tctcagctttgagaagcct

SEQ ID NO: 3225204 - DNA, 19 bp, Homo sapiens
tctcaggaagtccagccac

SEQ ID NO: 3225205 - DNA, 16 bp, Homo sapiens
tctcaggagatggagg

SEQ ID NO: 3225206 - DNA, 18 bp, Homo sapiens
tctcaggagcacaggcag

SEQ ID NO: 3225207 - DNA, 15 bp, Homo sapiens
tctcaggagtatctt

SEQ ID NO: 3225208 - DNA, 22 bp, Homo sapiens
tctcaggatttcaccagaagtt

SEQ ID NO: 3225209 - DNA, 18 bp, Homo sapiens
tctcaggctggtgggagg

SEQ ID NO: 3225210 - DNA, 19 bp, Homo sapiens
tctcaggctggtgggaggg

SEQ ID NO: 3225211 - DNA, 12 bp, Homo sapiens
tctcagggcctg

SEQ ID NO: 3225212 - DNA, 15 bp, Homo sapiens
tctcagggcctggca

SEQ ID NO: 3225213 - DNA, 13 bp, Homo sapiens
tctcagggctcct

SEQ ID NO: 3225214 - DNA, 17 bp, Homo sapiens
tctcagggctcctgcct

SEQ ID NO: 3225215 - DNA, 20 bp, Homo sapiens
tctcaggggccagaggaact

SEQ ID NO: 3225216 - DNA, 17 bp, Homo sapiens
tctcaggtgccactccc

SEQ ID NO: 3225217 - DNA, 20 bp, Homo sapiens
tctcaggtgccactccctga

SEQ ID NO: 3225218 - DNA, 21 bp, Homo sapiens
tctcaggtgccactccctgag

SEQ ID NO: 3225219 - DNA, 20 bp, Homo sapiens
tctcaggtttgttttgtgaa

SEQ ID NO: 3225220 - DNA, 24 bp, Homo sapiens
tctcagtctaaggtctcatgctgt

SEQ ID NO: 3225221 - DNA, 13 bp, Homo sapiens
tctcagtgttggt

SEQ ID NO: 3225222 - DNA, 14 bp, Homo sapiens
tctcagtgttggta

SEQ ID NO: 3225223 - DNA, 15 bp, Homo sapiens
tctcagtgttttgga

SEQ ID NO: 3225224 - DNA, 21 bp, Homo sapiens
tctcagttaaaatgtgaggaa

SEQ ID NO: 3225225 - DNA, 16 bp, Homo sapiens
tctcagttctctccct

SEQ ID NO: 3225226 - DNA, 13 bp, Homo sapiens
tctcagtttcact

SEQ ID NO: 3225227 - DNA, 18 bp, Homo sapiens
tctcagtttgtgtgtctt

SEQ ID NO: 3225228 - DNA, 13 bp, Homo sapiens
tctcataaatctt

SEQ ID NO: 3225229 - DNA, 13 bp, Homo sapiens
tctcatactgtct

SEQ ID NO: 3225230 - DNA, 20 bp, Homo sapiens
tctcatagcattaactaatc

SEQ ID NO: 3225231 - DNA, 24 bp, Homo sapiens
tctcatagcattaactaatctatt

SEQ ID NO: 3225232 - DNA, 16 bp, Homo sapiens
tctcataggaaaagta

SEQ ID NO: 3225233 - DNA, 21 bp, Homo sapiens
tctcataggaaaagtacattt

SEQ ID NO: 3225234 - DNA, 23 bp, Homo sapiens
tctcataggaaaagtacatttaa

SEQ ID NO: 3225235 - DNA, 24 bp, Homo sapiens
tctcataggaaaagtacatttaat

SEQ ID NO: 3225236 - DNA, 17 bp, Homo sapiens
tctcataggttaaaaaa

SEQ ID NO: 3225237 - DNA, 17 bp, Homo sapiens
tctcatatatattttaa

SEQ ID NO: 3225238 - DNA, 18 bp, Homo sapiens
tctcatatatattttaaa

SEQ ID NO: 3225239 - DNA, 20 bp, Homo sapiens
tctcatatgccaccccatgt

SEQ ID NO: 3225240 - DNA, 21 bp, Homo sapiens
tctcatcagtgtcctcttgct

SEQ ID NO: 3225241 - DNA, 14 bp, Homo sapiens
tctcatccccaggg

SEQ ID NO: 3225242 - DNA, 15 bp, Homo sapiens
tctcatccccagggg

SEQ ID NO: 3225243 - DNA, 22 bp, Homo sapiens
tctcatccccaggggtcccagc

SEQ ID NO: 3225244 - DNA, 14 bp, Homo sapiens
tctcatcctcctgg

SEQ ID NO: 3225245 - DNA, 13 bp, Homo sapiens
tctcatctcttca

SEQ ID NO: 3225246 - DNA, 17 bp, Homo sapiens
tctcatcttaaaaatat

SEQ ID NO: 3225247 - DNA, 14 bp, Homo sapiens
tctcatcttgttct

SEQ ID NO: 3225248 - DNA, 15 bp, Homo sapiens
tctcatcttgttctt

SEQ ID NO: 3225249 - DNA, 16 bp, Homo sapiens
tctcatcttgttcttc

SEQ ID NO: 3225250 - DNA, 21 bp, Homo sapiens
tctcatcttgttcttccccct

SEQ ID NO: 3225251 - DNA, 23 bp, Homo sapiens
tctcatgataccacctttactgt

SEQ ID NO: 3225252 - DNA, 16 bp, Homo sapiens
tctcatgcctcagcct

SEQ ID NO: 3225253 - DNA, 12 bp, Homo sapiens
tctcatgtcctg

SEQ ID NO: 3225254 - DNA, 13 bp, Homo sapiens
tctcattcagtat

SEQ ID NO: 3225255 - DNA, 19 bp, Homo sapiens
tctcattccaacagtgagt

SEQ ID NO: 3225256 - DNA, 20 bp, Homo sapiens
tctcattccgttgtctgtgg

SEQ ID NO: 3225257 - DNA, 19 bp, Homo sapiens
tctcattcgcctttgtctt

SEQ ID NO: 3225258 - DNA, 21 bp, Homo sapiens
tctcattcgcctttgtcttgt

SEQ ID NO: 3225259 - DNA, 16 bp, Homo sapiens
tctcatttgtcacaca

SEQ ID NO: 3225260 - DNA, 23 bp, Homo sapiens
tctccaaaccagacggtgacgcc

SEQ ID NO: 3225261 - DNA, 19 bp, Homo sapiens
tctccaaaggggctgctgg

SEQ ID NO: 3225262 - DNA, 15 bp, Homo sapiens
tctccaaataaaaat

SEQ ID NO: 3225263 - DNA, 20 bp, Homo sapiens
tctccaagataagcctgagc

SEQ ID NO: 3225264 - DNA, 21 bp, Homo sapiens
tctccaagtgccagaggtggg

SEQ ID NO: 3225265 - DNA, 21 bp, Homo sapiens
tctccaccaactggagcactg

SEQ ID NO: 3225266 - DNA, 13 bp, Homo sapiens
tctccaccctgct

SEQ ID NO: 3225267 - DNA, 14 bp, Homo sapiens
tctccaccctgctc

SEQ ID NO: 3225268 - DNA, 16 bp, Homo sapiens
tctccaccctgctctc

SEQ ID NO: 3225269 - DNA, 18 bp, Homo sapiens
tctccaccctggctggga

SEQ ID NO: 3225270 - DNA, 21 bp, Homo sapiens
tctccacctgagaccctggga

SEQ ID NO: 3225271 - DNA, 15 bp, Homo sapiens
tctccagaatgtaag

SEQ ID NO: 3225272 - DNA, 19 bp, Homo sapiens
tctccagaatgtaagaaaa

SEQ ID NO: 3225273 - DNA, 15 bp, Homo sapiens
tctccagatgtttcc

SEQ ID NO: 3225274 - DNA, 12 bp, Homo sapiens
tctccagccagc

SEQ ID NO: 3225275 - DNA, 16 bp, Homo sapiens
tctccagccagcaatg

SEQ ID NO: 3225276 - DNA, 20 bp, Homo sapiens
tctccagctcagaacccagg

SEQ ID NO: 3225277 - DNA, 14 bp, Homo sapiens
tctccagctccaag

SEQ ID NO: 3225278 - DNA, 13 bp, Homo sapiens
tctccaggaccaa

SEQ ID NO: 3225279 - DNA, 19 bp, Homo sapiens
tctccaggcaccatctccc

SEQ ID NO: 3225280 - DNA, 17 bp, Homo sapiens
tctccaggcacccttct

SEQ ID NO: 3225281 - DNA, 23 bp, Homo sapiens
tctccaggcacccttctttcctc

SEQ ID NO: 3225282 - DNA, 11 bp, Homo sapiens
tctccaggctg

SEQ ID NO: 3225283 - DNA, 16 bp, Homo sapiens
tctccaggctgtatcc

SEQ ID NO: 3225284 - DNA, 21 bp, Homo sapiens
tctccagggagcaagacagag

SEQ ID NO: 3225285 - DNA, 20 bp, Homo sapiens
tctccaggggctgcttcctc

SEQ ID NO: 3225286 - DNA, 23 bp, Homo sapiens
tctccaggggctgcttcctcctg

SEQ ID NO: 3225287 - DNA, 20 bp, Homo sapiens
tctccagttgggactcagga

SEQ ID NO: 3225288 - DNA, 18 bp, Homo sapiens
tctccagtttgcacctgt

SEQ ID NO: 3225289 - DNA, 18 bp, Homo sapiens
tccaggtgttactgtaat

SEQ ID NO: 3225290 - DNA, 18 bp, Homo sapiens
tccaggttccctcccaga

SEQ ID NO: 3225291 - DNA, 15 bp, Homo sapiens
tccagtaactttttt

SEQ ID NO: 3225292 - DNA, 18 bp, Homo sapiens
tccagtaacttttttgtg

SEQ ID NO: 3225293 - DNA, 21 bp, Homo sapiens
tccagtataagactactgaat

SEQ ID NO: 3225294 - DNA, 18 bp, Homo sapiens
tccagtattgaaaacttc

SEQ ID NO: 3225295 - DNA, 21 bp, Homo sapiens
tccagtccccctatccttggc

SEQ ID NO: 3225296 - DNA, 19 bp, Homo sapiens
tccagtcttcctgacactt

SEQ ID NO: 3225297 - DNA, 13 bp, Homo sapiens
tccagtgctggat

SEQ ID NO: 3225298 - DNA, 17 bp, Homo sapiens
tccagtggaggtttgtc

SEQ ID NO: 3225299 - DNA, 21 bp, Homo sapiens
tccagtgggctgatgctggga

SEQ ID NO: 3225300 - DNA, 13 bp, Homo sapiens
tccagtggttctg

SEQ ID NO: 3225301 - DNA, 13 bp, Homo sapiens
tccagtgtacata

SEQ ID NO: 3225302 - DNA, 17 bp, Homo sapiens
tccagtgtcacctctct

SEQ ID NO: 3225303 - DNA, 21 bp, Homo sapiens
tccagtgtccttagaacattt

SEQ ID NO: 3225304 - DNA, 16 bp, Homo sapiens
tccagtgtctcggagg

SEQ ID NO: 3225305 - DNA, 17 bp, Homo sapiens
tccagtgttctatgaac

SEQ ID NO: 3225306 - DNA, 13 bp, Homo sapiens
tccagttataaga

SEQ ID NO: 3225307 - DNA, 15 bp, Homo sapiens
tccagttataagaag

SEQ ID NO: 3225308 - DNA, 20 bp, Homo sapiens
tccagttcatcgattttcta

SEQ ID NO: 3225309 - DNA, 17 bp, Homo sapiens
tccagtttgcacctgtc

SEQ ID NO: 3225310 - DNA, 18 bp, Homo sapiens
tccagtttgcacctgtcc

SEQ ID NO: 3225311 - DNA, 14 bp, Homo sapiens
tccagtttgttctc

SEQ ID NO: 3225312 - DNA, 23 bp, Homo sapiens
tccataaacagactgttaattat

SEQ ID NO: 3225313 - DNA, 21 bp, Homo sapiens
tccataatctggactcctctg

SEQ ID NO: 3225314 - DNA, 23 bp, Homo sapiens
tccataatctggactcctctgtc

SEQ ID NO: 3225315 - DNA, 18 bp, Homo sapiens
tccataatgcattcttct

SEQ ID NO: 3225316 - DNA, 18 bp, Homo sapiens
tccataatgctactgtct

SEQ ID NO: 3225317 - DNA, 21 bp, Homo sapiens
tccataattatgacagttata

SEQ ID NO: 3225318 - DNA, 23 bp, Homo sapiens
tccatacaatgactagtcacctg

SEQ ID NO: 3225319 - DNA, 22 bp, Homo sapiens
tccataccagctcgcacccccc

SEQ ID NO: 3225320 - DNA, 21 bp, Homo sapiens
tccatagcctaatccctgggc

SEQ ID NO: 3225321 - DNA, 22 bp, Homo sapiens
tccataggagggaaggagcagt

SEQ ID NO: 3225322 - DNA, 24 bp, Homo sapiens
tccatatctccttcccctacacct

SEQ ID NO: 3225323 - DNA, 14 bp, Homo sapiens
tccatatttattca

SEQ ID NO: 3225324 - DNA, 17 bp, Homo sapiens
tccatatttggaagaaa

SEQ ID NO: 3225325 - DNA, 15 bp, Homo sapiens
tccatcaataaatgc

SEQ ID NO: 3225326 - DNA, 13 bp, Homo sapiens
tccatcagccagg

SEQ ID NO: 3225327 - DNA, 13 bp, Homo sapiens
tccatcatttctg

SEQ ID NO: 3225328 - DNA, 14 bp, Homo sapiens
tccatcattttaca

SEQ ID NO: 3225329 - DNA, 18 bp, Homo sapiens
tccatccacctttcccaa

SEQ ID NO: 3225330 - DNA, 22 bp, Homo sapiens
tccatccataaatccagttcta

SEQ ID NO: 3225331 - DNA, 21 bp, Homo sapiens
tccatcccaggacaccacacc

SEQ ID NO: 3225332 - DNA, 18 bp, Homo sapiens
tccatccctaccccctaa

SEQ ID NO: 3225333 - DNA, 23 bp, Homo sapiens
tccatccctggccccctccctgg

SEQ ID NO: 3225334 - DNA, 14 bp, Homo sapiens
tccatcccttttcc

SEQ ID NO: 3225335 - DNA, 18 bp, Homo sapiens
tccatcccttttcctgtc

SEQ ID NO: 3225336 - DNA, 15 bp, Homo sapiens
tccatccgactgccc

SEQ ID NO: 3225337 - DNA, 17 bp, Homo sapiens
tccatccgactgcccct

SEQ ID NO: 3225338 - DNA, 18 bp, Homo sapiens
tccatccgactgcccctg

SEQ ID NO: 3225339 - DNA, 15 bp, Homo sapiens
tccatcctgaggctc

SEQ ID NO: 3225340 - DNA, 16 bp, Homo sapiens
tccatctctcatcctc

SEQ ID NO: 3225341 - DNA, 18 bp, Homo sapiens
tccatcttctccccacag

SEQ ID NO: 3225342 - DNA, 21 bp, Homo sapiens
tccatcttgagatggtgaggc

SEQ ID NO: 3225343 - DNA, 12 bp, Homo sapiens
tccatcttgcta

SEQ ID NO: 3225344 - DNA, 13 bp, Homo sapiens
tccatctttacaa

SEQ ID NO: 3225345 - DNA, 18 bp, Homo sapiens
tccatctttctacagaga

SEQ ID NO: 3225346 - DNA, 13 bp, Homo sapiens
tccatgaatgtat

SEQ ID NO: 3225347 - DNA, 15 bp, Homo sapiens
tccatgaatgtatca

SEQ ID NO: 3225348 - DNA, 20 bp, Homo sapiens
tccatgacctagttttccat

SEQ ID NO: 3225349 - DNA, 19 bp, Homo sapiens
tccatgagcaccccaaggc

SEQ ID NO: 3225350 - DNA, 14 bp, Homo sapiens
tccatgatggaata

SEQ ID NO: 3225351 - DNA, 12 bp, Homo sapiens
tccatgattcta

SEQ ID NO: 3225352 - DNA, 16 bp, Homo sapiens
tccatgattctctgag

SEQ ID NO: 3225353 - DNA, 13 bp, Homo sapiens
tccatgcaccaaa

SEQ ID NO: 3225354 - DNA, 16 bp, Homo sapiens
tccatgcagccttggg

SEQ ID NO: 3225355 - DNA, 14 bp, Homo sapiens
tccatgcctctgga

SEQ ID NO: 3225356 - DNA, 14 bp, Homo sapiens
tccatgcctgaggg

SEQ ID NO: 3225357 - DNA, 21 bp, Homo sapiens
tccatgcctgagggtggagac

SEQ ID NO: 3225358 - DNA, 20 bp, Homo sapiens
tccatgcgtgtttctgactc

SEQ ID NO: 3225359 - DNA, 21 bp, Homo sapiens
tccatgctcctcactgcccgc

SEQ ID NO: 3225360 - DNA, 16 bp, Homo sapiens
tccatggcaccagccc

SEQ ID NO: 3225361 - DNA, 18 bp, Homo sapiens
tccatggcaccagccccc

SEQ ID NO: 3225362 - DNA, 13 bp, Homo sapiens
tccatggcctttc

SEQ ID NO: 3225363 - DNA, 18 bp, Homo sapiens
tccatggcctttctaata

SEQ ID NO: 3225364 - DNA, 14 bp, Homo sapiens
tccatgggagccag

SEQ ID NO: 3225365 - DNA, 13 bp, Homo sapiens
tccatgtactgta

SEQ ID NO: 3225366 - DNA, 16 bp, Homo sapiens
tccatgtactgtagtt

SEQ ID NO: 3225367 - DNA, 18 bp, Homo sapiens
tccatgtcctatgtgtga

SEQ ID NO: 3225368 - DNA, 16 bp, Homo sapiens
tccatgtcgcctctgc

SEQ ID NO: 3225369 - DNA, 19 bp, Homo sapiens
tccatgtcgcctctgcatt

SEQ ID NO: 3225370 - DNA, 19 bp, Homo sapiens
tccatgttaaaatagacaa

SEQ ID NO: 3225371 - DNA, 22 bp, Homo sapiens
tccatgttagtaatggcagagc

SEQ ID NO: 3225372 - DNA, 23 bp, Homo sapiens
tccatgttagtaatggcagagca

SEQ ID NO: 3225373 - DNA, 18 bp, Homo sapiens
tccatgttagtttttact

SEQ ID NO: 3225374 - DNA, 19 bp, Homo sapiens
tccattaaagtctgaatca

SEQ ID NO: 3225375 - DNA, 13 bp, Homo sapiens
tccattaaatggt

SEQ ID NO: 3225376 - DNA, 14 bp, Homo sapiens
tccattaacaaatg

SEQ ID NO: 3225377 - DNA, 15 bp, Homo sapiens
tccattaggccagca

SEQ ID NO: 3225378 - DNA, 15 bp, Homo sapiens
tccattatgattctt

SEQ ID NO: 3225379 - DNA, 11 bp, Homo sapiens
tccattattta

SEQ ID NO: 3225380 - DNA, 14 bp, Homo sapiens
tccattatttatat

SEQ ID NO: 3225381 - DNA, 10 bp, Homo sapiens
tccattccca

SEQ ID NO: 3225382 - DNA, 16 bp, Homo sapiens
tccattctcccaggta

SEQ ID NO: 3225383 - DNA, 16 bp, Homo sapiens
tccattgtttaaagat

SEQ ID NO: 3225384 - DNA, 17 bp, Homo sapiens
tccatttataaccccag

SEQ ID NO: 3225385 - DNA, 19 bp, Homo sapiens
tccatttatttatgaaaaa

SEQ ID NO: 3225386 - DNA, 18 bp, Homo sapiens
tccatttcccacatcttt

SEQ ID NO: 3225387 - DNA, 18 bp, Homo sapiens
tccatttcccctccttcc

SEQ ID NO: 3225388 - DNA, 11 bp, Homo sapiens
tccatttctga

SEQ ID NO: 3225389 - DNA, 16 bp, Homo sapiens
tccatttggtcctttc

SEQ ID NO: 3225390 - DNA, 14 bp, Homo sapiens
tccattttatgcag

SEQ ID NO: 3225391 - DNA, 22 bp, Homo sapiens
tccattttggcgctattacaaa

SEQ ID NO: 3225392 - DNA, 20 bp, Homo sapiens
tcccaaaacccttacagtga

SEQ ID NO: 3225393 - DNA, 15 bp, Homo sapiens
tcccaaacgcctccc

SEQ ID NO: 3225394 - DNA, 23 bp, Homo sapiens
tcccaaagaactacccccttttc

SEQ ID NO: 3225395 - DNA, 20 bp, Homo sapiens
tcccaaagtgctgagattac

SEQ ID NO: 3225396 - DNA, 21 bp, Homo sapiens
tcccaaagtgctgggattaca

SEQ ID NO: 3225397 - DNA, 22 bp, Homo sapiens
tcccaaatttgattgatttgaa

SEQ ID NO: 3225398 - DNA, 16 bp, Homo sapiens
tcccaacagccatgcc

SEQ ID NO: 3225399 - DNA, 13 bp, Homo sapiens
tcccaacagcctt

SEQ ID NO: 3225400 - DNA, 15 bp, Homo sapiens
tcccaaccaggcacc

SEQ ID NO: 3225401 - DNA, 14 bp, Homo sapiens
tcccaaccagtgcc

SEQ ID NO: 3225402 - DNA, 15 bp, Homo sapiens
tcccaacccccctcc

SEQ ID NO: 3225403 - DNA, 19 bp, Homo sapiens
tcccaacccccctcctgct

SEQ ID NO: 3225404 - DNA, 20 bp, Homo sapiens
tcccaacccccctcctgctc

SEQ ID NO: 3225405 - DNA, 23 bp, Homo sapiens
tcccaacccccctcctgctcctc

SEQ ID NO: 3225406 - DNA, 17 bp, Homo sapiens
tcccaactcctataatt

SEQ ID NO: 3225407 - DNA, 13 bp, Homo sapiens
tcccaagaaatgc

SEQ ID NO: 3225408 - DNA, 12 bp, Homo sapiens
tcccaagacagt

SEQ ID NO: 3225409 - DNA, 14 bp, Homo sapiens
tcccaagctctgct

SEQ ID NO: 3225410 - DNA, 15 bp, Homo sapiens
tcccaagctctgctc

SEQ ID NO: 3225411 - DNA, 13 bp, Homo sapiens
tcccaaggacttc

SEQ ID NO: 3225412 - DNA, 18 bp, Homo sapiens
tcccaaggacttccacat

SEQ ID NO: 3225413 - DNA, 15 bp, Homo sapiens
tcccaaggagctgat

SEQ ID NO: 3225414 - DNA, 20 bp, Homo sapiens
tcccaagtagctgggactac

SEQ ID NO: 3225415 - DNA, 20 bp, Homo sapiens
tcccaagtagctgggattac

SEQ ID NO: 3225416 - DNA, 17 bp, Homo sapiens
tcccaagtgccagtctt

SEQ ID NO: 3225417 - DNA, 16 bp, Homo sapiens
tcccaagttgtgcttg

SEQ ID NO: 3225418 - DNA, 22 bp, Homo sapiens
tcccaagtttccatagcaacag

SEQ ID NO: 3225419 - DNA, 22 bp, Homo sapiens
tcccaatagcaacgtagcttct

SEQ ID NO: 3225420 - DNA, 18 bp, Homo sapiens
tcccaatagcactttcat

SEQ ID NO: 3225421 - DNA, 20 bp, Homo sapiens
tcccaatagcactttcattg

SEQ ID NO: 3225422 - DNA, 18 bp, Homo sapiens
tcccaatcaaagaattac

SEQ ID NO: 3225423 - DNA, 21 bp, Homo sapiens
tcccaatcaaagaattacagt

SEQ ID NO: 3225424 - DNA, 15 bp, Homo sapiens
tcccaatcagcactg

SEQ ID NO: 3225425 - DNA, 16 bp, Homo sapiens
tcccaatcagcactga

SEQ ID NO: 3225426 - DNA, 17 bp, Homo sapiens
tcccaatcagcactgaa

SEQ ID NO: 3225427 - DNA, 18 bp, Homo sapiens
tcccaatcagcactgaaa

SEQ ID NO: 3225428 - DNA, 21 bp, Homo sapiens
tcccaatctctacccctttct

SEQ ID NO: 3225429 - DNA, 20 bp, Homo sapiens
tcccaatgcacatccattcc

SEQ ID NO: 3225430 - DNA, 18 bp, Homo sapiens
tcccacacctccacagtt

SEQ ID NO: 3225431 - DNA, 23 bp, Homo sapiens
tcccacactgaaaccaaaacata

SEQ ID NO: 3225432 - DNA, 13 bp, Homo sapiens
tcccacacttgct

SEQ ID NO: 3225433 - DNA, 21 bp, Homo sapiens
tcccacagagtgctggactgt

SEQ ID NO: 3225434 - DNA, 21 bp, Homo sapiens
tcccacaggcccttcctctcc

SEQ ID NO: 3225435 - DNA, 22 bp, Homo sapiens
tcccacaggcccttcctctcca

SEQ ID NO: 3225436 - DNA, 19 bp, Homo sapiens
tcccacatccaactccagc

SEQ ID NO: 3225437 - DNA, 13 bp, Homo sapiens
tcccacatgaggc

SEQ ID NO: 3225438 - DNA, 14 bp, Homo sapiens
tcccacatgaggcc

SEQ ID NO: 3225439 - DNA, 19 bp, Homo sapiens
tcccacatgaggccatctc

SEQ ID NO: 3225440 - DNA, 14 bp, Homo sapiens
tcccaccacaggca

SEQ ID NO: 3225441 - DNA, 14 bp, Homo sapiens
tcccaccattcctg

SEQ ID NO: 3225442 - DNA, 15 bp, Homo sapiens
tcccaccattcctgc

SEQ ID NO: 3225443 - DNA, 15 bp, Homo sapiens
tcccacccacatgtg

SEQ ID NO: 3225444 - DNA, 15 bp, Homo sapiens
tcccacccacccgcc

SEQ ID NO: 3225445 - DNA, 18 bp, Homo sapiens
tcccacccccacccccag

SEQ ID NO: 3225446 - DNA, 22 bp, Homo sapiens
tcccacccccacccccagctca

SEQ ID NO: 3225447 - DNA, 19 bp, Homo sapiens
tcccacccctccctctgtc

SEQ ID NO: 3225448 - DNA, 18 bp, Homo sapiens
tcccacccgatgctgctt

SEQ ID NO: 3225449 - DNA, 13 bp, Homo sapiens
tcccaccctgttc

SEQ ID NO: 3225450 - DNA, 16 bp, Homo sapiens
tcccaccgcccccacc

SEQ ID NO: 3225451 - DNA, 17 bp, Homo sapiens
tcccacctccagtcccc

SEQ ID NO: 3225452 - DNA, 20 bp, Homo sapiens
tcccacctctccttttgagg

SEQ ID NO: 3225453 - DNA, 11 bp, Homo sapiens
tcccacctctg

SEQ ID NO: 3225454 - DNA, 23 bp, Homo sapiens
tcccacctgacacaccaggcgct

SEQ ID NO: 3225455 - DNA, 13 bp, Homo sapiens
tcccaccttgacc

SEQ ID NO: 3225456 - DNA, 16 bp, Homo sapiens
tcccaccttgccaaag

SEQ ID NO: 3225457 - DNA, 18 bp, Homo sapiens
tcccaccttggctgcagg

SEQ ID NO: 3225458 - DNA, 20 bp, Homo sapiens
tcccacgcactccatgagca

SEQ ID NO: 3225459 - DNA, 23 bp, Homo sapiens
tcccacgcctgtcctcctggaag

SEQ ID NO: 3225460 - DNA, 15 bp, Homo sapiens
tcccacgtgtcttcc

SEQ ID NO: 3225461 - DNA, 18 bp, Homo sapiens
tcccacgtgtcttccact

SEQ ID NO: 3225462 - DNA, 14 bp, Homo sapiens
tcccactgccctgg

SEQ ID NO: 3225463 - DNA, 18 bp, Homo sapiens
tcccactgcctcaggttc

SEQ ID NO: 3225464 - DNA, 13 bp, Homo sapiens
tcccactggaaga

SEQ ID NO: 3225465 - DNA, 13 bp, Homo sapiens
tcccactgtatga

SEQ ID NO: 3225466 - DNA, 14 bp, Homo sapiens
tcccacttctcatc

SEQ ID NO: 3225467 - DNA, 19 bp, Homo sapiens
tcccacttctcatcttaaa

SEQ ID NO: 3225468 - DNA, 13 bp, Homo sapiens
tcccagaccagcc

SEQ ID NO: 3225469 - DNA, 12 bp, Homo sapiens
tcccagagggag

SEQ ID NO: 3225470 - DNA, 13 bp, Homo sapiens
tcccagagggagc

SEQ ID NO: 3225471 - DNA, 15 bp, Homo sapiens
tcccagagggagcag

SEQ ID NO: 3225472 - DNA, 13 bp, Homo sapiens
tcccagaggtcca

SEQ ID NO: 3225473 - DNA, 23 bp, Homo sapiens
tcccagaggtccagcccatctcg

SEQ ID NO: 3225474 - DNA, 22 bp, Homo sapiens
tcccagaggtgggatcctccct

SEQ ID NO: 3225475 - DNA, 19 bp, Homo sapiens
tcccagaggttatctgcct

SEQ ID NO: 3225476 - DNA, 21 bp, Homo sapiens
tcccagagtcagaggagaaga

SEQ ID NO: 3225477 - DNA, 22 bp, Homo sapiens
tcccagagtcagaggagaagag

SEQ ID NO: 3225478 - DNA, 22 bp, Homo sapiens
tcccagcactccccttgccttc

SEQ ID NO: 3225479 - DNA, 13 bp, Homo sapiens
tcccagcactttg

SEQ ID NO: 3225480 - DNA, 19 bp, Homo sapiens
tcccagcactttgggaggc

SEQ ID NO: 3225481 - DNA, 24 bp, Homo sapiens
tcccagcactttgggaggccgagg

SEQ ID NO: 3225482 - DNA, 14 bp, Homo sapiens
tcccagcagcccaa

SEQ ID NO: 3225483 - DNA, 18 bp, Homo sapiens
tcccagcagccctaagga

SEQ ID NO: 3225484 - DNA, 21 bp, Homo sapiens
tcccagcatccctggagcagg

SEQ ID NO: 3225485 - DNA, 23 bp, Homo sapiens
tcccagcatccctggagcaggag

SEQ ID NO: 3225486 - DNA, 12 bp, Homo sapiens
tcccagccaccc

SEQ ID NO: 3225487 - DNA, 13 bp, Homo sapiens
tcccagccacccc

SEQ ID NO: 3225488 - DNA, 18 bp, Homo sapiens
tcccagccatgcccagga

SEQ ID NO: 3225489 - DNA, 19 bp, Homo sapiens
tcccagccatgcccaggac

SEQ ID NO: 3225490 - DNA, 15 bp, Homo sapiens
tcccagccctatgga

SEQ ID NO: 3225491 - DNA, 13 bp, Homo sapiens
tcccagccggcca

SEQ ID NO: 3225492 - DNA, 22 bp, Homo sapiens
tcccagccggccaatggaaacc

SEQ ID NO: 3225493 - DNA, 23 bp, Homo sapiens
tcccagcctgccctccagctgct

SEQ ID NO: 3225494 - DNA, 16 bp, Homo sapiens
tcccagcctgctgaga

SEQ ID NO: 3225495 - DNA, 19 bp, Homo sapiens
tcccagcctgctgagagcc

SEQ ID NO: 3225496 - DNA, 22 bp, Homo sapiens
tcccagcctggggctccctctc

SEQ ID NO: 3225497 - DNA, 14 bp, Homo sapiens
tcccagcgtgtgta

SEQ ID NO: 3225498 - DNA, 18 bp, Homo sapiens
tcccagcgtgtgtatccg

SEQ ID NO: 3225499 - DNA, 21 bp, Homo sapiens
tcccagcgtgtgtatccgact

SEQ ID NO: 3225500 - DNA, 23 bp, Homo sapiens
tcccagctactcagaagcctgag

SEQ ID NO: 3225501 - DNA, 18 bp, Homo sapiens
tcccagctacttgggagg

SEQ ID NO: 3225502 - DNA, 16 bp, Homo sapiens
tcccagctaggaagag

SEQ ID NO: 3225503 - DNA, 18 bp, Homo sapiens
tcccagctccccccgccc

SEQ ID NO: 3225504 - DNA, 21 bp, Homo sapiens
tcccagctcctttctcctgtg

SEQ ID NO: 3225505 - DNA, 22 bp, Homo sapiens
tcccagctcctttctcctgtga

SEQ ID NO: 3225506 - DNA, 19 bp, Homo sapiens
tcccagctgaaggcagtgg

SEQ ID NO: 3225507 - DNA, 13 bp, Homo sapiens
tccaagattctag

SEQ ID NO: 3225508 - DNA, 16 bp, Homo sapiens
tccaagattctagatg

SEQ ID NO: 3225509 - DNA, 20 bp, Homo sapiens
tccaagattctagatgatta

SEQ ID NO: 3225510 - DNA, 16 bp, Homo sapiens
tccaagcctccacagc

SEQ ID NO: 3225511 - DNA, 20 bp, Homo sapiens
tccaagcctccacagcgagg

SEQ ID NO: 3225512 - DNA, 21 bp, Homo sapiens
tccaagcctccacagcgaggg

SEQ ID NO: 3225513 - DNA, 17 bp, Homo sapiens
tccaagcctgcctccca

SEQ ID NO: 3225514 - DNA, 17 bp, Homo sapiens
tccaagctcactcccca

SEQ ID NO: 3225515 - DNA, 12 bp, Homo sapiens
tccaagctccct

SEQ ID NO: 3225516 - DNA, 14 bp, Homo sapiens
tccaagctccttat

SEQ ID NO: 3225517 - DNA, 21 bp, Homo sapiens
tccaagctggtcccactcagt

SEQ ID NO: 3225518 - DNA, 19 bp, Homo sapiens
tccaaggagaaacagagac

SEQ ID NO: 3225519 - DNA, 20 bp, Homo sapiens
tccaaggagaaacagagaca

SEQ ID NO: 3225520 - DNA, 15 bp, Homo sapiens
tccaaggcaaacaat

SEQ ID NO: 3225521 - DNA, 12 bp, Homo sapiens
tccaaggccctg

SEQ ID NO: 3225522 - DNA, 23 bp, Homo sapiens
tccaagggcttctgcaccctcca

SEQ ID NO: 3225523 - DNA, 22 bp, Homo sapiens
tccaagggtttcgactggtcca

SEQ ID NO: 3225524 - DNA, 24 bp, Homo sapiens
tccaagggtttcgactggtccagc

SEQ ID NO: 3225525 - DNA, 16 bp, Homo sapiens
tccaaggtgatgttgt

SEQ ID NO: 3225526 - DNA, 14 bp, Homo sapiens
tccaaggtttaaag

SEQ ID NO: 3225527 - DNA, 16 bp, Homo sapiens
tccaaggtttaaagag

SEQ ID NO: 3225528 - DNA, 22 bp, Homo sapiens
tcacctttgtaagacatttgta

SEQ ID NO: 3225529 - DNA, 23 bp, Homo sapiens
tcacctttgtaagacatttgtat

SEQ ID NO: 3225530 - DNA, 16 bp, Homo sapiens
tcacctttgtgtattt

SEQ ID NO: 3225531 - DNA, 16 bp, Homo sapiens
tcacgagatttgccag

SEQ ID NO: 3225532 - DNA, 14 bp, Homo sapiens
tcacgccactgcac

SEQ ID NO: 3225533 - DNA, 16 bp, Homo sapiens
tccactcgacccagaa

SEQ ID NO: 3225534 - DNA, 17 bp, Homo sapiens
tccactctaccctccca

SEQ ID NO: 3225535 - DNA, 18 bp, Homo sapiens
tccactctaccctcccac

SEQ ID NO: 3225536 - DNA, 14 bp, Homo sapiens
tccactctgcttct

SEQ ID NO: 3225537 - DNA, 15 bp, Homo sapiens
tccactctgcttctc

SEQ ID NO: 3225538 - DNA, 21 bp, Homo sapiens
tccactctgcttctctgactt

SEQ ID NO: 3225539 - DNA, 23 bp, Homo sapiens
tccactctgcttctctgacttct

SEQ ID NO: 3225540 - DNA, 15 bp, Homo sapiens
tccactgataagact

SEQ ID NO: 3225541 - DNA, 19 bp, Homo sapiens
tccactgcaaataaagcct

SEQ ID NO: 3225542 - DNA, 22 bp, Homo sapiens
tccactgcaaataaagcctttt

SEQ ID NO: 3225543 - DNA, 13 bp, Homo sapiens
tccactgccctgg

SEQ ID NO: 3225544 - DNA, 13 bp, Homo sapiens
tccactgcctctg

SEQ ID NO: 3225545 - DNA, 18 bp, Homo sapiens
tccactgcctctgcctta

SEQ ID NO: 3225546 - DNA, 13 bp, Homo sapiens
tccactggacaga

SEQ ID NO: 3225547 - DNA, 14 bp, Homo sapiens
tccactggacagac

SEQ ID NO: 3225548 - DNA, 19 bp, Homo sapiens
tccactggacagacccagg

SEQ ID NO: 3225549 - DNA, 16 bp, Homo sapiens
tccactggctccatga

SEQ ID NO: 3225550 - DNA, 22 bp, Homo sapiens
tccactggggaatgctcccagc

SEQ ID NO: 3225551 - DNA, 19 bp, Homo sapiens
tccactgtcaccctccacc

SEQ ID NO: 3225552 - DNA, 22 bp, Homo sapiens
tccactgtcactgtttctctgc

SEQ ID NO: 3225553 - DNA, 17 bp, Homo sapiens
tccactgtggcactggc

SEQ ID NO: 3225554 - DNA, 21 bp, Homo sapiens
tccacttagaaattgcatttc

SEQ ID NO: 3225555 - DNA, 17 bp, Homo sapiens
tccacttctaactccac

SEQ ID NO: 3225556 - DNA, 18 bp, Homo sapiens
tccacttcttcctttctc

SEQ ID NO: 3225557 - DNA, 18 bp, Homo sapiens
tccacttgccctgttctc

SEQ ID NO: 3225558 - DNA, 14 bp, Homo sapiens
tccactttcatctg

SEQ ID NO: 3225559 - DNA, 23 bp, Homo sapiens
tccactttgtttcgtggggaggt

SEQ ID NO: 3225560 - DNA, 14 bp, Homo sapiens
tccagaaaggatat

SEQ ID NO: 3225561 - DNA, 14 bp, Homo sapiens
tccccgcctgcagt

SEQ ID NO: 3225562 - DNA, 20 bp, Homo sapiens
tccccgcctggccagggcag

SEQ ID NO: 3225563 - DNA, 18 bp, Homo sapiens
tccccgcttctgcctgca

SEQ ID NO: 3225564 - DNA, 20 bp, Homo sapiens
tccccggacatactctctgc

SEQ ID NO: 3225565 - DNA, 17 bp, Homo sapiens
tccccggcaccctctgg

SEQ ID NO: 3225566 - DNA, 13 bp, Homo sapiens
tccccggctcgag

SEQ ID NO: 3225567 - DNA, 15 bp, Homo sapiens
tccccgtctcattcc

SEQ ID NO: 3225568 - DNA, 20 bp, Homo sapiens
tccccgtgccccgcctcccc

SEQ ID NO: 3225569 - DNA, 19 bp, Homo sapiens
tcccctatggggatggtcc

SEQ ID NO: 3225570 - DNA, 19 bp, Homo sapiens
tcccctcaaactcattgca

SEQ ID NO: 3225571 - DNA, 17 bp, Homo sapiens
tcccctcaaagtctgca

SEQ ID NO: 3225572 - DNA, 17 bp, Homo sapiens
tcccctcacagcctctg

SEQ ID NO: 3225573 - DNA, 18 bp, Homo sapiens
tcccctcacagcctctga

SEQ ID NO: 3225574 - DNA, 19 bp, Homo sapiens
tcccctcacagcctctgac

SEQ ID NO: 3225575 - DNA, 21 bp, Homo sapiens
tcccctcacagcctctgaccc

SEQ ID NO: 3225576 - DNA, 16 bp, Homo sapiens
tcccctcactctgtca

SEQ ID NO: 3225577 - DNA, 18 bp, Homo sapiens
tcccctcactctgtcagc

SEQ ID NO: 3225578 - DNA, 21 bp, Homo sapiens
tcccctcactctgtcagccag

SEQ ID NO: 3225579 - DNA, 12 bp, Homo sapiens
tcccctcactgg

SEQ ID NO: 3225580 - DNA, 21 bp, Homo sapiens
tcccctcagccacacccaggc

SEQ ID NO: 3225581 - DNA, 12 bp, Homo sapiens
tcccctcagctc

SEQ ID NO: 3225582 - DNA, 12 bp, Homo sapiens
tcccctccagcc

SEQ ID NO: 3225583 - DNA, 15 bp, Homo sapiens
tcccctccatccctg

SEQ ID NO: 3225584 - DNA, 16 bp, Homo sapiens
tcccctccatccctgg

SEQ ID NO: 3225585 - DNA, 17 bp, Homo sapiens
tcccctccatgggcgtc

SEQ ID NO: 3225586 - DNA, 12 bp, Homo sapiens
tcccctcccagt

SEQ ID NO: 3225587 - DNA, 11 bp, Homo sapiens
tcccctcccat

SEQ ID NO: 3225588 - DNA, 17 bp, Homo sapiens
tcccctcccatctggga

SEQ ID NO: 3225589 - DNA, 19 bp, Homo sapiens
tcccctccccgcctggcca

SEQ ID NO: 3225590 - DNA, 20 bp, Homo sapiens
tcccctccccgcctggccag

SEQ ID NO: 3225591 - DNA, 16 bp, Homo sapiens
tcccctcccctccttg

SEQ ID NO: 3225592 - DNA, 16 bp, Homo sapiens
tcccctcccctgctgc

SEQ ID NO: 3225593 - DNA, 17 bp, Homo sapiens
tcccctcccctgctgca

SEQ ID NO: 3225594 - DNA, 21 bp, Homo sapiens
tcccctccggactggtgccct

SEQ ID NO: 3225595 - DNA, 14 bp, Homo sapiens
tcccctccttctcc

SEQ ID NO: 3225596 - DNA, 19 bp, Homo sapiens
tcccctcgtcctgtcccag

SEQ ID NO: 3225597 - DNA, 19 bp, Homo sapiens
tcccctcgtgtcagctcag

SEQ ID NO: 3225598 - DNA, 17 bp, Homo sapiens
tcccctctcttgcaccc

SEQ ID NO: 3225599 - DNA, 19 bp, Homo sapiens
tcccctctcttgcacccgc

SEQ ID NO: 3225600 - DNA, 20 bp, Homo sapiens
tcccctctcttgcacccgcc

SEQ ID NO: 3225601 - DNA, 14 bp, Homo sapiens
tcccctctgctgct

SEQ ID NO: 3225602 - DNA, 20 bp, Homo sapiens
tcccctctgctgctgtccct

SEQ ID NO: 3225603 - DNA, 19 bp, Homo sapiens
tcccctctgtcatcactcc

SEQ ID NO: 3225604 - DNA, 12 bp, Homo sapiens
tcccctgagccc

SEQ ID NO: 3225605 - DNA, 17 bp, Homo sapiens
tcccctgccaccaggcc

SEQ ID NO: 3225606 - DNA, 13 bp, Homo sapiens
tcccctgccattt

SEQ ID NO: 3225607 - DNA, 12 bp, Homo sapiens
tcccctgccctg

SEQ ID NO: 3225608 - DNA, 15 bp, Homo sapiens
tcccctgccctgctg

SEQ ID NO: 3225609 - DNA, 16 bp, Homo sapiens
tcccctgccctgctgc

SEQ ID NO: 3225610 - DNA, 23 bp, Homo sapiens
tcccctgccctgctgccgcctcc

SEQ ID NO: 3225611 - DNA, 17 bp, Homo sapiens
tcccctgcggtcaggct

SEQ ID NO: 3225612 - DNA, 19 bp, Homo sapiens
tcccctgcggtcaggctgg

SEQ ID NO: 3225613 - DNA, 13 bp, Homo sapiens
tcccctgctaccc

SEQ ID NO: 3225614 - DNA, 19 bp, Homo sapiens
tcccctgctactcctgtgc

SEQ ID NO: 3225615 - DNA, 23 bp, Homo sapiens
tcccctgctactcctgtgctctg

SEQ ID NO: 3225616 - DNA, 18 bp, Homo sapiens
tcccctgctgcaggggct

SEQ ID NO: 3225617 - DNA, 23 bp, Homo sapiens
tcccctgctgcaggggctctgga

SEQ ID NO: 3225618 - DNA, 15 bp, Homo sapiens
tcccctggactggga

SEQ ID NO: 3225619 - DNA, 16 bp, Homo sapiens
tcccctgtcctgtgaa

SEQ ID NO: 3225620 - DNA, 17 bp, Homo sapiens
tcccctgtcctgtgaat

SEQ ID NO: 3225621 - DNA, 16 bp, Homo sapiens
tcccctgtcttcacct

SEQ ID NO: 3225622 - DNA, 16 bp, Homo sapiens
tcccctgttaaacagt

SEQ ID NO: 3225623 - DNA, 16 bp, Homo sapiens
tccccttcctcactgc

SEQ ID NO: 3225624 - DNA, 19 bp, Homo sapiens
tccccttgcccttgccctg

SEQ ID NO: 3225625 - DNA, 23 bp, Homo sapiens
tccccttgcccttgccctgacct

SEQ ID NO: 3225626 - DNA, 23 bp, Homo sapiens
tccccttggcaggtcctggccag

SEQ ID NO: 3225627 - DNA, 16 bp, Homo sapiens
tccccttggcttcctc

SEQ ID NO: 3225628 - DNA, 21 bp, Homo sapiens
tcccctttgtattccttaaat

SEQ ID NO: 3225629 - DNA, 15 bp, Homo sapiens
tccccttttgcctgg

SEQ ID NO: 3225630 - DNA, 17 bp, Homo sapiens
tccccttttgcctggct

SEQ ID NO: 3225631 - DNA, 20 bp, Homo sapiens
tccccttttgcctggctgtg

SEQ ID NO: 3225632 - DNA, 13 bp, Homo sapiens
tcccgaagccacc

SEQ ID NO: 3225633 - DNA, 16 bp, Homo sapiens
tcccgaatagctggga

SEQ ID NO: 3225634 - DNA, 15 bp, Homo sapiens
tcccgaggaggggcc

SEQ ID NO: 3225635 - DNA, 17 bp, Homo sapiens
tcccgagtagctgggac

SEQ ID NO: 3225636 - DNA, 17 bp, Homo sapiens
tcccgcactctgccccc

SEQ ID NO: 3225637 - DNA, 23 bp, Homo sapiens
tcccgcatcaaggtcagcatgag

SEQ ID NO: 3225638 - DNA, 17 bp, Homo sapiens
tcccgccagagggcttg

SEQ ID NO: 3225639 - DNA, 21 bp, Homo sapiens
tcccgcctcttcttcttcaga

SEQ ID NO: 3225640 - DNA, 18 bp, Homo sapiens
tcccgccttcctcctcca

SEQ ID NO: 3225641 - DNA, 23 bp, Homo sapiens
tcccgcgggttccgcaggcagac

SEQ ID NO: 3225642 - DNA, 13 bp, Homo sapiens
tcccgctcagccc

SEQ ID NO: 3225643 - DNA, 14 bp, Homo sapiens
tcccgctcagccct

SEQ ID NO: 3225644 - DNA, 9 bp, Homo sapiens
tcccgctcc

SEQ ID NO: 3225645 - DNA, 13 bp, Homo sapiens
tcccgctcccagg

SEQ ID NO: 3225646 - DNA, 14 bp, Homo sapiens
tcccggagcacagc

SEQ ID NO: 3225647 - DNA, 17 bp, Homo sapiens
tcccggagcacagccct

SEQ ID NO: 3225648 - DNA, 19 bp, Homo sapiens
tcccggagcacagccctgg

SEQ ID NO: 3225649 - DNA, 13 bp, Homo sapiens
tcccggcctcttc

SEQ ID NO: 3225650 - DNA, 13 bp, Homo sapiens
tcccggctgcctg

SEQ ID NO: 3225651 - DNA, 15 bp, Homo sapiens
tcccggctgcctgcc

SEQ ID NO: 3225652 - DNA, 16 bp, Homo sapiens
tcccggctgcctgccg

SEQ ID NO: 3225653 - DNA, 20 bp, Homo sapiens
tcccgggccacgccccagcc

SEQ ID NO: 3225654 - DNA, 20 bp, Homo sapiens
tcccggttcagacccctgcc

SEQ ID NO: 3225655 - DNA, 21 bp, Homo sapiens
tcccggttcagacccctgcct

SEQ ID NO: 3225656 - DNA, 14 bp, Homo sapiens
tcccgtacctcttc

SEQ ID NO: 3225657 - DNA, 16 bp, Homo sapiens
tcccgtagtctcctgg

SEQ ID NO: 3225658 - DNA, 20 bp, Homo sapiens
tcccgtcacccctgtttctg

SEQ ID NO: 3225659 - DNA, 18 bp, Homo sapiens
tccctaaagaaaaaaaat

SEQ ID NO: 3225660 - DNA, 19 bp, Homo sapiens
tccctaagtaagtttcttc

SEQ ID NO: 3225661 - DNA, 21 bp, Homo sapiens
tccctaagtaagtttcttcct

SEQ ID NO: 3225662 - DNA, 16 bp, Homo sapiens
tccctaatctatggtc

SEQ ID NO: 3225663 - DNA, 18 bp, Homo sapiens
tccctaatttatgtgcta

SEQ ID NO: 3225664 - DNA, 15 bp, Homo sapiens
tccctacactgatgc

SEQ ID NO: 3225665 - DNA, 16 bp, Homo sapiens
tccctaccccatttgt

SEQ ID NO: 3225666 - DNA, 20 bp, Homo sapiens
tccctaccccctaagagcca

SEQ ID NO: 3225667 - DNA, 22 bp, Homo sapiens
tccctaccgagtctcttctcca

SEQ ID NO: 3225668 - DNA, 17 bp, Homo sapiens
tccctacttcctgtgac

SEQ ID NO: 3225669 - DNA, 13 bp, Homo sapiens
tccctagactgca

SEQ ID NO: 3225670 - DNA, 18 bp, Homo sapiens
tccctagagggttcctgt

SEQ ID NO: 3225671 - DNA, 16 bp, Homo sapiens
tccctagccagcactt

SEQ ID NO: 3225672 - DNA, 19 bp, Homo sapiens
tccctagctttagaccctg

SEQ ID NO: 3225673 - DNA, 22 bp, Homo sapiens
tccctagtccccctgttttctg

SEQ ID NO: 3225674 - DNA, 16 bp, Homo sapiens
tccctatcaagcacta

SEQ ID NO: 3225675 - DNA, 14 bp, Homo sapiens
tccctatggaaaga

SEQ ID NO: 3225676 - DNA, 15 bp, Homo sapiens
tccctatgtatttgc

SEQ ID NO: 3225677 - DNA, 22 bp, Homo sapiens
tccctcaacaagggagagacct

SEQ ID NO: 3225678 - DNA, 23 bp, Homo sapiens
tccctcaacaagggagagacctc

SEQ ID NO: 3225679 - DNA, 14 bp, Homo sapiens
tccctcacctgtag

SEQ ID NO: 3225680 - DNA, 13 bp, Homo sapiens
tccctccacccca

SEQ ID NO: 3225681 - DNA, 15 bp, Homo sapiens
tccctccactccatc

SEQ ID NO: 3225682 - DNA, 22 bp, Homo sapiens
tccctccagtaccataatctta

SEQ ID NO: 3225683 - DNA, 15 bp, Homo sapiens
tccctcccacctctg

SEQ ID NO: 3225684 - DNA, 12 bp, Homo sapiens
tccctccccctt

SEQ ID NO: 3225685 - DNA, 13 bp, Homo sapiens
tccctcccctgcc

SEQ ID NO: 3225686 - DNA, 16 bp, Homo sapiens
tccctcccctgccatt

SEQ ID NO: 3225687 - DNA, 19 bp, Homo sapiens
tccctcccctgccctggtc

SEQ ID NO: 3225688 - DNA, 20 bp, Homo sapiens
tccctcccggcatgggaaag

SEQ ID NO: 3225689 - DNA, 20 bp, Homo sapiens
tccctcccgtagtctcctgg

SEQ ID NO: 3225690 - DNA, 22 bp, Homo sapiens
tccctcccgtagtctcctgggt

SEQ ID NO: 3225691 - DNA, 22 bp, Homo sapiens
tccagaaaggatatttaagaaa

SEQ ID NO: 3225692 - DNA, 20 bp, Homo sapiens
tccagaacacggctcacgct

SEQ ID NO: 3225693 - DNA, 19 bp, Homo sapiens
tccagaagaatattcagga

SEQ ID NO: 3225694 - DNA, 20 bp, Homo sapiens
tccagaagaatattcaggac

SEQ ID NO: 3225695 - DNA, 21 bp, Homo sapiens
tccagaagaatattcaggact

SEQ ID NO: 3225696 - DNA, 17 bp, Homo sapiens
tccagaagcctctggct

SEQ ID NO: 3225697 - DNA, 21 bp, Homo sapiens
tccagaaggggtttggtctgg

SEQ ID NO: 3225698 - DNA, 23 bp, Homo sapiens
tccagaaggggtttggtctggga

SEQ ID NO: 3225699 - DNA, 18 bp, Homo sapiens
tccagaatggtctttcta

SEQ ID NO: 3225700 - DNA, 15 bp, Homo sapiens
tccagaatgtaagaa

SEQ ID NO: 3225701 - DNA, 18 bp, Homo sapiens
tccagaatgtaagaaaac

SEQ ID NO: 3225702 - DNA, 21 bp, Homo sapiens
tccagacatcatgaattttac

SEQ ID NO: 3225703 - DNA, 15 bp, Homo sapiens
tccagacccctggct

SEQ ID NO: 3225704 - DNA, 17 bp, Homo sapiens
tccagacccctggcttt

SEQ ID NO: 3225705 - DNA, 18 bp, Homo sapiens
tccagacccggctgcgtg

SEQ ID NO: 3225706 - DNA, 20 bp, Homo sapiens
tccagacctgcttcctgaaa

SEQ ID NO: 3225707 - DNA, 21 bp, Homo sapiens
tccagacctgcttcctgaaat

SEQ ID NO: 3225708 - DNA, 22 bp, Homo sapiens
tccagacctgcttcctgaaata

SEQ ID NO: 3225709 - DNA, 19 bp, Homo sapiens
tccagactgtaagatgttg

SEQ ID NO: 3225710 - DNA, 12 bp, Homo sapiens
tccagacttcaa

SEQ ID NO: 3225711 - DNA, 18 bp, Homo sapiens
tccagacttcaaaaggaa

SEQ ID NO: 3225712 - DNA, 16 bp, Homo sapiens
tccagagagtggctcc

SEQ ID NO: 3225713 - DNA, 15 bp, Homo sapiens
tccagagcagagttt

SEQ ID NO: 3225714 - DNA, 10 bp, Homo sapiens
tccagagcca

SEQ ID NO: 3225715 - DNA, 13 bp, Homo sapiens
tccagagccagcc

SEQ ID NO: 3225716 - DNA, 15 bp, Homo sapiens
tccagagtctgagcc

SEQ ID NO: 3225717 - DNA, 17 bp, Homo sapiens
tccagagtctgagcccc

SEQ ID NO: 3225718 - DNA, 16 bp, Homo sapiens
tccagatccagactgt

SEQ ID NO: 3225719 - DNA, 17 bp, Homo sapiens
tccagatccagactgta

SEQ ID NO: 3225720 - DNA, 17 bp, Homo sapiens
tccagatctttcagaaa

SEQ ID NO: 3225721 - DNA, 18 bp, Homo sapiens
tccagatgtttccagact

SEQ ID NO: 3225722 - DNA, 19 bp, Homo sapiens
tccagatgtttccagactt

SEQ ID NO: 3225723 - DNA, 19 bp, Homo sapiens
tccagcaacttcttctcca

SEQ ID NO: 3225724 - DNA, 20 bp, Homo sapiens
tccagcaacttcttctccat

SEQ ID NO: 3225725 - DNA, 21 bp, Homo sapiens
tccagcaattctcctgcctca

SEQ ID NO: 3225726 - DNA, 19 bp, Homo sapiens
tccagcaccttctttctgg

SEQ ID NO: 3225727 - DNA, 23 bp, Homo sapiens
tccagcaccttctttctggactg

SEQ ID NO: 3225728 - DNA, 17 bp, Homo sapiens
tccagcagaagacaaaa

SEQ ID NO: 3225729 - DNA, 12 bp, Homo sapiens
tccagcagctgc

SEQ ID NO: 3225730 - DNA, 14 bp, Homo sapiens
tccagcagttttca

SEQ ID NO: 3225731 - DNA, 14 bp, Homo sapiens
tccagcatccagcc

SEQ ID NO: 3225732 - DNA, 15 bp, Homo sapiens
tccagcatccagcct

SEQ ID NO: 3225733 - DNA, 16 bp, Homo sapiens
tccagcatccagcctg

SEQ ID NO: 3225734 - DNA, 17 bp, Homo sapiens
tccagcatccagcctgt

SEQ ID NO: 3225735 - DNA, 9 bp, Homo sapiens
tccagccac

SEQ ID NO: 3225736 - DNA, 19 bp, Homo sapiens
tccagcccatctcggagca

SEQ ID NO: 3225737 - DNA, 16 bp, Homo sapiens
tccagcccctctggtc

SEQ ID NO: 3225738 - DNA, 15 bp, Homo sapiens
tccagcccctgtccc

SEQ ID NO: 3225739 - DNA, 20 bp, Homo sapiens
tccagcccctgtcccacccc

SEQ ID NO: 3225740 - DNA, 23 bp, Homo sapiens
tccagcccctgtcccaccccctt

SEQ ID NO: 3225741 - DNA, 15 bp, Homo sapiens
tccagcccgggagcc

SEQ ID NO: 3225742 - DNA, 14 bp, Homo sapiens
tccagccgaagctg

SEQ ID NO: 3225743 - DNA, 18 bp, Homo sapiens
tccagccgaagtctgtgg

SEQ ID NO: 3225744 - DNA, 19 bp, Homo sapiens
tccagccgccattgccacc

SEQ ID NO: 3225745 - DNA, 20 bp, Homo sapiens
tccagccgccattgccacca

SEQ ID NO: 3225746 - DNA, 13 bp, Homo sapiens
tccagcctctccc

SEQ ID NO: 3225747 - DNA, 15 bp, Homo sapiens
tccagcctctcccgg

SEQ ID NO: 3225748 - DNA, 17 bp, Homo sapiens
tccagcctctcccggct

SEQ ID NO: 3225749 - DNA, 23 bp, Homo sapiens
tccagcctctcccggctgcctgc

SEQ ID NO: 3225750 - DNA, 13 bp, Homo sapiens
tccagcctgagca

SEQ ID NO: 3225751 - DNA, 16 bp, Homo sapiens
tccagcctgcctggca

SEQ ID NO: 3225752 - DNA, 12 bp, Homo sapiens
tccagcctggac

SEQ ID NO: 3225753 - DNA, 17 bp, Homo sapiens
tccagcctggaccccca

SEQ ID NO: 3225754 - DNA, 23 bp, Homo sapiens
tccagcctgggcagccaggctgc

SEQ ID NO: 3225755 - DNA, 17 bp, Homo sapiens
tccagcctgggcgacag

SEQ ID NO: 3225756 - DNA, 20 bp, Homo sapiens
tccagcctgggcgacagagc

SEQ ID NO: 3225757 - DNA, 13 bp, Homo sapiens
tccagcctgtgtg

SEQ ID NO: 3225758 - DNA, 23 bp, Homo sapiens
tccagctcaccagccccagtgcc

SEQ ID NO: 3225759 - DNA, 15 bp, Homo sapiens
tccagctcagaaccc

SEQ ID NO: 3225760 - DNA, 17 bp, Homo sapiens
tccagctcagaacccag

SEQ ID NO: 3225761 - DNA, 19 bp, Homo sapiens
tccagctcagaacccaggg

SEQ ID NO: 3225762 - DNA, 22 bp, Homo sapiens
tccagctctaataaaacagctg

SEQ ID NO: 3225763 - DNA, 15 bp, Homo sapiens
tccagctctgacatc

SEQ ID NO: 3225764 - DNA, 16 bp, Homo sapiens
tccagctctgacatcc

SEQ ID NO: 3225765 - DNA, 18 bp, Homo sapiens
tccagctctgacatccct

SEQ ID NO: 3225766 - DNA, 22 bp, Homo sapiens
tccagctctgacatcccttcct

SEQ ID NO: 3225767 - DNA, 23 bp, Homo sapiens
tccagctctgacatcccttcctg

SEQ ID NO: 3225768 - DNA, 12 bp, Homo sapiens
tccagctctgga

SEQ ID NO: 3225769 - DNA, 17 bp, Homo sapiens
tccagctgcaccagagc

SEQ ID NO: 3225770 - DNA, 13 bp, Homo sapiens
tccagctggcctg

SEQ ID NO: 3225771 - DNA, 18 bp, Homo sapiens
tccagctggcctggacag

SEQ ID NO: 3225772 - DNA, 18 bp, Homo sapiens
tccagctgggaagccctt

SEQ ID NO: 3225773 - DNA, 16 bp, Homo sapiens
tccagcttcaggcacc

SEQ ID NO: 3225774 - DNA, 17 bp, Homo sapiens
tccagcttcaggcacca

SEQ ID NO: 3225775 - DNA, 18 bp, Homo sapiens
tccagcttcaggcaccag

SEQ ID NO: 3225776 - DNA, 20 bp, Homo sapiens
tccagcttcaggcaccagca

SEQ ID NO: 3225777 - DNA, 16 bp, Homo sapiens
tccagctttctgccat

SEQ ID NO: 3225778 - DNA, 23 bp, Homo sapiens
tccaggaaactccacatctgcct

SEQ ID NO: 3225779 - DNA, 19 bp, Homo sapiens
tccaggaaggcagctgctc

SEQ ID NO: 3225780 - DNA, 23 bp, Homo sapiens
tccaggactccactggacagacc

SEQ ID NO: 3225781 - DNA, 17 bp, Homo sapiens
tccaggagagagccagg

SEQ ID NO: 3225782 - DNA, 14 bp, Homo sapiens
tccaggagcctggc

SEQ ID NO: 3225783 - DNA, 23 bp, Homo sapiens
tccaggagcctggctccgtccag

SEQ ID NO: 3225784 - DNA, 15 bp, Homo sapiens
tccaggagcctgtgc

SEQ ID NO: 3225785 - DNA, 12 bp, Homo sapiens
tccaggagctca

SEQ ID NO: 3225786 - DNA, 18 bp, Homo sapiens
tccaggagctcaggaaga

SEQ ID NO: 3225787 - DNA, 18 bp, Homo sapiens
tccaggataaggagactg

SEQ ID NO: 3225788 - DNA, 22 bp, Homo sapiens
tccaggatgctaacatctaaaa

SEQ ID NO: 3225789 - DNA, 19 bp, Homo sapiens
tccaggcacccttctttcc

SEQ ID NO: 3225790 - DNA, 23 bp, Homo sapiens
tccaggcagtcgggggctggcct

SEQ ID NO: 3225791 - DNA, 16 bp, Homo sapiens
tccaggccactgtggc

SEQ ID NO: 3225792 - DNA, 20 bp, Homo sapiens
tccaggccactgtggccaga

SEQ ID NO: 3225793 - DNA, 22 bp, Homo sapiens
tccaggccactgtggccagagc

SEQ ID NO: 3225794 - DNA, 11 bp, Homo sapiens
tccaggcccaa

SEQ ID NO: 3225795 - DNA, 17 bp, Homo sapiens
tccaggcccaaggctcc

SEQ ID NO: 3225796 - DNA, 18 bp, Homo sapiens
tccaggcccaaggctccc

SEQ ID NO: 3225797 - DNA, 19 bp, Homo sapiens
tccaggcccaaggctcccg

SEQ ID NO: 3225798 - DNA, 22 bp, Homo sapiens
tccaggcccctgaggactggag

SEQ ID NO: 3225799 - DNA, 13 bp, Homo sapiens
tccaggccctcca

SEQ ID NO: 3225800 - DNA, 14 bp, Homo sapiens
tccaggccctccag

SEQ ID NO: 3225801 - DNA, 21 bp, Homo sapiens
tccaggccctgccccctccca

SEQ ID NO: 3225802 - DNA, 13 bp, Homo sapiens
tccaggcctgcct

SEQ ID NO: 3225803 - DNA, 14 bp, Homo sapiens
tccaggcctgcctc

SEQ ID NO: 3225804 - DNA, 15 bp, Homo sapiens
tccaggcctgcctcc

SEQ ID NO: 3225805 - DNA, 17 bp, Homo sapiens
tccaggcctgcctccca

SEQ ID NO: 3225806 - DNA, 13 bp, Homo sapiens
tccaggctagtcc

SEQ ID NO: 3225807 - DNA, 19 bp, Homo sapiens
tccaggctcttcctggacc

SEQ ID NO: 3225808 - DNA, 18 bp, Homo sapiens
tccagggaatccaagcct

SEQ ID NO: 3225809 - DNA, 22 bp, Homo sapiens
tccagggaccactgggtgagag

SEQ ID NO: 3225810 - DNA, 17 bp, Homo sapiens
tccagggagcaagacag

SEQ ID NO: 3225811 - DNA, 21 bp, Homo sapiens
tccaggggcccttgggacagc

SEQ ID NO: 3225812 - DNA, 13 bp, Homo sapiens
tccaggggcctgc

SEQ ID NO: 3225813 - DNA, 21 bp, Homo sapiens
tccaggggcctgcagaaggaa

SEQ ID NO: 3225814 - DNA, 18 bp, Homo sapiens
tccagggtccctctgtgt

SEQ ID NO: 3225815 - DNA, 13 bp, Homo sapiens
tccagggtctgag

SEQ ID NO: 3225816 - DNA, 14 bp, Homo sapiens
tccagggtctgagt

SEQ ID NO: 3225817 - DNA, 13 bp, Homo sapiens
tccagggtcttgg

SEQ ID NO: 3225818 - DNA, 17 bp, Homo sapiens
tccagggtcttgggcta

SEQ ID NO: 3225819 - DNA, 17 bp, Homo sapiens
tccaggtgtgcacgtgg

SEQ ID NO: 3225820 - DNA, 17 bp, Homo sapiens
gcaacttcagtcctggg

SEQ ID NO: 3225821 - DNA, 23 bp, Homo sapiens
gcaacttcagttttatttttgcc

SEQ ID NO: 3225822 - DNA, 13 bp, Homo sapiens
aaaaaaaaaaaga

SEQ ID NO: 3225823 - DNA, 13 bp, Homo sapiens
aaaaaaaaatgtt

SEQ ID NO: 3225824 - DNA, 11 bp, Homo sapiens
aaaaaaagaaa

SEQ ID NO: 3225825 - DNA, 13 bp, Homo sapiens
aaaaaaagaaaat

SEQ ID NO: 3225826 - DNA, 14 bp, Homo sapiens
aaaaaaagaagtta

SEQ ID NO: 3225827 - DNA, 11 bp, Homo sapiens
aaaaaaagcaa

SEQ ID NO: 3225828 - DNA, 12 bp, Homo sapiens
aaaaaaagcaaa

SEQ ID NO: 3225829 - DNA, 11 bp, Homo sapiens
aaaaaaagcct

SEQ ID NO: 3225830 - DNA, 14 bp, Homo sapiens
aaaaaaagcctcca

SEQ ID NO: 3225831 - DNA, 13 bp, Homo sapiens
aaaaaaaggaaaa

SEQ ID NO: 3225832 - DNA, 11 bp, Homo sapiens
aaaaaaatagt

SEQ ID NO: 3225833 - DNA, 13 bp, Homo sapiens
aaaaaaatgacta

SEQ ID NO: 3225834 - DNA, 13 bp, Homo sapiens
aaaaaagaaccaa

SEQ ID NO: 3225835 - DNA, 21 bp, Homo sapiens
aaaaaagagaaaaaccaatga

SEQ ID NO: 3225836 - DNA, 12 bp, Homo sapiens
aaaaaagcacat

SEQ ID NO: 3225837 - DNA, 12 bp, Homo sapiens
aaaaaaggaaaa

SEQ ID NO: 3225838 - DNA, 9 bp, Homo sapiens
aaaaaatag

SEQ ID NO: 3225839 - DNA, 13 bp, Homo sapiens
aaaaaatatcaga

SEQ ID NO: 3225840 - DNA, 13 bp, Homo sapiens
aaaaaatctatcc

SEQ ID NO: 3225841 - DNA, 22 bp, Homo sapiens
aaaaaatctctcagagccctca

SEQ ID NO: 3225842 - DNA, 11 bp, Homo sapiens
aaaaaatgtcc

SEQ ID NO: 3225843 - DNA, 11 bp, Homo sapiens
aaaaaattggt

SEQ ID NO: 3225844 - DNA, 22 bp, Homo sapiens
aaaaaatttgagaaagccttca

SEQ ID NO: 3225845 - DNA, 12 bp, Homo sapiens
aaaaacactagt

SEQ ID NO: 3225846 - DNA, 17 bp, Homo sapiens
aaaaacagcattgcttt

SEQ ID NO: 3225847 - DNA, 21 bp, Homo sapiens
aaaaacagcattgctttctga

SEQ ID NO: 3225848 - DNA, 18 bp, Homo sapiens
aaaaacagccaccgtttc

SEQ ID NO: 3225849 - DNA, 18 bp, Homo sapiens
aaaaacaggtatatactt

SEQ ID NO: 3225850 - DNA, 14 bp, Homo sapiens
aaaaacatattctt

SEQ ID NO: 3225851 - DNA, 15 bp, Homo sapiens
aaaaacatattcttg

SEQ ID NO: 3225852 - DNA, 20 bp, Homo sapiens
aaaaacatgtatgtgcattt

SEQ ID NO: 3225853 - DNA, 17 bp, Homo sapiens
aaaaaccaatgattcat

SEQ ID NO: 3225854 - DNA, 17 bp, Homo sapiens
aaaaaccgttcaaattc

SEQ ID NO: 3225855 - DNA, 22 bp, Homo sapiens
aaaaaccttgtaaaaaaagcaa

SEQ ID NO: 3225856 - DNA, 14 bp, Homo sapiens
aaaaactccttttg

SEQ ID NO: 3225857 - DNA, 15 bp, Homo sapiens
aaaaactgtctttaa

SEQ ID NO: 3225858 - DNA, 21 bp, Homo sapiens
aaaaacttagtgacaaaatag

SEQ ID NO: 3225859 - DNA, 23 bp, Homo sapiens
aaaaacttcatgtaattttattt

SEQ ID NO: 3225860 - DNA, 18 bp, Homo sapiens
aaaaacttgtaaatgctg

SEQ ID NO: 3225861 - DNA, 13 bp, Homo sapiens
aaaaactttcatt

SEQ ID NO: 3225862 - DNA, 14 bp, Homo sapiens
aaaaagaaaagata

SEQ ID NO: 3225863 - DNA, 14 bp, Homo sapiens
aaaaagaaaatgaa

SEQ ID NO: 3225864 - DNA, 14 bp, Homo sapiens
aaaaagaaatcttg

SEQ ID NO: 3225865 - DNA, 22 bp, Homo sapiens
aaaaagaagttactttgtaatt

SEQ ID NO: 3225866 - DNA, 12 bp, Homo sapiens
aaaaagactatt

SEQ ID NO: 3225867 - DNA, 18 bp, Homo sapiens
aaaaagactgaacatgtt

SEQ ID NO: 3225868 - DNA, 16 bp, Homo sapiens
aaaaagcacatacatt

SEQ ID NO: 3225869 - DNA, 21 bp, Homo sapiens
aaaaagcagacagaagtcact

SEQ ID NO: 3225870 - DNA, 23 bp, Homo sapiens
aaaaagcagagtggactgcattt

SEQ ID NO: 3225871 - DNA, 13 bp, Homo sapiens
aaaaagcagctac

SEQ ID NO: 3225872 - DNA, 20 bp, Homo sapiens
aaaaagcataaaaacatttt

SEQ ID NO: 3225873 - DNA, 23 bp, Homo sapiens
aaaaagccagtttgggtaaaata

SEQ ID NO: 3225874 - DNA, 23 bp, Homo sapiens
aaaaagcctaacaaatgggatta

SEQ ID NO: 3225875 - DNA, 18 bp, Homo sapiens
aaaaagctcactgctgat

SEQ ID NO: 3225876 - DNA, 22 bp, Homo sapiens
aaaaagcttgtggccaatggaa

SEQ ID NO: 3225877 - DNA, 14 bp, Homo sapiens
aaaaagctttttcc

SEQ ID NO: 3225878 - DNA, 12 bp, Homo sapiens
aaaaaggaaaaa

SEQ ID NO: 3225879 - DNA, 15 bp, Homo sapiens
aaaaaggaaatttgt

SEQ ID NO: 3225880 - DNA, 16 bp, Homo sapiens
aaaaaggccaaagata

SEQ ID NO: 3225881 - DNA, 18 bp, Homo sapiens
aaaaaggccaaagataaa

SEQ ID NO: 3225882 - DNA, 21 bp, Homo sapiens
aaaccaaacttgttcatttag

SEQ ID NO: 3225883 - DNA, 19 bp, Homo sapiens
aaaccaaagagggcttcct

SEQ ID NO: 3225884 - DNA, 21 bp, Homo sapiens
aaaccaaagagggcttcctct

SEQ ID NO: 3225885 - DNA, 22 bp, Homo sapiens
aaaccaacctttaaaattgtca

SEQ ID NO: 3225886 - DNA, 14 bp, Homo sapiens
aaaccaactctaat

SEQ ID NO: 3225887 - DNA, 12 bp, Homo sapiens
aaaccaatgatt

SEQ ID NO: 3225888 - DNA, 14 bp, Homo sapiens
aaaccaatttcttc

SEQ ID NO: 3225889 - DNA, 16 bp, Homo sapiens
aaaccaatttcttcct

SEQ ID NO: 3225890 - DNA, 18 bp, Homo sapiens
aaaccaatttcttccttc

SEQ ID NO: 3225891 - DNA, 20 bp, Homo sapiens
aaaccaatttcttccttcca

SEQ ID NO: 3225892 - DNA, 14 bp, Homo sapiens
aaaccacaactttt

SEQ ID NO: 3225893 - DNA, 15 bp, Homo sapiens
aaaccactagaaagt

SEQ ID NO: 3225894 - DNA, 16 bp, Homo sapiens
aaaccagacaaggaaa

SEQ ID NO: 3225895 - DNA, 13 bp, Homo sapiens
aaaccagcaggtg

SEQ ID NO: 3225896 - DNA, 16 bp, Homo sapiens
aaaccagccttcggag

SEQ ID NO: 3225897 - DNA, 15 bp, Homo sapiens
aaaccaggacattaa

SEQ ID NO: 3225898 - DNA, 17 bp, Homo sapiens
aaaccatatgaacatat

SEQ ID NO: 3225899 - DNA, 17 bp, Homo sapiens
aaaccatattttattgt

SEQ ID NO: 3225900 - DNA, 23 bp, Homo sapiens
aaaccatccagtgacaaaccatc

SEQ ID NO: 3225901 - DNA, 15 bp, Homo sapiens
aaaccattgtaacta

SEQ ID NO: 3225902 - DNA, 18 bp, Homo sapiens
aaaccattgtaactatta

SEQ ID NO: 3225903 - DNA, 22 bp, Homo sapiens
aaaccattgtaactattaacct

SEQ ID NO: 3225904 - DNA, 13 bp, Homo sapiens
aaacccaagtccc

SEQ ID NO: 3225905 - DNA, 23 bp, Homo sapiens
aaacccaagtttatttctctctt

SEQ ID NO: 3225906 - DNA, 12 bp, Homo sapiens
aaacccacagtt

SEQ ID NO: 3225907 - DNA, 18 bp, Homo sapiens
aaacccagacaaccaaaa

SEQ ID NO: 3225908 - DNA, 13 bp, Homo sapiens
aaacccagggcaa

SEQ ID NO: 3225909 - DNA, 14 bp, Homo sapiens
aaaccctagccttg

SEQ ID NO: 3225910 - DNA, 17 bp, Homo sapiens
aaaccctagccttgctt

SEQ ID NO: 3225911 - DNA, 18 bp, Homo sapiens
aaaccctcattgtgtttc

SEQ ID NO: 3225912 - DNA, 17 bp, Homo sapiens
aaaccctggcttgcttg

SEQ ID NO: 3225913 - DNA, 21 bp, Homo sapiens
aaaccctggtggtattttatt

SEQ ID NO: 3225914 - DNA, 18 bp, Homo sapiens
aaacctatcctcactgcc

SEQ ID NO: 3225915 - DNA, 18 bp, Homo sapiens
aaacctgacccctgctca

SEQ ID NO: 3225916 - DNA, 22 bp, Homo sapiens
aaacctgcagttaacaggatat

SEQ ID NO: 3225917 - DNA, 18 bp, Homo sapiens
aaacctgggattcaggaa

SEQ ID NO: 3225918 - DNA, 17 bp, Homo sapiens
aaacctgggctcagcct

SEQ ID NO: 3225919 - DNA, 21 bp, Homo sapiens
aaacctgggtatgttcctaag

SEQ ID NO: 3225920 - DNA, 16 bp, Homo sapiens
aaacctgtagaatcaa

SEQ ID NO: 3225921 - DNA, 18 bp, Homo sapiens
aaaccttattgtacctct

SEQ ID NO: 3225922 - DNA, 13 bp, Homo sapiens
aaaccttcagaag

SEQ ID NO: 3225923 - DNA, 14 bp, Homo sapiens
aaaccttgcctttc

SEQ ID NO: 3225924 - DNA, 20 bp, Homo sapiens
aaaccttgctaattttctca

SEQ ID NO: 3225925 - DNA, 15 bp, Homo sapiens
aaaccttgttctatt

SEQ ID NO: 3225926 - DNA, 16 bp, Homo sapiens
aaaccttgttctattt

SEQ ID NO: 3225927 - DNA, 20 bp, Homo sapiens
aaaccttgttctatttttca

SEQ ID NO: 3225928 - DNA, 11 bp, Homo sapiens
aaacctttcaa

SEQ ID NO: 3225929 - DNA, 17 bp, Homo sapiens
aaacctttcaaatttca

SEQ ID NO: 3225930 - DNA, 21 bp, Homo sapiens
aaacgccccgggcaaagggtc

SEQ ID NO: 3225931 - DNA, 13 bp, Homo sapiens
aaacgctgtcaaa

SEQ ID NO: 3225932 - DNA, 20 bp, Homo sapiens
aaacgggaacatgccccctg

SEQ ID NO: 3225933 - DNA, 23 bp, Homo sapiens
aaacgtcctctttagtttttggt

SEQ ID NO: 3225934 - DNA, 18 bp, Homo sapiens
aaacgtcttattgtggta

SEQ ID NO: 3225935 - DNA, 17 bp, Homo sapiens
aaacgtgtcacacttgt

SEQ ID NO: 3225936 - DNA, 22 bp, Homo sapiens
aaacgtttcagtaataaaacat

SEQ ID NO: 3225937 - DNA, 17 bp, Homo sapiens
aaacgttttgtttgaaa

SEQ ID NO: 3225938 - DNA, 12 bp, Homo sapiens
aaactaaaaata

SEQ ID NO: 3225939 - DNA, 14 bp, Homo sapiens
aaactaaaaatatt

SEQ ID NO: 3225940 - DNA, 15 bp, Homo sapiens
aaactaagattcttt

SEQ ID NO: 3225941 - DNA, 12 bp, Homo sapiens
aaactaatgtga

SEQ ID NO: 3225942 - DNA, 18 bp, Homo sapiens
aaactacagacctgcttt

SEQ ID NO: 3225943 - DNA, 16 bp, Homo sapiens
aaactactgaatgaag

SEQ ID NO: 3225944 - DNA, 17 bp, Homo sapiens
aaactaggaaatttttt

SEQ ID NO: 3225945 - DNA, 17 bp, Homo sapiens
aaactaggtaatgtttt

SEQ ID NO: 3225946 - DNA, 16 bp, Homo sapiens
aaactagtttttccta

SEQ ID NO: 3225947 - DNA, 16 bp, Homo sapiens
aaactatcagtttgtc

SEQ ID NO: 3225948 - DNA, 16 bp, Homo sapiens
aaactatctgtattta

SEQ ID NO: 3225949 - DNA, 16 bp, Homo sapiens
aaactatcttggtgaa

SEQ ID NO: 3225950 - DNA, 20 bp, Homo sapiens
aaactatttttgtaaaagac

SEQ ID NO: 3225951 - DNA, 13 bp, Homo sapiens
aaactcaaaactt

SEQ ID NO: 3225952 - DNA, 22 bp, Homo sapiens
aaactcaaaacttaacatattt

SEQ ID NO: 3225953 - DNA, 13 bp, Homo sapiens
aaactcaagacaa

SEQ ID NO: 3225954 - DNA, 14 bp, Homo sapiens
aaactcaagacaat

SEQ ID NO: 3225955 - DNA, 22 bp, Homo sapiens
aaactcacggaccactcgaggc

SEQ ID NO: 3225956 - DNA, 16 bp, Homo sapiens
aaactcactgctcaag

SEQ ID NO: 3225957 - DNA, 13 bp, Homo sapiens
aaactcactgtga

SEQ ID NO: 3225958 - DNA, 22 bp, Homo sapiens
aaactcactgtgatcaatattt

SEQ ID NO: 3225959 - DNA, 19 bp, Homo sapiens
aaactcagaatataacatg

SEQ ID NO: 3225960 - DNA, 17 bp, Homo sapiens
aaactcagggacagagc

SEQ ID NO: 3225961 - DNA, 19 bp, Homo sapiens
aaactcagggacagagcca

SEQ ID NO: 3225962 - DNA, 12 bp, Homo sapiens
aaactcattgca

SEQ ID NO: 3225963 - DNA, 15 bp, Homo sapiens
aaactcattgcagca

SEQ ID NO: 3225964 - DNA, 12 bp, Homo sapiens
aaactcattttt

SEQ ID NO: 3225965 - DNA, 18 bp, Homo sapiens
aaactccacatctgcctt

SEQ ID NO: 3225966 - DNA, 15 bp, Homo sapiens
aaactccaccttccc

SEQ ID NO: 3225967 - DNA, 14 bp, Homo sapiens
aaactcgaaaataa

SEQ ID NO: 3225968 - DNA, 21 bp, Homo sapiens
aaactctaaacattaatcaat

SEQ ID NO: 3225969 - DNA, 15 bp, Homo sapiens
aaactctacatttaa

SEQ ID NO: 3225970 - DNA, 14 bp, Homo sapiens
aaactctttaactt

SEQ ID NO: 3225971 - DNA, 13 bp, Homo sapiens
aaactcttttccc

SEQ ID NO: 3225972 - DNA, 12 bp, Homo sapiens
aaactgaaaatc

SEQ ID NO: 3225973 - DNA, 15 bp, Homo sapiens
aaactgaaagtgttt

SEQ ID NO: 3225974 - DNA, 23 bp, Homo sapiens
aaactgaaagtgttttactcttt

SEQ ID NO: 3225975 - DNA, 14 bp, Homo sapiens
aaactgaatatttt

SEQ ID NO: 3225976 - DNA, 17 bp, Homo sapiens
aaactgaatttgtactt

SEQ ID NO: 3225977 - DNA, 12 bp, Homo sapiens
aaactgacttta

SEQ ID NO: 3225978 - DNA, 11 bp, Homo sapiens
aaactgagcct

SEQ ID NO: 3225979 - DNA, 22 bp, Homo sapiens
aaactgagcctcacttgccctc

SEQ ID NO: 3225980 - DNA, 14 bp, Homo sapiens
aaactgaggaattt

SEQ ID NO: 3225981 - DNA, 19 bp, Homo sapiens
aaactgaggaatttcacct

SEQ ID NO: 3225982 - DNA, 21 bp, Homo sapiens
aaactgatggaccgggtgggc

SEQ ID NO: 3225983 - DNA, 12 bp, Homo sapiens
aaactgcaatag

SEQ ID NO: 3225984 - DNA, 18 bp, Homo sapiens
aaactgcaatagagactg

SEQ ID NO: 3225985 - DNA, 22 bp, Homo sapiens
aaactgcaatagagactgtaga

SEQ ID NO: 3225986 - DNA, 15 bp, Homo sapiens
aaactgcacagtgct

SEQ ID NO: 3225987 - DNA, 14 bp, Homo sapiens
aaactgcattagaa

SEQ ID NO: 3225988 - DNA, 16 bp, Homo sapiens
aaactgctaaattcta

SEQ ID NO: 3225989 - DNA, 23 bp, Homo sapiens
aaactgctaaattctatgttaaa

SEQ ID NO: 3225990 - DNA, 21 bp, Homo sapiens
aaactgcttttttttttccag

SEQ ID NO: 3225991 - DNA, 15 bp, Homo sapiens
aaactggcctgactt

SEQ ID NO: 3225992 - DNA, 15 bp, Homo sapiens
aaactgggataactg

SEQ ID NO: 3225993 - DNA, 17 bp, Homo sapiens
aaactggggcctccaga

SEQ ID NO: 3225994 - DNA, 18 bp, Homo sapiens
aaactggggcctccagaa

SEQ ID NO: 3225995 - DNA, 16 bp, Homo sapiens
aaactggggcctccct

SEQ ID NO: 3225996 - DNA, 21 bp, Homo sapiens
aaactgggtatgcgtttcatg

SEQ ID NO: 3225997 - DNA, 18 bp, Homo sapiens
aaactggtatgaataatt

SEQ ID NO: 3225998 - DNA, 20 bp, Homo sapiens
aaactggtatgaataattgc

SEQ ID NO: 3225999 - DNA, 18 bp, Homo sapiens
aaactgtagaaatgatga

SEQ ID NO: 3226000 - DNA, 18 bp, Homo sapiens
aaactgtatcaaatctgt

SEQ ID NO: 3226001 - DNA, 19 bp, Homo sapiens
aaactgtctttaaaagaga

SEQ ID NO: 3226002 - DNA, 16 bp, Homo sapiens
aaactgtgtattccaa

SEQ ID NO: 3226003 - DNA, 19 bp, Homo sapiens
aaactgttagcactgttga

SEQ ID NO: 3226004 - DNA, 22 bp, Homo sapiens
aaactgttagcactgttgatgt

SEQ ID NO: 3226005 - DNA, 20 bp, Homo sapiens
aaactgttctctttaaaata

SEQ ID NO: 3226006 - DNA, 23 bp, Homo sapiens
aaacttaactttaactgaacaat

SEQ ID NO: 3226007 - DNA, 14 bp, Homo sapiens
aaacttaagaaaca

SEQ ID NO: 3226008 - DNA, 23 bp, Homo sapiens
aaacttacctaagtgacatttgt

SEQ ID NO: 3226009 - DNA, 17 bp, Homo sapiens
aaagtgtttatttttca

SEQ ID NO: 3226010 - DNA, 18 bp, Homo sapiens
aaagtgtttatttttcat

SEQ ID NO: 3226011 - DNA, 20 bp, Homo sapiens
aaagtgtttatttttcatat

SEQ ID NO: 3226012 - DNA, 21 bp, Homo sapiens
aaagtgtttatttttcatatt

SEQ ID NO: 3226013 - DNA, 13 bp, Homo sapiens
aaagtgtttgcct

SEQ ID NO: 3226014 - DNA, 14 bp, Homo sapiens
aaagtgttttcaga

SEQ ID NO: 3226015 - DNA, 15 bp, Homo sapiens
aaagtgttttcagag

SEQ ID NO: 3226016 - DNA, 16 bp, Homo sapiens
aaagttaaacattgaa

SEQ ID NO: 3226017 - DNA, 16 bp, Homo sapiens
aaagttaacagatttt

SEQ ID NO: 3226018 - DNA, 20 bp, Homo sapiens
aaagttaattcacctatgtt

SEQ ID NO: 3226019 - DNA, 12 bp, Homo sapiens
aaagttactagg

SEQ ID NO: 3226020 - DNA, 15 bp, Homo sapiens
aaagttactaggtaa

SEQ ID NO: 3226021 - DNA, 21 bp, Homo sapiens
aaagttactaggtaacttcat

SEQ ID NO: 3226022 - DNA, 18 bp, Homo sapiens
aaagttagcctttgaatg

SEQ ID NO: 3226023 - DNA, 13 bp, Homo sapiens
aaagttattatgt

SEQ ID NO: 3226024 - DNA, 13 bp, Homo sapiens
aaagttatttatg

SEQ ID NO: 3226025 - DNA, 22 bp, Homo sapiens
aaagttcatagggtctcttcag

SEQ ID NO: 3226026 - DNA, 18 bp, Homo sapiens
aaagttccaagagtctaa

SEQ ID NO: 3226027 - DNA, 21 bp, Homo sapiens
aaagttccaagagtctaaaga

SEQ ID NO: 3226028 - DNA, 21 bp, Homo sapiens
aaagttccctacttcctgtga

SEQ ID NO: 3226029 - DNA, 18 bp, Homo sapiens
aaagttccctgaaacacg

SEQ ID NO: 3226030 - DNA, 17 bp, Homo sapiens
aaagttctaagattctg

SEQ ID NO: 3226031 - DNA, 18 bp, Homo sapiens
aaagttctaataatttct

SEQ ID NO: 3226032 - DNA, 19 bp, Homo sapiens
aaagttctaataatttcta

SEQ ID NO: 3226033 - DNA, 21 bp, Homo sapiens
aaagttctgtgtaaacagaag

SEQ ID NO: 3226034 - DNA, 16 bp, Homo sapiens
aaagttctgtgtattt

SEQ ID NO: 3226035 - DNA, 21 bp, Homo sapiens
aaagttctgtgtatttaattg

SEQ ID NO: 3226036 - DNA, 20 bp, Homo sapiens
aaagttgaaccattatactt

SEQ ID NO: 3226037 - DNA, 17 bp, Homo sapiens
aaagttgcagatgtatt

SEQ ID NO: 3226038 - DNA, 13 bp, Homo sapiens
aaagttggactaa

SEQ ID NO: 3226039 - DNA, 14 bp, Homo sapiens
aaagttggactaaa

SEQ ID NO: 3226040 - DNA, 19 bp, Homo sapiens
aaagttggactaaatgcct

SEQ ID NO: 3226041 - DNA, 17 bp, Homo sapiens
aaagttggtattaataa

SEQ ID NO: 3226042 - DNA, 18 bp, Homo sapiens
aaagttggtattaataaa

SEQ ID NO: 3226043 - DNA, 17 bp, Homo sapiens
aaagttgtataaaaaca

SEQ ID NO: 3226044 - DNA, 13 bp, Homo sapiens
aaagtttcaatgt

SEQ ID NO: 3226045 - DNA, 13 bp, Homo sapiens
aaagtttccatat

SEQ ID NO: 3226046 - DNA, 15 bp, Homo sapiens
aaagtttgcttagaa

SEQ ID NO: 3226047 - DNA, 16 bp, Homo sapiens
aaagtttgcttagaaa

SEQ ID NO: 3226048 - DNA, 13 bp, Homo sapiens
aaagttttatcaa

SEQ ID NO: 3226049 - DNA, 16 bp, Homo sapiens
aaagttttatttttct

SEQ ID NO: 3226050 - DNA, 15 bp, Homo sapiens
aaagttttccagtat

SEQ ID NO: 3226051 - DNA, 16 bp, Homo sapiens
aaagttttgaaaagct

SEQ ID NO: 3226052 - DNA, 23 bp, Homo sapiens
aaagttttgagtagatattactt

SEQ ID NO: 3226053 - DNA, 24 bp, Homo sapiens
aaagttttgagtagatattacttt

SEQ ID NO: 3226054 - DNA, 21 bp, Homo sapiens
aaagttttgatgaaattcttg

SEQ ID NO: 3226055 - DNA, 12 bp, Homo sapiens
aaagttttgttg

SEQ ID NO: 3226056 - DNA, 23 bp, Homo sapiens
aaagttttgttgtacttaaatgg

SEQ ID NO: 3226057 - DNA, 14 bp, Homo sapiens
aaagtttttgtttg

SEQ ID NO: 3226058 - DNA, 19 bp, Homo sapiens
aaataaaaaaaaaaggatg

SEQ ID NO: 3226059 - DNA, 22 bp, Homo sapiens
aaataaaaaaaaaaggatgaaa

SEQ ID NO: 3226060 - DNA, 18 bp, Homo sapiens
aaataaaaaagtctctat

SEQ ID NO: 3226061 - DNA, 18 bp, Homo sapiens
aaataaaaaatctgaaga

SEQ ID NO: 3226062 - DNA, 23 bp, Homo sapiens
aaataaaaactaaattgtaaact

SEQ ID NO: 3226063 - DNA, 15 bp, Homo sapiens
aaataaaaagtgaca

SEQ ID NO: 3226064 - DNA, 20 bp, Homo sapiens
aaataaaaagtgacacagca

SEQ ID NO: 3226065 - DNA, 14 bp, Homo sapiens
aaataaaaataaat

SEQ ID NO: 3226066 - DNA, 14 bp, Homo sapiens
aaataaaaatattg

SEQ ID NO: 3226067 - DNA, 15 bp, Homo sapiens
aaataaaaatggata

SEQ ID NO: 3226068 - DNA, 14 bp, Homo sapiens
aaataaaaccagct

SEQ ID NO: 3226069 - DNA, 12 bp, Homo sapiens
aaataaaacctt

SEQ ID NO: 3226070 - DNA, 13 bp, Homo sapiens
aaataaaaccttt

SEQ ID NO: 3226071 - DNA, 15 bp, Homo sapiens
aaataaaacctttca

SEQ ID NO: 3226072 - DNA, 13 bp, Homo sapiens
aaataaaactgaa

SEQ ID NO: 3226073 - DNA, 12 bp, Homo sapiens
aaataaaactgt

SEQ ID NO: 3226074 - DNA, 11 bp, Homo sapiens
aaataaaagca

SEQ ID NO: 3226075 - DNA, 19 bp, Homo sapiens
aaataaaagcagcatctgc

SEQ ID NO: 3226076 - DNA, 14 bp, Homo sapiens
aaataaaataaagc

SEQ ID NO: 3226077 - DNA, 15 bp, Homo sapiens
aaataaaatgaaaat

SEQ ID NO: 3226078 - DNA, 23 bp, Homo sapiens
aaataaaatgaaaattgtattat

SEQ ID NO: 3226079 - DNA, 16 bp, Homo sapiens
aaataaaatgtgtaca

SEQ ID NO: 3226080 - DNA, 13 bp, Homo sapiens
aaataaaccaaat

SEQ ID NO: 3226081 - DNA, 14 bp, Homo sapiens
aaataaaccaaata

SEQ ID NO: 3226082 - DNA, 15 bp, Homo sapiens
aaataaaccaaatat

SEQ ID NO: 3226083 - DNA, 12 bp, Homo sapiens
aaataaactgtt

SEQ ID NO: 3226084 - DNA, 13 bp, Homo sapiens
aaataaactgttt

SEQ ID NO: 3226085 - DNA, 14 bp, Homo sapiens
aaataaactgttta

SEQ ID NO: 3226086 - DNA, 15 bp, Homo sapiens
aaataaactgtttat

SEQ ID NO: 3226087 - DNA, 17 bp, Homo sapiens
aaataaactgtttatat

SEQ ID NO: 3226088 - DNA, 11 bp, Homo sapiens
aaataaacttt

SEQ ID NO: 3226089 - DNA, 17 bp, Homo sapiens
aaataaactttttttca

SEQ ID NO: 3226090 - DNA, 19 bp, Homo sapiens
aaataaactttttttcaat

SEQ ID NO: 3226091 - DNA, 20 bp, Homo sapiens
aaataaactttttttcaatg

SEQ ID NO: 3226092 - DNA, 21 bp, Homo sapiens
aaataaactttttttcaatgt

SEQ ID NO: 3226093 - DNA, 12 bp, Homo sapiens
aaataaagcctt

SEQ ID NO: 3226094 - DNA, 20 bp, Homo sapiens
aaataaagcttgcaacaaaa

SEQ ID NO: 3226095 - DNA, 16 bp, Homo sapiens
aaataaaggataactc

SEQ ID NO: 3226096 - DNA, 13 bp, Homo sapiens
aaataaagtatat

SEQ ID NO: 3226097 - DNA, 20 bp, Homo sapiens
aaataaagtatatatagaat

SEQ ID NO: 3226098 - DNA, 15 bp, Homo sapiens
aaataaatagaaaag

SEQ ID NO: 3226099 - DNA, 13 bp, Homo sapiens
aaataaatagctt

SEQ ID NO: 3226100 - DNA, 12 bp, Homo sapiens
aaataaatgaat

SEQ ID NO: 3226101 - DNA, 15 bp, Homo sapiens
aaataaatgtatcat

SEQ ID NO: 3226102 - DNA, 13 bp, Homo sapiens
aaataaatgtgca

SEQ ID NO: 3226103 - DNA, 12 bp, Homo sapiens
aaataaattagt

SEQ ID NO: 3226104 - DNA, 11 bp, Homo sapiens
aaataaattat

SEQ ID NO: 3226105 - DNA, 14 bp, Homo sapiens
aaataaattcctaa

SEQ ID NO: 3226106 - DNA, 23 bp, Homo sapiens
aaataaattggtgataagtggaa

SEQ ID NO: 3226107 - DNA, 12 bp, Homo sapiens
aaataaatttct

SEQ ID NO: 3226108 - DNA, 14 bp, Homo sapiens
aaataacaatgtta

SEQ ID NO: 3226109 - DNA, 13 bp, Homo sapiens
aaataacacacat

SEQ ID NO: 3226110 - DNA, 12 bp, Homo sapiens
aaataacagtat

SEQ ID NO: 3226111 - DNA, 16 bp, Homo sapiens
aaataaccacaaggtc

SEQ ID NO: 3226112 - DNA, 17 bp, Homo sapiens
aaataactgaaccaaat

SEQ ID NO: 3226113 - DNA, 19 bp, Homo sapiens
aaataactgaaccaaattg

SEQ ID NO: 3226114 - DNA, 16 bp, Homo sapiens
aaataacttcaagcaa

SEQ ID NO: 3226115 - DNA, 16 bp, Homo sapiens
aaataagaaataatgc

SEQ ID NO: 3226116 - DNA, 14 bp, Homo sapiens
aaataagaatagaa

SEQ ID NO: 3226117 - DNA, 12 bp, Homo sapiens
aaataagattct

SEQ ID NO: 3226118 - DNA, 14 bp, Homo sapiens
aaataagattctaa

SEQ ID NO: 3226119 - DNA, 13 bp, Homo sapiens
aaataagcaggtg

SEQ ID NO: 3226120 - DNA, 22 bp, Homo sapiens
aaataagcaggtggatctattt

SEQ ID NO: 3226121 - DNA, 18 bp, Homo sapiens
aaataagctcgagtgaat

SEQ ID NO: 3226122 - DNA, 19 bp, Homo sapiens
aaataagtaaataataaat

SEQ ID NO: 3226123 - DNA, 15 bp, Homo sapiens
aaataagtatttata

SEQ ID NO: 3226124 - DNA, 17 bp, Homo sapiens
aaataagtatttataat

SEQ ID NO: 3226125 - DNA, 15 bp, Homo sapiens
aaataataataatgt

SEQ ID NO: 3226126 - DNA, 13 bp, Homo sapiens
aaataatgctaca

SEQ ID NO: 3226127 - DNA, 19 bp, Homo sapiens
aaataatgctacaatttta

SEQ ID NO: 3226128 - DNA, 20 bp, Homo sapiens
aaataatgctacaattttaa

SEQ ID NO: 3226129 - DNA, 17 bp, Homo sapiens
aaataatgcttcagata

SEQ ID NO: 3226130 - DNA, 21 bp, Homo sapiens
aaataatgcttcagatattat

SEQ ID NO: 3226131 - DNA, 12 bp, Homo sapiens
aaataattattt

SEQ ID NO: 3226132 - DNA, 14 bp, Homo sapiens
aaataattgccaca

SEQ ID NO: 3226133 - DNA, 15 bp, Homo sapiens
aaataattgtgtcat

SEQ ID NO: 3226134 - DNA, 12 bp, Homo sapiens
aaataattttaa

SEQ ID NO: 3226135 - DNA, 19 bp, Homo sapiens
aaataattttaaataacct

SEQ ID NO: 3226136 - DNA, 12 bp, Homo sapiens
aaatacaataaa

SEQ ID NO: 3226137 - DNA, 15 bp, Homo sapiens
aacaaacaaaactta

SEQ ID NO: 3226138 - DNA, 15 bp, Homo sapiens
aacaaacattgtgtt

SEQ ID NO: 3226139 - DNA, 21 bp, Homo sapiens
aacaaacattgtgttgacatt

SEQ ID NO: 3226140 - DNA, 17 bp, Homo sapiens
aacaaacctcactgaga

SEQ ID NO: 3226141 - DNA, 15 bp, Homo sapiens
aacaaactaaaaata

SEQ ID NO: 3226142 - DNA, 19 bp, Homo sapiens
aacaaagagaaaaaataca

SEQ ID NO: 3226143 - DNA, 15 bp, Homo sapiens
aacaaagcacagtgt

SEQ ID NO: 3226144 - DNA, 13 bp, Homo sapiens
aacaaagccaaac

SEQ ID NO: 3226145 - DNA, 15 bp, Homo sapiens
aacaaagctgttaaa

SEQ ID NO: 3226146 - DNA, 17 bp, Homo sapiens
aacaaagctgttaaact

SEQ ID NO: 3226147 - DNA, 20 bp, Homo sapiens
aacaaagtgactgtttggct

SEQ ID NO: 3226148 - DNA, 19 bp, Homo sapiens
aacaaatcaaattgcttaa

SEQ ID NO: 3226149 - DNA, 15 bp, Homo sapiens
aacaaattatttttg

SEQ ID NO: 3226150 - DNA, 13 bp, Homo sapiens
aacaacaattggt

SEQ ID NO: 3226151 - DNA, 18 bp, Homo sapiens
aacaacctcaactgccta

SEQ ID NO: 3226152 - DNA, 15 bp, Homo sapiens
aacaacgtgagagaa

SEQ ID NO: 3226153 - DNA, 19 bp, Homo sapiens
aacaacgtgtatagtgcct

SEQ ID NO: 3226154 - DNA, 22 bp, Homo sapiens
aacaacttaatgttctgaataa

SEQ ID NO: 3226155 - DNA, 15 bp, Homo sapiens
aacaacttggcattt

SEQ ID NO: 3226156 - DNA, 12 bp, Homo sapiens
aacaagaattgg

SEQ ID NO: 3226157 - DNA, 22 bp, Homo sapiens
aacaagaccaccacttcgaaac

SEQ ID NO: 3226158 - DNA, 22 bp, Homo sapiens
aacaagacctcagtgccttcct

SEQ ID NO: 3226159 - DNA, 18 bp, Homo sapiens
aacaagagtttgttctgt

SEQ ID NO: 3226160 - DNA, 23 bp, Homo sapiens
aacaagagtttgttctgttctgg

SEQ ID NO: 3226161 - DNA, 12 bp, Homo sapiens
aacaagatttcc

SEQ ID NO: 3226162 - DNA, 20 bp, Homo sapiens
aacaagatttccttgtgcaa

SEQ ID NO: 3226163 - DNA, 20 bp, Homo sapiens
aacaagatttgtaattacag

SEQ ID NO: 3226164 - DNA, 12 bp, Homo sapiens
aacaagctgtgc

SEQ ID NO: 3226165 - DNA, 17 bp, Homo sapiens
aacaaggagctcaccct

SEQ ID NO: 3226166 - DNA, 21 bp, Homo sapiens
aacaagggagagacctcatca

SEQ ID NO: 3226167 - DNA, 19 bp, Homo sapiens
aacaaggggctgttacata

SEQ ID NO: 3226168 - DNA, 14 bp, Homo sapiens
aacaagtaagaaaa

SEQ ID NO: 3226169 - DNA, 14 bp, Homo sapiens
aacaagtaatgtat

SEQ ID NO: 3226170 - DNA, 15 bp, Homo sapiens
aacaagtaatgtatt

SEQ ID NO: 3226171 - DNA, 13 bp, Homo sapiens
aacaagtaccaaa

SEQ ID NO: 3226172 - DNA, 19 bp, Homo sapiens
aacaagtcacagctgcagc

SEQ ID NO: 3226173 - DNA, 20 bp, Homo sapiens
aacaagtgctcctgaaagaa

SEQ ID NO: 3226174 - DNA, 16 bp, Homo sapiens
aacaagtggatgtttt

SEQ ID NO: 3226175 - DNA, 22 bp, Homo sapiens
aacaagtggatgtttttaatga

SEQ ID NO: 3226176 - DNA, 20 bp, Homo sapiens
aacaagttttaatgtatagt

SEQ ID NO: 3226177 - DNA, 17 bp, Homo sapiens
aacaagtttttctgtca

SEQ ID NO: 3226178 - DNA, 14 bp, Homo sapiens
aacaataaaatttt

SEQ ID NO: 3226179 - DNA, 15 bp, Homo sapiens
aacaataactactgt

SEQ ID NO: 3226180 - DNA, 14 bp, Homo sapiens
aacaatacaaatgg

SEQ ID NO: 3226181 - DNA, 15 bp, Homo sapiens
aacaatacaaatgga

SEQ ID NO: 3226182 - DNA, 15 bp, Homo sapiens
aacaatacatgagaa

SEQ ID NO: 3226183 - DNA, 18 bp, Homo sapiens
aacaataggctgttccca

SEQ ID NO: 3226184 - DNA, 15 bp, Homo sapiens
aacaatatatagaat

SEQ ID NO: 3226185 - DNA, 21 bp, Homo sapiens
aacaatatgtttgcaaacttg

SEQ ID NO: 3226186 - DNA, 20 bp, Homo sapiens
aacaatccattcacaagcct

SEQ ID NO: 3226187 - DNA, 18 bp, Homo sapiens
aacaatcttattccgagc

SEQ ID NO: 3226188 - DNA, 22 bp, Homo sapiens
aacaatcttattccgagcattc

SEQ ID NO: 3226189 - DNA, 24 bp, Homo sapiens
aacaatcttattccgagcattcca

SEQ ID NO: 3226190 - DNA, 19 bp, Homo sapiens
aacaatgacactagaaaac

SEQ ID NO: 3226191 - DNA, 14 bp, Homo sapiens
aacaatgtaaagta

SEQ ID NO: 3226192 - DNA, 16 bp, Homo sapiens
aacaatgtataaagat

SEQ ID NO: 3226193 - DNA, 20 bp, Homo sapiens
aacaatgtataaagattgta

SEQ ID NO: 3226194 - DNA, 21 bp, Homo sapiens
aacaatgtataaagattgtac

SEQ ID NO: 3226195 - DNA, 11 bp, Homo sapiens
aacaatgtgtg

SEQ ID NO: 3226196 - DNA, 11 bp, Homo sapiens
aacaatgttaa

SEQ ID NO: 3226197 - DNA, 12 bp, Homo sapiens
aacaatgttaag

SEQ ID NO: 3226198 - DNA, 21 bp, Homo sapiens
aacaatgttaaggaaactctt

SEQ ID NO: 3226199 - DNA, 22 bp, Homo sapiens
aacaatgttaaggaaactctta

SEQ ID NO: 3226200 - DNA, 16 bp, Homo sapiens
aacaattgaagtaaac

SEQ ID NO: 3226201 - DNA, 17 bp, Homo sapiens
aacaattgaagtaaact

SEQ ID NO: 3226202 - DNA, 17 bp, Homo sapiens
aacaattggtaaaactc

SEQ ID NO: 3226203 - DNA, 23 bp, Homo sapiens
aacaattggtaaaactcactgtg

SEQ ID NO: 3226204 - DNA, 13 bp, Homo sapiens
aacaatttatgaa

SEQ ID NO: 3226205 - DNA, 21 bp, Homo sapiens
aacaatttcctttatatttag

SEQ ID NO: 3226206 - DNA, 22 bp, Homo sapiens
aacaatttcctttatatttagt

SEQ ID NO: 3226207 - DNA, 13 bp, Homo sapiens
aacaatttctgtc

SEQ ID NO: 3226208 - DNA, 15 bp, Homo sapiens
aacacaaaccacaac

SEQ ID NO: 3226209 - DNA, 19 bp, Homo sapiens
aacacaaagcggggggagg

SEQ ID NO: 3226210 - DNA, 14 bp, Homo sapiens
aacacaagaaaaag

SEQ ID NO: 3226211 - DNA, 13 bp, Homo sapiens
aacacaagcaaaa

SEQ ID NO: 3226212 - DNA, 14 bp, Homo sapiens
aacacacaaaggta

SEQ ID NO: 3226213 - DNA, 12 bp, Homo sapiens
aacacacaacag

SEQ ID NO: 3226214 - DNA, 20 bp, Homo sapiens
aacacacacaacgtaaaaat

SEQ ID NO: 3226215 - DNA, 16 bp, Homo sapiens
aacacacagactttct

SEQ ID NO: 3226216 - DNA, 20 bp, Homo sapiens
aacacacagatacacacaca

SEQ ID NO: 3226217 - DNA, 12 bp, Homo sapiens
aacacacctggt

SEQ ID NO: 3226218 - DNA, 18 bp, Homo sapiens
aacacactcaaaagacaa

SEQ ID NO: 3226219 - DNA, 19 bp, Homo sapiens
aacacagaaacctttttaa

SEQ ID NO: 3226220 - DNA, 17 bp, Homo sapiens
aacacagcatgtgccaa

SEQ ID NO: 3226221 - DNA, 19 bp, Homo sapiens
aacacagcatgtgccaaga

SEQ ID NO: 3226222 - DNA, 15 bp, Homo sapiens
aacacaggcaaaatc

SEQ ID NO: 3226223 - DNA, 15 bp, Homo sapiens
aacacaggcagcttt

SEQ ID NO: 3226224 - DNA, 17 bp, Homo sapiens
aacacaggcagctttct

SEQ ID NO: 3226225 - DNA, 15 bp, Homo sapiens
aacacagggttttgt

SEQ ID NO: 3226226 - DNA, 13 bp, Homo sapiens
aacacagtatttt

SEQ ID NO: 3226227 - DNA, 21 bp, Homo sapiens
aacacatacaggaaggtagaa

SEQ ID NO: 3226228 - DNA, 17 bp, Homo sapiens
aacacatctttcctgtc

SEQ ID NO: 3226229 - DNA, 18 bp, Homo sapiens
aacacattcttattgaca

SEQ ID NO: 3226230 - DNA, 18 bp, Homo sapiens
aacacattgaatgcgctt

SEQ ID NO: 3226231 - DNA, 20 bp, Homo sapiens
aacacatttgattctgtgtg

SEQ ID NO: 3226232 - DNA, 22 bp, Homo sapiens
aacacatttgggatgttccttt

SEQ ID NO: 3226233 - DNA, 20 bp, Homo sapiens
aacacatttttttgcatgca

SEQ ID NO: 3226234 - DNA, 22 bp, Homo sapiens
aacaccaatcccagggctggct

SEQ ID NO: 3226235 - DNA, 13 bp, Homo sapiens
aacaccacagaca

SEQ ID NO: 3226236 - DNA, 13 bp, Homo sapiens
aacacccttagaa

SEQ ID NO: 3226237 - DNA, 15 bp, Homo sapiens
aacacccttagaaaa

SEQ ID NO: 3226238 - DNA, 20 bp, Homo sapiens
aacacccttagaaaatgtgt

SEQ ID NO: 3226239 - DNA, 22 bp, Homo sapiens
aacaccctttcatctcagagtc

SEQ ID NO: 3226240 - DNA, 13 bp, Homo sapiens
aacaccggcagaa

SEQ ID NO: 3226241 - DNA, 19 bp, Homo sapiens
aacacctgggcttaagaaa

SEQ ID NO: 3226242 - DNA, 17 bp, Homo sapiens
aacaccttcatccagat

SEQ ID NO: 3226243 - DNA, 15 bp, Homo sapiens
aacaccttcctcctg

SEQ ID NO: 3226244 - DNA, 20 bp, Homo sapiens
aacacgaaacttgttattgt

SEQ ID NO: 3226245 - DNA, 15 bp, Homo sapiens
aacacgaaagaaatg

SEQ ID NO: 3226246 - DNA, 17 bp, Homo sapiens
aacacgcacaccctgcc

SEQ ID NO: 3226247 - DNA, 18 bp, Homo sapiens
aacacgtttttacatact

SEQ ID NO: 3226248 - DNA, 19 bp, Homo sapiens
aacacgtttttacatactt

SEQ ID NO: 3226249 - DNA, 13 bp, Homo sapiens
aacactaaaattt

SEQ ID NO: 3226250 - DNA, 19 bp, Homo sapiens
aacactaactcaccagccc

SEQ ID NO: 3226251 - DNA, 16 bp, Homo sapiens
aacactaattcataat

SEQ ID NO: 3226252 - DNA, 17 bp, Homo sapiens
aacactatatattttat

SEQ ID NO: 3226253 - DNA, 19 bp, Homo sapiens
aacactattttcagaatct

SEQ ID NO: 3226254 - DNA, 13 bp, Homo sapiens
aacactccaggcc

SEQ ID NO: 3226255 - DNA, 14 bp, Homo sapiens
aacactgctcacag

SEQ ID NO: 3226256 - DNA, 15 bp, Homo sapiens
aacactggctctggg

SEQ ID NO: 3226257 - DNA, 16 bp, Homo sapiens
aacactggctctggga

SEQ ID NO: 3226258 - DNA, 21 bp, Homo sapiens
aacactgggggcaccttaaga

SEQ ID NO: 3226259 - DNA, 13 bp, Homo sapiens
aacactggtgcca

SEQ ID NO: 3226260 - DNA, 15 bp, Homo sapiens
aacactggtgccaac

SEQ ID NO: 3226261 - DNA, 16 bp, Homo sapiens
aacactggtgccaacc

SEQ ID NO: 3226262 - DNA, 17 bp, Homo sapiens
aacacttatcttctgga

SEQ ID NO: 3226263 - DNA, 17 bp, Homo sapiens
aacacttgtagagcaga

SEQ ID NO: 3226264 - DNA, 19 bp, Homo sapiens
aaccttattgtacctctct

SEQ ID NO: 3226265 - DNA, 21 bp, Homo sapiens
aaccttcaaagaaacttgaag

SEQ ID NO: 3226266 - DNA, 19 bp, Homo sapiens
aaccttcctgggaggacag

SEQ ID NO: 3226267 - DNA, 21 bp, Homo sapiens
aaccttcctgggaggacaggc

SEQ ID NO: 3226268 - DNA, 16 bp, Homo sapiens
aaccttcggctccggg

SEQ ID NO: 3226269 - DNA, 17 bp, Homo sapiens
aaccttgaaaaaaaaca

SEQ ID NO: 3226270 - DNA, 20 bp, Homo sapiens
aaccttgaaaaaaaacagtg

SEQ ID NO: 3226271 - DNA, 13 bp, Homo sapiens
aaccttgcctttc

SEQ ID NO: 3226272 - DNA, 16 bp, Homo sapiens
aaccttgctgtcctga

SEQ ID NO: 3226273 - DNA, 17 bp, Homo sapiens
aaccttgttctattttt

SEQ ID NO: 3226274 - DNA, 18 bp, Homo sapiens
aaccttgtttattaaatt

SEQ ID NO: 3226275 - DNA, 19 bp, Homo sapiens
aaccttgtttattaaattg

SEQ ID NO: 3226276 - DNA, 20 bp, Homo sapiens
aacctttaaaattgtcacct

SEQ ID NO: 3226277 - DNA, 16 bp, Homo sapiens
aacctttagggcagct

SEQ ID NO: 3226278 - DNA, 11 bp, Homo sapiens
aacctttgcta

SEQ ID NO: 3226279 - DNA, 17 bp, Homo sapiens
aacctttttcttgatct

SEQ ID NO: 3226280 - DNA, 13 bp, Homo sapiens
aacctttttgtaa

SEQ ID NO: 3226281 - DNA, 20 bp, Homo sapiens
aacctttttttttgaaacag

SEQ ID NO: 3226282 - DNA, 11 bp, Homo sapiens
aacgaatgaag

SEQ ID NO: 3226283 - DNA, 15 bp, Homo sapiens
aacgagcactggcca

SEQ ID NO: 3226284 - DNA, 22 bp, Homo sapiens
aacgagggctgatggaggaaaa

SEQ ID NO: 3226285 - DNA, 13 bp, Homo sapiens
aacgagttaatga

SEQ ID NO: 3226286 - DNA, 17 bp, Homo sapiens
aacgatgaatttcttct

SEQ ID NO: 3226287 - DNA, 12 bp, Homo sapiens
aacgatttagaa

SEQ ID NO: 3226288 - DNA, 11 bp, Homo sapiens
aacgcagccct

SEQ ID NO: 3226289 - DNA, 24 bp, Homo sapiens
aacgcaggagaatcactgcagccc

SEQ ID NO: 3226290 - DNA, 23 bp, Homo sapiens
aacgcatggagtgtgtattgttc

SEQ ID NO: 3226291 - DNA, 22 bp, Homo sapiens
aacgccccagataccagcccct

SEQ ID NO: 3226292 - DNA, 19 bp, Homo sapiens
aacgccccgggcaaagggt

SEQ ID NO: 3226293 - DNA, 15 bp, Homo sapiens
aacgcccctgtggcc

SEQ ID NO: 3226294 - DNA, 17 bp, Homo sapiens
aacgcctcccctgcccc

SEQ ID NO: 3226295 - DNA, 21 bp, Homo sapiens
aacgctaaagagcccttgcct

SEQ ID NO: 3226296 - DNA, 22 bp, Homo sapiens
aacgctaaagagcccttgcctc

SEQ ID NO: 3226297 - DNA, 20 bp, Homo sapiens
aacgctctaggtacgatgac

SEQ ID NO: 3226298 - DNA, 17 bp, Homo sapiens
aacgcttaaaggaagtc

SEQ ID NO: 3226299 - DNA, 23 bp, Homo sapiens
aacgcttgtagaactcactctgg

SEQ ID NO: 3226300 - DNA, 14 bp, Homo sapiens
aacggcaacagcat

SEQ ID NO: 3226301 - DNA, 17 bp, Homo sapiens
aacgggaacatgccccc

SEQ ID NO: 3226302 - DNA, 18 bp, Homo sapiens
aacgggaggctgggcaca

SEQ ID NO: 3226303 - DNA, 14 bp, Homo sapiens
aacgggtcagtatt

SEQ ID NO: 3226304 - DNA, 13 bp, Homo sapiens
aacggtgcttgtg

SEQ ID NO: 3226305 - DNA, 19 bp, Homo sapiens
aacggttcctggtgactcc

SEQ ID NO: 3226306 - DNA, 18 bp, Homo sapiens
aacgtgaaacttatagtt

SEQ ID NO: 3226307 - DNA, 20 bp, Homo sapiens
aacgtgagagaaagagagaa

SEQ ID NO: 3226308 - DNA, 23 bp, Homo sapiens
aacgtgagagaaagagagaagcc

SEQ ID NO: 3226309 - DNA, 20 bp, Homo sapiens
aacgtgatgatcagctgttt

SEQ ID NO: 3226310 - DNA, 17 bp, Homo sapiens
aacgtgcagactatgca

SEQ ID NO: 3226311 - DNA, 20 bp, Homo sapiens
aacgttcgatttctacctca

SEQ ID NO: 3226312 - DNA, 18 bp, Homo sapiens
aacgttttgtttgaaaaa

SEQ ID NO: 3226313 - DNA, 23 bp, Homo sapiens
aacgtttttcctttaaaaaaatt

SEQ ID NO: 3226314 - DNA, 23 bp, Homo sapiens
aactaaaaatattcctccaaatc

SEQ ID NO: 3226315 - DNA, 12 bp, Homo sapiens
aactaaaatcat

SEQ ID NO: 3226316 - DNA, 17 bp, Homo sapiens
aactaaaatcattgtca

SEQ ID NO: 3226317 - DNA, 19 bp, Homo sapiens
aactaaactagtttttcct

SEQ ID NO: 3226318 - DNA, 18 bp, Homo sapiens
aactaaactcttaccata

SEQ ID NO: 3226319 - DNA, 14 bp, Homo sapiens
aactaaatgtagtt

SEQ ID NO: 3226320 - DNA, 13 bp, Homo sapiens
aactaaatgttct

SEQ ID NO: 3226321 - DNA, 13 bp, Homo sapiens
aactaaatttcac

SEQ ID NO: 3226322 - DNA, 14 bp, Homo sapiens
aactaaatttgata

SEQ ID NO: 3226323 - DNA, 17 bp, Homo sapiens
aactaaatttgatactt

SEQ ID NO: 3226324 - DNA, 15 bp, Homo sapiens
aactaacatgtcctg

SEQ ID NO: 3226325 - DNA, 18 bp, Homo sapiens
aactaagaaacttttgta

SEQ ID NO: 3226326 - DNA, 15 bp, Homo sapiens
aactaagattctttt

SEQ ID NO: 3226327 - DNA, 13 bp, Homo sapiens
aactaagccctcg

SEQ ID NO: 3226328 - DNA, 14 bp, Homo sapiens
aactaataaaagca

SEQ ID NO: 3226329 - DNA, 22 bp, Homo sapiens
aactaatctattgggttcatta

SEQ ID NO: 3226330 - DNA, 12 bp, Homo sapiens
aactaatgcctt

SEQ ID NO: 3226331 - DNA, 15 bp, Homo sapiens
aactaatgccttact

SEQ ID NO: 3226332 - DNA, 19 bp, Homo sapiens
aactaatttgaatgtggtt

SEQ ID NO: 3226333 - DNA, 23 bp, Homo sapiens
aactaatttgaatgtggttactt

SEQ ID NO: 3226334 - DNA, 20 bp, Homo sapiens
aactacaaagctttgctaca

SEQ ID NO: 3226335 - DNA, 22 bp, Homo sapiens
aactacatgagaacaaacagat

SEQ ID NO: 3226336 - DNA, 22 bp, Homo sapiens
aactaccaggtgtgcctggaag

SEQ ID NO: 3226337 - DNA, 16 bp, Homo sapiens
aactacggttgggaga

SEQ ID NO: 3226338 - DNA, 19 bp, Homo sapiens
aactactgaatgaagcagt

SEQ ID NO: 3226339 - DNA, 15 bp, Homo sapiens
aactactgtactttg

SEQ ID NO: 3226340 - DNA, 16 bp, Homo sapiens
aactactgtgttcctg

SEQ ID NO: 3226341 - DNA, 16 bp, Homo sapiens
aactagaaatctgcca

SEQ ID NO: 3226342 - DNA, 21 bp, Homo sapiens
aactagaattagtatgtctgt

SEQ ID NO: 3226343 - DNA, 21 bp, Homo sapiens
aactagagatgtgcaattgat

SEQ ID NO: 3226344 - DNA, 17 bp, Homo sapiens
aactagatttgtccttt

SEQ ID NO: 3226345 - DNA, 21 bp, Homo sapiens
aactagccaaaccaggaccct

SEQ ID NO: 3226346 - DNA, 14 bp, Homo sapiens
aactagccaaggct

SEQ ID NO: 3226347 - DNA, 21 bp, Homo sapiens
aactaggtaatgttttgtata

SEQ ID NO: 3226348 - DNA, 18 bp, Homo sapiens
aactaggtttttgcttct

SEQ ID NO: 3226349 - DNA, 23 bp, Homo sapiens
aactagtttttcctatcatgtta

SEQ ID NO: 3226350 - DNA, 23 bp, Homo sapiens
aactatatgtacagctctcccct

SEQ ID NO: 3226351 - DNA, 14 bp, Homo sapiens
aactatatgtgaat

SEQ ID NO: 3226352 - DNA, 20 bp, Homo sapiens
aactatattcatttccactc

SEQ ID NO: 3226353 - DNA, 15 bp, Homo sapiens
aactatctgtattta

SEQ ID NO: 3226354 - DNA, 17 bp, Homo sapiens
aactatgaactacaaag

SEQ ID NO: 3226355 - DNA, 18 bp, Homo sapiens
aactatgatatggtaaaa

SEQ ID NO: 3226356 - DNA, 18 bp, Homo sapiens
aactatggatcagaatag

SEQ ID NO: 3226357 - DNA, 18 bp, Homo sapiens
aactatggcaaggaactt

SEQ ID NO: 3226358 - DNA, 22 bp, Homo sapiens
aactatgtgtttttctcatatt

SEQ ID NO: 3226359 - DNA, 15 bp, Homo sapiens
aactattctgttcca

SEQ ID NO: 3226360 - DNA, 13 bp, Homo sapiens
aactatttatctg

SEQ ID NO: 3226361 - DNA, 20 bp, Homo sapiens
aactatttatctgtgttttt

SEQ ID NO: 3226362 - DNA, 17 bp, Homo sapiens
aactcaaaaccatctct

SEQ ID NO: 3226363 - DNA, 16 bp, Homo sapiens
aactcaaaatatttgt

SEQ ID NO: 3226364 - DNA, 13 bp, Homo sapiens
aactcaaatacac

SEQ ID NO: 3226365 - DNA, 15 bp, Homo sapiens
aactcaacattactg

SEQ ID NO: 3226366 - DNA, 14 bp, Homo sapiens
aactcacaaatgat

SEQ ID NO: 3226367 - DNA, 16 bp, Homo sapiens
aactcaccatgtaaaa

SEQ ID NO: 3226368 - DNA, 12 bp, Homo sapiens
aactcactctgg

SEQ ID NO: 3226369 - DNA, 13 bp, Homo sapiens
aactcactctggg

SEQ ID NO: 3226370 - DNA, 17 bp, Homo sapiens
aactcactctgggctgt

SEQ ID NO: 3226371 - DNA, 17 bp, Homo sapiens
aactcagggacagagcc

SEQ ID NO: 3226372 - DNA, 18 bp, Homo sapiens
aactcagggacagagcca

SEQ ID NO: 3226373 - DNA, 10 bp, Homo sapiens
aactcaggtt

SEQ ID NO: 3226374 - DNA, 18 bp, Homo sapiens
aactcagttttaactaga

SEQ ID NO: 3226375 - DNA, 14 bp, Homo sapiens
aactcatcataaaa

SEQ ID NO: 3226376 - DNA, 17 bp, Homo sapiens
aactcatcataaaataa

SEQ ID NO: 3226377 - DNA, 14 bp, Homo sapiens
aactcattgcagca

SEQ ID NO: 3226378 - DNA, 16 bp, Homo sapiens
aactcattgcagcaga

SEQ ID NO: 3226379 - DNA, 19 bp, Homo sapiens
aactcatttttgccataca

SEQ ID NO: 3226380 - DNA, 14 bp, Homo sapiens
aactccacatctgc

SEQ ID NO: 3226381 - DNA, 16 bp, Homo sapiens
aactccaggccctcct

SEQ ID NO: 3226382 - DNA, 23 bp, Homo sapiens
aactcccctgggggtttcacctg

SEQ ID NO: 3226383 - DNA, 14 bp, Homo sapiens
aactcccttcaaaa

SEQ ID NO: 3226384 - DNA, 12 bp, Homo sapiens
aactccggattg

SEQ ID NO: 3226385 - DNA, 22 bp, Homo sapiens
aactcctcacacaccctgaggt

SEQ ID NO: 3226386 - DNA, 19 bp, Homo sapiens
aactcctgattttgtagtt

SEQ ID NO: 3226387 - DNA, 21 bp, Homo sapiens
aactcctgattttgtagttaa

SEQ ID NO: 3226388 - DNA, 14 bp, Homo sapiens
aactcctggcctca

SEQ ID NO: 3226389 - DNA, 11 bp, Homo sapiens
aactccttggc

SEQ ID NO: 3226390 - DNA, 17 bp, Homo sapiens
aagactatctaaatgtt

SEQ ID NO: 3226391 - DNA, 14 bp, Homo sapiens
aagactcaaatgtt

SEQ ID NO: 3226392 - DNA, 12 bp, Homo sapiens
aagactcagcca

SEQ ID NO: 3226393 - DNA, 13 bp, Homo sapiens
aagactgaacatg

SEQ ID NO: 3226394 - DNA, 14 bp, Homo sapiens
aagactgaacatgt

SEQ ID NO: 3226395 - DNA, 16 bp, Homo sapiens
aagactgaacatgttt

SEQ ID NO: 3226396 - DNA, 17 bp, Homo sapiens
aagactgaacatgttta

SEQ ID NO: 3226397 - DNA, 20 bp, Homo sapiens
aagactggaagctaatttgc

SEQ ID NO: 3226398 - DNA, 23 bp, Homo sapiens
aagactggaagctaatttgcatt

SEQ ID NO: 3226399 - DNA, 16 bp, Homo sapiens
aagactggttttctgc

SEQ ID NO: 3226400 - DNA, 17 bp, Homo sapiens
aagactggttttctgcc

SEQ ID NO: 3226401 - DNA, 22 bp, Homo sapiens
aagacttaaagggcccaatgaa

SEQ ID NO: 3226402 - DNA, 16 bp, Homo sapiens
aagacttactctaaga

SEQ ID NO: 3226403 - DNA, 21 bp, Homo sapiens
aagacttcattgtccctcttc

SEQ ID NO: 3226404 - DNA, 12 bp, Homo sapiens
aagacttgtttt

SEQ ID NO: 3226405 - DNA, 15 bp, Homo sapiens
aagacttttattaat

SEQ ID NO: 3226406 - DNA, 19 bp, Homo sapiens
aagagaaaaaccaatgatt

SEQ ID NO: 3226407 - DNA, 12 bp, Homo sapiens
aagagaaacttt

SEQ ID NO: 3226408 - DNA, 17 bp, Homo sapiens
aagagaaaggcctgcac

SEQ ID NO: 3226409 - DNA, 14 bp, Homo sapiens
aagagaaatctcat

SEQ ID NO: 3226410 - DNA, 12 bp, Homo sapiens
aagagaaatttt

SEQ ID NO: 3226411 - DNA, 21 bp, Homo sapiens
aagagaaccgagcaaagatca

SEQ ID NO: 3226412 - DNA, 20 bp, Homo sapiens
aagagaactactaaggaaaa

SEQ ID NO: 3226413 - DNA, 20 bp, Homo sapiens
aagagaagagggcccagccc

SEQ ID NO: 3226414 - DNA, 21 bp, Homo sapiens
aagagaagagggcccagccca

SEQ ID NO: 3226415 - DNA, 22 bp, Homo sapiens
aagagaagagggcccagcccag

SEQ ID NO: 3226416 - DNA, 17 bp, Homo sapiens
aagagaagtctcattcg

SEQ ID NO: 3226417 - DNA, 20 bp, Homo sapiens
aagagaatattcctacttgc

SEQ ID NO: 3226418 - DNA, 21 bp, Homo sapiens
aagagaatattcctacttgca

SEQ ID NO: 3226419 - DNA, 13 bp, Homo sapiens
aagagaatgttga

SEQ ID NO: 3226420 - DNA, 21 bp, Homo sapiens
aagagacaaacacctcccagg

SEQ ID NO: 3226421 - DNA, 18 bp, Homo sapiens
aagagacagaatgtatct

SEQ ID NO: 3226422 - DNA, 18 bp, Homo sapiens
aagagacagagacaagta

SEQ ID NO: 3226423 - DNA, 22 bp, Homo sapiens
aagagacagagacaagtaattt

SEQ ID NO: 3226424 - DNA, 15 bp, Homo sapiens
aagagacatggaaga

SEQ ID NO: 3226425 - DNA, 21 bp, Homo sapiens
aagagacctacctcaggttgc

SEQ ID NO: 3226426 - DNA, 13 bp, Homo sapiens
aagagagaaatct

SEQ ID NO: 3226427 - DNA, 20 bp, Homo sapiens
aagagagaagccagccacag

SEQ ID NO: 3226428 - DNA, 13 bp, Homo sapiens
aagagagaatgta

SEQ ID NO: 3226429 - DNA, 19 bp, Homo sapiens
aagagagagagagagagaa

SEQ ID NO: 3226430 - DNA, 16 bp, Homo sapiens
aagagagccttggttc

SEQ ID NO: 3226431 - DNA, 22 bp, Homo sapiens
aagagagggccatgcaattcat

SEQ ID NO: 3226432 - DNA, 15 bp, Homo sapiens
aagagataagtcttt

SEQ ID NO: 3226433 - DNA, 20 bp, Homo sapiens
aagagatctttctttccaaa

SEQ ID NO: 3226434 - DNA, 21 bp, Homo sapiens
aagagatgggccttttcttga

SEQ ID NO: 3226435 - DNA, 22 bp, Homo sapiens
aagagatttatctttatacaga

SEQ ID NO: 3226436 - DNA, 18 bp, Homo sapiens
aagagatttcaacatatc

SEQ ID NO: 3226437 - DNA, 16 bp, Homo sapiens
aagagcaaacaaaagt

SEQ ID NO: 3226438 - DNA, 17 bp, Homo sapiens
aagagcacaaacatttt

SEQ ID NO: 3226439 - DNA, 21 bp, Homo sapiens
aagagcacacagagaagggaa

SEQ ID NO: 3226440 - DNA, 18 bp, Homo sapiens
aagagcagagtctgggcc

SEQ ID NO: 3226441 - DNA, 19 bp, Homo sapiens
aagagcagagtctgggcct

SEQ ID NO: 3226442 - DNA, 14 bp, Homo sapiens
aagagcagcctgtg

SEQ ID NO: 3226443 - DNA, 17 bp, Homo sapiens
aagagcaggactccagg

SEQ ID NO: 3226444 - DNA, 14 bp, Homo sapiens
aagagcatggatgc

SEQ ID NO: 3226445 - DNA, 17 bp, Homo sapiens
aagagcatggatgcatt

SEQ ID NO: 3226446 - DNA, 13 bp, Homo sapiens
aagagcccttgcc

SEQ ID NO: 3226447 - DNA, 18 bp, Homo sapiens
aagagcccttgcctcccc

SEQ ID NO: 3226448 - DNA, 19 bp, Homo sapiens
aagagcctgatctcttcct

SEQ ID NO: 3226449 - DNA, 21 bp, Homo sapiens
aagagcctgatctcttcctgt

SEQ ID NO: 3226450 - DNA, 15 bp, Homo sapiens
aagagctaataaatc

SEQ ID NO: 3226451 - DNA, 14 bp, Homo sapiens
aagagctgcctgga

SEQ ID NO: 3226452 - DNA, 15 bp, Homo sapiens
aagagctgcctggat

SEQ ID NO: 3226453 - DNA, 16 bp, Homo sapiens
aagaggaactgggcct

SEQ ID NO: 3226454 - DNA, 20 bp, Homo sapiens
aagaggactcgcttgtaaat

SEQ ID NO: 3226455 - DNA, 22 bp, Homo sapiens
aagaggactcgcttgtaaatac

SEQ ID NO: 3226456 - DNA, 21 bp, Homo sapiens
aagaggagcacttccaaaatt

SEQ ID NO: 3226457 - DNA, 14 bp, Homo sapiens
aagaggaggccgcc

SEQ ID NO: 3226458 - DNA, 15 bp, Homo sapiens
aagaggatattcttc

SEQ ID NO: 3226459 - DNA, 22 bp, Homo sapiens
aagaggcagagttctgtgaaga

SEQ ID NO: 3226460 - DNA, 19 bp, Homo sapiens
aagaggcatcctgcctggg

SEQ ID NO: 3226461 - DNA, 17 bp, Homo sapiens
aagaggcctcatgcctg

SEQ ID NO: 3226462 - DNA, 18 bp, Homo sapiens
aagaggctgaaagaggcc

SEQ ID NO: 3226463 - DNA, 16 bp, Homo sapiens
aagaggcttctcctgt

SEQ ID NO: 3226464 - DNA, 17 bp, Homo sapiens
aagagggagaagcatga

SEQ ID NO: 3226465 - DNA, 18 bp, Homo sapiens
aagagggagaagcatgaa

SEQ ID NO: 3226466 - DNA, 18 bp, Homo sapiens
aagagggagatggagact

SEQ ID NO: 3226467 - DNA, 15 bp, Homo sapiens
aagagggcccagccc

SEQ ID NO: 3226468 - DNA, 17 bp, Homo sapiens
aagagggcccagcccag

SEQ ID NO: 3226469 - DNA, 23 bp, Homo sapiens
aagagggcccagcccagagccac

SEQ ID NO: 3226470 - DNA, 14 bp, Homo sapiens
aagagggcctgtgg

SEQ ID NO: 3226471 - DNA, 14 bp, Homo sapiens
aagagggctgagct

SEQ ID NO: 3226472 - DNA, 11 bp, Homo sapiens
aagaggggcag

SEQ ID NO: 3226473 - DNA, 15 bp, Homo sapiens
aagaggggctggggc

SEQ ID NO: 3226474 - DNA, 16 bp, Homo sapiens
aagaggggctggggca

SEQ ID NO: 3226475 - DNA, 15 bp, Homo sapiens
aagaggtataaagct

SEQ ID NO: 3226476 - DNA, 19 bp, Homo sapiens
aagaggtctccccatcccc

SEQ ID NO: 3226477 - DNA, 13 bp, Homo sapiens
aagaggtctgagc

SEQ ID NO: 3226478 - DNA, 19 bp, Homo sapiens
aagaggtgaaaatgaagaa

SEQ ID NO: 3226479 - DNA, 15 bp, Homo sapiens
aagaggtgggagggc

SEQ ID NO: 3226480 - DNA, 15 bp, Homo sapiens
aagagtagaattgca

SEQ ID NO: 3226481 - DNA, 17 bp, Homo sapiens
aagagtagcatttcatt

SEQ ID NO: 3226482 - DNA, 19 bp, Homo sapiens
aagagtagttgatgttgca

SEQ ID NO: 3226483 - DNA, 22 bp, Homo sapiens
aagagtagttgatgttgcattt

SEQ ID NO: 3226484 - DNA, 23 bp, Homo sapiens
aagagtagttgatgttgcatttt

SEQ ID NO: 3226485 - DNA, 14 bp, Homo sapiens
aagagtatgtagtg

SEQ ID NO: 3226486 - DNA, 24 bp, Homo sapiens
aagagtctaaagatggagtttcta

SEQ ID NO: 3226487 - DNA, 14 bp, Homo sapiens
aagagtcttccaat

SEQ ID NO: 3226488 - DNA, 22 bp, Homo sapiens
aagagtgacagtggattgcatt

SEQ ID NO: 3226489 - DNA, 21 bp, Homo sapiens
aagagtgacttattttgtctt

SEQ ID NO: 3226490 - DNA, 19 bp, Homo sapiens
aagagtgggggagagcagg

SEQ ID NO: 3226491 - DNA, 13 bp, Homo sapiens
aagagtgtagaag

SEQ ID NO: 3226492 - DNA, 16 bp, Homo sapiens
aagagtgtagaagcat

SEQ ID NO: 3226493 - DNA, 20 bp, Homo sapiens
aagagttcccttgaaacttt

SEQ ID NO: 3226494 - DNA, 19 bp, Homo sapiens
aagagttggggacagaact

SEQ ID NO: 3226495 - DNA, 15 bp, Homo sapiens
aagagtttgttctgt

SEQ ID NO: 3226496 - DNA, 23 bp, Homo sapiens
aagagttttagagaaaataaatt

SEQ ID NO: 3226497 - DNA, 17 bp, Homo sapiens
aagagttttctttagta

SEQ ID NO: 3226498 - DNA, 13 bp, Homo sapiens
aagataaaaatca

SEQ ID NO: 3226499 - DNA, 14 bp, Homo sapiens
aagataaaaatcag

SEQ ID NO: 3226500 - DNA, 17 bp, Homo sapiens
aagataaagatgatcta

SEQ ID NO: 3226501 - DNA, 14 bp, Homo sapiens
aagataaatgtgct

SEQ ID NO: 3226502 - DNA, 19 bp, Homo sapiens
aagataacaagatctttca

SEQ ID NO: 3226503 - DNA, 20 bp, Homo sapiens
aagataacaagatctttcag

SEQ ID NO: 3226504 - DNA, 19 bp, Homo sapiens
aagataacccttattccat

SEQ ID NO: 3226505 - DNA, 14 bp, Homo sapiens
aagataacttactg

SEQ ID NO: 3226506 - DNA, 17 bp, Homo sapiens
aagataacttactgtat

SEQ ID NO: 3226507 - DNA, 18 bp, Homo sapiens
aagataacttactgtata

SEQ ID NO: 3226508 - DNA, 14 bp, Homo sapiens
aagataagcctgag

SEQ ID NO: 3226509 - DNA, 16 bp, Homo sapiens
aagataagcctgagcc

SEQ ID NO: 3226510 - DNA, 18 bp, Homo sapiens
aagataagcctgagcctt

SEQ ID NO: 3226511 - DNA, 15 bp, Homo sapiens
aagataatctcagtg

SEQ ID NO: 3226512 - DNA, 22 bp, Homo sapiens
aagataatctcagtgctttcct

SEQ ID NO: 3226513 - DNA, 12 bp, Homo sapiens
aagataatgttc

SEQ ID NO: 3226514 - DNA, 16 bp, Homo sapiens
aagataatgttcttta

SEQ ID NO: 3226515 - DNA, 23 bp, Homo sapiens
aagataatgttctttaatgttgt

SEQ ID NO: 3226516 - DNA, 20 bp, Homo sapiens
aaggaaagaagggggccctg

SEQ ID NO: 3226517 - DNA, 19 bp, Homo sapiens
aaggaaagatttgtgaact

SEQ ID NO: 3226518 - DNA, 13 bp, Homo sapiens
aaggaaagcaata

SEQ ID NO: 3226519 - DNA, 12 bp, Homo sapiens
aaggaaagctgt

SEQ ID NO: 3226520 - DNA, 22 bp, Homo sapiens
aaggaaagggggtcccagtggg

SEQ ID NO: 3226521 - DNA, 20 bp, Homo sapiens
aaggaaatacccttctttta

SEQ ID NO: 3226522 - DNA, 23 bp, Homo sapiens
aaggaaatacccttcttttatga

SEQ ID NO: 3226523 - DNA, 16 bp, Homo sapiens
aaggaaatctcacccc

SEQ ID NO: 3226524 - DNA, 14 bp, Homo sapiens
aaggaaatttgttt

SEQ ID NO: 3226525 - DNA, 16 bp, Homo sapiens
aaggaacacagagcag

SEQ ID NO: 3226526 - DNA, 13 bp, Homo sapiens
aaggaacctggga

SEQ ID NO: 3226527 - DNA, 12 bp, Homo sapiens
aaggaaccttcc

SEQ ID NO: 3226528 - DNA, 13 bp, Homo sapiens
aaggaagactaga

SEQ ID NO: 3226529 - DNA, 13 bp, Homo sapiens
aaggaagagaaga

SEQ ID NO: 3226530 - DNA, 11 bp, Homo sapiens
aaggaagaggg

SEQ ID NO: 3226531 - DNA, 16 bp, Homo sapiens
aaggaagccaaattta

SEQ ID NO: 3226532 - DNA, 18 bp, Homo sapiens
aaggaaggtggatggccc

SEQ ID NO: 3226533 - DNA, 16 bp, Homo sapiens
aaggaatagccagaga

SEQ ID NO: 3226534 - DNA, 21 bp, Homo sapiens
aaggaatagccagagaggagc

SEQ ID NO: 3226535 - DNA, 21 bp, Homo sapiens
aaggaatctccagttttcagt

SEQ ID NO: 3226536 - DNA, 14 bp, Homo sapiens
aaggaatctttaag

SEQ ID NO: 3226537 - DNA, 19 bp, Homo sapiens
aaggaatgcctgtgccaat

SEQ ID NO: 3226538 - DNA, 15 bp, Homo sapiens
aaggaattctaggca

SEQ ID NO: 3226539 - DNA, 14 bp, Homo sapiens
aaggaatttcttaa

SEQ ID NO: 3226540 - DNA, 19 bp, Homo sapiens
aaggaatttcttaacttct

SEQ ID NO: 3226541 - DNA, 17 bp, Homo sapiens
aaggacaaaaatgaact

SEQ ID NO: 3226542 - DNA, 17 bp, Homo sapiens
aaggacagagtatgaac

SEQ ID NO: 3226543 - DNA, 20 bp, Homo sapiens
aaggaccacattttatattt

SEQ ID NO: 3226544 - DNA, 23 bp, Homo sapiens
aaggaccacattttatatttatt

SEQ ID NO: 3226545 - DNA, 13 bp, Homo sapiens
aaggaccaggact

SEQ ID NO: 3226546 - DNA, 13 bp, Homo sapiens
aaggacccaccca

SEQ ID NO: 3226547 - DNA, 23 bp, Homo sapiens
aaggacccacccatcttcctgct

SEQ ID NO: 3226548 - DNA, 18 bp, Homo sapiens
aaggacctgaaattccaa

SEQ ID NO: 3226549 - DNA, 21 bp, Homo sapiens
aaggactaacataaaatctgt

SEQ ID NO: 3226550 - DNA, 17 bp, Homo sapiens
aaggactagatactact

SEQ ID NO: 3226551 - DNA, 23 bp, Homo sapiens
aaggactagatactactttctct

SEQ ID NO: 3226552 - DNA, 22 bp, Homo sapiens
aaggactcctcctttttccatg

SEQ ID NO: 3226553 - DNA, 23 bp, Homo sapiens
aaggactctggtttctcattctt

SEQ ID NO: 3226554 - DNA, 23 bp, Homo sapiens
aaggactgcgggacttgggtctc

SEQ ID NO: 3226555 - DNA, 16 bp, Homo sapiens
aaggacttccacattt

SEQ ID NO: 3226556 - DNA, 22 bp, Homo sapiens
aaggacttgaaagcatccatgt

SEQ ID NO: 3226557 - DNA, 16 bp, Homo sapiens
aaggagaaaaaaaacc

SEQ ID NO: 3226558 - DNA, 18 bp, Homo sapiens
aaggagaaaaaaaacctt

SEQ ID NO: 3226559 - DNA, 20 bp, Homo sapiens
aaggagaaaaaaaaccttgt

SEQ ID NO: 3226560 - DNA, 21 bp, Homo sapiens
aaggagaaaaaaaaccttgta

SEQ ID NO: 3226561 - DNA, 14 bp, Homo sapiens
aaggagagaaagtg

SEQ ID NO: 3226562 - DNA, 17 bp, Homo sapiens
aaggagagcaagaagga

SEQ ID NO: 3226563 - DNA, 14 bp, Homo sapiens
aaggagagcctgct

SEQ ID NO: 3226564 - DNA, 20 bp, Homo sapiens
aaggagaggcaacatccaaa

SEQ ID NO: 3226565 - DNA, 17 bp, Homo sapiens
aaggagagttcaagcct

SEQ ID NO: 3226566 - DNA, 15 bp, Homo sapiens
aaggagattccacac

SEQ ID NO: 3226567 - DNA, 21 bp, Homo sapiens
aaggagcacaggtcccacctc

SEQ ID NO: 3226568 - DNA, 22 bp, Homo sapiens
aaggagcggcgccctggacttg

SEQ ID NO: 3226569 - DNA, 16 bp, Homo sapiens
aaggagctcaccctgc

SEQ ID NO: 3226570 - DNA, 21 bp, Homo sapiens
aaggagctcaccctgcccgct

SEQ ID NO: 3226571 - DNA, 19 bp, Homo sapiens
aaggagctgatttccaggc

SEQ ID NO: 3226572 - DNA, 23 bp, Homo sapiens
aaggaggaggagggagaagagaa

SEQ ID NO: 3226573 - DNA, 19 bp, Homo sapiens
aaggaggccaaccagcccg

SEQ ID NO: 3226574 - DNA, 20 bp, Homo sapiens
aaggaggcctggggaggccc

SEQ ID NO: 3226575 - DNA, 19 bp, Homo sapiens
aaggagggcagagccatgg

SEQ ID NO: 3226576 - DNA, 18 bp, Homo sapiens
aaggagggtacagctggg

SEQ ID NO: 3226577 - DNA, 14 bp, Homo sapiens
aaggaggttctaat

SEQ ID NO: 3226578 - DNA, 20 bp, Homo sapiens
aaggagtcagacattttaag

SEQ ID NO: 3226579 - DNA, 19 bp, Homo sapiens
aaggataaatcataaagtc

SEQ ID NO: 3226580 - DNA, 15 bp, Homo sapiens
aaggataactctgta

SEQ ID NO: 3226581 - DNA, 14 bp, Homo sapiens
aaggatagtaagca

SEQ ID NO: 3226582 - DNA, 20 bp, Homo sapiens
aaggatatgaaactctacat

SEQ ID NO: 3226583 - DNA, 23 bp, Homo sapiens
aaggatatgattaatattattaa

SEQ ID NO: 3226584 - DNA, 18 bp, Homo sapiens
aaggatatttaagaaaat

SEQ ID NO: 3226585 - DNA, 16 bp, Homo sapiens
aaggatccaggaatat

SEQ ID NO: 3226586 - DNA, 18 bp, Homo sapiens
aaggatccttccctgtaa

SEQ ID NO: 3226587 - DNA, 20 bp, Homo sapiens
aaggatctctcaggagcaca

SEQ ID NO: 3226588 - DNA, 22 bp, Homo sapiens
aaggatctctcaggagcacagg

SEQ ID NO: 3226589 - DNA, 14 bp, Homo sapiens
aaggatgaaagaaa

SEQ ID NO: 3226590 - DNA, 19 bp, Homo sapiens
aaggatgaagaacacagca

SEQ ID NO: 3226591 - DNA, 15 bp, Homo sapiens
aaggatgctctttcc

SEQ ID NO: 3226592 - DNA, 15 bp, Homo sapiens
aaggatgtgattgtg

SEQ ID NO: 3226593 - DNA, 22 bp, Homo sapiens
aaggatgtgattgtggaatgga

SEQ ID NO: 3226594 - DNA, 20 bp, Homo sapiens
aaggattacagaaactgatg

SEQ ID NO: 3226595 - DNA, 23 bp, Homo sapiens
aaggattacagaaactgatgcca

SEQ ID NO: 3226596 - DNA, 20 bp, Homo sapiens
aaggattatggaaaaataaa

SEQ ID NO: 3226597 - DNA, 13 bp, Homo sapiens
aaggattgaaaat

SEQ ID NO: 3226598 - DNA, 14 bp, Homo sapiens
aaggattgtaaaaa

SEQ ID NO: 3226599 - DNA, 23 bp, Homo sapiens
aaggattgtaaaaaaaaatgcct

SEQ ID NO: 3226600 - DNA, 14 bp, Homo sapiens
aaggattgtgatat

SEQ ID NO: 3226601 - DNA, 17 bp, Homo sapiens
aaggattgtgatatttt

SEQ ID NO: 3226602 - DNA, 13 bp, Homo sapiens
aaggattttacca

SEQ ID NO: 3226603 - DNA, 17 bp, Homo sapiens
aaggattttaccaaagc

SEQ ID NO: 3226604 - DNA, 21 bp, Homo sapiens
aaggattttttaaagtttttt

SEQ ID NO: 3226605 - DNA, 18 bp, Homo sapiens
aaggcaaaaatatcagga

SEQ ID NO: 3226606 - DNA, 14 bp, Homo sapiens
aaggcaaaattgca

SEQ ID NO: 3226607 - DNA, 15 bp, Homo sapiens
aaggcaaaattgcaa

SEQ ID NO: 3226608 - DNA, 13 bp, Homo sapiens
aaggcagagaaat

SEQ ID NO: 3226609 - DNA, 21 bp, Homo sapiens
aaggcagcctccagagccagc

SEQ ID NO: 3226610 - DNA, 22 bp, Homo sapiens
aaggcagcctccagagccagcc

SEQ ID NO: 3226611 - DNA, 15 bp, Homo sapiens
aaggcagctcacccc

SEQ ID NO: 3226612 - DNA, 16 bp, Homo sapiens
aaggcagctcacccct

SEQ ID NO: 3226613 - DNA, 20 bp, Homo sapiens
aaggcagctcacccctgggc

SEQ ID NO: 3226614 - DNA, 22 bp, Homo sapiens
aaggcagctcacccctgggcag

SEQ ID NO: 3226615 - DNA, 12 bp, Homo sapiens
aaggcagctgcc

SEQ ID NO: 3226616 - DNA, 13 bp, Homo sapiens
aaggcagctgcct

SEQ ID NO: 3226617 - DNA, 15 bp, Homo sapiens
aaggcagctgcctct

SEQ ID NO: 3226618 - DNA, 22 bp, Homo sapiens
aaggcagctgcctctgctccct

SEQ ID NO: 3226619 - DNA, 14 bp, Homo sapiens
aaggcagctgctct

SEQ ID NO: 3226620 - DNA, 22 bp, Homo sapiens
aaggcagggcccttggggctgg

SEQ ID NO: 3226621 - DNA, 16 bp, Homo sapiens
aaggcaggtgcctcca

SEQ ID NO: 3226622 - DNA, 23 bp, Homo sapiens
aaggcagtagaactccaggccct

SEQ ID NO: 3226623 - DNA, 18 bp, Homo sapiens
aaggcagtggcaggggag

SEQ ID NO: 3226624 - DNA, 17 bp, Homo sapiens
aaggcatacgagagcag

SEQ ID NO: 3226625 - DNA, 22 bp, Homo sapiens
aaggcatacgagagcagaggtc

SEQ ID NO: 3226626 - DNA, 20 bp, Homo sapiens
aaggcatcagtccctatgta

SEQ ID NO: 3226627 - DNA, 13 bp, Homo sapiens
aaggcatgagaaa

SEQ ID NO: 3226628 - DNA, 16 bp, Homo sapiens
aaggcatgttcctctg

SEQ ID NO: 3226629 - DNA, 17 bp, Homo sapiens
aaggccaaactgctgga

SEQ ID NO: 3226630 - DNA, 19 bp, Homo sapiens
aaggccacatacctctctg

SEQ ID NO: 3226631 - DNA, 20 bp, Homo sapiens
aaggccacatacctctctga

SEQ ID NO: 3226632 - DNA, 20 bp, Homo sapiens
aaggccagagtggcctggcc

SEQ ID NO: 3226633 - DNA, 23 bp, Homo sapiens
aaggccagagtggcctggccagg

SEQ ID NO: 3226634 - DNA, 16 bp, Homo sapiens
aaggccagtggaagaa

SEQ ID NO: 3226635 - DNA, 17 bp, Homo sapiens
aaggccagtggaagaaa

SEQ ID NO: 3226636 - DNA, 20 bp, Homo sapiens
aaggcccagccataaaagca

SEQ ID NO: 3226637 - DNA, 23 bp, Homo sapiens
aaggcccccaaacatagcccctg

SEQ ID NO: 3226638 - DNA, 17 bp, Homo sapiens
aaggcccccacttctcc

SEQ ID NO: 3226639 - DNA, 15 bp, Homo sapiens
aaggccctgctgccc

SEQ ID NO: 3226640 - DNA, 23 bp, Homo sapiens
aaggccgagcgttcccagcaggg

SEQ ID NO: 3226641 - DNA, 15 bp, Homo sapiens
aagttctaagttcat

SEQ ID NO: 3226642 - DNA, 18 bp, Homo sapiens
aagttctaataatttcta

SEQ ID NO: 3226643 - DNA, 20 bp, Homo sapiens
aagttctcaaagttaattca

SEQ ID NO: 3226644 - DNA, 20 bp, Homo sapiens
aagttctgtgtttaatttct

SEQ ID NO: 3226645 - DNA, 23 bp, Homo sapiens
aagttctgtgtttaatttcttca

SEQ ID NO: 3226646 - DNA, 15 bp, Homo sapiens
aagttcttcacctct

SEQ ID NO: 3226647 - DNA, 19 bp, Homo sapiens
aagttgaaccattatactt

SEQ ID NO: 3226648 - DNA, 22 bp, Homo sapiens
aagttgaaccattatactttat

SEQ ID NO: 3226649 - DNA, 23 bp, Homo sapiens
aagttgaaccattatactttata

SEQ ID NO: 3226650 - DNA, 17 bp, Homo sapiens
aagttgaagctaagatt

SEQ ID NO: 3226651 - DNA, 16 bp, Homo sapiens
aagttgcagtgagctg

SEQ ID NO: 3226652 - DNA, 19 bp, Homo sapiens
aagttgcattcctttgtct

SEQ ID NO: 3226653 - DNA, 21 bp, Homo sapiens
aagttgcctttatttgctgtt

SEQ ID NO: 3226654 - DNA, 16 bp, Homo sapiens
aagttgctgtcactgt

SEQ ID NO: 3226655 - DNA, 17 bp, Homo sapiens
aagttggcacatttcat

SEQ ID NO: 3226656 - DNA, 16 bp, Homo sapiens
aagttggcttctgttt

SEQ ID NO: 3226657 - DNA, 19 bp, Homo sapiens
aagttggcttctgtttcta

SEQ ID NO: 3226658 - DNA, 20 bp, Homo sapiens
aagttggtattaataaaaag

SEQ ID NO: 3226659 - DNA, 21 bp, Homo sapiens
aagttggtattaataaaaaga

SEQ ID NO: 3226660 - DNA, 11 bp, Homo sapiens
aagttgtacaa

SEQ ID NO: 3226661 - DNA, 17 bp, Homo sapiens
aagttgtacaaatgtat

SEQ ID NO: 3226662 - DNA, 19 bp, Homo sapiens
aagttgtacaaatgtattt

SEQ ID NO: 3226663 - DNA, 20 bp, Homo sapiens
aagttgtacaaatgtatttt

SEQ ID NO: 3226664 - DNA, 15 bp, Homo sapiens
aagttgtataaaaac

SEQ ID NO: 3226665 - DNA, 21 bp, Homo sapiens
aagttgtataaaaacatgagt

SEQ ID NO: 3226666 - DNA, 14 bp, Homo sapiens
aagttgtcttaaaa

SEQ ID NO: 3226667 - DNA, 20 bp, Homo sapiens
aagttgtgccttttatagct

SEQ ID NO: 3226668 - DNA, 16 bp, Homo sapiens
aagttgtgtctgaaaa

SEQ ID NO: 3226669 - DNA, 23 bp, Homo sapiens
aagttgtgtctgaaaatatctct

SEQ ID NO: 3226670 - DNA, 22 bp, Homo sapiens
aagttgttctagtaacaataca

SEQ ID NO: 3226671 - DNA, 17 bp, Homo sapiens
aagtttaagtgtgcagc

SEQ ID NO: 3226672 - DNA, 18 bp, Homo sapiens
aagtttacaatcaaagga

SEQ ID NO: 3226673 - DNA, 19 bp, Homo sapiens
aagtttacaatcaaaggaa

SEQ ID NO: 3226674 - DNA, 15 bp, Homo sapiens
aagtttacacttcat

SEQ ID NO: 3226675 - DNA, 15 bp, Homo sapiens
aagtttaggtcgagg

SEQ ID NO: 3226676 - DNA, 18 bp, Homo sapiens
aagtttatccaaatcttg

SEQ ID NO: 3226677 - DNA, 12 bp, Homo sapiens
aagtttattctc

SEQ ID NO: 3226678 - DNA, 16 bp, Homo sapiens
aagtttattctcattt

SEQ ID NO: 3226679 - DNA, 13 bp, Homo sapiens
aagtttatttctc

SEQ ID NO: 3226680 - DNA, 22 bp, Homo sapiens
aagtttcaaacttactattttg

SEQ ID NO: 3226681 - DNA, 19 bp, Homo sapiens
aagtttcaggtgacatgtg

SEQ ID NO: 3226682 - DNA, 23 bp, Homo sapiens
aagtttcattctccctttcacta

SEQ ID NO: 3226683 - DNA, 11 bp, Homo sapiens
aagtttctaag

SEQ ID NO: 3226684 - DNA, 13 bp, Homo sapiens
aagtttctaagat

SEQ ID NO: 3226685 - DNA, 15 bp, Homo sapiens
aagtttctaagattc

SEQ ID NO: 3226686 - DNA, 18 bp, Homo sapiens
aagtttctaagattctaa

SEQ ID NO: 3226687 - DNA, 20 bp, Homo sapiens
aagtttctaagattctaaag

SEQ ID NO: 3226688 - DNA, 18 bp, Homo sapiens
aagtttgaaaagcaatat

SEQ ID NO: 3226689 - DNA, 17 bp, Homo sapiens
aagtttgaaggaaacag

SEQ ID NO: 3226690 - DNA, 15 bp, Homo sapiens
aagtttgatttcatt

SEQ ID NO: 3226691 - DNA, 16 bp, Homo sapiens
aagtttgcttagaaaa

SEQ ID NO: 3226692 - DNA, 17 bp, Homo sapiens
aagtttgtaaaaatata

SEQ ID NO: 3226693 - DNA, 13 bp, Homo sapiens
aagtttgtagcca

SEQ ID NO: 3226694 - DNA, 21 bp, Homo sapiens
aagtttgtgttctgtttgtta

SEQ ID NO: 3226695 - DNA, 22 bp, Homo sapiens
aagtttgtgttctgtttgttaa

SEQ ID NO: 3226696 - DNA, 17 bp, Homo sapiens
aagttttaaaaagccag

SEQ ID NO: 3226697 - DNA, 19 bp, Homo sapiens
aagttttaaaaagccagtt

SEQ ID NO: 3226698 - DNA, 13 bp, Homo sapiens
aagttttaaagtt

SEQ ID NO: 3226699 - DNA, 16 bp, Homo sapiens
aagttttcaaatttgt

SEQ ID NO: 3226700 - DNA, 12 bp, Homo sapiens
aagttttcagtg

SEQ ID NO: 3226701 - DNA, 21 bp, Homo sapiens
aagttttcctttgtaatcact

SEQ ID NO: 3226702 - DNA, 13 bp, Homo sapiens
aagttttctgtag

SEQ ID NO: 3226703 - DNA, 16 bp, Homo sapiens
aagttttgaaaagcta

SEQ ID NO: 3226704 - DNA, 18 bp, Homo sapiens
aagttttgaaaagctatt

SEQ ID NO: 3226705 - DNA, 19 bp, Homo sapiens
aagttttgatgaaattctt

SEQ ID NO: 3226706 - DNA, 21 bp, Homo sapiens
aagttttgattaatgtttctt

SEQ ID NO: 3226707 - DNA, 12 bp, Homo sapiens
aagttttgctgt

SEQ ID NO: 3226708 - DNA, 23 bp, Homo sapiens
aagttttgggtatgtttaatctg

SEQ ID NO: 3226709 - DNA, 23 bp, Homo sapiens
aagttttgtacaaagttttcctt

SEQ ID NO: 3226710 - DNA, 20 bp, Homo sapiens
aagttttgtataaataataa

SEQ ID NO: 3226711 - DNA, 14 bp, Homo sapiens
aagttttgttcttt

SEQ ID NO: 3226712 - DNA, 13 bp, Homo sapiens
aagttttgttgta

SEQ ID NO: 3226713 - DNA, 22 bp, Homo sapiens
aagttttgttgtacttaaatgg

SEQ ID NO: 3226714 - DNA, 15 bp, Homo sapiens
aagtttttgaaatac

SEQ ID NO: 3226715 - DNA, 17 bp, Homo sapiens
aagtttttgtactgtaa

SEQ ID NO: 3226716 - DNA, 12 bp, Homo sapiens
aagtttttttgc

SEQ ID NO: 3226717 - DNA, 19 bp, Homo sapiens
aataaaaaaaaaaggatga

SEQ ID NO: 3226718 - DNA, 15 bp, Homo sapiens
aataaaaaagtctct

SEQ ID NO: 3226719 - DNA, 16 bp, Homo sapiens
aataaaaaatagacat

SEQ ID NO: 3226720 - DNA, 14 bp, Homo sapiens
aataaaaaattatg

SEQ ID NO: 3226721 - DNA, 14 bp, Homo sapiens
aataaaaagacaac

SEQ ID NO: 3226722 - DNA, 17 bp, Homo sapiens
aataaaaagatcacttt

SEQ ID NO: 3226723 - DNA, 19 bp, Homo sapiens
aataaaaagatcactttct

SEQ ID NO: 3226724 - DNA, 23 bp, Homo sapiens
aataaaaagatcactttctcagt

SEQ ID NO: 3226725 - DNA, 13 bp, Homo sapiens
aataaaaagtgac

SEQ ID NO: 3226726 - DNA, 20 bp, Homo sapiens
aataaaaagtgacacagcag

SEQ ID NO: 3226727 - DNA, 16 bp, Homo sapiens
aataaaacctttcaaa

SEQ ID NO: 3226728 - DNA, 12 bp, Homo sapiens
aataaaactgaa

SEQ ID NO: 3226729 - DNA, 13 bp, Homo sapiens
aataaaactgaat

SEQ ID NO: 3226730 - DNA, 23 bp, Homo sapiens
aataaaagttaataacagctcct

SEQ ID NO: 3226731 - DNA, 15 bp, Homo sapiens
aataaaataattcta

SEQ ID NO: 3226732 - DNA, 16 bp, Homo sapiens
aataaaatcttgaaaa

SEQ ID NO: 3226733 - DNA, 19 bp, Homo sapiens
aataaaatgaggacatgtt

SEQ ID NO: 3226734 - DNA, 21 bp, Homo sapiens
aataaaatgccatagtttgtg

SEQ ID NO: 3226735 - DNA, 14 bp, Homo sapiens
aataaaatgtgatt

SEQ ID NO: 3226736 - DNA, 21 bp, Homo sapiens
aataaaatgtgatttttctga

SEQ ID NO: 3226737 - DNA, 15 bp, Homo sapiens
aataaaatgtgtaca

SEQ ID NO: 3226738 - DNA, 16 bp, Homo sapiens
aataaaatgtgtacag

SEQ ID NO: 3226739 - DNA, 17 bp, Homo sapiens
aataaaatgtgtacagt

SEQ ID NO: 3226740 - DNA, 14 bp, Homo sapiens
aataaaattgcact

SEQ ID NO: 3226741 - DNA, 17 bp, Homo sapiens
aataaacacacagatct

SEQ ID NO: 3226742 - DNA, 17 bp, Homo sapiens
aataaacactggctctg

SEQ ID NO: 3226743 - DNA, 14 bp, Homo sapiens
aataaacagctatt

SEQ ID NO: 3226744 - DNA, 23 bp, Homo sapiens
aataaacaggaattttattttgc

SEQ ID NO: 3226745 - DNA, 18 bp, Homo sapiens
aataaacattaattttgt

SEQ ID NO: 3226746 - DNA, 21 bp, Homo sapiens
aataaacattaattttgtgca

SEQ ID NO: 3226747 - DNA, 13 bp, Homo sapiens
aataaaccaaata

SEQ ID NO: 3226748 - DNA, 17 bp, Homo sapiens
aataaacctcaaaatgt

SEQ ID NO: 3226749 - DNA, 21 bp, Homo sapiens
aataaactcctactaaatccc

SEQ ID NO: 3226750 - DNA, 15 bp, Homo sapiens
aataaactctaaaca

SEQ ID NO: 3226751 - DNA, 23 bp, Homo sapiens
aataaactggtatgaataattgc

SEQ ID NO: 3226752 - DNA, 13 bp, Homo sapiens
aataaactgtatt

SEQ ID NO: 3226753 - DNA, 14 bp, Homo sapiens
aataaactgtatta

SEQ ID NO: 3226754 - DNA, 18 bp, Homo sapiens
aataaactgtattaaatc

SEQ ID NO: 3226755 - DNA, 14 bp, Homo sapiens
aataaactgtttat

SEQ ID NO: 3226756 - DNA, 17 bp, Homo sapiens
aataaactgtttatata

SEQ ID NO: 3226757 - DNA, 19 bp, Homo sapiens
aataaactttttttcaatg

SEQ ID NO: 3226758 - DNA, 22 bp, Homo sapiens
aataaagaactccttattttgt

SEQ ID NO: 3226759 - DNA, 16 bp, Homo sapiens
aataaagcagaagcaa

SEQ ID NO: 3226760 - DNA, 17 bp, Homo sapiens
aataaagcagcctcatt

SEQ ID NO: 3226761 - DNA, 12 bp, Homo sapiens
aataaagctttt

SEQ ID NO: 3226762 - DNA, 15 bp, Homo sapiens
aataaagcttttgga

SEQ ID NO: 3226763 - DNA, 16 bp, Homo sapiens
aataaagcttttggaa

SEQ ID NO: 3226764 - DNA, 17 bp, Homo sapiens
aataaagcttttggaag

SEQ ID NO: 3226765 - DNA, 24 bp, Homo sapiens
aataaaggataactctgtattaca

SEQ ID NO: 3226766 - DNA, 16 bp, Homo sapiens
aataaaggatgtgatt

SEQ ID NO: 3226767 - DNA, 14 bp, Homo sapiens
aatcataaagtcag

SEQ ID NO: 3226768 - DNA, 20 bp, Homo sapiens
aatcatattaaaattacaga

SEQ ID NO: 3226769 - DNA, 14 bp, Homo sapiens
aatcatattgatga

SEQ ID NO: 3226770 - DNA, 21 bp, Homo sapiens
aatcatcgaaaattcatttca

SEQ ID NO: 3226771 - DNA, 19 bp, Homo sapiens
aatcatgaacagctctgag

SEQ ID NO: 3226772 - DNA, 16 bp, Homo sapiens
aatcatgtcaggcctg

SEQ ID NO: 3226773 - DNA, 23 bp, Homo sapiens
aatcatgtccatcccttttcctg

SEQ ID NO: 3226774 - DNA, 23 bp, Homo sapiens
aatcatgtgggtgagccagtgga

SEQ ID NO: 3226775 - DNA, 15 bp, Homo sapiens
aatcattagttttag

SEQ ID NO: 3226776 - DNA, 13 bp, Homo sapiens
aatcattcagaaa

SEQ ID NO: 3226777 - DNA, 16 bp, Homo sapiens
aatcattcagaaatgt

SEQ ID NO: 3226778 - DNA, 23 bp, Homo sapiens
aatcattcagaaatgttgagtct

SEQ ID NO: 3226779 - DNA, 14 bp, Homo sapiens
aatcattgctttga

SEQ ID NO: 3226780 - DNA, 14 bp, Homo sapiens
aatcattgttttga

SEQ ID NO: 3226781 - DNA, 16 bp, Homo sapiens
aatcattgttttgaat

SEQ ID NO: 3226782 - DNA, 20 bp, Homo sapiens
aatcattgttttgaatatta

SEQ ID NO: 3226783 - DNA, 22 bp, Homo sapiens
aatcattgttttgaatattact

SEQ ID NO: 3226784 - DNA, 16 bp, Homo sapiens
aatcatttctcactgt

SEQ ID NO: 3226785 - DNA, 14 bp, Homo sapiens
aatcatttgctttt

SEQ ID NO: 3226786 - DNA, 16 bp, Homo sapiens
aatcatttgtttacat

SEQ ID NO: 3226787 - DNA, 20 bp, Homo sapiens
aatcattttaattattattc

SEQ ID NO: 3226788 - DNA, 19 bp, Homo sapiens
aatcattttgcctcttttc

SEQ ID NO: 3226789 - DNA, 16 bp, Homo sapiens
aatcatttttcactgt

SEQ ID NO: 3226790 - DNA, 13 bp, Homo sapiens
aatccaaaatgaa

SEQ ID NO: 3226791 - DNA, 20 bp, Homo sapiens
aatccaaatggcgtctggaa

SEQ ID NO: 3226792 - DNA, 17 bp, Homo sapiens
aatccaagctccctgcc

SEQ ID NO: 3226793 - DNA, 22 bp, Homo sapiens
aatccaagctccctgccccaaa

SEQ ID NO: 3226794 - DNA, 11 bp, Homo sapiens
aatccacctcg

SEQ ID NO: 3226795 - DNA, 19 bp, Homo sapiens
aatccagacccggctgcgt

SEQ ID NO: 3226796 - DNA, 20 bp, Homo sapiens
aatccatgtgattaatgttt

SEQ ID NO: 3226797 - DNA, 21 bp, Homo sapiens
aatccatgtgattaatgtttt

SEQ ID NO: 3226798 - DNA, 23 bp, Homo sapiens
aatccatgtgattaatgttttca

SEQ ID NO: 3226799 - DNA, 19 bp, Homo sapiens
aatccattgtttaaagatg

SEQ ID NO: 3226800 - DNA, 21 bp, Homo sapiens
aatcccaaatttgattgattt

SEQ ID NO: 3226801 - DNA, 15 bp, Homo sapiens
aatcccaatctttct

SEQ ID NO: 3226802 - DNA, 20 bp, Homo sapiens
aatcccaatctttctatata

SEQ ID NO: 3226803 - DNA, 17 bp, Homo sapiens
aatcccacctagcccag

SEQ ID NO: 3226804 - DNA, 15 bp, Homo sapiens
aatcccagcaatttg

SEQ ID NO: 3226805 - DNA, 23 bp, Homo sapiens
aatcccagccggccaatggaaac

SEQ ID NO: 3226806 - DNA, 22 bp, Homo sapiens
aatcccagggaaggacttggag

SEQ ID NO: 3226807 - DNA, 14 bp, Homo sapiens
aatcccagggctgg

SEQ ID NO: 3226808 - DNA, 19 bp, Homo sapiens
aatcccatcagtgaatcct

SEQ ID NO: 3226809 - DNA, 13 bp, Homo sapiens
aatcccccaggag

SEQ ID NO: 3226810 - DNA, 14 bp, Homo sapiens
aatcccccaggaga

SEQ ID NO: 3226811 - DNA, 12 bp, Homo sapiens
aatcccccaggg

SEQ ID NO: 3226812 - DNA, 14 bp, Homo sapiens
aatcccctaaaata

SEQ ID NO: 3226813 - DNA, 20 bp, Homo sapiens
aatcccctatcccattctgc

SEQ ID NO: 3226814 - DNA, 11 bp, Homo sapiens
aatcccctcct

SEQ ID NO: 3226815 - DNA, 15 bp, Homo sapiens
aatccccttatgact

SEQ ID NO: 3226816 - DNA, 15 bp, Homo sapiens
aatccctatgtttgt

SEQ ID NO: 3226817 - DNA, 19 bp, Homo sapiens
aatccctgggcattgcttt

SEQ ID NO: 3226818 - DNA, 16 bp, Homo sapiens
aatcccttcacagtcc

SEQ ID NO: 3226819 - DNA, 19 bp, Homo sapiens
aatcccttcacagtcccag

SEQ ID NO: 3226820 - DNA, 14 bp, Homo sapiens
aatcctaagacaca

SEQ ID NO: 3226821 - DNA, 24 bp, Homo sapiens
aatcctaatttctcctcccttcct

SEQ ID NO: 3226822 - DNA, 19 bp, Homo sapiens
aatcctagacttgaaagtt

SEQ ID NO: 3226823 - DNA, 20 bp, Homo sapiens
aatcctatctggggagctcc

SEQ ID NO: 3226824 - DNA, 22 bp, Homo sapiens
aatcctatctggggagctcctg

SEQ ID NO: 3226825 - DNA, 23 bp, Homo sapiens
aatcctatctggggagctcctgg

SEQ ID NO: 3226826 - DNA, 13 bp, Homo sapiens
aatcctcctccag

SEQ ID NO: 3226827 - DNA, 17 bp, Homo sapiens
aatcctgaactttctcc

SEQ ID NO: 3226828 - DNA, 20 bp, Homo sapiens
aatcctgaactttctccctc

SEQ ID NO: 3226829 - DNA, 11 bp, Homo sapiens
aatcctgtacc

SEQ ID NO: 3226830 - DNA, 17 bp, Homo sapiens
aatcctgtaccaaatct

SEQ ID NO: 3226831 - DNA, 12 bp, Homo sapiens
aatccttccaaa

SEQ ID NO: 3226832 - DNA, 19 bp, Homo sapiens
aatccttctattctagcct

SEQ ID NO: 3226833 - DNA, 13 bp, Homo sapiens
aatccttgcttat

SEQ ID NO: 3226834 - DNA, 22 bp, Homo sapiens
aatcctttgttttctgactaat

SEQ ID NO: 3226835 - DNA, 17 bp, Homo sapiens
aatcgactcaaaaataa

SEQ ID NO: 3226836 - DNA, 14 bp, Homo sapiens
aatcgattggcttt

SEQ ID NO: 3226837 - DNA, 20 bp, Homo sapiens
aatctaaaacaaaatctgaa

SEQ ID NO: 3226838 - DNA, 14 bp, Homo sapiens
aatctaaatctatt

SEQ ID NO: 3226839 - DNA, 15 bp, Homo sapiens
aatctaaatctattt

SEQ ID NO: 3226840 - DNA, 16 bp, Homo sapiens
aatctaaatctattta

SEQ ID NO: 3226841 - DNA, 17 bp, Homo sapiens
aatctaaatctatttat

SEQ ID NO: 3226842 - DNA, 19 bp, Homo sapiens
aatctaaatctatttatta

SEQ ID NO: 3226843 - DNA, 19 bp, Homo sapiens
aatctaacaataatatttc

SEQ ID NO: 3226844 - DNA, 23 bp, Homo sapiens
aatctaacaataatatttcaagt

SEQ ID NO: 3226845 - DNA, 17 bp, Homo sapiens
aatctaatattaaaaat

SEQ ID NO: 3226846 - DNA, 20 bp, Homo sapiens
aatctaatattaaaaatatg

SEQ ID NO: 3226847 - DNA, 18 bp, Homo sapiens
aatctacagatccttttt

SEQ ID NO: 3226848 - DNA, 19 bp, Homo sapiens
aatctacagatcctttttc

SEQ ID NO: 3226849 - DNA, 17 bp, Homo sapiens
aatctactaattccaca

SEQ ID NO: 3226850 - DNA, 23 bp, Homo sapiens
aatctaggcatgaagagcaaaaa

SEQ ID NO: 3226851 - DNA, 15 bp, Homo sapiens
aatctagtttacaga

SEQ ID NO: 3226852 - DNA, 18 bp, Homo sapiens
aatctagtttacagaaaa

SEQ ID NO: 3226853 - DNA, 19 bp, Homo sapiens
aatctagtttacagaaaaa

SEQ ID NO: 3226854 - DNA, 19 bp, Homo sapiens
aatctagttttttttgtaa

SEQ ID NO: 3226855 - DNA, 12 bp, Homo sapiens
aatctataaaag

SEQ ID NO: 3226856 - DNA, 21 bp, Homo sapiens
aatctatggtcgggagacagc

SEQ ID NO: 3226857 - DNA, 19 bp, Homo sapiens
aatctattcagacaagcaa

SEQ ID NO: 3226858 - DNA, 16 bp, Homo sapiens
aatctattctgtgttg

SEQ ID NO: 3226859 - DNA, 21 bp, Homo sapiens
aatctattctgtgttgcatta

SEQ ID NO: 3226860 - DNA, 16 bp, Homo sapiens
aatctatttattaata

SEQ ID NO: 3226861 - DNA, 20 bp, Homo sapiens
aatctatttattaatattta

SEQ ID NO: 3226862 - DNA, 12 bp, Homo sapiens
aatctcaaaatt

SEQ ID NO: 3226863 - DNA, 16 bp, Homo sapiens
aatctcaaaggagaaa

SEQ ID NO: 3226864 - DNA, 22 bp, Homo sapiens
aatctcaaaggagaaaaaaaac

SEQ ID NO: 3226865 - DNA, 12 bp, Homo sapiens
aatctcaaatag

SEQ ID NO: 3226866 - DNA, 16 bp, Homo sapiens
aatctcaaataggcta

SEQ ID NO: 3226867 - DNA, 15 bp, Homo sapiens
aatctcaagattcta

SEQ ID NO: 3226868 - DNA, 15 bp, Homo sapiens
aatctcaaggaatct

SEQ ID NO: 3226869 - DNA, 22 bp, Homo sapiens
aatctcagaggtagggctgcca

SEQ ID NO: 3226870 - DNA, 15 bp, Homo sapiens
aatctcagtgctttc

SEQ ID NO: 3226871 - DNA, 17 bp, Homo sapiens
aatctcataattggaat

SEQ ID NO: 3226872 - DNA, 18 bp, Homo sapiens
aatctcatacctctgacc

SEQ ID NO: 3226873 - DNA, 21 bp, Homo sapiens
aatctcctatttttttaaaat

SEQ ID NO: 3226874 - DNA, 12 bp, Homo sapiens
aatctccttact

SEQ ID NO: 3226875 - DNA, 15 bp, Homo sapiens
aatctcggctcactg

SEQ ID NO: 3226876 - DNA, 14 bp, Homo sapiens
aatctcgttcccaa

SEQ ID NO: 3226877 - DNA, 18 bp, Homo sapiens
aatctctaaatcaagtat

SEQ ID NO: 3226878 - DNA, 22 bp, Homo sapiens
aatctctacccctttcttctcg

SEQ ID NO: 3226879 - DNA, 14 bp, Homo sapiens
aatctctctctgtg

SEQ ID NO: 3226880 - DNA, 21 bp, Homo sapiens
aatctctgcctagaatcttta

SEQ ID NO: 3226881 - DNA, 22 bp, Homo sapiens
aatctctgcctagaatctttat

SEQ ID NO: 3226882 - DNA, 14 bp, Homo sapiens
aatctctgttatgt

SEQ ID NO: 3226883 - DNA, 18 bp, Homo sapiens
aatctcttgcttgtcatt

SEQ ID NO: 3226884 - DNA, 17 bp, Homo sapiens
aatctctttttgtttgc

SEQ ID NO: 3226885 - DNA, 18 bp, Homo sapiens
aatctctttttgtttgcc

SEQ ID NO: 3226886 - DNA, 16 bp, Homo sapiens
aatctgaaattctaaa

SEQ ID NO: 3226887 - DNA, 16 bp, Homo sapiens
aatctgaactctcaaa

SEQ ID NO: 3226888 - DNA, 21 bp, Homo sapiens
aatctgaagaggcttctcctg

SEQ ID NO: 3226889 - DNA, 18 bp, Homo sapiens
aatctgaagcttcactca

SEQ ID NO: 3226890 - DNA, 15 bp, Homo sapiens
aatctgaatgtaatt

SEQ ID NO: 3226891 - DNA, 12 bp, Homo sapiens
aatctgacatat

SEQ ID NO: 3226892 - DNA, 21 bp, Homo sapiens
aatctgccatttcaaatttct

SEQ ID NO: 3226893 - DNA, 16 bp, Homo sapiens
aatgttatcttctcaa

SEQ ID NO: 3226894 - DNA, 22 bp, Homo sapiens
aatgttatgggatgtaaacaat

SEQ ID NO: 3226895 - DNA, 17 bp, Homo sapiens
aatgttcatcaattccc

SEQ ID NO: 3226896 - DNA, 11 bp, Homo sapiens
aatgttccatt

SEQ ID NO: 3226897 - DNA, 16 bp, Homo sapiens
aatgttctaagtttct

SEQ ID NO: 3226898 - DNA, 21 bp, Homo sapiens
aatgttctatggttatgaaag

SEQ ID NO: 3226899 - DNA, 21 bp, Homo sapiens
aatgttctgaataatttctta

SEQ ID NO: 3226900 - DNA, 12 bp, Homo sapiens
aatgttctgaca

SEQ ID NO: 3226901 - DNA, 14 bp, Homo sapiens
aatgttctgacatt

SEQ ID NO: 3226902 - DNA, 10 bp, Homo sapiens
aatgttcttt

SEQ ID NO: 3226903 - DNA, 15 bp, Homo sapiens
aatgttctttaatgt

SEQ ID NO: 3226904 - DNA, 11 bp, Homo sapiens
aatgttctttg

SEQ ID NO: 3226905 - DNA, 14 bp, Homo sapiens
aatgttctttggaa

SEQ ID NO: 3226906 - DNA, 21 bp, Homo sapiens
aatgttctttggaaagtacac

SEQ ID NO: 3226907 - DNA, 22 bp, Homo sapiens
aatgttctttggaaagtacact

SEQ ID NO: 3226908 - DNA, 18 bp, Homo sapiens
aatgttggtttactttca

SEQ ID NO: 3226909 - DNA, 19 bp, Homo sapiens
aatgttgtccaacaataaa

SEQ ID NO: 3226910 - DNA, 15 bp, Homo sapiens
aatgttgttatttaa

SEQ ID NO: 3226911 - DNA, 20 bp, Homo sapiens
aatgtttaaatcatgtatgt

SEQ ID NO: 3226912 - DNA, 14 bp, Homo sapiens
aatgtttaatgctg

SEQ ID NO: 3226913 - DNA, 23 bp, Homo sapiens
aatgtttacactctttgtaagag

SEQ ID NO: 3226914 - DNA, 22 bp, Homo sapiens
aatgtttatgagccagacaaat

SEQ ID NO: 3226915 - DNA, 20 bp, Homo sapiens
aatgtttattcctgataata

SEQ ID NO: 3226916 - DNA, 15 bp, Homo sapiens
aatgtttattccttg

SEQ ID NO: 3226917 - DNA, 20 bp, Homo sapiens
aatgtttccaacctggagta

SEQ ID NO: 3226918 - DNA, 23 bp, Homo sapiens
aatgtttcttctaggttctaaaa

SEQ ID NO: 3226919 - DNA, 20 bp, Homo sapiens
aatgtttgaggagcatgttt

SEQ ID NO: 3226920 - DNA, 22 bp, Homo sapiens
aatgtttgaggagcatgttttg

SEQ ID NO: 3226921 - DNA, 21 bp, Homo sapiens
aatgtttggattctcttagct

SEQ ID NO: 3226922 - DNA, 19 bp, Homo sapiens
aatgtttgtctcagttgga

SEQ ID NO: 3226923 - DNA, 19 bp, Homo sapiens
aatgtttgttaaaaataaa

SEQ ID NO: 3226924 - DNA, 14 bp, Homo sapiens
aatgttttaaattc

SEQ ID NO: 3226925 - DNA, 15 bp, Homo sapiens
aatgttttaaattct

SEQ ID NO: 3226926 - DNA, 19 bp, Homo sapiens
aatgttttcattatgttca

SEQ ID NO: 3226927 - DNA, 14 bp, Homo sapiens
aatgttttgtatat

SEQ ID NO: 3226928 - DNA, 20 bp, Homo sapiens
aatgttttgtatatacagtt

SEQ ID NO: 3226929 - DNA, 22 bp, Homo sapiens
aatgttttgtatatacagttat

SEQ ID NO: 3226930 - DNA, 15 bp, Homo sapiens
aatgttttttgccac

SEQ ID NO: 3226931 - DNA, 23 bp, Homo sapiens
aatgttttttgccacagcttttg

SEQ ID NO: 3226932 - DNA, 21 bp, Homo sapiens
aattaaaaaaaaagatctgtt

SEQ ID NO: 3226933 - DNA, 14 bp, Homo sapiens
aattaaaaaccact

SEQ ID NO: 3226934 - DNA, 16 bp, Homo sapiens
aattaaaactcaacat

SEQ ID NO: 3226935 - DNA, 22 bp, Homo sapiens
aattaaaaggatagtattttta

SEQ ID NO: 3226936 - DNA, 15 bp, Homo sapiens
aattaaaattgtgca

SEQ ID NO: 3226937 - DNA, 22 bp, Homo sapiens
aattaaaattgtgcataatgct

SEQ ID NO: 3226938 - DNA, 22 bp, Homo sapiens
aattaaacttccaaagaaagtt

SEQ ID NO: 3226939 - DNA, 14 bp, Homo sapiens
aattaaacttttaa

SEQ ID NO: 3226940 - DNA, 12 bp, Homo sapiens
aattaaagcaaa

SEQ ID NO: 3226941 - DNA, 14 bp, Homo sapiens
aattaaattaggaa

SEQ ID NO: 3226942 - DNA, 15 bp, Homo sapiens
aattaacacaaagga

SEQ ID NO: 3226943 - DNA, 13 bp, Homo sapiens
aattaacctggtg

SEQ ID NO: 3226944 - DNA, 14 bp, Homo sapiens
aattaacctggtgc

SEQ ID NO: 3226945 - DNA, 16 bp, Homo sapiens
aattaacctggtgctg

SEQ ID NO: 3226946 - DNA, 12 bp, Homo sapiens
aattaactgtat

SEQ ID NO: 3226947 - DNA, 15 bp, Homo sapiens
aattaacttgagttt

SEQ ID NO: 3226948 - DNA, 19 bp, Homo sapiens
aattaagaaggcaaaaatg

SEQ ID NO: 3226949 - DNA, 12 bp, Homo sapiens
aattaagacaag

SEQ ID NO: 3226950 - DNA, 23 bp, Homo sapiens
aattaagcaaatgttaaaagttt

SEQ ID NO: 3226951 - DNA, 14 bp, Homo sapiens
aattaagtagaaca

SEQ ID NO: 3226952 - DNA, 15 bp, Homo sapiens
aattaagttacaatt

SEQ ID NO: 3226953 - DNA, 22 bp, Homo sapiens
aattaagttacaattacatctc

SEQ ID NO: 3226954 - DNA, 13 bp, Homo sapiens
aattaatagcttt

SEQ ID NO: 3226955 - DNA, 14 bp, Homo sapiens
aattaatagtttgt

SEQ ID NO: 3226956 - DNA, 19 bp, Homo sapiens
aattaatatccctacatgt

SEQ ID NO: 3226957 - DNA, 21 bp, Homo sapiens
aattaatgtcagtatttcaac

SEQ ID NO: 3226958 - DNA, 15 bp, Homo sapiens
aattaattgtaatct

SEQ ID NO: 3226959 - DNA, 12 bp, Homo sapiens
aattaattttac

SEQ ID NO: 3226960 - DNA, 15 bp, Homo sapiens
aattacaagccctgg

SEQ ID NO: 3226961 - DNA, 23 bp, Homo sapiens
aattacaattgtcatttataaaa

SEQ ID NO: 3226962 - DNA, 15 bp, Homo sapiens
aattacaattttatc

SEQ ID NO: 3226963 - DNA, 14 bp, Homo sapiens
aattacagatgtga

SEQ ID NO: 3226964 - DNA, 17 bp, Homo sapiens
aattacagatgtgaaaa

SEQ ID NO: 3226965 - DNA, 21 bp, Homo sapiens
aattacagcttttatggatga

SEQ ID NO: 3226966 - DNA, 18 bp, Homo sapiens
aattacaggagggaacat

SEQ ID NO: 3226967 - DNA, 20 bp, Homo sapiens
aattacaggagggaacattt

SEQ ID NO: 3226968 - DNA, 16 bp, Homo sapiens
aattacatctctaatt

SEQ ID NO: 3226969 - DNA, 13 bp, Homo sapiens
aattacattccta

SEQ ID NO: 3226970 - DNA, 22 bp, Homo sapiens
aattaccattaattacatacag

SEQ ID NO: 3226971 - DNA, 22 bp, Homo sapiens
aattacgtatgcaagtctgtga

SEQ ID NO: 3226972 - DNA, 16 bp, Homo sapiens
aattacgtttgttatt

SEQ ID NO: 3226973 - DNA, 13 bp, Homo sapiens
aattactaatttt

SEQ ID NO: 3226974 - DNA, 17 bp, Homo sapiens
aattactacaaaatttg

SEQ ID NO: 3226975 - DNA, 14 bp, Homo sapiens
aattactgtatata

SEQ ID NO: 3226976 - DNA, 20 bp, Homo sapiens
aattactgtatataaactcc

SEQ ID NO: 3226977 - DNA, 22 bp, Homo sapiens
aattactttggggctaatttaa

SEQ ID NO: 3226978 - DNA, 16 bp, Homo sapiens
aattagaaaatatagt

SEQ ID NO: 3226979 - DNA, 14 bp, Homo sapiens
aattagaaaatatt

SEQ ID NO: 3226980 - DNA, 16 bp, Homo sapiens
aattagaaaatattct

SEQ ID NO: 3226981 - DNA, 16 bp, Homo sapiens
aattagacactttgga

SEQ ID NO: 3226982 - DNA, 19 bp, Homo sapiens
aattagactgtgattcaga

SEQ ID NO: 3226983 - DNA, 20 bp, Homo sapiens
aattagactgtgattcagaa

SEQ ID NO: 3226984 - DNA, 18 bp, Homo sapiens
aattagagaagctgaaag

SEQ ID NO: 3226985 - DNA, 23 bp, Homo sapiens
aattagatgattatatattgttg

SEQ ID NO: 3226986 - DNA, 15 bp, Homo sapiens
aattagcatgctgct

SEQ ID NO: 3226987 - DNA, 23 bp, Homo sapiens
aattagcatgctgctttttgtac

SEQ ID NO: 3226988 - DNA, 13 bp, Homo sapiens
aattagcattctg

SEQ ID NO: 3226989 - DNA, 11 bp, Homo sapiens
aattagctctg

SEQ ID NO: 3226990 - DNA, 14 bp, Homo sapiens
aattagctctgggg

SEQ ID NO: 3226991 - DNA, 20 bp, Homo sapiens
aattaggaataaataaaaat

SEQ ID NO: 3226992 - DNA, 20 bp, Homo sapiens
aattaggcaaggctatgtga

SEQ ID NO: 3226993 - DNA, 23 bp, Homo sapiens
aattaggcaaggctatgtgatta

SEQ ID NO: 3226994 - DNA, 18 bp, Homo sapiens
aattaggctgtaactact

SEQ ID NO: 3226995 - DNA, 21 bp, Homo sapiens
aattaggctgtaactacttta

SEQ ID NO: 3226996 - DNA, 23 bp, Homo sapiens
aattaggctgtaactactttata

SEQ ID NO: 3226997 - DNA, 17 bp, Homo sapiens
aattaggggttgctaag

SEQ ID NO: 3226998 - DNA, 14 bp, Homo sapiens
aattaggttaacat

SEQ ID NO: 3226999 - DNA, 15 bp, Homo sapiens
aattagtaatgtact

SEQ ID NO: 3227000 - DNA, 15 bp, Homo sapiens
aattagtatgtctgt

SEQ ID NO: 3227001 - DNA, 23 bp, Homo sapiens
aattagtatgtctgtttttgtat

SEQ ID NO: 3227002 - DNA, 18 bp, Homo sapiens
aattagtatttatttaat

SEQ ID NO: 3227003 - DNA, 12 bp, Homo sapiens
aattataaactt

SEQ ID NO: 3227004 - DNA, 23 bp, Homo sapiens
aattataacagttatatttttgt

SEQ ID NO: 3227005 - DNA, 23 bp, Homo sapiens
aattataacttaaaatattttat

SEQ ID NO: 3227006 - DNA, 16 bp, Homo sapiens
aattataatatactat

SEQ ID NO: 3227007 - DNA, 12 bp, Homo sapiens
aattatactaac

SEQ ID NO: 3227008 - DNA, 21 bp, Homo sapiens
aattataggagccttaatttt

SEQ ID NO: 3227009 - DNA, 15 bp, Homo sapiens
aattatagtttctga

SEQ ID NO: 3227010 - DNA, 12 bp, Homo sapiens
aattatatattt

SEQ ID NO: 3227011 - DNA, 20 bp, Homo sapiens
aattatcaatatctaatata

SEQ ID NO: 3227012 - DNA, 20 bp, Homo sapiens
aattatcggaagcagtgcct

SEQ ID NO: 3227013 - DNA, 21 bp, Homo sapiens
aattatcggaagcagtgcctt

SEQ ID NO: 3227014 - DNA, 17 bp, Homo sapiens
aattatcgggaacagtg

SEQ ID NO: 3227015 - DNA, 14 bp, Homo sapiens
aattatctaattta

SEQ ID NO: 3227016 - DNA, 19 bp, Homo sapiens
aattatctaatttataaaa

SEQ ID NO: 3227017 - DNA, 19 bp, Homo sapiens
aattatgagttatttttat

SEQ ID NO: 3227018 - DNA, 18 bp, Homo sapiens
aattatgcactaaatatg

SEQ ID NO: 3227019 - DNA, 13 bp, Homo sapiens
acaaactgcaata

SEQ ID NO: 3227020 - DNA, 19 bp, Homo sapiens
acaaactgcaatagagact

SEQ ID NO: 3227021 - DNA, 20 bp, Homo sapiens
acaaactgcaatagagactg

SEQ ID NO: 3227022 - DNA, 19 bp, Homo sapiens
acaaagaaccatgcaggaa

SEQ ID NO: 3227023 - DNA, 20 bp, Homo sapiens
acaaagaaccatgcaggaag

SEQ ID NO: 3227024 - DNA, 17 bp, Homo sapiens
acaaagacaaaagtctg

SEQ ID NO: 3227025 - DNA, 13 bp, Homo sapiens
acaaagactcctc

SEQ ID NO: 3227026 - DNA, 20 bp, Homo sapiens
acaaagactcctctgggcct

SEQ ID NO: 3227027 - DNA, 21 bp, Homo sapiens
acaaagactcctctgggcctg

SEQ ID NO: 3227028 - DNA, 23 bp, Homo sapiens
acaaagagttctggaaaagaact

SEQ ID NO: 3227029 - DNA, 21 bp, Homo sapiens
acaaagatgtttgtcagatat

SEQ ID NO: 3227030 - DNA, 14 bp, Homo sapiens
acaaagattgagaa

SEQ ID NO: 3227031 - DNA, 17 bp, Homo sapiens
acaaagcacagtttgaa

SEQ ID NO: 3227032 - DNA, 19 bp, Homo sapiens
acaaagcacagtttgaaca

SEQ ID NO: 3227033 - DNA, 19 bp, Homo sapiens
acaaagccttatcaagtgt

SEQ ID NO: 3227034 - DNA, 20 bp, Homo sapiens
acaaagcgtttctttacttc

SEQ ID NO: 3227035 - DNA, 22 bp, Homo sapiens
acaaagctaggatggttctgtg

SEQ ID NO: 3227036 - DNA, 23 bp, Homo sapiens
acaaagctaggatggttctgtga

SEQ ID NO: 3227037 - DNA, 13 bp, Homo sapiens
acaaagctgctaa

SEQ ID NO: 3227038 - DNA, 14 bp, Homo sapiens
acaaagctgttaaa

SEQ ID NO: 3227039 - DNA, 18 bp, Homo sapiens
acaaagctgttaaactgt

SEQ ID NO: 3227040 - DNA, 19 bp, Homo sapiens
acaaagctgttaaactgtt

SEQ ID NO: 3227041 - DNA, 23 bp, Homo sapiens
acaaagcttctatcccaggaggt

SEQ ID NO: 3227042 - DNA, 11 bp, Homo sapiens
acaaaggatga

SEQ ID NO: 3227043 - DNA, 16 bp, Homo sapiens
acaaaggatgaagaac

SEQ ID NO: 3227044 - DNA, 17 bp, Homo sapiens
acaaaggccaaactgct

SEQ ID NO: 3227045 - DNA, 18 bp, Homo sapiens
acaaagggagggagcaag

SEQ ID NO: 3227046 - DNA, 21 bp, Homo sapiens
acaaagggagggagcaagccc

SEQ ID NO: 3227047 - DNA, 21 bp, Homo sapiens
acaaaggtggaataaacatta

SEQ ID NO: 3227048 - DNA, 24 bp, Homo sapiens
acaaaggtggaataaacattaatt

SEQ ID NO: 3227049 - DNA, 21 bp, Homo sapiens
acaaaggttttcctcttctat

SEQ ID NO: 3227050 - DNA, 19 bp, Homo sapiens
acaaagtaaatacaagact

SEQ ID NO: 3227051 - DNA, 20 bp, Homo sapiens
acaaagtaaatacaagactg

SEQ ID NO: 3227052 - DNA, 18 bp, Homo sapiens
acaaagtgactgtttggc

SEQ ID NO: 3227053 - DNA, 14 bp, Homo sapiens
acaaagtttcagag

SEQ ID NO: 3227054 - DNA, 20 bp, Homo sapiens
acaaagtttcagagtatatt

SEQ ID NO: 3227055 - DNA, 22 bp, Homo sapiens
acaaagtttcagagtatattgt

SEQ ID NO: 3227056 - DNA, 14 bp, Homo sapiens
acaaagttttcctt

SEQ ID NO: 3227057 - DNA, 15 bp, Homo sapiens
acaaagttttccttt

SEQ ID NO: 3227058 - DNA, 18 bp, Homo sapiens
acaaataaaattggcacc

SEQ ID NO: 3227059 - DNA, 13 bp, Homo sapiens
acaaataaataaa

SEQ ID NO: 3227060 - DNA, 16 bp, Homo sapiens
acaaataacaatgtgc

SEQ ID NO: 3227061 - DNA, 13 bp, Homo sapiens
acaaataatcaca

SEQ ID NO: 3227062 - DNA, 22 bp, Homo sapiens
acaaatacctccattaaatggt

SEQ ID NO: 3227063 - DNA, 12 bp, Homo sapiens
acaaatatattg

SEQ ID NO: 3227064 - DNA, 11 bp, Homo sapiens
acaaatatgca

SEQ ID NO: 3227065 - DNA, 18 bp, Homo sapiens
acaaatatgctaatttgg

SEQ ID NO: 3227066 - DNA, 20 bp, Homo sapiens
acaaatatggctagttttca

SEQ ID NO: 3227067 - DNA, 21 bp, Homo sapiens
acaaatattatttgtgtttcc

SEQ ID NO: 3227068 - DNA, 12 bp, Homo sapiens
acaaatatttat

SEQ ID NO: 3227069 - DNA, 18 bp, Homo sapiens
acaaatatttattttctt

SEQ ID NO: 3227070 - DNA, 13 bp, Homo sapiens
acaaatattttca

SEQ ID NO: 3227071 - DNA, 17 bp, Homo sapiens
acaaatcaacagaagca

SEQ ID NO: 3227072 - DNA, 19 bp, Homo sapiens
acaaatcttgggtgggtga

SEQ ID NO: 3227073 - DNA, 19 bp, Homo sapiens
acaaatgacagattctgac

SEQ ID NO: 3227074 - DNA, 13 bp, Homo sapiens
acaaatgccttga

SEQ ID NO: 3227075 - DNA, 16 bp, Homo sapiens
acaaatgtattttgaa

SEQ ID NO: 3227076 - DNA, 14 bp, Homo sapiens
acaaatgtgtatgt

SEQ ID NO: 3227077 - DNA, 14 bp, Homo sapiens
acaaattaaaaaga

SEQ ID NO: 3227078 - DNA, 17 bp, Homo sapiens
acaaattaaaaagattc

SEQ ID NO: 3227079 - DNA, 21 bp, Homo sapiens
acaaattaaaaagattctttt

SEQ ID NO: 3227080 - DNA, 18 bp, Homo sapiens
acaaattgaaaacacact

SEQ ID NO: 3227081 - DNA, 15 bp, Homo sapiens
acaaatttatgcatt

SEQ ID NO: 3227082 - DNA, 16 bp, Homo sapiens
acaaatttatgcattt

SEQ ID NO: 3227083 - DNA, 17 bp, Homo sapiens
acaaattttcagaaggt

SEQ ID NO: 3227084 - DNA, 15 bp, Homo sapiens
acaacaaactgaatt

SEQ ID NO: 3227085 - DNA, 18 bp, Homo sapiens
acaacaattggtaaaact

SEQ ID NO: 3227086 - DNA, 19 bp, Homo sapiens
acaacaattggtaaaactc

SEQ ID NO: 3227087 - DNA, 18 bp, Homo sapiens
acaacaccttcctcctgc

SEQ ID NO: 3227088 - DNA, 13 bp, Homo sapiens
acaacagaaaaac

SEQ ID NO: 3227089 - DNA, 15 bp, Homo sapiens
acaacagaaaaacaa

SEQ ID NO: 3227090 - DNA, 13 bp, Homo sapiens
acaacagaataaa

SEQ ID NO: 3227091 - DNA, 15 bp, Homo sapiens
acaacagaataaagc

SEQ ID NO: 3227092 - DNA, 17 bp, Homo sapiens
acaacagaataaagcag

SEQ ID NO: 3227093 - DNA, 21 bp, Homo sapiens
acaacagaataaagcagcctg

SEQ ID NO: 3227094 - DNA, 14 bp, Homo sapiens
acaacagcagtctc

SEQ ID NO: 3227095 - DNA, 15 bp, Homo sapiens
acaacagctgaagca

SEQ ID NO: 3227096 - DNA, 16 bp, Homo sapiens
acaacaggtaaaacag

SEQ ID NO: 3227097 - DNA, 20 bp, Homo sapiens
acaacagtgctttgtaaatt

SEQ ID NO: 3227098 - DNA, 17 bp, Homo sapiens
acaacatccatgtccta

SEQ ID NO: 3227099 - DNA, 13 bp, Homo sapiens
acaaccgttggaa

SEQ ID NO: 3227100 - DNA, 15 bp, Homo sapiens
acaacctcaactgcc

SEQ ID NO: 3227101 - DNA, 21 bp, Homo sapiens
acaacctccctcttgttttgt

SEQ ID NO: 3227102 - DNA, 16 bp, Homo sapiens
acaacctgaaagacaa

SEQ ID NO: 3227103 - DNA, 15 bp, Homo sapiens
acaacctgaaattta

SEQ ID NO: 3227104 - DNA, 15 bp, Homo sapiens
acaacgtaaaaataa

SEQ ID NO: 3227105 - DNA, 19 bp, Homo sapiens
acaactaggcttcagcata

SEQ ID NO: 3227106 - DNA, 16 bp, Homo sapiens
acaactgacacaggaa

SEQ ID NO: 3227107 - DNA, 15 bp, Homo sapiens
acaactgcaaagaaa

SEQ ID NO: 3227108 - DNA, 20 bp, Homo sapiens
acaactgcaataacttctga

SEQ ID NO: 3227109 - DNA, 22 bp, Homo sapiens
acaactgcctcgaaacacagaa

SEQ ID NO: 3227110 - DNA, 11 bp, Homo sapiens
acaactgtgac

SEQ ID NO: 3227111 - DNA, 16 bp, Homo sapiens
acaacttatttaaaaa

SEQ ID NO: 3227112 - DNA, 21 bp, Homo sapiens
acaacttatttaaaaatattt

SEQ ID NO: 3227113 - DNA, 22 bp, Homo sapiens
acaacttatttaaaaatatttc

SEQ ID NO: 3227114 - DNA, 18 bp, Homo sapiens
acaacttggcatttctat

SEQ ID NO: 3227115 - DNA, 16 bp, Homo sapiens
acaacttgtatttcca

SEQ ID NO: 3227116 - DNA, 17 bp, Homo sapiens
acaacttgtatttccaa

SEQ ID NO: 3227117 - DNA, 13 bp, Homo sapiens
acaactttgccag

SEQ ID NO: 3227118 - DNA, 15 bp, Homo sapiens
acaagaaatccctgt

SEQ ID NO: 3227119 - DNA, 21 bp, Homo sapiens
acaagaaatccctgtttaata

SEQ ID NO: 3227120 - DNA, 23 bp, Homo sapiens
acaagaaatccctgtttaatatt

SEQ ID NO: 3227121 - DNA, 18 bp, Homo sapiens
acaagaaatttgatttct

SEQ ID NO: 3227122 - DNA, 21 bp, Homo sapiens
acaagaagtttattctcattt

SEQ ID NO: 3227123 - DNA, 13 bp, Homo sapiens
acaagaatggatc

SEQ ID NO: 3227124 - DNA, 15 bp, Homo sapiens
acaagagcactacat

SEQ ID NO: 3227125 - DNA, 19 bp, Homo sapiens
acaagagcagcctgtggca

SEQ ID NO: 3227126 - DNA, 16 bp, Homo sapiens
acaagagtccctttga

SEQ ID NO: 3227127 - DNA, 22 bp, Homo sapiens
acaagagtttatttccaaataa

SEQ ID NO: 3227128 - DNA, 22 bp, Homo sapiens
acaagatccatttgcctttctg

SEQ ID NO: 3227129 - DNA, 20 bp, Homo sapiens
acaagatctttcaggaaaga

SEQ ID NO: 3227130 - DNA, 19 bp, Homo sapiens
acaagatttcctactttct

SEQ ID NO: 3227131 - DNA, 14 bp, Homo sapiens
acaagatttcctta

SEQ ID NO: 3227132 - DNA, 15 bp, Homo sapiens
acaagcactatttta

SEQ ID NO: 3227133 - DNA, 22 bp, Homo sapiens
acaagcagagtgcacagctgtc

SEQ ID NO: 3227134 - DNA, 17 bp, Homo sapiens
acaagcagcccttgctt

SEQ ID NO: 3227135 - DNA, 17 bp, Homo sapiens
acaagccaatgtgaatt

SEQ ID NO: 3227136 - DNA, 15 bp, Homo sapiens
acaagcccacagcac

SEQ ID NO: 3227137 - DNA, 16 bp, Homo sapiens
acaagcccacagcaca

SEQ ID NO: 3227138 - DNA, 21 bp, Homo sapiens
acaagcctcctgtacctcagt

SEQ ID NO: 3227139 - DNA, 18 bp, Homo sapiens
acaagcctggcaacacac

SEQ ID NO: 3227140 - DNA, 16 bp, Homo sapiens
acaagctcctggtctt

SEQ ID NO: 3227141 - DNA, 14 bp, Homo sapiens
acaagctgacttgg

SEQ ID NO: 3227142 - DNA, 17 bp, Homo sapiens
acaagctgtccctgcag

SEQ ID NO: 3227143 - DNA, 19 bp, Homo sapiens
acaagctgtccctgcaggg

SEQ ID NO: 3227144 - DNA, 18 bp, Homo sapiens
acaaggaatgcctgtgcc

SEQ ID NO: 3227145 - DNA, 22 bp, Homo sapiens
acagcactggctctctccagga

SEQ ID NO: 3227146 - DNA, 18 bp, Homo sapiens
acagcagcctgcttccca

SEQ ID NO: 3227147 - DNA, 16 bp, Homo sapiens
acagcagcttcaccag

SEQ ID NO: 3227148 - DNA, 12 bp, Homo sapiens
acagcaggcagc

SEQ ID NO: 3227149 - DNA, 21 bp, Homo sapiens
acagcagtcccagtattctca

SEQ ID NO: 3227150 - DNA, 18 bp, Homo sapiens
acagcagtctccttcagc

SEQ ID NO: 3227151 - DNA, 16 bp, Homo sapiens
acagcatgaataaaac

SEQ ID NO: 3227152 - DNA, 13 bp, Homo sapiens
acagcatgcccct

SEQ ID NO: 3227153 - DNA, 21 bp, Homo sapiens
acagcatgccccttggctgga

SEQ ID NO: 3227154 - DNA, 14 bp, Homo sapiens
acagcatgtgccaa

SEQ ID NO: 3227155 - DNA, 12 bp, Homo sapiens
acagcattgctt

SEQ ID NO: 3227156 - DNA, 15 bp, Homo sapiens
acagcattgctttct

SEQ ID NO: 3227157 - DNA, 15 bp, Homo sapiens
acagcattgtctttg

SEQ ID NO: 3227158 - DNA, 14 bp, Homo sapiens
acagccaaatttaa

SEQ ID NO: 3227159 - DNA, 17 bp, Homo sapiens
acagccaactagcccct

SEQ ID NO: 3227160 - DNA, 18 bp, Homo sapiens
acagccaactagcccctg

SEQ ID NO: 3227161 - DNA, 20 bp, Homo sapiens
acagccaagattttcctctt

SEQ ID NO: 3227162 - DNA, 12 bp, Homo sapiens
acagccaagtgt

SEQ ID NO: 3227163 - DNA, 21 bp, Homo sapiens
acagccacccgtggggtgctg

SEQ ID NO: 3227164 - DNA, 16 bp, Homo sapiens
acagccacggccaggc

SEQ ID NO: 3227165 - DNA, 19 bp, Homo sapiens
acagccacggccaggccag

SEQ ID NO: 3227166 - DNA, 19 bp, Homo sapiens
acagccagagctgggtggg

SEQ ID NO: 3227167 - DNA, 22 bp, Homo sapiens
acagccatgtccaagttcttca

SEQ ID NO: 3227168 - DNA, 16 bp, Homo sapiens
acagccattgcggccc

SEQ ID NO: 3227169 - DNA, 14 bp, Homo sapiens
acagccatttgtaa

SEQ ID NO: 3227170 - DNA, 17 bp, Homo sapiens
acagccatttgtaatga

SEQ ID NO: 3227171 - DNA, 13 bp, Homo sapiens
acagcccaagagg

SEQ ID NO: 3227172 - DNA, 13 bp, Homo sapiens
acagcccagagcc

SEQ ID NO: 3227173 - DNA, 21 bp, Homo sapiens
acagcccaggatactggcaca

SEQ ID NO: 3227174 - DNA, 21 bp, Homo sapiens
acagcccaggcatctccttgg

SEQ ID NO: 3227175 - DNA, 18 bp, Homo sapiens
acagcccaggtccctccg

SEQ ID NO: 3227176 - DNA, 14 bp, Homo sapiens
acagcccatctgcc

SEQ ID NO: 3227177 - DNA, 20 bp, Homo sapiens
acagcccccttgccctccgc

SEQ ID NO: 3227178 - DNA, 22 bp, Homo sapiens
acagcccttatgcggttaattt

SEQ ID NO: 3227179 - DNA, 23 bp, Homo sapiens
acagcccttatgcggttaatttt

SEQ ID NO: 3227180 - DNA, 13 bp, Homo sapiens
acagccgcagcct

SEQ ID NO: 3227181 - DNA, 20 bp, Homo sapiens
acagccgcagcctccctctg

SEQ ID NO: 3227182 - DNA, 20 bp, Homo sapiens
acagccgtcagccaaatgta

SEQ ID NO: 3227183 - DNA, 21 bp, Homo sapiens
acagcctccgccaagatctac

SEQ ID NO: 3227184 - DNA, 18 bp, Homo sapiens
acagcctctgacccctcc

SEQ ID NO: 3227185 - DNA, 22 bp, Homo sapiens
acagcctctgacccctcctcac

SEQ ID NO: 3227186 - DNA, 18 bp, Homo sapiens
acagcctctggctccaca

SEQ ID NO: 3227187 - DNA, 22 bp, Homo sapiens
acagcctcttcagccccttctc

SEQ ID NO: 3227188 - DNA, 11 bp, Homo sapiens
acagcctggca

SEQ ID NO: 3227189 - DNA, 15 bp, Homo sapiens
acagcctggcacagg

SEQ ID NO: 3227190 - DNA, 19 bp, Homo sapiens
acagccttagctgccagtg

SEQ ID NO: 3227191 - DNA, 19 bp, Homo sapiens
acagcgaagtagcttgctc

SEQ ID NO: 3227192 - DNA, 16 bp, Homo sapiens
acagcgagggcagctg

SEQ ID NO: 3227193 - DNA, 17 bp, Homo sapiens
acagcgagggcagctgc

SEQ ID NO: 3227194 - DNA, 16 bp, Homo sapiens
acagcgcccctgctgt

SEQ ID NO: 3227195 - DNA, 23 bp, Homo sapiens
acagcgcccctgctgtcttcccc

SEQ ID NO: 3227196 - DNA, 19 bp, Homo sapiens
acagcgcggaggaggaggg

SEQ ID NO: 3227197 - DNA, 16 bp, Homo sapiens
acagcggaggtgtgga

SEQ ID NO: 3227198 - DNA, 19 bp, Homo sapiens
acagcggcccctgcatccc

SEQ ID NO: 3227199 - DNA, 15 bp, Homo sapiens
acagcgtccctggcg

SEQ ID NO: 3227200 - DNA, 17 bp, Homo sapiens
acagcgtccctggcgca

SEQ ID NO: 3227201 - DNA, 18 bp, Homo sapiens
acagctaaatttggagat

SEQ ID NO: 3227202 - DNA, 22 bp, Homo sapiens
acagctaatcagcattctcact

SEQ ID NO: 3227203 - DNA, 16 bp, Homo sapiens
acagctaatgggacac

SEQ ID NO: 3227204 - DNA, 15 bp, Homo sapiens
acagctacctgagac

SEQ ID NO: 3227205 - DNA, 22 bp, Homo sapiens
acagctactctccccacgaggg

SEQ ID NO: 3227206 - DNA, 22 bp, Homo sapiens
acagctatcgaacttcacaact

SEQ ID NO: 3227207 - DNA, 17 bp, Homo sapiens
acagctatgggagcccc

SEQ ID NO: 3227208 - DNA, 21 bp, Homo sapiens
acagctcagccagtggggatg

SEQ ID NO: 3227209 - DNA, 18 bp, Homo sapiens
acagctccttctgtccta

SEQ ID NO: 3227210 - DNA, 15 bp, Homo sapiens
acagctcgatccaaa

SEQ ID NO: 3227211 - DNA, 16 bp, Homo sapiens
acagctctgtcctggg

SEQ ID NO: 3227212 - DNA, 17 bp, Homo sapiens
acagctctgtcctggga

SEQ ID NO: 3227213 - DNA, 16 bp, Homo sapiens
acagctcttctccagg

SEQ ID NO: 3227214 - DNA, 13 bp, Homo sapiens
acagctcttcttg

SEQ ID NO: 3227215 - DNA, 17 bp, Homo sapiens
acagctgactgaatgca

SEQ ID NO: 3227216 - DNA, 16 bp, Homo sapiens
acagctgagagacttt

SEQ ID NO: 3227217 - DNA, 16 bp, Homo sapiens
acagctgaggtctctt

SEQ ID NO: 3227218 - DNA, 12 bp, Homo sapiens
acagctgcagct

SEQ ID NO: 3227219 - DNA, 14 bp, Homo sapiens
acagctgcagctgg

SEQ ID NO: 3227220 - DNA, 16 bp, Homo sapiens
acagctgcagctgggc

SEQ ID NO: 3227221 - DNA, 18 bp, Homo sapiens
acagctgcagctgggccc

SEQ ID NO: 3227222 - DNA, 15 bp, Homo sapiens
acagctggagctctc

SEQ ID NO: 3227223 - DNA, 12 bp, Homo sapiens
acagctgggcaa

SEQ ID NO: 3227224 - DNA, 17 bp, Homo sapiens
acagctgtattgtctga

SEQ ID NO: 3227225 - DNA, 19 bp, Homo sapiens
acagctgtattgtctgaac

SEQ ID NO: 3227226 - DNA, 16 bp, Homo sapiens
acagcttaacaatgca

SEQ ID NO: 3227227 - DNA, 18 bp, Homo sapiens
acagcttaacaatgcaac

SEQ ID NO: 3227228 - DNA, 19 bp, Homo sapiens
acagcttaacaatgcaact

SEQ ID NO: 3227229 - DNA, 22 bp, Homo sapiens
acagcttacactgattggtgtt

SEQ ID NO: 3227230 - DNA, 15 bp, Homo sapiens
acagcttcaggttat

SEQ ID NO: 3227231 - DNA, 20 bp, Homo sapiens
acagcttcaggttatcgaaa

SEQ ID NO: 3227232 - DNA, 18 bp, Homo sapiens
acagcttcctttcctgtg

SEQ ID NO: 3227233 - DNA, 14 bp, Homo sapiens
acagcttctctgca

SEQ ID NO: 3227234 - DNA, 16 bp, Homo sapiens
acagcttctctgcagt

SEQ ID NO: 3227235 - DNA, 19 bp, Homo sapiens
acagcttgacctgaggctg

SEQ ID NO: 3227236 - DNA, 15 bp, Homo sapiens
acagctttcaagtgc

SEQ ID NO: 3227237 - DNA, 20 bp, Homo sapiens
acagctttcatgattagcaa

SEQ ID NO: 3227238 - DNA, 20 bp, Homo sapiens
acagctttcccctcattttt

SEQ ID NO: 3227239 - DNA, 17 bp, Homo sapiens
acagctttcttgctccc

SEQ ID NO: 3227240 - DNA, 15 bp, Homo sapiens
acagctttgctccgc

SEQ ID NO: 3227241 - DNA, 21 bp, Homo sapiens
acagctttggggtgtcttttt

SEQ ID NO: 3227242 - DNA, 22 bp, Homo sapiens
acagctttggggtgtctttttt

SEQ ID NO: 3227243 - DNA, 12 bp, Homo sapiens
acagcttttgca

SEQ ID NO: 3227244 - DNA, 13 bp, Homo sapiens
acagcttttgcaa

SEQ ID NO: 3227245 - DNA, 15 bp, Homo sapiens
acagcttttgcaact

SEQ ID NO: 3227246 - DNA, 16 bp, Homo sapiens
acaggaaaagctgctg

SEQ ID NO: 3227247 - DNA, 20 bp, Homo sapiens
acaggaaaagctgctgacag

SEQ ID NO: 3227248 - DNA, 21 bp, Homo sapiens
acaggaaaagctgctgacagt

SEQ ID NO: 3227249 - DNA, 20 bp, Homo sapiens
acaggaaaattttaaaaata

SEQ ID NO: 3227250 - DNA, 17 bp, Homo sapiens
acaggaaagagtcacac

SEQ ID NO: 3227251 - DNA, 15 bp, Homo sapiens
acaggaaagccctcc

SEQ ID NO: 3227252 - DNA, 19 bp, Homo sapiens
acaggaaagccctccccct

SEQ ID NO: 3227253 - DNA, 14 bp, Homo sapiens
acaggaagaaagag

SEQ ID NO: 3227254 - DNA, 15 bp, Homo sapiens
acaggaagcacccca

SEQ ID NO: 3227255 - DNA, 20 bp, Homo sapiens
acaggaaggtggtgcttaca

SEQ ID NO: 3227256 - DNA, 17 bp, Homo sapiens
acaggaagtcttcaggg

SEQ ID NO: 3227257 - DNA, 15 bp, Homo sapiens
acaggaatgaagaac

SEQ ID NO: 3227258 - DNA, 16 bp, Homo sapiens
acaggaatgtctggag

SEQ ID NO: 3227259 - DNA, 14 bp, Homo sapiens
acaggaattttatt

SEQ ID NO: 3227260 - DNA, 18 bp, Homo sapiens
acaggacaaagggaggga

SEQ ID NO: 3227261 - DNA, 23 bp, Homo sapiens
acaggacagagttcacaggaggc

SEQ ID NO: 3227262 - DNA, 20 bp, Homo sapiens
acaggacagtgcttcagcct

SEQ ID NO: 3227263 - DNA, 13 bp, Homo sapiens
acaggaccctcag

SEQ ID NO: 3227264 - DNA, 16 bp, Homo sapiens
acaggactctgcctcc

SEQ ID NO: 3227265 - DNA, 22 bp, Homo sapiens
acaggagaggcagcatgcttgg

SEQ ID NO: 3227266 - DNA, 13 bp, Homo sapiens
acaggaggccagt

SEQ ID NO: 3227267 - DNA, 17 bp, Homo sapiens
acaggaggccagtgggc

SEQ ID NO: 3227268 - DNA, 13 bp, Homo sapiens
acaggaggcggcc

SEQ ID NO: 3227269 - DNA, 22 bp, Homo sapiens
acaggaggcggcccggccagcg

SEQ ID NO: 3227270 - DNA, 23 bp, Homo sapiens
acaggaggcggcccggccagcgg

SEQ ID NO: 3227271 - DNA, 14 bp, Homo sapiens
accacctccctcac

SEQ ID NO: 3227272 - DNA, 20 bp, Homo sapiens
accaccttctgtccccagcc

SEQ ID NO: 3227273 - DNA, 15 bp, Homo sapiens
accacctttactgtg

SEQ ID NO: 3227274 - DNA, 13 bp, Homo sapiens
accacgactggcc

SEQ ID NO: 3227275 - DNA, 20 bp, Homo sapiens
accacgcccgtcctgcctgt

SEQ ID NO: 3227276 - DNA, 21 bp, Homo sapiens
accacgcccgtcctgcctgtg

SEQ ID NO: 3227277 - DNA, 18 bp, Homo sapiens
accacggcgtttttttac

SEQ ID NO: 3227278 - DNA, 16 bp, Homo sapiens
accacgtctgccaggc

SEQ ID NO: 3227279 - DNA, 22 bp, Homo sapiens
accacgtctgccaggcccatct

SEQ ID NO: 3227280 - DNA, 17 bp, Homo sapiens
accacgtctgtcttcac

SEQ ID NO: 3227281 - DNA, 18 bp, Homo sapiens
accacgtctgtcttcaca

SEQ ID NO: 3227282 - DNA, 13 bp, Homo sapiens
accacgtggggct

SEQ ID NO: 3227283 - DNA, 19 bp, Homo sapiens
accactaggaatcccagag

SEQ ID NO: 3227284 - DNA, 20 bp, Homo sapiens
accactcaaattaatctttc

SEQ ID NO: 3227285 - DNA, 14 bp, Homo sapiens
accactcagcccct

SEQ ID NO: 3227286 - DNA, 17 bp, Homo sapiens
accactcagcccctagg

SEQ ID NO: 3227287 - DNA, 21 bp, Homo sapiens
accactgagagcgagatggga

SEQ ID NO: 3227288 - DNA, 17 bp, Homo sapiens
accactgcactccagcc

SEQ ID NO: 3227289 - DNA, 16 bp, Homo sapiens
accactgcctgactgc

SEQ ID NO: 3227290 - DNA, 15 bp, Homo sapiens
accactggccaccag

SEQ ID NO: 3227291 - DNA, 16 bp, Homo sapiens
accactggccaccagg

SEQ ID NO: 3227292 - DNA, 20 bp, Homo sapiens
accactggccaccaggctgg

SEQ ID NO: 3227293 - DNA, 20 bp, Homo sapiens
accactgtaaaatgaaatta

SEQ ID NO: 3227294 - DNA, 13 bp, Homo sapiens
accacttcactga

SEQ ID NO: 3227295 - DNA, 16 bp, Homo sapiens
accacttcactgaaag

SEQ ID NO: 3227296 - DNA, 15 bp, Homo sapiens
accacttcagggctt

SEQ ID NO: 3227297 - DNA, 17 bp, Homo sapiens
accacttcaggggatgg

SEQ ID NO: 3227298 - DNA, 20 bp, Homo sapiens
accacttccaggggaacctg

SEQ ID NO: 3227299 - DNA, 14 bp, Homo sapiens
accacttcctgcta

SEQ ID NO: 3227300 - DNA, 20 bp, Homo sapiens
accacttcctgctacaggag

SEQ ID NO: 3227301 - DNA, 22 bp, Homo sapiens
accactttggagactggggtgg

SEQ ID NO: 3227302 - DNA, 13 bp, Homo sapiens
accagaaaagcaa

SEQ ID NO: 3227303 - DNA, 16 bp, Homo sapiens
accagaaatcaaaaag

SEQ ID NO: 3227304 - DNA, 13 bp, Homo sapiens
accagaagggaaa

SEQ ID NO: 3227305 - DNA, 16 bp, Homo sapiens
accagacaaggaaata

SEQ ID NO: 3227306 - DNA, 23 bp, Homo sapiens
accagacaccttgacagggcaca

SEQ ID NO: 3227307 - DNA, 14 bp, Homo sapiens
accagacctcttct

SEQ ID NO: 3227308 - DNA, 18 bp, Homo sapiens
accagagaccgtcctcac

SEQ ID NO: 3227309 - DNA, 12 bp, Homo sapiens
accagagcagat

SEQ ID NO: 3227310 - DNA, 22 bp, Homo sapiens
accagagccagatgcaggacag

SEQ ID NO: 3227311 - DNA, 14 bp, Homo sapiens
accagagcccacct

SEQ ID NO: 3227312 - DNA, 19 bp, Homo sapiens
accagagcccaccttggct

SEQ ID NO: 3227313 - DNA, 13 bp, Homo sapiens
accagagccttca

SEQ ID NO: 3227314 - DNA, 19 bp, Homo sapiens
accagagccttcaagtgcc

SEQ ID NO: 3227315 - DNA, 21 bp, Homo sapiens
accagagccttcaagtgccaa

SEQ ID NO: 3227316 - DNA, 23 bp, Homo sapiens
accagagccttcaagtgccaaac

SEQ ID NO: 3227317 - DNA, 15 bp, Homo sapiens
accagagcttggaga

SEQ ID NO: 3227318 - DNA, 23 bp, Homo sapiens
accagaggccgaaggtgcctcag

SEQ ID NO: 3227319 - DNA, 22 bp, Homo sapiens
accagataccttatcttacaat

SEQ ID NO: 3227320 - DNA, 21 bp, Homo sapiens
accagatctgtctccaagacc

SEQ ID NO: 3227321 - DNA, 14 bp, Homo sapiens
accagatgctactg

SEQ ID NO: 3227322 - DNA, 17 bp, Homo sapiens
accagcaatatatctga

SEQ ID NO: 3227323 - DNA, 15 bp, Homo sapiens
accagcactgtctca

SEQ ID NO: 3227324 - DNA, 16 bp, Homo sapiens
accagcactgtctcag

SEQ ID NO: 3227325 - DNA, 11 bp, Homo sapiens
accagccagcg

SEQ ID NO: 3227326 - DNA, 18 bp, Homo sapiens
accagcccatggccctgt

SEQ ID NO: 3227327 - DNA, 22 bp, Homo sapiens
accagccccactgccagcagca

SEQ ID NO: 3227328 - DNA, 18 bp, Homo sapiens
accagccccagtgcccac

SEQ ID NO: 3227329 - DNA, 20 bp, Homo sapiens
accagccccagtgcccacag

SEQ ID NO: 3227330 - DNA, 14 bp, Homo sapiens
accagcccccagga

SEQ ID NO: 3227331 - DNA, 13 bp, Homo sapiens
accagccccctgg

SEQ ID NO: 3227332 - DNA, 14 bp, Homo sapiens
accagccccctgga

SEQ ID NO: 3227333 - DNA, 15 bp, Homo sapiens
accagccccctggat

SEQ ID NO: 3227334 - DNA, 18 bp, Homo sapiens
accagcccctgccccagc

SEQ ID NO: 3227335 - DNA, 15 bp, Homo sapiens
accagccccttcctg

SEQ ID NO: 3227336 - DNA, 18 bp, Homo sapiens
accagccccttcctgggt

SEQ ID NO: 3227337 - DNA, 21 bp, Homo sapiens
accagcccgcaactctccagc

SEQ ID NO: 3227338 - DNA, 22 bp, Homo sapiens
accagcccgcaactctccagcc

SEQ ID NO: 3227339 - DNA, 12 bp, Homo sapiens
accagccctggg

SEQ ID NO: 3227340 - DNA, 16 bp, Homo sapiens
accagccctggggctg

SEQ ID NO: 3227341 - DNA, 15 bp, Homo sapiens
accagccgccccagc

SEQ ID NO: 3227342 - DNA, 16 bp, Homo sapiens
accagccgccccagcc

SEQ ID NO: 3227343 - DNA, 17 bp, Homo sapiens
accagccgccccagccc

SEQ ID NO: 3227344 - DNA, 13 bp, Homo sapiens
accagccgctgca

SEQ ID NO: 3227345 - DNA, 15 bp, Homo sapiens
accagccgtatttta

SEQ ID NO: 3227346 - DNA, 20 bp, Homo sapiens
accagcctccatgctgcctc

SEQ ID NO: 3227347 - DNA, 20 bp, Homo sapiens
accagcctggccaacatggt

SEQ ID NO: 3227348 - DNA, 20 bp, Homo sapiens
accagcctggtcaacatggt

SEQ ID NO: 3227349 - DNA, 22 bp, Homo sapiens
accagctaagaaaagattttaa

SEQ ID NO: 3227350 - DNA, 23 bp, Homo sapiens
accagctaagaaaagattttaat

SEQ ID NO: 3227351 - DNA, 15 bp, Homo sapiens
accagctatctgtca

SEQ ID NO: 3227352 - DNA, 21 bp, Homo sapiens
accagctatctgtcatctctc

SEQ ID NO: 3227353 - DNA, 14 bp, Homo sapiens
accagctcatctcc

SEQ ID NO: 3227354 - DNA, 15 bp, Homo sapiens
accagctcatctcca

SEQ ID NO: 3227355 - DNA, 23 bp, Homo sapiens
accagctcgtttttcagcacccc

SEQ ID NO: 3227356 - DNA, 13 bp, Homo sapiens
accagctctgtgg

SEQ ID NO: 3227357 - DNA, 15 bp, Homo sapiens
accagctctgtggcc

SEQ ID NO: 3227358 - DNA, 20 bp, Homo sapiens
accagctctgtggcctgtgt

SEQ ID NO: 3227359 - DNA, 15 bp, Homo sapiens
accagctgctctgcc

SEQ ID NO: 3227360 - DNA, 20 bp, Homo sapiens
accagcttagccaacatagt

SEQ ID NO: 3227361 - DNA, 18 bp, Homo sapiens
accagcttgcgaataaca

SEQ ID NO: 3227362 - DNA, 16 bp, Homo sapiens
accaggactccctcct

SEQ ID NO: 3227363 - DNA, 19 bp, Homo sapiens
accaggacttggggtcagg

SEQ ID NO: 3227364 - DNA, 16 bp, Homo sapiens
accaggcacctcttcc

SEQ ID NO: 3227365 - DNA, 17 bp, Homo sapiens
accaggcacctcttcct

SEQ ID NO: 3227366 - DNA, 12 bp, Homo sapiens
accaggccacct

SEQ ID NO: 3227367 - DNA, 15 bp, Homo sapiens
accaggccattctgc

SEQ ID NO: 3227368 - DNA, 12 bp, Homo sapiens
accaggcccagc

SEQ ID NO: 3227369 - DNA, 16 bp, Homo sapiens
accaggcccagccagt

SEQ ID NO: 3227370 - DNA, 16 bp, Homo sapiens
accaggctggcgcagc

SEQ ID NO: 3227371 - DNA, 17 bp, Homo sapiens
accaggctggcgcagcc

SEQ ID NO: 3227372 - DNA, 22 bp, Homo sapiens
accaggctggcgcagccaaggc

SEQ ID NO: 3227373 - DNA, 23 bp, Homo sapiens
accagggaagaagatcaacgcct

SEQ ID NO: 3227374 - DNA, 14 bp, Homo sapiens
accagggaggagag

SEQ ID NO: 3227375 - DNA, 13 bp, Homo sapiens
accagggatgctg

SEQ ID NO: 3227376 - DNA, 23 bp, Homo sapiens
accagggatgctgggctgggccc

SEQ ID NO: 3227377 - DNA, 16 bp, Homo sapiens
accagggccgaggagg

SEQ ID NO: 3227378 - DNA, 19 bp, Homo sapiens
accaggggaggagcctgtg

SEQ ID NO: 3227379 - DNA, 19 bp, Homo sapiens
accaggggctgggctccct

SEQ ID NO: 3227380 - DNA, 21 bp, Homo sapiens
accaggggctgggctccctga

SEQ ID NO: 3227381 - DNA, 21 bp, Homo sapiens
accagggtccgcaccagctgc

SEQ ID NO: 3227382 - DNA, 22 bp, Homo sapiens
accagggtccgcaccagctgct

SEQ ID NO: 3227383 - DNA, 17 bp, Homo sapiens
accaggtccagatgtgc

SEQ ID NO: 3227384 - DNA, 20 bp, Homo sapiens
accaggtccattttgcctga

SEQ ID NO: 3227385 - DNA, 20 bp, Homo sapiens
accaggtgttctacactcat

SEQ ID NO: 3227386 - DNA, 23 bp, Homo sapiens
accaggtgttctacactcatctt

SEQ ID NO: 3227387 - DNA, 11 bp, Homo sapiens
accagtattta

SEQ ID NO: 3227388 - DNA, 18 bp, Homo sapiens
accagtatttagaagcca

SEQ ID NO: 3227389 - DNA, 23 bp, Homo sapiens
accagtctcctcactctgtccct

SEQ ID NO: 3227390 - DNA, 21 bp, Homo sapiens
accagtctgtgtttacagaca

SEQ ID NO: 3227391 - DNA, 23 bp, Homo sapiens
accagtctttaaaggcccagccc

SEQ ID NO: 3227392 - DNA, 13 bp, Homo sapiens
accagtgaaagaa

SEQ ID NO: 3227393 - DNA, 15 bp, Homo sapiens
accagtgaaagaagc

SEQ ID NO: 3227394 - DNA, 16 bp, Homo sapiens
accagtgaccccagaa

SEQ ID NO: 3227395 - DNA, 15 bp, Homo sapiens
accagtgccaaggac

SEQ ID NO: 3227396 - DNA, 23 bp, Homo sapiens
accagtgtatcaggtcagggact

SEQ ID NO: 3227397 - DNA, 20 bp, Homo sapiens
acctgaaattccaaagtctc

SEQ ID NO: 3227398 - DNA, 22 bp, Homo sapiens
acctgaaattccaaagtctcta

SEQ ID NO: 3227399 - DNA, 19 bp, Homo sapiens
acctgaagactgaggacaa

SEQ ID NO: 3227400 - DNA, 22 bp, Homo sapiens
acctgaataccacttacctcaa

SEQ ID NO: 3227401 - DNA, 16 bp, Homo sapiens
acctgacacaagagga

SEQ ID NO: 3227402 - DNA, 12 bp, Homo sapiens
acctgacagatg

SEQ ID NO: 3227403 - DNA, 16 bp, Homo sapiens
acctgacccctgctca

SEQ ID NO: 3227404 - DNA, 14 bp, Homo sapiens
acctgacctcttgc

SEQ ID NO: 3227405 - DNA, 19 bp, Homo sapiens
acctgacctcttgctgtct

SEQ ID NO: 3227406 - DNA, 14 bp, Homo sapiens
acctgactctgaaa

SEQ ID NO: 3227407 - DNA, 15 bp, Homo sapiens
acctgactctgaaat

SEQ ID NO: 3227408 - DNA, 16 bp, Homo sapiens
acctgactctgaaatc

SEQ ID NO: 3227409 - DNA, 19 bp, Homo sapiens
acctgactctgaaatctga

SEQ ID NO: 3227410 - DNA, 22 bp, Homo sapiens
acctgactctgaaatctgaaga

SEQ ID NO: 3227411 - DNA, 23 bp, Homo sapiens
acctgactctgaaatctgaagac

SEQ ID NO: 3227412 - DNA, 23 bp, Homo sapiens
acctgagaccagttgggagcact

SEQ ID NO: 3227413 - DNA, 16 bp, Homo sapiens
acctgagaccctggga

SEQ ID NO: 3227414 - DNA, 23 bp, Homo sapiens
acctgagaccctgggagagaagt

SEQ ID NO: 3227415 - DNA, 21 bp, Homo sapiens
acctgagcccggatgcttctc

SEQ ID NO: 3227416 - DNA, 21 bp, Homo sapiens
acctgaggccaggacgtctgg

SEQ ID NO: 3227417 - DNA, 13 bp, Homo sapiens
acctgaggtgggc

SEQ ID NO: 3227418 - DNA, 17 bp, Homo sapiens
acctgaggtgggctggg

SEQ ID NO: 3227419 - DNA, 20 bp, Homo sapiens
acctgaggtgggctggggct

SEQ ID NO: 3227420 - DNA, 22 bp, Homo sapiens
acctgagtcaccctacctgtgc

SEQ ID NO: 3227421 - DNA, 21 bp, Homo sapiens
acctgagtcgtacagaaagct

SEQ ID NO: 3227422 - DNA, 19 bp, Homo sapiens
acctgatgtacctgatgct

SEQ ID NO: 3227423 - DNA, 21 bp, Homo sapiens
acctgatgttaaaattccatc

SEQ ID NO: 3227424 - DNA, 14 bp, Homo sapiens
acctgattgtattt

SEQ ID NO: 3227425 - DNA, 16 bp, Homo sapiens
acctgattgtattttt

SEQ ID NO: 3227426 - DNA, 15 bp, Homo sapiens
acctgcaaaaaatag

SEQ ID NO: 3227427 - DNA, 14 bp, Homo sapiens
acctgcaagcccca

SEQ ID NO: 3227428 - DNA, 18 bp, Homo sapiens
acctgcaagccccagggc

SEQ ID NO: 3227429 - DNA, 22 bp, Homo sapiens
acctgcaagccccagggcctgg

SEQ ID NO: 3227430 - DNA, 16 bp, Homo sapiens
acctgcaatcccagca

SEQ ID NO: 3227431 - DNA, 19 bp, Homo sapiens
acctgcaatcccagcacct

SEQ ID NO: 3227432 - DNA, 17 bp, Homo sapiens
acctgcaggctgagcca

SEQ ID NO: 3227433 - DNA, 17 bp, Homo sapiens
acctgcatctggggccc

SEQ ID NO: 3227434 - DNA, 21 bp, Homo sapiens
acctgcatttgtatgtgtccc

SEQ ID NO: 3227435 - DNA, 15 bp, Homo sapiens
acctgccaagagtca

SEQ ID NO: 3227436 - DNA, 11 bp, Homo sapiens
acctgccacca

SEQ ID NO: 3227437 - DNA, 20 bp, Homo sapiens
acctgccaggcaggggtggg

SEQ ID NO: 3227438 - DNA, 18 bp, Homo sapiens
acctgccatttgcaccct

SEQ ID NO: 3227439 - DNA, 22 bp, Homo sapiens
acctgcccacaactcccttgca

SEQ ID NO: 3227440 - DNA, 17 bp, Homo sapiens
acctgccctgcccccac

SEQ ID NO: 3227441 - DNA, 20 bp, Homo sapiens
acctgcctcctcgttccttt

SEQ ID NO: 3227442 - DNA, 23 bp, Homo sapiens
acctgcctcggcctcccaaagtg

SEQ ID NO: 3227443 - DNA, 23 bp, Homo sapiens
acctgcctctcacacacatagat

SEQ ID NO: 3227444 - DNA, 20 bp, Homo sapiens
acctgcctgccccacacgga

SEQ ID NO: 3227445 - DNA, 22 bp, Homo sapiens
acctgcctgccccacacggact

SEQ ID NO: 3227446 - DNA, 13 bp, Homo sapiens
acctgctccagga

SEQ ID NO: 3227447 - DNA, 15 bp, Homo sapiens
acctgctccgctgct

SEQ ID NO: 3227448 - DNA, 12 bp, Homo sapiens
acctgctctcct

SEQ ID NO: 3227449 - DNA, 17 bp, Homo sapiens
acctgctgccccagctg

SEQ ID NO: 3227450 - DNA, 14 bp, Homo sapiens
acctgctggacagc

SEQ ID NO: 3227451 - DNA, 15 bp, Homo sapiens
acctgctggacagcc

SEQ ID NO: 3227452 - DNA, 20 bp, Homo sapiens
acctgctggacagcctccgc

SEQ ID NO: 3227453 - DNA, 20 bp, Homo sapiens
acctgctgtgatacgatgct

SEQ ID NO: 3227454 - DNA, 19 bp, Homo sapiens
acctgcttcctgaaataaa

SEQ ID NO: 3227455 - DNA, 23 bp, Homo sapiens
acctgcttcctgaaataaacact

SEQ ID NO: 3227456 - DNA, 15 bp, Homo sapiens
acctgctttgactga

SEQ ID NO: 3227457 - DNA, 15 bp, Homo sapiens
acctgctttttgaaa

SEQ ID NO: 3227458 - DNA, 18 bp, Homo sapiens
acctgctttttgaaatga

SEQ ID NO: 3227459 - DNA, 21 bp, Homo sapiens
acctggagaaggaagctgcct

SEQ ID NO: 3227460 - DNA, 14 bp, Homo sapiens
acctggagcccctg

SEQ ID NO: 3227461 - DNA, 18 bp, Homo sapiens
acctggatccagcactgg

SEQ ID NO: 3227462 - DNA, 21 bp, Homo sapiens
acctggcatctaattctgatt

SEQ ID NO: 3227463 - DNA, 17 bp, Homo sapiens
acctggcctgctgggaa

SEQ ID NO: 3227464 - DNA, 22 bp, Homo sapiens
acctggccttaaagagggacag

SEQ ID NO: 3227465 - DNA, 23 bp, Homo sapiens
acctggctaattttttgtacttt

SEQ ID NO: 3227466 - DNA, 19 bp, Homo sapiens
acctggctgaggttcctct

SEQ ID NO: 3227467 - DNA, 21 bp, Homo sapiens
acctggctgaggttcctctgc

SEQ ID NO: 3227468 - DNA, 17 bp, Homo sapiens
acctggcttttacttta

SEQ ID NO: 3227469 - DNA, 21 bp, Homo sapiens
acctggcttttactttattaa

SEQ ID NO: 3227470 - DNA, 12 bp, Homo sapiens
acctgggacccc

SEQ ID NO: 3227471 - DNA, 14 bp, Homo sapiens
acctgggaccccga

SEQ ID NO: 3227472 - DNA, 18 bp, Homo sapiens
acctgggattcaggaatg

SEQ ID NO: 3227473 - DNA, 15 bp, Homo sapiens
acctgggcatatcca

SEQ ID NO: 3227474 - DNA, 19 bp, Homo sapiens
acctgggcatttggtgaga

SEQ ID NO: 3227475 - DNA, 14 bp, Homo sapiens
acctgggctgtgct

SEQ ID NO: 3227476 - DNA, 15 bp, Homo sapiens
acctgggctgtgctg

SEQ ID NO: 3227477 - DNA, 17 bp, Homo sapiens
acctggggtgaatactt

SEQ ID NO: 3227478 - DNA, 18 bp, Homo sapiens
acctgggtatgttcctaa

SEQ ID NO: 3227479 - DNA, 15 bp, Homo sapiens
acctgggtccaaata

SEQ ID NO: 3227480 - DNA, 16 bp, Homo sapiens
acctgggtccaaataa

SEQ ID NO: 3227481 - DNA, 20 bp, Homo sapiens
acctgggtccaaataaaaac

SEQ ID NO: 3227482 - DNA, 22 bp, Homo sapiens
acctgggttccctttccttcca

SEQ ID NO: 3227483 - DNA, 18 bp, Homo sapiens
acctggtaccctcctggc

SEQ ID NO: 3227484 - DNA, 16 bp, Homo sapiens
acctggtgtgtttctt

SEQ ID NO: 3227485 - DNA, 15 bp, Homo sapiens
acctggttcatattt

SEQ ID NO: 3227486 - DNA, 11 bp, Homo sapiens
acctgtaatca

SEQ ID NO: 3227487 - DNA, 14 bp, Homo sapiens
acctgtagccatct

SEQ ID NO: 3227488 - DNA, 15 bp, Homo sapiens
acctgtagccatctg

SEQ ID NO: 3227489 - DNA, 14 bp, Homo sapiens
acctgtagtcccag

SEQ ID NO: 3227490 - DNA, 23 bp, Homo sapiens
acctgtatgtcaataaacaacag

SEQ ID NO: 3227491 - DNA, 18 bp, Homo sapiens
acctgtcaccgtgagcag

SEQ ID NO: 3227492 - DNA, 15 bp, Homo sapiens
acctgtcatgccccc

SEQ ID NO: 3227493 - DNA, 21 bp, Homo sapiens
acctgtccccaccctccactc

SEQ ID NO: 3227494 - DNA, 14 bp, Homo sapiens
acctgtctcagcct

SEQ ID NO: 3227495 - DNA, 19 bp, Homo sapiens
acctgtcttccaaggagac

SEQ ID NO: 3227496 - DNA, 15 bp, Homo sapiens
acctgtgaagctgaa

SEQ ID NO: 3227497 - DNA, 18 bp, Homo sapiens
acctgtgacaaaggatga

SEQ ID NO: 3227498 - DNA, 20 bp, Homo sapiens
acctgtgacaaaggatgaag

SEQ ID NO: 3227499 - DNA, 13 bp, Homo sapiens
acctgtgccaggc

SEQ ID NO: 3227500 - DNA, 17 bp, Homo sapiens
acctgtgccctcaccac

SEQ ID NO: 3227501 - DNA, 14 bp, Homo sapiens
acctgtggatattt

SEQ ID NO: 3227502 - DNA, 23 bp, Homo sapiens
acctgttaaggtggaaaatggac

SEQ ID NO: 3227503 - DNA, 17 bp, Homo sapiens
acctgttatgtatgaag

SEQ ID NO: 3227504 - DNA, 18 bp, Homo sapiens
acctgttcttagagtgta

SEQ ID NO: 3227505 - DNA, 21 bp, Homo sapiens
acctgttcttagagtgtagct

SEQ ID NO: 3227506 - DNA, 16 bp, Homo sapiens
acctgttcttgggcct

SEQ ID NO: 3227507 - DNA, 15 bp, Homo sapiens
acctgttgctgtgtt

SEQ ID NO: 3227508 - DNA, 18 bp, Homo sapiens
acctgttgctgtgtttaa

SEQ ID NO: 3227509 - DNA, 19 bp, Homo sapiens
acctgttgctgtgtttaat

SEQ ID NO: 3227510 - DNA, 14 bp, Homo sapiens
acctgttggttcca

SEQ ID NO: 3227511 - DNA, 16 bp, Homo sapiens
acctgttggttccaag

SEQ ID NO: 3227512 - DNA, 21 bp, Homo sapiens
acctgtttatgagatgctggt

SEQ ID NO: 3227513 - DNA, 16 bp, Homo sapiens
acctgtttctctttgt

SEQ ID NO: 3227514 - DNA, 18 bp, Homo sapiens
acctgttttgttaatgct

SEQ ID NO: 3227515 - DNA, 18 bp, Homo sapiens
acctgtttttttttcatt

SEQ ID NO: 3227516 - DNA, 14 bp, Homo sapiens
accttaaaacagct

SEQ ID NO: 3227517 - DNA, 15 bp, Homo sapiens
accttaaaacagctg

SEQ ID NO: 3227518 - DNA, 12 bp, Homo sapiens
accttaagacct

SEQ ID NO: 3227519 - DNA, 19 bp, Homo sapiens
accttaatgacaacactta

SEQ ID NO: 3227520 - DNA, 16 bp, Homo sapiens
accttaccaactttct

SEQ ID NO: 3227521 - DNA, 17 bp, Homo sapiens
accttaccaactttctg

SEQ ID NO: 3227522 - DNA, 21 bp, Homo sapiens
actcactaggcccccacttgc

SEQ ID NO: 3227523 - DNA, 15 bp, Homo sapiens
actcactctgggctg

SEQ ID NO: 3227524 - DNA, 16 bp, Homo sapiens
actcactgaagcctgc

SEQ ID NO: 3227525 - DNA, 18 bp, Homo sapiens
actcactgaagcctgcgt

SEQ ID NO: 3227526 - DNA, 19 bp, Homo sapiens
actcactgaagcctgcgtt

SEQ ID NO: 3227527 - DNA, 14 bp, Homo sapiens
actcactgtcaatg

SEQ ID NO: 3227528 - DNA, 15 bp, Homo sapiens
actcactttcccttg

SEQ ID NO: 3227529 - DNA, 19 bp, Homo sapiens
actcagaaaagaaaaccat

SEQ ID NO: 3227530 - DNA, 20 bp, Homo sapiens
actcagaaaagaaaaccatt

SEQ ID NO: 3227531 - DNA, 15 bp, Homo sapiens
actcagaagacactg

SEQ ID NO: 3227532 - DNA, 15 bp, Homo sapiens
actcagaagcctgag

SEQ ID NO: 3227533 - DNA, 18 bp, Homo sapiens
actcagaagcctgaggct

SEQ ID NO: 3227534 - DNA, 17 bp, Homo sapiens
actcagaatataacatg

SEQ ID NO: 3227535 - DNA, 23 bp, Homo sapiens
actcagaatataacatgtaaaat

SEQ ID NO: 3227536 - DNA, 14 bp, Homo sapiens
actcagaatattgc

SEQ ID NO: 3227537 - DNA, 18 bp, Homo sapiens
actcagaattatttttaa

SEQ ID NO: 3227538 - DNA, 12 bp, Homo sapiens
actcagacctga

SEQ ID NO: 3227539 - DNA, 12 bp, Homo sapiens
actcagagcaga

SEQ ID NO: 3227540 - DNA, 15 bp, Homo sapiens
actcagagcagagca

SEQ ID NO: 3227541 - DNA, 19 bp, Homo sapiens
actcagaggctgggagcat

SEQ ID NO: 3227542 - DNA, 16 bp, Homo sapiens
actcagatgaggacag

SEQ ID NO: 3227543 - DNA, 14 bp, Homo sapiens
actcagcagcctgc

SEQ ID NO: 3227544 - DNA, 12 bp, Homo sapiens
actcagcagtga

SEQ ID NO: 3227545 - DNA, 14 bp, Homo sapiens
actcagcagtgacc

SEQ ID NO: 3227546 - DNA, 20 bp, Homo sapiens
actcagccacgaccagcccc

SEQ ID NO: 3227547 - DNA, 22 bp, Homo sapiens
actcagccacgaccagcccctt

SEQ ID NO: 3227548 - DNA, 17 bp, Homo sapiens
actcagcctagcacagg

SEQ ID NO: 3227549 - DNA, 11 bp, Homo sapiens
actcagccttc

SEQ ID NO: 3227550 - DNA, 16 bp, Homo sapiens
actcagcgctcctcct

SEQ ID NO: 3227551 - DNA, 20 bp, Homo sapiens
actcagcgctcctcctgtgt

SEQ ID NO: 3227552 - DNA, 21 bp, Homo sapiens
actcagcgctcctcctgtgtg

SEQ ID NO: 3227553 - DNA, 22 bp, Homo sapiens
actcagcgctcctcctgtgtga

SEQ ID NO: 3227554 - DNA, 22 bp, Homo sapiens
actcagctggaagtctacctgc

SEQ ID NO: 3227555 - DNA, 16 bp, Homo sapiens
actcagctgtccagaa

SEQ ID NO: 3227556 - DNA, 14 bp, Homo sapiens
actcagctgtcctg

SEQ ID NO: 3227557 - DNA, 17 bp, Homo sapiens
actcagctgtcctgcag

SEQ ID NO: 3227558 - DNA, 18 bp, Homo sapiens
actcaggaggctgagggg

SEQ ID NO: 3227559 - DNA, 23 bp, Homo sapiens
actcaggcgcctggcacatttca

SEQ ID NO: 3227560 - DNA, 15 bp, Homo sapiens
actcagggacagagc

SEQ ID NO: 3227561 - DNA, 17 bp, Homo sapiens
actcagggacagagcca

SEQ ID NO: 3227562 - DNA, 16 bp, Homo sapiens
actcagggctcctccc

SEQ ID NO: 3227563 - DNA, 19 bp, Homo sapiens
actcagggctcctcccagc

SEQ ID NO: 3227564 - DNA, 13 bp, Homo sapiens
actcaggtgggcc

SEQ ID NO: 3227565 - DNA, 19 bp, Homo sapiens
actcagtccatagcagaga

SEQ ID NO: 3227566 - DNA, 23 bp, Homo sapiens
actcagtctctcttctctccagc

SEQ ID NO: 3227567 - DNA, 15 bp, Homo sapiens
actcagtctcttcca

SEQ ID NO: 3227568 - DNA, 16 bp, Homo sapiens
actcagtgttagagaa

SEQ ID NO: 3227569 - DNA, 18 bp, Homo sapiens
actcagtgttagagaaat

SEQ ID NO: 3227570 - DNA, 20 bp, Homo sapiens
actcagtgttagagaaatcc

SEQ ID NO: 3227571 - DNA, 13 bp, Homo sapiens
actcagtttgtca

SEQ ID NO: 3227572 - DNA, 15 bp, Homo sapiens
actcagttttaacta

SEQ ID NO: 3227573 - DNA, 20 bp, Homo sapiens
actcatcaatcaaataagta

SEQ ID NO: 3227574 - DNA, 12 bp, Homo sapiens
actcatcagagc

SEQ ID NO: 3227575 - DNA, 15 bp, Homo sapiens
actcatcataaaata

SEQ ID NO: 3227576 - DNA, 15 bp, Homo sapiens
actcatgggtaataa

SEQ ID NO: 3227577 - DNA, 20 bp, Homo sapiens
actcattactgcaaattgat

SEQ ID NO: 3227578 - DNA, 13 bp, Homo sapiens
actcattccttca

SEQ ID NO: 3227579 - DNA, 19 bp, Homo sapiens
actcattctgaattaatta

SEQ ID NO: 3227580 - DNA, 14 bp, Homo sapiens
actcattgaaatgt

SEQ ID NO: 3227581 - DNA, 13 bp, Homo sapiens
actcattgcagca

SEQ ID NO: 3227582 - DNA, 21 bp, Homo sapiens
actcattgcagcagataactt

SEQ ID NO: 3227583 - DNA, 23 bp, Homo sapiens
actcattgcagcagataactttt

SEQ ID NO: 3227584 - DNA, 14 bp, Homo sapiens
actcattgccccca

SEQ ID NO: 3227585 - DNA, 17 bp, Homo sapiens
actcattgcccccacct

SEQ ID NO: 3227586 - DNA, 20 bp, Homo sapiens
actcattgctgagcctctgc

SEQ ID NO: 3227587 - DNA, 21 bp, Homo sapiens
actcattgctgagcctctgct

SEQ ID NO: 3227588 - DNA, 22 bp, Homo sapiens
actcattgctgagcctctgctc

SEQ ID NO: 3227589 - DNA, 14 bp, Homo sapiens
actcatttctaaaa

SEQ ID NO: 3227590 - DNA, 21 bp, Homo sapiens
actcatttctaaaagaatatt

SEQ ID NO: 3227591 - DNA, 22 bp, Homo sapiens
actcatttgttaaaattatcaa

SEQ ID NO: 3227592 - DNA, 21 bp, Homo sapiens
actcattttattcactaagct

SEQ ID NO: 3227593 - DNA, 16 bp, Homo sapiens
actcattttctataac

SEQ ID NO: 3227594 - DNA, 21 bp, Homo sapiens
actcattttctataacagata

SEQ ID NO: 3227595 - DNA, 19 bp, Homo sapiens
actcatttttttaatttat

SEQ ID NO: 3227596 - DNA, 18 bp, Homo sapiens
actccaacagaagaactg

SEQ ID NO: 3227597 - DNA, 14 bp, Homo sapiens
actccacatctgcc

SEQ ID NO: 3227598 - DNA, 17 bp, Homo sapiens
actccacatctgcctta

SEQ ID NO: 3227599 - DNA, 19 bp, Homo sapiens
actccaccagatagcagag

SEQ ID NO: 3227600 - DNA, 18 bp, Homo sapiens
actccacgatcctgccac

SEQ ID NO: 3227601 - DNA, 23 bp, Homo sapiens
actccactgccctggcagcagca

SEQ ID NO: 3227602 - DNA, 15 bp, Homo sapiens
actccactggacaga

SEQ ID NO: 3227603 - DNA, 16 bp, Homo sapiens
actccactggacagac

SEQ ID NO: 3227604 - DNA, 17 bp, Homo sapiens
actccactggacagacc

SEQ ID NO: 3227605 - DNA, 14 bp, Homo sapiens
actccactggctcc

SEQ ID NO: 3227606 - DNA, 17 bp, Homo sapiens
actccagaatctgctgt

SEQ ID NO: 3227607 - DNA, 17 bp, Homo sapiens
actccagagtctgagcc

SEQ ID NO: 3227608 - DNA, 17 bp, Homo sapiens
actccagatagagaaat

SEQ ID NO: 3227609 - DNA, 15 bp, Homo sapiens
actccagcaacttct

SEQ ID NO: 3227610 - DNA, 20 bp, Homo sapiens
actccagcctgagcaacaga

SEQ ID NO: 3227611 - DNA, 19 bp, Homo sapiens
actccagcctggcgacaga

SEQ ID NO: 3227612 - DNA, 16 bp, Homo sapiens
actccaggcccaaggc

SEQ ID NO: 3227613 - DNA, 19 bp, Homo sapiens
actccaggcccaaggctcc

SEQ ID NO: 3227614 - DNA, 12 bp, Homo sapiens
actccaggccct

SEQ ID NO: 3227615 - DNA, 15 bp, Homo sapiens
actccagtgccagca

SEQ ID NO: 3227616 - DNA, 17 bp, Homo sapiens
actccatcatggctgct

SEQ ID NO: 3227617 - DNA, 11 bp, Homo sapiens
actccatctct

SEQ ID NO: 3227618 - DNA, 17 bp, Homo sapiens
actccatgagcacccca

SEQ ID NO: 3227619 - DNA, 19 bp, Homo sapiens
actcccaaagctcagactt

SEQ ID NO: 3227620 - DNA, 15 bp, Homo sapiens
actcccagtccccag

SEQ ID NO: 3227621 - DNA, 16 bp, Homo sapiens
actccccaacccccaa

SEQ ID NO: 3227622 - DNA, 14 bp, Homo sapiens
actccccagagctg

SEQ ID NO: 3227623 - DNA, 14 bp, Homo sapiens
actccccagcccca

SEQ ID NO: 3227624 - DNA, 14 bp, Homo sapiens
actcccctgtttca

SEQ ID NO: 3227625 - DNA, 22 bp, Homo sapiens
actccccttgccttcccctgtc

SEQ ID NO: 3227626 - DNA, 21 bp, Homo sapiens
actcccgggccacgccccagc

SEQ ID NO: 3227627 - DNA, 22 bp, Homo sapiens
actcccgggccacgccccagcc

SEQ ID NO: 3227628 - DNA, 23 bp, Homo sapiens
actccctacactgatgcaaggat

SEQ ID NO: 3227629 - DNA, 19 bp, Homo sapiens
actccctagtctccacctg

SEQ ID NO: 3227630 - DNA, 20 bp, Homo sapiens
actccctcctcacctctgga

SEQ ID NO: 3227631 - DNA, 13 bp, Homo sapiens
actccctcttcca

SEQ ID NO: 3227632 - DNA, 12 bp, Homo sapiens
actccctgagct

SEQ ID NO: 3227633 - DNA, 14 bp, Homo sapiens
actccctgcagatg

SEQ ID NO: 3227634 - DNA, 17 bp, Homo sapiens
actccctgcagatgcca

SEQ ID NO: 3227635 - DNA, 13 bp, Homo sapiens
actccctgctcca

SEQ ID NO: 3227636 - DNA, 13 bp, Homo sapiens
actccctgctcta

SEQ ID NO: 3227637 - DNA, 23 bp, Homo sapiens
actccctgtagtgaatcctctgt

SEQ ID NO: 3227638 - DNA, 22 bp, Homo sapiens
actcccttaaggtctccaaacc

SEQ ID NO: 3227639 - DNA, 11 bp, Homo sapiens
actcccttcct

SEQ ID NO: 3227640 - DNA, 17 bp, Homo sapiens
actcccttcctggcctc

SEQ ID NO: 3227641 - DNA, 18 bp, Homo sapiens
actcccttcctggcctca

SEQ ID NO: 3227642 - DNA, 16 bp, Homo sapiens
actcccttgctggccc

SEQ ID NO: 3227643 - DNA, 23 bp, Homo sapiens
actcccttgctggccccagccct

SEQ ID NO: 3227644 - DNA, 14 bp, Homo sapiens
actccctttcaaca

SEQ ID NO: 3227645 - DNA, 12 bp, Homo sapiens
actccgccccca

SEQ ID NO: 3227646 - DNA, 16 bp, Homo sapiens
actccgcccccagcct

SEQ ID NO: 3227647 - DNA, 17 bp, Homo sapiens
actccgcccccagccta

SEQ ID NO: 3227648 - DNA, 14 bp, Homo sapiens
actggagttacatt

SEQ ID NO: 3227649 - DNA, 17 bp, Homo sapiens
actggagttacattaat

SEQ ID NO: 3227650 - DNA, 19 bp, Homo sapiens
actggagttctatgctctc

SEQ ID NO: 3227651 - DNA, 21 bp, Homo sapiens
actggagttgggggcggcttg

SEQ ID NO: 3227652 - DNA, 19 bp, Homo sapiens
actggataaattgtttagt

SEQ ID NO: 3227653 - DNA, 10 bp, Homo sapiens
actggatgaa

SEQ ID NO: 3227654 - DNA, 16 bp, Homo sapiens
actggcaagaggcctc

SEQ ID NO: 3227655 - DNA, 16 bp, Homo sapiens
actggcaataaactcc

SEQ ID NO: 3227656 - DNA, 17 bp, Homo sapiens
actggcacacacccctc

SEQ ID NO: 3227657 - DNA, 12 bp, Homo sapiens
actggcacagag

SEQ ID NO: 3227658 - DNA, 20 bp, Homo sapiens
actggcactgaattaatcat

SEQ ID NO: 3227659 - DNA, 12 bp, Homo sapiens
actggcaggtgc

SEQ ID NO: 3227660 - DNA, 21 bp, Homo sapiens
actggcatggatatagtttta

SEQ ID NO: 3227661 - DNA, 17 bp, Homo sapiens
actggcattgtccctgt

SEQ ID NO: 3227662 - DNA, 21 bp, Homo sapiens
actggcattgtccctgtgcct

SEQ ID NO: 3227663 - DNA, 19 bp, Homo sapiens
actggccaccaggctggcg

SEQ ID NO: 3227664 - DNA, 14 bp, Homo sapiens
actggccacccctc

SEQ ID NO: 3227665 - DNA, 18 bp, Homo sapiens
actggccagttgcccaga

SEQ ID NO: 3227666 - DNA, 20 bp, Homo sapiens
actggccagttgcccagagc

SEQ ID NO: 3227667 - DNA, 20 bp, Homo sapiens
actggcccctaggctgctgc

SEQ ID NO: 3227668 - DNA, 15 bp, Homo sapiens
actggccgggcaggc

SEQ ID NO: 3227669 - DNA, 23 bp, Homo sapiens
actggccggtctgcaagtcagag

SEQ ID NO: 3227670 - DNA, 17 bp, Homo sapiens
actggcctaaatttctt

SEQ ID NO: 3227671 - DNA, 13 bp, Homo sapiens
actggcctgactt

SEQ ID NO: 3227672 - DNA, 19 bp, Homo sapiens
actggcggagaaggagagg

SEQ ID NO: 3227673 - DNA, 18 bp, Homo sapiens
actggctagagtcctcac

SEQ ID NO: 3227674 - DNA, 15 bp, Homo sapiens
actggctctccaagt

SEQ ID NO: 3227675 - DNA, 15 bp, Homo sapiens
actggctctctccag

SEQ ID NO: 3227676 - DNA, 17 bp, Homo sapiens
actggctctctccagga

SEQ ID NO: 3227677 - DNA, 17 bp, Homo sapiens
actggctggctcctagg

SEQ ID NO: 3227678 - DNA, 17 bp, Homo sapiens
actggctggctgcagtg

SEQ ID NO: 3227679 - DNA, 16 bp, Homo sapiens
actggctggggcagag

SEQ ID NO: 3227680 - DNA, 18 bp, Homo sapiens
actggctgtctgcctgta

SEQ ID NO: 3227681 - DNA, 13 bp, Homo sapiens
actggcttcagca

SEQ ID NO: 3227682 - DNA, 12 bp, Homo sapiens
actggcttccat

SEQ ID NO: 3227683 - DNA, 22 bp, Homo sapiens
actgggaagataggctctgcac

SEQ ID NO: 3227684 - DNA, 20 bp, Homo sapiens
actgggaaggcttgggattt

SEQ ID NO: 3227685 - DNA, 16 bp, Homo sapiens
actgggagaatcacta

SEQ ID NO: 3227686 - DNA, 16 bp, Homo sapiens
actgggagtcagagcc

SEQ ID NO: 3227687 - DNA, 19 bp, Homo sapiens
actgggagtcagagccctg

SEQ ID NO: 3227688 - DNA, 20 bp, Homo sapiens
actgggagtcagagccctgg

SEQ ID NO: 3227689 - DNA, 22 bp, Homo sapiens
actgggagtgtccttagtgtat

SEQ ID NO: 3227690 - DNA, 15 bp, Homo sapiens
actgggataactgat

SEQ ID NO: 3227691 - DNA, 19 bp, Homo sapiens
actgggataactgatttct

SEQ ID NO: 3227692 - DNA, 16 bp, Homo sapiens
actgggatgagccgct

SEQ ID NO: 3227693 - DNA, 13 bp, Homo sapiens
actgggcaatgat

SEQ ID NO: 3227694 - DNA, 17 bp, Homo sapiens
actgggccagccctgca

SEQ ID NO: 3227695 - DNA, 19 bp, Homo sapiens
actgggccagccctgcagc

SEQ ID NO: 3227696 - DNA, 13 bp, Homo sapiens
actgggctgggcc

SEQ ID NO: 3227697 - DNA, 15 bp, Homo sapiens
actggggcatcctgt

SEQ ID NO: 3227698 - DNA, 16 bp, Homo sapiens
actggggcctccagaa

SEQ ID NO: 3227699 - DNA, 17 bp, Homo sapiens
actggggcctccagaac

SEQ ID NO: 3227700 - DNA, 20 bp, Homo sapiens
actggggctggggtgagaga

SEQ ID NO: 3227701 - DNA, 19 bp, Homo sapiens
actgggggactgggagtca

SEQ ID NO: 3227702 - DNA, 19 bp, Homo sapiens
actgggtacttgtggacac

SEQ ID NO: 3227703 - DNA, 17 bp, Homo sapiens
actgggtatgcgtttca

SEQ ID NO: 3227704 - DNA, 19 bp, Homo sapiens
actgggtgaggaaatccat

SEQ ID NO: 3227705 - DNA, 18 bp, Homo sapiens
actgggtggggtgaggac

SEQ ID NO: 3227706 - DNA, 20 bp, Homo sapiens
actgggtggggtgaggacca

SEQ ID NO: 3227707 - DNA, 22 bp, Homo sapiens
actgggtggggtgaggaccact

SEQ ID NO: 3227708 - DNA, 14 bp, Homo sapiens
actgggtgttgatc

SEQ ID NO: 3227709 - DNA, 22 bp, Homo sapiens
actgggtgttgatcttacaaga

SEQ ID NO: 3227710 - DNA, 22 bp, Homo sapiens
actgggttcttgttttatatac

SEQ ID NO: 3227711 - DNA, 16 bp, Homo sapiens
actgggtttcaagaaa

SEQ ID NO: 3227712 - DNA, 22 bp, Homo sapiens
actgggtttcaagaaaatcttt

SEQ ID NO: 3227713 - DNA, 16 bp, Homo sapiens
actgggtttggacccc

SEQ ID NO: 3227714 - DNA, 19 bp, Homo sapiens
actgggtttggaccccagc

SEQ ID NO: 3227715 - DNA, 21 bp, Homo sapiens
actgggtttggaccccagctg

SEQ ID NO: 3227716 - DNA, 23 bp, Homo sapiens
actgggtttggaccccagctggg

SEQ ID NO: 3227717 - DNA, 18 bp, Homo sapiens
actggtatgaataattgc

SEQ ID NO: 3227718 - DNA, 16 bp, Homo sapiens
actggtcattaatgtg

SEQ ID NO: 3227719 - DNA, 14 bp, Homo sapiens
actggtccagctct

SEQ ID NO: 3227720 - DNA, 17 bp, Homo sapiens
actggtccagctctgac

SEQ ID NO: 3227721 - DNA, 18 bp, Homo sapiens
actggtccagctctgaca

SEQ ID NO: 3227722 - DNA, 13 bp, Homo sapiens
actggtctgctgt

SEQ ID NO: 3227723 - DNA, 21 bp, Homo sapiens
actggtggcccgacagcctgg

SEQ ID NO: 3227724 - DNA, 14 bp, Homo sapiens
actggtgtccagct

SEQ ID NO: 3227725 - DNA, 21 bp, Homo sapiens
actggtttccccagggaagga

SEQ ID NO: 3227726 - DNA, 23 bp, Homo sapiens
actggtttccccagggaaggaaa

SEQ ID NO: 3227727 - DNA, 17 bp, Homo sapiens
actggtttgttccctgt

SEQ ID NO: 3227728 - DNA, 20 bp, Homo sapiens
actgtaaagatttgttgaca

SEQ ID NO: 3227729 - DNA, 22 bp, Homo sapiens
actgtaaataaaatgtgtacag

SEQ ID NO: 3227730 - DNA, 17 bp, Homo sapiens
actgtaaatatgaatct

SEQ ID NO: 3227731 - DNA, 14 bp, Homo sapiens
actgtaactgtcag

SEQ ID NO: 3227732 - DNA, 13 bp, Homo sapiens
actgtaataatac

SEQ ID NO: 3227733 - DNA, 16 bp, Homo sapiens
actgtaataatacctc

SEQ ID NO: 3227734 - DNA, 16 bp, Homo sapiens
actgtaatatttaaat

SEQ ID NO: 3227735 - DNA, 15 bp, Homo sapiens
actgtacaaagtaga

SEQ ID NO: 3227736 - DNA, 13 bp, Homo sapiens
actgtacacactt

SEQ ID NO: 3227737 - DNA, 15 bp, Homo sapiens
actgtacacacttta

SEQ ID NO: 3227738 - DNA, 22 bp, Homo sapiens
actgtacacactttatttactt

SEQ ID NO: 3227739 - DNA, 15 bp, Homo sapiens
actgtacataaacaa

SEQ ID NO: 3227740 - DNA, 21 bp, Homo sapiens
actgtaccacagacacaatat

SEQ ID NO: 3227741 - DNA, 16 bp, Homo sapiens
actgtacccaaatgga

SEQ ID NO: 3227742 - DNA, 13 bp, Homo sapiens
actgtactcctcc

SEQ ID NO: 3227743 - DNA, 14 bp, Homo sapiens
actgtactcctccc

SEQ ID NO: 3227744 - DNA, 12 bp, Homo sapiens
actgtactggcc

SEQ ID NO: 3227745 - DNA, 14 bp, Homo sapiens
actgtactggccag

SEQ ID NO: 3227746 - DNA, 23 bp, Homo sapiens
actgtactggccagtgtcatttt

SEQ ID NO: 3227747 - DNA, 18 bp, Homo sapiens
actgtacttaataaattc

SEQ ID NO: 3227748 - DNA, 20 bp, Homo sapiens
actgtagatatgtattcttt

SEQ ID NO: 3227749 - DNA, 16 bp, Homo sapiens
actgtagattgcttct

SEQ ID NO: 3227750 - DNA, 21 bp, Homo sapiens
actgtagattgcttctgtagt

SEQ ID NO: 3227751 - DNA, 20 bp, Homo sapiens
actgtaggaagagtagcatt

SEQ ID NO: 3227752 - DNA, 12 bp, Homo sapiens
actgtagggcca

SEQ ID NO: 3227753 - DNA, 13 bp, Homo sapiens
actgtagttctaa

SEQ ID NO: 3227754 - DNA, 17 bp, Homo sapiens
actgtagttctaagact

SEQ ID NO: 3227755 - DNA, 18 bp, Homo sapiens
actgtagtttttcttcaa

SEQ ID NO: 3227756 - DNA, 17 bp, Homo sapiens
actgtataaactttttt

SEQ ID NO: 3227757 - DNA, 12 bp, Homo sapiens
actgtataaata

SEQ ID NO: 3227758 - DNA, 13 bp, Homo sapiens
actgtataaatag

SEQ ID NO: 3227759 - DNA, 22 bp, Homo sapiens
actgtataagtactagatgcat

SEQ ID NO: 3227760 - DNA, 20 bp, Homo sapiens
actgtataggtagatccaga

SEQ ID NO: 3227761 - DNA, 14 bp, Homo sapiens
actgtatataaact

SEQ ID NO: 3227762 - DNA, 14 bp, Homo sapiens
actgtatattcagg

SEQ ID NO: 3227763 - DNA, 16 bp, Homo sapiens
actgtatcattttctt

SEQ ID NO: 3227764 - DNA, 16 bp, Homo sapiens
actgtatggaaacact

SEQ ID NO: 3227765 - DNA, 19 bp, Homo sapiens
actgtatggaaacactgat

SEQ ID NO: 3227766 - DNA, 17 bp, Homo sapiens
actgtatgtgtgtaggt

SEQ ID NO: 3227767 - DNA, 16 bp, Homo sapiens
actgtattaaatctta

SEQ ID NO: 3227768 - DNA, 19 bp, Homo sapiens
actgtattgggccttttgg

SEQ ID NO: 3227769 - DNA, 13 bp, Homo sapiens
actgtcaataaac

SEQ ID NO: 3227770 - DNA, 17 bp, Homo sapiens
actgtcaataaacagct

SEQ ID NO: 3227771 - DNA, 14 bp, Homo sapiens
actgtcaccctcca

SEQ ID NO: 3227772 - DNA, 14 bp, Homo sapiens
actgtcactcattg

SEQ ID NO: 3227773 - DNA, 15 bp, Homo sapiens
actgtcactcattgc

SEQ ID NO: 3227774 - DNA, 13 bp, Homo sapiens
actttacccacct

SEQ ID NO: 3227775 - DNA, 18 bp, Homo sapiens
actttacccacctagaac

SEQ ID NO: 3227776 - DNA, 21 bp, Homo sapiens
actttacttgtggtgtgacca

SEQ ID NO: 3227777 - DNA, 14 bp, Homo sapiens
actttagaaataaa

SEQ ID NO: 3227778 - DNA, 20 bp, Homo sapiens
actttagaagtgcatttctg

SEQ ID NO: 3227779 - DNA, 21 bp, Homo sapiens
actttagaagtgcatttctga

SEQ ID NO: 3227780 - DNA, 15 bp, Homo sapiens
actttagagtagcat

SEQ ID NO: 3227781 - DNA, 19 bp, Homo sapiens
actttagagtagcatgaga

SEQ ID NO: 3227782 - DNA, 21 bp, Homo sapiens
actttagagtagcatgagaga

SEQ ID NO: 3227783 - DNA, 13 bp, Homo sapiens
actttagatgctg

SEQ ID NO: 3227784 - DNA, 13 bp, Homo sapiens
actttagtatgac

SEQ ID NO: 3227785 - DNA, 15 bp, Homo sapiens
actttagtgccctgc

SEQ ID NO: 3227786 - DNA, 14 bp, Homo sapiens
actttataaatttc

SEQ ID NO: 3227787 - DNA, 22 bp, Homo sapiens
actttataagtcattgtatgtt

SEQ ID NO: 3227788 - DNA, 15 bp, Homo sapiens
actttatatctgtaa

SEQ ID NO: 3227789 - DNA, 19 bp, Homo sapiens
actttatatctgtaatgat

SEQ ID NO: 3227790 - DNA, 22 bp, Homo sapiens
actttatatctgtaatgatact

SEQ ID NO: 3227791 - DNA, 13 bp, Homo sapiens
actttatcacatt

SEQ ID NO: 3227792 - DNA, 16 bp, Homo sapiens
actttatcatgaatgc

SEQ ID NO: 3227793 - DNA, 14 bp, Homo sapiens
actttatgtactgc

SEQ ID NO: 3227794 - DNA, 23 bp, Homo sapiens
actttatgttgtatgattccaat

SEQ ID NO: 3227795 - DNA, 15 bp, Homo sapiens
actttattcttgctg

SEQ ID NO: 3227796 - DNA, 14 bp, Homo sapiens
actttattgtacag

SEQ ID NO: 3227797 - DNA, 16 bp, Homo sapiens
actttattgtacagac

SEQ ID NO: 3227798 - DNA, 16 bp, Homo sapiens
actttatttatttcta

SEQ ID NO: 3227799 - DNA, 12 bp, Homo sapiens
actttatttctg

SEQ ID NO: 3227800 - DNA, 14 bp, Homo sapiens
actttatttgtaaa

SEQ ID NO: 3227801 - DNA, 23 bp, Homo sapiens
actttatttgtaaaccattgtaa

SEQ ID NO: 3227802 - DNA, 17 bp, Homo sapiens
actttcaaaagagtaga

SEQ ID NO: 3227803 - DNA, 20 bp, Homo sapiens
actttcaaaagagtagaaag

SEQ ID NO: 3227804 - DNA, 15 bp, Homo sapiens
actttcaaaatatat

SEQ ID NO: 3227805 - DNA, 20 bp, Homo sapiens
actttcaaaattaaatctgt

SEQ ID NO: 3227806 - DNA, 17 bp, Homo sapiens
actttcaaagacaatca

SEQ ID NO: 3227807 - DNA, 15 bp, Homo sapiens
actttcacatagatg

SEQ ID NO: 3227808 - DNA, 17 bp, Homo sapiens
actttcacatagatgtc

SEQ ID NO: 3227809 - DNA, 13 bp, Homo sapiens
actttcaggggct

SEQ ID NO: 3227810 - DNA, 17 bp, Homo sapiens
actttcattgccagtgt

SEQ ID NO: 3227811 - DNA, 18 bp, Homo sapiens
actttccacttcttcctt

SEQ ID NO: 3227812 - DNA, 19 bp, Homo sapiens
actttcctttccccagccc

SEQ ID NO: 3227813 - DNA, 21 bp, Homo sapiens
actttccttttctattccttc

SEQ ID NO: 3227814 - DNA, 22 bp, Homo sapiens
actttcggagaaattctcttta

SEQ ID NO: 3227815 - DNA, 17 bp, Homo sapiens
actttctaatgtttctg

SEQ ID NO: 3227816 - DNA, 19 bp, Homo sapiens
actttctacaatgtgaact

SEQ ID NO: 3227817 - DNA, 13 bp, Homo sapiens
actttctcagttt

SEQ ID NO: 3227818 - DNA, 17 bp, Homo sapiens
actttctcagttttcat

SEQ ID NO: 3227819 - DNA, 18 bp, Homo sapiens
actttctcagttttcata

SEQ ID NO: 3227820 - DNA, 14 bp, Homo sapiens
actttctctgtagt

SEQ ID NO: 3227821 - DNA, 14 bp, Homo sapiens
actttctgtaaact

SEQ ID NO: 3227822 - DNA, 18 bp, Homo sapiens
actttctgtaaactcaaa

SEQ ID NO: 3227823 - DNA, 19 bp, Homo sapiens
actttctgtaaactcaaaa

SEQ ID NO: 3227824 - DNA, 17 bp, Homo sapiens
actttctgtgacgcaga

SEQ ID NO: 3227825 - DNA, 14 bp, Homo sapiens
actttcttcaggta

SEQ ID NO: 3227826 - DNA, 17 bp, Homo sapiens
actttctttcagatgtt

SEQ ID NO: 3227827 - DNA, 20 bp, Homo sapiens
actttgaaaggagatgtctt

SEQ ID NO: 3227828 - DNA, 14 bp, Homo sapiens
actttgaaatacct

SEQ ID NO: 3227829 - DNA, 22 bp, Homo sapiens
actttgaaatacctcatgttta

SEQ ID NO: 3227830 - DNA, 23 bp, Homo sapiens
actttgaaatacctcatgtttat

SEQ ID NO: 3227831 - DNA, 22 bp, Homo sapiens
actttgacctaaattatttact

SEQ ID NO: 3227832 - DNA, 23 bp, Homo sapiens
actttgacgagtcaccttccagg

SEQ ID NO: 3227833 - DNA, 15 bp, Homo sapiens
actttgactttttgc

SEQ ID NO: 3227834 - DNA, 20 bp, Homo sapiens
actttgactttttgcattta

SEQ ID NO: 3227835 - DNA, 21 bp, Homo sapiens
actttgactttttgcatttaa

SEQ ID NO: 3227836 - DNA, 23 bp, Homo sapiens
actttgagatgtgttcctcctgc

SEQ ID NO: 3227837 - DNA, 18 bp, Homo sapiens
actttgagcatttttaag

SEQ ID NO: 3227838 - DNA, 14 bp, Homo sapiens
actttgcacatttt

SEQ ID NO: 3227839 - DNA, 13 bp, Homo sapiens
actttgcacttaa

SEQ ID NO: 3227840 - DNA, 19 bp, Homo sapiens
actttgccagcttttcctc

SEQ ID NO: 3227841 - DNA, 16 bp, Homo sapiens
actttgccatttttct

SEQ ID NO: 3227842 - DNA, 19 bp, Homo sapiens
actttgccatttttctata

SEQ ID NO: 3227843 - DNA, 16 bp, Homo sapiens
actttgcctcctgtgt

SEQ ID NO: 3227844 - DNA, 15 bp, Homo sapiens
actttgctgatttcc

SEQ ID NO: 3227845 - DNA, 14 bp, Homo sapiens
actttgcttcccat

SEQ ID NO: 3227846 - DNA, 23 bp, Homo sapiens
actttgcttccgccactcagcca

SEQ ID NO: 3227847 - DNA, 20 bp, Homo sapiens
actttgcttgctttgaagta

SEQ ID NO: 3227848 - DNA, 21 bp, Homo sapiens
actttggaagtttgtgttctg

SEQ ID NO: 3227849 - DNA, 16 bp, Homo sapiens
actttggcaatttcct

SEQ ID NO: 3227850 - DNA, 18 bp, Homo sapiens
actttggcaatttcctgg

SEQ ID NO: 3227851 - DNA, 16 bp, Homo sapiens
actttggctacaaata

SEQ ID NO: 3227852 - DNA, 19 bp, Homo sapiens
actttgggaaaacatgtta

SEQ ID NO: 3227853 - DNA, 21 bp, Homo sapiens
actttgggacttgggagctgg

SEQ ID NO: 3227854 - DNA, 12 bp, Homo sapiens
actttgggaggc

SEQ ID NO: 3227855 - DNA, 19 bp, Homo sapiens
actttgggaggctgaggcg

SEQ ID NO: 3227856 - DNA, 19 bp, Homo sapiens
actttgggaggctgaggtg

SEQ ID NO: 3227857 - DNA, 15 bp, Homo sapiens
actttggggaaggga

SEQ ID NO: 3227858 - DNA, 23 bp, Homo sapiens
actttggtactgctgtcttccaa

SEQ ID NO: 3227859 - DNA, 17 bp, Homo sapiens
actttgtaaaaatcttt

SEQ ID NO: 3227860 - DNA, 21 bp, Homo sapiens
actttgtaaaaatcttttgaa

SEQ ID NO: 3227861 - DNA, 12 bp, Homo sapiens
actttgtaaata

SEQ ID NO: 3227862 - DNA, 12 bp, Homo sapiens
actttgtaattt

SEQ ID NO: 3227863 - DNA, 22 bp, Homo sapiens
actttgtacttgtgtttgctta

SEQ ID NO: 3227864 - DNA, 15 bp, Homo sapiens
actttgtattactta

SEQ ID NO: 3227865 - DNA, 22 bp, Homo sapiens
actttgtattacttaggttatt

SEQ ID NO: 3227866 - DNA, 22 bp, Homo sapiens
actttgtcgtggttcttaaatg

SEQ ID NO: 3227867 - DNA, 23 bp, Homo sapiens
actttgtcgtggttcttaaatgt

SEQ ID NO: 3227868 - DNA, 17 bp, Homo sapiens
actttgtctgaaaaatt

SEQ ID NO: 3227869 - DNA, 18 bp, Homo sapiens
actttgtgcattctggat

SEQ ID NO: 3227870 - DNA, 20 bp, Homo sapiens
actttgtggaccaattattg

SEQ ID NO: 3227871 - DNA, 21 bp, Homo sapiens
actttgtggaccaattattga

SEQ ID NO: 3227872 - DNA, 22 bp, Homo sapiens
actttgtggaccaattattgat

SEQ ID NO: 3227873 - DNA, 15 bp, Homo sapiens
actttgttctttagg

SEQ ID NO: 3227874 - DNA, 20 bp, Homo sapiens
actttgttctttaggagatt

SEQ ID NO: 3227875 - DNA, 20 bp, Homo sapiens
actttgtttcgtggggaggt

SEQ ID NO: 3227876 - DNA, 14 bp, Homo sapiens
acttttaaactgtg

SEQ ID NO: 3227877 - DNA, 15 bp, Homo sapiens
acttttaaagaaaaa

SEQ ID NO: 3227878 - DNA, 20 bp, Homo sapiens
acttttaaccaaacaattat

SEQ ID NO: 3227879 - DNA, 18 bp, Homo sapiens
acttttaaggataaatca

SEQ ID NO: 3227880 - DNA, 11 bp, Homo sapiens
acttttaataa

SEQ ID NO: 3227881 - DNA, 17 bp, Homo sapiens
acttttaattactgttt

SEQ ID NO: 3227882 - DNA, 14 bp, Homo sapiens
acttttataaagca

SEQ ID NO: 3227883 - DNA, 23 bp, Homo sapiens
acttttatactctttctgtatat

SEQ ID NO: 3227884 - DNA, 19 bp, Homo sapiens
acttttatgatgtatattt

SEQ ID NO: 3227885 - DNA, 23 bp, Homo sapiens
acttttattagccagtgaaacac

SEQ ID NO: 3227886 - DNA, 20 bp, Homo sapiens
acttttatttcctgtatgtt

SEQ ID NO: 3227887 - DNA, 18 bp, Homo sapiens
acttttatttgcaacatt

SEQ ID NO: 3227888 - DNA, 18 bp, Homo sapiens
acttttcatccttcccca

SEQ ID NO: 3227889 - DNA, 17 bp, Homo sapiens
acttttcccctgttaaa

SEQ ID NO: 3227890 - DNA, 15 bp, Homo sapiens
acttttctaagaaaa

SEQ ID NO: 3227891 - DNA, 16 bp, Homo sapiens
acttttctaagaaaag

SEQ ID NO: 3227892 - DNA, 20 bp, Homo sapiens
acttttctaagaaaagcatt

SEQ ID NO: 3227893 - DNA, 12 bp, Homo sapiens
acttttctgatt

SEQ ID NO: 3227894 - DNA, 17 bp, Homo sapiens
acttttgtaagacaaag

SEQ ID NO: 3227895 - DNA, 20 bp, Homo sapiens
acttttgttattccatcaat

SEQ ID NO: 3227896 - DNA, 18 bp, Homo sapiens
actttttaaatgtaaaga

SEQ ID NO: 3227897 - DNA, 22 bp, Homo sapiens
actttttagccagtgacttttt

SEQ ID NO: 3227898 - DNA, 15 bp, Homo sapiens
actttttagtaattt

SEQ ID NO: 3227899 - DNA, 16 bp, Homo sapiens
agaagtttttgtactg

SEQ ID NO: 3227900 - DNA, 17 bp, Homo sapiens
agaagtttttgtactgt

SEQ ID NO: 3227901 - DNA, 22 bp, Homo sapiens
agaagtttttgtactgtaaaga

SEQ ID NO: 3227902 - DNA, 14 bp, Homo sapiens
agaataaaagctat

SEQ ID NO: 3227903 - DNA, 19 bp, Homo sapiens
agaataaaagctataaagt

SEQ ID NO: 3227904 - DNA, 11 bp, Homo sapiens
agaataaagca

SEQ ID NO: 3227905 - DNA, 14 bp, Homo sapiens
agaataagagaaag

SEQ ID NO: 3227906 - DNA, 16 bp, Homo sapiens
agaataagagaaagaa

SEQ ID NO: 3227907 - DNA, 14 bp, Homo sapiens
agaataaggaggag

SEQ ID NO: 3227908 - DNA, 17 bp, Homo sapiens
agaataaggcacaaaat

SEQ ID NO: 3227909 - DNA, 23 bp, Homo sapiens
agaataatatgctgccaaatttt

SEQ ID NO: 3227910 - DNA, 20 bp, Homo sapiens
agaataatcacgctttcctg

SEQ ID NO: 3227911 - DNA, 15 bp, Homo sapiens
agaataatggaaaca

SEQ ID NO: 3227912 - DNA, 14 bp, Homo sapiens
agaataatgttcta

SEQ ID NO: 3227913 - DNA, 14 bp, Homo sapiens
agaatactttttaa

SEQ ID NO: 3227914 - DNA, 22 bp, Homo sapiens
agaatagaaataaaggatgtga

SEQ ID NO: 3227915 - DNA, 20 bp, Homo sapiens
agaatagatctgatggtgag

SEQ ID NO: 3227916 - DNA, 15 bp, Homo sapiens
agaatataattatcg

SEQ ID NO: 3227917 - DNA, 23 bp, Homo sapiens
agaatataattatcggaagcagt

SEQ ID NO: 3227918 - DNA, 19 bp, Homo sapiens
agaatatagaagcatttga

SEQ ID NO: 3227919 - DNA, 13 bp, Homo sapiens
agaatatatttat

SEQ ID NO: 3227920 - DNA, 21 bp, Homo sapiens
agaatatatttatttaaagca

SEQ ID NO: 3227921 - DNA, 11 bp, Homo sapiens
agaatatctgg

SEQ ID NO: 3227922 - DNA, 12 bp, Homo sapiens
agaatattgtcc

SEQ ID NO: 3227923 - DNA, 14 bp, Homo sapiens
agaatatttaagaa

SEQ ID NO: 3227924 - DNA, 21 bp, Homo sapiens
agaatatttaagaaaagcact

SEQ ID NO: 3227925 - DNA, 22 bp, Homo sapiens
agaatatttaagaaaagcactt

SEQ ID NO: 3227926 - DNA, 23 bp, Homo sapiens
agaatatttaagaaaagcacttt

SEQ ID NO: 3227927 - DNA, 17 bp, Homo sapiens
agaatcactgcagccca

SEQ ID NO: 3227928 - DNA, 17 bp, Homo sapiens
agaatcagagtagaaat

SEQ ID NO: 3227929 - DNA, 22 bp, Homo sapiens
agaatcagtctatccacagaga

SEQ ID NO: 3227930 - DNA, 21 bp, Homo sapiens
agaatcatgctgttgcattta

SEQ ID NO: 3227931 - DNA, 18 bp, Homo sapiens
agaatcatgtgaacccgg

SEQ ID NO: 3227932 - DNA, 14 bp, Homo sapiens
agaatccaaacttg

SEQ ID NO: 3227933 - DNA, 21 bp, Homo sapiens
agaatccaaacttggattttt

SEQ ID NO: 3227934 - DNA, 18 bp, Homo sapiens
agaatccacatttctaaa

SEQ ID NO: 3227935 - DNA, 17 bp, Homo sapiens
agaatccataaatgtgt

SEQ ID NO: 3227936 - DNA, 18 bp, Homo sapiens
agaatcccaaatttgatt

SEQ ID NO: 3227937 - DNA, 12 bp, Homo sapiens
agaatcccagcc

SEQ ID NO: 3227938 - DNA, 17 bp, Homo sapiens
agaatcccttaaaatta

SEQ ID NO: 3227939 - DNA, 14 bp, Homo sapiens
agaatcctttacat

SEQ ID NO: 3227940 - DNA, 15 bp, Homo sapiens
agaatcctttacatt

SEQ ID NO: 3227941 - DNA, 20 bp, Homo sapiens
agaatctaaaccttacatgt

SEQ ID NO: 3227942 - DNA, 14 bp, Homo sapiens
agaatctatagtga

SEQ ID NO: 3227943 - DNA, 18 bp, Homo sapiens
agaatctatatttaacaa

SEQ ID NO: 3227944 - DNA, 17 bp, Homo sapiens
agaatctgctgttgcca

SEQ ID NO: 3227945 - DNA, 18 bp, Homo sapiens
agaatctgctgttgccat

SEQ ID NO: 3227946 - DNA, 19 bp, Homo sapiens
agaatcttgttttgaaaat

SEQ ID NO: 3227947 - DNA, 22 bp, Homo sapiens
agaatcttgttttgaaaataac

SEQ ID NO: 3227948 - DNA, 23 bp, Homo sapiens
agaatctttagagaagtatacat

SEQ ID NO: 3227949 - DNA, 21 bp, Homo sapiens
agaatgaaagctgttccttgg

SEQ ID NO: 3227950 - DNA, 18 bp, Homo sapiens
agaatgaaagggcccaga

SEQ ID NO: 3227951 - DNA, 23 bp, Homo sapiens
agaatgagagagagactgtgtgt

SEQ ID NO: 3227952 - DNA, 21 bp, Homo sapiens
agaatgagtccttgatttcaa

SEQ ID NO: 3227953 - DNA, 13 bp, Homo sapiens
agaatgattaatc

SEQ ID NO: 3227954 - DNA, 13 bp, Homo sapiens
agaatgatttcat

SEQ ID NO: 3227955 - DNA, 20 bp, Homo sapiens
agaatgcacaagaatggatc

SEQ ID NO: 3227956 - DNA, 22 bp, Homo sapiens
agaatgcagattcctgggcctg

SEQ ID NO: 3227957 - DNA, 16 bp, Homo sapiens
agaatgccggttaaat

SEQ ID NO: 3227958 - DNA, 18 bp, Homo sapiens
agaatgctctttacttca

SEQ ID NO: 3227959 - DNA, 13 bp, Homo sapiens
agaatgctggttt

SEQ ID NO: 3227960 - DNA, 14 bp, Homo sapiens
agaatgctgtacat

SEQ ID NO: 3227961 - DNA, 20 bp, Homo sapiens
agaatgctgtacatctattt

SEQ ID NO: 3227962 - DNA, 23 bp, Homo sapiens
agaatggttgccttaaagaaagt

SEQ ID NO: 3227963 - DNA, 16 bp, Homo sapiens
agaatgtatctgtgaa

SEQ ID NO: 3227964 - DNA, 17 bp, Homo sapiens
agaatgtatctgtgaag

SEQ ID NO: 3227965 - DNA, 18 bp, Homo sapiens
agaatgtcagattccttt

SEQ ID NO: 3227966 - DNA, 18 bp, Homo sapiens
agaatgtgctcatgcatt

SEQ ID NO: 3227967 - DNA, 16 bp, Homo sapiens
agaatgtggccactta

SEQ ID NO: 3227968 - DNA, 18 bp, Homo sapiens
agaatgtggccacttatt

SEQ ID NO: 3227969 - DNA, 22 bp, Homo sapiens
agaatgtggccacttatttcac

SEQ ID NO: 3227970 - DNA, 17 bp, Homo sapiens
agaatgtgtgtgtgtgg

SEQ ID NO: 3227971 - DNA, 17 bp, Homo sapiens
agaatgttggtttactt

SEQ ID NO: 3227972 - DNA, 23 bp, Homo sapiens
agaatgttggtttactttcaaat

SEQ ID NO: 3227973 - DNA, 15 bp, Homo sapiens
agaatgttgtattca

SEQ ID NO: 3227974 - DNA, 21 bp, Homo sapiens
agaattaaaactcaacattac

SEQ ID NO: 3227975 - DNA, 18 bp, Homo sapiens
agaattaaacttttaatt

SEQ ID NO: 3227976 - DNA, 20 bp, Homo sapiens
agaattaaacttttaattca

SEQ ID NO: 3227977 - DNA, 22 bp, Homo sapiens
agaattaaacttttaattcatt

SEQ ID NO: 3227978 - DNA, 20 bp, Homo sapiens
agaattaccattaattacat

SEQ ID NO: 3227979 - DNA, 14 bp, Homo sapiens
agaattagattata

SEQ ID NO: 3227980 - DNA, 19 bp, Homo sapiens
agaattatgtaatatattg

SEQ ID NO: 3227981 - DNA, 20 bp, Homo sapiens
agaattatgtaatatattgt

SEQ ID NO: 3227982 - DNA, 17 bp, Homo sapiens
agaattctcttatccaa

SEQ ID NO: 3227983 - DNA, 16 bp, Homo sapiens
agaattgaaaagtttt

SEQ ID NO: 3227984 - DNA, 17 bp, Homo sapiens
agaattgaaaagttttt

SEQ ID NO: 3227985 - DNA, 21 bp, Homo sapiens
agaattgatcattttcccccc

SEQ ID NO: 3227986 - DNA, 18 bp, Homo sapiens
agaattggggattctcta

SEQ ID NO: 3227987 - DNA, 23 bp, Homo sapiens
agaattgtatctcatactgtctg

SEQ ID NO: 3227988 - DNA, 20 bp, Homo sapiens
agaatttaagtagaaaagtt

SEQ ID NO: 3227989 - DNA, 13 bp, Homo sapiens
agaatttagatct

SEQ ID NO: 3227990 - DNA, 14 bp, Homo sapiens
agaatttagggaga

SEQ ID NO: 3227991 - DNA, 14 bp, Homo sapiens
agaatttagtgtat

SEQ ID NO: 3227992 - DNA, 21 bp, Homo sapiens
agaatttattcaattcctctg

SEQ ID NO: 3227993 - DNA, 17 bp, Homo sapiens
agaatttctaaaaagat

SEQ ID NO: 3227994 - DNA, 23 bp, Homo sapiens
agaatttctaaaaagattagcaa

SEQ ID NO: 3227995 - DNA, 16 bp, Homo sapiens
agaatttctaccattt

SEQ ID NO: 3227996 - DNA, 16 bp, Homo sapiens
agaatttgtatgtatt

SEQ ID NO: 3227997 - DNA, 15 bp, Homo sapiens
agaatttgtattttg

SEQ ID NO: 3227998 - DNA, 18 bp, Homo sapiens
agaatttgtattttgctt

SEQ ID NO: 3227999 - DNA, 19 bp, Homo sapiens
agaatttgtattttgctta

SEQ ID NO: 3228000 - DNA, 18 bp, Homo sapiens
agaattttaatgtgaaga

SEQ ID NO: 3228001 - DNA, 19 bp, Homo sapiens
agaattttaatgtgaagac

SEQ ID NO: 3228002 - DNA, 16 bp, Homo sapiens
agaatttttccctcca

SEQ ID NO: 3228003 - DNA, 20 bp, Homo sapiens
agacaaaaaaatttaaaatt

SEQ ID NO: 3228004 - DNA, 14 bp, Homo sapiens
agacaaaaagacaa

SEQ ID NO: 3228005 - DNA, 15 bp, Homo sapiens
agacaaaaagacaaa

SEQ ID NO: 3228006 - DNA, 23 bp, Homo sapiens
agacaaaaagtatattaaacaaa

SEQ ID NO: 3228007 - DNA, 13 bp, Homo sapiens
agacaaaatttta

SEQ ID NO: 3228008 - DNA, 19 bp, Homo sapiens
agacaaacacctcccagga

SEQ ID NO: 3228009 - DNA, 22 bp, Homo sapiens
agacaaaccttaaaacagctgt

SEQ ID NO: 3228010 - DNA, 17 bp, Homo sapiens
agacaaatcaacagaag

SEQ ID NO: 3228011 - DNA, 21 bp, Homo sapiens
agacaaatcaacagaagcatt

SEQ ID NO: 3228012 - DNA, 18 bp, Homo sapiens
agacaaatggaggaatat

SEQ ID NO: 3228013 - DNA, 15 bp, Homo sapiens
agacaacagcccagg

SEQ ID NO: 3228014 - DNA, 16 bp, Homo sapiens
agacaacagcccaggc

SEQ ID NO: 3228015 - DNA, 19 bp, Homo sapiens
agacaacaggtaaaacagg

SEQ ID NO: 3228016 - DNA, 16 bp, Homo sapiens
agacaaccaaaacata

SEQ ID NO: 3228017 - DNA, 17 bp, Homo sapiens
agacaacctgaaattta

SEQ ID NO: 3228018 - DNA, 14 bp, Homo sapiens
agacaactagattt

SEQ ID NO: 3228019 - DNA, 17 bp, Homo sapiens
agacaactagatttgtc

SEQ ID NO: 3228020 - DNA, 18 bp, Homo sapiens
agacaactagatttgtcc

SEQ ID NO: 3228021 - DNA, 16 bp, Homo sapiens
agacaagcactatttt

SEQ ID NO: 3228022 - DNA, 18 bp, Homo sapiens
agacaagcactattttat

SEQ ID NO: 3228023 - DNA, 18 bp, Homo sapiens
agacaagcagcccttgct

SEQ ID NO: 3228024 - DNA, 15 bp, Homo sapiens
agagtctagattcaa

SEQ ID NO: 3228025 - DNA, 17 bp, Homo sapiens
agagtctagattcaaag

SEQ ID NO: 3228026 - DNA, 20 bp, Homo sapiens
agagtctcagaaactcccct

SEQ ID NO: 3228027 - DNA, 13 bp, Homo sapiens
agagtctgagccc

SEQ ID NO: 3228028 - DNA, 14 bp, Homo sapiens
agagtctgagcccc

SEQ ID NO: 3228029 - DNA, 17 bp, Homo sapiens
agagtctgggcctctga

SEQ ID NO: 3228030 - DNA, 21 bp, Homo sapiens
agagtcttacaatcaaatctc

SEQ ID NO: 3228031 - DNA, 23 bp, Homo sapiens
agagtcttacaatcaaatctcct

SEQ ID NO: 3228032 - DNA, 19 bp, Homo sapiens
agagtcttgggcctggccc

SEQ ID NO: 3228033 - DNA, 14 bp, Homo sapiens
agagtgaaagggct

SEQ ID NO: 3228034 - DNA, 22 bp, Homo sapiens
agagtgaaataattaaaaacca

SEQ ID NO: 3228035 - DNA, 15 bp, Homo sapiens
agagtgagactctgt

SEQ ID NO: 3228036 - DNA, 14 bp, Homo sapiens
agagtgcacagctg

SEQ ID NO: 3228037 - DNA, 18 bp, Homo sapiens
agagtgcattgtgagggt

SEQ ID NO: 3228038 - DNA, 21 bp, Homo sapiens
agagtggaaggactgtggctg

SEQ ID NO: 3228039 - DNA, 20 bp, Homo sapiens
agagtggactgaatgtgcct

SEQ ID NO: 3228040 - DNA, 17 bp, Homo sapiens
agagtggagactctgtt

SEQ ID NO: 3228041 - DNA, 16 bp, Homo sapiens
agagtggagtctgagt

SEQ ID NO: 3228042 - DNA, 20 bp, Homo sapiens
agagtggcctccctgctgtg

SEQ ID NO: 3228043 - DNA, 22 bp, Homo sapiens
agagtggcctccctgctgtgcc

SEQ ID NO: 3228044 - DNA, 12 bp, Homo sapiens
agagtggcctgg

SEQ ID NO: 3228045 - DNA, 15 bp, Homo sapiens
agagtggcctggcca

SEQ ID NO: 3228046 - DNA, 17 bp, Homo sapiens
agagtggcctggccagg

SEQ ID NO: 3228047 - DNA, 19 bp, Homo sapiens
agagtggcctggccaggag

SEQ ID NO: 3228048 - DNA, 23 bp, Homo sapiens
agagtgggccccgggctggagaa

SEQ ID NO: 3228049 - DNA, 20 bp, Homo sapiens
agagtgggggagagcaggct

SEQ ID NO: 3228050 - DNA, 17 bp, Homo sapiens
agagtgtacatcatgtt

SEQ ID NO: 3228051 - DNA, 13 bp, Homo sapiens
agagtgtagaagc

SEQ ID NO: 3228052 - DNA, 15 bp, Homo sapiens
agagtgtagaagcat

SEQ ID NO: 3228053 - DNA, 14 bp, Homo sapiens
agagtgtctctgat

SEQ ID NO: 3228054 - DNA, 15 bp, Homo sapiens
agagtgtggaggctg

SEQ ID NO: 3228055 - DNA, 23 bp, Homo sapiens
agagttaaatagagtatatgcac

SEQ ID NO: 3228056 - DNA, 14 bp, Homo sapiens
agagttaagaagct

SEQ ID NO: 3228057 - DNA, 12 bp, Homo sapiens
agagttaagaat

SEQ ID NO: 3228058 - DNA, 18 bp, Homo sapiens
agagttcacaggaggcca

SEQ ID NO: 3228059 - DNA, 16 bp, Homo sapiens
agagttcactataaat

SEQ ID NO: 3228060 - DNA, 22 bp, Homo sapiens
agagttcctgcggagtgaagag

SEQ ID NO: 3228061 - DNA, 14 bp, Homo sapiens
agagttctgctcta

SEQ ID NO: 3228062 - DNA, 21 bp, Homo sapiens
agagttgctgagagggctcga

SEQ ID NO: 3228063 - DNA, 15 bp, Homo sapiens
agagtttaacacaag

SEQ ID NO: 3228064 - DNA, 14 bp, Homo sapiens
agagtttgtgtgta

SEQ ID NO: 3228065 - DNA, 15 bp, Homo sapiens
agagtttgtgtgtat

SEQ ID NO: 3228066 - DNA, 16 bp, Homo sapiens
agagtttgtgtgttgt

SEQ ID NO: 3228067 - DNA, 19 bp, Homo sapiens
agagtttgtgtgttgtctt

SEQ ID NO: 3228068 - DNA, 17 bp, Homo sapiens
agagtttttatgccttt

SEQ ID NO: 3228069 - DNA, 22 bp, Homo sapiens
agagtttttatgcctttctctc

SEQ ID NO: 3228070 - DNA, 12 bp, Homo sapiens
agataaaaagat

SEQ ID NO: 3228071 - DNA, 13 bp, Homo sapiens
agataaaaatcag

SEQ ID NO: 3228072 - DNA, 17 bp, Homo sapiens
agataaaactctagcag

SEQ ID NO: 3228073 - DNA, 23 bp, Homo sapiens
agataaaccgtttttaacacata

SEQ ID NO: 3228074 - DNA, 13 bp, Homo sapiens
agataaagatgat

SEQ ID NO: 3228075 - DNA, 12 bp, Homo sapiens
agataaatgtgc

SEQ ID NO: 3228076 - DNA, 18 bp, Homo sapiens
agataacaagatctttca

SEQ ID NO: 3228077 - DNA, 21 bp, Homo sapiens
agataacaagatctttcagga

SEQ ID NO: 3228078 - DNA, 21 bp, Homo sapiens
agataacaatgcagcaaggcc

SEQ ID NO: 3228079 - DNA, 22 bp, Homo sapiens
agataacacactttttattaga

SEQ ID NO: 3228080 - DNA, 22 bp, Homo sapiens
agataacgcttaaaggaagtca

SEQ ID NO: 3228081 - DNA, 12 bp, Homo sapiens
agataacttact

SEQ ID NO: 3228082 - DNA, 22 bp, Homo sapiens
agataacttactgtatatgtat

SEQ ID NO: 3228083 - DNA, 13 bp, Homo sapiens
agataagcaagag

SEQ ID NO: 3228084 - DNA, 15 bp, Homo sapiens
agataagcctgagcc

SEQ ID NO: 3228085 - DNA, 22 bp, Homo sapiens
agataaggactagatactactt

SEQ ID NO: 3228086 - DNA, 20 bp, Homo sapiens
agataagtgtatttttcaat

SEQ ID NO: 3228087 - DNA, 14 bp, Homo sapiens
agataattgctatt

SEQ ID NO: 3228088 - DNA, 14 bp, Homo sapiens
agataatttgcata

SEQ ID NO: 3228089 - DNA, 21 bp, Homo sapiens
agataatttgcatattctatt

SEQ ID NO: 3228090 - DNA, 20 bp, Homo sapiens
agatacaagtttcagacagg

SEQ ID NO: 3228091 - DNA, 18 bp, Homo sapiens
agatacatatgagtgtgg

SEQ ID NO: 3228092 - DNA, 13 bp, Homo sapiens
agatacatcactg

SEQ ID NO: 3228093 - DNA, 22 bp, Homo sapiens
agataccttatcttacaatatt

SEQ ID NO: 3228094 - DNA, 18 bp, Homo sapiens
agataccttgaaaggaag

SEQ ID NO: 3228095 - DNA, 19 bp, Homo sapiens
agataccttgaaaggaaga

SEQ ID NO: 3228096 - DNA, 20 bp, Homo sapiens
agatacgactttattttctg

SEQ ID NO: 3228097 - DNA, 16 bp, Homo sapiens
agatactactttctct

SEQ ID NO: 3228098 - DNA, 17 bp, Homo sapiens
agatactactttctctt

SEQ ID NO: 3228099 - DNA, 23 bp, Homo sapiens
agatactgctactgtaattttat

SEQ ID NO: 3228100 - DNA, 19 bp, Homo sapiens
agatactggaagttttgca

SEQ ID NO: 3228101 - DNA, 15 bp, Homo sapiens
agatagaaataaata

SEQ ID NO: 3228102 - DNA, 20 bp, Homo sapiens
agatagagaaatagtgacaa

SEQ ID NO: 3228103 - DNA, 18 bp, Homo sapiens
agatagagagttgttgtg

SEQ ID NO: 3228104 - DNA, 22 bp, Homo sapiens
agatagagagttgttgtgtaca

SEQ ID NO: 3228105 - DNA, 17 bp, Homo sapiens
agatagatttggaatag

SEQ ID NO: 3228106 - DNA, 22 bp, Homo sapiens
agatataagagaagtctcattc

SEQ ID NO: 3228107 - DNA, 19 bp, Homo sapiens
agatataatgaacaaaatt

SEQ ID NO: 3228108 - DNA, 18 bp, Homo sapiens
agatatatttaagcctta

SEQ ID NO: 3228109 - DNA, 15 bp, Homo sapiens
agatatatttttcac

SEQ ID NO: 3228110 - DNA, 13 bp, Homo sapiens
agatatcaaaatt

SEQ ID NO: 3228111 - DNA, 15 bp, Homo sapiens
agatatcagagctct

SEQ ID NO: 3228112 - DNA, 19 bp, Homo sapiens
agatatcagagctcttaat

SEQ ID NO: 3228113 - DNA, 14 bp, Homo sapiens
agatatcagtgtct

SEQ ID NO: 3228114 - DNA, 21 bp, Homo sapiens
agatatcatactgatttttaa

SEQ ID NO: 3228115 - DNA, 15 bp, Homo sapiens
agatatccatctttt

SEQ ID NO: 3228116 - DNA, 17 bp, Homo sapiens
agatatctgagggagga

SEQ ID NO: 3228117 - DNA, 21 bp, Homo sapiens
agatatctgagggaggaggcc

SEQ ID NO: 3228118 - DNA, 20 bp, Homo sapiens
agatatggagaattgctgaa

SEQ ID NO: 3228119 - DNA, 14 bp, Homo sapiens
agatatgtattctt

SEQ ID NO: 3228120 - DNA, 21 bp, Homo sapiens
agatattactacttaccattt

SEQ ID NO: 3228121 - DNA, 13 bp, Homo sapiens
agatattacttta

SEQ ID NO: 3228122 - DNA, 14 bp, Homo sapiens
agatattactttat

SEQ ID NO: 3228123 - DNA, 17 bp, Homo sapiens
agatattactttatcac

SEQ ID NO: 3228124 - DNA, 22 bp, Homo sapiens
agatattactttatcacttttt

SEQ ID NO: 3228125 - DNA, 17 bp, Homo sapiens
agatattgctactataa

SEQ ID NO: 3228126 - DNA, 18 bp, Homo sapiens
agatattgtgaagtacat

SEQ ID NO: 3228127 - DNA, 17 bp, Homo sapiens
agatatttatattttta

SEQ ID NO: 3228128 - DNA, 20 bp, Homo sapiens
agatatttatatttttattt

SEQ ID NO: 3228129 - DNA, 23 bp, Homo sapiens
agatatttatatttttattttat

SEQ ID NO: 3228130 - DNA, 11 bp, Homo sapiens
agatatttggc

SEQ ID NO: 3228131 - DNA, 17 bp, Homo sapiens
agatatttttatcttta

SEQ ID NO: 3228132 - DNA, 18 bp, Homo sapiens
agatcaaaaggttaataa

SEQ ID NO: 3228133 - DNA, 16 bp, Homo sapiens
agatcaaaataaaaag

SEQ ID NO: 3228134 - DNA, 17 bp, Homo sapiens
agatcaaaataaaaagt

SEQ ID NO: 3228135 - DNA, 16 bp, Homo sapiens
agatcaacgcctcact

SEQ ID NO: 3228136 - DNA, 15 bp, Homo sapiens
agatcaagagatcaa

SEQ ID NO: 3228137 - DNA, 16 bp, Homo sapiens
agatcaaggcaaaaat

SEQ ID NO: 3228138 - DNA, 16 bp, Homo sapiens
agatcaagtgggcctt

SEQ ID NO: 3228139 - DNA, 20 bp, Homo sapiens
agatcacagcctccagggcc

SEQ ID NO: 3228140 - DNA, 21 bp, Homo sapiens
agatcaccagcccggcctgct

SEQ ID NO: 3228141 - DNA, 13 bp, Homo sapiens
agatcacgaggtc

SEQ ID NO: 3228142 - DNA, 17 bp, Homo sapiens
agatcacgccactgcac

SEQ ID NO: 3228143 - DNA, 23 bp, Homo sapiens
agatcactttctcagttttcata

SEQ ID NO: 3228144 - DNA, 20 bp, Homo sapiens
agatcagcaaaccggggcct

SEQ ID NO: 3228145 - DNA, 18 bp, Homo sapiens
agatcagtgtaccatttg

SEQ ID NO: 3228146 - DNA, 16 bp, Homo sapiens
agatccacacacagag

SEQ ID NO: 3228147 - DNA, 20 bp, Homo sapiens
agatccaccccctgcccaca

SEQ ID NO: 3228148 - DNA, 14 bp, Homo sapiens
agatccagactgta

SEQ ID NO: 3228149 - DNA, 15 bp, Homo sapiens
agatccagactgtaa

SEQ ID NO: 3228150 - DNA, 17 bp, Homo sapiens
agcacgaaatgttattt

SEQ ID NO: 3228151 - DNA, 13 bp, Homo sapiens
agcacggacaata

SEQ ID NO: 3228152 - DNA, 14 bp, Homo sapiens
agcacggacaataa

SEQ ID NO: 3228153 - DNA, 21 bp, Homo sapiens
agcacggacaataaacctccg

SEQ ID NO: 3228154 - DNA, 17 bp, Homo sapiens
agcacgtttaaagttct

SEQ ID NO: 3228155 - DNA, 19 bp, Homo sapiens
agcactaaggtgtgctctg

SEQ ID NO: 3228156 - DNA, 16 bp, Homo sapiens
agcactacataaactg

SEQ ID NO: 3228157 - DNA, 21 bp, Homo sapiens
agcactacataaactgacttt

SEQ ID NO: 3228158 - DNA, 17 bp, Homo sapiens
agcactactctgtgcca

SEQ ID NO: 3228159 - DNA, 18 bp, Homo sapiens
agcactagtttgattatt

SEQ ID NO: 3228160 - DNA, 17 bp, Homo sapiens
agcactattttatattt

SEQ ID NO: 3228161 - DNA, 22 bp, Homo sapiens
agcactattttatatttaaaaa

SEQ ID NO: 3228162 - DNA, 17 bp, Homo sapiens
agcactcagaaaagaaa

SEQ ID NO: 3228163 - DNA, 22 bp, Homo sapiens
agcactcagaaaagaaaaccat

SEQ ID NO: 3228164 - DNA, 18 bp, Homo sapiens
agcactcattttctataa

SEQ ID NO: 3228165 - DNA, 18 bp, Homo sapiens
agcactccccagagctgt

SEQ ID NO: 3228166 - DNA, 22 bp, Homo sapiens
agcactccccagagctgtgcca

SEQ ID NO: 3228167 - DNA, 23 bp, Homo sapiens
agcactccccagagctgtgccag

SEQ ID NO: 3228168 - DNA, 12 bp, Homo sapiens
agcactcccctt

SEQ ID NO: 3228169 - DNA, 16 bp, Homo sapiens
agcactccccttgcct

SEQ ID NO: 3228170 - DNA, 19 bp, Homo sapiens
agcactccccttgccttcc

SEQ ID NO: 3228171 - DNA, 22 bp, Homo sapiens
agcactccccttgccttcccct

SEQ ID NO: 3228172 - DNA, 23 bp, Homo sapiens
agcactccccttgccttcccctg

SEQ ID NO: 3228173 - DNA, 13 bp, Homo sapiens
agcactgacctgt

SEQ ID NO: 3228174 - DNA, 15 bp, Homo sapiens
agcactggccagaga

SEQ ID NO: 3228175 - DNA, 14 bp, Homo sapiens
agcactggctctct

SEQ ID NO: 3228176 - DNA, 20 bp, Homo sapiens
agcactgtctcagtttcact

SEQ ID NO: 3228177 - DNA, 14 bp, Homo sapiens
agcactgtgctaat

SEQ ID NO: 3228178 - DNA, 21 bp, Homo sapiens
agcactgttgatgtatctgag

SEQ ID NO: 3228179 - DNA, 16 bp, Homo sapiens
agcacttccaaaattc

SEQ ID NO: 3228180 - DNA, 22 bp, Homo sapiens
agcacttgagaaccagtctcct

SEQ ID NO: 3228181 - DNA, 15 bp, Homo sapiens
agcacttgcgtcctg

SEQ ID NO: 3228182 - DNA, 19 bp, Homo sapiens
agcacttgcgtcctgcaga

SEQ ID NO: 3228183 - DNA, 20 bp, Homo sapiens
agcacttgcgtcctgcagag

SEQ ID NO: 3228184 - DNA, 14 bp, Homo sapiens
agcacttgttttca

SEQ ID NO: 3228185 - DNA, 16 bp, Homo sapiens
agcactttcattgcca

SEQ ID NO: 3228186 - DNA, 19 bp, Homo sapiens
agcactttcattgccagtg

SEQ ID NO: 3228187 - DNA, 22 bp, Homo sapiens
agcactttctacaatgtgaact

SEQ ID NO: 3228188 - DNA, 14 bp, Homo sapiens
agcactttgggagg

SEQ ID NO: 3228189 - DNA, 17 bp, Homo sapiens
agcactttgggaggccg

SEQ ID NO: 3228190 - DNA, 14 bp, Homo sapiens
agcagaaacagcca

SEQ ID NO: 3228191 - DNA, 15 bp, Homo sapiens
agcagaaacagccat

SEQ ID NO: 3228192 - DNA, 20 bp, Homo sapiens
agcagaacagatcttttact

SEQ ID NO: 3228193 - DNA, 22 bp, Homo sapiens
agcagaactgaagtgtgctgtg

SEQ ID NO: 3228194 - DNA, 16 bp, Homo sapiens
agcagaaggatttttt

SEQ ID NO: 3228195 - DNA, 19 bp, Homo sapiens
agcagaatagcaaggtgct

SEQ ID NO: 3228196 - DNA, 22 bp, Homo sapiens
agcagaatctgttgagttgctg

SEQ ID NO: 3228197 - DNA, 15 bp, Homo sapiens
agcagaattttaatg

SEQ ID NO: 3228198 - DNA, 16 bp, Homo sapiens
agcagacagaaactgg

SEQ ID NO: 3228199 - DNA, 17 bp, Homo sapiens
agcagacagaaactgga

SEQ ID NO: 3228200 - DNA, 17 bp, Homo sapiens
agcagaggaattatgaa

SEQ ID NO: 3228201 - DNA, 22 bp, Homo sapiens
agcagaggacagtctggagaag

SEQ ID NO: 3228202 - DNA, 13 bp, Homo sapiens
agcagaggcagcg

SEQ ID NO: 3228203 - DNA, 18 bp, Homo sapiens
agcagaggggccaggccc

SEQ ID NO: 3228204 - DNA, 21 bp, Homo sapiens
agcagaggggccaggcccagg

SEQ ID NO: 3228205 - DNA, 22 bp, Homo sapiens
agcagaggggccaggcccaggc

SEQ ID NO: 3228206 - DNA, 14 bp, Homo sapiens
agcagagggggagt

SEQ ID NO: 3228207 - DNA, 23 bp, Homo sapiens
agcagaggtggccagagctggga

SEQ ID NO: 3228208 - DNA, 14 bp, Homo sapiens
agcagagtctgggc

SEQ ID NO: 3228209 - DNA, 19 bp, Homo sapiens
agcagagtgcacagctgtc

SEQ ID NO: 3228210 - DNA, 17 bp, Homo sapiens
agcagagtggactgcat

SEQ ID NO: 3228211 - DNA, 19 bp, Homo sapiens
agcagagttattgaatctt

SEQ ID NO: 3228212 - DNA, 13 bp, Homo sapiens
agcagagttttca

SEQ ID NO: 3228213 - DNA, 16 bp, Homo sapiens
agcagataactttttt

SEQ ID NO: 3228214 - DNA, 20 bp, Homo sapiens
agcagatacatatgagtgtg

SEQ ID NO: 3228215 - DNA, 17 bp, Homo sapiens
agcagatgcagagagcc

SEQ ID NO: 3228216 - DNA, 18 bp, Homo sapiens
agcagatgcagagagcca

SEQ ID NO: 3228217 - DNA, 21 bp, Homo sapiens
agcagatgcagagagccattt

SEQ ID NO: 3228218 - DNA, 18 bp, Homo sapiens
agcagatttaacaattcc

SEQ ID NO: 3228219 - DNA, 13 bp, Homo sapiens
agcagattttaat

SEQ ID NO: 3228220 - DNA, 20 bp, Homo sapiens
agcagcaaaaatataaaata

SEQ ID NO: 3228221 - DNA, 16 bp, Homo sapiens
agcagcagcaggtgat

SEQ ID NO: 3228222 - DNA, 22 bp, Homo sapiens
agcagcagctaggactgaggag

SEQ ID NO: 3228223 - DNA, 16 bp, Homo sapiens
agcagcaggtctagaa

SEQ ID NO: 3228224 - DNA, 14 bp, Homo sapiens
agcagcatcttctg

SEQ ID NO: 3228225 - DNA, 15 bp, Homo sapiens
agcagcatggaaaaa

SEQ ID NO: 3228226 - DNA, 11 bp, Homo sapiens
agcagccagcc

SEQ ID NO: 3228227 - DNA, 20 bp, Homo sapiens
agcagccatcataggaaggg

SEQ ID NO: 3228228 - DNA, 12 bp, Homo sapiens
agcagcccagct

SEQ ID NO: 3228229 - DNA, 17 bp, Homo sapiens
agcagcccagcttcctg

SEQ ID NO: 3228230 - DNA, 13 bp, Homo sapiens
agcagccccccag

SEQ ID NO: 3228231 - DNA, 15 bp, Homo sapiens
agcagccccgggagg

SEQ ID NO: 3228232 - DNA, 19 bp, Homo sapiens
agcagccgccagctgggag

SEQ ID NO: 3228233 - DNA, 22 bp, Homo sapiens
agcagcctcaaaacgggtcagt

SEQ ID NO: 3228234 - DNA, 16 bp, Homo sapiens
agcagcctcattctga

SEQ ID NO: 3228235 - DNA, 20 bp, Homo sapiens
agcagcctctccccaggtcc

SEQ ID NO: 3228236 - DNA, 21 bp, Homo sapiens
agcagcctctccccaggtcca

SEQ ID NO: 3228237 - DNA, 23 bp, Homo sapiens
agcagcctgagcaactcttgatt

SEQ ID NO: 3228238 - DNA, 14 bp, Homo sapiens
agcagcctgatggc

SEQ ID NO: 3228239 - DNA, 21 bp, Homo sapiens
agcagcctgcgctcggcagga

SEQ ID NO: 3228240 - DNA, 18 bp, Homo sapiens
agcagctaggactgagga

SEQ ID NO: 3228241 - DNA, 22 bp, Homo sapiens
agcagctaggactgaggagtgg

SEQ ID NO: 3228242 - DNA, 14 bp, Homo sapiens
agcagctctgagcc

SEQ ID NO: 3228243 - DNA, 17 bp, Homo sapiens
agcagctctgagccaga

SEQ ID NO: 3228244 - DNA, 21 bp, Homo sapiens
agcagctctgagccagattac

SEQ ID NO: 3228245 - DNA, 15 bp, Homo sapiens
agcagctgcattttt

SEQ ID NO: 3228246 - DNA, 16 bp, Homo sapiens
agcagctgcgggtctg

SEQ ID NO: 3228247 - DNA, 10 bp, Homo sapiens
agcagctgga

SEQ ID NO: 3228248 - DNA, 14 bp, Homo sapiens
agcagcttccagat

SEQ ID NO: 3228249 - DNA, 14 bp, Homo sapiens
agcagcttccttct

SEQ ID NO: 3228250 - DNA, 17 bp, Homo sapiens
agcagcttccttctggg

SEQ ID NO: 3228251 - DNA, 18 bp, Homo sapiens
agcagcttccttctggga

SEQ ID NO: 3228252 - DNA, 19 bp, Homo sapiens
agcagctttaaactcaggg

SEQ ID NO: 3228253 - DNA, 20 bp, Homo sapiens
agcagctttaaactcaggga

SEQ ID NO: 3228254 - DNA, 20 bp, Homo sapiens
agcagctttttattccctgc

SEQ ID NO: 3228255 - DNA, 23 bp, Homo sapiens
agcagctttttattccctgccca

SEQ ID NO: 3228256 - DNA, 21 bp, Homo sapiens
agcaggaagcattcagagagc

SEQ ID NO: 3228257 - DNA, 14 bp, Homo sapiens
agcaggaattatgt

SEQ ID NO: 3228258 - DNA, 16 bp, Homo sapiens
agcaggacctcccttc

SEQ ID NO: 3228259 - DNA, 18 bp, Homo sapiens
agcaggacctcccttccg

SEQ ID NO: 3228260 - DNA, 17 bp, Homo sapiens
agcaggacctggcatca

SEQ ID NO: 3228261 - DNA, 20 bp, Homo sapiens
agcaggacctggcatcatgg

SEQ ID NO: 3228262 - DNA, 19 bp, Homo sapiens
agcaggactccaggcccaa

SEQ ID NO: 3228263 - DNA, 22 bp, Homo sapiens
agcaggactccaggcccaaggc

SEQ ID NO: 3228264 - DNA, 23 bp, Homo sapiens
agcaggactccaggcccaaggct

SEQ ID NO: 3228265 - DNA, 21 bp, Homo sapiens
agcaggacttgctaaagcact

SEQ ID NO: 3228266 - DNA, 21 bp, Homo sapiens
agcaggagagactgagcagcc

SEQ ID NO: 3228267 - DNA, 18 bp, Homo sapiens
agcaggagattgagaagg

SEQ ID NO: 3228268 - DNA, 19 bp, Homo sapiens
agcaggagattgagaagga

SEQ ID NO: 3228269 - DNA, 20 bp, Homo sapiens
agcaggagattgagaaggag

SEQ ID NO: 3228270 - DNA, 17 bp, Homo sapiens
agcaggagccccgccac

SEQ ID NO: 3228271 - DNA, 18 bp, Homo sapiens
agcaggagtggtgcagac

SEQ ID NO: 3228272 - DNA, 17 bp, Homo sapiens
agcaggcaaaaaaggga

SEQ ID NO: 3228273 - DNA, 22 bp, Homo sapiens
agcaggcaaaaaagggacagca

SEQ ID NO: 3228274 - DNA, 19 bp, Homo sapiens
agcaggcaatgctgtactt

SEQ ID NO: 3228275 - DNA, 14 bp, Homo sapiens
aggagatgggcctt

SEQ ID NO: 3228276 - DNA, 12 bp, Homo sapiens
aggagattccac

SEQ ID NO: 3228277 - DNA, 14 bp, Homo sapiens
aggagattccacac

SEQ ID NO: 3228278 - DNA, 15 bp, Homo sapiens
aggagattgagaagg

SEQ ID NO: 3228279 - DNA, 17 bp, Homo sapiens
aggagattgagaaggag

SEQ ID NO: 3228280 - DNA, 19 bp, Homo sapiens
aggagattgagaaggagag

SEQ ID NO: 3228281 - DNA, 20 bp, Homo sapiens
aggagcaaaacgcctctttt

SEQ ID NO: 3228282 - DNA, 19 bp, Homo sapiens
aggagcaaacactgaaata

SEQ ID NO: 3228283 - DNA, 22 bp, Homo sapiens
aggagcacaggcagctggatga

SEQ ID NO: 3228284 - DNA, 16 bp, Homo sapiens
aggagcacaggtccca

SEQ ID NO: 3228285 - DNA, 17 bp, Homo sapiens
aggagcacttccaaaat

SEQ ID NO: 3228286 - DNA, 23 bp, Homo sapiens
aggagcagcttccttctgggact

SEQ ID NO: 3228287 - DNA, 14 bp, Homo sapiens
aggagccagacaga

SEQ ID NO: 3228288 - DNA, 15 bp, Homo sapiens
aggagccagacagac

SEQ ID NO: 3228289 - DNA, 13 bp, Homo sapiens
aggagccaggcaa

SEQ ID NO: 3228290 - DNA, 23 bp, Homo sapiens
aggagccagtttgccggatacaa

SEQ ID NO: 3228291 - DNA, 23 bp, Homo sapiens
aggagcccgaagtctgctgctgt

SEQ ID NO: 3228292 - DNA, 20 bp, Homo sapiens
aggagcctgtgcgtcccagc

SEQ ID NO: 3228293 - DNA, 21 bp, Homo sapiens
aggagcctgtgcgtcccagct

SEQ ID NO: 3228294 - DNA, 22 bp, Homo sapiens
aggagcctgtgcgtcccagctg

SEQ ID NO: 3228295 - DNA, 21 bp, Homo sapiens
aggagccttgttggtggagag

SEQ ID NO: 3228296 - DNA, 20 bp, Homo sapiens
aggagcggcgccctggactt

SEQ ID NO: 3228297 - DNA, 20 bp, Homo sapiens
aggagctaaggctctatgag

SEQ ID NO: 3228298 - DNA, 21 bp, Homo sapiens
aggagctaaggctctatgagt

SEQ ID NO: 3228299 - DNA, 22 bp, Homo sapiens
aggagctacccttttcctttgt

SEQ ID NO: 3228300 - DNA, 14 bp, Homo sapiens
aggagctagcctga

SEQ ID NO: 3228301 - DNA, 18 bp, Homo sapiens
aggagctagcctgaagga

SEQ ID NO: 3228302 - DNA, 15 bp, Homo sapiens
aggagctcaccctgc

SEQ ID NO: 3228303 - DNA, 16 bp, Homo sapiens
aggagctcaccctgcc

SEQ ID NO: 3228304 - DNA, 22 bp, Homo sapiens
aggagctcaggaagaagagatg

SEQ ID NO: 3228305 - DNA, 20 bp, Homo sapiens
aggagctctaccctgctccc

SEQ ID NO: 3228306 - DNA, 21 bp, Homo sapiens
aggagctctaccctgctccct

SEQ ID NO: 3228307 - DNA, 17 bp, Homo sapiens
aggagctcttcaggcct

SEQ ID NO: 3228308 - DNA, 21 bp, Homo sapiens
aggagctcttcaggcctccct

SEQ ID NO: 3228309 - DNA, 22 bp, Homo sapiens
aggagctgactcacacctgaac

SEQ ID NO: 3228310 - DNA, 15 bp, Homo sapiens
aggagctgatacttt

SEQ ID NO: 3228311 - DNA, 21 bp, Homo sapiens
aggagctgatttccaggcccc

SEQ ID NO: 3228312 - DNA, 15 bp, Homo sapiens
aggagctgcactgat

SEQ ID NO: 3228313 - DNA, 20 bp, Homo sapiens
aggagctgggcccctgcaca

SEQ ID NO: 3228314 - DNA, 20 bp, Homo sapiens
aggagctgtcaccaaggaaa

SEQ ID NO: 3228315 - DNA, 17 bp, Homo sapiens
aggagcttttgtgtgcc

SEQ ID NO: 3228316 - DNA, 14 bp, Homo sapiens
aggaggaaggcaag

SEQ ID NO: 3228317 - DNA, 17 bp, Homo sapiens
aggaggaatgctggact

SEQ ID NO: 3228318 - DNA, 10 bp, Homo sapiens
aggaggagaa

SEQ ID NO: 3228319 - DNA, 18 bp, Homo sapiens
aggaggagggagaagaga

SEQ ID NO: 3228320 - DNA, 21 bp, Homo sapiens
aggaggcagagggttgcagtg

SEQ ID NO: 3228321 - DNA, 16 bp, Homo sapiens
aggaggcagccccctc

SEQ ID NO: 3228322 - DNA, 18 bp, Homo sapiens
aggaggcagccccctcca

SEQ ID NO: 3228323 - DNA, 15 bp, Homo sapiens
aggaggccaataaaa

SEQ ID NO: 3228324 - DNA, 22 bp, Homo sapiens
aggaggccaataaaaagttcag

SEQ ID NO: 3228325 - DNA, 14 bp, Homo sapiens
aggaggccacctct

SEQ ID NO: 3228326 - DNA, 16 bp, Homo sapiens
aggaggccacctctcc

SEQ ID NO: 3228327 - DNA, 17 bp, Homo sapiens
aggaggccacctctcca

SEQ ID NO: 3228328 - DNA, 18 bp, Homo sapiens
aggaggccacctctccaa

SEQ ID NO: 3228329 - DNA, 20 bp, Homo sapiens
aggaggcgcccttggcttct

SEQ ID NO: 3228330 - DNA, 23 bp, Homo sapiens
aggaggcggcccggccagcgggc

SEQ ID NO: 3228331 - DNA, 20 bp, Homo sapiens
aggaggctcaacaataaaac

SEQ ID NO: 3228332 - DNA, 13 bp, Homo sapiens
aggaggctggcag

SEQ ID NO: 3228333 - DNA, 20 bp, Homo sapiens
aggaggcttggaaagcatca

SEQ ID NO: 3228334 - DNA, 12 bp, Homo sapiens
aggagggagagg

SEQ ID NO: 3228335 - DNA, 13 bp, Homo sapiens
aggagggagaggg

SEQ ID NO: 3228336 - DNA, 14 bp, Homo sapiens
aggagggaggccag

SEQ ID NO: 3228337 - DNA, 15 bp, Homo sapiens
aggagggagggggct

SEQ ID NO: 3228338 - DNA, 13 bp, Homo sapiens
aggagggatgctg

SEQ ID NO: 3228339 - DNA, 18 bp, Homo sapiens
aggagggcagagccatgg

SEQ ID NO: 3228340 - DNA, 14 bp, Homo sapiens
aggagggcatccat

SEQ ID NO: 3228341 - DNA, 22 bp, Homo sapiens
aggagggcatccataccagctc

SEQ ID NO: 3228342 - DNA, 20 bp, Homo sapiens
aggagggccctacctgattg

SEQ ID NO: 3228343 - DNA, 16 bp, Homo sapiens
aggaggggctgtaaaa

SEQ ID NO: 3228344 - DNA, 20 bp, Homo sapiens
aggagggggttcttcctcac

SEQ ID NO: 3228345 - DNA, 22 bp, Homo sapiens
aggaggggtgagtcccctactc

SEQ ID NO: 3228346 - DNA, 17 bp, Homo sapiens
aggagggtacagctggg

SEQ ID NO: 3228347 - DNA, 14 bp, Homo sapiens
aggagggtggagga

SEQ ID NO: 3228348 - DNA, 15 bp, Homo sapiens
aggagggtggaggaa

SEQ ID NO: 3228349 - DNA, 22 bp, Homo sapiens
aggagggtggaggaaggtgctg

SEQ ID NO: 3228350 - DNA, 18 bp, Homo sapiens
aggagggtttgggcagag

SEQ ID NO: 3228351 - DNA, 18 bp, Homo sapiens
aggaggtccttaggcctc

SEQ ID NO: 3228352 - DNA, 18 bp, Homo sapiens
aggaggtggcagccctgt

SEQ ID NO: 3228353 - DNA, 20 bp, Homo sapiens
aggaggttgagaatgcagtg

SEQ ID NO: 3228354 - DNA, 17 bp, Homo sapiens
aggaggttggtgactga

SEQ ID NO: 3228355 - DNA, 19 bp, Homo sapiens
aggagtcagtctctttctg

SEQ ID NO: 3228356 - DNA, 14 bp, Homo sapiens
aggagtcagtgtct

SEQ ID NO: 3228357 - DNA, 16 bp, Homo sapiens
aggagtctctgccacc

SEQ ID NO: 3228358 - DNA, 14 bp, Homo sapiens
aggagtctgtgctc

SEQ ID NO: 3228359 - DNA, 12 bp, Homo sapiens
aggagtgagcac

SEQ ID NO: 3228360 - DNA, 14 bp, Homo sapiens
aggagtgagcacta

SEQ ID NO: 3228361 - DNA, 21 bp, Homo sapiens
aggagtgattgaaccagctca

SEQ ID NO: 3228362 - DNA, 12 bp, Homo sapiens
aggagtgctggc

SEQ ID NO: 3228363 - DNA, 21 bp, Homo sapiens
aggagtgggaaaacactgcca

SEQ ID NO: 3228364 - DNA, 21 bp, Homo sapiens
aggagtgggtgacaagagcct

SEQ ID NO: 3228365 - DNA, 17 bp, Homo sapiens
aggagtggtgatttgaa

SEQ ID NO: 3228366 - DNA, 14 bp, Homo sapiens
aggagtgtcctctt

SEQ ID NO: 3228367 - DNA, 19 bp, Homo sapiens
aggagttcctaaccagcct

SEQ ID NO: 3228368 - DNA, 19 bp, Homo sapiens
aggagttcgagaccagcct

SEQ ID NO: 3228369 - DNA, 21 bp, Homo sapiens
aggagttcgagaccagcctcg

SEQ ID NO: 3228370 - DNA, 22 bp, Homo sapiens
aggagttggagaccaggcctga

SEQ ID NO: 3228371 - DNA, 22 bp, Homo sapiens
aggagttgtttctgacccactg

SEQ ID NO: 3228372 - DNA, 15 bp, Homo sapiens
aggagtttgaatcca

SEQ ID NO: 3228373 - DNA, 23 bp, Homo sapiens
aggagtttgagacaagccctggc

SEQ ID NO: 3228374 - DNA, 21 bp, Homo sapiens
aggagttttctccatatcaaa

SEQ ID NO: 3228375 - DNA, 15 bp, Homo sapiens
aggataaaatggtac

SEQ ID NO: 3228376 - DNA, 12 bp, Homo sapiens
aggataatggtg

SEQ ID NO: 3228377 - DNA, 17 bp, Homo sapiens
aggatagctaactgtaa

SEQ ID NO: 3228378 - DNA, 20 bp, Homo sapiens
aggatagctaactgtaaatc

SEQ ID NO: 3228379 - DNA, 15 bp, Homo sapiens
aggatatactgcagc

SEQ ID NO: 3228380 - DNA, 18 bp, Homo sapiens
aggatatattttcacttt

SEQ ID NO: 3228381 - DNA, 19 bp, Homo sapiens
aggatatccttatcagagc

SEQ ID NO: 3228382 - DNA, 20 bp, Homo sapiens
aggatatccttatcagagct

SEQ ID NO: 3228383 - DNA, 23 bp, Homo sapiens
aggatatccttatcagagctaag

SEQ ID NO: 3228384 - DNA, 23 bp, Homo sapiens
aggatatgaaactctacatttaa

SEQ ID NO: 3228385 - DNA, 22 bp, Homo sapiens
aggatattctactgtacttttt

SEQ ID NO: 3228386 - DNA, 18 bp, Homo sapiens
aggatatttaagaaaata

SEQ ID NO: 3228387 - DNA, 19 bp, Homo sapiens
aggatatttaagaaaatac

SEQ ID NO: 3228388 - DNA, 22 bp, Homo sapiens
aggatcactggagcccaggagt

SEQ ID NO: 3228389 - DNA, 13 bp, Homo sapiens
aggatcagttttt

SEQ ID NO: 3228390 - DNA, 22 bp, Homo sapiens
aggatcatggtgtaataagaca

SEQ ID NO: 3228391 - DNA, 14 bp, Homo sapiens
aggatcctctccac

SEQ ID NO: 3228392 - DNA, 18 bp, Homo sapiens
aggatcctctccactcca

SEQ ID NO: 3228393 - DNA, 12 bp, Homo sapiens
aggatcctgcag

SEQ ID NO: 3228394 - DNA, 16 bp, Homo sapiens
aggatccttccctgta

SEQ ID NO: 3228395 - DNA, 21 bp, Homo sapiens
aggatctctcaggagcacagg

SEQ ID NO: 3228396 - DNA, 22 bp, Homo sapiens
aggatctgcaaacaatgaagaa

SEQ ID NO: 3228397 - DNA, 21 bp, Homo sapiens
aggatgaagaacacagcatgt

SEQ ID NO: 3228398 - DNA, 18 bp, Homo sapiens
aggatgaaggctgtgaaa

SEQ ID NO: 3228399 - DNA, 12 bp, Homo sapiens
aggatgaatgta

SEQ ID NO: 3228400 - DNA, 12 bp, Homo sapiens
aaaaaattatgg

SEQ ID NO: 3228401 - DNA, 21 bp, Homo sapiens
aaaaaatttaaaattacgttt

SEQ ID NO: 3228402 - DNA, 12 bp, Homo sapiens
aaaaaatttaag

SEQ ID NO: 3228403 - DNA, 12 bp, Homo sapiens
aaaaacaaccaa

SEQ ID NO: 3228404 - DNA, 14 bp, Homo sapiens
aaaaacacaaaagt

SEQ ID NO: 3228405 - DNA, 15 bp, Homo sapiens
aaaaacacctagctt

SEQ ID NO: 3228406 - DNA, 23 bp, Homo sapiens
aaaaacactacttttgctttttt

SEQ ID NO: 3228407 - DNA, 16 bp, Homo sapiens
aaaaacataaaaagca

SEQ ID NO: 3228408 - DNA, 16 bp, Homo sapiens
aaaaacatagaaaaat

SEQ ID NO: 3228409 - DNA, 18 bp, Homo sapiens
aaaaaccactgaacattt

SEQ ID NO: 3228410 - DNA, 11 bp, Homo sapiens
aaaaactattt

SEQ ID NO: 3228411 - DNA, 13 bp, Homo sapiens
aaaaactcttcag

SEQ ID NO: 3228412 - DNA, 14 bp, Homo sapiens
aaaaactcttcagt

SEQ ID NO: 3228413 - DNA, 13 bp, Homo sapiens
aaaaactgctgta

SEQ ID NO: 3228414 - DNA, 13 bp, Homo sapiens
aaaaactgggata

SEQ ID NO: 3228415 - DNA, 20 bp, Homo sapiens
aaaaactgggataactgatt

SEQ ID NO: 3228416 - DNA, 20 bp, Homo sapiens
aaaaactgtctttaaaagag

SEQ ID NO: 3228417 - DNA, 22 bp, Homo sapiens
aaaaacttcatgtaattttatt

SEQ ID NO: 3228418 - DNA, 15 bp, Homo sapiens
aaaaacttgaaaata

SEQ ID NO: 3228419 - DNA, 12 bp, Homo sapiens
aaaaactttatt

SEQ ID NO: 3228420 - DNA, 20 bp, Homo sapiens
aaaaagaaaatggctaataa

SEQ ID NO: 3228421 - DNA, 12 bp, Homo sapiens
aaaaagaaacta

SEQ ID NO: 3228422 - DNA, 15 bp, Homo sapiens
aaaaagaagttactt

SEQ ID NO: 3228423 - DNA, 22 bp, Homo sapiens
aaaaagactgaacatgtttaca

SEQ ID NO: 3228424 - DNA, 22 bp, Homo sapiens
aaaaagatggcctttgcttatg

SEQ ID NO: 3228425 - DNA, 14 bp, Homo sapiens
aaaaagattagcaa

SEQ ID NO: 3228426 - DNA, 19 bp, Homo sapiens
aaaaagattgtattacttt

SEQ ID NO: 3228427 - DNA, 23 bp, Homo sapiens
aaaaagattttcagaaaatatta

SEQ ID NO: 3228428 - DNA, 20 bp, Homo sapiens
aaaaagcacatacattaaaa

SEQ ID NO: 3228429 - DNA, 17 bp, Homo sapiens
aaaaagcactagtataa

SEQ ID NO: 3228430 - DNA, 22 bp, Homo sapiens
aaaaagcagagtggactgcatt

SEQ ID NO: 3228431 - DNA, 17 bp, Homo sapiens
aaaaagcataaaaacat

SEQ ID NO: 3228432 - DNA, 19 bp, Homo sapiens
aaaaagctcaatgcattgt

SEQ ID NO: 3228433 - DNA, 19 bp, Homo sapiens
aaaaagctcatattttgta

SEQ ID NO: 3228434 - DNA, 19 bp, Homo sapiens
aaaaagcttccatgattct

SEQ ID NO: 3228435 - DNA, 17 bp, Homo sapiens
aaaaagcttgtggccaa

SEQ ID NO: 3228436 - DNA, 11 bp, Homo sapiens
aaaaaggaaaa

SEQ ID NO: 3228437 - DNA, 19 bp, Homo sapiens
aaaaaggaaaaaattaata

SEQ ID NO: 3228438 - DNA, 14 bp, Homo sapiens
aaaaaggaaaaata

SEQ ID NO: 3228439 - DNA, 14 bp, Homo sapiens
aaaaaggccaaaga

SEQ ID NO: 3228440 - DNA, 22 bp, Homo sapiens
aaaaaggctagtttattttgtt

SEQ ID NO: 3228441 - DNA, 17 bp, Homo sapiens
aaaaagggaagtaagca

SEQ ID NO: 3228442 - DNA, 18 bp, Homo sapiens
aaaaaggtctgttaatgt

SEQ ID NO: 3228443 - DNA, 21 bp, Homo sapiens
aaaaagtaagttaataatgta

SEQ ID NO: 3228444 - DNA, 15 bp, Homo sapiens
aaaaagtctctattt

SEQ ID NO: 3228445 - DNA, 23 bp, Homo sapiens
aaaaagtctctatttaaattctt

SEQ ID NO: 3228446 - DNA, 17 bp, Homo sapiens
aaaaagtgacacagcag

SEQ ID NO: 3228447 - DNA, 13 bp, Homo sapiens
aaaaagtgtttat

SEQ ID NO: 3228448 - DNA, 15 bp, Homo sapiens
aaaaagttgaaccat

SEQ ID NO: 3228449 - DNA, 16 bp, Homo sapiens
aaaaataaaaatggaa

SEQ ID NO: 3228450 - DNA, 12 bp, Homo sapiens
aaaaataaaata

SEQ ID NO: 3228451 - DNA, 16 bp, Homo sapiens
aaaaataataataatg

SEQ ID NO: 3228452 - DNA, 17 bp, Homo sapiens
aaaaataatcaagattt

SEQ ID NO: 3228453 - DNA, 18 bp, Homo sapiens
aaaaataatcaagatttt

SEQ ID NO: 3228454 - DNA, 19 bp, Homo sapiens
aaaaataatcaagatttta

SEQ ID NO: 3228455 - DNA, 13 bp, Homo sapiens
aaaaatacaaaat

SEQ ID NO: 3228456 - DNA, 14 bp, Homo sapiens
aaaaatacatgttc

SEQ ID NO: 3228457 - DNA, 12 bp, Homo sapiens
aaaaatatatat

SEQ ID NO: 3228458 - DNA, 18 bp, Homo sapiens
aaaaatattgtcatgttt

SEQ ID NO: 3228459 - DNA, 20 bp, Homo sapiens
aaaaatattgtcatgtttat

SEQ ID NO: 3228460 - DNA, 15 bp, Homo sapiens
aaaaatattttctga

SEQ ID NO: 3228461 - DNA, 21 bp, Homo sapiens
aaaaatccattttacacagca

SEQ ID NO: 3228462 - DNA, 22 bp, Homo sapiens
aaaaatctgaccaaaacaaaca

SEQ ID NO: 3228463 - DNA, 18 bp, Homo sapiens
aaaaatctgctgttaact

SEQ ID NO: 3228464 - DNA, 16 bp, Homo sapiens
aaaaatcttctccaga

SEQ ID NO: 3228465 - DNA, 15 bp, Homo sapiens
aaaaatctttttgat

SEQ ID NO: 3228466 - DNA, 20 bp, Homo sapiens
aaaaatgactaaaaatatta

SEQ ID NO: 3228467 - DNA, 18 bp, Homo sapiens
aaaaatgcccttaaatca

SEQ ID NO: 3228468 - DNA, 21 bp, Homo sapiens
aaaaatgcctttgagacagtt

SEQ ID NO: 3228469 - DNA, 20 bp, Homo sapiens
aaaaatgctgcttctcctcc

SEQ ID NO: 3228470 - DNA, 12 bp, Homo sapiens
aaaaatggatat

SEQ ID NO: 3228471 - DNA, 15 bp, Homo sapiens
aaaaatggatattat

SEQ ID NO: 3228472 - DNA, 18 bp, Homo sapiens
aaaaatgggtcttttata

SEQ ID NO: 3228473 - DNA, 12 bp, Homo sapiens
aaaaatgtaaat

SEQ ID NO: 3228474 - DNA, 16 bp, Homo sapiens
aaaaatgtaacatcat

SEQ ID NO: 3228475 - DNA, 19 bp, Homo sapiens
aaaaatgtaatttagaaac

SEQ ID NO: 3228476 - DNA, 21 bp, Homo sapiens
aaaaatgtacatttattcata

SEQ ID NO: 3228477 - DNA, 20 bp, Homo sapiens
aaaaatgtatccagtctgaa

SEQ ID NO: 3228478 - DNA, 23 bp, Homo sapiens
aaaaatgttagtattttaatcct

SEQ ID NO: 3228479 - DNA, 12 bp, Homo sapiens
aaaaatgttgaa

SEQ ID NO: 3228480 - DNA, 16 bp, Homo sapiens
aaaaatgttgagaagc

SEQ ID NO: 3228481 - DNA, 18 bp, Homo sapiens
aaaaattaaaacgaaaat

SEQ ID NO: 3228482 - DNA, 23 bp, Homo sapiens
aaaaattacagcttcaccctgtc

SEQ ID NO: 3228483 - DNA, 14 bp, Homo sapiens
aaaaattatcagtt

SEQ ID NO: 3228484 - DNA, 20 bp, Homo sapiens
aaaaattatcagttatattt

SEQ ID NO: 3228485 - DNA, 11 bp, Homo sapiens
aaaaattatta

SEQ ID NO: 3228486 - DNA, 22 bp, Homo sapiens
aaaaattcagcaaaccattttt

SEQ ID NO: 3228487 - DNA, 19 bp, Homo sapiens
aaaaattgctctgtgtata

SEQ ID NO: 3228488 - DNA, 14 bp, Homo sapiens
aaaaattgtgatca

SEQ ID NO: 3228489 - DNA, 21 bp, Homo sapiens
aaaaattgttaatttttccta

SEQ ID NO: 3228490 - DNA, 15 bp, Homo sapiens
aaaaatttaagcatt

SEQ ID NO: 3228491 - DNA, 16 bp, Homo sapiens
aaaaatttaagcattg

SEQ ID NO: 3228492 - DNA, 22 bp, Homo sapiens
aaaaattttataaaattaagca

SEQ ID NO: 3228493 - DNA, 18 bp, Homo sapiens
aaaacaaaatctgaactc

SEQ ID NO: 3228494 - DNA, 12 bp, Homo sapiens
aaaacaaaattt

SEQ ID NO: 3228495 - DNA, 19 bp, Homo sapiens
aaaacaacttggcatttct

SEQ ID NO: 3228496 - DNA, 20 bp, Homo sapiens
aaaacaacttggcatttcta

SEQ ID NO: 3228497 - DNA, 13 bp, Homo sapiens
aaaacacacaggt

SEQ ID NO: 3228498 - DNA, 15 bp, Homo sapiens
aaaacacctagcttt

SEQ ID NO: 3228499 - DNA, 10 bp, Homo sapiens
aaaacactaa

SEQ ID NO: 3228500 - DNA, 14 bp, Homo sapiens
aaaacactgtggaa

SEQ ID NO: 3228501 - DNA, 13 bp, Homo sapiens
aaaacacttattc

SEQ ID NO: 3228502 - DNA, 18 bp, Homo sapiens
aaaacagaacatcattag

SEQ ID NO: 3228503 - DNA, 22 bp, Homo sapiens
aaaacagaacatcattagaaca

SEQ ID NO: 3228504 - DNA, 18 bp, Homo sapiens
aaaacagatgaccataat

SEQ ID NO: 3228505 - DNA, 18 bp, Homo sapiens
aaaacagattctatatta

SEQ ID NO: 3228506 - DNA, 19 bp, Homo sapiens
aaaacagctgcattagaaa

SEQ ID NO: 3228507 - DNA, 23 bp, Homo sapiens
aaaacagggccacatagatgctg

SEQ ID NO: 3228508 - DNA, 20 bp, Homo sapiens
aaaacagggtgggcaaactc

SEQ ID NO: 3228509 - DNA, 17 bp, Homo sapiens
aaaacaggtagaattat

SEQ ID NO: 3228510 - DNA, 21 bp, Homo sapiens
aaaacaggtcttcatcgaatc

SEQ ID NO: 3228511 - DNA, 17 bp, Homo sapiens
aaaacatttactgacca

SEQ ID NO: 3228512 - DNA, 20 bp, Homo sapiens
aaaacatttttaatttaaca

SEQ ID NO: 3228513 - DNA, 21 bp, Homo sapiens
aaaaccaaacttgttcattta

SEQ ID NO: 3228514 - DNA, 16 bp, Homo sapiens
aaaaccaaattagcca

SEQ ID NO: 3228515 - DNA, 13 bp, Homo sapiens
aaaaccaatgatt

SEQ ID NO: 3228516 - DNA, 20 bp, Homo sapiens
aaaaccactgaacatttgct

SEQ ID NO: 3228517 - DNA, 22 bp, Homo sapiens
aaaaccagtctgtgtttacaga

SEQ ID NO: 3228518 - DNA, 22 bp, Homo sapiens
aaaaccatattttattgtattt

SEQ ID NO: 3228519 - DNA, 20 bp, Homo sapiens
aaaaccatcaaaaatattcc

SEQ ID NO: 3228520 - DNA, 21 bp, Homo sapiens
aaaaccatctctcttccagct

SEQ ID NO: 3228521 - DNA, 21 bp, Homo sapiens
aaaaccatcttctgtgtttat

SEQ ID NO: 3228522 - DNA, 19 bp, Homo sapiens
aaaacccaagtttatttct

SEQ ID NO: 3228523 - DNA, 14 bp, Homo sapiens
aaaacccagggcaa

SEQ ID NO: 3228524 - DNA, 17 bp, Homo sapiens
aaaacctgtcaatgata

SEQ ID NO: 3228525 - DNA, 22 bp, Homo sapiens
aaaaccttgtaaaaaaagcaaa

SEQ ID NO: 3228526 - DNA, 17 bp, Homo sapiens
aaaatgctgttaatgta

SEQ ID NO: 3228527 - DNA, 19 bp, Homo sapiens
aaaatgctttttatttctg

SEQ ID NO: 3228528 - DNA, 18 bp, Homo sapiens
aaaatggaaaaaaacata

SEQ ID NO: 3228529 - DNA, 23 bp, Homo sapiens
aaaatggccatttgctttttcac

SEQ ID NO: 3228530 - DNA, 17 bp, Homo sapiens
aaaatggctaataaact

SEQ ID NO: 3228531 - DNA, 21 bp, Homo sapiens
aaaatggctaataaactgtat

SEQ ID NO: 3228532 - DNA, 23 bp, Homo sapiens
aaaatggctaataaactgtatta

SEQ ID NO: 3228533 - DNA, 20 bp, Homo sapiens
aaaatgggaaaaataaaaga

SEQ ID NO: 3228534 - DNA, 17 bp, Homo sapiens
aaaatgggaagactgag

SEQ ID NO: 3228535 - DNA, 17 bp, Homo sapiens
aaaatgggtcttttata

SEQ ID NO: 3228536 - DNA, 18 bp, Homo sapiens
aaaatggttgatggaaaa

SEQ ID NO: 3228537 - DNA, 19 bp, Homo sapiens
aaaatggttgatggaaaat

SEQ ID NO: 3228538 - DNA, 19 bp, Homo sapiens
aaaatgtaaaggagtcaaa

SEQ ID NO: 3228539 - DNA, 22 bp, Homo sapiens
aaaatgtaacatcataattaca

SEQ ID NO: 3228540 - DNA, 18 bp, Homo sapiens
aaaatgtaatttagaaac

SEQ ID NO: 3228541 - DNA, 13 bp, Homo sapiens
aaaatgtatctaa

SEQ ID NO: 3228542 - DNA, 17 bp, Homo sapiens
aaaatgtattcaagcaa

SEQ ID NO: 3228543 - DNA, 21 bp, Homo sapiens
aaaatgtattcaagcaaacat

SEQ ID NO: 3228544 - DNA, 16 bp, Homo sapiens
aaaatgtatttttcta

SEQ ID NO: 3228545 - DNA, 18 bp, Homo sapiens
aaaatgtcctgcctttta

SEQ ID NO: 3228546 - DNA, 12 bp, Homo sapiens
aaaatgtctgta

SEQ ID NO: 3228547 - DNA, 20 bp, Homo sapiens
aaaatgtgaaatctcagaat

SEQ ID NO: 3228548 - DNA, 17 bp, Homo sapiens
aaaatgtgatgttctaa

SEQ ID NO: 3228549 - DNA, 13 bp, Homo sapiens
aaaatgtgatttt

SEQ ID NO: 3228550 - DNA, 19 bp, Homo sapiens
aaaatgtgtacagtgaatt

SEQ ID NO: 3228551 - DNA, 22 bp, Homo sapiens
aaaatgtgtacagtgaattgtc

SEQ ID NO: 3228552 - DNA, 15 bp, Homo sapiens
aaaatgtgttgaaac

SEQ ID NO: 3228553 - DNA, 14 bp, Homo sapiens
aaaatgtgtttgct

SEQ ID NO: 3228554 - DNA, 16 bp, Homo sapiens
aaaatgttcagaaggt

SEQ ID NO: 3228555 - DNA, 15 bp, Homo sapiens
aaaatgttctttgga

SEQ ID NO: 3228556 - DNA, 20 bp, Homo sapiens
aaaattaagacaagcctggc

SEQ ID NO: 3228557 - DNA, 18 bp, Homo sapiens
aaaattaagtagaacaaa

SEQ ID NO: 3228558 - DNA, 15 bp, Homo sapiens
aaaattactaatttt

SEQ ID NO: 3228559 - DNA, 17 bp, Homo sapiens
aaaattactaattttac

SEQ ID NO: 3228560 - DNA, 19 bp, Homo sapiens
aaaattaggatttcatgat

SEQ ID NO: 3228561 - DNA, 13 bp, Homo sapiens
aaaattatcagtg

SEQ ID NO: 3228562 - DNA, 14 bp, Homo sapiens
aaaattatgaatct

SEQ ID NO: 3228563 - DNA, 16 bp, Homo sapiens
aaaattatgaatctga

SEQ ID NO: 3228564 - DNA, 19 bp, Homo sapiens
aaaattatgaatctgattt

SEQ ID NO: 3228565 - DNA, 18 bp, Homo sapiens
aaaattatggaatatcat

SEQ ID NO: 3228566 - DNA, 15 bp, Homo sapiens
aaaattcaaagcatg

SEQ ID NO: 3228567 - DNA, 21 bp, Homo sapiens
aaaattcagcaaaccattttt

SEQ ID NO: 3228568 - DNA, 16 bp, Homo sapiens
aaaattcagtttttgt

SEQ ID NO: 3228569 - DNA, 20 bp, Homo sapiens
aaaattcagtttttgtatct

SEQ ID NO: 3228570 - DNA, 13 bp, Homo sapiens
aaaattcatttca

SEQ ID NO: 3228571 - DNA, 12 bp, Homo sapiens
aaaattcatttt

SEQ ID NO: 3228572 - DNA, 22 bp, Homo sapiens
aaaattcctttgtgtttctatt

SEQ ID NO: 3228573 - DNA, 23 bp, Homo sapiens
aaaattctgtgccttgttttttg

SEQ ID NO: 3228574 - DNA, 17 bp, Homo sapiens
aaaattgccattttatt

SEQ ID NO: 3228575 - DNA, 15 bp, Homo sapiens
aaaattgcctttaaa

SEQ ID NO: 3228576 - DNA, 21 bp, Homo sapiens
aaaattgtcacctctgttaag

SEQ ID NO: 3228577 - DNA, 14 bp, Homo sapiens
aaaattgtgcataa

SEQ ID NO: 3228578 - DNA, 20 bp, Homo sapiens
aaaattgttaatttttccta

SEQ ID NO: 3228579 - DNA, 15 bp, Homo sapiens
aaaattgtttcttga

SEQ ID NO: 3228580 - DNA, 19 bp, Homo sapiens
aaaattgttttcacttgta

SEQ ID NO: 3228581 - DNA, 14 bp, Homo sapiens
aaaatttaaaatta

SEQ ID NO: 3228582 - DNA, 16 bp, Homo sapiens
aaaatttaaaattacg

SEQ ID NO: 3228583 - DNA, 15 bp, Homo sapiens
aaaatttaagcattg

SEQ ID NO: 3228584 - DNA, 23 bp, Homo sapiens
aaaatttaagcattgtttgctta

SEQ ID NO: 3228585 - DNA, 15 bp, Homo sapiens
aaaatttaagtgcgt

SEQ ID NO: 3228586 - DNA, 23 bp, Homo sapiens
aaaatttagtttttgttcttaat

SEQ ID NO: 3228587 - DNA, 13 bp, Homo sapiens
aaaatttatttca

SEQ ID NO: 3228588 - DNA, 14 bp, Homo sapiens
aaaatttatttcat

SEQ ID NO: 3228589 - DNA, 23 bp, Homo sapiens
aaaatttccagtacctttgtcac

SEQ ID NO: 3228590 - DNA, 18 bp, Homo sapiens
aaaatttgaaatttagct

SEQ ID NO: 3228591 - DNA, 15 bp, Homo sapiens
aaaatttgaagtatt

SEQ ID NO: 3228592 - DNA, 13 bp, Homo sapiens
aaaatttgagact

SEQ ID NO: 3228593 - DNA, 22 bp, Homo sapiens
aaaatttgtctgaaacatttca

SEQ ID NO: 3228594 - DNA, 19 bp, Homo sapiens
aaaatttgtttgaaatctt

SEQ ID NO: 3228595 - DNA, 19 bp, Homo sapiens
aaaattttaccagcagaag

SEQ ID NO: 3228596 - DNA, 22 bp, Homo sapiens
aaaattttaccagcagaaggat

SEQ ID NO: 3228597 - DNA, 19 bp, Homo sapiens
aaaattttacttttgttct

SEQ ID NO: 3228598 - DNA, 13 bp, Homo sapiens
aaaattttataag

SEQ ID NO: 3228599 - DNA, 23 bp, Homo sapiens
aaaattttataagcaaatttcaa

SEQ ID NO: 3228600 - DNA, 15 bp, Homo sapiens
aaaattttctcattt

SEQ ID NO: 3228601 - DNA, 17 bp, Homo sapiens
aaaattttgcttttaat

SEQ ID NO: 3228602 - DNA, 20 bp, Homo sapiens
aaaatttttaaaatacttgt

SEQ ID NO: 3228603 - DNA, 16 bp, Homo sapiens
aaacaaaaattgtctt

SEQ ID NO: 3228604 - DNA, 21 bp, Homo sapiens
aaacaaaacccctaagagact

SEQ ID NO: 3228605 - DNA, 13 bp, Homo sapiens
aaacaaaacttaa

SEQ ID NO: 3228606 - DNA, 12 bp, Homo sapiens
aaacaaaagcac

SEQ ID NO: 3228607 - DNA, 15 bp, Homo sapiens
aaacaaaatctaaaa

SEQ ID NO: 3228608 - DNA, 13 bp, Homo sapiens
aaacaaaatttga

SEQ ID NO: 3228609 - DNA, 22 bp, Homo sapiens
aaacaaacattgtgttgacatt

SEQ ID NO: 3228610 - DNA, 12 bp, Homo sapiens
aaacaaagatgt

SEQ ID NO: 3228611 - DNA, 17 bp, Homo sapiens
aaacaaaggttgagatg

SEQ ID NO: 3228612 - DNA, 13 bp, Homo sapiens
aaacaaataaaaa

SEQ ID NO: 3228613 - DNA, 15 bp, Homo sapiens
aaacaaataatcaca

SEQ ID NO: 3228614 - DNA, 17 bp, Homo sapiens
aaacaaatatgcaaaag

SEQ ID NO: 3228615 - DNA, 16 bp, Homo sapiens
aaacaacaacacaata

SEQ ID NO: 3228616 - DNA, 20 bp, Homo sapiens
aaacaacagctcgatccaaa

SEQ ID NO: 3228617 - DNA, 12 bp, Homo sapiens
aaacaacattta

SEQ ID NO: 3228618 - DNA, 18 bp, Homo sapiens
aaacaacatttatatgta

SEQ ID NO: 3228619 - DNA, 18 bp, Homo sapiens
aaacaacgtgtatagtgc

SEQ ID NO: 3228620 - DNA, 17 bp, Homo sapiens
aaacaacttggcatttc

SEQ ID NO: 3228621 - DNA, 20 bp, Homo sapiens
aaacaacttggcatttctat

SEQ ID NO: 3228622 - DNA, 13 bp, Homo sapiens
aaacaagctgtgc

SEQ ID NO: 3228623 - DNA, 20 bp, Homo sapiens
aaacaagctgtgcaggcatg

SEQ ID NO: 3228624 - DNA, 17 bp, Homo sapiens
aaacaagtttagaaagc

SEQ ID NO: 3228625 - DNA, 14 bp, Homo sapiens
aaacaataaagaga

SEQ ID NO: 3228626 - DNA, 18 bp, Homo sapiens
aaacaatctggaagaaaa

SEQ ID NO: 3228627 - DNA, 17 bp, Homo sapiens
aaacaatgaagaattat

SEQ ID NO: 3228628 - DNA, 21 bp, Homo sapiens
aaacaatgaagaattatgtaa

SEQ ID NO: 3228629 - DNA, 15 bp, Homo sapiens
aaacaatgtataaag

SEQ ID NO: 3228630 - DNA, 17 bp, Homo sapiens
aaacaatgtataaagat

SEQ ID NO: 3228631 - DNA, 14 bp, Homo sapiens
aaacacaatatttt

SEQ ID NO: 3228632 - DNA, 17 bp, Homo sapiens
aaacacaccaggctgtg

SEQ ID NO: 3228633 - DNA, 15 bp, Homo sapiens
aaacacactcaaaag

SEQ ID NO: 3228634 - DNA, 11 bp, Homo sapiens
aaacacagctg

SEQ ID NO: 3228635 - DNA, 16 bp, Homo sapiens
aaacacatcttcccta

SEQ ID NO: 3228636 - DNA, 21 bp, Homo sapiens
aaacacatgccttaaatttgt

SEQ ID NO: 3228637 - DNA, 14 bp, Homo sapiens
aaacacctagcttt

SEQ ID NO: 3228638 - DNA, 16 bp, Homo sapiens
aaacacgaaacttgtt

SEQ ID NO: 3228639 - DNA, 19 bp, Homo sapiens
aaacactcaataaattgca

SEQ ID NO: 3228640 - DNA, 24 bp, Homo sapiens
aaacactcagttgttcaataataa

SEQ ID NO: 3228641 - DNA, 20 bp, Homo sapiens
aaacactccaccctccacct

SEQ ID NO: 3228642 - DNA, 21 bp, Homo sapiens
aaacactcggcatttcaaatg

SEQ ID NO: 3228643 - DNA, 13 bp, Homo sapiens
aaacactgccatc

SEQ ID NO: 3228644 - DNA, 18 bp, Homo sapiens
aaacactggctctgggac

SEQ ID NO: 3228645 - DNA, 18 bp, Homo sapiens
aaacactggtgccaacca

SEQ ID NO: 3228646 - DNA, 18 bp, Homo sapiens
aaacacttatcttctgga

SEQ ID NO: 3228647 - DNA, 17 bp, Homo sapiens
aaacactttgcctcctg

SEQ ID NO: 3228648 - DNA, 15 bp, Homo sapiens
aaacagaacagggtc

SEQ ID NO: 3228649 - DNA, 13 bp, Homo sapiens
aaacagaacatca

SEQ ID NO: 3228650 - DNA, 22 bp, Homo sapiens
aaacagagacaggcccaagaga

SEQ ID NO: 3228651 - DNA, 20 bp, Homo sapiens
aaacagagtccaatttaagg

SEQ ID NO: 3228652 - DNA, 20 bp, Homo sapiens
aaactaaataatgaataaac

SEQ ID NO: 3228653 - DNA, 13 bp, Homo sapiens
aaactaaatctct

SEQ ID NO: 3228654 - DNA, 13 bp, Homo sapiens
aaactaaatttca

SEQ ID NO: 3228655 - DNA, 14 bp, Homo sapiens
aaactaagcattgt

SEQ ID NO: 3228656 - DNA, 16 bp, Homo sapiens
aaactaatattttatg

SEQ ID NO: 3228657 - DNA, 17 bp, Homo sapiens
aaactacagaataatgt

SEQ ID NO: 3228658 - DNA, 20 bp, Homo sapiens
aaactacctaacattattta

SEQ ID NO: 3228659 - DNA, 20 bp, Homo sapiens
aaactactgaatgaagcagt

SEQ ID NO: 3228660 - DNA, 21 bp, Homo sapiens
aaactactgaatgaagcagta

SEQ ID NO: 3228661 - DNA, 16 bp, Homo sapiens
aaactaggtaatgttt

SEQ ID NO: 3228662 - DNA, 20 bp, Homo sapiens
aaactaggtaatgttttgta

SEQ ID NO: 3228663 - DNA, 21 bp, Homo sapiens
aaactaggtaatgttttgtat

SEQ ID NO: 3228664 - DNA, 22 bp, Homo sapiens
aaactaggtaatgttttgtata

SEQ ID NO: 3228665 - DNA, 14 bp, Homo sapiens
aaactagtttttcc

SEQ ID NO: 3228666 - DNA, 15 bp, Homo sapiens
aaactagtttttcct

SEQ ID NO: 3228667 - DNA, 18 bp, Homo sapiens
aaactatctgtatttatt

SEQ ID NO: 3228668 - DNA, 14 bp, Homo sapiens
aaactatcttgtgt

SEQ ID NO: 3228669 - DNA, 20 bp, Homo sapiens
aaactatgtgtttttctcat

SEQ ID NO: 3228670 - DNA, 21 bp, Homo sapiens
aaactatgtgtttttctcata

SEQ ID NO: 3228671 - DNA, 20 bp, Homo sapiens
aaactatttgtctttcagga

SEQ ID NO: 3228672 - DNA, 14 bp, Homo sapiens
aaactatttttgta

SEQ ID NO: 3228673 - DNA, 18 bp, Homo sapiens
aaactcaaaacttaacat

SEQ ID NO: 3228674 - DNA, 21 bp, Homo sapiens
aaactcaaaatatttgtacat

SEQ ID NO: 3228675 - DNA, 18 bp, Homo sapiens
aaactcaccatgtaaaag

SEQ ID NO: 3228676 - DNA, 18 bp, Homo sapiens
aaactcagggacagagcc

SEQ ID NO: 3228677 - DNA, 14 bp, Homo sapiens
aaactccaaagtcc

SEQ ID NO: 3228678 - DNA, 17 bp, Homo sapiens
aaactccacatctgcct

SEQ ID NO: 3228679 - DNA, 19 bp, Homo sapiens
aaactccacatctgcctta

SEQ ID NO: 3228680 - DNA, 17 bp, Homo sapiens
aaactccggattgcgtt

SEQ ID NO: 3228681 - DNA, 22 bp, Homo sapiens
aaactctgggaaataagagaga

SEQ ID NO: 3228682 - DNA, 15 bp, Homo sapiens
aaactcttaatctgt

SEQ ID NO: 3228683 - DNA, 13 bp, Homo sapiens
aaactcttatctc

SEQ ID NO: 3228684 - DNA, 14 bp, Homo sapiens
aaactcttcagtgc

SEQ ID NO: 3228685 - DNA, 13 bp, Homo sapiens
aaactgaaaatct

SEQ ID NO: 3228686 - DNA, 18 bp, Homo sapiens
aaactgaaaatctaatat

SEQ ID NO: 3228687 - DNA, 13 bp, Homo sapiens
aaactgaaagtgt

SEQ ID NO: 3228688 - DNA, 21 bp, Homo sapiens
aaactgaagcagcctctcccc

SEQ ID NO: 3228689 - DNA, 20 bp, Homo sapiens
aaactgactttttcccccca

SEQ ID NO: 3228690 - DNA, 18 bp, Homo sapiens
aaactgaggaattttctt

SEQ ID NO: 3228691 - DNA, 19 bp, Homo sapiens
aaactgaggaattttcttt

SEQ ID NO: 3228692 - DNA, 11 bp, Homo sapiens
aaactgatttc

SEQ ID NO: 3228693 - DNA, 16 bp, Homo sapiens
aaactgcacagtgctg

SEQ ID NO: 3228694 - DNA, 17 bp, Homo sapiens
aaactgcattagaaatt

SEQ ID NO: 3228695 - DNA, 22 bp, Homo sapiens
aaactgcttttttttttccagc

SEQ ID NO: 3228696 - DNA, 23 bp, Homo sapiens
aaactgcttttttttttccagca

SEQ ID NO: 3228697 - DNA, 16 bp, Homo sapiens
aaactggattaaaaca

SEQ ID NO: 3228698 - DNA, 19 bp, Homo sapiens
aaactggattaaaacaatt

SEQ ID NO: 3228699 - DNA, 21 bp, Homo sapiens
aaactggcatctgacacaaaa

SEQ ID NO: 3228700 - DNA, 15 bp, Homo sapiens
aaactggccccggat

SEQ ID NO: 3228701 - DNA, 16 bp, Homo sapiens
aaactgggataactga

SEQ ID NO: 3228702 - DNA, 20 bp, Homo sapiens
aaactggggcctccagaact

SEQ ID NO: 3228703 - DNA, 17 bp, Homo sapiens
aaactgtaaataaaatg

SEQ ID NO: 3228704 - DNA, 15 bp, Homo sapiens
aaactgtacatttaa

SEQ ID NO: 3228705 - DNA, 15 bp, Homo sapiens
aaactgtagaaatga

SEQ ID NO: 3228706 - DNA, 16 bp, Homo sapiens
aaactgtagaaatgat

SEQ ID NO: 3228707 - DNA, 21 bp, Homo sapiens
aaactgtgggattctgatttg

SEQ ID NO: 3228708 - DNA, 19 bp, Homo sapiens
aaactgtgtggactgtgat

SEQ ID NO: 3228709 - DNA, 20 bp, Homo sapiens
aaactgtgtggactgtgatg

SEQ ID NO: 3228710 - DNA, 12 bp, Homo sapiens
aaactgttagca

SEQ ID NO: 3228711 - DNA, 16 bp, Homo sapiens
aaactgttagcactgt

SEQ ID NO: 3228712 - DNA, 21 bp, Homo sapiens
aaactgttagcactgttgatg

SEQ ID NO: 3228713 - DNA, 15 bp, Homo sapiens
aaactgtttttacta

SEQ ID NO: 3228714 - DNA, 17 bp, Homo sapiens
aaacttaacatatttac

SEQ ID NO: 3228715 - DNA, 18 bp, Homo sapiens
aaacttaagatgaataca

SEQ ID NO: 3228716 - DNA, 14 bp, Homo sapiens
aaacttagaggaaa

SEQ ID NO: 3228717 - DNA, 15 bp, Homo sapiens
aaacttataaatcat

SEQ ID NO: 3228718 - DNA, 23 bp, Homo sapiens
aaacttatgctagtttattggaa

SEQ ID NO: 3228719 - DNA, 17 bp, Homo sapiens
aaacttccccatcttct

SEQ ID NO: 3228720 - DNA, 17 bp, Homo sapiens
aaacttctgaagactga

SEQ ID NO: 3228721 - DNA, 15 bp, Homo sapiens
aaacttcttgtcaga

SEQ ID NO: 3228722 - DNA, 20 bp, Homo sapiens
aaacttcttttctcttctac

SEQ ID NO: 3228723 - DNA, 19 bp, Homo sapiens
aaacttgactccatttcat

SEQ ID NO: 3228724 - DNA, 24 bp, Homo sapiens
aaacttggctcgaatctctgtgcc

SEQ ID NO: 3228725 - DNA, 12 bp, Homo sapiens
aaacttgtgaat

SEQ ID NO: 3228726 - DNA, 18 bp, Homo sapiens
aaacttgttattgtgaat

SEQ ID NO: 3228727 - DNA, 21 bp, Homo sapiens
aaacttgttattgtgaatgat

SEQ ID NO: 3228728 - DNA, 12 bp, Homo sapiens
aaactttaaaaa

SEQ ID NO: 3228729 - DNA, 20 bp, Homo sapiens
aaactttaaaaaatatttat

SEQ ID NO: 3228730 - DNA, 13 bp, Homo sapiens
aaactttaatata

SEQ ID NO: 3228731 - DNA, 19 bp, Homo sapiens
aaactttagggtaaaaatt

SEQ ID NO: 3228732 - DNA, 13 bp, Homo sapiens
aaactttcacttt

SEQ ID NO: 3228733 - DNA, 18 bp, Homo sapiens
aaactttcctcgcctgac

SEQ ID NO: 3228734 - DNA, 13 bp, Homo sapiens
aaactttgggaaa

SEQ ID NO: 3228735 - DNA, 13 bp, Homo sapiens
aaacttttctgct

SEQ ID NO: 3228736 - DNA, 14 bp, Homo sapiens
aaactttttttcaa

SEQ ID NO: 3228737 - DNA, 13 bp, Homo sapiens
aaagaaaaatcaa

SEQ ID NO: 3228738 - DNA, 16 bp, Homo sapiens
aaagaaaaccatttta

SEQ ID NO: 3228739 - DNA, 19 bp, Homo sapiens
aaagaaaaccattttagtt

SEQ ID NO: 3228740 - DNA, 22 bp, Homo sapiens
aaagaaaatgaaaaacaaccaa

SEQ ID NO: 3228741 - DNA, 13 bp, Homo sapiens
aaagaaaattgag

SEQ ID NO: 3228742 - DNA, 13 bp, Homo sapiens
aaagaaaattttt

SEQ ID NO: 3228743 - DNA, 19 bp, Homo sapiens
aaagaaaattttttttcaa

SEQ ID NO: 3228744 - DNA, 14 bp, Homo sapiens
aaagaaacaagctg

SEQ ID NO: 3228745 - DNA, 17 bp, Homo sapiens
aaagaaacaagctgtgc

SEQ ID NO: 3228746 - DNA, 20 bp, Homo sapiens
aaagaaacaagctgtgcagg

SEQ ID NO: 3228747 - DNA, 15 bp, Homo sapiens
aaagaaacagctttc

SEQ ID NO: 3228748 - DNA, 20 bp, Homo sapiens
aaagaaacctggggtgaata

SEQ ID NO: 3228749 - DNA, 15 bp, Homo sapiens
aaagaaagggaaaag

SEQ ID NO: 3228750 - DNA, 17 bp, Homo sapiens
aaagaaaggttgcgttt

SEQ ID NO: 3228751 - DNA, 19 bp, Homo sapiens
aaagaaatagaaaaggaag

SEQ ID NO: 3228752 - DNA, 23 bp, Homo sapiens
aaagaaatccatatcttaaagaa

SEQ ID NO: 3228753 - DNA, 20 bp, Homo sapiens
aaagaacatggacttgtata

SEQ ID NO: 3228754 - DNA, 19 bp, Homo sapiens
aaagaacttgatttgcatg

SEQ ID NO: 3228755 - DNA, 21 bp, Homo sapiens
aaagaagaagaagaaggagag

SEQ ID NO: 3228756 - DNA, 12 bp, Homo sapiens
aaagaagatgtt

SEQ ID NO: 3228757 - DNA, 13 bp, Homo sapiens
aaagaagcaagac

SEQ ID NO: 3228758 - DNA, 18 bp, Homo sapiens
aaagaagccacagctctt

SEQ ID NO: 3228759 - DNA, 18 bp, Homo sapiens
aaagaagggggccctgct

SEQ ID NO: 3228760 - DNA, 23 bp, Homo sapiens
aaagaagggggccctgctacctg

SEQ ID NO: 3228761 - DNA, 13 bp, Homo sapiens
aaagaagtggaga

SEQ ID NO: 3228762 - DNA, 21 bp, Homo sapiens
aaagaagtgtccgagaactaa

SEQ ID NO: 3228763 - DNA, 24 bp, Homo sapiens
aaagaagtgtggggattttcactg

SEQ ID NO: 3228764 - DNA, 17 bp, Homo sapiens
aaagaagttactttgta

SEQ ID NO: 3228765 - DNA, 20 bp, Homo sapiens
aaagaagttactttgtaatt

SEQ ID NO: 3228766 - DNA, 15 bp, Homo sapiens
aaagaatagaaggat

SEQ ID NO: 3228767 - DNA, 15 bp, Homo sapiens
aaagaatatgacttt

SEQ ID NO: 3228768 - DNA, 20 bp, Homo sapiens
aaagaatatgactttttata

SEQ ID NO: 3228769 - DNA, 12 bp, Homo sapiens
aaagaatttaaa

SEQ ID NO: 3228770 - DNA, 14 bp, Homo sapiens
aaagacaatcactg

SEQ ID NO: 3228771 - DNA, 19 bp, Homo sapiens
aaagacaatcactgaaaca

SEQ ID NO: 3228772 - DNA, 20 bp, Homo sapiens
aaagacaatcactgaaacaa

SEQ ID NO: 3228773 - DNA, 14 bp, Homo sapiens
aaagacagtattta

SEQ ID NO: 3228774 - DNA, 14 bp, Homo sapiens
aaagacatgttgta

SEQ ID NO: 3228775 - DNA, 14 bp, Homo sapiens
aaagaccagaaatt

SEQ ID NO: 3228776 - DNA, 22 bp, Homo sapiens
aaagacctttggagcaaagctg

SEQ ID NO: 3228777 - DNA, 14 bp, Homo sapiens
aaagactaatttaa

SEQ ID NO: 3228778 - DNA, 22 bp, Homo sapiens
aaataaattcctacaacttaat

SEQ ID NO: 3228779 - DNA, 14 bp, Homo sapiens
aaataaatttctgg

SEQ ID NO: 3228780 - DNA, 19 bp, Homo sapiens
aaataacaactatttttgt

SEQ ID NO: 3228781 - DNA, 17 bp, Homo sapiens
aaataacaatgtgctct

SEQ ID NO: 3228782 - DNA, 16 bp, Homo sapiens
aaataacaatgttaag

SEQ ID NO: 3228783 - DNA, 12 bp, Homo sapiens
aaataaccacaa

SEQ ID NO: 3228784 - DNA, 20 bp, Homo sapiens
aaataacctaattaatatat

SEQ ID NO: 3228785 - DNA, 14 bp, Homo sapiens
aaataactgaacca

SEQ ID NO: 3228786 - DNA, 15 bp, Homo sapiens
aaataactgaaccaa

SEQ ID NO: 3228787 - DNA, 18 bp, Homo sapiens
aaataactgaaccaaatt

SEQ ID NO: 3228788 - DNA, 21 bp, Homo sapiens
aaataactgaaccaaattgca

SEQ ID NO: 3228789 - DNA, 15 bp, Homo sapiens
aaataactgaatttg

SEQ ID NO: 3228790 - DNA, 14 bp, Homo sapiens
aaataacttcagtc

SEQ ID NO: 3228791 - DNA, 14 bp, Homo sapiens
aaataagaaaccta

SEQ ID NO: 3228792 - DNA, 13 bp, Homo sapiens
aaataagacaata

SEQ ID NO: 3228793 - DNA, 22 bp, Homo sapiens
aaataagacaatagtatttctc

SEQ ID NO: 3228794 - DNA, 12 bp, Homo sapiens
aaataagagaga

SEQ ID NO: 3228795 - DNA, 12 bp, Homo sapiens
aaataagagatt

SEQ ID NO: 3228796 - DNA, 17 bp, Homo sapiens
aaataagcaaataaaca

SEQ ID NO: 3228797 - DNA, 12 bp, Homo sapiens
aaataagtattt

SEQ ID NO: 3228798 - DNA, 14 bp, Homo sapiens
aaataagtatttat

SEQ ID NO: 3228799 - DNA, 22 bp, Homo sapiens
aaataagtatttataatagcaa

SEQ ID NO: 3228800 - DNA, 20 bp, Homo sapiens
aaataagtggttatttctca

SEQ ID NO: 3228801 - DNA, 14 bp, Homo sapiens
aaataataaaagat

SEQ ID NO: 3228802 - DNA, 14 bp, Homo sapiens
aaataatagggaaa

SEQ ID NO: 3228803 - DNA, 13 bp, Homo sapiens
aaataatatgcat

SEQ ID NO: 3228804 - DNA, 14 bp, Homo sapiens
aaataatatgcatt

SEQ ID NO: 3228805 - DNA, 14 bp, Homo sapiens
aaataatcaagatt

SEQ ID NO: 3228806 - DNA, 12 bp, Homo sapiens
aaataatgaata

SEQ ID NO: 3228807 - DNA, 19 bp, Homo sapiens
aaataatgaataaactgaa

SEQ ID NO: 3228808 - DNA, 12 bp, Homo sapiens
aaataattaaat

SEQ ID NO: 3228809 - DNA, 13 bp, Homo sapiens
aaataattctaaa

SEQ ID NO: 3228810 - DNA, 14 bp, Homo sapiens
aaataattttaaac

SEQ ID NO: 3228811 - DNA, 18 bp, Homo sapiens
aaataattttaaacaaag

SEQ ID NO: 3228812 - DNA, 19 bp, Homo sapiens
aaatacaaagtaaatacaa

SEQ ID NO: 3228813 - DNA, 19 bp, Homo sapiens
aaatacaacttaaataata

SEQ ID NO: 3228814 - DNA, 17 bp, Homo sapiens
aaatacaagactgttgt

SEQ ID NO: 3228815 - DNA, 19 bp, Homo sapiens
aaatacaagactgttgtga

SEQ ID NO: 3228816 - DNA, 21 bp, Homo sapiens
aaatacaagactgttgtgatc

SEQ ID NO: 3228817 - DNA, 20 bp, Homo sapiens
aaatacaatttttatttctt

SEQ ID NO: 3228818 - DNA, 16 bp, Homo sapiens
aaatacacatttcaca

SEQ ID NO: 3228819 - DNA, 18 bp, Homo sapiens
aaatacacatttcacatt

SEQ ID NO: 3228820 - DNA, 21 bp, Homo sapiens
aaatacaccacctcactcctg

SEQ ID NO: 3228821 - DNA, 23 bp, Homo sapiens
aaatacaccacctcactcctgtt

SEQ ID NO: 3228822 - DNA, 14 bp, Homo sapiens
aaatacagacacta

SEQ ID NO: 3228823 - DNA, 22 bp, Homo sapiens
aaatacagacactaagttatag

SEQ ID NO: 3228824 - DNA, 22 bp, Homo sapiens
aaatacagataattcatttgta

SEQ ID NO: 3228825 - DNA, 18 bp, Homo sapiens
aaatacaggaagaaagag

SEQ ID NO: 3228826 - DNA, 16 bp, Homo sapiens
aaatacagtattctgt

SEQ ID NO: 3228827 - DNA, 23 bp, Homo sapiens
aaatacatgccacatcaaacctt

SEQ ID NO: 3228828 - DNA, 15 bp, Homo sapiens
aaataccacaagcct

SEQ ID NO: 3228829 - DNA, 13 bp, Homo sapiens
aaataccagagcc

SEQ ID NO: 3228830 - DNA, 17 bp, Homo sapiens
aaataccagtgtggttt

SEQ ID NO: 3228831 - DNA, 17 bp, Homo sapiens
aaatacctcatgtttat

SEQ ID NO: 3228832 - DNA, 21 bp, Homo sapiens
aaatacctttgtagttactca

SEQ ID NO: 3228833 - DNA, 23 bp, Homo sapiens
aaatacctttgtagttactcaag

SEQ ID NO: 3228834 - DNA, 15 bp, Homo sapiens
aaatactaaaagcaa

SEQ ID NO: 3228835 - DNA, 19 bp, Homo sapiens
aaatactaaaagcaaatct

SEQ ID NO: 3228836 - DNA, 20 bp, Homo sapiens
aaatactctgctatttctct

SEQ ID NO: 3228837 - DNA, 18 bp, Homo sapiens
aaatacttaaatttggtt

SEQ ID NO: 3228838 - DNA, 21 bp, Homo sapiens
aaatactttcgaaatttcatt

SEQ ID NO: 3228839 - DNA, 19 bp, Homo sapiens
aaatacttttactctgcct

SEQ ID NO: 3228840 - DNA, 18 bp, Homo sapiens
aaatagaaaagtagacaa

SEQ ID NO: 3228841 - DNA, 14 bp, Homo sapiens
aaatagacaaaaag

SEQ ID NO: 3228842 - DNA, 19 bp, Homo sapiens
aaatagacaaaaagtatat

SEQ ID NO: 3228843 - DNA, 15 bp, Homo sapiens
aaatagacaaataga

SEQ ID NO: 3228844 - DNA, 15 bp, Homo sapiens
aaatagacagtatat

SEQ ID NO: 3228845 - DNA, 16 bp, Homo sapiens
aaatagacagtatatt

SEQ ID NO: 3228846 - DNA, 12 bp, Homo sapiens
aaatagacatgt

SEQ ID NO: 3228847 - DNA, 15 bp, Homo sapiens
aaatagagcttttaa

SEQ ID NO: 3228848 - DNA, 17 bp, Homo sapiens
aaatagagtatatgcac

SEQ ID NO: 3228849 - DNA, 19 bp, Homo sapiens
aaatagagtatatgcactt

SEQ ID NO: 3228850 - DNA, 19 bp, Homo sapiens
aaatagagtttgctattag

SEQ ID NO: 3228851 - DNA, 18 bp, Homo sapiens
aaatagatgatggtatga

SEQ ID NO: 3228852 - DNA, 21 bp, Homo sapiens
aaatagccctgcaaaaattca

SEQ ID NO: 3228853 - DNA, 19 bp, Homo sapiens
aaatagctatatccatgta

SEQ ID NO: 3228854 - DNA, 24 bp, Homo sapiens
aaatagctcaggtgtccctgcact

SEQ ID NO: 3228855 - DNA, 14 bp, Homo sapiens
aaataggagaggat

SEQ ID NO: 3228856 - DNA, 23 bp, Homo sapiens
aaataggagaggatgagagccca

SEQ ID NO: 3228857 - DNA, 16 bp, Homo sapiens
aaataggatttttaga

SEQ ID NO: 3228858 - DNA, 19 bp, Homo sapiens
aaataggctattaaaaaag

SEQ ID NO: 3228859 - DNA, 16 bp, Homo sapiens
aaatagggtctaactc

SEQ ID NO: 3228860 - DNA, 19 bp, Homo sapiens
aaatagtgacataatatat

SEQ ID NO: 3228861 - DNA, 21 bp, Homo sapiens
aaatagtgacataatatattc

SEQ ID NO: 3228862 - DNA, 18 bp, Homo sapiens
aaatagtgtgaaatatat

SEQ ID NO: 3228863 - DNA, 17 bp, Homo sapiens
aaatagttcaaactgca

SEQ ID NO: 3228864 - DNA, 14 bp, Homo sapiens
aaatagttcccttt

SEQ ID NO: 3228865 - DNA, 22 bp, Homo sapiens
aaatagttgcatagcagtatat

SEQ ID NO: 3228866 - DNA, 23 bp, Homo sapiens
aaatagttgtccatattttcaca

SEQ ID NO: 3228867 - DNA, 20 bp, Homo sapiens
aaatagtttgaattcagtaa

SEQ ID NO: 3228868 - DNA, 12 bp, Homo sapiens
aaatataaaata

SEQ ID NO: 3228869 - DNA, 22 bp, Homo sapiens
aaatataagccttttatactga

SEQ ID NO: 3228870 - DNA, 19 bp, Homo sapiens
aaatataagctgggaaaaa

SEQ ID NO: 3228871 - DNA, 11 bp, Homo sapiens
aaatataattc

SEQ ID NO: 3228872 - DNA, 16 bp, Homo sapiens
aaatataattctgtaa

SEQ ID NO: 3228873 - DNA, 16 bp, Homo sapiens
aaatataccactcttt

SEQ ID NO: 3228874 - DNA, 12 bp, Homo sapiens
aaatatacttga

SEQ ID NO: 3228875 - DNA, 16 bp, Homo sapiens
aaatatacttgactct

SEQ ID NO: 3228876 - DNA, 19 bp, Homo sapiens
aaatatacttgactctaat

SEQ ID NO: 3228877 - DNA, 18 bp, Homo sapiens
aaatatagatcagttata

SEQ ID NO: 3228878 - DNA, 19 bp, Homo sapiens
aaatatagcaaatgcagaa

SEQ ID NO: 3228879 - DNA, 22 bp, Homo sapiens
aaatatagtttgattcttcatt

SEQ ID NO: 3228880 - DNA, 23 bp, Homo sapiens
aaatatatacccccccatgcagt

SEQ ID NO: 3228881 - DNA, 23 bp, Homo sapiens
aaatatatatgtgtgtgtatgtt

SEQ ID NO: 3228882 - DNA, 15 bp, Homo sapiens
aaatatatattttgt

SEQ ID NO: 3228883 - DNA, 19 bp, Homo sapiens
aaatatattacttaactgt

SEQ ID NO: 3228884 - DNA, 16 bp, Homo sapiens
aaatatattcaggagt

SEQ ID NO: 3228885 - DNA, 21 bp, Homo sapiens
aaatatatttaagataattat

SEQ ID NO: 3228886 - DNA, 15 bp, Homo sapiens
aaatatcagactagt

SEQ ID NO: 3228887 - DNA, 18 bp, Homo sapiens
aaatatcatttatttttt

SEQ ID NO: 3228888 - DNA, 17 bp, Homo sapiens
aaatatccaaagactgt

SEQ ID NO: 3228889 - DNA, 18 bp, Homo sapiens
aaatatccaaagactgta

SEQ ID NO: 3228890 - DNA, 14 bp, Homo sapiens
aaatatcccttccg

SEQ ID NO: 3228891 - DNA, 17 bp, Homo sapiens
aaatatccttgatgtac

SEQ ID NO: 3228892 - DNA, 15 bp, Homo sapiens
aaatatctctgagtt

SEQ ID NO: 3228893 - DNA, 19 bp, Homo sapiens
aaatatctcttgtgctttt

SEQ ID NO: 3228894 - DNA, 12 bp, Homo sapiens
aaatatctgaaa

SEQ ID NO: 3228895 - DNA, 20 bp, Homo sapiens
aaatatcttgtgttgtcctt

SEQ ID NO: 3228896 - DNA, 16 bp, Homo sapiens
aaatatgaacctattt

SEQ ID NO: 3228897 - DNA, 23 bp, Homo sapiens
aaatatgagtggttattgaaaat

SEQ ID NO: 3228898 - DNA, 12 bp, Homo sapiens
aaatatgatact

SEQ ID NO: 3228899 - DNA, 19 bp, Homo sapiens
aaatatgattttatttgac

SEQ ID NO: 3228900 - DNA, 10 bp, Homo sapiens
aaatatgcaa

SEQ ID NO: 3228901 - DNA, 23 bp, Homo sapiens
aaatatgcagtgatatggcagaa

SEQ ID NO: 3228902 - DNA, 23 bp, Homo sapiens
aaatatgccccttcttgggcccc

SEQ ID NO: 3228903 - DNA, 18 bp, Homo sapiens
aaatatggaacttacatt

SEQ ID NO: 3228904 - DNA, 15 bp, Homo sapiens
aacactaattcataa

SEQ ID NO: 3228905 - DNA, 17 bp, Homo sapiens
aacactaattcataatc

SEQ ID NO: 3228906 - DNA, 15 bp, Homo sapiens
aacactataaaggtt

SEQ ID NO: 3228907 - DNA, 16 bp, Homo sapiens
aacactatgtttattt

SEQ ID NO: 3228908 - DNA, 15 bp, Homo sapiens
aacactattttcaga

SEQ ID NO: 3228909 - DNA, 16 bp, Homo sapiens
aacactattttcagaa

SEQ ID NO: 3228910 - DNA, 17 bp, Homo sapiens
aacactattttcagaat

SEQ ID NO: 3228911 - DNA, 21 bp, Homo sapiens
aacactcacatttattctgct

SEQ ID NO: 3228912 - DNA, 10 bp, Homo sapiens
aacactccag

SEQ ID NO: 3228913 - DNA, 19 bp, Homo sapiens
aacactccaggccctgccc

SEQ ID NO: 3228914 - DNA, 16 bp, Homo sapiens
aacactcttttgcttt

SEQ ID NO: 3228915 - DNA, 19 bp, Homo sapiens
aacactcttttgctttatt

SEQ ID NO: 3228916 - DNA, 14 bp, Homo sapiens
aacactggctctgg

SEQ ID NO: 3228917 - DNA, 17 bp, Homo sapiens
aacactggctctgggac

SEQ ID NO: 3228918 - DNA, 18 bp, Homo sapiens
aacactggctctgggact

SEQ ID NO: 3228919 - DNA, 17 bp, Homo sapiens
aacactggtgccaacca

SEQ ID NO: 3228920 - DNA, 13 bp, Homo sapiens
aacactgtgccct

SEQ ID NO: 3228921 - DNA, 21 bp, Homo sapiens
aacactgtgccctggtggaga

SEQ ID NO: 3228922 - DNA, 20 bp, Homo sapiens
aacactgtggaactaataaa

SEQ ID NO: 3228923 - DNA, 14 bp, Homo sapiens
aacacttaatagca

SEQ ID NO: 3228924 - DNA, 16 bp, Homo sapiens
aacacttatcttctgg

SEQ ID NO: 3228925 - DNA, 22 bp, Homo sapiens
aacacttgcaggggtccctgct

SEQ ID NO: 3228926 - DNA, 23 bp, Homo sapiens
aacacttgcaggggtccctgcta

SEQ ID NO: 3228927 - DNA, 18 bp, Homo sapiens
aacacttgcttgccaact

SEQ ID NO: 3228928 - DNA, 19 bp, Homo sapiens
aacactttctcttcttgtt

SEQ ID NO: 3228929 - DNA, 19 bp, Homo sapiens
aacactttgagcattttta

SEQ ID NO: 3228930 - DNA, 18 bp, Homo sapiens
aacactttgtattactta

SEQ ID NO: 3228931 - DNA, 14 bp, Homo sapiens
aacagaaaaacaat

SEQ ID NO: 3228932 - DNA, 16 bp, Homo sapiens
aacagaaacaaaaaca

SEQ ID NO: 3228933 - DNA, 14 bp, Homo sapiens
aacagaaatggaaa

SEQ ID NO: 3228934 - DNA, 16 bp, Homo sapiens
aacagaacagcttcag

SEQ ID NO: 3228935 - DNA, 20 bp, Homo sapiens
aacagaacatcattagaaca

SEQ ID NO: 3228936 - DNA, 13 bp, Homo sapiens
aacagaactaaat

SEQ ID NO: 3228937 - DNA, 15 bp, Homo sapiens
aacagaactaaatgt

SEQ ID NO: 3228938 - DNA, 18 bp, Homo sapiens
aacagaactaaatgttct

SEQ ID NO: 3228939 - DNA, 17 bp, Homo sapiens
aacagaataaagcagcc

SEQ ID NO: 3228940 - DNA, 16 bp, Homo sapiens
aacagaataatgcatg

SEQ ID NO: 3228941 - DNA, 14 bp, Homo sapiens
aacagaatgtttta

SEQ ID NO: 3228942 - DNA, 13 bp, Homo sapiens
aacagaccagtga

SEQ ID NO: 3228943 - DNA, 19 bp, Homo sapiens
aacagaccccctctagaaa

SEQ ID NO: 3228944 - DNA, 19 bp, Homo sapiens
aacagactggaagcacagc

SEQ ID NO: 3228945 - DNA, 13 bp, Homo sapiens
aacagagatgtga

SEQ ID NO: 3228946 - DNA, 20 bp, Homo sapiens
aacagagtccaatttaagga

SEQ ID NO: 3228947 - DNA, 23 bp, Homo sapiens
aacagagtccgggagaatgctgg

SEQ ID NO: 3228948 - DNA, 18 bp, Homo sapiens
aacagagtggcctccctg

SEQ ID NO: 3228949 - DNA, 19 bp, Homo sapiens
aacagataagcaagagaga

SEQ ID NO: 3228950 - DNA, 13 bp, Homo sapiens
aacagataatcag

SEQ ID NO: 3228951 - DNA, 17 bp, Homo sapiens
aacagatatcagtgtct

SEQ ID NO: 3228952 - DNA, 16 bp, Homo sapiens
aacagatcaatttgta

SEQ ID NO: 3228953 - DNA, 16 bp, Homo sapiens
aacagatgaataaact

SEQ ID NO: 3228954 - DNA, 21 bp, Homo sapiens
aacagatgatgagaatttcta

SEQ ID NO: 3228955 - DNA, 12 bp, Homo sapiens
aacagatgtgaa

SEQ ID NO: 3228956 - DNA, 20 bp, Homo sapiens
aacagatgtgaaaatatact

SEQ ID NO: 3228957 - DNA, 21 bp, Homo sapiens
aacagatgtgaaaatatactt

SEQ ID NO: 3228958 - DNA, 21 bp, Homo sapiens
aacagattcaggccagcccag

SEQ ID NO: 3228959 - DNA, 16 bp, Homo sapiens
aacagattttggggtt

SEQ ID NO: 3228960 - DNA, 14 bp, Homo sapiens
aacagcaagaaata

SEQ ID NO: 3228961 - DNA, 20 bp, Homo sapiens
aacagcactggctctctcca

SEQ ID NO: 3228962 - DNA, 21 bp, Homo sapiens
aacagcactggctctctccag

SEQ ID NO: 3228963 - DNA, 17 bp, Homo sapiens
aacagcagaggttcttt

SEQ ID NO: 3228964 - DNA, 20 bp, Homo sapiens
aacagcagtctccttcagca

SEQ ID NO: 3228965 - DNA, 19 bp, Homo sapiens
aacagcatgaataaaacac

SEQ ID NO: 3228966 - DNA, 19 bp, Homo sapiens
aacagcatgctgctttgcc

SEQ ID NO: 3228967 - DNA, 22 bp, Homo sapiens
aacagcatgtacggattttcag

SEQ ID NO: 3228968 - DNA, 23 bp, Homo sapiens
aacagcattcttgtcacaataaa

SEQ ID NO: 3228969 - DNA, 15 bp, Homo sapiens
aacagcattgctttc

SEQ ID NO: 3228970 - DNA, 19 bp, Homo sapiens
aacagccaactagcccctg

SEQ ID NO: 3228971 - DNA, 19 bp, Homo sapiens
aacagccctcctctgcact

SEQ ID NO: 3228972 - DNA, 22 bp, Homo sapiens
aacagccttagctgccagtgct

SEQ ID NO: 3228973 - DNA, 20 bp, Homo sapiens
aacagcgaagtagcttgctc

SEQ ID NO: 3228974 - DNA, 18 bp, Homo sapiens
aacagctatgggagcccc

SEQ ID NO: 3228975 - DNA, 19 bp, Homo sapiens
aacagctatgggagcccca

SEQ ID NO: 3228976 - DNA, 22 bp, Homo sapiens
aacagctatgggagccccaggg

SEQ ID NO: 3228977 - DNA, 16 bp, Homo sapiens
aacagctatttaaggg

SEQ ID NO: 3228978 - DNA, 11 bp, Homo sapiens
aacagctcctt

SEQ ID NO: 3228979 - DNA, 14 bp, Homo sapiens
aacagctctgagat

SEQ ID NO: 3228980 - DNA, 16 bp, Homo sapiens
aacagctctgagatcc

SEQ ID NO: 3228981 - DNA, 21 bp, Homo sapiens
aacagctctgcaggcttaata

SEQ ID NO: 3228982 - DNA, 19 bp, Homo sapiens
aacagctgaggtctcttga

SEQ ID NO: 3228983 - DNA, 18 bp, Homo sapiens
aacagctgcattagaaaa

SEQ ID NO: 3228984 - DNA, 16 bp, Homo sapiens
aacagctttcaagtgc

SEQ ID NO: 3228985 - DNA, 14 bp, Homo sapiens
aacaggaatgtctg

SEQ ID NO: 3228986 - DNA, 21 bp, Homo sapiens
aacaggacagagttcacagga

SEQ ID NO: 3228987 - DNA, 22 bp, Homo sapiens
aacaggacagagttcacaggag

SEQ ID NO: 3228988 - DNA, 23 bp, Homo sapiens
aacaggagtcagtctctttctgt

SEQ ID NO: 3228989 - DNA, 14 bp, Homo sapiens
aacaggataaccct

SEQ ID NO: 3228990 - DNA, 12 bp, Homo sapiens
aacaggcccagg

SEQ ID NO: 3228991 - DNA, 20 bp, Homo sapiens
aacaggcccagggagggaag

SEQ ID NO: 3228992 - DNA, 17 bp, Homo sapiens
aacaggggaggaaaaaa

SEQ ID NO: 3228993 - DNA, 21 bp, Homo sapiens
aacaggggaggaaaaaagaac

SEQ ID NO: 3228994 - DNA, 20 bp, Homo sapiens
aacagtatgtgggatattga

SEQ ID NO: 3228995 - DNA, 22 bp, Homo sapiens
aacagtatttcattgcctgtgt

SEQ ID NO: 3228996 - DNA, 17 bp, Homo sapiens
aacagtcttcaggcaaa

SEQ ID NO: 3228997 - DNA, 13 bp, Homo sapiens
aacagtgagcctg

SEQ ID NO: 3228998 - DNA, 15 bp, Homo sapiens
aacagtgcatattcc

SEQ ID NO: 3228999 - DNA, 17 bp, Homo sapiens
aacagtggttgcctggg

SEQ ID NO: 3229000 - DNA, 18 bp, Homo sapiens
aacagtggttgcctgggg

SEQ ID NO: 3229001 - DNA, 22 bp, Homo sapiens
aacagtgtggtttgggaaagat

SEQ ID NO: 3229002 - DNA, 13 bp, Homo sapiens
aacagtgtttaaa

SEQ ID NO: 3229003 - DNA, 13 bp, Homo sapiens
aacagtgtttccc

SEQ ID NO: 3229004 - DNA, 19 bp, Homo sapiens
aacagtgtttcccataatt

SEQ ID NO: 3229005 - DNA, 13 bp, Homo sapiens
aacagttaacttt

SEQ ID NO: 3229006 - DNA, 17 bp, Homo sapiens
aacagttaactttcaga

SEQ ID NO: 3229007 - DNA, 18 bp, Homo sapiens
aacagttaactttcagaa

SEQ ID NO: 3229008 - DNA, 20 bp, Homo sapiens
aacagttaactttcagaaga

SEQ ID NO: 3229009 - DNA, 13 bp, Homo sapiens
aacagttccattt

SEQ ID NO: 3229010 - DNA, 14 bp, Homo sapiens
aacagttggtaact

SEQ ID NO: 3229011 - DNA, 21 bp, Homo sapiens
aacagttggtaacttttgtga

SEQ ID NO: 3229012 - DNA, 22 bp, Homo sapiens
aacagttggtaacttttgtgaa

SEQ ID NO: 3229013 - DNA, 23 bp, Homo sapiens
aacagtttcttgcttggaagcca

SEQ ID NO: 3229014 - DNA, 13 bp, Homo sapiens
aacagttttccat

SEQ ID NO: 3229015 - DNA, 12 bp, Homo sapiens
aacataaaacaa

SEQ ID NO: 3229016 - DNA, 14 bp, Homo sapiens
aacataaaatctgt

SEQ ID NO: 3229017 - DNA, 21 bp, Homo sapiens
aacataaccattacagggagc

SEQ ID NO: 3229018 - DNA, 20 bp, Homo sapiens
aacataataaatcacacatt

SEQ ID NO: 3229019 - DNA, 17 bp, Homo sapiens
aacataattcttgtata

SEQ ID NO: 3229020 - DNA, 21 bp, Homo sapiens
aacatacttcaaaaataatgt

SEQ ID NO: 3229021 - DNA, 13 bp, Homo sapiens
aacatataatgtt

SEQ ID NO: 3229022 - DNA, 22 bp, Homo sapiens
aacatataatgttgttatttaa

SEQ ID NO: 3229023 - DNA, 13 bp, Homo sapiens
aacatatcatttt

SEQ ID NO: 3229024 - DNA, 21 bp, Homo sapiens
aacatatgtacataaattgca

SEQ ID NO: 3229025 - DNA, 23 bp, Homo sapiens
aacatattctgtatgaactttat

SEQ ID NO: 3229026 - DNA, 17 bp, Homo sapiens
aacatatttcattttaa

SEQ ID NO: 3229027 - DNA, 18 bp, Homo sapiens
aacatatttcattttaac

SEQ ID NO: 3229028 - DNA, 19 bp, Homo sapiens
aacatcaaataaatttctg

SEQ ID NO: 3229029 - DNA, 13 bp, Homo sapiens
aactctgagccca

SEQ ID NO: 3229030 - DNA, 18 bp, Homo sapiens
aactctgagcccatactt

SEQ ID NO: 3229031 - DNA, 19 bp, Homo sapiens
aactctggacccctgggcc

SEQ ID NO: 3229032 - DNA, 19 bp, Homo sapiens
aactctggctccttctcca

SEQ ID NO: 3229033 - DNA, 16 bp, Homo sapiens
aactctgtggcattat

SEQ ID NO: 3229034 - DNA, 14 bp, Homo sapiens
aactctgttccccc

SEQ ID NO: 3229035 - DNA, 19 bp, Homo sapiens
aactctgttcccccaccct

SEQ ID NO: 3229036 - DNA, 17 bp, Homo sapiens
aactcttagaaatgaag

SEQ ID NO: 3229037 - DNA, 14 bp, Homo sapiens
aactcttatctcag

SEQ ID NO: 3229038 - DNA, 21 bp, Homo sapiens
aactcttcaatctcttgcact

SEQ ID NO: 3229039 - DNA, 18 bp, Homo sapiens
aactcttcacaaaatctg

SEQ ID NO: 3229040 - DNA, 12 bp, Homo sapiens
aactcttcagaa

SEQ ID NO: 3229041 - DNA, 11 bp, Homo sapiens
aactcttcagt

SEQ ID NO: 3229042 - DNA, 13 bp, Homo sapiens
aactcttcagtgc

SEQ ID NO: 3229043 - DNA, 22 bp, Homo sapiens
aactcttcagtgcaaattgtat

SEQ ID NO: 3229044 - DNA, 16 bp, Homo sapiens
aactcttccatttatt

SEQ ID NO: 3229045 - DNA, 23 bp, Homo sapiens
aactctttgctgctgcccatgtt

SEQ ID NO: 3229046 - DNA, 19 bp, Homo sapiens
aactctttgttatttgaaa

SEQ ID NO: 3229047 - DNA, 14 bp, Homo sapiens
aactcttttctatt

SEQ ID NO: 3229048 - DNA, 16 bp, Homo sapiens
aactgaaagtgtttta

SEQ ID NO: 3229049 - DNA, 21 bp, Homo sapiens
aactgaaagtgttttactctt

SEQ ID NO: 3229050 - DNA, 14 bp, Homo sapiens
aactgaaattacat

SEQ ID NO: 3229051 - DNA, 21 bp, Homo sapiens
aactgaacaccattgaaggct

SEQ ID NO: 3229052 - DNA, 14 bp, Homo sapiens
aactgaacgacaaa

SEQ ID NO: 3229053 - DNA, 15 bp, Homo sapiens
aactgaacttcagag

SEQ ID NO: 3229054 - DNA, 20 bp, Homo sapiens
aactgaagatccacaaaaga

SEQ ID NO: 3229055 - DNA, 18 bp, Homo sapiens
aactgaagttctatttat

SEQ ID NO: 3229056 - DNA, 14 bp, Homo sapiens
aactgaatattttg

SEQ ID NO: 3229057 - DNA, 15 bp, Homo sapiens
aactgaatattttgg

SEQ ID NO: 3229058 - DNA, 18 bp, Homo sapiens
aactgaatattttggaaa

SEQ ID NO: 3229059 - DNA, 20 bp, Homo sapiens
aactgaatattttggaaact

SEQ ID NO: 3229060 - DNA, 14 bp, Homo sapiens
aactgacataatgt

SEQ ID NO: 3229061 - DNA, 14 bp, Homo sapiens
aactgaccagcctc

SEQ ID NO: 3229062 - DNA, 18 bp, Homo sapiens
aactgactttttcccccc

SEQ ID NO: 3229063 - DNA, 20 bp, Homo sapiens
aactgagctgggcaggaagg

SEQ ID NO: 3229064 - DNA, 18 bp, Homo sapiens
aactgaggaatttcacct

SEQ ID NO: 3229065 - DNA, 22 bp, Homo sapiens
aactgaggagatgaccagggat

SEQ ID NO: 3229066 - DNA, 15 bp, Homo sapiens
aactgatggaccggg

SEQ ID NO: 3229067 - DNA, 22 bp, Homo sapiens
aactgatggaccgggtgggcct

SEQ ID NO: 3229068 - DNA, 17 bp, Homo sapiens
aactgattacctgccaa

SEQ ID NO: 3229069 - DNA, 12 bp, Homo sapiens
aactgatttcta

SEQ ID NO: 3229070 - DNA, 12 bp, Homo sapiens
aactgcaaaaaa

SEQ ID NO: 3229071 - DNA, 17 bp, Homo sapiens
aactgcaataacttctg

SEQ ID NO: 3229072 - DNA, 13 bp, Homo sapiens
aactgcaatagag

SEQ ID NO: 3229073 - DNA, 22 bp, Homo sapiens
aactgcaatagagactgtagat

SEQ ID NO: 3229074 - DNA, 23 bp, Homo sapiens
aactgcaatagagactgtagatt

SEQ ID NO: 3229075 - DNA, 19 bp, Homo sapiens
aactgcacacacagctcct

SEQ ID NO: 3229076 - DNA, 14 bp, Homo sapiens
aactgcacagtgct

SEQ ID NO: 3229077 - DNA, 18 bp, Homo sapiens
aactgcacagtgctgttg

SEQ ID NO: 3229078 - DNA, 13 bp, Homo sapiens
aactgcactttta

SEQ ID NO: 3229079 - DNA, 13 bp, Homo sapiens
aactgcaggccct

SEQ ID NO: 3229080 - DNA, 17 bp, Homo sapiens
aactgcaggccctggcc

SEQ ID NO: 3229081 - DNA, 15 bp, Homo sapiens
aactgcatggaccta

SEQ ID NO: 3229082 - DNA, 11 bp, Homo sapiens
aactgccatta

SEQ ID NO: 3229083 - DNA, 23 bp, Homo sapiens
aactgccattattttctgtcaga

SEQ ID NO: 3229084 - DNA, 16 bp, Homo sapiens
aactgcccttgctgcc

SEQ ID NO: 3229085 - DNA, 17 bp, Homo sapiens
aactgcccttgctgccc

SEQ ID NO: 3229086 - DNA, 20 bp, Homo sapiens
aactgcctactccaaaatgt

SEQ ID NO: 3229087 - DNA, 20 bp, Homo sapiens
aactgcctcgaaacacagaa

SEQ ID NO: 3229088 - DNA, 15 bp, Homo sapiens
aactgctaaattcta

SEQ ID NO: 3229089 - DNA, 19 bp, Homo sapiens
aactgctaaattctatgtt

SEQ ID NO: 3229090 - DNA, 21 bp, Homo sapiens
aactgctaaattctatgttaa

SEQ ID NO: 3229091 - DNA, 23 bp, Homo sapiens
aactgctaaattctatgttaaat

SEQ ID NO: 3229092 - DNA, 18 bp, Homo sapiens
aactgctaatgcaaatta

SEQ ID NO: 3229093 - DNA, 12 bp, Homo sapiens
aactgctcttga

SEQ ID NO: 3229094 - DNA, 13 bp, Homo sapiens
aactgctgagcca

SEQ ID NO: 3229095 - DNA, 20 bp, Homo sapiens
aactgctgctttttgaggtg

SEQ ID NO: 3229096 - DNA, 17 bp, Homo sapiens
aactgctttctgttcca

SEQ ID NO: 3229097 - DNA, 15 bp, Homo sapiens
aactggaagaaagca

SEQ ID NO: 3229098 - DNA, 19 bp, Homo sapiens
aactggcaattgtctattt

SEQ ID NO: 3229099 - DNA, 23 bp, Homo sapiens
aactggcaggggagacaggagcc

SEQ ID NO: 3229100 - DNA, 20 bp, Homo sapiens
aactggcatctgacacaaaa

SEQ ID NO: 3229101 - DNA, 21 bp, Homo sapiens
aactggccccggatcagagca

SEQ ID NO: 3229102 - DNA, 21 bp, Homo sapiens
aactggccggtctgcaagtca

SEQ ID NO: 3229103 - DNA, 23 bp, Homo sapiens
aactggccggtctgcaagtcaga

SEQ ID NO: 3229104 - DNA, 11 bp, Homo sapiens
aactggctgca

SEQ ID NO: 3229105 - DNA, 16 bp, Homo sapiens
aactgggataactgat

SEQ ID NO: 3229106 - DNA, 20 bp, Homo sapiens
aactgggataactgatttct

SEQ ID NO: 3229107 - DNA, 15 bp, Homo sapiens
aactggggctttgcc

SEQ ID NO: 3229108 - DNA, 16 bp, Homo sapiens
aactggggctttgcct

SEQ ID NO: 3229109 - DNA, 18 bp, Homo sapiens
aactggggctttgccttg

SEQ ID NO: 3229110 - DNA, 16 bp, Homo sapiens
aactgggtacttgtgg

SEQ ID NO: 3229111 - DNA, 21 bp, Homo sapiens
aactggtattctgttctggag

SEQ ID NO: 3229112 - DNA, 22 bp, Homo sapiens
aactggtattctgttctggagg

SEQ ID NO: 3229113 - DNA, 19 bp, Homo sapiens
aactgtatcaaatctgtat

SEQ ID NO: 3229114 - DNA, 23 bp, Homo sapiens
aactgtcaaattttcaaataata

SEQ ID NO: 3229115 - DNA, 14 bp, Homo sapiens
aactgtccagagag

SEQ ID NO: 3229116 - DNA, 16 bp, Homo sapiens
aactgtccagagagca

SEQ ID NO: 3229117 - DNA, 14 bp, Homo sapiens
aactgtcctttcct

SEQ ID NO: 3229118 - DNA, 17 bp, Homo sapiens
aactgtgaagtttacat

SEQ ID NO: 3229119 - DNA, 19 bp, Homo sapiens
aactgtgcagttttgtttg

SEQ ID NO: 3229120 - DNA, 17 bp, Homo sapiens
aactgtgcgttaaataa

SEQ ID NO: 3229121 - DNA, 13 bp, Homo sapiens
aactgtggatatt

SEQ ID NO: 3229122 - DNA, 18 bp, Homo sapiens
aactgtggatattgttac

SEQ ID NO: 3229123 - DNA, 21 bp, Homo sapiens
aactgtgtacataactgaaaa

SEQ ID NO: 3229124 - DNA, 13 bp, Homo sapiens
aactgtgtatgta

SEQ ID NO: 3229125 - DNA, 18 bp, Homo sapiens
aactgtgtctctgaattc

SEQ ID NO: 3229126 - DNA, 15 bp, Homo sapiens
aactgtgtgattaaa

SEQ ID NO: 3229127 - DNA, 16 bp, Homo sapiens
aactgtgttgtattaa

SEQ ID NO: 3229128 - DNA, 18 bp, Homo sapiens
aactgtgttgtattaaca

SEQ ID NO: 3229129 - DNA, 14 bp, Homo sapiens
aactgttacaactt

SEQ ID NO: 3229130 - DNA, 20 bp, Homo sapiens
aactgttacaacttgtattt

SEQ ID NO: 3229131 - DNA, 21 bp, Homo sapiens
aactgttctctattagacttt

SEQ ID NO: 3229132 - DNA, 19 bp, Homo sapiens
aactgttctctttaaaata

SEQ ID NO: 3229133 - DNA, 18 bp, Homo sapiens
aactgttcttttgcattt

SEQ ID NO: 3229134 - DNA, 17 bp, Homo sapiens
aactgtttccctgctga

SEQ ID NO: 3229135 - DNA, 13 bp, Homo sapiens
aactgttttttaa

SEQ ID NO: 3229136 - DNA, 17 bp, Homo sapiens
aacttaaaataattaaa

SEQ ID NO: 3229137 - DNA, 22 bp, Homo sapiens
aacttaaaataattaaataaat

SEQ ID NO: 3229138 - DNA, 14 bp, Homo sapiens
aacttaacatattt

SEQ ID NO: 3229139 - DNA, 17 bp, Homo sapiens
aacttaacattctgtaa

SEQ ID NO: 3229140 - DNA, 18 bp, Homo sapiens
aacttacacttggagccc

SEQ ID NO: 3229141 - DNA, 19 bp, Homo sapiens
aacttacctgggcattctt

SEQ ID NO: 3229142 - DNA, 19 bp, Homo sapiens
aacttactgtatatgtatt

SEQ ID NO: 3229143 - DNA, 20 bp, Homo sapiens
aacttagactctagtattta

SEQ ID NO: 3229144 - DNA, 16 bp, Homo sapiens
aacttaggtggcaagc

SEQ ID NO: 3229145 - DNA, 15 bp, Homo sapiens
aacttataaatcata

SEQ ID NO: 3229146 - DNA, 19 bp, Homo sapiens
aacttataaatcatattga

SEQ ID NO: 3229147 - DNA, 20 bp, Homo sapiens
aacttatatactatttccct

SEQ ID NO: 3229148 - DNA, 12 bp, Homo sapiens
aacttatgtttt

SEQ ID NO: 3229149 - DNA, 17 bp, Homo sapiens
aacttatttaaaaatat

SEQ ID NO: 3229150 - DNA, 19 bp, Homo sapiens
aacttatttaaaaatattt

SEQ ID NO: 3229151 - DNA, 20 bp, Homo sapiens
aacttcaaaaactaaaatca

SEQ ID NO: 3229152 - DNA, 13 bp, Homo sapiens
aacttcaaagctg

SEQ ID NO: 3229153 - DNA, 16 bp, Homo sapiens
aacttcacaactaggc

SEQ ID NO: 3229154 - DNA, 13 bp, Homo sapiens
aacttcactctgg

SEQ ID NO: 3229155 - DNA, 17 bp, Homo sapiens
aagatatggcacttctc

SEQ ID NO: 3229156 - DNA, 20 bp, Homo sapiens
aagatatttgcagtttttca

SEQ ID NO: 3229157 - DNA, 23 bp, Homo sapiens
aagatcaaaaggttaataaagta

SEQ ID NO: 3229158 - DNA, 15 bp, Homo sapiens
aagatcaaaataaaa

SEQ ID NO: 3229159 - DNA, 17 bp, Homo sapiens
aagatcaaaataaaaag

SEQ ID NO: 3229160 - DNA, 17 bp, Homo sapiens
aagatcacgctccccgc

SEQ ID NO: 3229161 - DNA, 17 bp, Homo sapiens
aagatcactttctcagt

SEQ ID NO: 3229162 - DNA, 20 bp, Homo sapiens
aagatccaccccctgcccac

SEQ ID NO: 3229163 - DNA, 15 bp, Homo sapiens
aagatccatttgcct

SEQ ID NO: 3229164 - DNA, 16 bp, Homo sapiens
aagatctataaagcga

SEQ ID NO: 3229165 - DNA, 23 bp, Homo sapiens
aagatctgcagggggtgtgtctg

SEQ ID NO: 3229166 - DNA, 15 bp, Homo sapiens
aagatcttagattct

SEQ ID NO: 3229167 - DNA, 12 bp, Homo sapiens
aagatgaaataa

SEQ ID NO: 3229168 - DNA, 14 bp, Homo sapiens
aagatgaactctga

SEQ ID NO: 3229169 - DNA, 19 bp, Homo sapiens
aagatgaatacattttgtt

SEQ ID NO: 3229170 - DNA, 16 bp, Homo sapiens
aagatgaggttctgag

SEQ ID NO: 3229171 - DNA, 12 bp, Homo sapiens
aagatgagttgg

SEQ ID NO: 3229172 - DNA, 17 bp, Homo sapiens
aagatgatctactcaga

SEQ ID NO: 3229173 - DNA, 12 bp, Homo sapiens
aagatgcactga

SEQ ID NO: 3229174 - DNA, 23 bp, Homo sapiens
aagatgcactgaaaacttagcca

SEQ ID NO: 3229175 - DNA, 16 bp, Homo sapiens
aagatgccatctgtgt

SEQ ID NO: 3229176 - DNA, 20 bp, Homo sapiens
aagatgctgggttggtgcac

SEQ ID NO: 3229177 - DNA, 16 bp, Homo sapiens
aagatggagtttctaa

SEQ ID NO: 3229178 - DNA, 18 bp, Homo sapiens
aagatggataaactgagc

SEQ ID NO: 3229179 - DNA, 16 bp, Homo sapiens
aagatggctgtgcctc

SEQ ID NO: 3229180 - DNA, 20 bp, Homo sapiens
aagatggctgtgcctctgcc

SEQ ID NO: 3229181 - DNA, 23 bp, Homo sapiens
aagatggctgtgcctctgcctgt

SEQ ID NO: 3229182 - DNA, 15 bp, Homo sapiens
aagatggttgaccaa

SEQ ID NO: 3229183 - DNA, 23 bp, Homo sapiens
aagatgtctcaggtttgttttgt

SEQ ID NO: 3229184 - DNA, 16 bp, Homo sapiens
aagatgtgatattcta

SEQ ID NO: 3229185 - DNA, 17 bp, Homo sapiens
aagatgtgatattctaa

SEQ ID NO: 3229186 - DNA, 19 bp, Homo sapiens
aagatgtgatattctaaga

SEQ ID NO: 3229187 - DNA, 17 bp, Homo sapiens
aagatgttaagcattta

SEQ ID NO: 3229188 - DNA, 16 bp, Homo sapiens
aagatgttatggtgtt

SEQ ID NO: 3229189 - DNA, 20 bp, Homo sapiens
aagatgttatggtgtttaga

SEQ ID NO: 3229190 - DNA, 15 bp, Homo sapiens
aagatgttgaagaat

SEQ ID NO: 3229191 - DNA, 12 bp, Homo sapiens
aagatgttgttt

SEQ ID NO: 3229192 - DNA, 17 bp, Homo sapiens
aagattaaacagatgat

SEQ ID NO: 3229193 - DNA, 12 bp, Homo sapiens
aagattaaagga

SEQ ID NO: 3229194 - DNA, 15 bp, Homo sapiens
aagattaaaggaagg

SEQ ID NO: 3229195 - DNA, 18 bp, Homo sapiens
aagattaaatgtgtcatt

SEQ ID NO: 3229196 - DNA, 11 bp, Homo sapiens
aagattagaag

SEQ ID NO: 3229197 - DNA, 22 bp, Homo sapiens
aagattagcaaggtcatttctt

SEQ ID NO: 3229198 - DNA, 24 bp, Homo sapiens
aagattagcaaggtcatttcttca

SEQ ID NO: 3229199 - DNA, 18 bp, Homo sapiens
aagattaggagaaacaca

SEQ ID NO: 3229200 - DNA, 16 bp, Homo sapiens
aagattagtttcaatg

SEQ ID NO: 3229201 - DNA, 17 bp, Homo sapiens
aagattagtttcaatgt

SEQ ID NO: 3229202 - DNA, 15 bp, Homo sapiens
aagattatagattct

SEQ ID NO: 3229203 - DNA, 20 bp, Homo sapiens
aagattatgatgcatacagt

SEQ ID NO: 3229204 - DNA, 21 bp, Homo sapiens
aagattatgatgcatacagtt

SEQ ID NO: 3229205 - DNA, 20 bp, Homo sapiens
aagattcatatttacttctt

SEQ ID NO: 3229206 - DNA, 21 bp, Homo sapiens
aagattccacagagatgttta

SEQ ID NO: 3229207 - DNA, 11 bp, Homo sapiens
aagattctaaa

SEQ ID NO: 3229208 - DNA, 12 bp, Homo sapiens
aagattctaaag

SEQ ID NO: 3229209 - DNA, 16 bp, Homo sapiens
aagattctaatgatga

SEQ ID NO: 3229210 - DNA, 23 bp, Homo sapiens
aagattctactcttgtcattttt

SEQ ID NO: 3229211 - DNA, 12 bp, Homo sapiens
aagattctagat

SEQ ID NO: 3229212 - DNA, 19 bp, Homo sapiens
aagattctatagttctaga

SEQ ID NO: 3229213 - DNA, 20 bp, Homo sapiens
aagattctatagttctagac

SEQ ID NO: 3229214 - DNA, 12 bp, Homo sapiens
aagattgctgaa

SEQ ID NO: 3229215 - DNA, 15 bp, Homo sapiens
aagattgctgaaatt

SEQ ID NO: 3229216 - DNA, 23 bp, Homo sapiens
aagattgtattactttaatgatt

SEQ ID NO: 3229217 - DNA, 23 bp, Homo sapiens
aagattgttgataggaactgtct

SEQ ID NO: 3229218 - DNA, 13 bp, Homo sapiens
aagatttagaaaa

SEQ ID NO: 3229219 - DNA, 17 bp, Homo sapiens
aagatttccaagtgcca

SEQ ID NO: 3229220 - DNA, 18 bp, Homo sapiens
aagatttccttaaaatct

SEQ ID NO: 3229221 - DNA, 15 bp, Homo sapiens
aagatttgcccattt

SEQ ID NO: 3229222 - DNA, 16 bp, Homo sapiens
aagatttgtgaactgg

SEQ ID NO: 3229223 - DNA, 18 bp, Homo sapiens
aagatttgtgaactggaa

SEQ ID NO: 3229224 - DNA, 19 bp, Homo sapiens
aagatttgtgaactggaag

SEQ ID NO: 3229225 - DNA, 13 bp, Homo sapiens
aagattttaaatt

SEQ ID NO: 3229226 - DNA, 18 bp, Homo sapiens
aagattttaatcaagttg

SEQ ID NO: 3229227 - DNA, 14 bp, Homo sapiens
aagattttagggct

SEQ ID NO: 3229228 - DNA, 19 bp, Homo sapiens
aagattttagggcttttat

SEQ ID NO: 3229229 - DNA, 15 bp, Homo sapiens
aagattttattgtat

SEQ ID NO: 3229230 - DNA, 20 bp, Homo sapiens
aagattttattgtataaaaa

SEQ ID NO: 3229231 - DNA, 19 bp, Homo sapiens
aagattttcctcttgtgat

SEQ ID NO: 3229232 - DNA, 20 bp, Homo sapiens
aagattttcctcttgtgatt

SEQ ID NO: 3229233 - DNA, 23 bp, Homo sapiens
aagattttctgggcctaaaggat

SEQ ID NO: 3229234 - DNA, 21 bp, Homo sapiens
aagattttggaggagaaggac

SEQ ID NO: 3229235 - DNA, 15 bp, Homo sapiens
aagatttttctcaaa

SEQ ID NO: 3229236 - DNA, 19 bp, Homo sapiens
aagatttttctcaaagttt

SEQ ID NO: 3229237 - DNA, 21 bp, Homo sapiens
aagatttttctcaaagttttg

SEQ ID NO: 3229238 - DNA, 21 bp, Homo sapiens
aagcaaaaatgacaacagaaa

SEQ ID NO: 3229239 - DNA, 20 bp, Homo sapiens
aagcaaaaggctgagaagga

SEQ ID NO: 3229240 - DNA, 13 bp, Homo sapiens
aagcaaacatcaa

SEQ ID NO: 3229241 - DNA, 17 bp, Homo sapiens
aagcaaacatcaaataa

SEQ ID NO: 3229242 - DNA, 21 bp, Homo sapiens
aagcaaactctaaaattataa

SEQ ID NO: 3229243 - DNA, 21 bp, Homo sapiens
aagcaaagcacccatttcaat

SEQ ID NO: 3229244 - DNA, 17 bp, Homo sapiens
aagcaaatcagaaactt

SEQ ID NO: 3229245 - DNA, 13 bp, Homo sapiens
aagcaaatttcaa

SEQ ID NO: 3229246 - DNA, 19 bp, Homo sapiens
aagcaacaaagagcgagtc

SEQ ID NO: 3229247 - DNA, 20 bp, Homo sapiens
aagcaacaaagattgagaag

SEQ ID NO: 3229248 - DNA, 14 bp, Homo sapiens
aagcaacatggctt

SEQ ID NO: 3229249 - DNA, 18 bp, Homo sapiens
aagcaacctgggtccaaa

SEQ ID NO: 3229250 - DNA, 14 bp, Homo sapiens
aagcaagaaacagt

SEQ ID NO: 3229251 - DNA, 17 bp, Homo sapiens
aagcaagagagatgttt

SEQ ID NO: 3229252 - DNA, 23 bp, Homo sapiens
aagcaagaggcaagctgaaattt

SEQ ID NO: 3229253 - DNA, 20 bp, Homo sapiens
aagcaaggaagatatacatg

SEQ ID NO: 3229254 - DNA, 13 bp, Homo sapiens
aagcaagggagaa

SEQ ID NO: 3229255 - DNA, 21 bp, Homo sapiens
aagcaagggagaaaagagaaa

SEQ ID NO: 3229256 - DNA, 22 bp, Homo sapiens
aagcaagggagaaaagagaaac

SEQ ID NO: 3229257 - DNA, 16 bp, Homo sapiens
aagcaagtagctttcc

SEQ ID NO: 3229258 - DNA, 21 bp, Homo sapiens
aagcaataatggtcccatcca

SEQ ID NO: 3229259 - DNA, 22 bp, Homo sapiens
aagcaataatggtcccatccag

SEQ ID NO: 3229260 - DNA, 14 bp, Homo sapiens
aagcaataattgtt

SEQ ID NO: 3229261 - DNA, 15 bp, Homo sapiens
aagcaataattgttt

SEQ ID NO: 3229262 - DNA, 18 bp, Homo sapiens
aagcaataattgtttcca

SEQ ID NO: 3229263 - DNA, 12 bp, Homo sapiens
aagcaatgcaag

SEQ ID NO: 3229264 - DNA, 22 bp, Homo sapiens
aagcaatgctgatgaatcactg

SEQ ID NO: 3229265 - DNA, 15 bp, Homo sapiens
aagcacaaactttag

SEQ ID NO: 3229266 - DNA, 23 bp, Homo sapiens
aagcacaagcagagtgcacagct

SEQ ID NO: 3229267 - DNA, 14 bp, Homo sapiens
aagcacacttgtag

SEQ ID NO: 3229268 - DNA, 18 bp, Homo sapiens
aagcacaggagacactgt

SEQ ID NO: 3229269 - DNA, 18 bp, Homo sapiens
aagcacagtgttaaatga

SEQ ID NO: 3229270 - DNA, 15 bp, Homo sapiens
aagcacccatttcaa

SEQ ID NO: 3229271 - DNA, 16 bp, Homo sapiens
aagcacctactatgtg

SEQ ID NO: 3229272 - DNA, 13 bp, Homo sapiens
aagcacctcctgc

SEQ ID NO: 3229273 - DNA, 14 bp, Homo sapiens
aagcacctcctgcc

SEQ ID NO: 3229274 - DNA, 20 bp, Homo sapiens
aagcactaaaaagttgaacc

SEQ ID NO: 3229275 - DNA, 23 bp, Homo sapiens
aagcactacaccttgccttgctg

SEQ ID NO: 3229276 - DNA, 13 bp, Homo sapiens
aagcactagagaa

SEQ ID NO: 3229277 - DNA, 16 bp, Homo sapiens
aagcactattttatat

SEQ ID NO: 3229278 - DNA, 13 bp, Homo sapiens
aagcactgtgcta

SEQ ID NO: 3229279 - DNA, 18 bp, Homo sapiens
aagcacttcacagctgga

SEQ ID NO: 3229280 - DNA, 20 bp, Homo sapiens
aagcacttggactcttgctc

SEQ ID NO: 3229281 - DNA, 22 bp, Homo sapiens
aaggcctggaaccagggaggag

SEQ ID NO: 3229282 - DNA, 13 bp, Homo sapiens
aaggcctggctgg

SEQ ID NO: 3229283 - DNA, 23 bp, Homo sapiens
aaggcctgggctggcctggcagt

SEQ ID NO: 3229284 - DNA, 12 bp, Homo sapiens
aaggcctgggtg

SEQ ID NO: 3229285 - DNA, 20 bp, Homo sapiens
aaggcgagtccaggagctca

SEQ ID NO: 3229286 - DNA, 15 bp, Homo sapiens
aaggctcagaggagc

SEQ ID NO: 3229287 - DNA, 15 bp, Homo sapiens
aaggctccaagacct

SEQ ID NO: 3229288 - DNA, 19 bp, Homo sapiens
aaggctctcacccccatcc

SEQ ID NO: 3229289 - DNA, 16 bp, Homo sapiens
aaggctctgagagtct

SEQ ID NO: 3229290 - DNA, 15 bp, Homo sapiens
aaggctgaccaagag

SEQ ID NO: 3229291 - DNA, 14 bp, Homo sapiens
aaggctgagaagga

SEQ ID NO: 3229292 - DNA, 20 bp, Homo sapiens
aaggctgccaacggggagcg

SEQ ID NO: 3229293 - DNA, 20 bp, Homo sapiens
aaggctggccagcaaggcag

SEQ ID NO: 3229294 - DNA, 22 bp, Homo sapiens
aaggctggccagcaaggcaggt

SEQ ID NO: 3229295 - DNA, 14 bp, Homo sapiens
aaggctggctgtgt

SEQ ID NO: 3229296 - DNA, 14 bp, Homo sapiens
aaggcttgggattt

SEQ ID NO: 3229297 - DNA, 19 bp, Homo sapiens
aaggcttgggatttgctgt

SEQ ID NO: 3229298 - DNA, 16 bp, Homo sapiens
aagggaaacaaagaag

SEQ ID NO: 3229299 - DNA, 15 bp, Homo sapiens
aagggaaagtttttt

SEQ ID NO: 3229300 - DNA, 16 bp, Homo sapiens
aagggaaatatcattt

SEQ ID NO: 3229301 - DNA, 14 bp, Homo sapiens
aagggaacagaaag

SEQ ID NO: 3229302 - DNA, 17 bp, Homo sapiens
aagggaatcctcctcca

SEQ ID NO: 3229303 - DNA, 12 bp, Homo sapiens
aagggagaagaa

SEQ ID NO: 3229304 - DNA, 15 bp, Homo sapiens
aagggagaagaaagg

SEQ ID NO: 3229305 - DNA, 13 bp, Homo sapiens
aagggagaatata

SEQ ID NO: 3229306 - DNA, 17 bp, Homo sapiens
aagggagagacctcatc

SEQ ID NO: 3229307 - DNA, 15 bp, Homo sapiens
aagggagtttttgat

SEQ ID NO: 3229308 - DNA, 16 bp, Homo sapiens
aagggatcctgcctgc

SEQ ID NO: 3229309 - DNA, 15 bp, Homo sapiens
aagggatggaaaagg

SEQ ID NO: 3229310 - DNA, 21 bp, Homo sapiens
aagggatggaaaaggaagact

SEQ ID NO: 3229311 - DNA, 20 bp, Homo sapiens
aagggattggtttggcaaga

SEQ ID NO: 3229312 - DNA, 15 bp, Homo sapiens
aagggatttcttagg

SEQ ID NO: 3229313 - DNA, 15 bp, Homo sapiens
aagggcaaataatga

SEQ ID NO: 3229314 - DNA, 21 bp, Homo sapiens
aagggcacttaatttgtaaac

SEQ ID NO: 3229315 - DNA, 19 bp, Homo sapiens
aagggcagagaatggctgg

SEQ ID NO: 3229316 - DNA, 22 bp, Homo sapiens
aagggcagggcccacgtgtata

SEQ ID NO: 3229317 - DNA, 17 bp, Homo sapiens
aagggcaggtcttcata

SEQ ID NO: 3229318 - DNA, 18 bp, Homo sapiens
aagggcaggtcttcatat

SEQ ID NO: 3229319 - DNA, 17 bp, Homo sapiens
aagggcatcaggcactg

SEQ ID NO: 3229320 - DNA, 13 bp, Homo sapiens
aagggcatgcctt

SEQ ID NO: 3229321 - DNA, 16 bp, Homo sapiens
aagggcatgccttgtg

SEQ ID NO: 3229322 - DNA, 21 bp, Homo sapiens
aagggccagcgtggctctaaa

SEQ ID NO: 3229323 - DNA, 11 bp, Homo sapiens
aagggcccagg

SEQ ID NO: 3229324 - DNA, 13 bp, Homo sapiens
aagggccctggca

SEQ ID NO: 3229325 - DNA, 23 bp, Homo sapiens
aagggcctgcccagttgcactca

SEQ ID NO: 3229326 - DNA, 12 bp, Homo sapiens
aagggctccagc

SEQ ID NO: 3229327 - DNA, 21 bp, Homo sapiens
aagggctccagcatccagcct

SEQ ID NO: 3229328 - DNA, 23 bp, Homo sapiens
aagggctccagcatccagcctgt

SEQ ID NO: 3229329 - DNA, 19 bp, Homo sapiens
aagggctctttctctctgc

SEQ ID NO: 3229330 - DNA, 17 bp, Homo sapiens
aagggctgacctgcctc

SEQ ID NO: 3229331 - DNA, 13 bp, Homo sapiens
aagggctgggtgt

SEQ ID NO: 3229332 - DNA, 15 bp, Homo sapiens
aagggcttactattt

SEQ ID NO: 3229333 - DNA, 17 bp, Homo sapiens
aagggcttctgcaccct

SEQ ID NO: 3229334 - DNA, 22 bp, Homo sapiens
aagggcttctgcaccctccacc

SEQ ID NO: 3229335 - DNA, 23 bp, Homo sapiens
aaggggaatgtttgcctctgcct

SEQ ID NO: 3229336 - DNA, 23 bp, Homo sapiens
aaggggagaaactgaaagtgttt

SEQ ID NO: 3229337 - DNA, 16 bp, Homo sapiens
aaggggagaagggaat

SEQ ID NO: 3229338 - DNA, 18 bp, Homo sapiens
aaggggagagcctgctgg

SEQ ID NO: 3229339 - DNA, 14 bp, Homo sapiens
aaggggaggcagcc

SEQ ID NO: 3229340 - DNA, 13 bp, Homo sapiens
aaggggagttgag

SEQ ID NO: 3229341 - DNA, 21 bp, Homo sapiens
aaggggcacaccactgccctg

SEQ ID NO: 3229342 - DNA, 17 bp, Homo sapiens
aaggggccccggggctg

SEQ ID NO: 3229343 - DNA, 14 bp, Homo sapiens
aaggggccctggtc

SEQ ID NO: 3229344 - DNA, 12 bp, Homo sapiens
aagggggccctg

SEQ ID NO: 3229345 - DNA, 13 bp, Homo sapiens
aagggggccctgc

SEQ ID NO: 3229346 - DNA, 14 bp, Homo sapiens
aagggggccctgct

SEQ ID NO: 3229347 - DNA, 15 bp, Homo sapiens
aagggggccctgcta

SEQ ID NO: 3229348 - DNA, 16 bp, Homo sapiens
aaggggggagggggag

SEQ ID NO: 3229349 - DNA, 17 bp, Homo sapiens
aagggggtcccagtggg

SEQ ID NO: 3229350 - DNA, 19 bp, Homo sapiens
aagggggtcccagtgggag

SEQ ID NO: 3229351 - DNA, 14 bp, Homo sapiens
aaggggtgctttta

SEQ ID NO: 3229352 - DNA, 20 bp, Homo sapiens
aaggggtgggtcagaacatg

SEQ ID NO: 3229353 - DNA, 22 bp, Homo sapiens
aaggggtgggtcagaacatgtt

SEQ ID NO: 3229354 - DNA, 13 bp, Homo sapiens
aagggtagctggg

SEQ ID NO: 3229355 - DNA, 17 bp, Homo sapiens
aagggtatcaggtgctg

SEQ ID NO: 3229356 - DNA, 19 bp, Homo sapiens
aagggtatcaggtgctgcc

SEQ ID NO: 3229357 - DNA, 19 bp, Homo sapiens
aagggtcgaaagctctaga

SEQ ID NO: 3229358 - DNA, 16 bp, Homo sapiens
aagggtgggtgctcag

SEQ ID NO: 3229359 - DNA, 22 bp, Homo sapiens
aagggttaatcatatttgaaaa

SEQ ID NO: 3229360 - DNA, 17 bp, Homo sapiens
aagggtttgtggctggg

SEQ ID NO: 3229361 - DNA, 19 bp, Homo sapiens
aagggttttccaccctgga

SEQ ID NO: 3229362 - DNA, 13 bp, Homo sapiens
aaggtaattgttt

SEQ ID NO: 3229363 - DNA, 23 bp, Homo sapiens
aaggtaatttgatggtatttctt

SEQ ID NO: 3229364 - DNA, 12 bp, Homo sapiens
aaggtagctcta

SEQ ID NO: 3229365 - DNA, 16 bp, Homo sapiens
aaggtataaataataa

SEQ ID NO: 3229366 - DNA, 18 bp, Homo sapiens
aaggtattaaattgatgt

SEQ ID NO: 3229367 - DNA, 22 bp, Homo sapiens
aaggtattatacatgtgataca

SEQ ID NO: 3229368 - DNA, 18 bp, Homo sapiens
aaggtattccttttgtgt

SEQ ID NO: 3229369 - DNA, 17 bp, Homo sapiens
aaggtcatttcttcagt

SEQ ID NO: 3229370 - DNA, 19 bp, Homo sapiens
aaggtccggtgttctaaga

SEQ ID NO: 3229371 - DNA, 21 bp, Homo sapiens
aaggtccggtgttctaagatg

SEQ ID NO: 3229372 - DNA, 14 bp, Homo sapiens
aaggtcctctcagt

SEQ ID NO: 3229373 - DNA, 13 bp, Homo sapiens
aaggtcctgccct

SEQ ID NO: 3229374 - DNA, 21 bp, Homo sapiens
aaggtctccttactctgagcc

SEQ ID NO: 3229375 - DNA, 23 bp, Homo sapiens
aaggtcttgcagtggcttttcat

SEQ ID NO: 3229376 - DNA, 12 bp, Homo sapiens
aaggtctttcag

SEQ ID NO: 3229377 - DNA, 19 bp, Homo sapiens
aaggtctttggttcagcta

SEQ ID NO: 3229378 - DNA, 20 bp, Homo sapiens
aaggtgacacattacaaagc

SEQ ID NO: 3229379 - DNA, 20 bp, Homo sapiens
aaggtgacagaaggaccagc

SEQ ID NO: 3229380 - DNA, 20 bp, Homo sapiens
aaggtgagtttgagctgcct

SEQ ID NO: 3229381 - DNA, 22 bp, Homo sapiens
aaggtgagtttgagctgccttc

SEQ ID NO: 3229382 - DNA, 23 bp, Homo sapiens
aaggtgcagttcccccaacctca

SEQ ID NO: 3229383 - DNA, 13 bp, Homo sapiens
aaggtgccacttt

SEQ ID NO: 3229384 - DNA, 17 bp, Homo sapiens
aaggtggaataaacatt

SEQ ID NO: 3229385 - DNA, 21 bp, Homo sapiens
aaggtggaataaacattaatt

SEQ ID NO: 3229386 - DNA, 19 bp, Homo sapiens
aaggtggatggccccagca

SEQ ID NO: 3229387 - DNA, 21 bp, Homo sapiens
aaggtggattttaaaaattgg

SEQ ID NO: 3229388 - DNA, 17 bp, Homo sapiens
aaggtgggccttgctac

SEQ ID NO: 3229389 - DNA, 22 bp, Homo sapiens
aaggtgggccttgctacctcaa

SEQ ID NO: 3229390 - DNA, 18 bp, Homo sapiens
aaggtgggctgagccctg

SEQ ID NO: 3229391 - DNA, 19 bp, Homo sapiens
aaggtgggctgagccctgg

SEQ ID NO: 3229392 - DNA, 20 bp, Homo sapiens
aaggtgggctgagccctggc

SEQ ID NO: 3229393 - DNA, 21 bp, Homo sapiens
aaggtgggctgagccctggca

SEQ ID NO: 3229394 - DNA, 22 bp, Homo sapiens
aaggtggtatgtaatttatgca

SEQ ID NO: 3229395 - DNA, 21 bp, Homo sapiens
aaggttccaactgtatatatt

SEQ ID NO: 3229396 - DNA, 17 bp, Homo sapiens
aaggttctcataggaaa

SEQ ID NO: 3229397 - DNA, 16 bp, Homo sapiens
aaggttcttctaaaat

SEQ ID NO: 3229398 - DNA, 13 bp, Homo sapiens
aaggttgaataat

SEQ ID NO: 3229399 - DNA, 20 bp, Homo sapiens
aaggtttaaagagtctagat

SEQ ID NO: 3229400 - DNA, 15 bp, Homo sapiens
aaggttttaggttct

SEQ ID NO: 3229401 - DNA, 20 bp, Homo sapiens
aaggttttaggttctaaagt

SEQ ID NO: 3229402 - DNA, 23 bp, Homo sapiens
aaggttttaggttctaaagttct

SEQ ID NO: 3229403 - DNA, 23 bp, Homo sapiens
aaggttttggatcttgaatgtgg

SEQ ID NO: 3229404 - DNA, 19 bp, Homo sapiens
aaggttttggttgcattat

SEQ ID NO: 3229405 - DNA, 15 bp, Homo sapiens
aaggttttgtatttt

SEQ ID NO: 3229406 - DNA, 15 bp, Homo sapiens
aattcatttttttca

SEQ ID NO: 3229407 - DNA, 18 bp, Homo sapiens
aattccaaagtctctaat

SEQ ID NO: 3229408 - DNA, 20 bp, Homo sapiens
aattccacaccttttattga

SEQ ID NO: 3229409 - DNA, 22 bp, Homo sapiens
aattccactgtcaagaaagagc

SEQ ID NO: 3229410 - DNA, 20 bp, Homo sapiens
aattccagaaaggatattta

SEQ ID NO: 3229411 - DNA, 19 bp, Homo sapiens
aattccatatgctccagga

SEQ ID NO: 3229412 - DNA, 17 bp, Homo sapiens
aattcccattttgcaaa

SEQ ID NO: 3229413 - DNA, 20 bp, Homo sapiens
aattcccgttttgtcacttt

SEQ ID NO: 3229414 - DNA, 21 bp, Homo sapiens
aattcccgttttgtcactttt

SEQ ID NO: 3229415 - DNA, 23 bp, Homo sapiens
aattccctatcttttagttttag

SEQ ID NO: 3229416 - DNA, 15 bp, Homo sapiens
aattcccttttaatc

SEQ ID NO: 3229417 - DNA, 20 bp, Homo sapiens
aattcctagataaaaagatg

SEQ ID NO: 3229418 - DNA, 14 bp, Homo sapiens
aattcctctgggaa

SEQ ID NO: 3229419 - DNA, 11 bp, Homo sapiens
aattcctgggc

SEQ ID NO: 3229420 - DNA, 19 bp, Homo sapiens
aattccttgccccacagtt

SEQ ID NO: 3229421 - DNA, 21 bp, Homo sapiens
aattcgcccgagctgtttatg

SEQ ID NO: 3229422 - DNA, 19 bp, Homo sapiens
aattctaaatgaatgttta

SEQ ID NO: 3229423 - DNA, 17 bp, Homo sapiens
aattctaacccaggtat

SEQ ID NO: 3229424 - DNA, 23 bp, Homo sapiens
aattctaggcatcccaggggacc

SEQ ID NO: 3229425 - DNA, 14 bp, Homo sapiens
aattctatgttaaa

SEQ ID NO: 3229426 - DNA, 21 bp, Homo sapiens
aattctatgttaaatactgtg

SEQ ID NO: 3229427 - DNA, 23 bp, Homo sapiens
aattctatgttaaatactgtgca

SEQ ID NO: 3229428 - DNA, 15 bp, Homo sapiens
aattctcaaagtttt

SEQ ID NO: 3229429 - DNA, 20 bp, Homo sapiens
aattctcctgcctcagcctc

SEQ ID NO: 3229430 - DNA, 21 bp, Homo sapiens
aattctgagaaaacttctttt

SEQ ID NO: 3229431 - DNA, 15 bp, Homo sapiens
aattctgattgattt

SEQ ID NO: 3229432 - DNA, 12 bp, Homo sapiens
aattctggaaac

SEQ ID NO: 3229433 - DNA, 19 bp, Homo sapiens
aattctgtacatagcctat

SEQ ID NO: 3229434 - DNA, 23 bp, Homo sapiens
aattctgtgggtccgataatatc

SEQ ID NO: 3229435 - DNA, 22 bp, Homo sapiens
aattctgttggtgccacgcttt

SEQ ID NO: 3229436 - DNA, 17 bp, Homo sapiens
aattctgttgttccatt

SEQ ID NO: 3229437 - DNA, 22 bp, Homo sapiens
aattctgtttttaatgctattt

SEQ ID NO: 3229438 - DNA, 23 bp, Homo sapiens
aattcttaaaaggcccatagcag

SEQ ID NO: 3229439 - DNA, 16 bp, Homo sapiens
aattcttaagtatgtt

SEQ ID NO: 3229440 - DNA, 18 bp, Homo sapiens
aattcttattttagaaat

SEQ ID NO: 3229441 - DNA, 19 bp, Homo sapiens
aattcttattttagaaatt

SEQ ID NO: 3229442 - DNA, 23 bp, Homo sapiens
aattcttcacctgttatgtatga

SEQ ID NO: 3229443 - DNA, 23 bp, Homo sapiens
aattcttctgaactcaaactgag

SEQ ID NO: 3229444 - DNA, 15 bp, Homo sapiens
aattcttctgtcctg

SEQ ID NO: 3229445 - DNA, 21 bp, Homo sapiens
aattcttgaaggaaaatgata

SEQ ID NO: 3229446 - DNA, 16 bp, Homo sapiens
aattctttatttctgt

SEQ ID NO: 3229447 - DNA, 20 bp, Homo sapiens
aattctttatttctgtcatt

SEQ ID NO: 3229448 - DNA, 12 bp, Homo sapiens
aattctttctat

SEQ ID NO: 3229449 - DNA, 17 bp, Homo sapiens
aattctttgttctgttt

SEQ ID NO: 3229450 - DNA, 18 bp, Homo sapiens
aattgaagccagaccatg

SEQ ID NO: 3229451 - DNA, 16 bp, Homo sapiens
aattgaagtttcaagt

SEQ ID NO: 3229452 - DNA, 21 bp, Homo sapiens
aattgaatcagtataaacaaa

SEQ ID NO: 3229453 - DNA, 15 bp, Homo sapiens
aattgacaaatgatg

SEQ ID NO: 3229454 - DNA, 14 bp, Homo sapiens
aattgacatgttgt

SEQ ID NO: 3229455 - DNA, 19 bp, Homo sapiens
aattgaccatctgctttta

SEQ ID NO: 3229456 - DNA, 14 bp, Homo sapiens
aattgactgtcact

SEQ ID NO: 3229457 - DNA, 21 bp, Homo sapiens
aattgagtaatggtgtagaac

SEQ ID NO: 3229458 - DNA, 15 bp, Homo sapiens
aattgatgtatatgt

SEQ ID NO: 3229459 - DNA, 14 bp, Homo sapiens
aattgattattctg

SEQ ID NO: 3229460 - DNA, 22 bp, Homo sapiens
aattgatttcttttcttcctgg

SEQ ID NO: 3229461 - DNA, 22 bp, Homo sapiens
aattgatttttctcttcatttt

SEQ ID NO: 3229462 - DNA, 20 bp, Homo sapiens
aattgcaaaaacatagaaat

SEQ ID NO: 3229463 - DNA, 15 bp, Homo sapiens
aattgcactaaatga

SEQ ID NO: 3229464 - DNA, 23 bp, Homo sapiens
aattgcactgaagtttttgaaat

SEQ ID NO: 3229465 - DNA, 15 bp, Homo sapiens
aattgcactgctgtt

SEQ ID NO: 3229466 - DNA, 18 bp, Homo sapiens
aattgcacttttaaacct

SEQ ID NO: 3229467 - DNA, 11 bp, Homo sapiens
aattgcattga

SEQ ID NO: 3229468 - DNA, 19 bp, Homo sapiens
aattgctaaatataaaaac

SEQ ID NO: 3229469 - DNA, 13 bp, Homo sapiens
aattgctatgtta

SEQ ID NO: 3229470 - DNA, 20 bp, Homo sapiens
aattgctatgttactatttt

SEQ ID NO: 3229471 - DNA, 21 bp, Homo sapiens
aattgctcatgcatagtccca

SEQ ID NO: 3229472 - DNA, 19 bp, Homo sapiens
aattgctcatgttggccaa

SEQ ID NO: 3229473 - DNA, 21 bp, Homo sapiens
aattgctcctaactccaccgc

SEQ ID NO: 3229474 - DNA, 12 bp, Homo sapiens
aattgctccttg

SEQ ID NO: 3229475 - DNA, 23 bp, Homo sapiens
aattgctgaagggcattctttcc

SEQ ID NO: 3229476 - DNA, 17 bp, Homo sapiens
aattgcttaaaagacat

SEQ ID NO: 3229477 - DNA, 19 bp, Homo sapiens
aattgcttaaaagacattt

SEQ ID NO: 3229478 - DNA, 20 bp, Homo sapiens
aattgctttgccaaaatacc

SEQ ID NO: 3229479 - DNA, 20 bp, Homo sapiens
aattgcttttgttgtgactt

SEQ ID NO: 3229480 - DNA, 20 bp, Homo sapiens
aattggaacagaatgtttta

SEQ ID NO: 3229481 - DNA, 19 bp, Homo sapiens
aattggactttcaaaatta

SEQ ID NO: 3229482 - DNA, 22 bp, Homo sapiens
aattggatattgatgaaatcat

SEQ ID NO: 3229483 - DNA, 17 bp, Homo sapiens
aattggatttcctaata

SEQ ID NO: 3229484 - DNA, 15 bp, Homo sapiens
aattggcagtgactt

SEQ ID NO: 3229485 - DNA, 18 bp, Homo sapiens
aattggcagtggcagaga

SEQ ID NO: 3229486 - DNA, 16 bp, Homo sapiens
aattggtgataagtgg

SEQ ID NO: 3229487 - DNA, 17 bp, Homo sapiens
aattggtgataagtgga

SEQ ID NO: 3229488 - DNA, 14 bp, Homo sapiens
aattgtaaactgta

SEQ ID NO: 3229489 - DNA, 17 bp, Homo sapiens
aattgtaaactgtacta

SEQ ID NO: 3229490 - DNA, 17 bp, Homo sapiens
aattgtaaattgaatca

SEQ ID NO: 3229491 - DNA, 13 bp, Homo sapiens
aattgtacaaaat

SEQ ID NO: 3229492 - DNA, 18 bp, Homo sapiens
aattgtacaaaattaagc

SEQ ID NO: 3229493 - DNA, 19 bp, Homo sapiens
aattgtacaaaattaagca

SEQ ID NO: 3229494 - DNA, 14 bp, Homo sapiens
aattgtacatattt

SEQ ID NO: 3229495 - DNA, 17 bp, Homo sapiens
aattgtagactgatgtt

SEQ ID NO: 3229496 - DNA, 18 bp, Homo sapiens
aattgtaggggtgtgtgt

SEQ ID NO: 3229497 - DNA, 18 bp, Homo sapiens
aattgtagttctgtgtac

SEQ ID NO: 3229498 - DNA, 20 bp, Homo sapiens
aattgtagttctgtgtactt

SEQ ID NO: 3229499 - DNA, 10 bp, Homo sapiens
aattgtataa

SEQ ID NO: 3229500 - DNA, 11 bp, Homo sapiens
aattgtataag

SEQ ID NO: 3229501 - DNA, 13 bp, Homo sapiens
aattgtatacatt

SEQ ID NO: 3229502 - DNA, 13 bp, Homo sapiens
aattgtatctagt

SEQ ID NO: 3229503 - DNA, 20 bp, Homo sapiens
aattgtatctagtgcagctg

SEQ ID NO: 3229504 - DNA, 14 bp, Homo sapiens
aattgtatgaaaat

SEQ ID NO: 3229505 - DNA, 11 bp, Homo sapiens
aattgtcatgg

SEQ ID NO: 3229506 - DNA, 17 bp, Homo sapiens
aattgtccgtgttcata

SEQ ID NO: 3229507 - DNA, 14 bp, Homo sapiens
aattgtctatttat

SEQ ID NO: 3229508 - DNA, 17 bp, Homo sapiens
aattgtctatttatctt

SEQ ID NO: 3229509 - DNA, 21 bp, Homo sapiens
aattgtctatttatcttttat

SEQ ID NO: 3229510 - DNA, 12 bp, Homo sapiens
aattgtctcttc

SEQ ID NO: 3229511 - DNA, 23 bp, Homo sapiens
aattgtcttttagacaactagat

SEQ ID NO: 3229512 - DNA, 21 bp, Homo sapiens
aattgtgcagtactttgtgca

SEQ ID NO: 3229513 - DNA, 16 bp, Homo sapiens
aattgtgcataatgct

SEQ ID NO: 3229514 - DNA, 17 bp, Homo sapiens
aattgtgcataatgctt

SEQ ID NO: 3229515 - DNA, 18 bp, Homo sapiens
aattgtgcataatgcttt

SEQ ID NO: 3229516 - DNA, 21 bp, Homo sapiens
aattgtgcataatgctttgga

SEQ ID NO: 3229517 - DNA, 20 bp, Homo sapiens
aattgtgcttctccccagaa

SEQ ID NO: 3229518 - DNA, 21 bp, Homo sapiens
aattgtgtaaaaaatggaaaa

SEQ ID NO: 3229519 - DNA, 23 bp, Homo sapiens
aattgtgtaaaaaatggaaaaaa

SEQ ID NO: 3229520 - DNA, 22 bp, Homo sapiens
aattgtgtacactttcattact

SEQ ID NO: 3229521 - DNA, 15 bp, Homo sapiens
aattgtgtagccttt

SEQ ID NO: 3229522 - DNA, 23 bp, Homo sapiens
aattgtgtcatgattaatgtgta

SEQ ID NO: 3229523 - DNA, 23 bp, Homo sapiens
aattgtgtgtctggtaactggaa

SEQ ID NO: 3229524 - DNA, 15 bp, Homo sapiens
aattgttaatgtgat

SEQ ID NO: 3229525 - DNA, 15 bp, Homo sapiens
aattgttgtttcttt

SEQ ID NO: 3229526 - DNA, 17 bp, Homo sapiens
aattgttgtttctttct

SEQ ID NO: 3229527 - DNA, 20 bp, Homo sapiens
aattgttgtttctttctagt

SEQ ID NO: 3229528 - DNA, 23 bp, Homo sapiens
aattgttgtttctttctagtggt

SEQ ID NO: 3229529 - DNA, 15 bp, Homo sapiens
aattgtttaagtgtt

SEQ ID NO: 3229530 - DNA, 20 bp, Homo sapiens
aattgtttaagtgttgtaaa

SEQ ID NO: 3229531 - DNA, 18 bp, Homo sapiens
acaagcgtgagccactgc

SEQ ID NO: 3229532 - DNA, 23 bp, Homo sapiens
acaagctattccctcaaatctga

SEQ ID NO: 3229533 - DNA, 15 bp, Homo sapiens
acaagctgacttggc

SEQ ID NO: 3229534 - DNA, 19 bp, Homo sapiens
acaagctgacttggcactt

SEQ ID NO: 3229535 - DNA, 16 bp, Homo sapiens
acaagctgtccctgca

SEQ ID NO: 3229536 - DNA, 13 bp, Homo sapiens
acaagctgtgcag

SEQ ID NO: 3229537 - DNA, 13 bp, Homo sapiens
acaaggaataaat

SEQ ID NO: 3229538 - DNA, 23 bp, Homo sapiens
acaaggaataaatgagagggaat

SEQ ID NO: 3229539 - DNA, 16 bp, Homo sapiens
acaaggaatgcctgtg

SEQ ID NO: 3229540 - DNA, 20 bp, Homo sapiens
acaaggaatgcctgtgccaa

SEQ ID NO: 3229541 - DNA, 20 bp, Homo sapiens
acaaggagctcaccctgccc

SEQ ID NO: 3229542 - DNA, 15 bp, Homo sapiens
acaaggattgaaaat

SEQ ID NO: 3229543 - DNA, 17 bp, Homo sapiens
acaaggattgaaaattc

SEQ ID NO: 3229544 - DNA, 13 bp, Homo sapiens
acaaggctgacca

SEQ ID NO: 3229545 - DNA, 20 bp, Homo sapiens
acaaggctgaccaagagaga

SEQ ID NO: 3229546 - DNA, 16 bp, Homo sapiens
acaagggagaaaagct

SEQ ID NO: 3229547 - DNA, 11 bp, Homo sapiens
acaagggattc

SEQ ID NO: 3229548 - DNA, 13 bp, Homo sapiens
acaagggattctg

SEQ ID NO: 3229549 - DNA, 21 bp, Homo sapiens
acaagggctctcaaagtataa

SEQ ID NO: 3229550 - DNA, 21 bp, Homo sapiens
acaagggctgacctgcctctc

SEQ ID NO: 3229551 - DNA, 18 bp, Homo sapiens
acaaggggctgttacata

SEQ ID NO: 3229552 - DNA, 14 bp, Homo sapiens
acaaggtagttttt

SEQ ID NO: 3229553 - DNA, 16 bp, Homo sapiens
acaaggtagtttttac

SEQ ID NO: 3229554 - DNA, 21 bp, Homo sapiens
acaaggtccactccctgctcc

SEQ ID NO: 3229555 - DNA, 19 bp, Homo sapiens
acaaggttggcaccccagc

SEQ ID NO: 3229556 - DNA, 17 bp, Homo sapiens
acaaggttggttgctaa

SEQ ID NO: 3229557 - DNA, 19 bp, Homo sapiens
acaagtatatacttttaaa

SEQ ID NO: 3229558 - DNA, 20 bp, Homo sapiens
acaagtatatgtgaaaaaaa

SEQ ID NO: 3229559 - DNA, 23 bp, Homo sapiens
acaagtatgaataaagacaccta

SEQ ID NO: 3229560 - DNA, 14 bp, Homo sapiens
acaagtcacagctg

SEQ ID NO: 3229561 - DNA, 17 bp, Homo sapiens
acaagtcctgtgaattt

SEQ ID NO: 3229562 - DNA, 17 bp, Homo sapiens
acaagtgagacaaaaag

SEQ ID NO: 3229563 - DNA, 14 bp, Homo sapiens
acaagtgccctcca

SEQ ID NO: 3229564 - DNA, 15 bp, Homo sapiens
acaagtgctcctgaa

SEQ ID NO: 3229565 - DNA, 19 bp, Homo sapiens
acaagtgtatatcagaaaa

SEQ ID NO: 3229566 - DNA, 20 bp, Homo sapiens
acaagtgtatatcagaaaag

SEQ ID NO: 3229567 - DNA, 17 bp, Homo sapiens
acaagttccctggagaa

SEQ ID NO: 3229568 - DNA, 18 bp, Homo sapiens
acaagttccctggagaaa

SEQ ID NO: 3229569 - DNA, 19 bp, Homo sapiens
acaagttgttattgttgaa

SEQ ID NO: 3229570 - DNA, 14 bp, Homo sapiens
acaagttttaaata

SEQ ID NO: 3229571 - DNA, 12 bp, Homo sapiens
acaagttttgta

SEQ ID NO: 3229572 - DNA, 21 bp, Homo sapiens
acaagttttgtataaataata

SEQ ID NO: 3229573 - DNA, 15 bp, Homo sapiens
acaagtttttctgtc

SEQ ID NO: 3229574 - DNA, 14 bp, Homo sapiens
acaataaaaatgtt

SEQ ID NO: 3229575 - DNA, 16 bp, Homo sapiens
acaataaaaatgttta

SEQ ID NO: 3229576 - DNA, 21 bp, Homo sapiens
acaataaacaggaattttatt

SEQ ID NO: 3229577 - DNA, 12 bp, Homo sapiens
acaataaagaga

SEQ ID NO: 3229578 - DNA, 13 bp, Homo sapiens
acaataaatgtat

SEQ ID NO: 3229579 - DNA, 18 bp, Homo sapiens
acaataaatgtattcaaa

SEQ ID NO: 3229580 - DNA, 17 bp, Homo sapiens
acaataacccagttact

SEQ ID NO: 3229581 - DNA, 16 bp, Homo sapiens
acaataactactgtgt

SEQ ID NO: 3229582 - DNA, 19 bp, Homo sapiens
acaataactactgtgttcc

SEQ ID NO: 3229583 - DNA, 21 bp, Homo sapiens
acaataactactgtgttcctg

SEQ ID NO: 3229584 - DNA, 18 bp, Homo sapiens
acaataatatttcaagtg

SEQ ID NO: 3229585 - DNA, 20 bp, Homo sapiens
acaataatatttcaagtgcc

SEQ ID NO: 3229586 - DNA, 14 bp, Homo sapiens
acaatacagataac

SEQ ID NO: 3229587 - DNA, 17 bp, Homo sapiens
acaatacagataacatt

SEQ ID NO: 3229588 - DNA, 18 bp, Homo sapiens
acaatacatgagaaagat

SEQ ID NO: 3229589 - DNA, 22 bp, Homo sapiens
acaatacctacaataaactggt

SEQ ID NO: 3229590 - DNA, 18 bp, Homo sapiens
acaataggtgcttattct

SEQ ID NO: 3229591 - DNA, 15 bp, Homo sapiens
acaatagtatttctc

SEQ ID NO: 3229592 - DNA, 17 bp, Homo sapiens
acaatagtatttctcct

SEQ ID NO: 3229593 - DNA, 21 bp, Homo sapiens
acaatataaccacaaagcaca

SEQ ID NO: 3229594 - DNA, 17 bp, Homo sapiens
acaatatcatatcatca

SEQ ID NO: 3229595 - DNA, 21 bp, Homo sapiens
acaatatgaatacagggcatg

SEQ ID NO: 3229596 - DNA, 12 bp, Homo sapiens
acaatattatgt

SEQ ID NO: 3229597 - DNA, 20 bp, Homo sapiens
acaatcaaaacacactacta

SEQ ID NO: 3229598 - DNA, 14 bp, Homo sapiens
acaatcaaatctcc

SEQ ID NO: 3229599 - DNA, 21 bp, Homo sapiens
acaatcaaatctcctgctgat

SEQ ID NO: 3229600 - DNA, 19 bp, Homo sapiens
acaatcactaaactttatt

SEQ ID NO: 3229601 - DNA, 17 bp, Homo sapiens
acaatcagtcccctccc

SEQ ID NO: 3229602 - DNA, 19 bp, Homo sapiens
acaatcagtcccctcccat

SEQ ID NO: 3229603 - DNA, 19 bp, Homo sapiens
acaatcatgaaatatgcat

SEQ ID NO: 3229604 - DNA, 22 bp, Homo sapiens
acaatccatgtgattaatgttt

SEQ ID NO: 3229605 - DNA, 17 bp, Homo sapiens
acaatcccaatctttct

SEQ ID NO: 3229606 - DNA, 16 bp, Homo sapiens
acaatcccacctagcc

SEQ ID NO: 3229607 - DNA, 21 bp, Homo sapiens
acaatcctgtttataatctga

SEQ ID NO: 3229608 - DNA, 12 bp, Homo sapiens
acaatctaacaa

SEQ ID NO: 3229609 - DNA, 19 bp, Homo sapiens
acaatctggcttagtgcca

SEQ ID NO: 3229610 - DNA, 15 bp, Homo sapiens
acaatgaatgtatat

SEQ ID NO: 3229611 - DNA, 21 bp, Homo sapiens
acaatgaatgtatattttgtg

SEQ ID NO: 3229612 - DNA, 21 bp, Homo sapiens
acaatgatgatgataatgatg

SEQ ID NO: 3229613 - DNA, 16 bp, Homo sapiens
acaatgcaacttttaa

SEQ ID NO: 3229614 - DNA, 19 bp, Homo sapiens
acaatgcacctagctgtgc

SEQ ID NO: 3229615 - DNA, 13 bp, Homo sapiens
acaatgcagcaag

SEQ ID NO: 3229616 - DNA, 14 bp, Homo sapiens
acaatgtataaaga

SEQ ID NO: 3229617 - DNA, 23 bp, Homo sapiens
acaatgtcagtatttcagtgtag

SEQ ID NO: 3229618 - DNA, 21 bp, Homo sapiens
acaatgtcgagtatattatta

SEQ ID NO: 3229619 - DNA, 19 bp, Homo sapiens
acaatgtgaactttattaa

SEQ ID NO: 3229620 - DNA, 14 bp, Homo sapiens
acaatgtgaatagt

SEQ ID NO: 3229621 - DNA, 23 bp, Homo sapiens
acaatgtgtgggataatgtcatt

SEQ ID NO: 3229622 - DNA, 15 bp, Homo sapiens
acaatgtgtttttct

SEQ ID NO: 3229623 - DNA, 22 bp, Homo sapiens
acaatgttaaggaaactcttat

SEQ ID NO: 3229624 - DNA, 22 bp, Homo sapiens
acaatgttgtccaacaataaac

SEQ ID NO: 3229625 - DNA, 23 bp, Homo sapiens
acaatgttgtccaacaataaaca

SEQ ID NO: 3229626 - DNA, 13 bp, Homo sapiens
acaatgtttgatg

SEQ ID NO: 3229627 - DNA, 21 bp, Homo sapiens
acaattaaaaacctgatggaa

SEQ ID NO: 3229628 - DNA, 17 bp, Homo sapiens
acaattactaaattgta

SEQ ID NO: 3229629 - DNA, 16 bp, Homo sapiens
acaattactcaggttt

SEQ ID NO: 3229630 - DNA, 17 bp, Homo sapiens
acaattatggaaatata

SEQ ID NO: 3229631 - DNA, 21 bp, Homo sapiens
acaattattccaaaccaaatt

SEQ ID NO: 3229632 - DNA, 15 bp, Homo sapiens
acaattcattggctc

SEQ ID NO: 3229633 - DNA, 15 bp, Homo sapiens
acaattctacattgt

SEQ ID NO: 3229634 - DNA, 15 bp, Homo sapiens
acaattctgttttta

SEQ ID NO: 3229635 - DNA, 22 bp, Homo sapiens
acaattgaagtaaactttttgt

SEQ ID NO: 3229636 - DNA, 21 bp, Homo sapiens
acaattgcaaatcagagcata

SEQ ID NO: 3229637 - DNA, 21 bp, Homo sapiens
acaattgcttactcattaaaa

SEQ ID NO: 3229638 - DNA, 23 bp, Homo sapiens
acaattggtaaaactcactgtga

SEQ ID NO: 3229639 - DNA, 18 bp, Homo sapiens
acaattgtgtagcctttt

SEQ ID NO: 3229640 - DNA, 21 bp, Homo sapiens
acaattgtgtagcctttttgt

SEQ ID NO: 3229641 - DNA, 24 bp, Homo sapiens
acaattgtgtataactggattgca

SEQ ID NO: 3229642 - DNA, 16 bp, Homo sapiens
acaattgttttaatct

SEQ ID NO: 3229643 - DNA, 22 bp, Homo sapiens
acaattgttttaatctgaaatt

SEQ ID NO: 3229644 - DNA, 23 bp, Homo sapiens
acaattgttttaatctgaaattc

SEQ ID NO: 3229645 - DNA, 14 bp, Homo sapiens
acaatttgttaatt

SEQ ID NO: 3229646 - DNA, 22 bp, Homo sapiens
acaatttgttaattcctatgaa

SEQ ID NO: 3229647 - DNA, 12 bp, Homo sapiens
acaattttaaga

SEQ ID NO: 3229648 - DNA, 12 bp, Homo sapiens
acaattttgtac

SEQ ID NO: 3229649 - DNA, 17 bp, Homo sapiens
acaattttttttttcct

SEQ ID NO: 3229650 - DNA, 18 bp, Homo sapiens
acaattttttttttcctc

SEQ ID NO: 3229651 - DNA, 16 bp, Homo sapiens
acacaaaactccgccc

SEQ ID NO: 3229652 - DNA, 20 bp, Homo sapiens
acacaaaccacaactgacac

SEQ ID NO: 3229653 - DNA, 13 bp, Homo sapiens
acacaaaggaagt

SEQ ID NO: 3229654 - DNA, 22 bp, Homo sapiens
acacaaaggtggaataaacatt

SEQ ID NO: 3229655 - DNA, 21 bp, Homo sapiens
acacaaatgtgatttttgtaa

SEQ ID NO: 3229656 - DNA, 15 bp, Homo sapiens
acagatgaaaatttg

SEQ ID NO: 3229657 - DNA, 23 bp, Homo sapiens
acagatgaaaatttgagactatt

SEQ ID NO: 3229658 - DNA, 14 bp, Homo sapiens
acagatgaatgtat

SEQ ID NO: 3229659 - DNA, 17 bp, Homo sapiens
acagatgcaatgtgcta

SEQ ID NO: 3229660 - DNA, 17 bp, Homo sapiens
acagatgccccagagct

SEQ ID NO: 3229661 - DNA, 21 bp, Homo sapiens
acagatgccccagagctgttt

SEQ ID NO: 3229662 - DNA, 22 bp, Homo sapiens
acagatgccccagagctgttta

SEQ ID NO: 3229663 - DNA, 16 bp, Homo sapiens
acagatggatttgcct

SEQ ID NO: 3229664 - DNA, 17 bp, Homo sapiens
acagatggatttgcctg

SEQ ID NO: 3229665 - DNA, 22 bp, Homo sapiens
acagatggcactttgaaggggc

SEQ ID NO: 3229666 - DNA, 16 bp, Homo sapiens
acagatgggcaaatta

SEQ ID NO: 3229667 - DNA, 22 bp, Homo sapiens
acagatgtcagcttcccagcca

SEQ ID NO: 3229668 - DNA, 14 bp, Homo sapiens
acagatgtctctgg

SEQ ID NO: 3229669 - DNA, 17 bp, Homo sapiens
acagatgtctctggggc

SEQ ID NO: 3229670 - DNA, 17 bp, Homo sapiens
acagatgtgaaaatata

SEQ ID NO: 3229671 - DNA, 22 bp, Homo sapiens
acagatgtgggctttgatttcc

SEQ ID NO: 3229672 - DNA, 15 bp, Homo sapiens
acagattcaggccag

SEQ ID NO: 3229673 - DNA, 17 bp, Homo sapiens
acagattcaggccagcc

SEQ ID NO: 3229674 - DNA, 23 bp, Homo sapiens
acagattcaggccagcccagcca

SEQ ID NO: 3229675 - DNA, 21 bp, Homo sapiens
acagattctagccaaactatt

SEQ ID NO: 3229676 - DNA, 22 bp, Homo sapiens
acagattctagccaaactattc

SEQ ID NO: 3229677 - DNA, 15 bp, Homo sapiens
acagattctttcagt

SEQ ID NO: 3229678 - DNA, 15 bp, Homo sapiens
acagattgcctcctt

SEQ ID NO: 3229679 - DNA, 18 bp, Homo sapiens
acagattgtttctataca

SEQ ID NO: 3229680 - DNA, 21 bp, Homo sapiens
acagattgtttctatacaaat

SEQ ID NO: 3229681 - DNA, 20 bp, Homo sapiens
acagatttaatacagtttat

SEQ ID NO: 3229682 - DNA, 15 bp, Homo sapiens
acagatttcatacct

SEQ ID NO: 3229683 - DNA, 11 bp, Homo sapiens
acagattttaa

SEQ ID NO: 3229684 - DNA, 17 bp, Homo sapiens
acagattttaattgtca

SEQ ID NO: 3229685 - DNA, 18 bp, Homo sapiens
acagcaaaatgttgaaga

SEQ ID NO: 3229686 - DNA, 15 bp, Homo sapiens
acagcaaacaggtgc

SEQ ID NO: 3229687 - DNA, 19 bp, Homo sapiens
acagcaacagcaagaaata

SEQ ID NO: 3229688 - DNA, 13 bp, Homo sapiens
acagcaagaaata

SEQ ID NO: 3229689 - DNA, 15 bp, Homo sapiens
acagcaagtagataa

SEQ ID NO: 3229690 - DNA, 15 bp, Homo sapiens
acagcaattcctcag

SEQ ID NO: 3229691 - DNA, 17 bp, Homo sapiens
acagcaattcctcaggc

SEQ ID NO: 3229692 - DNA, 19 bp, Homo sapiens
acagcacaccagccgctgc

SEQ ID NO: 3229693 - DNA, 17 bp, Homo sapiens
acagcacagctccctgc

SEQ ID NO: 3229694 - DNA, 16 bp, Homo sapiens
acagcacagggcaggg

SEQ ID NO: 3229695 - DNA, 21 bp, Homo sapiens
acagcacagggcaggggtggt

SEQ ID NO: 3229696 - DNA, 12 bp, Homo sapiens
acagcacatgct

SEQ ID NO: 3229697 - DNA, 21 bp, Homo sapiens
acagcacatgctggccagcct

SEQ ID NO: 3229698 - DNA, 17 bp, Homo sapiens
acagcacctccccgctg

SEQ ID NO: 3229699 - DNA, 18 bp, Homo sapiens
acagcacttgttttcagg

SEQ ID NO: 3229700 - DNA, 15 bp, Homo sapiens
acagcagaggttctt

SEQ ID NO: 3229701 - DNA, 21 bp, Homo sapiens
acagcagataacaatgcagca

SEQ ID NO: 3229702 - DNA, 17 bp, Homo sapiens
acagcagcccctgcaca

SEQ ID NO: 3229703 - DNA, 19 bp, Homo sapiens
acagcagcctgcttcccac

SEQ ID NO: 3229704 - DNA, 13 bp, Homo sapiens
acagcagcttcac

SEQ ID NO: 3229705 - DNA, 18 bp, Homo sapiens
acagcaggtcctccatcc

SEQ ID NO: 3229706 - DNA, 20 bp, Homo sapiens
acagcagtctccttcagcac

SEQ ID NO: 3229707 - DNA, 21 bp, Homo sapiens
acagcagtctccttcagcacg

SEQ ID NO: 3229708 - DNA, 18 bp, Homo sapiens
acagcatcgggagcaccc

SEQ ID NO: 3229709 - DNA, 20 bp, Homo sapiens
acagcatcgggagcacccag

SEQ ID NO: 3229710 - DNA, 14 bp, Homo sapiens
acagcatgaataaa

SEQ ID NO: 3229711 - DNA, 17 bp, Homo sapiens
acagcatgctgctttgc

SEQ ID NO: 3229712 - DNA, 22 bp, Homo sapiens
acagcatgtacggattttcagt

SEQ ID NO: 3229713 - DNA, 14 bp, Homo sapiens
acagcattgtcttt

SEQ ID NO: 3229714 - DNA, 19 bp, Homo sapiens
acagcattgtctttgctgt

SEQ ID NO: 3229715 - DNA, 20 bp, Homo sapiens
acagccaactagcccctggg

SEQ ID NO: 3229716 - DNA, 14 bp, Homo sapiens
acagccaagtgtga

SEQ ID NO: 3229717 - DNA, 11 bp, Homo sapiens
acagccacccg

SEQ ID NO: 3229718 - DNA, 23 bp, Homo sapiens
acagccacccgtggggtgctgcc

SEQ ID NO: 3229719 - DNA, 17 bp, Homo sapiens
acagccacggccaggcc

SEQ ID NO: 3229720 - DNA, 18 bp, Homo sapiens
acagccacggccaggcca

SEQ ID NO: 3229721 - DNA, 16 bp, Homo sapiens
acagccagcacctggc

SEQ ID NO: 3229722 - DNA, 14 bp, Homo sapiens
acagccagggggat

SEQ ID NO: 3229723 - DNA, 16 bp, Homo sapiens
acagccatgtccaagt

SEQ ID NO: 3229724 - DNA, 18 bp, Homo sapiens
acagccatgtccaagttc

SEQ ID NO: 3229725 - DNA, 22 bp, Homo sapiens
acagccattgcggccccaggag

SEQ ID NO: 3229726 - DNA, 18 bp, Homo sapiens
acagcccagagcctggct

SEQ ID NO: 3229727 - DNA, 13 bp, Homo sapiens
acagcccagggcc

SEQ ID NO: 3229728 - DNA, 15 bp, Homo sapiens
acagcccagggcctg

SEQ ID NO: 3229729 - DNA, 13 bp, Homo sapiens
acagccccagagc

SEQ ID NO: 3229730 - DNA, 14 bp, Homo sapiens
acagccccagagca

SEQ ID NO: 3229731 - DNA, 15 bp, Homo sapiens
acagccccagagcag

SEQ ID NO: 3229732 - DNA, 16 bp, Homo sapiens
acagccccagagcagg

SEQ ID NO: 3229733 - DNA, 15 bp, Homo sapiens
acagccccctctgcc

SEQ ID NO: 3229734 - DNA, 23 bp, Homo sapiens
acagccctcagcgtcagacagca

SEQ ID NO: 3229735 - DNA, 23 bp, Homo sapiens
acagccgcagcctccctctgacc

SEQ ID NO: 3229736 - DNA, 15 bp, Homo sapiens
acagccgccggaagt

SEQ ID NO: 3229737 - DNA, 17 bp, Homo sapiens
acagccgtcagccaaat

SEQ ID NO: 3229738 - DNA, 19 bp, Homo sapiens
acagccgtcagccaaatgt

SEQ ID NO: 3229739 - DNA, 13 bp, Homo sapiens
acagcctccaggg

SEQ ID NO: 3229740 - DNA, 14 bp, Homo sapiens
acagcctccagggc

SEQ ID NO: 3229741 - DNA, 15 bp, Homo sapiens
acagcctcccacccc

SEQ ID NO: 3229742 - DNA, 19 bp, Homo sapiens
acagcctccgccaagatct

SEQ ID NO: 3229743 - DNA, 20 bp, Homo sapiens
acagcctccgccaagatcta

SEQ ID NO: 3229744 - DNA, 12 bp, Homo sapiens
acagcctctgac

SEQ ID NO: 3229745 - DNA, 17 bp, Homo sapiens
acagcctctggctccac

SEQ ID NO: 3229746 - DNA, 13 bp, Homo sapiens
acagcctctgtga

SEQ ID NO: 3229747 - DNA, 14 bp, Homo sapiens
acagcctcttactt

SEQ ID NO: 3229748 - DNA, 13 bp, Homo sapiens
acagcctcttttt

SEQ ID NO: 3229749 - DNA, 14 bp, Homo sapiens
acagcctggcacag

SEQ ID NO: 3229750 - DNA, 18 bp, Homo sapiens
acagccttagctgccagt

SEQ ID NO: 3229751 - DNA, 15 bp, Homo sapiens
acagccttggctcct

SEQ ID NO: 3229752 - DNA, 16 bp, Homo sapiens
acagccttggctcctg

SEQ ID NO: 3229753 - DNA, 15 bp, Homo sapiens
acagcgagggcagct

SEQ ID NO: 3229754 - DNA, 23 bp, Homo sapiens
acagcgagggcagctgctattta

SEQ ID NO: 3229755 - DNA, 13 bp, Homo sapiens
acagcggcccctg

SEQ ID NO: 3229756 - DNA, 20 bp, Homo sapiens
acagcgggagacctgtgcta

SEQ ID NO: 3229757 - DNA, 16 bp, Homo sapiens
acagcggggccccagg

SEQ ID NO: 3229758 - DNA, 21 bp, Homo sapiens
acagcgtccctagcagtgaac

SEQ ID NO: 3229759 - DNA, 23 bp, Homo sapiens
acagctactctccccacgagggc

SEQ ID NO: 3229760 - DNA, 16 bp, Homo sapiens
acagctatgggagccc

SEQ ID NO: 3229761 - DNA, 17 bp, Homo sapiens
acagctatttaaggggg

SEQ ID NO: 3229762 - DNA, 23 bp, Homo sapiens
acagctcaagtcttccctgatca

SEQ ID NO: 3229763 - DNA, 16 bp, Homo sapiens
acagctcagccagtgg

SEQ ID NO: 3229764 - DNA, 12 bp, Homo sapiens
acagctccttct

SEQ ID NO: 3229765 - DNA, 15 bp, Homo sapiens
acagctccttctgtc

SEQ ID NO: 3229766 - DNA, 12 bp, Homo sapiens
acagctccttta

SEQ ID NO: 3229767 - DNA, 19 bp, Homo sapiens
acagctctgagatcctgga

SEQ ID NO: 3229768 - DNA, 20 bp, Homo sapiens
acagctctgtgttgccatgt

SEQ ID NO: 3229769 - DNA, 16 bp, Homo sapiens
acagctcttaaatgta

SEQ ID NO: 3229770 - DNA, 12 bp, Homo sapiens
acagctcttcat

SEQ ID NO: 3229771 - DNA, 13 bp, Homo sapiens
acagctcttcatt

SEQ ID NO: 3229772 - DNA, 17 bp, Homo sapiens
acagctcttctccaggc

SEQ ID NO: 3229773 - DNA, 18 bp, Homo sapiens
acagctcttctccaggct

SEQ ID NO: 3229774 - DNA, 16 bp, Homo sapiens
acagctgaattatcta

SEQ ID NO: 3229775 - DNA, 15 bp, Homo sapiens
acagctgagagactt

SEQ ID NO: 3229776 - DNA, 16 bp, Homo sapiens
acagctgagcacttag

SEQ ID NO: 3229777 - DNA, 15 bp, Homo sapiens
acagctgcagctggg

SEQ ID NO: 3229778 - DNA, 20 bp, Homo sapiens
acagctgcattagaaaaaga

SEQ ID NO: 3229779 - DNA, 17 bp, Homo sapiens
acagctgggcaaagcca

SEQ ID NO: 3229780 - DNA, 18 bp, Homo sapiens
acagctggtgcttagttt

SEQ ID NO: 3229781 - DNA, 12 bp, Homo sapiens
acagctgtgtta

SEQ ID NO: 3229782 - DNA, 15 bp, Homo sapiens
acagctgtttaagat

SEQ ID NO: 3229783 - DNA, 15 bp, Homo sapiens
acatggagactcctg

SEQ ID NO: 3229784 - DNA, 22 bp, Homo sapiens
acatggagactcctgccctgtt

SEQ ID NO: 3229785 - DNA, 14 bp, Homo sapiens
acatggccagtgtg

SEQ ID NO: 3229786 - DNA, 17 bp, Homo sapiens
acatggcctatgcacat

SEQ ID NO: 3229787 - DNA, 20 bp, Homo sapiens
acatggctctggactctaaa

SEQ ID NO: 3229788 - DNA, 13 bp, Homo sapiens
acatgggagttta

SEQ ID NO: 3229789 - DNA, 20 bp, Homo sapiens
acatggggagtgtttcatgg

SEQ ID NO: 3229790 - DNA, 17 bp, Homo sapiens
acatggggcctggccca

SEQ ID NO: 3229791 - DNA, 23 bp, Homo sapiens
acatggtgcctgagaggcaggca

SEQ ID NO: 3229792 - DNA, 20 bp, Homo sapiens
acatggttgtgacctgagga

SEQ ID NO: 3229793 - DNA, 21 bp, Homo sapiens
acatggtttaaaagaaaaaat

SEQ ID NO: 3229794 - DNA, 16 bp, Homo sapiens
acatgtaataaattca

SEQ ID NO: 3229795 - DNA, 22 bp, Homo sapiens
acatgtaattaagtactatgta

SEQ ID NO: 3229796 - DNA, 11 bp, Homo sapiens
acatgtatggt

SEQ ID NO: 3229797 - DNA, 22 bp, Homo sapiens
acatgtatggttactaaaaagt

SEQ ID NO: 3229798 - DNA, 23 bp, Homo sapiens
acatgtatggttactaaaaagta

SEQ ID NO: 3229799 - DNA, 11 bp, Homo sapiens
acatgtatgtg

SEQ ID NO: 3229800 - DNA, 13 bp, Homo sapiens
acatgtatttatg

SEQ ID NO: 3229801 - DNA, 15 bp, Homo sapiens
acatgtatttatgta

SEQ ID NO: 3229802 - DNA, 18 bp, Homo sapiens
acatgtatttatgtaatg

SEQ ID NO: 3229803 - DNA, 12 bp, Homo sapiens
acatgtcaatct

SEQ ID NO: 3229804 - DNA, 20 bp, Homo sapiens
acatgtcctaattcttctgt

SEQ ID NO: 3229805 - DNA, 22 bp, Homo sapiens
acatgtcctaattcttctgtcc

SEQ ID NO: 3229806 - DNA, 18 bp, Homo sapiens
acatgtctgttctacata

SEQ ID NO: 3229807 - DNA, 14 bp, Homo sapiens
acatgtgaaacctt

SEQ ID NO: 3229808 - DNA, 16 bp, Homo sapiens
acatgtgacatttata

SEQ ID NO: 3229809 - DNA, 15 bp, Homo sapiens
acatgtgatacattt

SEQ ID NO: 3229810 - DNA, 17 bp, Homo sapiens
acatgtgatacattttt

SEQ ID NO: 3229811 - DNA, 19 bp, Homo sapiens
acatgtgccgaatgtgcag

SEQ ID NO: 3229812 - DNA, 20 bp, Homo sapiens
acatgtgccgaatgtgcagg

SEQ ID NO: 3229813 - DNA, 17 bp, Homo sapiens
acatgtgccttttctga

SEQ ID NO: 3229814 - DNA, 18 bp, Homo sapiens
acatgtggaaagtgaatt

SEQ ID NO: 3229815 - DNA, 18 bp, Homo sapiens
acatgtggggccaggtca

SEQ ID NO: 3229816 - DNA, 18 bp, Homo sapiens
acatgtgtagcctgtgca

SEQ ID NO: 3229817 - DNA, 22 bp, Homo sapiens
acatgtgtatttatacccccag

SEQ ID NO: 3229818 - DNA, 23 bp, Homo sapiens
acatgttaagataacttactgta

SEQ ID NO: 3229819 - DNA, 16 bp, Homo sapiens
acatgttaatgacaat

SEQ ID NO: 3229820 - DNA, 22 bp, Homo sapiens
acatgttactggataaattgtt

SEQ ID NO: 3229821 - DNA, 14 bp, Homo sapiens
acatgttatatatt

SEQ ID NO: 3229822 - DNA, 15 bp, Homo sapiens
acatgttatatattt

SEQ ID NO: 3229823 - DNA, 20 bp, Homo sapiens
acatgttgggaaacttggct

SEQ ID NO: 3229824 - DNA, 21 bp, Homo sapiens
acatgttgtaaattaggaggc

SEQ ID NO: 3229825 - DNA, 16 bp, Homo sapiens
acatgtttcctctagt

SEQ ID NO: 3229826 - DNA, 18 bp, Homo sapiens
acatgtttttatatgtct

SEQ ID NO: 3229827 - DNA, 15 bp, Homo sapiens
acattaaaaaatgaa

SEQ ID NO: 3229828 - DNA, 14 bp, Homo sapiens
acattaaaaatgga

SEQ ID NO: 3229829 - DNA, 13 bp, Homo sapiens
acattaaaactag

SEQ ID NO: 3229830 - DNA, 22 bp, Homo sapiens
acattaaaactaggtaatgttt

SEQ ID NO: 3229831 - DNA, 12 bp, Homo sapiens
acattaaaagaa

SEQ ID NO: 3229832 - DNA, 19 bp, Homo sapiens
acattaaaagaagactgga

SEQ ID NO: 3229833 - DNA, 12 bp, Homo sapiens
acattaaatgtc

SEQ ID NO: 3229834 - DNA, 14 bp, Homo sapiens
acattaaatgtctt

SEQ ID NO: 3229835 - DNA, 11 bp, Homo sapiens
acattaacagt

SEQ ID NO: 3229836 - DNA, 16 bp, Homo sapiens
acattaacagttttcc

SEQ ID NO: 3229837 - DNA, 13 bp, Homo sapiens
acattaacatcta

SEQ ID NO: 3229838 - DNA, 16 bp, Homo sapiens
acattaacttgaaaat

SEQ ID NO: 3229839 - DNA, 19 bp, Homo sapiens
acattaatagcagcctttc

SEQ ID NO: 3229840 - DNA, 15 bp, Homo sapiens
acattaattttgtgc

SEQ ID NO: 3229841 - DNA, 19 bp, Homo sapiens
acattaattttgtgcattc

SEQ ID NO: 3229842 - DNA, 21 bp, Homo sapiens
acattaattttgtgcattctt

SEQ ID NO: 3229843 - DNA, 13 bp, Homo sapiens
acattacagttca

SEQ ID NO: 3229844 - DNA, 19 bp, Homo sapiens
acattagattttattttac

SEQ ID NO: 3229845 - DNA, 18 bp, Homo sapiens
acattagcagtttgcttt

SEQ ID NO: 3229846 - DNA, 19 bp, Homo sapiens
acattagtgaaaattctgt

SEQ ID NO: 3229847 - DNA, 19 bp, Homo sapiens
acattataaaccttcagaa

SEQ ID NO: 3229848 - DNA, 21 bp, Homo sapiens
acattatctcacttagtcctt

SEQ ID NO: 3229849 - DNA, 19 bp, Homo sapiens
acattatttattaaaaatg

SEQ ID NO: 3229850 - DNA, 22 bp, Homo sapiens
acattatttattaaaaatgttc

SEQ ID NO: 3229851 - DNA, 16 bp, Homo sapiens
acattatttattcagc

SEQ ID NO: 3229852 - DNA, 12 bp, Homo sapiens
acattatttcta

SEQ ID NO: 3229853 - DNA, 14 bp, Homo sapiens
acattatttgcatg

SEQ ID NO: 3229854 - DNA, 13 bp, Homo sapiens
acattcagctctg

SEQ ID NO: 3229855 - DNA, 15 bp, Homo sapiens
acattcagctctgga

SEQ ID NO: 3229856 - DNA, 18 bp, Homo sapiens
acattcagctctggagaa

SEQ ID NO: 3229857 - DNA, 16 bp, Homo sapiens
acattccaagactcta

SEQ ID NO: 3229858 - DNA, 16 bp, Homo sapiens
acattccatgacgaca

SEQ ID NO: 3229859 - DNA, 17 bp, Homo sapiens
acattcccatctgtcac

SEQ ID NO: 3229860 - DNA, 19 bp, Homo sapiens
acattccctctcctgccca

SEQ ID NO: 3229861 - DNA, 21 bp, Homo sapiens
acattccctctcctgcccaga

SEQ ID NO: 3229862 - DNA, 15 bp, Homo sapiens
acattcctgcattca

SEQ ID NO: 3229863 - DNA, 21 bp, Homo sapiens
acattcgatctcattcagtat

SEQ ID NO: 3229864 - DNA, 15 bp, Homo sapiens
acattcgtgagctgg

SEQ ID NO: 3229865 - DNA, 16 bp, Homo sapiens
acattctacttgctta

SEQ ID NO: 3229866 - DNA, 23 bp, Homo sapiens
acattctggggaaacaacattta

SEQ ID NO: 3229867 - DNA, 23 bp, Homo sapiens
acattctgtcgccttagcatgtt

SEQ ID NO: 3229868 - DNA, 18 bp, Homo sapiens
acattctgtctttcaaaa

SEQ ID NO: 3229869 - DNA, 19 bp, Homo sapiens
acattcttccaaaaagatt

SEQ ID NO: 3229870 - DNA, 20 bp, Homo sapiens
acattcttggcttaatcatt

SEQ ID NO: 3229871 - DNA, 12 bp, Homo sapiens
acattgaaagag

SEQ ID NO: 3229872 - DNA, 15 bp, Homo sapiens
acattgaagtaatga

SEQ ID NO: 3229873 - DNA, 19 bp, Homo sapiens
acattgaagtaatgaattt

SEQ ID NO: 3229874 - DNA, 18 bp, Homo sapiens
acattgaccaagaactgc

SEQ ID NO: 3229875 - DNA, 19 bp, Homo sapiens
acattgaccaagaactgca

SEQ ID NO: 3229876 - DNA, 20 bp, Homo sapiens
acattgaccaagaactgcat

SEQ ID NO: 3229877 - DNA, 17 bp, Homo sapiens
acattgacgattccttc

SEQ ID NO: 3229878 - DNA, 20 bp, Homo sapiens
acattgacgattccttctct

SEQ ID NO: 3229879 - DNA, 16 bp, Homo sapiens
acattgattcagcctg

SEQ ID NO: 3229880 - DNA, 23 bp, Homo sapiens
acattgcgtttgaccttttatgt

SEQ ID NO: 3229881 - DNA, 15 bp, Homo sapiens
acattgctctctggg

SEQ ID NO: 3229882 - DNA, 14 bp, Homo sapiens
acattgcttttgaa

SEQ ID NO: 3229883 - DNA, 16 bp, Homo sapiens
acattggtaagaatga

SEQ ID NO: 3229884 - DNA, 19 bp, Homo sapiens
acattggtgaaggatccag

SEQ ID NO: 3229885 - DNA, 19 bp, Homo sapiens
acattgtaaatagtatttg

SEQ ID NO: 3229886 - DNA, 21 bp, Homo sapiens
acattgtaaatagtatttgag

SEQ ID NO: 3229887 - DNA, 16 bp, Homo sapiens
acattgtaaatattta

SEQ ID NO: 3229888 - DNA, 22 bp, Homo sapiens
acattgtaaatatttactcttt

SEQ ID NO: 3229889 - DNA, 23 bp, Homo sapiens
acattgtaaatatttactctttg

SEQ ID NO: 3229890 - DNA, 12 bp, Homo sapiens
acattgtcaata

SEQ ID NO: 3229891 - DNA, 13 bp, Homo sapiens
acattgtcaataa

SEQ ID NO: 3229892 - DNA, 19 bp, Homo sapiens
acattgtgtgaaaaaagaa

SEQ ID NO: 3229893 - DNA, 22 bp, Homo sapiens
acattgtgtgaaaaaagaaaat

SEQ ID NO: 3229894 - DNA, 10 bp, Homo sapiens
acatttaaaa

SEQ ID NO: 3229895 - DNA, 14 bp, Homo sapiens
acatttaaaactta

SEQ ID NO: 3229896 - DNA, 12 bp, Homo sapiens
acatttaaatcc

SEQ ID NO: 3229897 - DNA, 23 bp, Homo sapiens
acatttaaattttaccctttaga

SEQ ID NO: 3229898 - DNA, 18 bp, Homo sapiens
acatttaataatgtatgt

SEQ ID NO: 3229899 - DNA, 19 bp, Homo sapiens
acatttaataatgtatgta

SEQ ID NO: 3229900 - DNA, 15 bp, Homo sapiens
acatttaatttagtg

SEQ ID NO: 3229901 - DNA, 19 bp, Homo sapiens
acatttaatttagtgatct

SEQ ID NO: 3229902 - DNA, 20 bp, Homo sapiens
acatttacaccacactttca

SEQ ID NO: 3229903 - DNA, 22 bp, Homo sapiens
acatttacaccacactttcaaa

SEQ ID NO: 3229904 - DNA, 22 bp, Homo sapiens
acatttagaaaagtgaattgaa

SEQ ID NO: 3229905 - DNA, 15 bp, Homo sapiens
acatttagaagaaag

SEQ ID NO: 3229906 - DNA, 18 bp, Homo sapiens
acatttagaagaaagatg

SEQ ID NO: 3229907 - DNA, 21 bp, Homo sapiens
acatttagagaactgtggccg

SEQ ID NO: 3229908 - DNA, 15 bp, Homo sapiens
acatttataatgttt

SEQ ID NO: 3229909 - DNA, 23 bp, Homo sapiens
acccagatggcctgaagcaactg

SEQ ID NO: 3229910 - DNA, 17 bp, Homo sapiens
acccagattttatttat

SEQ ID NO: 3229911 - DNA, 19 bp, Homo sapiens
acccagattttgctgtata

SEQ ID NO: 3229912 - DNA, 15 bp, Homo sapiens
acccagccatctgcc

SEQ ID NO: 3229913 - DNA, 15 bp, Homo sapiens
acccagcccacttct

SEQ ID NO: 3229914 - DNA, 10 bp, Homo sapiens
acccagcccc

SEQ ID NO: 3229915 - DNA, 20 bp, Homo sapiens
acccagccccttgagaaacc

SEQ ID NO: 3229916 - DNA, 17 bp, Homo sapiens
acccagcctcagtcctc

SEQ ID NO: 3229917 - DNA, 16 bp, Homo sapiens
acccagcgagccctgg

SEQ ID NO: 3229918 - DNA, 14 bp, Homo sapiens
acccagctactctg

SEQ ID NO: 3229919 - DNA, 19 bp, Homo sapiens
acccagctactctgtccag

SEQ ID NO: 3229920 - DNA, 20 bp, Homo sapiens
acccagctactctgtccagg

SEQ ID NO: 3229921 - DNA, 21 bp, Homo sapiens
acccagctactctgtccaggc

SEQ ID NO: 3229922 - DNA, 21 bp, Homo sapiens
acccagctccttttgtcccca

SEQ ID NO: 3229923 - DNA, 22 bp, Homo sapiens
acccagctccttttgtccccag

SEQ ID NO: 3229924 - DNA, 21 bp, Homo sapiens
acccaggacatctcctggcta

SEQ ID NO: 3229925 - DNA, 18 bp, Homo sapiens
acccaggacgcttctgaa

SEQ ID NO: 3229926 - DNA, 23 bp, Homo sapiens
acccaggagatggaagttgcagt

SEQ ID NO: 3229927 - DNA, 16 bp, Homo sapiens
acccaggccctccatg

SEQ ID NO: 3229928 - DNA, 11 bp, Homo sapiens
acccaggctcc

SEQ ID NO: 3229929 - DNA, 20 bp, Homo sapiens
acccaggctccgcccttagt

SEQ ID NO: 3229930 - DNA, 12 bp, Homo sapiens
acccaggctgca

SEQ ID NO: 3229931 - DNA, 14 bp, Homo sapiens
acccaggctgcact

SEQ ID NO: 3229932 - DNA, 15 bp, Homo sapiens
acccaggctgcactg

SEQ ID NO: 3229933 - DNA, 17 bp, Homo sapiens
acccaggctgcactgca

SEQ ID NO: 3229934 - DNA, 19 bp, Homo sapiens
acccaggctgcactgcagt

SEQ ID NO: 3229935 - DNA, 20 bp, Homo sapiens
acccaggctgcactgcagtg

SEQ ID NO: 3229936 - DNA, 20 bp, Homo sapiens
acccagggctctgccccagt

SEQ ID NO: 3229937 - DNA, 15 bp, Homo sapiens
acccaggtcttccag

SEQ ID NO: 3229938 - DNA, 16 bp, Homo sapiens
acccaggtcttccaga

SEQ ID NO: 3229939 - DNA, 20 bp, Homo sapiens
acccaggtcttccagacctg

SEQ ID NO: 3229940 - DNA, 23 bp, Homo sapiens
acccaggtggagggcacagccct

SEQ ID NO: 3229941 - DNA, 21 bp, Homo sapiens
acccagtgctgccatgccact

SEQ ID NO: 3229942 - DNA, 22 bp, Homo sapiens
acccagtgctgccatgccactg

SEQ ID NO: 3229943 - DNA, 15 bp, Homo sapiens
acccagttctgaata

SEQ ID NO: 3229944 - DNA, 22 bp, Homo sapiens
acccatagatcttctgaaatga

SEQ ID NO: 3229945 - DNA, 15 bp, Homo sapiens
acccatagcttccat

SEQ ID NO: 3229946 - DNA, 16 bp, Homo sapiens
acccatagcttccatg

SEQ ID NO: 3229947 - DNA, 19 bp, Homo sapiens
acccatctagtacttgaaa

SEQ ID NO: 3229948 - DNA, 19 bp, Homo sapiens
acccatcttcctgctgctg

SEQ ID NO: 3229949 - DNA, 20 bp, Homo sapiens
acccatgaagacaggacagt

SEQ ID NO: 3229950 - DNA, 13 bp, Homo sapiens
acccatgagcctg

SEQ ID NO: 3229951 - DNA, 13 bp, Homo sapiens
acccattcagaga

SEQ ID NO: 3229952 - DNA, 22 bp, Homo sapiens
acccattcccccatgtggctga

SEQ ID NO: 3229953 - DNA, 23 bp, Homo sapiens
acccatttaaatttttttcctta

SEQ ID NO: 3229954 - DNA, 21 bp, Homo sapiens
acccatttttgctctatggga

SEQ ID NO: 3229955 - DNA, 13 bp, Homo sapiens
accccaagagaac

SEQ ID NO: 3229956 - DNA, 16 bp, Homo sapiens
accccaagagaactcg

SEQ ID NO: 3229957 - DNA, 21 bp, Homo sapiens
accccaagctgcctctgggcc

SEQ ID NO: 3229958 - DNA, 20 bp, Homo sapiens
accccaatttcggatttttt

SEQ ID NO: 3229959 - DNA, 21 bp, Homo sapiens
accccacacttgttccagctc

SEQ ID NO: 3229960 - DNA, 14 bp, Homo sapiens
accccaccccaccc

SEQ ID NO: 3229961 - DNA, 18 bp, Homo sapiens
accccacccccgccatgc

SEQ ID NO: 3229962 - DNA, 15 bp, Homo sapiens
accccaccctcagca

SEQ ID NO: 3229963 - DNA, 22 bp, Homo sapiens
accccacgatttgtcttatccc

SEQ ID NO: 3229964 - DNA, 14 bp, Homo sapiens
accccacgcccgca

SEQ ID NO: 3229965 - DNA, 20 bp, Homo sapiens
accccacgcccgcacccccg

SEQ ID NO: 3229966 - DNA, 19 bp, Homo sapiens
accccactgggccagccct

SEQ ID NO: 3229967 - DNA, 20 bp, Homo sapiens
accccactgggccagccctg

SEQ ID NO: 3229968 - DNA, 17 bp, Homo sapiens
accccagagattcccaa

SEQ ID NO: 3229969 - DNA, 16 bp, Homo sapiens
accccagcccaccctg

SEQ ID NO: 3229970 - DNA, 19 bp, Homo sapiens
accccagcctacccttcct

SEQ ID NO: 3229971 - DNA, 19 bp, Homo sapiens
accccagcctgacctgaga

SEQ ID NO: 3229972 - DNA, 12 bp, Homo sapiens
accccagctggg

SEQ ID NO: 3229973 - DNA, 20 bp, Homo sapiens
accccagctgtgagccttgg

SEQ ID NO: 3229974 - DNA, 21 bp, Homo sapiens
accccagctgtgagccttggc

SEQ ID NO: 3229975 - DNA, 23 bp, Homo sapiens
accccaggctggacatgctgact

SEQ ID NO: 3229976 - DNA, 13 bp, Homo sapiens
accccaggtttct

SEQ ID NO: 3229977 - DNA, 15 bp, Homo sapiens
accccagttctaggg

SEQ ID NO: 3229978 - DNA, 15 bp, Homo sapiens
accccagttctgctc

SEQ ID NO: 3229979 - DNA, 16 bp, Homo sapiens
accccagttctgctcc

SEQ ID NO: 3229980 - DNA, 23 bp, Homo sapiens
accccagttctgctcctctccag

SEQ ID NO: 3229981 - DNA, 17 bp, Homo sapiens
accccatactctccttt

SEQ ID NO: 3229982 - DNA, 14 bp, Homo sapiens
accccatgggcttg

SEQ ID NO: 3229983 - DNA, 22 bp, Homo sapiens
acccccacaagctgtccctgca

SEQ ID NO: 3229984 - DNA, 15 bp, Homo sapiens
acccccacacctcag

SEQ ID NO: 3229985 - DNA, 17 bp, Homo sapiens
acccccaccccacactt

SEQ ID NO: 3229986 - DNA, 18 bp, Homo sapiens
acccccacccccagctca

SEQ ID NO: 3229987 - DNA, 13 bp, Homo sapiens
acccccagccagg

SEQ ID NO: 3229988 - DNA, 15 bp, Homo sapiens
acccccagcctgcta

SEQ ID NO: 3229989 - DNA, 12 bp, Homo sapiens
acccccagctca

SEQ ID NO: 3229990 - DNA, 20 bp, Homo sapiens
acccccagctcaatggactg

SEQ ID NO: 3229991 - DNA, 17 bp, Homo sapiens
acccccatccctcggga

SEQ ID NO: 3229992 - DNA, 19 bp, Homo sapiens
acccccatcttccacctgt

SEQ ID NO: 3229993 - DNA, 13 bp, Homo sapiens
acccccctcctgc

SEQ ID NO: 3229994 - DNA, 14 bp, Homo sapiens
acccccctcctgct

SEQ ID NO: 3229995 - DNA, 14 bp, Homo sapiens
acccccctgttcta

SEQ ID NO: 3229996 - DNA, 17 bp, Homo sapiens
acccccgccacctcagg

SEQ ID NO: 3229997 - DNA, 13 bp, Homo sapiens
acccccgccatgc

SEQ ID NO: 3229998 - DNA, 19 bp, Homo sapiens
accccctcaagccaatccc

SEQ ID NO: 3229999 - DNA, 15 bp, Homo sapiens
accccctcctggcaa

SEQ ID NO: 3230000 - DNA, 16 bp, Homo sapiens
accccctcctggcaat

SEQ ID NO: 3230001 - DNA, 15 bp, Homo sapiens
accccctccttcaga

SEQ ID NO: 3230002 - DNA, 17 bp, Homo sapiens
accccctccttcagaca

SEQ ID NO: 3230003 - DNA, 22 bp, Homo sapiens
accccctgagatcccctgagcc

SEQ ID NO: 3230004 - DNA, 23 bp, Homo sapiens
accccctgagatcccctgagccc

SEQ ID NO: 3230005 - DNA, 15 bp, Homo sapiens
accccctgcccacaa

SEQ ID NO: 3230006 - DNA, 15 bp, Homo sapiens
accccctgccctgca

SEQ ID NO: 3230007 - DNA, 13 bp, Homo sapiens
accccctggccct

SEQ ID NO: 3230008 - DNA, 17 bp, Homo sapiens
accccctggccctgcct

SEQ ID NO: 3230009 - DNA, 17 bp, Homo sapiens
acccccttaaatttaat

SEQ ID NO: 3230010 - DNA, 16 bp, Homo sapiens
acccccttctctgctc

SEQ ID NO: 3230011 - DNA, 19 bp, Homo sapiens
acccccttctctgctccac

SEQ ID NO: 3230012 - DNA, 20 bp, Homo sapiens
acccccttctctgctccacc

SEQ ID NO: 3230013 - DNA, 14 bp, Homo sapiens
acccccttctgggc

SEQ ID NO: 3230014 - DNA, 15 bp, Homo sapiens
acccccttctgggca

SEQ ID NO: 3230015 - DNA, 23 bp, Homo sapiens
acccccttttcagctgagccctg

SEQ ID NO: 3230016 - DNA, 20 bp, Homo sapiens
accccgcagacaccttggac

SEQ ID NO: 3230017 - DNA, 12 bp, Homo sapiens
accccgcagccc

SEQ ID NO: 3230018 - DNA, 15 bp, Homo sapiens
accccgcggtgctct

SEQ ID NO: 3230019 - DNA, 17 bp, Homo sapiens
accccgcggtgctctgg

SEQ ID NO: 3230020 - DNA, 21 bp, Homo sapiens
accccgcggtgctctggcggc

SEQ ID NO: 3230021 - DNA, 15 bp, Homo sapiens
accccggcaggccct

SEQ ID NO: 3230022 - DNA, 19 bp, Homo sapiens
accccggcaggccctgcag

SEQ ID NO: 3230023 - DNA, 21 bp, Homo sapiens
accccggcctccactccccca

SEQ ID NO: 3230024 - DNA, 13 bp, Homo sapiens
accccgggctctc

SEQ ID NO: 3230025 - DNA, 17 bp, Homo sapiens
accccgggctctctgct

SEQ ID NO: 3230026 - DNA, 18 bp, Homo sapiens
accccgggctctctgctg

SEQ ID NO: 3230027 - DNA, 16 bp, Homo sapiens
accccggggaccctgt

SEQ ID NO: 3230028 - DNA, 18 bp, Homo sapiens
accccggggaccctgtga

SEQ ID NO: 3230029 - DNA, 16 bp, Homo sapiens
accccgtctctactaa

SEQ ID NO: 3230030 - DNA, 22 bp, Homo sapiens
acccctaaagagatactttgat

SEQ ID NO: 3230031 - DNA, 12 bp, Homo sapiens
acccctccccag

SEQ ID NO: 3230032 - DNA, 17 bp, Homo sapiens
acccctccctctgtcca

SEQ ID NO: 3230033 - DNA, 16 bp, Homo sapiens
acccctcctcactggc

SEQ ID NO: 3230034 - DNA, 21 bp, Homo sapiens
acccctcctcactggccatcc

SEQ ID NO: 3230035 - DNA, 12 bp, Homo sapiens
acctctgtctca

SEQ ID NO: 3230036 - DNA, 13 bp, Homo sapiens
acctctgtctcat

SEQ ID NO: 3230037 - DNA, 16 bp, Homo sapiens
acctctgtctcatcct

SEQ ID NO: 3230038 - DNA, 21 bp, Homo sapiens
acctctgtctcatcctcctgg

SEQ ID NO: 3230039 - DNA, 16 bp, Homo sapiens
acctctgtgacctcag

SEQ ID NO: 3230040 - DNA, 12 bp, Homo sapiens
acctctgtgtgc

SEQ ID NO: 3230041 - DNA, 15 bp, Homo sapiens
acctctgttaaggtt

SEQ ID NO: 3230042 - DNA, 22 bp, Homo sapiens
acctctgttaaggttgaacttt

SEQ ID NO: 3230043 - DNA, 15 bp, Homo sapiens
acctcttcacccccc

SEQ ID NO: 3230044 - DNA, 14 bp, Homo sapiens
acctcttcccatga

SEQ ID NO: 3230045 - DNA, 16 bp, Homo sapiens
acctcttcccatgact

SEQ ID NO: 3230046 - DNA, 14 bp, Homo sapiens
acctcttccccaga

SEQ ID NO: 3230047 - DNA, 22 bp, Homo sapiens
acctcttccccagaaaggagac

SEQ ID NO: 3230048 - DNA, 16 bp, Homo sapiens
acctcttctggctcaa

SEQ ID NO: 3230049 - DNA, 13 bp, Homo sapiens
acctcttgctgtc

SEQ ID NO: 3230050 - DNA, 18 bp, Homo sapiens
acctcttgctgtctctgc

SEQ ID NO: 3230051 - DNA, 18 bp, Homo sapiens
acctgaaaaaaagtttac

SEQ ID NO: 3230052 - DNA, 14 bp, Homo sapiens
acctgaaattccaa

SEQ ID NO: 3230053 - DNA, 16 bp, Homo sapiens
acctgaaattccaaag

SEQ ID NO: 3230054 - DNA, 18 bp, Homo sapiens
acctgaaccccatgggct

SEQ ID NO: 3230055 - DNA, 17 bp, Homo sapiens
acctgacaatggcagct

SEQ ID NO: 3230056 - DNA, 22 bp, Homo sapiens
acctgacaatggcagctagact

SEQ ID NO: 3230057 - DNA, 15 bp, Homo sapiens
acctgacacaagagg

SEQ ID NO: 3230058 - DNA, 21 bp, Homo sapiens
acctgacacaccaggcgctaa

SEQ ID NO: 3230059 - DNA, 22 bp, Homo sapiens
acctgacactaaccagagtcag

SEQ ID NO: 3230060 - DNA, 22 bp, Homo sapiens
acctgacagatgtcagccgagc

SEQ ID NO: 3230061 - DNA, 15 bp, Homo sapiens
acctgacctcttgct

SEQ ID NO: 3230062 - DNA, 18 bp, Homo sapiens
acctgacctcttgctgtc

SEQ ID NO: 3230063 - DNA, 21 bp, Homo sapiens
acctgacctcttgctgtctct

SEQ ID NO: 3230064 - DNA, 22 bp, Homo sapiens
acctgacctcttgctgtctctg

SEQ ID NO: 3230065 - DNA, 20 bp, Homo sapiens
acctgactggttaacagcag

SEQ ID NO: 3230066 - DNA, 19 bp, Homo sapiens
acctgagaccctgggagag

SEQ ID NO: 3230067 - DNA, 15 bp, Homo sapiens
acctgagacgggcat

SEQ ID NO: 3230068 - DNA, 21 bp, Homo sapiens
acctgagactgtcggagaggc

SEQ ID NO: 3230069 - DNA, 22 bp, Homo sapiens
acctgagctaaataaagatatt

SEQ ID NO: 3230070 - DNA, 15 bp, Homo sapiens
acctgaggcctgaag

SEQ ID NO: 3230071 - DNA, 12 bp, Homo sapiens
acctgaggctgt

SEQ ID NO: 3230072 - DNA, 14 bp, Homo sapiens
acctgaggctgtgg

SEQ ID NO: 3230073 - DNA, 14 bp, Homo sapiens
acctgaggtgggcc

SEQ ID NO: 3230074 - DNA, 18 bp, Homo sapiens
acctgaggtgggcccagg

SEQ ID NO: 3230075 - DNA, 21 bp, Homo sapiens
acctgaggtgggcccaggacc

SEQ ID NO: 3230076 - DNA, 22 bp, Homo sapiens
acctgaggtgggcccaggacca

SEQ ID NO: 3230077 - DNA, 23 bp, Homo sapiens
acctgaggtgggcccaggaccag

SEQ ID NO: 3230078 - DNA, 24 bp, Homo sapiens
acctgaggtgggcccaggaccagc

SEQ ID NO: 3230079 - DNA, 22 bp, Homo sapiens
acctgagtcggccccacatggg

SEQ ID NO: 3230080 - DNA, 21 bp, Homo sapiens
acctgatggcacttagctatc

SEQ ID NO: 3230081 - DNA, 16 bp, Homo sapiens
acctgattgtaaactt

SEQ ID NO: 3230082 - DNA, 23 bp, Homo sapiens
acctgattgtattttttttttaa

SEQ ID NO: 3230083 - DNA, 17 bp, Homo sapiens
acctgatttcagaagag

SEQ ID NO: 3230084 - DNA, 20 bp, Homo sapiens
acctgatttcagaagagact

SEQ ID NO: 3230085 - DNA, 21 bp, Homo sapiens
acctgcaagccccagggcctg

SEQ ID NO: 3230086 - DNA, 23 bp, Homo sapiens
acctgcaagccccagggcctggg

SEQ ID NO: 3230087 - DNA, 20 bp, Homo sapiens
acctgcaataaaaaaattac

SEQ ID NO: 3230088 - DNA, 17 bp, Homo sapiens
acctgcactaacagagt

SEQ ID NO: 3230089 - DNA, 23 bp, Homo sapiens
acctgcaggctgagccactctct

SEQ ID NO: 3230090 - DNA, 16 bp, Homo sapiens
acctgcatctggggcc

SEQ ID NO: 3230091 - DNA, 13 bp, Homo sapiens
acctgccaagagt

SEQ ID NO: 3230092 - DNA, 13 bp, Homo sapiens
acctgccaccaca

SEQ ID NO: 3230093 - DNA, 15 bp, Homo sapiens
acctgccagcctggc

SEQ ID NO: 3230094 - DNA, 21 bp, Homo sapiens
acctgccagcctggcttctgg

SEQ ID NO: 3230095 - DNA, 13 bp, Homo sapiens
acctgccaggcag

SEQ ID NO: 3230096 - DNA, 15 bp, Homo sapiens
acctgccaggcaggg

SEQ ID NO: 3230097 - DNA, 19 bp, Homo sapiens
acctgccatgccaggaacc

SEQ ID NO: 3230098 - DNA, 23 bp, Homo sapiens
acctgcccacaactcccttgcac

SEQ ID NO: 3230099 - DNA, 21 bp, Homo sapiens
acctgccctctatttattagc

SEQ ID NO: 3230100 - DNA, 12 bp, Homo sapiens
acctgccctgga

SEQ ID NO: 3230101 - DNA, 14 bp, Homo sapiens
acctgccctggaac

SEQ ID NO: 3230102 - DNA, 11 bp, Homo sapiens
acctgcctctc

SEQ ID NO: 3230103 - DNA, 15 bp, Homo sapiens
acctgcctctcacac

SEQ ID NO: 3230104 - DNA, 22 bp, Homo sapiens
acctgcctctcacacacataga

SEQ ID NO: 3230105 - DNA, 20 bp, Homo sapiens
acctgctcacgtcaaatgca

SEQ ID NO: 3230106 - DNA, 17 bp, Homo sapiens
acctgctccgctgctcc

SEQ ID NO: 3230107 - DNA, 18 bp, Homo sapiens
acctgctctcctcttgcc

SEQ ID NO: 3230108 - DNA, 16 bp, Homo sapiens
acctgctgccccagct

SEQ ID NO: 3230109 - DNA, 18 bp, Homo sapiens
acctgctgccccagctga

SEQ ID NO: 3230110 - DNA, 14 bp, Homo sapiens
acctgctgcgtccc

SEQ ID NO: 3230111 - DNA, 19 bp, Homo sapiens
acctgctgcgtccccactc

SEQ ID NO: 3230112 - DNA, 21 bp, Homo sapiens
acctgctgcgtccccactccc

SEQ ID NO: 3230113 - DNA, 21 bp, Homo sapiens
acctgcttagctgccttgagc

SEQ ID NO: 3230114 - DNA, 17 bp, Homo sapiens
acctgcttcctgaaata

SEQ ID NO: 3230115 - DNA, 18 bp, Homo sapiens
acctgcttcctgaaataa

SEQ ID NO: 3230116 - DNA, 21 bp, Homo sapiens
acctgcttcctgaaataaaca

SEQ ID NO: 3230117 - DNA, 16 bp, Homo sapiens
acctgctttttgaaat

SEQ ID NO: 3230118 - DNA, 21 bp, Homo sapiens
acctgctttttgaaatgaaat

SEQ ID NO: 3230119 - DNA, 14 bp, Homo sapiens
acctggacctggaa

SEQ ID NO: 3230120 - DNA, 18 bp, Homo sapiens
acctggaccttttctgga

SEQ ID NO: 3230121 - DNA, 14 bp, Homo sapiens
acctggactgagcc

SEQ ID NO: 3230122 - DNA, 15 bp, Homo sapiens
acctggagcccctgg

SEQ ID NO: 3230123 - DNA, 16 bp, Homo sapiens
acctggagcccctggg

SEQ ID NO: 3230124 - DNA, 17 bp, Homo sapiens
acctggagcccctgggt

SEQ ID NO: 3230125 - DNA, 18 bp, Homo sapiens
acctggagcccctgggtg

SEQ ID NO: 3230126 - DNA, 21 bp, Homo sapiens
acctggattttttaaatcata

SEQ ID NO: 3230127 - DNA, 20 bp, Homo sapiens
acctggccacctgaggtggg

SEQ ID NO: 3230128 - DNA, 15 bp, Homo sapiens
acctggcctgctggg

SEQ ID NO: 3230129 - DNA, 23 bp, Homo sapiens
acctggccttaaagagggacagg

SEQ ID NO: 3230130 - DNA, 19 bp, Homo sapiens
acctggctaattttttgta

SEQ ID NO: 3230131 - DNA, 23 bp, Homo sapiens
acctggctgaggttcctctgcct

SEQ ID NO: 3230132 - DNA, 14 bp, Homo sapiens
acctggcttattta

SEQ ID NO: 3230133 - DNA, 18 bp, Homo sapiens
acctggcttttactttat

SEQ ID NO: 3230134 - DNA, 24 bp, Homo sapiens
acctgggaaaggacccacccatct

SEQ ID NO: 3230135 - DNA, 18 bp, Homo sapiens
acctggggtgaatactta

SEQ ID NO: 3230136 - DNA, 19 bp, Homo sapiens
acctgggtatgttcctaag

SEQ ID NO: 3230137 - DNA, 21 bp, Homo sapiens
acctgggtccaaataaaaact

SEQ ID NO: 3230138 - DNA, 23 bp, Homo sapiens
acctgggtccaaataaaaactaa

SEQ ID NO: 3230139 - DNA, 19 bp, Homo sapiens
acctggtaccctcctggct

SEQ ID NO: 3230140 - DNA, 17 bp, Homo sapiens
acctggtactccctctc

SEQ ID NO: 3230141 - DNA, 17 bp, Homo sapiens
acctgtaacttttgtaa

SEQ ID NO: 3230142 - DNA, 19 bp, Homo sapiens
acctgtaatcccagctact

SEQ ID NO: 3230143 - DNA, 17 bp, Homo sapiens
acctgtagccatctgca

SEQ ID NO: 3230144 - DNA, 23 bp, Homo sapiens
acctgtataagtggaggcacttt

SEQ ID NO: 3230145 - DNA, 17 bp, Homo sapiens
acctgtcatgcccccct

SEQ ID NO: 3230146 - DNA, 20 bp, Homo sapiens
acctgtcatgcccccctcaa

SEQ ID NO: 3230147 - DNA, 22 bp, Homo sapiens
acctgtcctaaggaaccttcct

SEQ ID NO: 3230148 - DNA, 23 bp, Homo sapiens
acctgtctataagagaattatat

SEQ ID NO: 3230149 - DNA, 17 bp, Homo sapiens
acctgtctcctttctca

SEQ ID NO: 3230150 - DNA, 17 bp, Homo sapiens
acctgtcttccaaggag

SEQ ID NO: 3230151 - DNA, 13 bp, Homo sapiens
acctgtgaccagc

SEQ ID NO: 3230152 - DNA, 19 bp, Homo sapiens
acctgtgagtttaaagcaa

SEQ ID NO: 3230153 - DNA, 14 bp, Homo sapiens
acctgtgccaggct

SEQ ID NO: 3230154 - DNA, 16 bp, Homo sapiens
acctgtgccaggctga

SEQ ID NO: 3230155 - DNA, 21 bp, Homo sapiens
acctgtgctagttttacagat

SEQ ID NO: 3230156 - DNA, 13 bp, Homo sapiens
acctgtgtacata

SEQ ID NO: 3230157 - DNA, 22 bp, Homo sapiens
acctgttaaggtggaaaatgga

SEQ ID NO: 3230158 - DNA, 21 bp, Homo sapiens
acctgttcttgggcctcaggc

SEQ ID NO: 3230159 - DNA, 16 bp, Homo sapiens
acctgttggctacaca

SEQ ID NO: 3230160 - DNA, 16 bp, Homo sapiens
actcctgctggtacct

SEQ ID NO: 3230161 - DNA, 15 bp, Homo sapiens
actcctggcctcaag

SEQ ID NO: 3230162 - DNA, 16 bp, Homo sapiens
actcctggggcctctt

SEQ ID NO: 3230163 - DNA, 13 bp, Homo sapiens
actcctggtctgt

SEQ ID NO: 3230164 - DNA, 12 bp, Homo sapiens
actcctggtgcc

SEQ ID NO: 3230165 - DNA, 15 bp, Homo sapiens
actcctggtgcccct

SEQ ID NO: 3230166 - DNA, 16 bp, Homo sapiens
actcctggtgcccctc

SEQ ID NO: 3230167 - DNA, 20 bp, Homo sapiens
actcctggtgcccctcgcca

SEQ ID NO: 3230168 - DNA, 23 bp, Homo sapiens
actcctggtgcccctcgccagct

SEQ ID NO: 3230169 - DNA, 16 bp, Homo sapiens
actcctgtacactgaa

SEQ ID NO: 3230170 - DNA, 12 bp, Homo sapiens
actcctgtcccg

SEQ ID NO: 3230171 - DNA, 20 bp, Homo sapiens
actcctgtcccgccttcctc

SEQ ID NO: 3230172 - DNA, 22 bp, Homo sapiens
actcctgtgctctggaggctgc

SEQ ID NO: 3230173 - DNA, 18 bp, Homo sapiens
actccttattttgtatta

SEQ ID NO: 3230174 - DNA, 12 bp, Homo sapiens
actccttggcct

SEQ ID NO: 3230175 - DNA, 18 bp, Homo sapiens
actccttggcctagccca

SEQ ID NO: 3230176 - DNA, 13 bp, Homo sapiens
actcgcagtcgca

SEQ ID NO: 3230177 - DNA, 16 bp, Homo sapiens
actcgcagtcgcagga

SEQ ID NO: 3230178 - DNA, 14 bp, Homo sapiens
actcgcttgtaaat

SEQ ID NO: 3230179 - DNA, 20 bp, Homo sapiens
actcggagactatggcctcg

SEQ ID NO: 3230180 - DNA, 17 bp, Homo sapiens
actcgggtctgcagacc

SEQ ID NO: 3230181 - DNA, 12 bp, Homo sapiens
actcggtttctc

SEQ ID NO: 3230182 - DNA, 14 bp, Homo sapiens
actcgtatatgtct

SEQ ID NO: 3230183 - DNA, 19 bp, Homo sapiens
actctaaaaaacattttta

SEQ ID NO: 3230184 - DNA, 21 bp, Homo sapiens
actctaaacaatagttcactc

SEQ ID NO: 3230185 - DNA, 14 bp, Homo sapiens
actctaaagaccaa

SEQ ID NO: 3230186 - DNA, 13 bp, Homo sapiens
actctaagatctt

SEQ ID NO: 3230187 - DNA, 21 bp, Homo sapiens
actctaagatcttagattctc

SEQ ID NO: 3230188 - DNA, 12 bp, Homo sapiens
actctaagctgt

SEQ ID NO: 3230189 - DNA, 15 bp, Homo sapiens
actctaagctgtgtg

SEQ ID NO: 3230190 - DNA, 19 bp, Homo sapiens
actctaagctgtgtgcagg

SEQ ID NO: 3230191 - DNA, 19 bp, Homo sapiens
actctaatatgattataca

SEQ ID NO: 3230192 - DNA, 21 bp, Homo sapiens
actctaattcccattttgcaa

SEQ ID NO: 3230193 - DNA, 17 bp, Homo sapiens
actctacccatattaca

SEQ ID NO: 3230194 - DNA, 18 bp, Homo sapiens
actctacccctgctccca

SEQ ID NO: 3230195 - DNA, 16 bp, Homo sapiens
actctaccctcccacc

SEQ ID NO: 3230196 - DNA, 16 bp, Homo sapiens
actctacctaatgtct

SEQ ID NO: 3230197 - DNA, 18 bp, Homo sapiens
actctacctccttagctt

SEQ ID NO: 3230198 - DNA, 19 bp, Homo sapiens
actctacttaatccaatgg

SEQ ID NO: 3230199 - DNA, 20 bp, Homo sapiens
actctacttagcatgtccct

SEQ ID NO: 3230200 - DNA, 19 bp, Homo sapiens
actctagagtccaaggttt

SEQ ID NO: 3230201 - DNA, 20 bp, Homo sapiens
actctaggatgtatatttta

SEQ ID NO: 3230202 - DNA, 22 bp, Homo sapiens
actctaggatgtatattttata

SEQ ID NO: 3230203 - DNA, 12 bp, Homo sapiens
actctaggttat

SEQ ID NO: 3230204 - DNA, 16 bp, Homo sapiens
actctatctgggcctg

SEQ ID NO: 3230205 - DNA, 17 bp, Homo sapiens
actctatctgggcctgg

SEQ ID NO: 3230206 - DNA, 21 bp, Homo sapiens
actctatgccccaaatatagc

SEQ ID NO: 3230207 - DNA, 16 bp, Homo sapiens
actctcagcccagaag

SEQ ID NO: 3230208 - DNA, 18 bp, Homo sapiens
actctcaggatcaagaaa

SEQ ID NO: 3230209 - DNA, 22 bp, Homo sapiens
actctcaggatcaagaaagtgt

SEQ ID NO: 3230210 - DNA, 22 bp, Homo sapiens
actctcagtgcttcttactatt

SEQ ID NO: 3230211 - DNA, 16 bp, Homo sapiens
actctccaatgttcta

SEQ ID NO: 3230212 - DNA, 13 bp, Homo sapiens
actctccatatcc

SEQ ID NO: 3230213 - DNA, 10 bp, Homo sapiens
actctcccca

SEQ ID NO: 3230214 - DNA, 21 bp, Homo sapiens
actctccccacgagggctggc

SEQ ID NO: 3230215 - DNA, 12 bp, Homo sapiens
actctcctagag

SEQ ID NO: 3230216 - DNA, 20 bp, Homo sapiens
actctcctcggccccctcca

SEQ ID NO: 3230217 - DNA, 18 bp, Homo sapiens
actctcctggaaatatta

SEQ ID NO: 3230218 - DNA, 13 bp, Homo sapiens
actctccttttga

SEQ ID NO: 3230219 - DNA, 17 bp, Homo sapiens
actctcggggcccttgg

SEQ ID NO: 3230220 - DNA, 15 bp, Homo sapiens
actctctaaactggt

SEQ ID NO: 3230221 - DNA, 13 bp, Homo sapiens
actctctgcctgg

SEQ ID NO: 3230222 - DNA, 15 bp, Homo sapiens
actctctgctctagc

SEQ ID NO: 3230223 - DNA, 20 bp, Homo sapiens
actctctgctctagccagga

SEQ ID NO: 3230224 - DNA, 22 bp, Homo sapiens
actctctggaagcccctgggcc

SEQ ID NO: 3230225 - DNA, 16 bp, Homo sapiens
actctcttccctttcc

SEQ ID NO: 3230226 - DNA, 20 bp, Homo sapiens
actctcttccctttccccag

SEQ ID NO: 3230227 - DNA, 21 bp, Homo sapiens
actctcttccctttccccagc

SEQ ID NO: 3230228 - DNA, 19 bp, Homo sapiens
actctcttttgaggtccct

SEQ ID NO: 3230229 - DNA, 10 bp, Homo sapiens
actctgaaaa

SEQ ID NO: 3230230 - DNA, 22 bp, Homo sapiens
actctgaaaagcaattgccctg

SEQ ID NO: 3230231 - DNA, 17 bp, Homo sapiens
actctgaaatctgaaga

SEQ ID NO: 3230232 - DNA, 13 bp, Homo sapiens
actctgaactttg

SEQ ID NO: 3230233 - DNA, 21 bp, Homo sapiens
actctgacaagggctgacctg

SEQ ID NO: 3230234 - DNA, 11 bp, Homo sapiens
actctgagccc

SEQ ID NO: 3230235 - DNA, 14 bp, Homo sapiens
actctgagcccagg

SEQ ID NO: 3230236 - DNA, 15 bp, Homo sapiens
actctgagcccaggc

SEQ ID NO: 3230237 - DNA, 17 bp, Homo sapiens
actctgagcccaggccg

SEQ ID NO: 3230238 - DNA, 16 bp, Homo sapiens
actctgagctgctcac

SEQ ID NO: 3230239 - DNA, 21 bp, Homo sapiens
actctgaggctctttctgggc

SEQ ID NO: 3230240 - DNA, 23 bp, Homo sapiens
actctgaggctctttctgggcca

SEQ ID NO: 3230241 - DNA, 14 bp, Homo sapiens
actctgcaaaggcc

SEQ ID NO: 3230242 - DNA, 16 bp, Homo sapiens
actctgcaaaggcctg

SEQ ID NO: 3230243 - DNA, 19 bp, Homo sapiens
actctgcaagtgtctggag

SEQ ID NO: 3230244 - DNA, 21 bp, Homo sapiens
actctgcaagtgtctggagcg

SEQ ID NO: 3230245 - DNA, 23 bp, Homo sapiens
actctgcaagtgtctggagcggc

SEQ ID NO: 3230246 - DNA, 18 bp, Homo sapiens
actctgcacatgtcttgt

SEQ ID NO: 3230247 - DNA, 21 bp, Homo sapiens
actctgcacatgtcttgtaca

SEQ ID NO: 3230248 - DNA, 14 bp, Homo sapiens
actctgcactactc

SEQ ID NO: 3230249 - DNA, 17 bp, Homo sapiens
actctgcagactgctag

SEQ ID NO: 3230250 - DNA, 14 bp, Homo sapiens
actctgcatgtaga

SEQ ID NO: 3230251 - DNA, 19 bp, Homo sapiens
actctgcctacagaacttc

SEQ ID NO: 3230252 - DNA, 16 bp, Homo sapiens
actctgctatttctct

SEQ ID NO: 3230253 - DNA, 17 bp, Homo sapiens
actctgctgaatgtaaa

SEQ ID NO: 3230254 - DNA, 18 bp, Homo sapiens
actctgctgaatgtaaaa

SEQ ID NO: 3230255 - DNA, 15 bp, Homo sapiens
actctgctgcttaga

SEQ ID NO: 3230256 - DNA, 14 bp, Homo sapiens
actctgctgtttga

SEQ ID NO: 3230257 - DNA, 12 bp, Homo sapiens
actctgcttctc

SEQ ID NO: 3230258 - DNA, 14 bp, Homo sapiens
actctgcttctctg

SEQ ID NO: 3230259 - DNA, 15 bp, Homo sapiens
actctgcttctctga

SEQ ID NO: 3230260 - DNA, 17 bp, Homo sapiens
actctgcttctctgact

SEQ ID NO: 3230261 - DNA, 18 bp, Homo sapiens
actctgcttgatttttgc

SEQ ID NO: 3230262 - DNA, 15 bp, Homo sapiens
actctggcaaagctt

SEQ ID NO: 3230263 - DNA, 17 bp, Homo sapiens
actctggcaaagctttt

SEQ ID NO: 3230264 - DNA, 12 bp, Homo sapiens
actctggccctg

SEQ ID NO: 3230265 - DNA, 14 bp, Homo sapiens
actctggccctggc

SEQ ID NO: 3230266 - DNA, 13 bp, Homo sapiens
actctgggaaata

SEQ ID NO: 3230267 - DNA, 20 bp, Homo sapiens
actctgggcacactctgcca

SEQ ID NO: 3230268 - DNA, 20 bp, Homo sapiens
actctggtgagtcaccactt

SEQ ID NO: 3230269 - DNA, 17 bp, Homo sapiens
actctggtgcctccaga

SEQ ID NO: 3230270 - DNA, 15 bp, Homo sapiens
actctggttctttgt

SEQ ID NO: 3230271 - DNA, 15 bp, Homo sapiens
actctggtttctcat

SEQ ID NO: 3230272 - DNA, 17 bp, Homo sapiens
actctggtttctcattc

SEQ ID NO: 3230273 - DNA, 18 bp, Homo sapiens
actctgtaatagttcagt

SEQ ID NO: 3230274 - DNA, 15 bp, Homo sapiens
actctgtataataga

SEQ ID NO: 3230275 - DNA, 13 bp, Homo sapiens
actctgtattaca

SEQ ID NO: 3230276 - DNA, 16 bp, Homo sapiens
actctgtcagccagcc

SEQ ID NO: 3230277 - DNA, 17 bp, Homo sapiens
actctgtcagccagccg

SEQ ID NO: 3230278 - DNA, 17 bp, Homo sapiens
actctgtccaggccact

SEQ ID NO: 3230279 - DNA, 14 bp, Homo sapiens
actctgtcttaaat

SEQ ID NO: 3230280 - DNA, 17 bp, Homo sapiens
actctgtggggccttgg

SEQ ID NO: 3230281 - DNA, 16 bp, Homo sapiens
actctgtgtcaggtgg

SEQ ID NO: 3230282 - DNA, 16 bp, Homo sapiens
actctgttatttagac

SEQ ID NO: 3230283 - DNA, 15 bp, Homo sapiens
actctgttcccccac

SEQ ID NO: 3230284 - DNA, 19 bp, Homo sapiens
actctgttcccccaccctc

SEQ ID NO: 3230285 - DNA, 22 bp, Homo sapiens
actctgttcccccaccctccat

SEQ ID NO: 3230286 - DNA, 23 bp, Homo sapiens
actctgttcccccaccctccatg

SEQ ID NO: 3230287 - DNA, 23 bp, Homo sapiens
actgtacacactttatttacttc

SEQ ID NO: 3230288 - DNA, 21 bp, Homo sapiens
actgtacaccatagtttacaa

SEQ ID NO: 3230289 - DNA, 14 bp, Homo sapiens
actgtacatttaaa

SEQ ID NO: 3230290 - DNA, 18 bp, Homo sapiens
actgtactaattcttaca

SEQ ID NO: 3230291 - DNA, 17 bp, Homo sapiens
actgtactccagcctgg

SEQ ID NO: 3230292 - DNA, 17 bp, Homo sapiens
actgtacttaataaatt

SEQ ID NO: 3230293 - DNA, 14 bp, Homo sapiens
actgtactttgcca

SEQ ID NO: 3230294 - DNA, 19 bp, Homo sapiens
actgtagaatgatttcatg

SEQ ID NO: 3230295 - DNA, 15 bp, Homo sapiens
actgtagatatgtat

SEQ ID NO: 3230296 - DNA, 15 bp, Homo sapiens
actgtagcaggttct

SEQ ID NO: 3230297 - DNA, 17 bp, Homo sapiens
actgtagcctggatatt

SEQ ID NO: 3230298 - DNA, 22 bp, Homo sapiens
actgtagctcaagtttaaaagc

SEQ ID NO: 3230299 - DNA, 15 bp, Homo sapiens
actgtaggattcaag

SEQ ID NO: 3230300 - DNA, 15 bp, Homo sapiens
actgtaggcacactt

SEQ ID NO: 3230301 - DNA, 13 bp, Homo sapiens
actgtagggaggg

SEQ ID NO: 3230302 - DNA, 15 bp, Homo sapiens
actgtagttctaaga

SEQ ID NO: 3230303 - DNA, 21 bp, Homo sapiens
actgtagtttttcttcaacat

SEQ ID NO: 3230304 - DNA, 14 bp, Homo sapiens
actgtataaatagg

SEQ ID NO: 3230305 - DNA, 17 bp, Homo sapiens
actgtataaataggaga

SEQ ID NO: 3230306 - DNA, 20 bp, Homo sapiens
actgtataaataggagagga

SEQ ID NO: 3230307 - DNA, 23 bp, Homo sapiens
actgtataaataggagaggatga

SEQ ID NO: 3230308 - DNA, 21 bp, Homo sapiens
actgtataggtagatccagat

SEQ ID NO: 3230309 - DNA, 19 bp, Homo sapiens
actgtatatgtattccctt

SEQ ID NO: 3230310 - DNA, 22 bp, Homo sapiens
actgtatcaaatctgtatatgt

SEQ ID NO: 3230311 - DNA, 17 bp, Homo sapiens
actgtatgccttctgta

SEQ ID NO: 3230312 - DNA, 13 bp, Homo sapiens
actgtatgctgga

SEQ ID NO: 3230313 - DNA, 14 bp, Homo sapiens
actgtatggaaaca

SEQ ID NO: 3230314 - DNA, 13 bp, Homo sapiens
actgtatttctaa

SEQ ID NO: 3230315 - DNA, 21 bp, Homo sapiens
actgtcaaggctgcttagaat

SEQ ID NO: 3230316 - DNA, 12 bp, Homo sapiens
actgtcaataaa

SEQ ID NO: 3230317 - DNA, 15 bp, Homo sapiens
actgtcaccctccac

SEQ ID NO: 3230318 - DNA, 17 bp, Homo sapiens
actgtcaccctccacct

SEQ ID NO: 3230319 - DNA, 15 bp, Homo sapiens
actgtcactgtttct

SEQ ID NO: 3230320 - DNA, 16 bp, Homo sapiens
actgtcactgtttctc

SEQ ID NO: 3230321 - DNA, 21 bp, Homo sapiens
actgtcactgtttctctgctg

SEQ ID NO: 3230322 - DNA, 15 bp, Homo sapiens
actgtcactttgctc

SEQ ID NO: 3230323 - DNA, 16 bp, Homo sapiens
actgtcagattaaatt

SEQ ID NO: 3230324 - DNA, 22 bp, Homo sapiens
actgtcaggcctctgagcccaa

SEQ ID NO: 3230325 - DNA, 14 bp, Homo sapiens
actgtcataatggt

SEQ ID NO: 3230326 - DNA, 21 bp, Homo sapiens
actgtcatcctcaaagaaagt

SEQ ID NO: 3230327 - DNA, 15 bp, Homo sapiens
actgtcatgcttcat

SEQ ID NO: 3230328 - DNA, 14 bp, Homo sapiens
actgtccagagagc

SEQ ID NO: 3230329 - DNA, 15 bp, Homo sapiens
actgtccagagagca

SEQ ID NO: 3230330 - DNA, 17 bp, Homo sapiens
actgtcccacttctcat

SEQ ID NO: 3230331 - DNA, 20 bp, Homo sapiens
actgtcctaccagttgccct

SEQ ID NO: 3230332 - DNA, 17 bp, Homo sapiens
actgtcctacccaccct

SEQ ID NO: 3230333 - DNA, 18 bp, Homo sapiens
actgtcctctcccctcca

SEQ ID NO: 3230334 - DNA, 21 bp, Homo sapiens
actgtcctttccttggcttta

SEQ ID NO: 3230335 - DNA, 20 bp, Homo sapiens
actgtcggagaggctgtctg

SEQ ID NO: 3230336 - DNA, 16 bp, Homo sapiens
actgtctcaaaaggat

SEQ ID NO: 3230337 - DNA, 19 bp, Homo sapiens
actgtctcaagagggcact

SEQ ID NO: 3230338 - DNA, 23 bp, Homo sapiens
actgtctcaagagggcactggtg

SEQ ID NO: 3230339 - DNA, 18 bp, Homo sapiens
actgtctgattggcttgt

SEQ ID NO: 3230340 - DNA, 22 bp, Homo sapiens
actgtctgctgatataatatca

SEQ ID NO: 3230341 - DNA, 19 bp, Homo sapiens
actgtctggttttaacaat

SEQ ID NO: 3230342 - DNA, 15 bp, Homo sapiens
actgtctgtgaacag

SEQ ID NO: 3230343 - DNA, 22 bp, Homo sapiens
actgtctgttctgcacaataaa

SEQ ID NO: 3230344 - DNA, 18 bp, Homo sapiens
actgtctttaaaagagag

SEQ ID NO: 3230345 - DNA, 20 bp, Homo sapiens
actgtcttttctattaatca

SEQ ID NO: 3230346 - DNA, 22 bp, Homo sapiens
actgtgaagtttacattgtaaa

SEQ ID NO: 3230347 - DNA, 13 bp, Homo sapiens
actgtgaccacct

SEQ ID NO: 3230348 - DNA, 16 bp, Homo sapiens
actgtgaccaccttct

SEQ ID NO: 3230349 - DNA, 23 bp, Homo sapiens
actgtgactctttttagggccag

SEQ ID NO: 3230350 - DNA, 17 bp, Homo sapiens
actgtgagaacccagtt

SEQ ID NO: 3230351 - DNA, 20 bp, Homo sapiens
actgtgatgccacacagagt

SEQ ID NO: 3230352 - DNA, 14 bp, Homo sapiens
actgtgcagaataa

SEQ ID NO: 3230353 - DNA, 15 bp, Homo sapiens
actgtgcagaataat

SEQ ID NO: 3230354 - DNA, 17 bp, Homo sapiens
actgtgccatgtgccag

SEQ ID NO: 3230355 - DNA, 12 bp, Homo sapiens
actgtgccctgg

SEQ ID NO: 3230356 - DNA, 13 bp, Homo sapiens
actgtgccctggt

SEQ ID NO: 3230357 - DNA, 14 bp, Homo sapiens
actgtgccctggtg

SEQ ID NO: 3230358 - DNA, 23 bp, Homo sapiens
actgtgcctttgcaaatcagtgt

SEQ ID NO: 3230359 - DNA, 13 bp, Homo sapiens
actgtgccttttc

SEQ ID NO: 3230360 - DNA, 22 bp, Homo sapiens
actgtgctactgtctttggaaa

SEQ ID NO: 3230361 - DNA, 21 bp, Homo sapiens
actgtgcttcgagccaactct

SEQ ID NO: 3230362 - DNA, 12 bp, Homo sapiens
actgtggaggaa

SEQ ID NO: 3230363 - DNA, 17 bp, Homo sapiens
actgtggaggaaggatt

SEQ ID NO: 3230364 - DNA, 18 bp, Homo sapiens
actgtggaggaaggattg

SEQ ID NO: 3230365 - DNA, 15 bp, Homo sapiens
actgtggccacagcc

SEQ ID NO: 3230366 - DNA, 14 bp, Homo sapiens
actgtggtcctatg

SEQ ID NO: 3230367 - DNA, 13 bp, Homo sapiens
actgtgtacacct

SEQ ID NO: 3230368 - DNA, 16 bp, Homo sapiens
actgtgtacacctcaa

SEQ ID NO: 3230369 - DNA, 17 bp, Homo sapiens
actgtgtacacctcaaa

SEQ ID NO: 3230370 - DNA, 18 bp, Homo sapiens
actgtgtacataactgaa

SEQ ID NO: 3230371 - DNA, 16 bp, Homo sapiens
actgtgtattccaaga

SEQ ID NO: 3230372 - DNA, 20 bp, Homo sapiens
actgtgtgggatacttagtg

SEQ ID NO: 3230373 - DNA, 22 bp, Homo sapiens
actgtgtgtgtgaatgaacact

SEQ ID NO: 3230374 - DNA, 14 bp, Homo sapiens
actgtgttcattag

SEQ ID NO: 3230375 - DNA, 14 bp, Homo sapiens
actgtgtttcaagt

SEQ ID NO: 3230376 - DNA, 16 bp, Homo sapiens
actgttaatacacagt

SEQ ID NO: 3230377 - DNA, 22 bp, Homo sapiens
actgttacaacttgtatttcca

SEQ ID NO: 3230378 - DNA, 23 bp, Homo sapiens
actgttacaacttgtatttccaa

SEQ ID NO: 3230379 - DNA, 20 bp, Homo sapiens
actgttacctaaagtatttt

SEQ ID NO: 3230380 - DNA, 16 bp, Homo sapiens
actgttagaacactat

SEQ ID NO: 3230381 - DNA, 14 bp, Homo sapiens
actgttagatgctg

SEQ ID NO: 3230382 - DNA, 17 bp, Homo sapiens
actgttagcactgttga

SEQ ID NO: 3230383 - DNA, 21 bp, Homo sapiens
actgttagcactgttgatgta

SEQ ID NO: 3230384 - DNA, 22 bp, Homo sapiens
actgttcaatgattatttgtat

SEQ ID NO: 3230385 - DNA, 20 bp, Homo sapiens
actgttcaatggttctgaaa

SEQ ID NO: 3230386 - DNA, 23 bp, Homo sapiens
actgttcaatggttctgaaataa

SEQ ID NO: 3230387 - DNA, 23 bp, Homo sapiens
actgttccaaagccagtgaaatg

SEQ ID NO: 3230388 - DNA, 18 bp, Homo sapiens
actgttccagattcctat

SEQ ID NO: 3230389 - DNA, 18 bp, Homo sapiens
actgttccctctgctcct

SEQ ID NO: 3230390 - DNA, 21 bp, Homo sapiens
actgttctaaagctctgacat

SEQ ID NO: 3230391 - DNA, 14 bp, Homo sapiens
actgttctgcaaag

SEQ ID NO: 3230392 - DNA, 20 bp, Homo sapiens
actgttctgcaaaggtggca

SEQ ID NO: 3230393 - DNA, 11 bp, Homo sapiens
actgttcttgc

SEQ ID NO: 3230394 - DNA, 14 bp, Homo sapiens
actgttcttgctgc

SEQ ID NO: 3230395 - DNA, 16 bp, Homo sapiens
actgttcttgctgcta

SEQ ID NO: 3230396 - DNA, 21 bp, Homo sapiens
actgttgaaaattattttaaa

SEQ ID NO: 3230397 - DNA, 23 bp, Homo sapiens
actgttgaaaattattttaaaca

SEQ ID NO: 3230398 - DNA, 13 bp, Homo sapiens
actgttgatgtat

SEQ ID NO: 3230399 - DNA, 15 bp, Homo sapiens
actgttgatgtatct

SEQ ID NO: 3230400 - DNA, 16 bp, Homo sapiens
actgttgcatttactt

SEQ ID NO: 3230401 - DNA, 14 bp, Homo sapiens
actgttgcccaggc

SEQ ID NO: 3230402 - DNA, 20 bp, Homo sapiens
actgttgcctaattggaaag

SEQ ID NO: 3230403 - DNA, 21 bp, Homo sapiens
actgttgcctaattggaaagt

SEQ ID NO: 3230404 - DNA, 14 bp, Homo sapiens
actgttgcctttta

SEQ ID NO: 3230405 - DNA, 21 bp, Homo sapiens
actgttgctcaaatctattca

SEQ ID NO: 3230406 - DNA, 12 bp, Homo sapiens
actgttggaatg

SEQ ID NO: 3230407 - DNA, 15 bp, Homo sapiens
actgttgtaagaatt

SEQ ID NO: 3230408 - DNA, 22 bp, Homo sapiens
actgtttatttctgtttctcat

SEQ ID NO: 3230409 - DNA, 16 bp, Homo sapiens
actgtttcatctaagt

SEQ ID NO: 3230410 - DNA, 13 bp, Homo sapiens
actgtttctctgc

SEQ ID NO: 3230411 - DNA, 17 bp, Homo sapiens
actgtttctcttgagct

SEQ ID NO: 3230412 - DNA, 20 bp, Homo sapiens
actgtttctcttgagctggc

SEQ ID NO: 3230413 - DNA, 23 bp, Homo sapiens
actttgtaaataggatttttaga

SEQ ID NO: 3230414 - DNA, 18 bp, Homo sapiens
actttgtaccccccaacc

SEQ ID NO: 3230415 - DNA, 14 bp, Homo sapiens
actttgtaggacaa

SEQ ID NO: 3230416 - DNA, 15 bp, Homo sapiens
actttgtcagaggca

SEQ ID NO: 3230417 - DNA, 18 bp, Homo sapiens
actttgtcctaagagatt

SEQ ID NO: 3230418 - DNA, 20 bp, Homo sapiens
actttgtcgtggttcttaaa

SEQ ID NO: 3230419 - DNA, 18 bp, Homo sapiens
actttgtggaccaattat

SEQ ID NO: 3230420 - DNA, 23 bp, Homo sapiens
actttgtggagagaatgtgtgtg

SEQ ID NO: 3230421 - DNA, 19 bp, Homo sapiens
actttgtggatgtcttcct

SEQ ID NO: 3230422 - DNA, 21 bp, Homo sapiens
actttgtggatgtcttccttg

SEQ ID NO: 3230423 - DNA, 18 bp, Homo sapiens
actttgtgttcaccttgt

SEQ ID NO: 3230424 - DNA, 17 bp, Homo sapiens
actttgttaaaaatatt

SEQ ID NO: 3230425 - DNA, 20 bp, Homo sapiens
actttgttaggattttcaca

SEQ ID NO: 3230426 - DNA, 19 bp, Homo sapiens
actttgttctttaggagat

SEQ ID NO: 3230427 - DNA, 15 bp, Homo sapiens
acttttaaaaatgta

SEQ ID NO: 3230428 - DNA, 13 bp, Homo sapiens
acttttaaactgt

SEQ ID NO: 3230429 - DNA, 17 bp, Homo sapiens
acttttaaactgtgtac

SEQ ID NO: 3230430 - DNA, 20 bp, Homo sapiens
acttttaaggataaatcata

SEQ ID NO: 3230431 - DNA, 18 bp, Homo sapiens
acttttaattactgtttt

SEQ ID NO: 3230432 - DNA, 22 bp, Homo sapiens
acttttatttcctgtatgttgt

SEQ ID NO: 3230433 - DNA, 15 bp, Homo sapiens
acttttatttgcaac

SEQ ID NO: 3230434 - DNA, 22 bp, Homo sapiens
acttttatttgcaacatttaca

SEQ ID NO: 3230435 - DNA, 12 bp, Homo sapiens
acttttcagtga

SEQ ID NO: 3230436 - DNA, 20 bp, Homo sapiens
acttttcataacctagcctt

SEQ ID NO: 3230437 - DNA, 18 bp, Homo sapiens
acttttcattctctttta

SEQ ID NO: 3230438 - DNA, 17 bp, Homo sapiens
acttttccattcccaat

SEQ ID NO: 3230439 - DNA, 20 bp, Homo sapiens
acttttcccctgttaaacag

SEQ ID NO: 3230440 - DNA, 22 bp, Homo sapiens
acttttcccctgttaaacagta

SEQ ID NO: 3230441 - DNA, 17 bp, Homo sapiens
acttttcctccctcagt

SEQ ID NO: 3230442 - DNA, 21 bp, Homo sapiens
acttttcctggacttaaagaa

SEQ ID NO: 3230443 - DNA, 12 bp, Homo sapiens
acttttcgttaa

SEQ ID NO: 3230444 - DNA, 17 bp, Homo sapiens
acttttcgttaacattg

SEQ ID NO: 3230445 - DNA, 22 bp, Homo sapiens
acttttcgttaacattgaccaa

SEQ ID NO: 3230446 - DNA, 17 bp, Homo sapiens
acttttctgattaatat

SEQ ID NO: 3230447 - DNA, 19 bp, Homo sapiens
acttttctgattaatatat

SEQ ID NO: 3230448 - DNA, 24 bp, Homo sapiens
acttttcttaaaccttcagttatg

SEQ ID NO: 3230449 - DNA, 19 bp, Homo sapiens
acttttgaatctataaaag

SEQ ID NO: 3230450 - DNA, 16 bp, Homo sapiens
acttttgagacttttt

SEQ ID NO: 3230451 - DNA, 21 bp, Homo sapiens
acttttgcaaaataagtaaat

SEQ ID NO: 3230452 - DNA, 17 bp, Homo sapiens
acttttgtaaagaaatt

SEQ ID NO: 3230453 - DNA, 18 bp, Homo sapiens
acttttgtgtaatgaaaa

SEQ ID NO: 3230454 - DNA, 19 bp, Homo sapiens
acttttgtgtaatgaaaat

SEQ ID NO: 3230455 - DNA, 17 bp, Homo sapiens
acttttgttattccatc

SEQ ID NO: 3230456 - DNA, 19 bp, Homo sapiens
acttttgttattccatcaa

SEQ ID NO: 3230457 - DNA, 16 bp, Homo sapiens
acttttgttctgcttt

SEQ ID NO: 3230458 - DNA, 18 bp, Homo sapiens
acttttgttctgtatttt

SEQ ID NO: 3230459 - DNA, 18 bp, Homo sapiens
acttttgttgtatgggat

SEQ ID NO: 3230460 - DNA, 15 bp, Homo sapiens
actttttaacatggt

SEQ ID NO: 3230461 - DNA, 11 bp, Homo sapiens
actttttacaa

SEQ ID NO: 3230462 - DNA, 12 bp, Homo sapiens
actttttataaa

SEQ ID NO: 3230463 - DNA, 14 bp, Homo sapiens
actttttatttaat

SEQ ID NO: 3230464 - DNA, 15 bp, Homo sapiens
actttttatttctaa

SEQ ID NO: 3230465 - DNA, 17 bp, Homo sapiens
actttttatttctaaat

SEQ ID NO: 3230466 - DNA, 21 bp, Homo sapiens
actttttatttctaaatgaga

SEQ ID NO: 3230467 - DNA, 16 bp, Homo sapiens
actttttcgtgtggat

SEQ ID NO: 3230468 - DNA, 11 bp, Homo sapiens
actttttctga

SEQ ID NO: 3230469 - DNA, 17 bp, Homo sapiens
actttttgaactaagaa

SEQ ID NO: 3230470 - DNA, 13 bp, Homo sapiens
actttttggctga

SEQ ID NO: 3230471 - DNA, 17 bp, Homo sapiens
actttttggtggatgta

SEQ ID NO: 3230472 - DNA, 21 bp, Homo sapiens
acttttttaaaaagaaactat

SEQ ID NO: 3230473 - DNA, 15 bp, Homo sapiens
acttttttaaataaa

SEQ ID NO: 3230474 - DNA, 18 bp, Homo sapiens
acttttttaaataaactt

SEQ ID NO: 3230475 - DNA, 19 bp, Homo sapiens
acttttttaaataaacttt

SEQ ID NO: 3230476 - DNA, 13 bp, Homo sapiens
acttttttatgaa

SEQ ID NO: 3230477 - DNA, 16 bp, Homo sapiens
acttttttatgaagaa

SEQ ID NO: 3230478 - DNA, 18 bp, Homo sapiens
acttttttatgaagaaaa

SEQ ID NO: 3230479 - DNA, 18 bp, Homo sapiens
acttttttccaaagtgta

SEQ ID NO: 3230480 - DNA, 12 bp, Homo sapiens
acttttttgtgt

SEQ ID NO: 3230481 - DNA, 13 bp, Homo sapiens
actttttttagta

SEQ ID NO: 3230482 - DNA, 21 bp, Homo sapiens
actttttttctgtaccagtta

SEQ ID NO: 3230483 - DNA, 18 bp, Homo sapiens
actttttttttttttccc

SEQ ID NO: 3230484 - DNA, 12 bp, Homo sapiens
agaaaaaaaacc

SEQ ID NO: 3230485 - DNA, 21 bp, Homo sapiens
agaaaaaaaaccttgtaaaaa

SEQ ID NO: 3230486 - DNA, 20 bp, Homo sapiens
agaaaaaaaataacacagag

SEQ ID NO: 3230487 - DNA, 16 bp, Homo sapiens
agaaaaaaatcttctc

SEQ ID NO: 3230488 - DNA, 17 bp, Homo sapiens
agaaaaaaatcttctcc

SEQ ID NO: 3230489 - DNA, 19 bp, Homo sapiens
agaaaaaaattactaattt

SEQ ID NO: 3230490 - DNA, 12 bp, Homo sapiens
agaaaaaaattg

SEQ ID NO: 3230491 - DNA, 14 bp, Homo sapiens
agaaaaaataaatg

SEQ ID NO: 3230492 - DNA, 18 bp, Homo sapiens
agaaaaaataacacacat

SEQ ID NO: 3230493 - DNA, 16 bp, Homo sapiens
agaaaaacaatcttat

SEQ ID NO: 3230494 - DNA, 14 bp, Homo sapiens
agaaaaaccaatga

SEQ ID NO: 3230495 - DNA, 19 bp, Homo sapiens
agaaaaaccccgtttccct

SEQ ID NO: 3230496 - DNA, 19 bp, Homo sapiens
agaaaaataaaaatctctt

SEQ ID NO: 3230497 - DNA, 15 bp, Homo sapiens
agaaaaataaccctt

SEQ ID NO: 3230498 - DNA, 23 bp, Homo sapiens
agaaaaataagctcgagtgaatt

SEQ ID NO: 3230499 - DNA, 13 bp, Homo sapiens
agaaaaatcaaag

SEQ ID NO: 3230500 - DNA, 20 bp, Homo sapiens
agaaaacaaaaaaacctcta

SEQ ID NO: 3230501 - DNA, 21 bp, Homo sapiens
agaaaacaaaaaacgaatgaa

SEQ ID NO: 3230502 - DNA, 22 bp, Homo sapiens
agaaaacaaactaaatgtagtt

SEQ ID NO: 3230503 - DNA, 22 bp, Homo sapiens
agaaaacaacttggcatttcta

SEQ ID NO: 3230504 - DNA, 23 bp, Homo sapiens
agaaaacaacttggcatttctat

SEQ ID NO: 3230505 - DNA, 16 bp, Homo sapiens
agaaaacagaaaacaa

SEQ ID NO: 3230506 - DNA, 13 bp, Homo sapiens
agaaaacagagcc

SEQ ID NO: 3230507 - DNA, 16 bp, Homo sapiens
agaaaacagagcctgc

SEQ ID NO: 3230508 - DNA, 18 bp, Homo sapiens
agaaaacagagcctgcct

SEQ ID NO: 3230509 - DNA, 15 bp, Homo sapiens
agaaaacatgcctct

SEQ ID NO: 3230510 - DNA, 16 bp, Homo sapiens
agaaaaccattttagt

SEQ ID NO: 3230511 - DNA, 20 bp, Homo sapiens
agaaaacggagagtgcttgg

SEQ ID NO: 3230512 - DNA, 21 bp, Homo sapiens
agaaaacggagagtgcttggg

SEQ ID NO: 3230513 - DNA, 20 bp, Homo sapiens
agaaaactttaaaaaatatt

SEQ ID NO: 3230514 - DNA, 13 bp, Homo sapiens
agaaaagaccctg

SEQ ID NO: 3230515 - DNA, 13 bp, Homo sapiens
agaaaagagagaa

SEQ ID NO: 3230516 - DNA, 20 bp, Homo sapiens
agaaaagatacgactttatt

SEQ ID NO: 3230517 - DNA, 15 bp, Homo sapiens
agaaaagcacttttg

SEQ ID NO: 3230518 - DNA, 16 bp, Homo sapiens
agaaaagcacttttgt

SEQ ID NO: 3230519 - DNA, 21 bp, Homo sapiens
agaaaagcaggcctttgcaga

SEQ ID NO: 3230520 - DNA, 13 bp, Homo sapiens
agaaaagccaagc

SEQ ID NO: 3230521 - DNA, 13 bp, Homo sapiens
agaaaagcccatt

SEQ ID NO: 3230522 - DNA, 13 bp, Homo sapiens
agaaaagccgaaa

SEQ ID NO: 3230523 - DNA, 19 bp, Homo sapiens
agaaaagccgaaagggtta

SEQ ID NO: 3230524 - DNA, 21 bp, Homo sapiens
agaaaaggttatgttcatttt

SEQ ID NO: 3230525 - DNA, 14 bp, Homo sapiens
agaaaagtgaattg

SEQ ID NO: 3230526 - DNA, 19 bp, Homo sapiens
agaaaagtgaattgaagtt

SEQ ID NO: 3230527 - DNA, 19 bp, Homo sapiens
agaaaagttgcagatgtat

SEQ ID NO: 3230528 - DNA, 16 bp, Homo sapiens
agaaaatacaataaac

SEQ ID NO: 3230529 - DNA, 23 bp, Homo sapiens
agaaaatagaatgtggccactta

SEQ ID NO: 3230530 - DNA, 18 bp, Homo sapiens
agaaaatcctaactttca

SEQ ID NO: 3230531 - DNA, 11 bp, Homo sapiens
agaaaatgaag

SEQ ID NO: 3230532 - DNA, 19 bp, Homo sapiens
agaaaatgaattttttcca

SEQ ID NO: 3230533 - DNA, 16 bp, Homo sapiens
agaaaatgatgagttt

SEQ ID NO: 3230534 - DNA, 22 bp, Homo sapiens
agaaaatgcggttataaaaaat

SEQ ID NO: 3230535 - DNA, 23 bp, Homo sapiens
agaaaatgcttgacaaatatttt

SEQ ID NO: 3230536 - DNA, 18 bp, Homo sapiens
agaaaatgtaaaggaggg

SEQ ID NO: 3230537 - DNA, 19 bp, Homo sapiens
agaaaatgtaaaggaggga

SEQ ID NO: 3230538 - DNA, 19 bp, Homo sapiens
agaaaatgttatttaacag

SEQ ID NO: 3230539 - DNA, 20 bp, Homo sapiens
agaatcacggtggtaaagaa

SEQ ID NO: 3230540 - DNA, 16 bp, Homo sapiens
agaatcagaagatagt

SEQ ID NO: 3230541 - DNA, 18 bp, Homo sapiens
agaatcagagtagaaata

SEQ ID NO: 3230542 - DNA, 20 bp, Homo sapiens
agaatcatgtcgatcctggg

SEQ ID NO: 3230543 - DNA, 17 bp, Homo sapiens
agaatccacatttctaa

SEQ ID NO: 3230544 - DNA, 20 bp, Homo sapiens
agaatccataaatgtgttcc

SEQ ID NO: 3230545 - DNA, 15 bp, Homo sapiens
agaatcccaaatttg

SEQ ID NO: 3230546 - DNA, 19 bp, Homo sapiens
agaatcccaaatttgattg

SEQ ID NO: 3230547 - DNA, 15 bp, Homo sapiens
agaatcccttaaaat

SEQ ID NO: 3230548 - DNA, 20 bp, Homo sapiens
agaatcccttaaaattacca

SEQ ID NO: 3230549 - DNA, 21 bp, Homo sapiens
agaatcctaggctccacccca

SEQ ID NO: 3230550 - DNA, 20 bp, Homo sapiens
agaatcctcagttggaatca

SEQ ID NO: 3230551 - DNA, 21 bp, Homo sapiens
agaatcctttacattcaactt

SEQ ID NO: 3230552 - DNA, 10 bp, Homo sapiens
agaatctaaa

SEQ ID NO: 3230553 - DNA, 14 bp, Homo sapiens
agaatctttagaga

SEQ ID NO: 3230554 - DNA, 15 bp, Homo sapiens
agaatgaaatgtatg

SEQ ID NO: 3230555 - DNA, 16 bp, Homo sapiens
agaatgaaatgtatgt

SEQ ID NO: 3230556 - DNA, 16 bp, Homo sapiens
agaatgatgcacactg

SEQ ID NO: 3230557 - DNA, 14 bp, Homo sapiens
agaatgattaatca

SEQ ID NO: 3230558 - DNA, 15 bp, Homo sapiens
agaatgattaatcaa

SEQ ID NO: 3230559 - DNA, 18 bp, Homo sapiens
agaatgattaatcaaagg

SEQ ID NO: 3230560 - DNA, 14 bp, Homo sapiens
agaatgatttcatg

SEQ ID NO: 3230561 - DNA, 16 bp, Homo sapiens
agaatgatttttagat

SEQ ID NO: 3230562 - DNA, 19 bp, Homo sapiens
agaatgcagattcctgggc

SEQ ID NO: 3230563 - DNA, 13 bp, Homo sapiens
agaatgctgtaca

SEQ ID NO: 3230564 - DNA, 23 bp, Homo sapiens
agaatggaaaccacaacttttaa

SEQ ID NO: 3230565 - DNA, 13 bp, Homo sapiens
agaatggagacag

SEQ ID NO: 3230566 - DNA, 14 bp, Homo sapiens
agaatggagaggaa

SEQ ID NO: 3230567 - DNA, 19 bp, Homo sapiens
agaatggatcacaagatgg

SEQ ID NO: 3230568 - DNA, 19 bp, Homo sapiens
agaatggctatcaaaagaa

SEQ ID NO: 3230569 - DNA, 21 bp, Homo sapiens
agaatggctatcaaaagaaat

SEQ ID NO: 3230570 - DNA, 18 bp, Homo sapiens
agaatggggatcacagag

SEQ ID NO: 3230571 - DNA, 19 bp, Homo sapiens
agaatggtgtgaacccggg

SEQ ID NO: 3230572 - DNA, 21 bp, Homo sapiens
agaatggttgccttaaagaaa

SEQ ID NO: 3230573 - DNA, 17 bp, Homo sapiens
agaatgtaaaagaactt

SEQ ID NO: 3230574 - DNA, 15 bp, Homo sapiens
agaatgtcagattcc

SEQ ID NO: 3230575 - DNA, 21 bp, Homo sapiens
agaatgtcagattcctttccc

SEQ ID NO: 3230576 - DNA, 21 bp, Homo sapiens
agaatgtggccacttatttca

SEQ ID NO: 3230577 - DNA, 21 bp, Homo sapiens
agaatgtgtgtgtgtggcagg

SEQ ID NO: 3230578 - DNA, 21 bp, Homo sapiens
agaatgttggtttactttcaa

SEQ ID NO: 3230579 - DNA, 18 bp, Homo sapiens
agaatgttttactgtgaa

SEQ ID NO: 3230580 - DNA, 14 bp, Homo sapiens
agaattaaactttt

SEQ ID NO: 3230581 - DNA, 17 bp, Homo sapiens
agaattaacagagattg

SEQ ID NO: 3230582 - DNA, 17 bp, Homo sapiens
agaattacagtacacat

SEQ ID NO: 3230583 - DNA, 15 bp, Homo sapiens
agaattaccattaat

SEQ ID NO: 3230584 - DNA, 16 bp, Homo sapiens
agaattaccattaatt

SEQ ID NO: 3230585 - DNA, 19 bp, Homo sapiens
agaattaccattaattaca

SEQ ID NO: 3230586 - DNA, 15 bp, Homo sapiens
agaattagtatgtct

SEQ ID NO: 3230587 - DNA, 22 bp, Homo sapiens
agaattagtatgtctgtttttg

SEQ ID NO: 3230588 - DNA, 14 bp, Homo sapiens
agaattatctaatt

SEQ ID NO: 3230589 - DNA, 18 bp, Homo sapiens
agaattatctaatttata

SEQ ID NO: 3230590 - DNA, 20 bp, Homo sapiens
agaattatctaatttataaa

SEQ ID NO: 3230591 - DNA, 21 bp, Homo sapiens
agaattatgtaatatattgta

SEQ ID NO: 3230592 - DNA, 23 bp, Homo sapiens
agaattatgtaatatattgtaca

SEQ ID NO: 3230593 - DNA, 11 bp, Homo sapiens
agaattattta

SEQ ID NO: 3230594 - DNA, 18 bp, Homo sapiens
agaattatttttaaaaag

SEQ ID NO: 3230595 - DNA, 23 bp, Homo sapiens
agaattctgattgatttgattgg

SEQ ID NO: 3230596 - DNA, 12 bp, Homo sapiens
agaattctgtac

SEQ ID NO: 3230597 - DNA, 19 bp, Homo sapiens
agaattgaattctggaaac

SEQ ID NO: 3230598 - DNA, 22 bp, Homo sapiens
agaattgatcattttcccccca

SEQ ID NO: 3230599 - DNA, 22 bp, Homo sapiens
agaattgtatctcatactgtct

SEQ ID NO: 3230600 - DNA, 10 bp, Homo sapiens
agaatttaaa

SEQ ID NO: 3230601 - DNA, 14 bp, Homo sapiens
agaatttagatctt

SEQ ID NO: 3230602 - DNA, 22 bp, Homo sapiens
agaatttagggagaaatgttgt

SEQ ID NO: 3230603 - DNA, 15 bp, Homo sapiens
agaatttaggttttt

SEQ ID NO: 3230604 - DNA, 16 bp, Homo sapiens
agaatttatctccctt

SEQ ID NO: 3230605 - DNA, 20 bp, Homo sapiens
agaatttctaccatttcaga

SEQ ID NO: 3230606 - DNA, 22 bp, Homo sapiens
agaatttggaaatcctagtttc

SEQ ID NO: 3230607 - DNA, 17 bp, Homo sapiens
agaattttaaatatttt

SEQ ID NO: 3230608 - DNA, 22 bp, Homo sapiens
agaattttaagtgctttgtaat

SEQ ID NO: 3230609 - DNA, 13 bp, Homo sapiens
agaattttaatgt

SEQ ID NO: 3230610 - DNA, 17 bp, Homo sapiens
agaattttaatgtgaag

SEQ ID NO: 3230611 - DNA, 23 bp, Homo sapiens
agaattttaatgtgaagacattt

SEQ ID NO: 3230612 - DNA, 14 bp, Homo sapiens
agaattttaggaac

SEQ ID NO: 3230613 - DNA, 18 bp, Homo sapiens
agacaaaaagacaaacat

SEQ ID NO: 3230614 - DNA, 14 bp, Homo sapiens
agacaaaaagtata

SEQ ID NO: 3230615 - DNA, 22 bp, Homo sapiens
agacaaaagtctgtctttcctg

SEQ ID NO: 3230616 - DNA, 18 bp, Homo sapiens
agacaaaggttttcctct

SEQ ID NO: 3230617 - DNA, 15 bp, Homo sapiens
agacaaatatttgga

SEQ ID NO: 3230618 - DNA, 18 bp, Homo sapiens
agacaaatcaacagaagc

SEQ ID NO: 3230619 - DNA, 18 bp, Homo sapiens
agacaaatctttaagaat

SEQ ID NO: 3230620 - DNA, 23 bp, Homo sapiens
agacaaatctttaagaatagttc

SEQ ID NO: 3230621 - DNA, 17 bp, Homo sapiens
agacaacagcccaggca

SEQ ID NO: 3230622 - DNA, 23 bp, Homo sapiens
agacaacaggtaaaacagggcca

SEQ ID NO: 3230623 - DNA, 17 bp, Homo sapiens
agacaactcttccattt

SEQ ID NO: 3230624 - DNA, 20 bp, Homo sapiens
agacaactcttccatttatt

SEQ ID NO: 3230625 - DNA, 14 bp, Homo sapiens
agacaactggacaa

SEQ ID NO: 3230626 - DNA, 17 bp, Homo sapiens
agacaagaaatccctgt

SEQ ID NO: 3230627 - DNA, 18 bp, Homo sapiens
agacaagaaatccctgtt

SEQ ID NO: 3230628 - DNA, 14 bp, Homo sapiens
agacaagcaacagg

SEQ ID NO: 3230629 - DNA, 16 bp, Homo sapiens
agacaagcagcccttg

SEQ ID NO: 3230630 - DNA, 19 bp, Homo sapiens
agacaagcagcccttgctt

SEQ ID NO: 3230631 - DNA, 13 bp, Homo sapiens
agacaagccctgg

SEQ ID NO: 3230632 - DNA, 14 bp, Homo sapiens
agacaagccctggc

SEQ ID NO: 3230633 - DNA, 18 bp, Homo sapiens
agacaagccctggcaaca

SEQ ID NO: 3230634 - DNA, 13 bp, Homo sapiens
agacaaggaaata

SEQ ID NO: 3230635 - DNA, 22 bp, Homo sapiens
agacaagtaatttcagtgtaaa

SEQ ID NO: 3230636 - DNA, 13 bp, Homo sapiens
agacaatagtatt

SEQ ID NO: 3230637 - DNA, 16 bp, Homo sapiens
agacaatagtatttct

SEQ ID NO: 3230638 - DNA, 18 bp, Homo sapiens
agacaatcactgaaacaa

SEQ ID NO: 3230639 - DNA, 19 bp, Homo sapiens
agacaatcactgaaacaaa

SEQ ID NO: 3230640 - DNA, 14 bp, Homo sapiens
agacaatcattgtt

SEQ ID NO: 3230641 - DNA, 14 bp, Homo sapiens
agacacaactattt

SEQ ID NO: 3230642 - DNA, 22 bp, Homo sapiens
agacacaaggtgatttcagact

SEQ ID NO: 3230643 - DNA, 16 bp, Homo sapiens
agacacaatatgtatg

SEQ ID NO: 3230644 - DNA, 22 bp, Homo sapiens
agacacacaattcattggctcc

SEQ ID NO: 3230645 - DNA, 23 bp, Homo sapiens
agacacacaattcattggctcct

SEQ ID NO: 3230646 - DNA, 11 bp, Homo sapiens
agacacacaca

SEQ ID NO: 3230647 - DNA, 14 bp, Homo sapiens
agacacacacacgc

SEQ ID NO: 3230648 - DNA, 16 bp, Homo sapiens
agacacacacacgcac

SEQ ID NO: 3230649 - DNA, 18 bp, Homo sapiens
agacacacacacgcacgc

SEQ ID NO: 3230650 - DNA, 20 bp, Homo sapiens
agacacacacacgcacgcac

SEQ ID NO: 3230651 - DNA, 12 bp, Homo sapiens
agacacacagcc

SEQ ID NO: 3230652 - DNA, 20 bp, Homo sapiens
agacacacagcctcacgccc

SEQ ID NO: 3230653 - DNA, 16 bp, Homo sapiens
agacacagaacacaga

SEQ ID NO: 3230654 - DNA, 20 bp, Homo sapiens
agacacagactggcaataaa

SEQ ID NO: 3230655 - DNA, 22 bp, Homo sapiens
agacacagactggcaataaact

SEQ ID NO: 3230656 - DNA, 18 bp, Homo sapiens
agacacagcgtccctagc

SEQ ID NO: 3230657 - DNA, 16 bp, Homo sapiens
agacacaggcccggct

SEQ ID NO: 3230658 - DNA, 17 bp, Homo sapiens
agacacaggcccggctc

SEQ ID NO: 3230659 - DNA, 20 bp, Homo sapiens
agacacaggcccggctccag

SEQ ID NO: 3230660 - DNA, 22 bp, Homo sapiens
agacacaggcccggctccaggc

SEQ ID NO: 3230661 - DNA, 23 bp, Homo sapiens
agacacaggcccggctccaggct

SEQ ID NO: 3230662 - DNA, 18 bp, Homo sapiens
agacaccaaagttctaat

SEQ ID NO: 3230663 - DNA, 14 bp, Homo sapiens
agacaccaaatata

SEQ ID NO: 3230664 - DNA, 21 bp, Homo sapiens
agacctccaataaagtgcctt

SEQ ID NO: 3230665 - DNA, 20 bp, Homo sapiens
agacctccccagcccctagc

SEQ ID NO: 3230666 - DNA, 17 bp, Homo sapiens
agacctgaataccactt

SEQ ID NO: 3230667 - DNA, 23 bp, Homo sapiens
agacctgaataccacttacctca

SEQ ID NO: 3230668 - DNA, 15 bp, Homo sapiens
agacctgaattcttt

SEQ ID NO: 3230669 - DNA, 18 bp, Homo sapiens
agacctgcttcctgaaat

SEQ ID NO: 3230670 - DNA, 13 bp, Homo sapiens
agacctgtaatca

SEQ ID NO: 3230671 - DNA, 23 bp, Homo sapiens
agacctgtcttccaaggagacca

SEQ ID NO: 3230672 - DNA, 22 bp, Homo sapiens
agacctgtgctagttttacaga

SEQ ID NO: 3230673 - DNA, 23 bp, Homo sapiens
agacctgtgctagttttacagat

SEQ ID NO: 3230674 - DNA, 21 bp, Homo sapiens
agaccttgttacttctgaggt

SEQ ID NO: 3230675 - DNA, 14 bp, Homo sapiens
agacgcaggaatgg

SEQ ID NO: 3230676 - DNA, 13 bp, Homo sapiens
agacgctgcactt

SEQ ID NO: 3230677 - DNA, 16 bp, Homo sapiens
agacgctgccgctgcc

SEQ ID NO: 3230678 - DNA, 12 bp, Homo sapiens
agacggcggcca

SEQ ID NO: 3230679 - DNA, 22 bp, Homo sapiens
agacggcggccaggcacagggc

SEQ ID NO: 3230680 - DNA, 18 bp, Homo sapiens
agacgggcaagaagctgc

SEQ ID NO: 3230681 - DNA, 15 bp, Homo sapiens
agacgggcacagaca

SEQ ID NO: 3230682 - DNA, 16 bp, Homo sapiens
agacgtccatagctcc

SEQ ID NO: 3230683 - DNA, 22 bp, Homo sapiens
agacgtgcagcgcccctctgca

SEQ ID NO: 3230684 - DNA, 19 bp, Homo sapiens
agacgtgtggcaatagtgg

SEQ ID NO: 3230685 - DNA, 16 bp, Homo sapiens
agacgtttaactgcag

SEQ ID NO: 3230686 - DNA, 13 bp, Homo sapiens
agactaagaaata

SEQ ID NO: 3230687 - DNA, 14 bp, Homo sapiens
agactaagaaatat

SEQ ID NO: 3230688 - DNA, 15 bp, Homo sapiens
agactacacaggatg

SEQ ID NO: 3230689 - DNA, 23 bp, Homo sapiens
agactagatgtagtattttttgt

SEQ ID NO: 3230690 - DNA, 20 bp, Homo sapiens
agactatatacatgtgtgta

SEQ ID NO: 3230691 - DNA, 21 bp, Homo sapiens
agactatatacatgtgtgtat

SEQ ID NO: 3230692 - DNA, 19 bp, Homo sapiens
agactatatatataaatgt

SEQ ID NO: 3230693 - DNA, 15 bp, Homo sapiens
agactatctaaatgt

SEQ ID NO: 3230694 - DNA, 17 bp, Homo sapiens
agactatctaaatgttg

SEQ ID NO: 3230695 - DNA, 18 bp, Homo sapiens
agactatctaaatgttga

SEQ ID NO: 3230696 - DNA, 20 bp, Homo sapiens
agactatggagcctggcaca

SEQ ID NO: 3230697 - DNA, 21 bp, Homo sapiens
agactatggagcctggcacag

SEQ ID NO: 3230698 - DNA, 17 bp, Homo sapiens
agactcaaatgttctaa

SEQ ID NO: 3230699 - DNA, 14 bp, Homo sapiens
agactcacttacat

SEQ ID NO: 3230700 - DNA, 18 bp, Homo sapiens
agactcagcgctcctcct

SEQ ID NO: 3230701 - DNA, 22 bp, Homo sapiens
agactcagcgctcctcctgtgt

SEQ ID NO: 3230702 - DNA, 19 bp, Homo sapiens
agactcaggccaagaaacg

SEQ ID NO: 3230703 - DNA, 12 bp, Homo sapiens
agactcagtgtt

SEQ ID NO: 3230704 - DNA, 15 bp, Homo sapiens
agactcattcttctg

SEQ ID NO: 3230705 - DNA, 24 bp, Homo sapiens
agactccagaatctgctgttgcca

SEQ ID NO: 3230706 - DNA, 19 bp, Homo sapiens
agactccggcctgtaatca

SEQ ID NO: 3230707 - DNA, 18 bp, Homo sapiens
agactccttcgtccccag

SEQ ID NO: 3230708 - DNA, 19 bp, Homo sapiens
agactctacagaggccatg

SEQ ID NO: 3230709 - DNA, 16 bp, Homo sapiens
agactctagagtccaa

SEQ ID NO: 3230710 - DNA, 15 bp, Homo sapiens
agactctagggtcca

SEQ ID NO: 3230711 - DNA, 18 bp, Homo sapiens
agactctaggttatacaa

SEQ ID NO: 3230712 - DNA, 21 bp, Homo sapiens
agactctaggttatacaataa

SEQ ID NO: 3230713 - DNA, 11 bp, Homo sapiens
agactctcagc

SEQ ID NO: 3230714 - DNA, 18 bp, Homo sapiens
agactctcagcccagaag

SEQ ID NO: 3230715 - DNA, 13 bp, Homo sapiens
agactctggtgtt

SEQ ID NO: 3230716 - DNA, 17 bp, Homo sapiens
agactctgtaacatcac

SEQ ID NO: 3230717 - DNA, 18 bp, Homo sapiens
agactctgtctcaaaaaa

SEQ ID NO: 3230718 - DNA, 17 bp, Homo sapiens
agactctttaataaatt

SEQ ID NO: 3230719 - DNA, 18 bp, Homo sapiens
agactcttttccttccct

SEQ ID NO: 3230720 - DNA, 16 bp, Homo sapiens
agactgaaagcagcag

SEQ ID NO: 3230721 - DNA, 16 bp, Homo sapiens
agactgaacatgttta

SEQ ID NO: 3230722 - DNA, 16 bp, Homo sapiens
agactgaactgtgtga

SEQ ID NO: 3230723 - DNA, 13 bp, Homo sapiens
agactgagaactt

SEQ ID NO: 3230724 - DNA, 18 bp, Homo sapiens
agactgagaacttttttg

SEQ ID NO: 3230725 - DNA, 16 bp, Homo sapiens
agactgaggacaaagt

SEQ ID NO: 3230726 - DNA, 17 bp, Homo sapiens
agactgaggacaaagtg

SEQ ID NO: 3230727 - DNA, 18 bp, Homo sapiens
agactgaggtataaagac

SEQ ID NO: 3230728 - DNA, 14 bp, Homo sapiens
agactgagtcagat

SEQ ID NO: 3230729 - DNA, 17 bp, Homo sapiens
agactgagtcagatggg

SEQ ID NO: 3230730 - DNA, 21 bp, Homo sapiens
agactgataacttggggaggc

SEQ ID NO: 3230731 - DNA, 16 bp, Homo sapiens
agactgcaaacttttt

SEQ ID NO: 3230732 - DNA, 21 bp, Homo sapiens
agactgcaaacttttttatat

SEQ ID NO: 3230733 - DNA, 17 bp, Homo sapiens
agactgcgttctgcaag

SEQ ID NO: 3230734 - DNA, 18 bp, Homo sapiens
agactgctagtgttctgt

SEQ ID NO: 3230735 - DNA, 14 bp, Homo sapiens
agactgctgggact

SEQ ID NO: 3230736 - DNA, 16 bp, Homo sapiens
agactgcttcccatcc

SEQ ID NO: 3230737 - DNA, 17 bp, Homo sapiens
agactgcttcccatcct

SEQ ID NO: 3230738 - DNA, 16 bp, Homo sapiens
agactggaaaaaatga

SEQ ID NO: 3230739 - DNA, 18 bp, Homo sapiens
agactggaaaaaatgagc

SEQ ID NO: 3230740 - DNA, 11 bp, Homo sapiens
agactggaaga

SEQ ID NO: 3230741 - DNA, 19 bp, Homo sapiens
agactggaagacacttcag

SEQ ID NO: 3230742 - DNA, 16 bp, Homo sapiens
agactggaagcacagc

SEQ ID NO: 3230743 - DNA, 19 bp, Homo sapiens
agactggaagctaatttgc

SEQ ID NO: 3230744 - DNA, 19 bp, Homo sapiens
agactggaagttcatacct

SEQ ID NO: 3230745 - DNA, 21 bp, Homo sapiens
agactggaagttcatacctaa

SEQ ID NO: 3230746 - DNA, 23 bp, Homo sapiens
agactggagtgaggcttccaggc

SEQ ID NO: 3230747 - DNA, 13 bp, Homo sapiens
agactggcaataa

SEQ ID NO: 3230748 - DNA, 12 bp, Homo sapiens
agactggcaggc

SEQ ID NO: 3230749 - DNA, 15 bp, Homo sapiens
agactggcggagaag

SEQ ID NO: 3230750 - DNA, 19 bp, Homo sapiens
agactgggaaggcttggga

SEQ ID NO: 3230751 - DNA, 21 bp, Homo sapiens
agactgggaaggcttgggatt

SEQ ID NO: 3230752 - DNA, 22 bp, Homo sapiens
agactgggaaggcttgggattt

SEQ ID NO: 3230753 - DNA, 23 bp, Homo sapiens
agactgggaaggcttgggatttg

SEQ ID NO: 3230754 - DNA, 18 bp, Homo sapiens
agactgggagccacttct

SEQ ID NO: 3230755 - DNA, 20 bp, Homo sapiens
agactgggagccacttctcc

SEQ ID NO: 3230756 - DNA, 18 bp, Homo sapiens
agactggtcctgtgtgca

SEQ ID NO: 3230757 - DNA, 14 bp, Homo sapiens
agactggttttctg

SEQ ID NO: 3230758 - DNA, 15 bp, Homo sapiens
agactggttttctgc

SEQ ID NO: 3230759 - DNA, 16 bp, Homo sapiens
agactggttttctgcc

SEQ ID NO: 3230760 - DNA, 16 bp, Homo sapiens
agactgtaagatgttg

SEQ ID NO: 3230761 - DNA, 21 bp, Homo sapiens
agactgtaagatgttgtttta

SEQ ID NO: 3230762 - DNA, 14 bp, Homo sapiens
agactgtacaaagt

SEQ ID NO: 3230763 - DNA, 12 bp, Homo sapiens
agactgtactgg

SEQ ID NO: 3230764 - DNA, 22 bp, Homo sapiens
agactgtagattgcttctgtag

SEQ ID NO: 3230765 - DNA, 18 bp, Homo sapiens
agactgtagcctggatat

SEQ ID NO: 3230766 - DNA, 20 bp, Homo sapiens
agactgtcggagaggctgtc

SEQ ID NO: 3230767 - DNA, 24 bp, Homo sapiens
agactgtcggagaggctgtctggg

SEQ ID NO: 3230768 - DNA, 18 bp, Homo sapiens
agactgtgaacttgactg

SEQ ID NO: 3230769 - DNA, 21 bp, Homo sapiens
agactgtgaacttgactgggt

SEQ ID NO: 3230770 - DNA, 18 bp, Homo sapiens
agactgtgacaactgtct

SEQ ID NO: 3230771 - DNA, 16 bp, Homo sapiens
agactgtgctctctgt

SEQ ID NO: 3230772 - DNA, 15 bp, Homo sapiens
agactgttactttgg

SEQ ID NO: 3230773 - DNA, 14 bp, Homo sapiens
agactgttttactg

SEQ ID NO: 3230774 - DNA, 23 bp, Homo sapiens
agactgttttactgttttaattg

SEQ ID NO: 3230775 - DNA, 21 bp, Homo sapiens
agacttaaagggcccaatgaa

SEQ ID NO: 3230776 - DNA, 20 bp, Homo sapiens
agacttactttactcatttt

SEQ ID NO: 3230777 - DNA, 19 bp, Homo sapiens
agacttagtatattttctt

SEQ ID NO: 3230778 - DNA, 16 bp, Homo sapiens
agacttcaaaaggaat

SEQ ID NO: 3230779 - DNA, 17 bp, Homo sapiens
agacttcccaacagcct

SEQ ID NO: 3230780 - DNA, 20 bp, Homo sapiens
agacttctggttgtatttct

SEQ ID NO: 3230781 - DNA, 20 bp, Homo sapiens
agacttgaaagttttccagt

SEQ ID NO: 3230782 - DNA, 15 bp, Homo sapiens
agacttgagaacttg

SEQ ID NO: 3230783 - DNA, 21 bp, Homo sapiens
agacttggttggtagggtggg

SEQ ID NO: 3230784 - DNA, 14 bp, Homo sapiens
agactttaattata

SEQ ID NO: 3230785 - DNA, 13 bp, Homo sapiens
agactttagctta

SEQ ID NO: 3230786 - DNA, 17 bp, Homo sapiens
agactttagtgccctgc

SEQ ID NO: 3230787 - DNA, 18 bp, Homo sapiens
agactttagtgccctgcc

SEQ ID NO: 3230788 - DNA, 17 bp, Homo sapiens
agactttatgtagtttt

SEQ ID NO: 3230789 - DNA, 23 bp, Homo sapiens
agaggacagagcaggggctccag

SEQ ID NO: 3230790 - DNA, 19 bp, Homo sapiens
agaggacagtctggagaag

SEQ ID NO: 3230791 - DNA, 20 bp, Homo sapiens
agaggacagtctggagaagg

SEQ ID NO: 3230792 - DNA, 23 bp, Homo sapiens
agaggacgcacgctcgctgccat

SEQ ID NO: 3230793 - DNA, 21 bp, Homo sapiens
agaggactcccaaccctggct

SEQ ID NO: 3230794 - DNA, 18 bp, Homo sapiens
agaggactcgcttgtaaa

SEQ ID NO: 3230795 - DNA, 19 bp, Homo sapiens
agaggactcgcttgtaaat

SEQ ID NO: 3230796 - DNA, 20 bp, Homo sapiens
agaggactgagactggcact

SEQ ID NO: 3230797 - DNA, 22 bp, Homo sapiens
agaggactgtagggagggcggc

SEQ ID NO: 3230798 - DNA, 22 bp, Homo sapiens
agaggacttttctttgtggctt

SEQ ID NO: 3230799 - DNA, 23 bp, Homo sapiens
agaggacttttctttgtggcttc

SEQ ID NO: 3230800 - DNA, 15 bp, Homo sapiens
agaggagaaacacat

SEQ ID NO: 3230801 - DNA, 15 bp, Homo sapiens
agaggagaccctgga

SEQ ID NO: 3230802 - DNA, 10 bp, Homo sapiens
agaggagaga

SEQ ID NO: 3230803 - DNA, 11 bp, Homo sapiens
agaggagagag

SEQ ID NO: 3230804 - DNA, 17 bp, Homo sapiens
agaggagccaccagttc

SEQ ID NO: 3230805 - DNA, 17 bp, Homo sapiens
agaggagccagacagac

SEQ ID NO: 3230806 - DNA, 21 bp, Homo sapiens
agaggagctctaccctgctcc

SEQ ID NO: 3230807 - DNA, 13 bp, Homo sapiens
agaggaggtgaga

SEQ ID NO: 3230808 - DNA, 19 bp, Homo sapiens
agaggatccgtgctgtctc

SEQ ID NO: 3230809 - DNA, 14 bp, Homo sapiens
agaggatggccagt

SEQ ID NO: 3230810 - DNA, 16 bp, Homo sapiens
agaggatggccagtgt

SEQ ID NO: 3230811 - DNA, 22 bp, Homo sapiens
agaggatggccagtgtctgtcc

SEQ ID NO: 3230812 - DNA, 21 bp, Homo sapiens
agaggatgtggaaagcacttt

SEQ ID NO: 3230813 - DNA, 20 bp, Homo sapiens
agaggatttttttctgagcg

SEQ ID NO: 3230814 - DNA, 15 bp, Homo sapiens
agaggcaacaggatt

SEQ ID NO: 3230815 - DNA, 24 bp, Homo sapiens
agaggcaccactaaaagatcgcag

SEQ ID NO: 3230816 - DNA, 12 bp, Homo sapiens
agaggcagagag

SEQ ID NO: 3230817 - DNA, 23 bp, Homo sapiens
agaggcagagagcggtctcaggc

SEQ ID NO: 3230818 - DNA, 12 bp, Homo sapiens
agaggcagcatg

SEQ ID NO: 3230819 - DNA, 20 bp, Homo sapiens
agaggcagcatgcttgggct

SEQ ID NO: 3230820 - DNA, 19 bp, Homo sapiens
agaggcagccccattctgc

SEQ ID NO: 3230821 - DNA, 21 bp, Homo sapiens
agaggcagccccattctgcct

SEQ ID NO: 3230822 - DNA, 24 bp, Homo sapiens
agaggcagccccattctgcctgcc

SEQ ID NO: 3230823 - DNA, 19 bp, Homo sapiens
agaggcagcttcaagtgcc

SEQ ID NO: 3230824 - DNA, 10 bp, Homo sapiens
agaggcaggg

SEQ ID NO: 3230825 - DNA, 13 bp, Homo sapiens
agaggcagggagg

SEQ ID NO: 3230826 - DNA, 17 bp, Homo sapiens
agaggcagggaggggac

SEQ ID NO: 3230827 - DNA, 14 bp, Homo sapiens
agaggcatcctgcc

SEQ ID NO: 3230828 - DNA, 18 bp, Homo sapiens
agaggcatcctgcctggg

SEQ ID NO: 3230829 - DNA, 16 bp, Homo sapiens
agaggccagccccacc

SEQ ID NO: 3230830 - DNA, 17 bp, Homo sapiens
agaggccagccccaccc

SEQ ID NO: 3230831 - DNA, 18 bp, Homo sapiens
agaggccagccccaccca

SEQ ID NO: 3230832 - DNA, 14 bp, Homo sapiens
agaggcccccagcc

SEQ ID NO: 3230833 - DNA, 16 bp, Homo sapiens
agaggcccccagccca

SEQ ID NO: 3230834 - DNA, 17 bp, Homo sapiens
agaggcccccagcccag

SEQ ID NO: 3230835 - DNA, 17 bp, Homo sapiens
agaggcccgcccgccca

SEQ ID NO: 3230836 - DNA, 14 bp, Homo sapiens
agaggccctggagg

SEQ ID NO: 3230837 - DNA, 15 bp, Homo sapiens
agaggccctggaggt

SEQ ID NO: 3230838 - DNA, 23 bp, Homo sapiens
agaggccctggaggtctccaggg

SEQ ID NO: 3230839 - DNA, 22 bp, Homo sapiens
agaggccgaaggtgcctcagac

SEQ ID NO: 3230840 - DNA, 12 bp, Homo sapiens
agaggcctcagt

SEQ ID NO: 3230841 - DNA, 23 bp, Homo sapiens
agaggcgagaggtgagctacttt

SEQ ID NO: 3230842 - DNA, 16 bp, Homo sapiens
agaggcggcctcgtgc

SEQ ID NO: 3230843 - DNA, 13 bp, Homo sapiens
agaggcgggccag

SEQ ID NO: 3230844 - DNA, 17 bp, Homo sapiens
agaggctagcttctgct

SEQ ID NO: 3230845 - DNA, 16 bp, Homo sapiens
agaggctccccagggc

SEQ ID NO: 3230846 - DNA, 17 bp, Homo sapiens
agaggctccccagggct

SEQ ID NO: 3230847 - DNA, 16 bp, Homo sapiens
agaggctcttgatggt

SEQ ID NO: 3230848 - DNA, 14 bp, Homo sapiens
agaggctgcccctc

SEQ ID NO: 3230849 - DNA, 16 bp, Homo sapiens
agaggctgcccctctc

SEQ ID NO: 3230850 - DNA, 14 bp, Homo sapiens
agaggctgggagca

SEQ ID NO: 3230851 - DNA, 17 bp, Homo sapiens
agaggcttctccgccag

SEQ ID NO: 3230852 - DNA, 21 bp, Homo sapiens
agaggcttctccgccagcctc

SEQ ID NO: 3230853 - DNA, 23 bp, Homo sapiens
agaggcttctcctgttttatata

SEQ ID NO: 3230854 - DNA, 17 bp, Homo sapiens
agagggaagagtgcatt

SEQ ID NO: 3230855 - DNA, 17 bp, Homo sapiens
agagggaatggatgggg

SEQ ID NO: 3230856 - DNA, 12 bp, Homo sapiens
agagggacagat

SEQ ID NO: 3230857 - DNA, 21 bp, Homo sapiens
agagggacagcccactgagaa

SEQ ID NO: 3230858 - DNA, 13 bp, Homo sapiens
agagggagagaga

SEQ ID NO: 3230859 - DNA, 12 bp, Homo sapiens
agagggagcagg

SEQ ID NO: 3230860 - DNA, 14 bp, Homo sapiens
agagggagcaggcc

SEQ ID NO: 3230861 - DNA, 20 bp, Homo sapiens
agagggaggtcactggaaag

SEQ ID NO: 3230862 - DNA, 22 bp, Homo sapiens
agagggaggtcactggaaaggg

SEQ ID NO: 3230863 - DNA, 18 bp, Homo sapiens
agagggatgggttcctgc

SEQ ID NO: 3230864 - DNA, 20 bp, Homo sapiens
agagggcaatctttgccttt

SEQ ID NO: 3230865 - DNA, 15 bp, Homo sapiens
agagggcagtacctg

SEQ ID NO: 3230866 - DNA, 17 bp, Homo sapiens
agagggcagtacctggg

SEQ ID NO: 3230867 - DNA, 18 bp, Homo sapiens
agagggcagtacctggga

SEQ ID NO: 3230868 - DNA, 23 bp, Homo sapiens
agagggcatgcgcacaaggctga

SEQ ID NO: 3230869 - DNA, 18 bp, Homo sapiens
agagggccaagacttggc

SEQ ID NO: 3230870 - DNA, 19 bp, Homo sapiens
agagggcccagcccagagc

SEQ ID NO: 3230871 - DNA, 19 bp, Homo sapiens
agagggcctgtgggagcct

SEQ ID NO: 3230872 - DNA, 20 bp, Homo sapiens
agagggctcgaggggtgggc

SEQ ID NO: 3230873 - DNA, 18 bp, Homo sapiens
agagggctggaggcccag

SEQ ID NO: 3230874 - DNA, 19 bp, Homo sapiens
agagggctggaggcccagg

SEQ ID NO: 3230875 - DNA, 13 bp, Homo sapiens
agagggcttcctc

SEQ ID NO: 3230876 - DNA, 14 bp, Homo sapiens
agagggcttgtgaa

SEQ ID NO: 3230877 - DNA, 18 bp, Homo sapiens
agagggcttgtgaacaga

SEQ ID NO: 3230878 - DNA, 22 bp, Homo sapiens
agaggggaaaccagtgtagcct

SEQ ID NO: 3230879 - DNA, 16 bp, Homo sapiens
agaggggaagggccag

SEQ ID NO: 3230880 - DNA, 17 bp, Homo sapiens
agaggggccaggcccag

SEQ ID NO: 3230881 - DNA, 13 bp, Homo sapiens
agaggggctgggg

SEQ ID NO: 3230882 - DNA, 19 bp, Homo sapiens
agagggggagtagccaagc

SEQ ID NO: 3230883 - DNA, 16 bp, Homo sapiens
agaggggtgcacccac

SEQ ID NO: 3230884 - DNA, 16 bp, Homo sapiens
agaggggtggagactg

SEQ ID NO: 3230885 - DNA, 22 bp, Homo sapiens
agagggtgggagcctaaggaag

SEQ ID NO: 3230886 - DNA, 19 bp, Homo sapiens
agagggtggtgacctctgc

SEQ ID NO: 3230887 - DNA, 13 bp, Homo sapiens
agagggttcctgt

SEQ ID NO: 3230888 - DNA, 18 bp, Homo sapiens
agaggtaacagaacagct

SEQ ID NO: 3230889 - DNA, 16 bp, Homo sapiens
agaggtattaaaacta

SEQ ID NO: 3230890 - DNA, 17 bp, Homo sapiens
agaggtattaaaactaa

SEQ ID NO: 3230891 - DNA, 17 bp, Homo sapiens
agaggtatttatcttta

SEQ ID NO: 3230892 - DNA, 13 bp, Homo sapiens
agaggtccagccc

SEQ ID NO: 3230893 - DNA, 15 bp, Homo sapiens
agaggtccagcccat

SEQ ID NO: 3230894 - DNA, 12 bp, Homo sapiens
agaggtctgagc

SEQ ID NO: 3230895 - DNA, 15 bp, Homo sapiens
agaggtctgagccct

SEQ ID NO: 3230896 - DNA, 20 bp, Homo sapiens
agaggtgcttctgcctgtgc

SEQ ID NO: 3230897 - DNA, 18 bp, Homo sapiens
agaggtggccagagctgg

SEQ ID NO: 3230898 - DNA, 17 bp, Homo sapiens
agaggtgggagggccct

SEQ ID NO: 3230899 - DNA, 19 bp, Homo sapiens
agaggtgggcagctgggcc

SEQ ID NO: 3230900 - DNA, 13 bp, Homo sapiens
agaggtgggcagg

SEQ ID NO: 3230901 - DNA, 19 bp, Homo sapiens
agaggtgggcaggtggtgg

SEQ ID NO: 3230902 - DNA, 13 bp, Homo sapiens
agaggtgggccag

SEQ ID NO: 3230903 - DNA, 24 bp, Homo sapiens
agaggtgggccagtctgtggatca

SEQ ID NO: 3230904 - DNA, 23 bp, Homo sapiens
agaggttaaggtgggtccaggaa

SEQ ID NO: 3230905 - DNA, 14 bp, Homo sapiens
agaggttaggagta

SEQ ID NO: 3230906 - DNA, 16 bp, Homo sapiens
agaggttatctgcctg

SEQ ID NO: 3230907 - DNA, 17 bp, Homo sapiens
agaggttatctgcctgg

SEQ ID NO: 3230908 - DNA, 20 bp, Homo sapiens
agaggttatctgcctggcct

SEQ ID NO: 3230909 - DNA, 19 bp, Homo sapiens
agaggttttaaagtgatta

SEQ ID NO: 3230910 - DNA, 19 bp, Homo sapiens
agaggttttgttgttttat

SEQ ID NO: 3230911 - DNA, 15 bp, Homo sapiens
agagtaaaaactgaa

SEQ ID NO: 3230912 - DNA, 16 bp, Homo sapiens
agagtaaataaactgt

SEQ ID NO: 3230913 - DNA, 17 bp, Homo sapiens
agagtaaataaactgtt

SEQ ID NO: 3230914 - DNA, 20 bp, Homo sapiens
agagtaaataaactgtttat

SEQ ID NO: 3230915 - DNA, 15 bp, Homo sapiens
agcaatatttatgga

SEQ ID NO: 3230916 - DNA, 22 bp, Homo sapiens
agcaatccatgttagtttttac

SEQ ID NO: 3230917 - DNA, 23 bp, Homo sapiens
agcaatccatgttagtttttact

SEQ ID NO: 3230918 - DNA, 23 bp, Homo sapiens
agcaatctccttactgtgtttca

SEQ ID NO: 3230919 - DNA, 16 bp, Homo sapiens
agcaatctgaccctat

SEQ ID NO: 3230920 - DNA, 21 bp, Homo sapiens
agcaatgacatctcaggggcc

SEQ ID NO: 3230921 - DNA, 23 bp, Homo sapiens
agcaatgcaagaaaaaaacttac

SEQ ID NO: 3230922 - DNA, 20 bp, Homo sapiens
agcaatgcccgtaatgctta

SEQ ID NO: 3230923 - DNA, 23 bp, Homo sapiens
agcaattccatgctataaaaact

SEQ ID NO: 3230924 - DNA, 18 bp, Homo sapiens
agcaattctcctgcctca

SEQ ID NO: 3230925 - DNA, 15 bp, Homo sapiens
agcaattgccctgta

SEQ ID NO: 3230926 - DNA, 20 bp, Homo sapiens
agcaatttatacaatatcat

SEQ ID NO: 3230927 - DNA, 16 bp, Homo sapiens
agcaattttctttgtt

SEQ ID NO: 3230928 - DNA, 10 bp, Homo sapiens
agcacaaccc

SEQ ID NO: 3230929 - DNA, 16 bp, Homo sapiens
agcacaagtacttttg

SEQ ID NO: 3230930 - DNA, 19 bp, Homo sapiens
agcacaatttgcactaaat

SEQ ID NO: 3230931 - DNA, 16 bp, Homo sapiens
agcacaccagccgctg

SEQ ID NO: 3230932 - DNA, 17 bp, Homo sapiens
agcacaccagccgctgc

SEQ ID NO: 3230933 - DNA, 20 bp, Homo sapiens
agcacaccagccgctgcagg

SEQ ID NO: 3230934 - DNA, 13 bp, Homo sapiens
agcacagagggct

SEQ ID NO: 3230935 - DNA, 15 bp, Homo sapiens
agcacagattttaat

SEQ ID NO: 3230936 - DNA, 23 bp, Homo sapiens
agcacagattttaattgtcatgg

SEQ ID NO: 3230937 - DNA, 21 bp, Homo sapiens
agcacagcagcccctgcacaa

SEQ ID NO: 3230938 - DNA, 13 bp, Homo sapiens
agcacagcccagg

SEQ ID NO: 3230939 - DNA, 16 bp, Homo sapiens
agcacagcccagggcc

SEQ ID NO: 3230940 - DNA, 14 bp, Homo sapiens
agcacagccctggg

SEQ ID NO: 3230941 - DNA, 15 bp, Homo sapiens
agcacagccctggga

SEQ ID NO: 3230942 - DNA, 22 bp, Homo sapiens
agcacagccctgggagggggct

SEQ ID NO: 3230943 - DNA, 12 bp, Homo sapiens
agcacagcctag

SEQ ID NO: 3230944 - DNA, 16 bp, Homo sapiens
agcacagcttagattt

SEQ ID NO: 3230945 - DNA, 20 bp, Homo sapiens
agcacagcttgacctgaggc

SEQ ID NO: 3230946 - DNA, 12 bp, Homo sapiens
agcacaggcagc

SEQ ID NO: 3230947 - DNA, 15 bp, Homo sapiens
agcacaggctggcag

SEQ ID NO: 3230948 - DNA, 12 bp, Homo sapiens
agcacaggggcc

SEQ ID NO: 3230949 - DNA, 19 bp, Homo sapiens
agcacaggggccccagatc

SEQ ID NO: 3230950 - DNA, 23 bp, Homo sapiens
agcacaggtcccacctccagccc

SEQ ID NO: 3230951 - DNA, 12 bp, Homo sapiens
agcacagtgtgt

SEQ ID NO: 3230952 - DNA, 18 bp, Homo sapiens
agcacagtgttaaatgaa

SEQ ID NO: 3230953 - DNA, 22 bp, Homo sapiens
agcacagtgttaaatgaaattg

SEQ ID NO: 3230954 - DNA, 16 bp, Homo sapiens
agcacatctgcatttt

SEQ ID NO: 3230955 - DNA, 19 bp, Homo sapiens
agcacatgctggccagcct

SEQ ID NO: 3230956 - DNA, 21 bp, Homo sapiens
agcacatgctggccagcctgg

SEQ ID NO: 3230957 - DNA, 16 bp, Homo sapiens
agcacatgcttagctt

SEQ ID NO: 3230958 - DNA, 15 bp, Homo sapiens
agcacatgtaataaa

SEQ ID NO: 3230959 - DNA, 13 bp, Homo sapiens
agcacatgttcat

SEQ ID NO: 3230960 - DNA, 14 bp, Homo sapiens
agcacatgttcata

SEQ ID NO: 3230961 - DNA, 23 bp, Homo sapiens
agcaccaccctagtcccttcccc

SEQ ID NO: 3230962 - DNA, 19 bp, Homo sapiens
agcaccccatgccaaagct

SEQ ID NO: 3230963 - DNA, 18 bp, Homo sapiens
agcacccccaagcctggg

SEQ ID NO: 3230964 - DNA, 13 bp, Homo sapiens
agcacccccaccc

SEQ ID NO: 3230965 - DNA, 15 bp, Homo sapiens
agcacccccacccac

SEQ ID NO: 3230966 - DNA, 16 bp, Homo sapiens
agcacccccacccacc

SEQ ID NO: 3230967 - DNA, 20 bp, Homo sapiens
agcaccccctgctccaccag

SEQ ID NO: 3230968 - DNA, 15 bp, Homo sapiens
agcaccctctcctgg

SEQ ID NO: 3230969 - DNA, 16 bp, Homo sapiens
agcaccctctcctggg

SEQ ID NO: 3230970 - DNA, 17 bp, Homo sapiens
agcaccgtgatggagag

SEQ ID NO: 3230971 - DNA, 21 bp, Homo sapiens
agcacctactatgtgctgggt

SEQ ID NO: 3230972 - DNA, 16 bp, Homo sapiens
agcacctccaaccaaa

SEQ ID NO: 3230973 - DNA, 17 bp, Homo sapiens
agcacctccaaccaaat

SEQ ID NO: 3230974 - DNA, 16 bp, Homo sapiens
agcacctccaggcctg

SEQ ID NO: 3230975 - DNA, 14 bp, Homo sapiens
agcacctccccgct

SEQ ID NO: 3230976 - DNA, 13 bp, Homo sapiens
agcacctcctgcc

SEQ ID NO: 3230977 - DNA, 18 bp, Homo sapiens
agcacctgcctcctcgtt

SEQ ID NO: 3230978 - DNA, 19 bp, Homo sapiens
agcaccttcctcacttcca

SEQ ID NO: 3230979 - DNA, 21 bp, Homo sapiens
agcaccttctttctggactgg

SEQ ID NO: 3230980 - DNA, 19 bp, Homo sapiens
agcacctttgcacaggatg

SEQ ID NO: 3230981 - DNA, 15 bp, Homo sapiens
agcacggacaataaa

SEQ ID NO: 3230982 - DNA, 18 bp, Homo sapiens
agcacgtttaaagttctg

SEQ ID NO: 3230983 - DNA, 18 bp, Homo sapiens
agcactacaccttgcctt

SEQ ID NO: 3230984 - DNA, 17 bp, Homo sapiens
agcactacataaactga

SEQ ID NO: 3230985 - DNA, 18 bp, Homo sapiens
agcactagacatgtcatg

SEQ ID NO: 3230986 - DNA, 15 bp, Homo sapiens
agcactagagaatgc

SEQ ID NO: 3230987 - DNA, 20 bp, Homo sapiens
agcactagagaatgcacaga

SEQ ID NO: 3230988 - DNA, 23 bp, Homo sapiens
agcactaggttcaattccctgaa

SEQ ID NO: 3230989 - DNA, 15 bp, Homo sapiens
agcactagtttgatt

SEQ ID NO: 3230990 - DNA, 13 bp, Homo sapiens
agcactattttat

SEQ ID NO: 3230991 - DNA, 23 bp, Homo sapiens
agcactccctaatttatgtgcta

SEQ ID NO: 3230992 - DNA, 19 bp, Homo sapiens
agcactctgagtttaccat

SEQ ID NO: 3230993 - DNA, 23 bp, Homo sapiens
agcactctgagtttaccatttgt

SEQ ID NO: 3230994 - DNA, 11 bp, Homo sapiens
agcactgaaaa

SEQ ID NO: 3230995 - DNA, 20 bp, Homo sapiens
agcactgacctgtcatgccc

SEQ ID NO: 3230996 - DNA, 22 bp, Homo sapiens
agcactgacctgtcatgccccc

SEQ ID NO: 3230997 - DNA, 22 bp, Homo sapiens
agcactgagggtggcactcaac

SEQ ID NO: 3230998 - DNA, 17 bp, Homo sapiens
agcactgatttcacaac

SEQ ID NO: 3230999 - DNA, 16 bp, Homo sapiens
agcactggagtgcagg

SEQ ID NO: 3231000 - DNA, 19 bp, Homo sapiens
agcactggagtgcagggag

SEQ ID NO: 3231001 - DNA, 20 bp, Homo sapiens
agcactggagtgcagggagg

SEQ ID NO: 3231002 - DNA, 12 bp, Homo sapiens
agcactggccag

SEQ ID NO: 3231003 - DNA, 14 bp, Homo sapiens
agcactggccagag

SEQ ID NO: 3231004 - DNA, 23 bp, Homo sapiens
agcactggccagagagggcccag

SEQ ID NO: 3231005 - DNA, 18 bp, Homo sapiens
agcactggctctctccag

SEQ ID NO: 3231006 - DNA, 19 bp, Homo sapiens
agcactggctctctccagg

SEQ ID NO: 3231007 - DNA, 19 bp, Homo sapiens
agcactgggttgcagggga

SEQ ID NO: 3231008 - DNA, 23 bp, Homo sapiens
agcactggtgaactgagctgggc

SEQ ID NO: 3231009 - DNA, 13 bp, Homo sapiens
agcactgtccctt

SEQ ID NO: 3231010 - DNA, 15 bp, Homo sapiens
agcactgtgctaata

SEQ ID NO: 3231011 - DNA, 18 bp, Homo sapiens
agcacttaaattcctcaa

SEQ ID NO: 3231012 - DNA, 22 bp, Homo sapiens
agcacttgcaaccgtctgttat

SEQ ID NO: 3231013 - DNA, 18 bp, Homo sapiens
agcacttggactcttgct

SEQ ID NO: 3231014 - DNA, 21 bp, Homo sapiens
agcacttggactcttgctctt

SEQ ID NO: 3231015 - DNA, 22 bp, Homo sapiens
agcactttcattgccagtgtct

SEQ ID NO: 3231016 - DNA, 19 bp, Homo sapiens
agcactttgaaatacctca

SEQ ID NO: 3231017 - DNA, 16 bp, Homo sapiens
agcactttgcacttaa

SEQ ID NO: 3231018 - DNA, 12 bp, Homo sapiens
agcactttggga

SEQ ID NO: 3231019 - DNA, 15 bp, Homo sapiens
agcacttttgttatt

SEQ ID NO: 3231020 - DNA, 16 bp, Homo sapiens
agcacttttgttattc

SEQ ID NO: 3231021 - DNA, 23 bp, Homo sapiens
agcacttttgttattccatcaat

SEQ ID NO: 3231022 - DNA, 18 bp, Homo sapiens
agcagaaaataaaggaag

SEQ ID NO: 3231023 - DNA, 17 bp, Homo sapiens
agcagaaaggctctgaa

SEQ ID NO: 3231024 - DNA, 11 bp, Homo sapiens
agcagaaatgc

SEQ ID NO: 3231025 - DNA, 16 bp, Homo sapiens
agcagaactcattcta

SEQ ID NO: 3231026 - DNA, 23 bp, Homo sapiens
agcagaactcattctatccccaa

SEQ ID NO: 3231027 - DNA, 14 bp, Homo sapiens
agcagaactgaagt

SEQ ID NO: 3231028 - DNA, 14 bp, Homo sapiens
agcagaagaaagga

SEQ ID NO: 3231029 - DNA, 14 bp, Homo sapiens
agcagaaggaaaca

SEQ ID NO: 3231030 - DNA, 23 bp, Homo sapiens
agcagaatcctcagttggaatca

SEQ ID NO: 3231031 - DNA, 21 bp, Homo sapiens
agcagaatggtgatcactcca

SEQ ID NO: 3231032 - DNA, 13 bp, Homo sapiens
agcagaattttaa

SEQ ID NO: 3231033 - DNA, 18 bp, Homo sapiens
agcagaattttaatgtga

SEQ ID NO: 3231034 - DNA, 20 bp, Homo sapiens
agcagaattttaatgtgaag

SEQ ID NO: 3231035 - DNA, 13 bp, Homo sapiens
agcagacagaaac

SEQ ID NO: 3231036 - DNA, 14 bp, Homo sapiens
agcagacagaaact

SEQ ID NO: 3231037 - DNA, 18 bp, Homo sapiens
agcagacagaaactggat

SEQ ID NO: 3231038 - DNA, 21 bp, Homo sapiens
agcagacagtgttttctggga

SEQ ID NO: 3231039 - DNA, 13 bp, Homo sapiens
agcagagaagggc

SEQ ID NO: 3231040 - DNA, 21 bp, Homo sapiens
agcagagaatgaaagggccca

SEQ ID NO: 3231041 - DNA, 22 bp, Homo sapiens
agccataaaagcattgtctctc

SEQ ID NO: 3231042 - DNA, 14 bp, Homo sapiens
agccataacttgaa

SEQ ID NO: 3231043 - DNA, 21 bp, Homo sapiens
agccataattccaccatcata

SEQ ID NO: 3231044 - DNA, 19 bp, Homo sapiens
agccatagcctccacggag

SEQ ID NO: 3231045 - DNA, 23 bp, Homo sapiens
agccatagtttgggtatttttgg

SEQ ID NO: 3231046 - DNA, 19 bp, Homo sapiens
agccatcactagaagaaaa

SEQ ID NO: 3231047 - DNA, 20 bp, Homo sapiens
agccatcactagaagaaaag

SEQ ID NO: 3231048 - DNA, 21 bp, Homo sapiens
agccatcactagaagaaaagc

SEQ ID NO: 3231049 - DNA, 23 bp, Homo sapiens
agccatcactagaagaaaagccc

SEQ ID NO: 3231050 - DNA, 18 bp, Homo sapiens
agccatcataggaaggga

SEQ ID NO: 3231051 - DNA, 21 bp, Homo sapiens
agccatcatatcccctgtgcc

SEQ ID NO: 3231052 - DNA, 15 bp, Homo sapiens
agccatcatgccttg

SEQ ID NO: 3231053 - DNA, 14 bp, Homo sapiens
agccatcgtcctgg

SEQ ID NO: 3231054 - DNA, 18 bp, Homo sapiens
agccatcgtcctgggact

SEQ ID NO: 3231055 - DNA, 19 bp, Homo sapiens
agccatctaatgcttgttt

SEQ ID NO: 3231056 - DNA, 19 bp, Homo sapiens
agccatgatcgagccactg

SEQ ID NO: 3231057 - DNA, 20 bp, Homo sapiens
agccatgatttgtcccagcc

SEQ ID NO: 3231058 - DNA, 21 bp, Homo sapiens
agccatgatttgtcccagcct

SEQ ID NO: 3231059 - DNA, 23 bp, Homo sapiens
agccatgatttgtcccagcctgg

SEQ ID NO: 3231060 - DNA, 13 bp, Homo sapiens
agccatgcccagg

SEQ ID NO: 3231061 - DNA, 17 bp, Homo sapiens
agccatgcctcatgcca

SEQ ID NO: 3231062 - DNA, 15 bp, Homo sapiens
agccatgctgggaag

SEQ ID NO: 3231063 - DNA, 19 bp, Homo sapiens
agccatgctgggaagacgc

SEQ ID NO: 3231064 - DNA, 18 bp, Homo sapiens
agccatggctcaggcaag

SEQ ID NO: 3231065 - DNA, 13 bp, Homo sapiens
agccatgggcctg

SEQ ID NO: 3231066 - DNA, 21 bp, Homo sapiens
agccatgggcctgggcctgct

SEQ ID NO: 3231067 - DNA, 20 bp, Homo sapiens
agccatgtactcaagtacca

SEQ ID NO: 3231068 - DNA, 21 bp, Homo sapiens
agccattaaatgaatattttg

SEQ ID NO: 3231069 - DNA, 22 bp, Homo sapiens
agccattcctggtacccagcca

SEQ ID NO: 3231070 - DNA, 23 bp, Homo sapiens
agccattcctggtacccagccat

SEQ ID NO: 3231071 - DNA, 15 bp, Homo sapiens
agccattgaccaccc

SEQ ID NO: 3231072 - DNA, 16 bp, Homo sapiens
agccattgcggcccca

SEQ ID NO: 3231073 - DNA, 17 bp, Homo sapiens
agccattgcggccccag

SEQ ID NO: 3231074 - DNA, 22 bp, Homo sapiens
agccattgcggccccaggaggg

SEQ ID NO: 3231075 - DNA, 22 bp, Homo sapiens
agccatttcactctcaaacttc

SEQ ID NO: 3231076 - DNA, 14 bp, Homo sapiens
agccattttgtgaa

SEQ ID NO: 3231077 - DNA, 19 bp, Homo sapiens
agccattttgtgaatggat

SEQ ID NO: 3231078 - DNA, 12 bp, Homo sapiens
agccatttttaa

SEQ ID NO: 3231079 - DNA, 16 bp, Homo sapiens
agccatttttaatgat

SEQ ID NO: 3231080 - DNA, 23 bp, Homo sapiens
agcccaacagacaccatcttttg

SEQ ID NO: 3231081 - DNA, 14 bp, Homo sapiens
agcccaagaggact

SEQ ID NO: 3231082 - DNA, 18 bp, Homo sapiens
agcccaagaggtctgagc

SEQ ID NO: 3231083 - DNA, 22 bp, Homo sapiens
agcccaagaggtctgagccctg

SEQ ID NO: 3231084 - DNA, 19 bp, Homo sapiens
agcccaagcttaatagccc

SEQ ID NO: 3231085 - DNA, 21 bp, Homo sapiens
agcccaagcttaatagccctc

SEQ ID NO: 3231086 - DNA, 24 bp, Homo sapiens
agcccaaggtgctgatgtcaaagt

SEQ ID NO: 3231087 - DNA, 10 bp, Homo sapiens
agcccaagtc

SEQ ID NO: 3231088 - DNA, 21 bp, Homo sapiens
agcccaagttcatgcagctgt

SEQ ID NO: 3231089 - DNA, 18 bp, Homo sapiens
agcccaatgcatagagcc

SEQ ID NO: 3231090 - DNA, 20 bp, Homo sapiens
agcccaatgcatagagccct

SEQ ID NO: 3231091 - DNA, 21 bp, Homo sapiens
agcccaatgcatagagccctg

SEQ ID NO: 3231092 - DNA, 23 bp, Homo sapiens
agcccaatgcatagagccctggc

SEQ ID NO: 3231093 - DNA, 22 bp, Homo sapiens
agcccacaaccttcggctccgg

SEQ ID NO: 3231094 - DNA, 24 bp, Homo sapiens
agcccacactatgcacagagccca

SEQ ID NO: 3231095 - DNA, 23 bp, Homo sapiens
agcccacacttgagaggatgaat

SEQ ID NO: 3231096 - DNA, 23 bp, Homo sapiens
agcccacagcacagctccctgcc

SEQ ID NO: 3231097 - DNA, 23 bp, Homo sapiens
agcccacattggattcatcagca

SEQ ID NO: 3231098 - DNA, 13 bp, Homo sapiens
agcccaccctgct

SEQ ID NO: 3231099 - DNA, 14 bp, Homo sapiens
agcccacctgcacc

SEQ ID NO: 3231100 - DNA, 13 bp, Homo sapiens
agcccaccttggc

SEQ ID NO: 3231101 - DNA, 20 bp, Homo sapiens
agcccacggctaagaggctg

SEQ ID NO: 3231102 - DNA, 21 bp, Homo sapiens
agcccacggctaagaggctgc

SEQ ID NO: 3231103 - DNA, 20 bp, Homo sapiens
agcccactgcccaccccctc

SEQ ID NO: 3231104 - DNA, 13 bp, Homo sapiens
agcccacttctgc

SEQ ID NO: 3231105 - DNA, 12 bp, Homo sapiens
agcccagacaaa

SEQ ID NO: 3231106 - DNA, 13 bp, Homo sapiens
agcccagactctg

SEQ ID NO: 3231107 - DNA, 14 bp, Homo sapiens
agcccagactctga

SEQ ID NO: 3231108 - DNA, 22 bp, Homo sapiens
agcccagactttagtgccctgc

SEQ ID NO: 3231109 - DNA, 23 bp, Homo sapiens
agcccagactttagtgccctgcc

SEQ ID NO: 3231110 - DNA, 12 bp, Homo sapiens
agcccagagact

SEQ ID NO: 3231111 - DNA, 20 bp, Homo sapiens
agcccagagactttgtagat

SEQ ID NO: 3231112 - DNA, 21 bp, Homo sapiens
agcccagagcctggctgccca

SEQ ID NO: 3231113 - DNA, 13 bp, Homo sapiens
agcccagaggtaa

SEQ ID NO: 3231114 - DNA, 16 bp, Homo sapiens
agcccagaggtaacag

SEQ ID NO: 3231115 - DNA, 21 bp, Homo sapiens
agcccagaggtaacagaacag

SEQ ID NO: 3231116 - DNA, 15 bp, Homo sapiens
agcccagcagggcct

SEQ ID NO: 3231117 - DNA, 12 bp, Homo sapiens
agcccagccagg

SEQ ID NO: 3231118 - DNA, 13 bp, Homo sapiens
agcccagctgcct

SEQ ID NO: 3231119 - DNA, 15 bp, Homo sapiens
agcccagctgcctgg

SEQ ID NO: 3231120 - DNA, 17 bp, Homo sapiens
agcccagcttcctggtg

SEQ ID NO: 3231121 - DNA, 18 bp, Homo sapiens
agcccagcttcctggtgt

SEQ ID NO: 3231122 - DNA, 24 bp, Homo sapiens
agcccaggaatttgaagctgcagt

SEQ ID NO: 3231123 - DNA, 14 bp, Homo sapiens
agcccaggagagag

SEQ ID NO: 3231124 - DNA, 17 bp, Homo sapiens
agcccaggagagagaaa

SEQ ID NO: 3231125 - DNA, 22 bp, Homo sapiens
agcccaggagggcatccatacc

SEQ ID NO: 3231126 - DNA, 21 bp, Homo sapiens
agcccaggatactggcacaga

SEQ ID NO: 3231127 - DNA, 12 bp, Homo sapiens
agcccaggccac

SEQ ID NO: 3231128 - DNA, 11 bp, Homo sapiens
agcccaggccg

SEQ ID NO: 3231129 - DNA, 22 bp, Homo sapiens
agcccaggctgatgcttgaagt

SEQ ID NO: 3231130 - DNA, 13 bp, Homo sapiens
agcccagggcctg

SEQ ID NO: 3231131 - DNA, 16 bp, Homo sapiens
agcccagggctcctgc

SEQ ID NO: 3231132 - DNA, 17 bp, Homo sapiens
agcccaggtgccagcct

SEQ ID NO: 3231133 - DNA, 14 bp, Homo sapiens
agcccagtgaagcc

SEQ ID NO: 3231134 - DNA, 15 bp, Homo sapiens
agcccagtgaagcct

SEQ ID NO: 3231135 - DNA, 18 bp, Homo sapiens
agcccagtgaagcctctg

SEQ ID NO: 3231136 - DNA, 18 bp, Homo sapiens
agcccagtgctgctgtaa

SEQ ID NO: 3231137 - DNA, 17 bp, Homo sapiens
agcccatactcagcctg

SEQ ID NO: 3231138 - DNA, 18 bp, Homo sapiens
agcccatactcagcctgc

SEQ ID NO: 3231139 - DNA, 16 bp, Homo sapiens
agcccatccatagtaa

SEQ ID NO: 3231140 - DNA, 20 bp, Homo sapiens
agcccatccattaggccagc

SEQ ID NO: 3231141 - DNA, 15 bp, Homo sapiens
agcccatccctgcct

SEQ ID NO: 3231142 - DNA, 20 bp, Homo sapiens
agcccatgcccacctgccca

SEQ ID NO: 3231143 - DNA, 22 bp, Homo sapiens
agcccatgcccacctgcccatc

SEQ ID NO: 3231144 - DNA, 18 bp, Homo sapiens
agcccatggcccccaata

SEQ ID NO: 3231145 - DNA, 19 bp, Homo sapiens
agcccatggcccccaataa

SEQ ID NO: 3231146 - DNA, 21 bp, Homo sapiens
agcccatggcccccaataaag

SEQ ID NO: 3231147 - DNA, 16 bp, Homo sapiens
agcccatggcctctgg

SEQ ID NO: 3231148 - DNA, 22 bp, Homo sapiens
agcccatggcctctggccaggc

SEQ ID NO: 3231149 - DNA, 20 bp, Homo sapiens
agcccatgttctgcccccag

SEQ ID NO: 3231150 - DNA, 23 bp, Homo sapiens
agcccatgttctgcccccagccc

SEQ ID NO: 3231151 - DNA, 18 bp, Homo sapiens
agccccaacgggaaagga

SEQ ID NO: 3231152 - DNA, 15 bp, Homo sapiens
agccccaagtcctga

SEQ ID NO: 3231153 - DNA, 20 bp, Homo sapiens
agccccacccccagccaggc

SEQ ID NO: 3231154 - DNA, 21 bp, Homo sapiens
agccccacccctaagtgccca

SEQ ID NO: 3231155 - DNA, 23 bp, Homo sapiens
agccccaccctccttgagactgg

SEQ ID NO: 3231156 - DNA, 23 bp, Homo sapiens
agccccacctctccaagtctctc

SEQ ID NO: 3231157 - DNA, 19 bp, Homo sapiens
agccccactgccagcagca

SEQ ID NO: 3231158 - DNA, 21 bp, Homo sapiens
agccccagacaacagcccagg

SEQ ID NO: 3231159 - DNA, 18 bp, Homo sapiens
agccccagagatgccagc

SEQ ID NO: 3231160 - DNA, 21 bp, Homo sapiens
agccccagagatgccagccct

SEQ ID NO: 3231161 - DNA, 18 bp, Homo sapiens
agccccagcagccctcaa

SEQ ID NO: 3231162 - DNA, 12 bp, Homo sapiens
agccccagggcc

SEQ ID NO: 3231163 - DNA, 14 bp, Homo sapiens
agccccagggcctg

SEQ ID NO: 3231164 - DNA, 14 bp, Homo sapiens
agccccaggggggc

SEQ ID NO: 3231165 - DNA, 17 bp, Homo sapiens
agcgctcctcctgtgtg

SEQ ID NO: 3231166 - DNA, 21 bp, Homo sapiens
agcgctgcagtagctgtggcc

SEQ ID NO: 3231167 - DNA, 16 bp, Homo sapiens
agcggaaaagttgtct

SEQ ID NO: 3231168 - DNA, 15 bp, Homo sapiens
agcggagcccagcct

SEQ ID NO: 3231169 - DNA, 21 bp, Homo sapiens
agcggaggttgcagtgagctg

SEQ ID NO: 3231170 - DNA, 17 bp, Homo sapiens
agcggagtctgtcctgt

SEQ ID NO: 3231171 - DNA, 19 bp, Homo sapiens
agcggagttcctaacagga

SEQ ID NO: 3231172 - DNA, 14 bp, Homo sapiens
agcggcgccctgga

SEQ ID NO: 3231173 - DNA, 16 bp, Homo sapiens
agcggcgccctggact

SEQ ID NO: 3231174 - DNA, 21 bp, Homo sapiens
agcggcgccctggacttggta

SEQ ID NO: 3231175 - DNA, 14 bp, Homo sapiens
agcggctacaaagc

SEQ ID NO: 3231176 - DNA, 16 bp, Homo sapiens
agcggctgttccccct

SEQ ID NO: 3231177 - DNA, 12 bp, Homo sapiens
agcgggaggcag

SEQ ID NO: 3231178 - DNA, 15 bp, Homo sapiens
agcgggaggcagagt

SEQ ID NO: 3231179 - DNA, 16 bp, Homo sapiens
agcgggcacagggcac

SEQ ID NO: 3231180 - DNA, 23 bp, Homo sapiens
agcgggcacagggcaccagaggc

SEQ ID NO: 3231181 - DNA, 22 bp, Homo sapiens
agcgggcggaggggatccagcc

SEQ ID NO: 3231182 - DNA, 21 bp, Homo sapiens
agcgggctaacgggaggctgg

SEQ ID NO: 3231183 - DNA, 15 bp, Homo sapiens
agcggggacagctcc

SEQ ID NO: 3231184 - DNA, 19 bp, Homo sapiens
agcggggcgaagcccaggc

SEQ ID NO: 3231185 - DNA, 14 bp, Homo sapiens
agcggggggagggt

SEQ ID NO: 3231186 - DNA, 16 bp, Homo sapiens
agcggggtatgaagag

SEQ ID NO: 3231187 - DNA, 14 bp, Homo sapiens
agcggtttggggag

SEQ ID NO: 3231188 - DNA, 23 bp, Homo sapiens
agcgtagctaagtgaaaaggtca

SEQ ID NO: 3231189 - DNA, 15 bp, Homo sapiens
agcgtcagctgctcc

SEQ ID NO: 3231190 - DNA, 17 bp, Homo sapiens
agcgtcccagggtaccc

SEQ ID NO: 3231191 - DNA, 15 bp, Homo sapiens
agcgtccctggcgca

SEQ ID NO: 3231192 - DNA, 13 bp, Homo sapiens
agcgtctttaaga

SEQ ID NO: 3231193 - DNA, 15 bp, Homo sapiens
agcgtctttaagaga

SEQ ID NO: 3231194 - DNA, 17 bp, Homo sapiens
agcgtctttaagagact

SEQ ID NO: 3231195 - DNA, 18 bp, Homo sapiens
agcgtctttaagagactc

SEQ ID NO: 3231196 - DNA, 20 bp, Homo sapiens
agcgtctttaagagactcac

SEQ ID NO: 3231197 - DNA, 18 bp, Homo sapiens
agcgtgaaggacttagcc

SEQ ID NO: 3231198 - DNA, 22 bp, Homo sapiens
agcgtgaaggacttagccgact

SEQ ID NO: 3231199 - DNA, 22 bp, Homo sapiens
agcgtgagccactgcaccgggc

SEQ ID NO: 3231200 - DNA, 16 bp, Homo sapiens
agcgtggggtagcaga

SEQ ID NO: 3231201 - DNA, 12 bp, Homo sapiens
agcgtgtgtatc

SEQ ID NO: 3231202 - DNA, 14 bp, Homo sapiens
agcgttcccagcag

SEQ ID NO: 3231203 - DNA, 23 bp, Homo sapiens
agcgtttagtttctagaggcctc

SEQ ID NO: 3231204 - DNA, 15 bp, Homo sapiens
agctaaaatgatttt

SEQ ID NO: 3231205 - DNA, 18 bp, Homo sapiens
agctaaacggattccaaa

SEQ ID NO: 3231206 - DNA, 21 bp, Homo sapiens
agctaaagaggctgaaagagg

SEQ ID NO: 3231207 - DNA, 16 bp, Homo sapiens
agctaaagcccaacct

SEQ ID NO: 3231208 - DNA, 13 bp, Homo sapiens
agctaaatccttt

SEQ ID NO: 3231209 - DNA, 23 bp, Homo sapiens
agctaaccagttaccacacatct

SEQ ID NO: 3231210 - DNA, 19 bp, Homo sapiens
agctaaggacatttcccag

SEQ ID NO: 3231211 - DNA, 20 bp, Homo sapiens
agctaagggtgggtgctcag

SEQ ID NO: 3231212 - DNA, 21 bp, Homo sapiens
agctaagggtgggtgctcaga

SEQ ID NO: 3231213 - DNA, 17 bp, Homo sapiens
agctaatctgtagggct

SEQ ID NO: 3231214 - DNA, 13 bp, Homo sapiens
agctaatgggaca

SEQ ID NO: 3231215 - DNA, 19 bp, Homo sapiens
agctacccaaaagagaaaa

SEQ ID NO: 3231216 - DNA, 17 bp, Homo sapiens
agctacccactatcctt

SEQ ID NO: 3231217 - DNA, 19 bp, Homo sapiens
agctacccttttcctttgt

SEQ ID NO: 3231218 - DNA, 16 bp, Homo sapiens
agctactaaaatcagt

SEQ ID NO: 3231219 - DNA, 13 bp, Homo sapiens
agctactaatgat

SEQ ID NO: 3231220 - DNA, 18 bp, Homo sapiens
agctactaatgatgtttt

SEQ ID NO: 3231221 - DNA, 14 bp, Homo sapiens
agctactcagaagc

SEQ ID NO: 3231222 - DNA, 20 bp, Homo sapiens
agctactgatttcctttgga

SEQ ID NO: 3231223 - DNA, 19 bp, Homo sapiens
agctactgcggaaaaggaa

SEQ ID NO: 3231224 - DNA, 19 bp, Homo sapiens
agctactgtgtgtgtgaat

SEQ ID NO: 3231225 - DNA, 19 bp, Homo sapiens
agctacttaagagaaatgg

SEQ ID NO: 3231226 - DNA, 14 bp, Homo sapiens
agctacttgggagg

SEQ ID NO: 3231227 - DNA, 16 bp, Homo sapiens
agctacttgggaggct

SEQ ID NO: 3231228 - DNA, 21 bp, Homo sapiens
agctacttgggaggctgaggc

SEQ ID NO: 3231229 - DNA, 15 bp, Homo sapiens
agctactttccattt

SEQ ID NO: 3231230 - DNA, 15 bp, Homo sapiens
agctagactggagtg

SEQ ID NO: 3231231 - DNA, 16 bp, Homo sapiens
agctagcttttaggaa

SEQ ID NO: 3231232 - DNA, 21 bp, Homo sapiens
agctaggaagagcaggactcc

SEQ ID NO: 3231233 - DNA, 19 bp, Homo sapiens
agctaggatggttctgtga

SEQ ID NO: 3231234 - DNA, 16 bp, Homo sapiens
agctaggccccagagg

SEQ ID NO: 3231235 - DNA, 19 bp, Homo sapiens
agctaggccccagaggccc

SEQ ID NO: 3231236 - DNA, 20 bp, Homo sapiens
agctaggccccagaggccct

SEQ ID NO: 3231237 - DNA, 14 bp, Homo sapiens
agctaggcctggcc

SEQ ID NO: 3231238 - DNA, 21 bp, Homo sapiens
agctaggcctggccagatgca

SEQ ID NO: 3231239 - DNA, 16 bp, Homo sapiens
agctagtatcttcaaa

SEQ ID NO: 3231240 - DNA, 17 bp, Homo sapiens
agctagtgcctttagag

SEQ ID NO: 3231241 - DNA, 23 bp, Homo sapiens
agctagtgtacctcctctcagtg

SEQ ID NO: 3231242 - DNA, 15 bp, Homo sapiens
agctatcacctagca

SEQ ID NO: 3231243 - DNA, 20 bp, Homo sapiens
agctatcattgcttcctcct

SEQ ID NO: 3231244 - DNA, 18 bp, Homo sapiens
agctatctaggtggagtt

SEQ ID NO: 3231245 - DNA, 18 bp, Homo sapiens
agctatctatatggaatt

SEQ ID NO: 3231246 - DNA, 20 bp, Homo sapiens
agctatggagagaattaaaa

SEQ ID NO: 3231247 - DNA, 18 bp, Homo sapiens
agctatgggagccccagg

SEQ ID NO: 3231248 - DNA, 21 bp, Homo sapiens
agctattactgtctggtttta

SEQ ID NO: 3231249 - DNA, 17 bp, Homo sapiens
agctattgccaaccagt

SEQ ID NO: 3231250 - DNA, 23 bp, Homo sapiens
agctatttttcttgttgcatctt

SEQ ID NO: 3231251 - DNA, 17 bp, Homo sapiens
agctcaaatgaaatgta

SEQ ID NO: 3231252 - DNA, 21 bp, Homo sapiens
agctcaagcccttggggaggg

SEQ ID NO: 3231253 - DNA, 18 bp, Homo sapiens
agctcaagtcttccctga

SEQ ID NO: 3231254 - DNA, 23 bp, Homo sapiens
agctcaagtcttccctgatcaag

SEQ ID NO: 3231255 - DNA, 11 bp, Homo sapiens
agctcaagttt

SEQ ID NO: 3231256 - DNA, 17 bp, Homo sapiens
agctcaagtttaaaagc

SEQ ID NO: 3231257 - DNA, 18 bp, Homo sapiens
agctcacagtgctgtgtg

SEQ ID NO: 3231258 - DNA, 15 bp, Homo sapiens
agctcacccctgggc

SEQ ID NO: 3231259 - DNA, 19 bp, Homo sapiens
agctcacccctgggcaggc

SEQ ID NO: 3231260 - DNA, 12 bp, Homo sapiens
agctcaccctgc

SEQ ID NO: 3231261 - DNA, 22 bp, Homo sapiens
agctcaccctgcccgctcccaa

SEQ ID NO: 3231262 - DNA, 15 bp, Homo sapiens
agctcacctctgaag

SEQ ID NO: 3231263 - DNA, 17 bp, Homo sapiens
agctcagaacccagggc

SEQ ID NO: 3231264 - DNA, 17 bp, Homo sapiens
agctcagcgccagcctg

SEQ ID NO: 3231265 - DNA, 21 bp, Homo sapiens
agctcaggaagaagagatgca

SEQ ID NO: 3231266 - DNA, 14 bp, Homo sapiens
agctcaggcagctc

SEQ ID NO: 3231267 - DNA, 17 bp, Homo sapiens
agctcaggggcagctca

SEQ ID NO: 3231268 - DNA, 20 bp, Homo sapiens
agctcaggtgtccctgcact

SEQ ID NO: 3231269 - DNA, 21 bp, Homo sapiens
agctcaggtgtccctgcactt

SEQ ID NO: 3231270 - DNA, 14 bp, Homo sapiens
agctcataaaatgg

SEQ ID NO: 3231271 - DNA, 21 bp, Homo sapiens
agctcatacaaaataaatggt

SEQ ID NO: 3231272 - DNA, 14 bp, Homo sapiens
agctcatattttgt

SEQ ID NO: 3231273 - DNA, 15 bp, Homo sapiens
agctcatattttgta

SEQ ID NO: 3231274 - DNA, 18 bp, Homo sapiens
agctcatattttgtatat

SEQ ID NO: 3231275 - DNA, 23 bp, Homo sapiens
agctcatctccaaggatcctctc

SEQ ID NO: 3231276 - DNA, 23 bp, Homo sapiens
agctccaagacctgttggttcca

SEQ ID NO: 3231277 - DNA, 22 bp, Homo sapiens
agctccacggtgcgtggctgtg

SEQ ID NO: 3231278 - DNA, 11 bp, Homo sapiens
agctccactct

SEQ ID NO: 3231279 - DNA, 19 bp, Homo sapiens
agctccactctgcttctct

SEQ ID NO: 3231280 - DNA, 18 bp, Homo sapiens
agctccactgtcaccctc

SEQ ID NO: 3231281 - DNA, 18 bp, Homo sapiens
agctccagctcaccagcc

SEQ ID NO: 3231282 - DNA, 14 bp, Homo sapiens
agctccagctttct

SEQ ID NO: 3231283 - DNA, 14 bp, Homo sapiens
agctccagggactg

SEQ ID NO: 3231284 - DNA, 15 bp, Homo sapiens
agctccaggggccct

SEQ ID NO: 3231285 - DNA, 13 bp, Homo sapiens
agctccatctcca

SEQ ID NO: 3231286 - DNA, 18 bp, Homo sapiens
agctcccagctagggggc

SEQ ID NO: 3231287 - DNA, 23 bp, Homo sapiens
agctccccacaccttccagggcc

SEQ ID NO: 3231288 - DNA, 18 bp, Homo sapiens
agctccccagatctccca

SEQ ID NO: 3231289 - DNA, 14 bp, Homo sapiens
agctccccctgtcc

SEQ ID NO: 3231290 - DNA, 21 bp, Homo sapiens
aggaaaaccaagccgtggctt

SEQ ID NO: 3231291 - DNA, 22 bp, Homo sapiens
aggaaaaccaagccgtggcttc

SEQ ID NO: 3231292 - DNA, 23 bp, Homo sapiens
aggaaaaccaagccgtggcttcc

SEQ ID NO: 3231293 - DNA, 20 bp, Homo sapiens
aggaaaactgcatggagacg

SEQ ID NO: 3231294 - DNA, 24 bp, Homo sapiens
aggaaaactgcatggagacgcatt

SEQ ID NO: 3231295 - DNA, 17 bp, Homo sapiens
aggaaaagaaacctggg

SEQ ID NO: 3231296 - DNA, 15 bp, Homo sapiens
aggaaaagggagcta

SEQ ID NO: 3231297 - DNA, 22 bp, Homo sapiens
aggaaaaggttgaataatatat

SEQ ID NO: 3231298 - DNA, 16 bp, Homo sapiens
aggaaaatagtttagg

SEQ ID NO: 3231299 - DNA, 16 bp, Homo sapiens
aggaaaattcttaaaa

SEQ ID NO: 3231300 - DNA, 20 bp, Homo sapiens
aggaaactccacatctgcct

SEQ ID NO: 3231301 - DNA, 20 bp, Homo sapiens
aggaaactcctgacagtctt

SEQ ID NO: 3231302 - DNA, 15 bp, Homo sapiens
aggaaacttttaact

SEQ ID NO: 3231303 - DNA, 20 bp, Homo sapiens
aggaaagaagggggccctgc

SEQ ID NO: 3231304 - DNA, 22 bp, Homo sapiens
aggaaagaagggggccctgcta

SEQ ID NO: 3231305 - DNA, 22 bp, Homo sapiens
aggaaagcaataaatgaatggg

SEQ ID NO: 3231306 - DNA, 15 bp, Homo sapiens
aggaaaggattttac

SEQ ID NO: 3231307 - DNA, 18 bp, Homo sapiens
aggaaaggggagaaggga

SEQ ID NO: 3231308 - DNA, 21 bp, Homo sapiens
aggaaagggggtcccagtggg

SEQ ID NO: 3231309 - DNA, 14 bp, Homo sapiens
aggaaataaaacct

SEQ ID NO: 3231310 - DNA, 17 bp, Homo sapiens
aggaaataaaacctttc

SEQ ID NO: 3231311 - DNA, 19 bp, Homo sapiens
aggaaataaaacctttcaa

SEQ ID NO: 3231312 - DNA, 15 bp, Homo sapiens
aggaaatacacttct

SEQ ID NO: 3231313 - DNA, 21 bp, Homo sapiens
aggaaatagtaccttcaatac

SEQ ID NO: 3231314 - DNA, 12 bp, Homo sapiens
aggaaatattaa

SEQ ID NO: 3231315 - DNA, 14 bp, Homo sapiens
aggaaatattaatt

SEQ ID NO: 3231316 - DNA, 18 bp, Homo sapiens
aggaaatccattgtttaa

SEQ ID NO: 3231317 - DNA, 23 bp, Homo sapiens
aggaaattgagattagagggagg

SEQ ID NO: 3231318 - DNA, 16 bp, Homo sapiens
aggaaatttgtttgta

SEQ ID NO: 3231319 - DNA, 20 bp, Homo sapiens
aggaaatttgtttgtatttt

SEQ ID NO: 3231320 - DNA, 16 bp, Homo sapiens
aggaacaaaaattaca

SEQ ID NO: 3231321 - DNA, 12 bp, Homo sapiens
aggaacacctga

SEQ ID NO: 3231322 - DNA, 14 bp, Homo sapiens
aggaacagtggctg

SEQ ID NO: 3231323 - DNA, 19 bp, Homo sapiens
aggaacatatgaaaataca

SEQ ID NO: 3231324 - DNA, 17 bp, Homo sapiens
aggaacatttaggggca

SEQ ID NO: 3231325 - DNA, 14 bp, Homo sapiens
aggaaccttccttc

SEQ ID NO: 3231326 - DNA, 20 bp, Homo sapiens
aggaaccttccttcctgctt

SEQ ID NO: 3231327 - DNA, 16 bp, Homo sapiens
aggaacgagcactggc

SEQ ID NO: 3231328 - DNA, 21 bp, Homo sapiens
aggaacgagcactggccagag

SEQ ID NO: 3231329 - DNA, 22 bp, Homo sapiens
aggaacgagcactggccagaga

SEQ ID NO: 3231330 - DNA, 13 bp, Homo sapiens
aggaactgggctg

SEQ ID NO: 3231331 - DNA, 23 bp, Homo sapiens
aggaactggggctttgccttgca

SEQ ID NO: 3231332 - DNA, 13 bp, Homo sapiens
aggaactgtacag

SEQ ID NO: 3231333 - DNA, 17 bp, Homo sapiens
aggaactgtccagagag

SEQ ID NO: 3231334 - DNA, 18 bp, Homo sapiens
aggaagaattcctgccat

SEQ ID NO: 3231335 - DNA, 17 bp, Homo sapiens
aggaagagcaggcacat

SEQ ID NO: 3231336 - DNA, 16 bp, Homo sapiens
aggaagagctaataaa

SEQ ID NO: 3231337 - DNA, 19 bp, Homo sapiens
aggaagagggctgagctga

SEQ ID NO: 3231338 - DNA, 21 bp, Homo sapiens
aggaagagggctgagctgagc

SEQ ID NO: 3231339 - DNA, 21 bp, Homo sapiens
aggaagagtagcatttcattc

SEQ ID NO: 3231340 - DNA, 19 bp, Homo sapiens
aggaagatgggggcaagaa

SEQ ID NO: 3231341 - DNA, 20 bp, Homo sapiens
aggaagatgggggcaagaag

SEQ ID NO: 3231342 - DNA, 18 bp, Homo sapiens
aggaagcaccccatgcca

SEQ ID NO: 3231343 - DNA, 20 bp, Homo sapiens
aggaagcctgcagtcctgga

SEQ ID NO: 3231344 - DNA, 15 bp, Homo sapiens
aggaagcgtggggta

SEQ ID NO: 3231345 - DNA, 17 bp, Homo sapiens
aggaagctgtgttgaaa

SEQ ID NO: 3231346 - DNA, 21 bp, Homo sapiens
aggaagctgtgttgaaacaga

SEQ ID NO: 3231347 - DNA, 23 bp, Homo sapiens
aggaagctgtgttgaaacagaaa

SEQ ID NO: 3231348 - DNA, 18 bp, Homo sapiens
aggaaggacagactggcc

SEQ ID NO: 3231349 - DNA, 15 bp, Homo sapiens
aggaaggagagcctg

SEQ ID NO: 3231350 - DNA, 21 bp, Homo sapiens
aggaaggagcggcgccctgga

SEQ ID NO: 3231351 - DNA, 15 bp, Homo sapiens
aggaaggcagctgct

SEQ ID NO: 3231352 - DNA, 17 bp, Homo sapiens
aggaagggaccaaggca

SEQ ID NO: 3231353 - DNA, 12 bp, Homo sapiens
aggaagggcaga

SEQ ID NO: 3231354 - DNA, 19 bp, Homo sapiens
aggaaggggggttgcagtg

SEQ ID NO: 3231355 - DNA, 21 bp, Homo sapiens
aggaagggggtctaaggtcta

SEQ ID NO: 3231356 - DNA, 17 bp, Homo sapiens
aggaaggtctcattctt

SEQ ID NO: 3231357 - DNA, 21 bp, Homo sapiens
aggaaggtgctgagcttagcc

SEQ ID NO: 3231358 - DNA, 16 bp, Homo sapiens
aggaaggtggatggcc

SEQ ID NO: 3231359 - DNA, 18 bp, Homo sapiens
aggaagtgtaacagctga

SEQ ID NO: 3231360 - DNA, 21 bp, Homo sapiens
aggaagtgttgaagggaggtg

SEQ ID NO: 3231361 - DNA, 20 bp, Homo sapiens
aggaagttttgagtttctct

SEQ ID NO: 3231362 - DNA, 21 bp, Homo sapiens
aggaataaataaaaatggata

SEQ ID NO: 3231363 - DNA, 20 bp, Homo sapiens
aggaataaattgctccttga

SEQ ID NO: 3231364 - DNA, 14 bp, Homo sapiens
aggaatagaggaag

SEQ ID NO: 3231365 - DNA, 16 bp, Homo sapiens
aggaatagaggaagaa

SEQ ID NO: 3231366 - DNA, 17 bp, Homo sapiens
aggaatcattcagaaat

SEQ ID NO: 3231367 - DNA, 23 bp, Homo sapiens
aggaatcattcagaaatgttgag

SEQ ID NO: 3231368 - DNA, 18 bp, Homo sapiens
aggaatcattccagtgct

SEQ ID NO: 3231369 - DNA, 20 bp, Homo sapiens
aggaatccagacccggctgc

SEQ ID NO: 3231370 - DNA, 15 bp, Homo sapiens
aggaatcccagaggt

SEQ ID NO: 3231371 - DNA, 14 bp, Homo sapiens
aggaatcctggcag

SEQ ID NO: 3231372 - DNA, 18 bp, Homo sapiens
aggaatcctggcagccca

SEQ ID NO: 3231373 - DNA, 23 bp, Homo sapiens
aggaatcggctggggactgctac

SEQ ID NO: 3231374 - DNA, 22 bp, Homo sapiens
aggaatctgtgggtctgggagt

SEQ ID NO: 3231375 - DNA, 23 bp, Homo sapiens
aggaatgaaatcctgcttcagtg

SEQ ID NO: 3231376 - DNA, 16 bp, Homo sapiens
aggaatgaacttgtta

SEQ ID NO: 3231377 - DNA, 14 bp, Homo sapiens
aggaatgaagaact

SEQ ID NO: 3231378 - DNA, 16 bp, Homo sapiens
aggaatgcctgtgtga

SEQ ID NO: 3231379 - DNA, 23 bp, Homo sapiens
aggaatggaatcttctccagtat

SEQ ID NO: 3231380 - DNA, 19 bp, Homo sapiens
aggaattagagaagctgaa

SEQ ID NO: 3231381 - DNA, 15 bp, Homo sapiens
aggaattcagtgcct

SEQ ID NO: 3231382 - DNA, 16 bp, Homo sapiens
aggaattcagtgcctt

SEQ ID NO: 3231383 - DNA, 20 bp, Homo sapiens
aggaattccccaaagaatgt

SEQ ID NO: 3231384 - DNA, 22 bp, Homo sapiens
aggaattctaggcatcccaggg

SEQ ID NO: 3231385 - DNA, 13 bp, Homo sapiens
aggaattggaaat

SEQ ID NO: 3231386 - DNA, 14 bp, Homo sapiens
aggaatttaaaatt

SEQ ID NO: 3231387 - DNA, 22 bp, Homo sapiens
aggaatttcacctgtaaacctg

SEQ ID NO: 3231388 - DNA, 19 bp, Homo sapiens
aggaatttcttaacttctt

SEQ ID NO: 3231389 - DNA, 23 bp, Homo sapiens
aggaatttcttaacttcttgctt

SEQ ID NO: 3231390 - DNA, 15 bp, Homo sapiens
aggaatttgtacttc

SEQ ID NO: 3231391 - DNA, 19 bp, Homo sapiens
aggaattttattttgctga

SEQ ID NO: 3231392 - DNA, 19 bp, Homo sapiens
aggacaaaaatgaactgaa

SEQ ID NO: 3231393 - DNA, 16 bp, Homo sapiens
aggacaaaacttcttg

SEQ ID NO: 3231394 - DNA, 21 bp, Homo sapiens
aggacaaaacttcttgtcaga

SEQ ID NO: 3231395 - DNA, 22 bp, Homo sapiens
aggacaaaacttcttgtcagac

SEQ ID NO: 3231396 - DNA, 17 bp, Homo sapiens
aggacaaagggagggag

SEQ ID NO: 3231397 - DNA, 19 bp, Homo sapiens
aggacaaagggagggagca

SEQ ID NO: 3231398 - DNA, 20 bp, Homo sapiens
aggacaatcagtcccctccc

SEQ ID NO: 3231399 - DNA, 18 bp, Homo sapiens
aggacacagttcctggga

SEQ ID NO: 3231400 - DNA, 23 bp, Homo sapiens
aggacacatcccggcctcttcca

SEQ ID NO: 3231401 - DNA, 18 bp, Homo sapiens
aggacaccacacccagcc

SEQ ID NO: 3231402 - DNA, 19 bp, Homo sapiens
aggacaccagtgaaagaag

SEQ ID NO: 3231403 - DNA, 22 bp, Homo sapiens
aggacaccagtgaaagaagcca

SEQ ID NO: 3231404 - DNA, 15 bp, Homo sapiens
aggacacgtggcctg

SEQ ID NO: 3231405 - DNA, 13 bp, Homo sapiens
aggacagaaagga

SEQ ID NO: 3231406 - DNA, 19 bp, Homo sapiens
aggacagactggccgggca

SEQ ID NO: 3231407 - DNA, 17 bp, Homo sapiens
aggacagagttcacagg

SEQ ID NO: 3231408 - DNA, 18 bp, Homo sapiens
aggacagagttcacagga

SEQ ID NO: 3231409 - DNA, 18 bp, Homo sapiens
aggacagcccttttgtga

SEQ ID NO: 3231410 - DNA, 17 bp, Homo sapiens
aggacaggaccctcagg

SEQ ID NO: 3231411 - DNA, 15 bp, Homo sapiens
aggacaggcaggcca

SEQ ID NO: 3231412 - DNA, 15 bp, Homo sapiens
aggacagtctggaga

SEQ ID NO: 3231413 - DNA, 16 bp, Homo sapiens
aggacagtttttttgt

SEQ ID NO: 3231414 - DNA, 21 bp, Homo sapiens
aggcagtcgggggctggccta

SEQ ID NO: 3231415 - DNA, 22 bp, Homo sapiens
aggcagtcgggggctggcctag

SEQ ID NO: 3231416 - DNA, 20 bp, Homo sapiens
aggcagtctctatattatgt

SEQ ID NO: 3231417 - DNA, 20 bp, Homo sapiens
aggcagtggcaggggagcag

SEQ ID NO: 3231418 - DNA, 13 bp, Homo sapiens
aggcataggcctg

SEQ ID NO: 3231419 - DNA, 14 bp, Homo sapiens
aggcataggcctgg

SEQ ID NO: 3231420 - DNA, 15 bp, Homo sapiens
aggcataggcctggg

SEQ ID NO: 3231421 - DNA, 16 bp, Homo sapiens
aggcataggcctgggt

SEQ ID NO: 3231422 - DNA, 17 bp, Homo sapiens
aggcataggcctgggtg

SEQ ID NO: 3231423 - DNA, 20 bp, Homo sapiens
aggcataggcctgggtgctg

SEQ ID NO: 3231424 - DNA, 20 bp, Homo sapiens
aggcatatcttctatatctg

SEQ ID NO: 3231425 - DNA, 20 bp, Homo sapiens
aggcatcagtccctatgtat

SEQ ID NO: 3231426 - DNA, 16 bp, Homo sapiens
aggcatcccaggggac

SEQ ID NO: 3231427 - DNA, 20 bp, Homo sapiens
aggcatcctgcctgggtggg

SEQ ID NO: 3231428 - DNA, 22 bp, Homo sapiens
aggcatctctgtactttgcttg

SEQ ID NO: 3231429 - DNA, 21 bp, Homo sapiens
aggcatgaagagcaaaaatat

SEQ ID NO: 3231430 - DNA, 23 bp, Homo sapiens
aggcatgagggatcacagggccc

SEQ ID NO: 3231431 - DNA, 14 bp, Homo sapiens
aggcatgcctctga

SEQ ID NO: 3231432 - DNA, 18 bp, Homo sapiens
aggcatggctcagagctt

SEQ ID NO: 3231433 - DNA, 15 bp, Homo sapiens
aggcatgtcccaccc

SEQ ID NO: 3231434 - DNA, 16 bp, Homo sapiens
aggcatgtcccaccca

SEQ ID NO: 3231435 - DNA, 14 bp, Homo sapiens
aggcatgtcctgga

SEQ ID NO: 3231436 - DNA, 19 bp, Homo sapiens
aggcatgttctctgaggac

SEQ ID NO: 3231437 - DNA, 21 bp, Homo sapiens
aggcattaatgtttctatctg

SEQ ID NO: 3231438 - DNA, 13 bp, Homo sapiens
aggcattggatat

SEQ ID NO: 3231439 - DNA, 20 bp, Homo sapiens
aggcattgttagtttagtgt

SEQ ID NO: 3231440 - DNA, 14 bp, Homo sapiens
aggccaaagataaa

SEQ ID NO: 3231441 - DNA, 20 bp, Homo sapiens
aggccaaaggccagtggaag

SEQ ID NO: 3231442 - DNA, 13 bp, Homo sapiens
aggccaaccagcc

SEQ ID NO: 3231443 - DNA, 19 bp, Homo sapiens
aggccaaccagcccgacag

SEQ ID NO: 3231444 - DNA, 14 bp, Homo sapiens
aggccaagagcaga

SEQ ID NO: 3231445 - DNA, 13 bp, Homo sapiens
aggccaaggcagg

SEQ ID NO: 3231446 - DNA, 18 bp, Homo sapiens
aggccaagtcaggccctt

SEQ ID NO: 3231447 - DNA, 16 bp, Homo sapiens
aggccaagttgtcagc

SEQ ID NO: 3231448 - DNA, 21 bp, Homo sapiens
aggccaccccctatcctctga

SEQ ID NO: 3231449 - DNA, 15 bp, Homo sapiens
aggccacctctccaa

SEQ ID NO: 3231450 - DNA, 15 bp, Homo sapiens
aggccactgtggcca

SEQ ID NO: 3231451 - DNA, 18 bp, Homo sapiens
aggccactgtggccagag

SEQ ID NO: 3231452 - DNA, 19 bp, Homo sapiens
aggccactgtggccagagc

SEQ ID NO: 3231453 - DNA, 21 bp, Homo sapiens
aggccactgtggccagagctg

SEQ ID NO: 3231454 - DNA, 22 bp, Homo sapiens
aggccactgtggccagagctgg

SEQ ID NO: 3231455 - DNA, 22 bp, Homo sapiens
aggccagagtggcctggccagg

SEQ ID NO: 3231456 - DNA, 16 bp, Homo sapiens
aggccagatggcccct

SEQ ID NO: 3231457 - DNA, 20 bp, Homo sapiens
aggccagatggcccctccac

SEQ ID NO: 3231458 - DNA, 13 bp, Homo sapiens
aggccagcaacgc

SEQ ID NO: 3231459 - DNA, 14 bp, Homo sapiens
aggccagcaacgct

SEQ ID NO: 3231460 - DNA, 13 bp, Homo sapiens
aggccagcccagc

SEQ ID NO: 3231461 - DNA, 15 bp, Homo sapiens
aggccagcccagcca

SEQ ID NO: 3231462 - DNA, 15 bp, Homo sapiens
aggccagccccaccc

SEQ ID NO: 3231463 - DNA, 16 bp, Homo sapiens
aggccagccccaccca

SEQ ID NO: 3231464 - DNA, 21 bp, Homo sapiens
aggccagccccacccaggagg

SEQ ID NO: 3231465 - DNA, 22 bp, Homo sapiens
aggccagcctccgagagggaga

SEQ ID NO: 3231466 - DNA, 13 bp, Homo sapiens
aggccaggaccac

SEQ ID NO: 3231467 - DNA, 17 bp, Homo sapiens
aggccaggtgaggtcca

SEQ ID NO: 3231468 - DNA, 15 bp, Homo sapiens
aggccagtggaagaa

SEQ ID NO: 3231469 - DNA, 18 bp, Homo sapiens
aggccagtgggcgggcca

SEQ ID NO: 3231470 - DNA, 12 bp, Homo sapiens
aggccatatttg

SEQ ID NO: 3231471 - DNA, 14 bp, Homo sapiens
aggccatctcagga

SEQ ID NO: 3231472 - DNA, 17 bp, Homo sapiens
aggccatctcaggagat

SEQ ID NO: 3231473 - DNA, 16 bp, Homo sapiens
aggccatgggcctcct

SEQ ID NO: 3231474 - DNA, 15 bp, Homo sapiens
aggccatgtgagcca

SEQ ID NO: 3231475 - DNA, 20 bp, Homo sapiens
aggccatgtgagccaccgct

SEQ ID NO: 3231476 - DNA, 12 bp, Homo sapiens
aggcccaaatga

SEQ ID NO: 3231477 - DNA, 15 bp, Homo sapiens
aggcccaaatgatgg

SEQ ID NO: 3231478 - DNA, 20 bp, Homo sapiens
aggcccaagagatgaagagt

SEQ ID NO: 3231479 - DNA, 22 bp, Homo sapiens
aggcccaagagcagagtctggg

SEQ ID NO: 3231480 - DNA, 19 bp, Homo sapiens
aggcccacaggaggcaagc

SEQ ID NO: 3231481 - DNA, 19 bp, Homo sapiens
aggcccaccatcaccaccg

SEQ ID NO: 3231482 - DNA, 21 bp, Homo sapiens
aggcccaccatcaccaccgcc

SEQ ID NO: 3231483 - DNA, 16 bp, Homo sapiens
aggcccagagcgagga

SEQ ID NO: 3231484 - DNA, 10 bp, Homo sapiens
aggcccagca

SEQ ID NO: 3231485 - DNA, 14 bp, Homo sapiens
aggcccagccccta

SEQ ID NO: 3231486 - DNA, 17 bp, Homo sapiens
aggcccagcccctagaa

SEQ ID NO: 3231487 - DNA, 19 bp, Homo sapiens
aggcccagcccctagaaac

SEQ ID NO: 3231488 - DNA, 18 bp, Homo sapiens
aggcccagcgcggccagc

SEQ ID NO: 3231489 - DNA, 20 bp, Homo sapiens
aggcccagcgcggccagcgt

SEQ ID NO: 3231490 - DNA, 16 bp, Homo sapiens
aggcccagcgggcaga

SEQ ID NO: 3231491 - DNA, 12 bp, Homo sapiens
aggcccaggcag

SEQ ID NO: 3231492 - DNA, 22 bp, Homo sapiens
aggcccagtgacaaagactcct

SEQ ID NO: 3231493 - DNA, 18 bp, Homo sapiens
aggcccatctcaggtgcc

SEQ ID NO: 3231494 - DNA, 20 bp, Homo sapiens
aggcccatctcaggtgccac

SEQ ID NO: 3231495 - DNA, 21 bp, Homo sapiens
aggcccatctcaggtgccact

SEQ ID NO: 3231496 - DNA, 22 bp, Homo sapiens
aggcccatctcaggtgccactc

SEQ ID NO: 3231497 - DNA, 19 bp, Homo sapiens
aggccccagaggccctgga

SEQ ID NO: 3231498 - DNA, 21 bp, Homo sapiens
aggccccagaggccctggagg

SEQ ID NO: 3231499 - DNA, 13 bp, Homo sapiens
aggccccagctct

SEQ ID NO: 3231500 - DNA, 17 bp, Homo sapiens
aggccccagctctgagg

SEQ ID NO: 3231501 - DNA, 13 bp, Homo sapiens
aggcccccacttg

SEQ ID NO: 3231502 - DNA, 20 bp, Homo sapiens
aggcccccacttgcctcttc

SEQ ID NO: 3231503 - DNA, 14 bp, Homo sapiens
aggcccccagccca

SEQ ID NO: 3231504 - DNA, 17 bp, Homo sapiens
aggcccccagcccaggg

SEQ ID NO: 3231505 - DNA, 22 bp, Homo sapiens
aggcccccagcccagggctcct

SEQ ID NO: 3231506 - DNA, 15 bp, Homo sapiens
aggcccctcctagac

SEQ ID NO: 3231507 - DNA, 19 bp, Homo sapiens
aggcccctcctagacccag

SEQ ID NO: 3231508 - DNA, 23 bp, Homo sapiens
aggcccctcctagacccaggtgg

SEQ ID NO: 3231509 - DNA, 13 bp, Homo sapiens
aggcccctgccac

SEQ ID NO: 3231510 - DNA, 15 bp, Homo sapiens
aggcccctgccaccc

SEQ ID NO: 3231511 - DNA, 14 bp, Homo sapiens
aggcccctggagcc

SEQ ID NO: 3231512 - DNA, 18 bp, Homo sapiens
aggccccttctctccctg

SEQ ID NO: 3231513 - DNA, 20 bp, Homo sapiens
aggccccttctctccctgcc

SEQ ID NO: 3231514 - DNA, 19 bp, Homo sapiens
aggcccgcaccccggcctc

SEQ ID NO: 3231515 - DNA, 21 bp, Homo sapiens
aggcccgcaccccggcctcag

SEQ ID NO: 3231516 - DNA, 23 bp, Homo sapiens
aggcccgcaccccggcctcaggg

SEQ ID NO: 3231517 - DNA, 21 bp, Homo sapiens
aggcccggctccaggctcctt

SEQ ID NO: 3231518 - DNA, 14 bp, Homo sapiens
aggccctcagtgag

SEQ ID NO: 3231519 - DNA, 14 bp, Homo sapiens
aggccctccctgac

SEQ ID NO: 3231520 - DNA, 22 bp, Homo sapiens
aggccctccctgactccctgtg

SEQ ID NO: 3231521 - DNA, 15 bp, Homo sapiens
aggccctcctgtgct

SEQ ID NO: 3231522 - DNA, 17 bp, Homo sapiens
aggccctcctgtgctgg

SEQ ID NO: 3231523 - DNA, 21 bp, Homo sapiens
aggccctcctgtgctggggga

SEQ ID NO: 3231524 - DNA, 11 bp, Homo sapiens
aggccctgcag

SEQ ID NO: 3231525 - DNA, 12 bp, Homo sapiens
aggccctgcagt

SEQ ID NO: 3231526 - DNA, 13 bp, Homo sapiens
aggccctgcagtg

SEQ ID NO: 3231527 - DNA, 12 bp, Homo sapiens
aggccctgcccc

SEQ ID NO: 3231528 - DNA, 17 bp, Homo sapiens
aggccctgctcctgcag

SEQ ID NO: 3231529 - DNA, 19 bp, Homo sapiens
aggccctgctcctgcagca

SEQ ID NO: 3231530 - DNA, 22 bp, Homo sapiens
aggccctgctcctgcagcatgg

SEQ ID NO: 3231531 - DNA, 12 bp, Homo sapiens
aggccctggagg

SEQ ID NO: 3231532 - DNA, 10 bp, Homo sapiens
aggccctggc

SEQ ID NO: 3231533 - DNA, 14 bp, Homo sapiens
aggccctggccctt

SEQ ID NO: 3231534 - DNA, 15 bp, Homo sapiens
aggccctggcccttt

SEQ ID NO: 3231535 - DNA, 20 bp, Homo sapiens
aggccctggccctttcccct

SEQ ID NO: 3231536 - DNA, 14 bp, Homo sapiens
aggccctggcctcc

SEQ ID NO: 3231537 - DNA, 15 bp, Homo sapiens
aggccctggcctccc

SEQ ID NO: 3231538 - DNA, 23 bp, Homo sapiens
aggccctggcctcccctgccacc

SEQ ID NO: 3231539 - DNA, 19 bp, Homo sapiens
aggcccttgtcctgccagc

SEQ ID NO: 3231540 - DNA, 15 bp, Homo sapiens
agggccagtctgggc

SEQ ID NO: 3231541 - DNA, 15 bp, Homo sapiens
agggccagtggggcc

SEQ ID NO: 3231542 - DNA, 17 bp, Homo sapiens
agggccagtggggcctg

SEQ ID NO: 3231543 - DNA, 18 bp, Homo sapiens
agggccagttggtgttcc

SEQ ID NO: 3231544 - DNA, 22 bp, Homo sapiens
agggccatacttttgagagggg

SEQ ID NO: 3231545 - DNA, 21 bp, Homo sapiens
agggccatgctgaggcctggg

SEQ ID NO: 3231546 - DNA, 22 bp, Homo sapiens
agggccatgctgaggcctgggc

SEQ ID NO: 3231547 - DNA, 23 bp, Homo sapiens
agggccatgctgaggcctgggcc

SEQ ID NO: 3231548 - DNA, 16 bp, Homo sapiens
agggcccaagtccctg

SEQ ID NO: 3231549 - DNA, 17 bp, Homo sapiens
agggcccaagtccctgt

SEQ ID NO: 3231550 - DNA, 19 bp, Homo sapiens
agggcccaagtccctgttt

SEQ ID NO: 3231551 - DNA, 15 bp, Homo sapiens
agggcccacttgtat

SEQ ID NO: 3231552 - DNA, 13 bp, Homo sapiens
agggcccagagca

SEQ ID NO: 3231553 - DNA, 14 bp, Homo sapiens
agggcccagagcag

SEQ ID NO: 3231554 - DNA, 15 bp, Homo sapiens
agggcccagagcagg

SEQ ID NO: 3231555 - DNA, 18 bp, Homo sapiens
agggcccagccaggagca

SEQ ID NO: 3231556 - DNA, 18 bp, Homo sapiens
agggcccagcccagagcc

SEQ ID NO: 3231557 - DNA, 22 bp, Homo sapiens
agggcccagcccagagccacct

SEQ ID NO: 3231558 - DNA, 13 bp, Homo sapiens
agggcccagctgt

SEQ ID NO: 3231559 - DNA, 17 bp, Homo sapiens
agggcccagctgtagcc

SEQ ID NO: 3231560 - DNA, 13 bp, Homo sapiens
agggcccctccct

SEQ ID NO: 3231561 - DNA, 16 bp, Homo sapiens
agggcccctccctctg

SEQ ID NO: 3231562 - DNA, 17 bp, Homo sapiens
agggcccctccctctgc

SEQ ID NO: 3231563 - DNA, 19 bp, Homo sapiens
agggcccctccctctgccc

SEQ ID NO: 3231564 - DNA, 12 bp, Homo sapiens
agggcccctgcg

SEQ ID NO: 3231565 - DNA, 19 bp, Homo sapiens
agggcccctgcgtgggggc

SEQ ID NO: 3231566 - DNA, 20 bp, Homo sapiens
agggcccctgggcccctctt

SEQ ID NO: 3231567 - DNA, 19 bp, Homo sapiens
agggcccgcagtgctggga

SEQ ID NO: 3231568 - DNA, 18 bp, Homo sapiens
agggcccggccacaccca

SEQ ID NO: 3231569 - DNA, 15 bp, Homo sapiens
agggccctaggcccc

SEQ ID NO: 3231570 - DNA, 12 bp, Homo sapiens
agggccctgcag

SEQ ID NO: 3231571 - DNA, 18 bp, Homo sapiens
agggcccttggggctggg

SEQ ID NO: 3231572 - DNA, 20 bp, Homo sapiens
agggccgaggaggtgcctgg

SEQ ID NO: 3231573 - DNA, 21 bp, Homo sapiens
agggccgaggaggtgcctgga

SEQ ID NO: 3231574 - DNA, 19 bp, Homo sapiens
agggccgtaccccaccctc

SEQ ID NO: 3231575 - DNA, 20 bp, Homo sapiens
agggcctatatgccagcgcc

SEQ ID NO: 3231576 - DNA, 20 bp, Homo sapiens
agggcctcaaaggcccgctc

SEQ ID NO: 3231577 - DNA, 12 bp, Homo sapiens
agggcctggagc

SEQ ID NO: 3231578 - DNA, 13 bp, Homo sapiens
agggcctggagcc

SEQ ID NO: 3231579 - DNA, 16 bp, Homo sapiens
agggcctggcaggcca

SEQ ID NO: 3231580 - DNA, 17 bp, Homo sapiens
agggcctggggcctgag

SEQ ID NO: 3231581 - DNA, 19 bp, Homo sapiens
agggcctggggcctgagag

SEQ ID NO: 3231582 - DNA, 20 bp, Homo sapiens
agggcctggggcctgagaga

SEQ ID NO: 3231583 - DNA, 22 bp, Homo sapiens
agggcctggggcctgagagaat

SEQ ID NO: 3231584 - DNA, 15 bp, Homo sapiens
agggcctgggggcag

SEQ ID NO: 3231585 - DNA, 21 bp, Homo sapiens
agggcctgggggcagtgactg

SEQ ID NO: 3231586 - DNA, 23 bp, Homo sapiens
agggcctgggggcagtgactggc

SEQ ID NO: 3231587 - DNA, 18 bp, Homo sapiens
agggcctgtgggagcctg

SEQ ID NO: 3231588 - DNA, 19 bp, Homo sapiens
agggcctgtgggagcctgc

SEQ ID NO: 3231589 - DNA, 15 bp, Homo sapiens
agggcgcccctggga

SEQ ID NO: 3231590 - DNA, 19 bp, Homo sapiens
agggcgctcagacggcggc

SEQ ID NO: 3231591 - DNA, 20 bp, Homo sapiens
agggcgctcagacggcggcc

SEQ ID NO: 3231592 - DNA, 15 bp, Homo sapiens
agggcggcaggggcc

SEQ ID NO: 3231593 - DNA, 18 bp, Homo sapiens
agggcggcaggggcctgg

SEQ ID NO: 3231594 - DNA, 17 bp, Homo sapiens
agggcgggcagagggct

SEQ ID NO: 3231595 - DNA, 19 bp, Homo sapiens
agggctaccctcccccagg

SEQ ID NO: 3231596 - DNA, 22 bp, Homo sapiens
agggctcagcggggacagctcc

SEQ ID NO: 3231597 - DNA, 23 bp, Homo sapiens
agggctcagcggggacagctcct

SEQ ID NO: 3231598 - DNA, 23 bp, Homo sapiens
agggctcaggatttcgtgggtct

SEQ ID NO: 3231599 - DNA, 13 bp, Homo sapiens
agggctccagcat

SEQ ID NO: 3231600 - DNA, 20 bp, Homo sapiens
agggctccagcatccagcct

SEQ ID NO: 3231601 - DNA, 14 bp, Homo sapiens
agggctcccagggg

SEQ ID NO: 3231602 - DNA, 12 bp, Homo sapiens
agggctcccatg

SEQ ID NO: 3231603 - DNA, 17 bp, Homo sapiens
agggctcctcccagctt

SEQ ID NO: 3231604 - DNA, 14 bp, Homo sapiens
agggctcctgcctt

SEQ ID NO: 3231605 - DNA, 20 bp, Homo sapiens
agggctcgaggggtgggctg

SEQ ID NO: 3231606 - DNA, 23 bp, Homo sapiens
agggctctcaaagtataatcttt

SEQ ID NO: 3231607 - DNA, 14 bp, Homo sapiens
agggctctgcccca

SEQ ID NO: 3231608 - DNA, 16 bp, Homo sapiens
agggctgagctgagct

SEQ ID NO: 3231609 - DNA, 17 bp, Homo sapiens
agggctgagctgagctt

SEQ ID NO: 3231610 - DNA, 22 bp, Homo sapiens
agggctggacctatgtcctaag

SEQ ID NO: 3231611 - DNA, 16 bp, Homo sapiens
agggctggaggcccag

SEQ ID NO: 3231612 - DNA, 18 bp, Homo sapiens
agggctggaggcccaggc

SEQ ID NO: 3231613 - DNA, 21 bp, Homo sapiens
agggctggaggcccaggctgg

SEQ ID NO: 3231614 - DNA, 11 bp, Homo sapiens
agggctggctc

SEQ ID NO: 3231615 - DNA, 17 bp, Homo sapiens
agggctggctggcctca

SEQ ID NO: 3231616 - DNA, 11 bp, Homo sapiens
agggctgggga

SEQ ID NO: 3231617 - DNA, 15 bp, Homo sapiens
agggctggggacaga

SEQ ID NO: 3231618 - DNA, 12 bp, Homo sapiens
agggctgggtgt

SEQ ID NO: 3231619 - DNA, 15 bp, Homo sapiens
agggctgtcattgca

SEQ ID NO: 3231620 - DNA, 21 bp, Homo sapiens
agggctgtgtgggtaaatgct

SEQ ID NO: 3231621 - DNA, 21 bp, Homo sapiens
agggcttcctctagaagccaa

SEQ ID NO: 3231622 - DNA, 22 bp, Homo sapiens
agggcttcctctagaagccaag

SEQ ID NO: 3231623 - DNA, 14 bp, Homo sapiens
agggcttctgcacc

SEQ ID NO: 3231624 - DNA, 15 bp, Homo sapiens
agggcttctgcaccc

SEQ ID NO: 3231625 - DNA, 16 bp, Homo sapiens
agggcttctgcaccct

SEQ ID NO: 3231626 - DNA, 18 bp, Homo sapiens
agggcttctgcaccctcc

SEQ ID NO: 3231627 - DNA, 18 bp, Homo sapiens
agggcttggcccagcgcc

SEQ ID NO: 3231628 - DNA, 13 bp, Homo sapiens
aggggaaaatgaa

SEQ ID NO: 3231629 - DNA, 20 bp, Homo sapiens
aggggaaaccagtgtagcct

SEQ ID NO: 3231630 - DNA, 16 bp, Homo sapiens
aggggaacagaccagt

SEQ ID NO: 3231631 - DNA, 14 bp, Homo sapiens
aggggaacctgcca

SEQ ID NO: 3231632 - DNA, 22 bp, Homo sapiens
aggggaagaaacactttctctt

SEQ ID NO: 3231633 - DNA, 13 bp, Homo sapiens
aggggaagaatga

SEQ ID NO: 3231634 - DNA, 12 bp, Homo sapiens
aggggaagctgc

SEQ ID NO: 3231635 - DNA, 14 bp, Homo sapiens
aggggaagctgcag

SEQ ID NO: 3231636 - DNA, 23 bp, Homo sapiens
aggggaagggccagtctgggctg

SEQ ID NO: 3231637 - DNA, 18 bp, Homo sapiens
aggggaataatagaagaa

SEQ ID NO: 3231638 - DNA, 17 bp, Homo sapiens
aggggacaggcctcacc

SEQ ID NO: 3231639 - DNA, 21 bp, Homo sapiens
aggggacaggcctcacctcta

SEQ ID NO: 3231640 - DNA, 19 bp, Homo sapiens
aggggactatttatgaagg

SEQ ID NO: 3231641 - DNA, 12 bp, Homo sapiens
aggggactgggg

SEQ ID NO: 3231642 - DNA, 18 bp, Homo sapiens
aggggactgggggactgg

SEQ ID NO: 3231643 - DNA, 21 bp, Homo sapiens
aggggactgggggactgggag

SEQ ID NO: 3231644 - DNA, 16 bp, Homo sapiens
aggggagaaactgaaa

SEQ ID NO: 3231645 - DNA, 21 bp, Homo sapiens
aggggagaaactgaaagtgtt

SEQ ID NO: 3231646 - DNA, 22 bp, Homo sapiens
aggggagaaactgaaagtgttt

SEQ ID NO: 3231647 - DNA, 16 bp, Homo sapiens
aggggagaagagccct

SEQ ID NO: 3231648 - DNA, 12 bp, Homo sapiens
aggggagagaga

SEQ ID NO: 3231649 - DNA, 16 bp, Homo sapiens
aggggagagcctgctg

SEQ ID NO: 3231650 - DNA, 17 bp, Homo sapiens
aggggagagcctgctgg

SEQ ID NO: 3231651 - DNA, 12 bp, Homo sapiens
aggggaggaaaa

SEQ ID NO: 3231652 - DNA, 16 bp, Homo sapiens
aggggaggagcctgtg

SEQ ID NO: 3231653 - DNA, 19 bp, Homo sapiens
aggggaggatcactggagc

SEQ ID NO: 3231654 - DNA, 13 bp, Homo sapiens
aggggaggcagcc

SEQ ID NO: 3231655 - DNA, 18 bp, Homo sapiens
aggggagggggatccgac

SEQ ID NO: 3231656 - DNA, 16 bp, Homo sapiens
aggggaggggggcaca

SEQ ID NO: 3231657 - DNA, 17 bp, Homo sapiens
aggggatataggagagg

SEQ ID NO: 3231658 - DNA, 14 bp, Homo sapiens
aggggatccagcca

SEQ ID NO: 3231659 - DNA, 16 bp, Homo sapiens
aggggatccagccact

SEQ ID NO: 3231660 - DNA, 17 bp, Homo sapiens
aggggatccagccactt

SEQ ID NO: 3231661 - DNA, 19 bp, Homo sapiens
aggggatgcccagaagagt

SEQ ID NO: 3231662 - DNA, 18 bp, Homo sapiens
aggggatggggatagagg

SEQ ID NO: 3231663 - DNA, 17 bp, Homo sapiens
aggggatggtagacctt

SEQ ID NO: 3231664 - DNA, 18 bp, Homo sapiens
aggggcaacgaagaaaaa

SEQ ID NO: 3231665 - DNA, 19 bp, Homo sapiens
aggggcaacgaagaaaaaa

SEQ ID NO: 3231666 - DNA, 15 bp, Homo sapiens
aggttgacctgtttc

SEQ ID NO: 3231667 - DNA, 22 bp, Homo sapiens
aggttgcagagaagcatcctcc

SEQ ID NO: 3231668 - DNA, 12 bp, Homo sapiens
aggttgcagtgc

SEQ ID NO: 3231669 - DNA, 15 bp, Homo sapiens
aggttggaagagaat

SEQ ID NO: 3231670 - DNA, 20 bp, Homo sapiens
aggttggacagcccccttcg

SEQ ID NO: 3231671 - DNA, 16 bp, Homo sapiens
aggttggaccccagag

SEQ ID NO: 3231672 - DNA, 12 bp, Homo sapiens
aggttggatggg

SEQ ID NO: 3231673 - DNA, 18 bp, Homo sapiens
aggttgggcttccatgcc

SEQ ID NO: 3231674 - DNA, 19 bp, Homo sapiens
aggttgggcttccatgcct

SEQ ID NO: 3231675 - DNA, 21 bp, Homo sapiens
aggttggggataggttttctg

SEQ ID NO: 3231676 - DNA, 13 bp, Homo sapiens
aggttggtgactg

SEQ ID NO: 3231677 - DNA, 13 bp, Homo sapiens
aggtttaaagagt

SEQ ID NO: 3231678 - DNA, 14 bp, Homo sapiens
aggtttaaagagtc

SEQ ID NO: 3231679 - DNA, 20 bp, Homo sapiens
aggtttaaagagtctagatt

SEQ ID NO: 3231680 - DNA, 15 bp, Homo sapiens
aggtttaacatttgc

SEQ ID NO: 3231681 - DNA, 22 bp, Homo sapiens
aggtttacaataggagtggtga

SEQ ID NO: 3231682 - DNA, 13 bp, Homo sapiens
aggtttcaaagat

SEQ ID NO: 3231683 - DNA, 17 bp, Homo sapiens
aggtttcgtttctgtat

SEQ ID NO: 3231684 - DNA, 19 bp, Homo sapiens
aggtttctttttttttcct

SEQ ID NO: 3231685 - DNA, 13 bp, Homo sapiens
aggtttggaagag

SEQ ID NO: 3231686 - DNA, 14 bp, Homo sapiens
aggtttggaagagt

SEQ ID NO: 3231687 - DNA, 21 bp, Homo sapiens
aggtttggatgggagtgagac

SEQ ID NO: 3231688 - DNA, 21 bp, Homo sapiens
aggtttggggagggggaagag

SEQ ID NO: 3231689 - DNA, 23 bp, Homo sapiens
aggtttggggagggggaagagaa

SEQ ID NO: 3231690 - DNA, 17 bp, Homo sapiens
aggtttgtcatcagatg

SEQ ID NO: 3231691 - DNA, 17 bp, Homo sapiens
aggtttgttttgtgaat

SEQ ID NO: 3231692 - DNA, 20 bp, Homo sapiens
aggtttgttttgtgaatttt

SEQ ID NO: 3231693 - DNA, 15 bp, Homo sapiens
aggttttaaagtgat

SEQ ID NO: 3231694 - DNA, 17 bp, Homo sapiens
aggttttaaagtgatta

SEQ ID NO: 3231695 - DNA, 14 bp, Homo sapiens
aggttttaggttct

SEQ ID NO: 3231696 - DNA, 22 bp, Homo sapiens
aggttttcccctcttttgttaa

SEQ ID NO: 3231697 - DNA, 17 bp, Homo sapiens
aggttttggagagtttg

SEQ ID NO: 3231698 - DNA, 12 bp, Homo sapiens
aggttttgttgt

SEQ ID NO: 3231699 - DNA, 13 bp, Homo sapiens
aggtttttattag

SEQ ID NO: 3231700 - DNA, 17 bp, Homo sapiens
agtaaaaataaaatact

SEQ ID NO: 3231701 - DNA, 20 bp, Homo sapiens
agtaaaaccttgttctattt

SEQ ID NO: 3231702 - DNA, 18 bp, Homo sapiens
agtaaaattatcctcttt

SEQ ID NO: 3231703 - DNA, 12 bp, Homo sapiens
agtaaaattcag

SEQ ID NO: 3231704 - DNA, 18 bp, Homo sapiens
agtaaaattcagtttttt

SEQ ID NO: 3231705 - DNA, 15 bp, Homo sapiens
agtaaaatttatttc

SEQ ID NO: 3231706 - DNA, 17 bp, Homo sapiens
agtaaaatttatttcat

SEQ ID NO: 3231707 - DNA, 16 bp, Homo sapiens
agtaaacagggtacct

SEQ ID NO: 3231708 - DNA, 23 bp, Homo sapiens
agtaaacgggaacatgccccctg

SEQ ID NO: 3231709 - DNA, 16 bp, Homo sapiens
agtaaactatttatct

SEQ ID NO: 3231710 - DNA, 24 bp, Homo sapiens
agtaaactcccctttccctcgcta

SEQ ID NO: 3231711 - DNA, 18 bp, Homo sapiens
agtaaagagaaactttgt

SEQ ID NO: 3231712 - DNA, 20 bp, Homo sapiens
agtaaagccattaaatgaat

SEQ ID NO: 3231713 - DNA, 17 bp, Homo sapiens
agtaaagctaaaatgat

SEQ ID NO: 3231714 - DNA, 13 bp, Homo sapiens
agtaaaggcctcc

SEQ ID NO: 3231715 - DNA, 18 bp, Homo sapiens
agtaaagtgttctgccag

SEQ ID NO: 3231716 - DNA, 13 bp, Homo sapiens
agtaaataaactg

SEQ ID NO: 3231717 - DNA, 20 bp, Homo sapiens
agtaaataaactgtttatat

SEQ ID NO: 3231718 - DNA, 14 bp, Homo sapiens
agtaaatctctttt

SEQ ID NO: 3231719 - DNA, 11 bp, Homo sapiens
agtaaatgcta

SEQ ID NO: 3231720 - DNA, 23 bp, Homo sapiens
agtaaatgctaggttaattccaa

SEQ ID NO: 3231721 - DNA, 19 bp, Homo sapiens
agtaaattgcctgatttgt

SEQ ID NO: 3231722 - DNA, 17 bp, Homo sapiens
agtaaattttgtgatga

SEQ ID NO: 3231723 - DNA, 20 bp, Homo sapiens
agtaacaatacaaatggatt

SEQ ID NO: 3231724 - DNA, 15 bp, Homo sapiens
agtaacaatacatga

SEQ ID NO: 3231725 - DNA, 23 bp, Homo sapiens
agtaacaggaaaccacttatcac

SEQ ID NO: 3231726 - DNA, 17 bp, Homo sapiens
agtaacatgaggggaca

SEQ ID NO: 3231727 - DNA, 18 bp, Homo sapiens
agtaacattctacttgct

SEQ ID NO: 3231728 - DNA, 16 bp, Homo sapiens
agtaactaattttgtt

SEQ ID NO: 3231729 - DNA, 23 bp, Homo sapiens
agtaactgttttttaagtctctc

SEQ ID NO: 3231730 - DNA, 14 bp, Homo sapiens
agtaacttggcttt

SEQ ID NO: 3231731 - DNA, 22 bp, Homo sapiens
agtaactttactctgtgtttaa

SEQ ID NO: 3231732 - DNA, 20 bp, Homo sapiens
agtaactttatgtgtaaata

SEQ ID NO: 3231733 - DNA, 14 bp, Homo sapiens
agtaacttttttgt

SEQ ID NO: 3231734 - DNA, 15 bp, Homo sapiens
agtaacttttttgtg

SEQ ID NO: 3231735 - DNA, 21 bp, Homo sapiens
agtaacttttttgtgtatgta

SEQ ID NO: 3231736 - DNA, 22 bp, Homo sapiens
agtaacttttttgtgtatgtac

SEQ ID NO: 3231737 - DNA, 14 bp, Homo sapiens
agtaagaaaacaat

SEQ ID NO: 3231738 - DNA, 14 bp, Homo sapiens
agtaagagctggtg

SEQ ID NO: 3231739 - DNA, 14 bp, Homo sapiens
agtaagatatctca

SEQ ID NO: 3231740 - DNA, 15 bp, Homo sapiens
agtaagttaataatg

SEQ ID NO: 3231741 - DNA, 15 bp, Homo sapiens
agtaagttaatgtat

SEQ ID NO: 3231742 - DNA, 17 bp, Homo sapiens
agtaagttcttcaaaca

SEQ ID NO: 3231743 - DNA, 23 bp, Homo sapiens
agtaagtttatccaaatcttgaa

SEQ ID NO: 3231744 - DNA, 13 bp, Homo sapiens
agtaataaaacat

SEQ ID NO: 3231745 - DNA, 13 bp, Homo sapiens
agtaatagagcaa

SEQ ID NO: 3231746 - DNA, 18 bp, Homo sapiens
agtaatcaataaagaaaa

SEQ ID NO: 3231747 - DNA, 14 bp, Homo sapiens
agtaatcccgccac

SEQ ID NO: 3231748 - DNA, 17 bp, Homo sapiens
agtaatcccgccaccta

SEQ ID NO: 3231749 - DNA, 16 bp, Homo sapiens
agtaatctttatactg

SEQ ID NO: 3231750 - DNA, 17 bp, Homo sapiens
agtaatgcatacagaaa

SEQ ID NO: 3231751 - DNA, 20 bp, Homo sapiens
agtaatgcatacagaaatat

SEQ ID NO: 3231752 - DNA, 16 bp, Homo sapiens
agtaatggtgtagaac

SEQ ID NO: 3231753 - DNA, 22 bp, Homo sapiens
agtaatggtgtagaacactaat

SEQ ID NO: 3231754 - DNA, 23 bp, Homo sapiens
agtaatgtggaagaaaatggttt

SEQ ID NO: 3231755 - DNA, 17 bp, Homo sapiens
agtaattcttaagtctt

SEQ ID NO: 3231756 - DNA, 18 bp, Homo sapiens
agtaattgacatgtgcca

SEQ ID NO: 3231757 - DNA, 12 bp, Homo sapiens
agtaattgtgaa

SEQ ID NO: 3231758 - DNA, 16 bp, Homo sapiens
agtaatttctaaagca

SEQ ID NO: 3231759 - DNA, 21 bp, Homo sapiens
agtaattttgtcacattattt

SEQ ID NO: 3231760 - DNA, 14 bp, Homo sapiens
agtacaatgaactg

SEQ ID NO: 3231761 - DNA, 14 bp, Homo sapiens
agtacactctgctg

SEQ ID NO: 3231762 - DNA, 16 bp, Homo sapiens
agtacagaatttgaat

SEQ ID NO: 3231763 - DNA, 17 bp, Homo sapiens
agtacagaatttgaatt

SEQ ID NO: 3231764 - DNA, 16 bp, Homo sapiens
agtacagcatgtgcct

SEQ ID NO: 3231765 - DNA, 17 bp, Homo sapiens
agtacatattaggaaaa

SEQ ID NO: 3231766 - DNA, 12 bp, Homo sapiens
agtacatttaat

SEQ ID NO: 3231767 - DNA, 19 bp, Homo sapiens
agtaccaaagttttatcaa

SEQ ID NO: 3231768 - DNA, 17 bp, Homo sapiens
agtaccaatgctgttgt

SEQ ID NO: 3231769 - DNA, 15 bp, Homo sapiens
agtaccacactgagt

SEQ ID NO: 3231770 - DNA, 15 bp, Homo sapiens
agtaccactcaggcc

SEQ ID NO: 3231771 - DNA, 15 bp, Homo sapiens
agtaccagcatgtta

SEQ ID NO: 3231772 - DNA, 21 bp, Homo sapiens
agtaccagcgctctaaaagca

SEQ ID NO: 3231773 - DNA, 15 bp, Homo sapiens
agtaccataatctta

SEQ ID NO: 3231774 - DNA, 16 bp, Homo sapiens
agtaccctctcagctc

SEQ ID NO: 3231775 - DNA, 19 bp, Homo sapiens
agtaccctctcagctccag

SEQ ID NO: 3231776 - DNA, 21 bp, Homo sapiens
agtaccctgatgccttttgga

SEQ ID NO: 3231777 - DNA, 21 bp, Homo sapiens
agtacctagctggctctgtga

SEQ ID NO: 3231778 - DNA, 15 bp, Homo sapiens
agtacctataaagta

SEQ ID NO: 3231779 - DNA, 13 bp, Homo sapiens
agtacctccaagc

SEQ ID NO: 3231780 - DNA, 14 bp, Homo sapiens
agtacctgaaaagt

SEQ ID NO: 3231781 - DNA, 17 bp, Homo sapiens
agtacctgattgtattt

SEQ ID NO: 3231782 - DNA, 12 bp, Homo sapiens
agtaccttgctt

SEQ ID NO: 3231783 - DNA, 13 bp, Homo sapiens
agtaccttgcttc

SEQ ID NO: 3231784 - DNA, 16 bp, Homo sapiens
agtacgaacctacagt

SEQ ID NO: 3231785 - DNA, 17 bp, Homo sapiens
agtactaacacaaggac

SEQ ID NO: 3231786 - DNA, 20 bp, Homo sapiens
agtactagatgcatcactgg

SEQ ID NO: 3231787 - DNA, 18 bp, Homo sapiens
agtactcctgcaaaattt

SEQ ID NO: 3231788 - DNA, 21 bp, Homo sapiens
agtactcctgcaaaattttat

SEQ ID NO: 3231789 - DNA, 15 bp, Homo sapiens
agtactccttaagaa

SEQ ID NO: 3231790 - DNA, 16 bp, Homo sapiens
agtactctctgctcta

SEQ ID NO: 3231791 - DNA, 19 bp, Homo sapiens
agtactctctgctctagcc

SEQ ID NO: 3231792 - DNA, 22 bp, Homo sapiens
agtactctctgctctagccagg

SEQ ID NO: 3231793 - DNA, 22 bp, Homo sapiens
agtggtaacagctctcttctta

SEQ ID NO: 3231794 - DNA, 16 bp, Homo sapiens
agtggtaatcatatgt

SEQ ID NO: 3231795 - DNA, 18 bp, Homo sapiens
agtggtaatcatatgtgt

SEQ ID NO: 3231796 - DNA, 18 bp, Homo sapiens
agtggtctttctggagag

SEQ ID NO: 3231797 - DNA, 20 bp, Homo sapiens
agtggtctttctggagaggt

SEQ ID NO: 3231798 - DNA, 21 bp, Homo sapiens
agtggtggttcctttgcaccc

SEQ ID NO: 3231799 - DNA, 24 bp, Homo sapiens
agtggtggttcctttgcaccctgt

SEQ ID NO: 3231800 - DNA, 23 bp, Homo sapiens
agtggttttatactgaaggaaaa

SEQ ID NO: 3231801 - DNA, 17 bp, Homo sapiens
agtgtaaaatagaatgt

SEQ ID NO: 3231802 - DNA, 20 bp, Homo sapiens
agtgtaaataattttaaata

SEQ ID NO: 3231803 - DNA, 14 bp, Homo sapiens
agtgtaaatccttt

SEQ ID NO: 3231804 - DNA, 15 bp, Homo sapiens
agtgtaacaattgtg

SEQ ID NO: 3231805 - DNA, 18 bp, Homo sapiens
agtgtaacaattgtgtag

SEQ ID NO: 3231806 - DNA, 22 bp, Homo sapiens
agtgtaacaattgtgtagcctt

SEQ ID NO: 3231807 - DNA, 23 bp, Homo sapiens
agtgtaacaattgtgtagccttt

SEQ ID NO: 3231808 - DNA, 15 bp, Homo sapiens
agtgtaacagctgag

SEQ ID NO: 3231809 - DNA, 15 bp, Homo sapiens
agtgtaataatatga

SEQ ID NO: 3231810 - DNA, 21 bp, Homo sapiens
agtgtacacgtctggaccccg

SEQ ID NO: 3231811 - DNA, 14 bp, Homo sapiens
agtgtacatagtgt

SEQ ID NO: 3231812 - DNA, 13 bp, Homo sapiens
agtgtacatcatg

SEQ ID NO: 3231813 - DNA, 22 bp, Homo sapiens
agtgtacatggaataacatgta

SEQ ID NO: 3231814 - DNA, 16 bp, Homo sapiens
agtgtaccatttgcct

SEQ ID NO: 3231815 - DNA, 15 bp, Homo sapiens
agtgtacctcctctc

SEQ ID NO: 3231816 - DNA, 17 bp, Homo sapiens
agtgtacctcctctcag

SEQ ID NO: 3231817 - DNA, 22 bp, Homo sapiens
agtgtacctcctctcagtgttt

SEQ ID NO: 3231818 - DNA, 17 bp, Homo sapiens
agtgtagaagcattcct

SEQ ID NO: 3231819 - DNA, 23 bp, Homo sapiens
agtgtagcccacacttgagagga

SEQ ID NO: 3231820 - DNA, 12 bp, Homo sapiens
agtgtagcctaa

SEQ ID NO: 3231821 - DNA, 19 bp, Homo sapiens
agtgtagcctaaagggcag

SEQ ID NO: 3231822 - DNA, 13 bp, Homo sapiens
agtgtagccttgc

SEQ ID NO: 3231823 - DNA, 15 bp, Homo sapiens
agtgtagccttgccc

SEQ ID NO: 3231824 - DNA, 12 bp, Homo sapiens
agtgtagctgta

SEQ ID NO: 3231825 - DNA, 23 bp, Homo sapiens
agtgtagctgtaagggcagtgcc

SEQ ID NO: 3231826 - DNA, 15 bp, Homo sapiens
agtgtagttaattta

SEQ ID NO: 3231827 - DNA, 21 bp, Homo sapiens
agtgtatatttattcataatg

SEQ ID NO: 3231828 - DNA, 18 bp, Homo sapiens
agtgtatgactgcacatg

SEQ ID NO: 3231829 - DNA, 14 bp, Homo sapiens
agtgtatgattact

SEQ ID NO: 3231830 - DNA, 13 bp, Homo sapiens
agtgtattagatg

SEQ ID NO: 3231831 - DNA, 16 bp, Homo sapiens
agtgtattatcactgt

SEQ ID NO: 3231832 - DNA, 16 bp, Homo sapiens
agtgtatttttcaata

SEQ ID NO: 3231833 - DNA, 17 bp, Homo sapiens
agtgtcaagttgtgctt

SEQ ID NO: 3231834 - DNA, 19 bp, Homo sapiens
agtgtcaagttgtgcttgt

SEQ ID NO: 3231835 - DNA, 20 bp, Homo sapiens
agtgtcaagttgtgcttgtt

SEQ ID NO: 3231836 - DNA, 16 bp, Homo sapiens
agtgtcacctctctca

SEQ ID NO: 3231837 - DNA, 18 bp, Homo sapiens
agtgtcacctctctcaga

SEQ ID NO: 3231838 - DNA, 20 bp, Homo sapiens
agtgtcatcagaagataact

SEQ ID NO: 3231839 - DNA, 14 bp, Homo sapiens
agtgtcccaggcag

SEQ ID NO: 3231840 - DNA, 15 bp, Homo sapiens
agtgtcccaggcagc

SEQ ID NO: 3231841 - DNA, 13 bp, Homo sapiens
agtgtcccctcca

SEQ ID NO: 3231842 - DNA, 14 bp, Homo sapiens
agtgtcccctccac

SEQ ID NO: 3231843 - DNA, 17 bp, Homo sapiens
agtgtcccctccactgt

SEQ ID NO: 3231844 - DNA, 21 bp, Homo sapiens
agtgtcccctccactgtcaca

SEQ ID NO: 3231845 - DNA, 16 bp, Homo sapiens
agtgtccgagaactaa

SEQ ID NO: 3231846 - DNA, 16 bp, Homo sapiens
agtgtcctgcccatgc

SEQ ID NO: 3231847 - DNA, 13 bp, Homo sapiens
agtgtctggagcg

SEQ ID NO: 3231848 - DNA, 16 bp, Homo sapiens
agtgtctggagcggct

SEQ ID NO: 3231849 - DNA, 22 bp, Homo sapiens
agtgtctggctttttcctctga

SEQ ID NO: 3231850 - DNA, 22 bp, Homo sapiens
agtgtctgtcccggggtcctgt

SEQ ID NO: 3231851 - DNA, 13 bp, Homo sapiens
agtgtcttccata

SEQ ID NO: 3231852 - DNA, 15 bp, Homo sapiens
agtgtcttccataat

SEQ ID NO: 3231853 - DNA, 16 bp, Homo sapiens
agtgtgacagggccag

SEQ ID NO: 3231854 - DNA, 12 bp, Homo sapiens
agtgtgagaatc

SEQ ID NO: 3231855 - DNA, 17 bp, Homo sapiens
agtgtgagcgccttggt

SEQ ID NO: 3231856 - DNA, 12 bp, Homo sapiens
agtgtgagtaag

SEQ ID NO: 3231857 - DNA, 19 bp, Homo sapiens
agtgtgagtggcagccatg

SEQ ID NO: 3231858 - DNA, 16 bp, Homo sapiens
agtgtgcacgagtggg

SEQ ID NO: 3231859 - DNA, 19 bp, Homo sapiens
agtgtgcatggaggccctc

SEQ ID NO: 3231860 - DNA, 17 bp, Homo sapiens
agtgtgcccttctctta

SEQ ID NO: 3231861 - DNA, 16 bp, Homo sapiens
agtgtgctaaaaatga

SEQ ID NO: 3231862 - DNA, 15 bp, Homo sapiens
agtgtgctgactttt

SEQ ID NO: 3231863 - DNA, 18 bp, Homo sapiens
agtgtgctgactttttaa

SEQ ID NO: 3231864 - DNA, 18 bp, Homo sapiens
agtgtgggcttgaccagg

SEQ ID NO: 3231865 - DNA, 23 bp, Homo sapiens
agtgtgtatatattttgtgtgaa

SEQ ID NO: 3231866 - DNA, 21 bp, Homo sapiens
agtgtgtattgttcccagtga

SEQ ID NO: 3231867 - DNA, 14 bp, Homo sapiens
agtgtgtctaaatt

SEQ ID NO: 3231868 - DNA, 20 bp, Homo sapiens
agtgtgtcttcctagaattc

SEQ ID NO: 3231869 - DNA, 14 bp, Homo sapiens
agtgtgtgacattc

SEQ ID NO: 3231870 - DNA, 21 bp, Homo sapiens
agtgtgtgattttttgcattc

SEQ ID NO: 3231871 - DNA, 14 bp, Homo sapiens
agtgtgtggctggg

SEQ ID NO: 3231872 - DNA, 20 bp, Homo sapiens
agtgtgttctgattagaaat

SEQ ID NO: 3231873 - DNA, 21 bp, Homo sapiens
agtgttaaaaaatttttgaaa

SEQ ID NO: 3231874 - DNA, 21 bp, Homo sapiens
agtgttactgcctataatctt

SEQ ID NO: 3231875 - DNA, 15 bp, Homo sapiens
agtgttagagaaatc

SEQ ID NO: 3231876 - DNA, 17 bp, Homo sapiens
agtgttagagaaatcct

SEQ ID NO: 3231877 - DNA, 16 bp, Homo sapiens
agtgttatcagtcata

SEQ ID NO: 3231878 - DNA, 17 bp, Homo sapiens
agtgttcaaaatactac

SEQ ID NO: 3231879 - DNA, 21 bp, Homo sapiens
agtgttcattttagtgactgt

SEQ ID NO: 3231880 - DNA, 22 bp, Homo sapiens
agtgttcattttagtgactgta

SEQ ID NO: 3231881 - DNA, 20 bp, Homo sapiens
agtgttcctttttaaatgtg

SEQ ID NO: 3231882 - DNA, 15 bp, Homo sapiens
agtgttctgcatgga

SEQ ID NO: 3231883 - DNA, 23 bp, Homo sapiens
agtgttctgcatggattcagcat

SEQ ID NO: 3231884 - DNA, 22 bp, Homo sapiens
agtgttctgtttgttattgttt

SEQ ID NO: 3231885 - DNA, 19 bp, Homo sapiens
agtgttgaagggaggtggc

SEQ ID NO: 3231886 - DNA, 21 bp, Homo sapiens
agtgttggtatattttatatt

SEQ ID NO: 3231887 - DNA, 20 bp, Homo sapiens
agtgttgtttgtaaataaga

SEQ ID NO: 3231888 - DNA, 21 bp, Homo sapiens
agtgttgtttgtaaataagag

SEQ ID NO: 3231889 - DNA, 22 bp, Homo sapiens
agtgttgtttgtaaataagaga

SEQ ID NO: 3231890 - DNA, 14 bp, Homo sapiens
agtgtttcatgggt

SEQ ID NO: 3231891 - DNA, 16 bp, Homo sapiens
agtgtttcccataatt

SEQ ID NO: 3231892 - DNA, 17 bp, Homo sapiens
agtgtttctaataaact

SEQ ID NO: 3231893 - DNA, 15 bp, Homo sapiens
agtgtttctgttatt

SEQ ID NO: 3231894 - DNA, 22 bp, Homo sapiens
agtgtttgggggacgtttctca

SEQ ID NO: 3231895 - DNA, 15 bp, Homo sapiens
agtgtttgtgtctga

SEQ ID NO: 3231896 - DNA, 16 bp, Homo sapiens
agtgtttgtgtctgac

SEQ ID NO: 3231897 - DNA, 17 bp, Homo sapiens
agtgtttgtgtctgact

SEQ ID NO: 3231898 - DNA, 18 bp, Homo sapiens
agtgttttaaattctgag

SEQ ID NO: 3231899 - DNA, 21 bp, Homo sapiens
agtgttttactctttttctaa

SEQ ID NO: 3231900 - DNA, 13 bp, Homo sapiens
agtgttttcagag

SEQ ID NO: 3231901 - DNA, 15 bp, Homo sapiens
agtgttttggactcc

SEQ ID NO: 3231902 - DNA, 19 bp, Homo sapiens
agtgttttggactccatct

SEQ ID NO: 3231903 - DNA, 13 bp, Homo sapiens
agttaaaagcatt

SEQ ID NO: 3231904 - DNA, 13 bp, Homo sapiens
agttaaagaaagg

SEQ ID NO: 3231905 - DNA, 16 bp, Homo sapiens
agttaaagaaaggaaa

SEQ ID NO: 3231906 - DNA, 18 bp, Homo sapiens
agttaaagaaaggaaaag

SEQ ID NO: 3231907 - DNA, 16 bp, Homo sapiens
agttaaagtgaataac

SEQ ID NO: 3231908 - DNA, 23 bp, Homo sapiens
agttaaatagagtatatgcactt

SEQ ID NO: 3231909 - DNA, 12 bp, Homo sapiens
agttaaatctca

SEQ ID NO: 3231910 - DNA, 13 bp, Homo sapiens
agttaacaaggaa

SEQ ID NO: 3231911 - DNA, 14 bp, Homo sapiens
agttaacaaggaat

SEQ ID NO: 3231912 - DNA, 20 bp, Homo sapiens
agttaacaaggaatgcctgt

SEQ ID NO: 3231913 - DNA, 12 bp, Homo sapiens
agttaacagaga

SEQ ID NO: 3231914 - DNA, 14 bp, Homo sapiens
agttaactgtgaaa

SEQ ID NO: 3231915 - DNA, 16 bp, Homo sapiens
agttaagaagccctgc

SEQ ID NO: 3231916 - DNA, 21 bp, Homo sapiens
agttaagaagctgttgtacat

SEQ ID NO: 3231917 - DNA, 19 bp, Homo sapiens
agttaagacatgatttcct

SEQ ID NO: 3231918 - DNA, 19 bp, Homo sapiens
agttaaggaccgtggccct

SEQ ID NO: 3231919 - DNA, 17 bp, Homo sapiens
agttctgctcctctcca

SEQ ID NO: 3231920 - DNA, 19 bp, Homo sapiens
agttctgctcctctccagg

SEQ ID NO: 3231921 - DNA, 16 bp, Homo sapiens
agttctgctctggttg

SEQ ID NO: 3231922 - DNA, 21 bp, Homo sapiens
agttctgtagagccttctgat

SEQ ID NO: 3231923 - DNA, 11 bp, Homo sapiens
agttctgtgta

SEQ ID NO: 3231924 - DNA, 14 bp, Homo sapiens
agttctgtgtacat

SEQ ID NO: 3231925 - DNA, 17 bp, Homo sapiens
agttctgtgtacatttt

SEQ ID NO: 3231926 - DNA, 14 bp, Homo sapiens
agttctgtgtactt

SEQ ID NO: 3231927 - DNA, 13 bp, Homo sapiens
agttctgtgtatt

SEQ ID NO: 3231928 - DNA, 15 bp, Homo sapiens
agttctgtgtttaat

SEQ ID NO: 3231929 - DNA, 22 bp, Homo sapiens
agttctgtgtttaatttcttca

SEQ ID NO: 3231930 - DNA, 16 bp, Homo sapiens
agttcttcacctctat

SEQ ID NO: 3231931 - DNA, 13 bp, Homo sapiens
agttcttctccaa

SEQ ID NO: 3231932 - DNA, 13 bp, Homo sapiens
agttctttcctcc

SEQ ID NO: 3231933 - DNA, 18 bp, Homo sapiens
agttctttcctccccctg

SEQ ID NO: 3231934 - DNA, 19 bp, Homo sapiens
agttctttgttcatagccc

SEQ ID NO: 3231935 - DNA, 21 bp, Homo sapiens
agttctttgttcatagcccag

SEQ ID NO: 3231936 - DNA, 22 bp, Homo sapiens
agttctttgttcatagcccagt

SEQ ID NO: 3231937 - DNA, 13 bp, Homo sapiens
agttctttttgta

SEQ ID NO: 3231938 - DNA, 15 bp, Homo sapiens
agttctttttgtaca

SEQ ID NO: 3231939 - DNA, 20 bp, Homo sapiens
agttgaaaatggatttttaa

SEQ ID NO: 3231940 - DNA, 19 bp, Homo sapiens
agttgaaccattatacttt

SEQ ID NO: 3231941 - DNA, 21 bp, Homo sapiens
agttgaagggaaacaaagaag

SEQ ID NO: 3231942 - DNA, 22 bp, Homo sapiens
agttgaagggaaacaaagaagt

SEQ ID NO: 3231943 - DNA, 22 bp, Homo sapiens
agttgaagttagtggaaatctg

SEQ ID NO: 3231944 - DNA, 22 bp, Homo sapiens
agttgaatataagaaaatgctt

SEQ ID NO: 3231945 - DNA, 18 bp, Homo sapiens
agttgacggggcagtcag

SEQ ID NO: 3231946 - DNA, 15 bp, Homo sapiens
agttgactcacaggc

SEQ ID NO: 3231947 - DNA, 23 bp, Homo sapiens
agttgactcacaggccctggaga

SEQ ID NO: 3231948 - DNA, 15 bp, Homo sapiens
agttgaggagtttcc

SEQ ID NO: 3231949 - DNA, 13 bp, Homo sapiens
agttgatgcatgt

SEQ ID NO: 3231950 - DNA, 23 bp, Homo sapiens
agttgatttttttttttttttcc

SEQ ID NO: 3231951 - DNA, 23 bp, Homo sapiens
agttgcacttattgaccattttt

SEQ ID NO: 3231952 - DNA, 22 bp, Homo sapiens
agttgcagatgtattgactgta

SEQ ID NO: 3231953 - DNA, 16 bp, Homo sapiens
agttgccaagacaaat

SEQ ID NO: 3231954 - DNA, 17 bp, Homo sapiens
agttgccaagacaaatc

SEQ ID NO: 3231955 - DNA, 19 bp, Homo sapiens
agttgccaagacaaatcaa

SEQ ID NO: 3231956 - DNA, 19 bp, Homo sapiens
agttgcccagagcacttta

SEQ ID NO: 3231957 - DNA, 18 bp, Homo sapiens
agttgccgtctaggattg

SEQ ID NO: 3231958 - DNA, 19 bp, Homo sapiens
agttgcctttatttgctgt

SEQ ID NO: 3231959 - DNA, 16 bp, Homo sapiens
agttgctgtgtgtctg

SEQ ID NO: 3231960 - DNA, 15 bp, Homo sapiens
agttggaatttacca

SEQ ID NO: 3231961 - DNA, 13 bp, Homo sapiens
agttggactaaat

SEQ ID NO: 3231962 - DNA, 14 bp, Homo sapiens
agttggactaaatg

SEQ ID NO: 3231963 - DNA, 16 bp, Homo sapiens
agttggactctcaggg

SEQ ID NO: 3231964 - DNA, 17 bp, Homo sapiens
agttggactctcaggga

SEQ ID NO: 3231965 - DNA, 15 bp, Homo sapiens
agttggcatgaaagt

SEQ ID NO: 3231966 - DNA, 20 bp, Homo sapiens
agttggccatgatgtctttt

SEQ ID NO: 3231967 - DNA, 18 bp, Homo sapiens
agttggctggatgaaatt

SEQ ID NO: 3231968 - DNA, 15 bp, Homo sapiens
agttgggagcactgg

SEQ ID NO: 3231969 - DNA, 16 bp, Homo sapiens
agttgggagcactgga

SEQ ID NO: 3231970 - DNA, 21 bp, Homo sapiens
agttgggtggatgcctggtgg

SEQ ID NO: 3231971 - DNA, 15 bp, Homo sapiens
agttggtaacttttg

SEQ ID NO: 3231972 - DNA, 14 bp, Homo sapiens
agttggtattaata

SEQ ID NO: 3231973 - DNA, 16 bp, Homo sapiens
agttggtggggccagg

SEQ ID NO: 3231974 - DNA, 19 bp, Homo sapiens
agttggtggggccaggcca

SEQ ID NO: 3231975 - DNA, 23 bp, Homo sapiens
agttggtgtgtttttgggatgtc

SEQ ID NO: 3231976 - DNA, 19 bp, Homo sapiens
agttggtttgtatgagatg

SEQ ID NO: 3231977 - DNA, 22 bp, Homo sapiens
agttgtaaaaatgaaagtgact

SEQ ID NO: 3231978 - DNA, 15 bp, Homo sapiens
agttgtacaaatgta

SEQ ID NO: 3231979 - DNA, 18 bp, Homo sapiens
agttgtacaaatgtattt

SEQ ID NO: 3231980 - DNA, 19 bp, Homo sapiens
agttgtacaaatgtatttt

SEQ ID NO: 3231981 - DNA, 14 bp, Homo sapiens
agttgtagacaaag

SEQ ID NO: 3231982 - DNA, 18 bp, Homo sapiens
agttgtagcagattgttt

SEQ ID NO: 3231983 - DNA, 18 bp, Homo sapiens
agttgtattcttctgtat

SEQ ID NO: 3231984 - DNA, 20 bp, Homo sapiens
agttgtccatattttcacag

SEQ ID NO: 3231985 - DNA, 16 bp, Homo sapiens
agttgtcctatggaca

SEQ ID NO: 3231986 - DNA, 19 bp, Homo sapiens
agttgtctattctgagcct

SEQ ID NO: 3231987 - DNA, 14 bp, Homo sapiens
agttgtctctcttc

SEQ ID NO: 3231988 - DNA, 21 bp, Homo sapiens
agttgtgccttttatagctat

SEQ ID NO: 3231989 - DNA, 23 bp, Homo sapiens
agttgtgccttttatagctatta

SEQ ID NO: 3231990 - DNA, 19 bp, Homo sapiens
agttgtggaaagcctctgc

SEQ ID NO: 3231991 - DNA, 16 bp, Homo sapiens
agttgtgtgtatgtgt

SEQ ID NO: 3231992 - DNA, 23 bp, Homo sapiens
agttgtgttgttttttgttcaat

SEQ ID NO: 3231993 - DNA, 14 bp, Homo sapiens
agttgtgtttcaac

SEQ ID NO: 3231994 - DNA, 18 bp, Homo sapiens
agttgttattgttgaaca

SEQ ID NO: 3231995 - DNA, 15 bp, Homo sapiens
agttgttcaactatt

SEQ ID NO: 3231996 - DNA, 15 bp, Homo sapiens
agttgttcacatata

SEQ ID NO: 3231997 - DNA, 19 bp, Homo sapiens
agttgttcacatatatgta

SEQ ID NO: 3231998 - DNA, 12 bp, Homo sapiens
agttgttgtaac

SEQ ID NO: 3231999 - DNA, 16 bp, Homo sapiens
agttgttgtaacctgc

SEQ ID NO: 3232000 - DNA, 16 bp, Homo sapiens
agttgtttctgaccca

SEQ ID NO: 3232001 - DNA, 22 bp, Homo sapiens
agtttaacacaagtcctgtgaa

SEQ ID NO: 3232002 - DNA, 18 bp, Homo sapiens
agtttaagacaccaaata

SEQ ID NO: 3232003 - DNA, 17 bp, Homo sapiens
agtttaagaccagcctg

SEQ ID NO: 3232004 - DNA, 14 bp, Homo sapiens
agtttaatgtctcc

SEQ ID NO: 3232005 - DNA, 21 bp, Homo sapiens
agtttacacttcatatagcat

SEQ ID NO: 3232006 - DNA, 14 bp, Homo sapiens
agtttacattctaa

SEQ ID NO: 3232007 - DNA, 15 bp, Homo sapiens
agtttacattgtaaa

SEQ ID NO: 3232008 - DNA, 13 bp, Homo sapiens
agtttaccatttg

SEQ ID NO: 3232009 - DNA, 14 bp, Homo sapiens
agtttaccatttgt

SEQ ID NO: 3232010 - DNA, 16 bp, Homo sapiens
agtttaccatttgtaa

SEQ ID NO: 3232011 - DNA, 20 bp, Homo sapiens
agtttacctctttaaaaaca

SEQ ID NO: 3232012 - DNA, 14 bp, Homo sapiens
agtttaccttgtat

SEQ ID NO: 3232013 - DNA, 21 bp, Homo sapiens
agtttagatttcaagaaaaaa

SEQ ID NO: 3232014 - DNA, 16 bp, Homo sapiens
agtttaggataaaata

SEQ ID NO: 3232015 - DNA, 22 bp, Homo sapiens
agtttatattctgaaaggaaat

SEQ ID NO: 3232016 - DNA, 16 bp, Homo sapiens
agtttatccaaatctt

SEQ ID NO: 3232017 - DNA, 17 bp, Homo sapiens
agtttatggcagaaggg

SEQ ID NO: 3232018 - DNA, 15 bp, Homo sapiens
agtttattctcattt

SEQ ID NO: 3232019 - DNA, 22 bp, Homo sapiens
agtttatttccaaataaaatga

SEQ ID NO: 3232020 - DNA, 14 bp, Homo sapiens
agtttattttgtta

SEQ ID NO: 3232021 - DNA, 13 bp, Homo sapiens
agtttatttttgt

SEQ ID NO: 3232022 - DNA, 18 bp, Homo sapiens
agtttcaagttttaaagt

SEQ ID NO: 3232023 - DNA, 14 bp, Homo sapiens
agtttcaatgtgat

SEQ ID NO: 3232024 - DNA, 17 bp, Homo sapiens
agtttcagagaccttaa

SEQ ID NO: 3232025 - DNA, 15 bp, Homo sapiens
agtttcagatatata

SEQ ID NO: 3232026 - DNA, 11 bp, Homo sapiens
agtttcaggtg

SEQ ID NO: 3232027 - DNA, 18 bp, Homo sapiens
agtttcaggtgacatgtg

SEQ ID NO: 3232028 - DNA, 21 bp, Homo sapiens
agtttcagtaaataatgaaaa

SEQ ID NO: 3232029 - DNA, 22 bp, Homo sapiens
agtttcagtattagatgcactt

SEQ ID NO: 3232030 - DNA, 17 bp, Homo sapiens
agtttcattctcctgcc

SEQ ID NO: 3232031 - DNA, 17 bp, Homo sapiens
agtttccatagcaacag

SEQ ID NO: 3232032 - DNA, 20 bp, Homo sapiens
agtttccatagcaacaggaa

SEQ ID NO: 3232033 - DNA, 15 bp, Homo sapiens
agtttcctaaaagtt

SEQ ID NO: 3232034 - DNA, 14 bp, Homo sapiens
agtttctaagattc

SEQ ID NO: 3232035 - DNA, 15 bp, Homo sapiens
agtttctaagattct

SEQ ID NO: 3232036 - DNA, 18 bp, Homo sapiens
agtttctaagattctaaa

SEQ ID NO: 3232037 - DNA, 19 bp, Homo sapiens
agtttctaagattctaaag

SEQ ID NO: 3232038 - DNA, 15 bp, Homo sapiens
agtttctagaggcct

SEQ ID NO: 3232039 - DNA, 21 bp, Homo sapiens
agtttctagctagaaatatga

SEQ ID NO: 3232040 - DNA, 13 bp, Homo sapiens
agtttctcagctc

SEQ ID NO: 3232041 - DNA, 22 bp, Homo sapiens
agtttctcatgacggcttttgt

SEQ ID NO: 3232042 - DNA, 14 bp, Homo sapiens
agtttctcttttca

SEQ ID NO: 3232043 - DNA, 17 bp, Homo sapiens
agtttctgggacctcag

SEQ ID NO: 3232044 - DNA, 14 bp, Homo sapiens
agtttcttagcttt

SEQ ID NO: 3232045 - DNA, 12 bp, Homo sapiens
ataataaaatca

SEQ ID NO: 3232046 - DNA, 16 bp, Homo sapiens
ataataaagctactga

SEQ ID NO: 3232047 - DNA, 13 bp, Homo sapiens
ataataaatcaca

SEQ ID NO: 3232048 - DNA, 14 bp, Homo sapiens
ataataaatcacac

SEQ ID NO: 3232049 - DNA, 15 bp, Homo sapiens
ataataatattgttt

SEQ ID NO: 3232050 - DNA, 22 bp, Homo sapiens
ataataattaggttaacattgt

SEQ ID NO: 3232051 - DNA, 17 bp, Homo sapiens
ataatactctgttgtac

SEQ ID NO: 3232052 - DNA, 12 bp, Homo sapiens
ataatagaagaa

SEQ ID NO: 3232053 - DNA, 17 bp, Homo sapiens
ataatagagataagtcc

SEQ ID NO: 3232054 - DNA, 22 bp, Homo sapiens
ataataggaacaatctttgctg

SEQ ID NO: 3232055 - DNA, 14 bp, Homo sapiens
ataatagggaaaat

SEQ ID NO: 3232056 - DNA, 17 bp, Homo sapiens
ataataggtagtttgga

SEQ ID NO: 3232057 - DNA, 20 bp, Homo sapiens
ataataggtagtttggatat

SEQ ID NO: 3232058 - DNA, 15 bp, Homo sapiens
ataatatattgtgtt

SEQ ID NO: 3232059 - DNA, 14 bp, Homo sapiens
ataatatatttgca

SEQ ID NO: 3232060 - DNA, 16 bp, Homo sapiens
ataatatatttgcaga

SEQ ID NO: 3232061 - DNA, 17 bp, Homo sapiens
ataatatatttgcagat

SEQ ID NO: 3232062 - DNA, 22 bp, Homo sapiens
ataatatctttgtgataattta

SEQ ID NO: 3232063 - DNA, 23 bp, Homo sapiens
ataatatggaaccttccctccaa

SEQ ID NO: 3232064 - DNA, 16 bp, Homo sapiens
ataatattaatttatt

SEQ ID NO: 3232065 - DNA, 14 bp, Homo sapiens
ataatattactgtt

SEQ ID NO: 3232066 - DNA, 12 bp, Homo sapiens
ataatattcatt

SEQ ID NO: 3232067 - DNA, 12 bp, Homo sapiens
ataatattgaaa

SEQ ID NO: 3232068 - DNA, 14 bp, Homo sapiens
ataatattgaaaat

SEQ ID NO: 3232069 - DNA, 18 bp, Homo sapiens
ataatattgaaaattgaa

SEQ ID NO: 3232070 - DNA, 14 bp, Homo sapiens
ataatattgttgta

SEQ ID NO: 3232071 - DNA, 17 bp, Homo sapiens
ataatattgttgtataa

SEQ ID NO: 3232072 - DNA, 16 bp, Homo sapiens
ataatattgtttggta

SEQ ID NO: 3232073 - DNA, 16 bp, Homo sapiens
ataatatttcaagtgc

SEQ ID NO: 3232074 - DNA, 15 bp, Homo sapiens
ataatcaaatgattt

SEQ ID NO: 3232075 - DNA, 17 bp, Homo sapiens
ataatcaaatgatttca

SEQ ID NO: 3232076 - DNA, 18 bp, Homo sapiens
ataatcaaatgatttcat

SEQ ID NO: 3232077 - DNA, 21 bp, Homo sapiens
ataatcaaatgatttcatatt

SEQ ID NO: 3232078 - DNA, 16 bp, Homo sapiens
ataatcaagattttag

SEQ ID NO: 3232079 - DNA, 21 bp, Homo sapiens
ataatcagcaagaatttgatc

SEQ ID NO: 3232080 - DNA, 13 bp, Homo sapiens
ataatcagcctct

SEQ ID NO: 3232081 - DNA, 16 bp, Homo sapiens
ataatcagcctcttaa

SEQ ID NO: 3232082 - DNA, 17 bp, Homo sapiens
ataatcagcctcttaaa

SEQ ID NO: 3232083 - DNA, 19 bp, Homo sapiens
ataatcagtatatttggtt

SEQ ID NO: 3232084 - DNA, 17 bp, Homo sapiens
ataatcagtgactgaaa

SEQ ID NO: 3232085 - DNA, 20 bp, Homo sapiens
ataatcagtgtgtctaaatt

SEQ ID NO: 3232086 - DNA, 19 bp, Homo sapiens
ataatcattagttttagag

SEQ ID NO: 3232087 - DNA, 19 bp, Homo sapiens
ataatccttgataatatat

SEQ ID NO: 3232088 - DNA, 22 bp, Homo sapiens
ataatctcaaaggagaaaaaaa

SEQ ID NO: 3232089 - DNA, 19 bp, Homo sapiens
ataatctggactcctctgt

SEQ ID NO: 3232090 - DNA, 20 bp, Homo sapiens
ataatcttcaggtgaacact

SEQ ID NO: 3232091 - DNA, 14 bp, Homo sapiens
ataatcttctgcct

SEQ ID NO: 3232092 - DNA, 15 bp, Homo sapiens
ataatcttctgcctt

SEQ ID NO: 3232093 - DNA, 13 bp, Homo sapiens
ataatcttgtaga

SEQ ID NO: 3232094 - DNA, 15 bp, Homo sapiens
ataatgaaataatca

SEQ ID NO: 3232095 - DNA, 18 bp, Homo sapiens
ataatgaaataatcagtg

SEQ ID NO: 3232096 - DNA, 16 bp, Homo sapiens
ataatgaacaaaatta

SEQ ID NO: 3232097 - DNA, 19 bp, Homo sapiens
ataatgaattataacagtt

SEQ ID NO: 3232098 - DNA, 20 bp, Homo sapiens
ataatgatcgaaaaaataat

SEQ ID NO: 3232099 - DNA, 21 bp, Homo sapiens
ataatgatttgctctttgaca

SEQ ID NO: 3232100 - DNA, 20 bp, Homo sapiens
ataatgctacaattttaaga

SEQ ID NO: 3232101 - DNA, 18 bp, Homo sapiens
ataatgcttaatttctaa

SEQ ID NO: 3232102 - DNA, 14 bp, Homo sapiens
ataatgctttggaa

SEQ ID NO: 3232103 - DNA, 14 bp, Homo sapiens
ataatgctttgtta

SEQ ID NO: 3232104 - DNA, 20 bp, Homo sapiens
ataatggaagagaaatctca

SEQ ID NO: 3232105 - DNA, 21 bp, Homo sapiens
ataatgggattttcttttctt

SEQ ID NO: 3232106 - DNA, 18 bp, Homo sapiens
ataatggtcccatccagg

SEQ ID NO: 3232107 - DNA, 23 bp, Homo sapiens
ataatgtaatcggcttgaatttt

SEQ ID NO: 3232108 - DNA, 19 bp, Homo sapiens
ataatgtactgatttcagt

SEQ ID NO: 3232109 - DNA, 14 bp, Homo sapiens
ataatgtattgttg

SEQ ID NO: 3232110 - DNA, 16 bp, Homo sapiens
ataatgtattttcagc

SEQ ID NO: 3232111 - DNA, 17 bp, Homo sapiens
ataatgtattttcagct

SEQ ID NO: 3232112 - DNA, 12 bp, Homo sapiens
ataatgtgtgta

SEQ ID NO: 3232113 - DNA, 14 bp, Homo sapiens
ataatgtgtgtatg

SEQ ID NO: 3232114 - DNA, 16 bp, Homo sapiens
ataatgttctttaatg

SEQ ID NO: 3232115 - DNA, 19 bp, Homo sapiens
ataatgttctttaatgttg

SEQ ID NO: 3232116 - DNA, 21 bp, Homo sapiens
ataatgttctttaatgttgtc

SEQ ID NO: 3232117 - DNA, 19 bp, Homo sapiens
ataatgttgttatttaaag

SEQ ID NO: 3232118 - DNA, 22 bp, Homo sapiens
ataatgtttaaatcatgtatgt

SEQ ID NO: 3232119 - DNA, 13 bp, Homo sapiens
ataatgtttgcta

SEQ ID NO: 3232120 - DNA, 14 bp, Homo sapiens
ataatgtttgctat

SEQ ID NO: 3232121 - DNA, 15 bp, Homo sapiens
ataattaaataaatg

SEQ ID NO: 3232122 - DNA, 15 bp, Homo sapiens
ataattacattccta

SEQ ID NO: 3232123 - DNA, 23 bp, Homo sapiens
ataattacattcctaactagaat

SEQ ID NO: 3232124 - DNA, 19 bp, Homo sapiens
ataattatcggaagcagtg

SEQ ID NO: 3232125 - DNA, 21 bp, Homo sapiens
ataattatcggaagcagtgcc

SEQ ID NO: 3232126 - DNA, 22 bp, Homo sapiens
ataattatcggaagcagtgcct

SEQ ID NO: 3232127 - DNA, 14 bp, Homo sapiens
ataattatgacagt

SEQ ID NO: 3232128 - DNA, 16 bp, Homo sapiens
ataattatgacagtta

SEQ ID NO: 3232129 - DNA, 20 bp, Homo sapiens
ataattatgacagttatact

SEQ ID NO: 3232130 - DNA, 17 bp, Homo sapiens
ataattatttatttaat

SEQ ID NO: 3232131 - DNA, 16 bp, Homo sapiens
ataattcactcaagca

SEQ ID NO: 3232132 - DNA, 18 bp, Homo sapiens
ataattcactcaagcact

SEQ ID NO: 3232133 - DNA, 13 bp, Homo sapiens
ataattcatttgt

SEQ ID NO: 3232134 - DNA, 20 bp, Homo sapiens
ataattccctatcttttagt

SEQ ID NO: 3232135 - DNA, 21 bp, Homo sapiens
ataattctaagttatttactt

SEQ ID NO: 3232136 - DNA, 14 bp, Homo sapiens
ataattctactttg

SEQ ID NO: 3232137 - DNA, 13 bp, Homo sapiens
ataattctgtaaa

SEQ ID NO: 3232138 - DNA, 13 bp, Homo sapiens
ataattctgtaca

SEQ ID NO: 3232139 - DNA, 14 bp, Homo sapiens
ataattctgtacat

SEQ ID NO: 3232140 - DNA, 14 bp, Homo sapiens
ataattcttgtata

SEQ ID NO: 3232141 - DNA, 22 bp, Homo sapiens
ataattgacaggattattggaa

SEQ ID NO: 3232142 - DNA, 15 bp, Homo sapiens
ataattgatcaaatt

SEQ ID NO: 3232143 - DNA, 20 bp, Homo sapiens
ataattgctatttattttta

SEQ ID NO: 3232144 - DNA, 17 bp, Homo sapiens
ataattggatttcctaa

SEQ ID NO: 3232145 - DNA, 17 bp, Homo sapiens
ataattggtgctatttg

SEQ ID NO: 3232146 - DNA, 23 bp, Homo sapiens
ataattggtgctatttgaagaaa

SEQ ID NO: 3232147 - DNA, 13 bp, Homo sapiens
ataattgtacaaa

SEQ ID NO: 3232148 - DNA, 19 bp, Homo sapiens
ataattgtacaaaattaag

SEQ ID NO: 3232149 - DNA, 19 bp, Homo sapiens
ataattgtaccaacctcat

SEQ ID NO: 3232150 - DNA, 12 bp, Homo sapiens
ataattgtatca

SEQ ID NO: 3232151 - DNA, 22 bp, Homo sapiens
ataattgttgaaattttgcaaa

SEQ ID NO: 3232152 - DNA, 16 bp, Homo sapiens
ataatttacctaagat

SEQ ID NO: 3232153 - DNA, 21 bp, Homo sapiens
ataatttcatactgaaattat

SEQ ID NO: 3232154 - DNA, 14 bp, Homo sapiens
ataatttctaatgt

SEQ ID NO: 3232155 - DNA, 18 bp, Homo sapiens
ataatttcttactaaaca

SEQ ID NO: 3232156 - DNA, 11 bp, Homo sapiens
ataatttgcat

SEQ ID NO: 3232157 - DNA, 16 bp, Homo sapiens
ataatttgcatattct

SEQ ID NO: 3232158 - DNA, 13 bp, Homo sapiens
ataatttgtttcc

SEQ ID NO: 3232159 - DNA, 14 bp, Homo sapiens
ataatttgtttcca

SEQ ID NO: 3232160 - DNA, 16 bp, Homo sapiens
ataatttgtttccagc

SEQ ID NO: 3232161 - DNA, 21 bp, Homo sapiens
ataattttaaaaaagccttcc

SEQ ID NO: 3232162 - DNA, 14 bp, Homo sapiens
ataattttaaagta

SEQ ID NO: 3232163 - DNA, 15 bp, Homo sapiens
ataattttaaagtaa

SEQ ID NO: 3232164 - DNA, 17 bp, Homo sapiens
ataattttaaataacct

SEQ ID NO: 3232165 - DNA, 22 bp, Homo sapiens
ataattttaaataacctctggc

SEQ ID NO: 3232166 - DNA, 15 bp, Homo sapiens
ataattttagtttat

SEQ ID NO: 3232167 - DNA, 14 bp, Homo sapiens
ataattttcctcaa

SEQ ID NO: 3232168 - DNA, 13 bp, Homo sapiens
ataattttcttca

SEQ ID NO: 3232169 - DNA, 15 bp, Homo sapiens
ataatttttaaagta

SEQ ID NO: 3232170 - DNA, 19 bp, Homo sapiens
ataatttttaaagtatata

SEQ ID NO: 3232171 - DNA, 23 bp, Homo sapiens
ataatttttatatttaattatta

SEQ ID NO: 3232172 - DNA, 21 bp, Homo sapiens
atatgtttaaaataaaatgaa

SEQ ID NO: 3232173 - DNA, 18 bp, Homo sapiens
atatgtttccttgtttat

SEQ ID NO: 3232174 - DNA, 12 bp, Homo sapiens
atattaaaaaac

SEQ ID NO: 3232175 - DNA, 23 bp, Homo sapiens
atattaaaaatatggaacttcta

SEQ ID NO: 3232176 - DNA, 15 bp, Homo sapiens
atattaaaagagacc

SEQ ID NO: 3232177 - DNA, 14 bp, Homo sapiens
atattaaaataagc

SEQ ID NO: 3232178 - DNA, 21 bp, Homo sapiens
atattaaaataagcactgtgc

SEQ ID NO: 3232179 - DNA, 18 bp, Homo sapiens
atattaaagattctcttt

SEQ ID NO: 3232180 - DNA, 13 bp, Homo sapiens
atattaaatacag

SEQ ID NO: 3232181 - DNA, 19 bp, Homo sapiens
atattaaatacagacacta

SEQ ID NO: 3232182 - DNA, 16 bp, Homo sapiens
atattaagacagtgta

SEQ ID NO: 3232183 - DNA, 18 bp, Homo sapiens
atattaagacagtgtaca

SEQ ID NO: 3232184 - DNA, 20 bp, Homo sapiens
atattaagacagtgtacaaa

SEQ ID NO: 3232185 - DNA, 12 bp, Homo sapiens
atattaagcact

SEQ ID NO: 3232186 - DNA, 20 bp, Homo sapiens
atattaagcactttaagctc

SEQ ID NO: 3232187 - DNA, 11 bp, Homo sapiens
atattaatcaa

SEQ ID NO: 3232188 - DNA, 21 bp, Homo sapiens
atattacaataccgttaagat

SEQ ID NO: 3232189 - DNA, 12 bp, Homo sapiens
atattaccaaaa

SEQ ID NO: 3232190 - DNA, 15 bp, Homo sapiens
atattaccagcaaga

SEQ ID NO: 3232191 - DNA, 21 bp, Homo sapiens
atattactacttaccatttgc

SEQ ID NO: 3232192 - DNA, 21 bp, Homo sapiens
atattactcctatttttgtaa

SEQ ID NO: 3232193 - DNA, 14 bp, Homo sapiens
atattactgtcttt

SEQ ID NO: 3232194 - DNA, 19 bp, Homo sapiens
atattactgtctttattct

SEQ ID NO: 3232195 - DNA, 11 bp, Homo sapiens
atattacttta

SEQ ID NO: 3232196 - DNA, 13 bp, Homo sapiens
atattactttatc

SEQ ID NO: 3232197 - DNA, 13 bp, Homo sapiens
atattagatcaaa

SEQ ID NO: 3232198 - DNA, 18 bp, Homo sapiens
atattaggctataaatgt

SEQ ID NO: 3232199 - DNA, 19 bp, Homo sapiens
atattagtattatcttgtt

SEQ ID NO: 3232200 - DNA, 15 bp, Homo sapiens
atattagtgattctg

SEQ ID NO: 3232201 - DNA, 21 bp, Homo sapiens
atattagtgattctgatttca

SEQ ID NO: 3232202 - DNA, 15 bp, Homo sapiens
atattataaatatat

SEQ ID NO: 3232203 - DNA, 16 bp, Homo sapiens
atattatggaagattt

SEQ ID NO: 3232204 - DNA, 13 bp, Homo sapiens
atattatgtcttc

SEQ ID NO: 3232205 - DNA, 15 bp, Homo sapiens
atattatgtgaagaa

SEQ ID NO: 3232206 - DNA, 13 bp, Homo sapiens
atattatgtgttt

SEQ ID NO: 3232207 - DNA, 17 bp, Homo sapiens
atattatgtgtttccat

SEQ ID NO: 3232208 - DNA, 23 bp, Homo sapiens
atattatgttcctcaaggtccat

SEQ ID NO: 3232209 - DNA, 13 bp, Homo sapiens
atattattatgaa

SEQ ID NO: 3232210 - DNA, 13 bp, Homo sapiens
atattatttggca

SEQ ID NO: 3232211 - DNA, 18 bp, Homo sapiens
atattatttggcagtttg

SEQ ID NO: 3232212 - DNA, 21 bp, Homo sapiens
atattatttggcagtttggta

SEQ ID NO: 3232213 - DNA, 18 bp, Homo sapiens
atattatttgtgtttcct

SEQ ID NO: 3232214 - DNA, 13 bp, Homo sapiens
atattcacatctt

SEQ ID NO: 3232215 - DNA, 16 bp, Homo sapiens
atattcacatgttcta

SEQ ID NO: 3232216 - DNA, 18 bp, Homo sapiens
atattcacatgttctaat

SEQ ID NO: 3232217 - DNA, 14 bp, Homo sapiens
atattcagacatca

SEQ ID NO: 3232218 - DNA, 14 bp, Homo sapiens
atattcagagaata

SEQ ID NO: 3232219 - DNA, 17 bp, Homo sapiens
atattcagagaatatca

SEQ ID NO: 3232220 - DNA, 20 bp, Homo sapiens
atattcagggtaaataggaa

SEQ ID NO: 3232221 - DNA, 21 bp, Homo sapiens
atattccagatctttcagaaa

SEQ ID NO: 3232222 - DNA, 15 bp, Homo sapiens
atattccatgaatgt

SEQ ID NO: 3232223 - DNA, 16 bp, Homo sapiens
atattccatgaatgta

SEQ ID NO: 3232224 - DNA, 18 bp, Homo sapiens
atattcccctatctctag

SEQ ID NO: 3232225 - DNA, 14 bp, Homo sapiens
atattcctccaaat

SEQ ID NO: 3232226 - DNA, 22 bp, Homo sapiens
atattcctgaatgaaatatcag

SEQ ID NO: 3232227 - DNA, 20 bp, Homo sapiens
atattcctttctatcatttt

SEQ ID NO: 3232228 - DNA, 16 bp, Homo sapiens
atattctaaaaccatt

SEQ ID NO: 3232229 - DNA, 13 bp, Homo sapiens
atattctaagcca

SEQ ID NO: 3232230 - DNA, 16 bp, Homo sapiens
atattctaattaaaat

SEQ ID NO: 3232231 - DNA, 20 bp, Homo sapiens
atattctgaaaggaaataca

SEQ ID NO: 3232232 - DNA, 17 bp, Homo sapiens
atattcttatgttatca

SEQ ID NO: 3232233 - DNA, 22 bp, Homo sapiens
atattcttattggaaatgtact

SEQ ID NO: 3232234 - DNA, 14 bp, Homo sapiens
atattcttctcttg

SEQ ID NO: 3232235 - DNA, 12 bp, Homo sapiens
atattcttgtca

SEQ ID NO: 3232236 - DNA, 13 bp, Homo sapiens
atattcttgtcaa

SEQ ID NO: 3232237 - DNA, 21 bp, Homo sapiens
atattcttttctgcaaaatag

SEQ ID NO: 3232238 - DNA, 16 bp, Homo sapiens
atattgaaaattgaaa

SEQ ID NO: 3232239 - DNA, 22 bp, Homo sapiens
atattgaataaaaaatagacat

SEQ ID NO: 3232240 - DNA, 14 bp, Homo sapiens
atattgacttgtat

SEQ ID NO: 3232241 - DNA, 14 bp, Homo sapiens
atattgatcaaata

SEQ ID NO: 3232242 - DNA, 14 bp, Homo sapiens
atattgatgaaaag

SEQ ID NO: 3232243 - DNA, 23 bp, Homo sapiens
atattgatgtcagtatttcaact

SEQ ID NO: 3232244 - DNA, 18 bp, Homo sapiens
atattgattctgaaattt

SEQ ID NO: 3232245 - DNA, 19 bp, Homo sapiens
atattgattgggaaaacat

SEQ ID NO: 3232246 - DNA, 20 bp, Homo sapiens
atattgcaggagacattttc

SEQ ID NO: 3232247 - DNA, 19 bp, Homo sapiens
atattgctactataatcaa

SEQ ID NO: 3232248 - DNA, 21 bp, Homo sapiens
atattgctactataatcaaat

SEQ ID NO: 3232249 - DNA, 22 bp, Homo sapiens
atattgctactataatcaaatg

SEQ ID NO: 3232250 - DNA, 22 bp, Homo sapiens
atattgctgagagaaatatgga

SEQ ID NO: 3232251 - DNA, 16 bp, Homo sapiens
atattgcttcttgtgt

SEQ ID NO: 3232252 - DNA, 13 bp, Homo sapiens
atattggtattca

SEQ ID NO: 3232253 - DNA, 15 bp, Homo sapiens
atattggtgcgtttt

SEQ ID NO: 3232254 - DNA, 19 bp, Homo sapiens
atattggtgcgtttttaca

SEQ ID NO: 3232255 - DNA, 16 bp, Homo sapiens
atattgtcagatattt

SEQ ID NO: 3232256 - DNA, 23 bp, Homo sapiens
atattgtcatgtttattctaata

SEQ ID NO: 3232257 - DNA, 19 bp, Homo sapiens
atattgtgattctgccttt

SEQ ID NO: 3232258 - DNA, 19 bp, Homo sapiens
atattgtgccaatatgtat

SEQ ID NO: 3232259 - DNA, 20 bp, Homo sapiens
atattgtgccaatatgtatt

SEQ ID NO: 3232260 - DNA, 17 bp, Homo sapiens
atattgttaatctctgt

SEQ ID NO: 3232261 - DNA, 22 bp, Homo sapiens
atattgttcaaacaatatcata

SEQ ID NO: 3232262 - DNA, 21 bp, Homo sapiens
atattgttgacaactgtgact

SEQ ID NO: 3232263 - DNA, 16 bp, Homo sapiens
atattgttgcattgct

SEQ ID NO: 3232264 - DNA, 20 bp, Homo sapiens
atattgttgcattgcttttt

SEQ ID NO: 3232265 - DNA, 21 bp, Homo sapiens
atattgttggcacagaacagg

SEQ ID NO: 3232266 - DNA, 22 bp, Homo sapiens
atattgttgtataatttcgaga

SEQ ID NO: 3232267 - DNA, 12 bp, Homo sapiens
atattgtttaaa

SEQ ID NO: 3232268 - DNA, 18 bp, Homo sapiens
atattgtttaaaattcag

SEQ ID NO: 3232269 - DNA, 18 bp, Homo sapiens
atattgtttggtaaatgt

SEQ ID NO: 3232270 - DNA, 19 bp, Homo sapiens
atattgtttggtaaatgtt

SEQ ID NO: 3232271 - DNA, 13 bp, Homo sapiens
atattgtttttct

SEQ ID NO: 3232272 - DNA, 18 bp, Homo sapiens
atattgtttttgtattta

SEQ ID NO: 3232273 - DNA, 19 bp, Homo sapiens
atattgtttttgtatttat

SEQ ID NO: 3232274 - DNA, 17 bp, Homo sapiens
atatttaaaaaattatg

SEQ ID NO: 3232275 - DNA, 14 bp, Homo sapiens
atatttaaaaattg

SEQ ID NO: 3232276 - DNA, 22 bp, Homo sapiens
atatttaaaaattgtttcttga

SEQ ID NO: 3232277 - DNA, 22 bp, Homo sapiens
atatttaaacctttttcttgat

SEQ ID NO: 3232278 - DNA, 19 bp, Homo sapiens
atatttaacattatttata

SEQ ID NO: 3232279 - DNA, 18 bp, Homo sapiens
atatttaacctatttcca

SEQ ID NO: 3232280 - DNA, 19 bp, Homo sapiens
atatttaagaaaatacaat

SEQ ID NO: 3232281 - DNA, 15 bp, Homo sapiens
atatttaatatattg

SEQ ID NO: 3232282 - DNA, 23 bp, Homo sapiens
atatttaatgcattaaacctgtc

SEQ ID NO: 3232283 - DNA, 23 bp, Homo sapiens
atatttacagtgaaaatgtaagc

SEQ ID NO: 3232284 - DNA, 16 bp, Homo sapiens
atatttactctttgca

SEQ ID NO: 3232285 - DNA, 17 bp, Homo sapiens
atatttactctttgcaa

SEQ ID NO: 3232286 - DNA, 19 bp, Homo sapiens
atatttacttcttatacat

SEQ ID NO: 3232287 - DNA, 15 bp, Homo sapiens
atatttataactcat

SEQ ID NO: 3232288 - DNA, 22 bp, Homo sapiens
atatttataactcatcataaaa

SEQ ID NO: 3232289 - DNA, 14 bp, Homo sapiens
atatttatatttca

SEQ ID NO: 3232290 - DNA, 18 bp, Homo sapiens
atatttatgtctatttaa

SEQ ID NO: 3232291 - DNA, 16 bp, Homo sapiens
atatttattacctctg

SEQ ID NO: 3232292 - DNA, 18 bp, Homo sapiens
atatttattcataatgaa

SEQ ID NO: 3232293 - DNA, 13 bp, Homo sapiens
atatttattgtta

SEQ ID NO: 3232294 - DNA, 22 bp, Homo sapiens
atatttattgtttatttatcag

SEQ ID NO: 3232295 - DNA, 16 bp, Homo sapiens
atatttatttaaagca

SEQ ID NO: 3232296 - DNA, 17 bp, Homo sapiens
atatttatttaaagcat

SEQ ID NO: 3232297 - DNA, 21 bp, Homo sapiens
atatttattttctttctgtaa

SEQ ID NO: 3232298 - DNA, 20 bp, Homo sapiens
atccacaggaaagtgttatt

SEQ ID NO: 3232299 - DNA, 14 bp, Homo sapiens
atccaccacctccc

SEQ ID NO: 3232300 - DNA, 17 bp, Homo sapiens
atccaccacctccctca

SEQ ID NO: 3232301 - DNA, 20 bp, Homo sapiens
atccacccaaccctatctcc

SEQ ID NO: 3232302 - DNA, 15 bp, Homo sapiens
atccacccacctcag

SEQ ID NO: 3232303 - DNA, 13 bp, Homo sapiens
atccacccagtgc

SEQ ID NO: 3232304 - DNA, 16 bp, Homo sapiens
atccacccagtgctgc

SEQ ID NO: 3232305 - DNA, 19 bp, Homo sapiens
atccacccagtgctgccat

SEQ ID NO: 3232306 - DNA, 23 bp, Homo sapiens
atccacccagtgctgccatgcca

SEQ ID NO: 3232307 - DNA, 11 bp, Homo sapiens
atccaccccct

SEQ ID NO: 3232308 - DNA, 20 bp, Homo sapiens
atccacccgggggagcccag

SEQ ID NO: 3232309 - DNA, 22 bp, Homo sapiens
atccacccgggggagcccagtg

SEQ ID NO: 3232310 - DNA, 18 bp, Homo sapiens
atccacctcggagcatgg

SEQ ID NO: 3232311 - DNA, 22 bp, Homo sapiens
atccacctcggagcatggtgtt

SEQ ID NO: 3232312 - DNA, 20 bp, Homo sapiens
atccaccttggctctgccag

SEQ ID NO: 3232313 - DNA, 18 bp, Homo sapiens
atccactctaccctccca

SEQ ID NO: 3232314 - DNA, 21 bp, Homo sapiens
atccactctaccctcccaccc

SEQ ID NO: 3232315 - DNA, 17 bp, Homo sapiens
atccactgggaccccca

SEQ ID NO: 3232316 - DNA, 13 bp, Homo sapiens
atccagaagtttt

SEQ ID NO: 3232317 - DNA, 22 bp, Homo sapiens
atccagaagttttaacttccag

SEQ ID NO: 3232318 - DNA, 19 bp, Homo sapiens
atccagactgtaagatgtt

SEQ ID NO: 3232319 - DNA, 20 bp, Homo sapiens
atccagactgtaagatgttg

SEQ ID NO: 3232320 - DNA, 13 bp, Homo sapiens
atccagagcagag

SEQ ID NO: 3232321 - DNA, 22 bp, Homo sapiens
atccagcgtgacggagcccaca

SEQ ID NO: 3232322 - DNA, 15 bp, Homo sapiens
atccaggcaccagga

SEQ ID NO: 3232323 - DNA, 16 bp, Homo sapiens
atccaggtcatgcagt

SEQ ID NO: 3232324 - DNA, 13 bp, Homo sapiens
atccagtataaga

SEQ ID NO: 3232325 - DNA, 16 bp, Homo sapiens
atccagtgatccttac

SEQ ID NO: 3232326 - DNA, 16 bp, Homo sapiens
atccagttcatgagaa

SEQ ID NO: 3232327 - DNA, 15 bp, Homo sapiens
atccagtttgttctc

SEQ ID NO: 3232328 - DNA, 15 bp, Homo sapiens
atccataaatgtgtt

SEQ ID NO: 3232329 - DNA, 20 bp, Homo sapiens
atccatagtaactgacatga

SEQ ID NO: 3232330 - DNA, 23 bp, Homo sapiens
atccatatcttaaagaaacagct

SEQ ID NO: 3232331 - DNA, 14 bp, Homo sapiens
atccatccatctcc

SEQ ID NO: 3232332 - DNA, 12 bp, Homo sapiens
atccatctccag

SEQ ID NO: 3232333 - DNA, 15 bp, Homo sapiens
atccatgcaccaaac

SEQ ID NO: 3232334 - DNA, 14 bp, Homo sapiens
atccatgtactgta

SEQ ID NO: 3232335 - DNA, 18 bp, Homo sapiens
atccatgtcctatgtgtg

SEQ ID NO: 3232336 - DNA, 19 bp, Homo sapiens
atccatgtgattaatgttt

SEQ ID NO: 3232337 - DNA, 15 bp, Homo sapiens
atccattaggccagc

SEQ ID NO: 3232338 - DNA, 16 bp, Homo sapiens
atccattaggccagca

SEQ ID NO: 3232339 - DNA, 17 bp, Homo sapiens
atccattaggccagcaa

SEQ ID NO: 3232340 - DNA, 13 bp, Homo sapiens
atccattcacaag

SEQ ID NO: 3232341 - DNA, 13 bp, Homo sapiens
atccatttgtaat

SEQ ID NO: 3232342 - DNA, 13 bp, Homo sapiens
atcccaaaagtca

SEQ ID NO: 3232343 - DNA, 15 bp, Homo sapiens
atcccaaagttgttg

SEQ ID NO: 3232344 - DNA, 15 bp, Homo sapiens
atcccaaccagtgcc

SEQ ID NO: 3232345 - DNA, 16 bp, Homo sapiens
atcccaaccagtgcca

SEQ ID NO: 3232346 - DNA, 17 bp, Homo sapiens
atcccaactgtcttttt

SEQ ID NO: 3232347 - DNA, 14 bp, Homo sapiens
atcccaagcctcct

SEQ ID NO: 3232348 - DNA, 19 bp, Homo sapiens
atcccaatcaaagaattac

SEQ ID NO: 3232349 - DNA, 22 bp, Homo sapiens
atcccacatccaactccagcaa

SEQ ID NO: 3232350 - DNA, 15 bp, Homo sapiens
atcccacccacatgt

SEQ ID NO: 3232351 - DNA, 23 bp, Homo sapiens
atcccacccacatgtgacacata

SEQ ID NO: 3232352 - DNA, 17 bp, Homo sapiens
atcccacctagcccagg

SEQ ID NO: 3232353 - DNA, 16 bp, Homo sapiens
atcccacgcactccat

SEQ ID NO: 3232354 - DNA, 17 bp, Homo sapiens
atcccacgcactccatg

SEQ ID NO: 3232355 - DNA, 23 bp, Homo sapiens
atcccacttagccgcaccctgca

SEQ ID NO: 3232356 - DNA, 22 bp, Homo sapiens
atcccactttctatagcagatt

SEQ ID NO: 3232357 - DNA, 17 bp, Homo sapiens
atcccagaaattagaaa

SEQ ID NO: 3232358 - DNA, 14 bp, Homo sapiens
atcccagaccagcc

SEQ ID NO: 3232359 - DNA, 20 bp, Homo sapiens
atcccagcactttgggaggc

SEQ ID NO: 3232360 - DNA, 15 bp, Homo sapiens
atcccagcctgtggt

SEQ ID NO: 3232361 - DNA, 16 bp, Homo sapiens
atcccagcctgtggtt

SEQ ID NO: 3232362 - DNA, 20 bp, Homo sapiens
atcccagctacttgggaagc

SEQ ID NO: 3232363 - DNA, 12 bp, Homo sapiens
atcccaggacac

SEQ ID NO: 3232364 - DNA, 21 bp, Homo sapiens
atcccaggacaccacacccag

SEQ ID NO: 3232365 - DNA, 12 bp, Homo sapiens
atcccagggctg

SEQ ID NO: 3232366 - DNA, 17 bp, Homo sapiens
atcccagggctggctct

SEQ ID NO: 3232367 - DNA, 20 bp, Homo sapiens
atcccaggggaccacacctc

SEQ ID NO: 3232368 - DNA, 17 bp, Homo sapiens
atcccagtctctgccag

SEQ ID NO: 3232369 - DNA, 19 bp, Homo sapiens
atcccatgagaccctggtg

SEQ ID NO: 3232370 - DNA, 13 bp, Homo sapiens
atcccatgagcct

SEQ ID NO: 3232371 - DNA, 18 bp, Homo sapiens
atcccattaatcatttcc

SEQ ID NO: 3232372 - DNA, 15 bp, Homo sapiens
atccccaccccaccc

SEQ ID NO: 3232373 - DNA, 21 bp, Homo sapiens
atccccactaggttcttttcc

SEQ ID NO: 3232374 - DNA, 23 bp, Homo sapiens
atccccaggggtcccagccaccc

SEQ ID NO: 3232375 - DNA, 16 bp, Homo sapiens
atccccatctccctgc

SEQ ID NO: 3232376 - DNA, 19 bp, Homo sapiens
atccccatctccctgcctg

SEQ ID NO: 3232377 - DNA, 20 bp, Homo sapiens
atccccatctccctgcctgg

SEQ ID NO: 3232378 - DNA, 15 bp, Homo sapiens
atccccccatcttgc

SEQ ID NO: 3232379 - DNA, 11 bp, Homo sapiens
atcccccccag

SEQ ID NO: 3232380 - DNA, 12 bp, Homo sapiens
atcccccccagc

SEQ ID NO: 3232381 - DNA, 16 bp, Homo sapiens
atcccccccagcctgg

SEQ ID NO: 3232382 - DNA, 14 bp, Homo sapiens
atccccctgccctc

SEQ ID NO: 3232383 - DNA, 15 bp, Homo sapiens
atccccctgccctcg

SEQ ID NO: 3232384 - DNA, 14 bp, Homo sapiens
atccccgcctggcc

SEQ ID NO: 3232385 - DNA, 18 bp, Homo sapiens
atccccgcctggccagga

SEQ ID NO: 3232386 - DNA, 19 bp, Homo sapiens
atccccgttcctgacatca

SEQ ID NO: 3232387 - DNA, 13 bp, Homo sapiens
atcccctaaaata

SEQ ID NO: 3232388 - DNA, 13 bp, Homo sapiens
atcccctccccca

SEQ ID NO: 3232389 - DNA, 21 bp, Homo sapiens
atcccctcgtcctgtcccaga

SEQ ID NO: 3232390 - DNA, 15 bp, Homo sapiens
atcccctctcctgcc

SEQ ID NO: 3232391 - DNA, 20 bp, Homo sapiens
atcccctctgtctacaaata

SEQ ID NO: 3232392 - DNA, 12 bp, Homo sapiens
atcccctgagcc

SEQ ID NO: 3232393 - DNA, 18 bp, Homo sapiens
atcccctttactatcatt

SEQ ID NO: 3232394 - DNA, 21 bp, Homo sapiens
atcccgaagaatggagaggaa

SEQ ID NO: 3232395 - DNA, 13 bp, Homo sapiens
atcccgagtctgg

SEQ ID NO: 3232396 - DNA, 16 bp, Homo sapiens
atcccgccacctatct

SEQ ID NO: 3232397 - DNA, 16 bp, Homo sapiens
atcccggaggaaatct

SEQ ID NO: 3232398 - DNA, 18 bp, Homo sapiens
atcccggcctcttccacc

SEQ ID NO: 3232399 - DNA, 16 bp, Homo sapiens
atcccgtgttctcctt

SEQ ID NO: 3232400 - DNA, 14 bp, Homo sapiens
atccctacccccta

SEQ ID NO: 3232401 - DNA, 21 bp, Homo sapiens
atccctaccccctaagagcca

SEQ ID NO: 3232402 - DNA, 21 bp, Homo sapiens
atccctagtccccctgttttc

SEQ ID NO: 3232403 - DNA, 21 bp, Homo sapiens
atccctcacacatccagacat

SEQ ID NO: 3232404 - DNA, 13 bp, Homo sapiens
atccctcacctgt

SEQ ID NO: 3232405 - DNA, 14 bp, Homo sapiens
atccctcacctgta

SEQ ID NO: 3232406 - DNA, 24 bp, Homo sapiens
atccctcgatatttttaaagatct

SEQ ID NO: 3232407 - DNA, 19 bp, Homo sapiens
atccctcggaagccgtctg

SEQ ID NO: 3232408 - DNA, 20 bp, Homo sapiens
atccctcgggaagcagccag

SEQ ID NO: 3232409 - DNA, 23 bp, Homo sapiens
atccctctaatgagactgaccat

SEQ ID NO: 3232410 - DNA, 18 bp, Homo sapiens
atccctgactggccaaac

SEQ ID NO: 3232411 - DNA, 22 bp, Homo sapiens
atccctgaggactgatttcaga

SEQ ID NO: 3232412 - DNA, 12 bp, Homo sapiens
atccctgccaca

SEQ ID NO: 3232413 - DNA, 10 bp, Homo sapiens
atccctggcc

SEQ ID NO: 3232414 - DNA, 12 bp, Homo sapiens
atccctggcccc

SEQ ID NO: 3232415 - DNA, 22 bp, Homo sapiens
atccctggccccctccctggat

SEQ ID NO: 3232416 - DNA, 16 bp, Homo sapiens
atccctgggcattgct

SEQ ID NO: 3232417 - DNA, 13 bp, Homo sapiens
atccctgggcccc

SEQ ID NO: 3232418 - DNA, 15 bp, Homo sapiens
atccctgggcccctc

SEQ ID NO: 3232419 - DNA, 16 bp, Homo sapiens
atccctgggcccctcc

SEQ ID NO: 3232420 - DNA, 17 bp, Homo sapiens
atccctgggcccctcca

SEQ ID NO: 3232421 - DNA, 19 bp, Homo sapiens
atccctgggggccttgggt

SEQ ID NO: 3232422 - DNA, 17 bp, Homo sapiens
atcccttattagttaca

SEQ ID NO: 3232423 - DNA, 13 bp, Homo sapiens
atcccttcctgga

SEQ ID NO: 3232424 - DNA, 15 bp, Homo sapiens
atcccttcctggaaa

SEQ ID NO: 3232425 - DNA, 21 bp, Homo sapiens
atcttacaagatattgatgat

SEQ ID NO: 3232426 - DNA, 17 bp, Homo sapiens
atcttacaatattgatt

SEQ ID NO: 3232427 - DNA, 23 bp, Homo sapiens
atcttaccagatgctactggact

SEQ ID NO: 3232428 - DNA, 21 bp, Homo sapiens
atcttagagacaaaccttaaa

SEQ ID NO: 3232429 - DNA, 22 bp, Homo sapiens
atcttagattctctgtgtctaa

SEQ ID NO: 3232430 - DNA, 23 bp, Homo sapiens
atcttagattctctgtgtctaag

SEQ ID NO: 3232431 - DNA, 22 bp, Homo sapiens
atcttagctggatataatgtat

SEQ ID NO: 3232432 - DNA, 21 bp, Homo sapiens
atcttagtgcctgagagtatt

SEQ ID NO: 3232433 - DNA, 12 bp, Homo sapiens
atcttatacaac

SEQ ID NO: 3232434 - DNA, 15 bp, Homo sapiens
atcttatagcacttt

SEQ ID NO: 3232435 - DNA, 17 bp, Homo sapiens
atcttatagcactttga

SEQ ID NO: 3232436 - DNA, 21 bp, Homo sapiens
atcttatagcactttgaaata

SEQ ID NO: 3232437 - DNA, 12 bp, Homo sapiens
atcttatattgg

SEQ ID NO: 3232438 - DNA, 13 bp, Homo sapiens
atcttattcacat

SEQ ID NO: 3232439 - DNA, 18 bp, Homo sapiens
atcttattccgagcattc

SEQ ID NO: 3232440 - DNA, 15 bp, Homo sapiens
atcttcaaagccttc

SEQ ID NO: 3232441 - DNA, 15 bp, Homo sapiens
atcttcaaagcttga

SEQ ID NO: 3232442 - DNA, 15 bp, Homo sapiens
atcttcaatggcttt

SEQ ID NO: 3232443 - DNA, 23 bp, Homo sapiens
atcttcacttctaaatgcatatc

SEQ ID NO: 3232444 - DNA, 17 bp, Homo sapiens
atcttcagaactgccct

SEQ ID NO: 3232445 - DNA, 22 bp, Homo sapiens
atcttcagttttatctttaatc

SEQ ID NO: 3232446 - DNA, 15 bp, Homo sapiens
atcttcattaccaat

SEQ ID NO: 3232447 - DNA, 14 bp, Homo sapiens
atcttccatatttg

SEQ ID NO: 3232448 - DNA, 15 bp, Homo sapiens
atcttccatatttgg

SEQ ID NO: 3232449 - DNA, 19 bp, Homo sapiens
atcttccatatttggaaga

SEQ ID NO: 3232450 - DNA, 14 bp, Homo sapiens
atcttcccatgcat

SEQ ID NO: 3232451 - DNA, 14 bp, Homo sapiens
atcttcctgctgct

SEQ ID NO: 3232452 - DNA, 14 bp, Homo sapiens
atcttcgtcttcac

SEQ ID NO: 3232453 - DNA, 15 bp, Homo sapiens
atcttcgtcttcact

SEQ ID NO: 3232454 - DNA, 16 bp, Homo sapiens
atcttcgtcttcactc

SEQ ID NO: 3232455 - DNA, 15 bp, Homo sapiens
atcttctcaagttct

SEQ ID NO: 3232456 - DNA, 19 bp, Homo sapiens
atcttctcaagttctaaga

SEQ ID NO: 3232457 - DNA, 16 bp, Homo sapiens
atcttctccccacagc

SEQ ID NO: 3232458 - DNA, 18 bp, Homo sapiens
atcttctccccacagcct

SEQ ID NO: 3232459 - DNA, 19 bp, Homo sapiens
atcttctgaaatgaaacaa

SEQ ID NO: 3232460 - DNA, 16 bp, Homo sapiens
atcttctgccttctca

SEQ ID NO: 3232461 - DNA, 12 bp, Homo sapiens
atcttctggaat

SEQ ID NO: 3232462 - DNA, 24 bp, Homo sapiens
atcttctgtgaaatataattgtac

SEQ ID NO: 3232463 - DNA, 20 bp, Homo sapiens
atcttcttatgcaatttcct

SEQ ID NO: 3232464 - DNA, 17 bp, Homo sapiens
atcttcttcaaatacaa

SEQ ID NO: 3232465 - DNA, 22 bp, Homo sapiens
atcttgaaattaagaaggcaaa

SEQ ID NO: 3232466 - DNA, 21 bp, Homo sapiens
atcttgaatatgggcggaagt

SEQ ID NO: 3232467 - DNA, 24 bp, Homo sapiens
atcttgcaccccaaagctttcctg

SEQ ID NO: 3232468 - DNA, 18 bp, Homo sapiens
atcttgcattcattttct

SEQ ID NO: 3232469 - DNA, 11 bp, Homo sapiens
atcttgccaca

SEQ ID NO: 3232470 - DNA, 19 bp, Homo sapiens
atcttgctaccagtattta

SEQ ID NO: 3232471 - DNA, 23 bp, Homo sapiens
atcttgctaccagtatttagaag

SEQ ID NO: 3232472 - DNA, 13 bp, Homo sapiens
atcttgctctgct

SEQ ID NO: 3232473 - DNA, 14 bp, Homo sapiens
atcttgctctgctg

SEQ ID NO: 3232474 - DNA, 16 bp, Homo sapiens
atcttgctctgctgac

SEQ ID NO: 3232475 - DNA, 16 bp, Homo sapiens
atcttggactgacatt

SEQ ID NO: 3232476 - DNA, 18 bp, Homo sapiens
atcttggggcaagactgc

SEQ ID NO: 3232477 - DNA, 23 bp, Homo sapiens
atcttgggggggtggccgctgag

SEQ ID NO: 3232478 - DNA, 20 bp, Homo sapiens
atcttggtcagatttgaact

SEQ ID NO: 3232479 - DNA, 14 bp, Homo sapiens
atcttgtagacact

SEQ ID NO: 3232480 - DNA, 16 bp, Homo sapiens
atcttgtatacacata

SEQ ID NO: 3232481 - DNA, 15 bp, Homo sapiens
atcttgtctctgggc

SEQ ID NO: 3232482 - DNA, 11 bp, Homo sapiens
atcttgtgaaa

SEQ ID NO: 3232483 - DNA, 20 bp, Homo sapiens
atcttgtgctagaatacttt

SEQ ID NO: 3232484 - DNA, 18 bp, Homo sapiens
atcttgtgtgattaactt

SEQ ID NO: 3232485 - DNA, 23 bp, Homo sapiens
atcttgtgtgattaacttattta

SEQ ID NO: 3232486 - DNA, 18 bp, Homo sapiens
atcttgttagagagcttt

SEQ ID NO: 3232487 - DNA, 14 bp, Homo sapiens
atcttgttcaggaa

SEQ ID NO: 3232488 - DNA, 15 bp, Homo sapiens
atcttgttcaggaaa

SEQ ID NO: 3232489 - DNA, 13 bp, Homo sapiens
atcttgttcttcc

SEQ ID NO: 3232490 - DNA, 15 bp, Homo sapiens
atcttgttcttcccc

SEQ ID NO: 3232491 - DNA, 17 bp, Homo sapiens
atcttgttttgaaaata

SEQ ID NO: 3232492 - DNA, 15 bp, Homo sapiens
atctttataaatgta

SEQ ID NO: 3232493 - DNA, 19 bp, Homo sapiens
atctttatacagattttct

SEQ ID NO: 3232494 - DNA, 21 bp, Homo sapiens
atctttatagaaggaatttgt

SEQ ID NO: 3232495 - DNA, 14 bp, Homo sapiens
atctttattaatca

SEQ ID NO: 3232496 - DNA, 15 bp, Homo sapiens
atctttattcaaact

SEQ ID NO: 3232497 - DNA, 15 bp, Homo sapiens
atctttcacttgaaa

SEQ ID NO: 3232498 - DNA, 14 bp, Homo sapiens
atctttcagaaata

SEQ ID NO: 3232499 - DNA, 17 bp, Homo sapiens
atctttcagaaatataa

SEQ ID NO: 3232500 - DNA, 19 bp, Homo sapiens
atctttcagcactcagaaa

SEQ ID NO: 3232501 - DNA, 23 bp, Homo sapiens
atctttccaggcttccctgactt

SEQ ID NO: 3232502 - DNA, 15 bp, Homo sapiens
atctttcccaggccg

SEQ ID NO: 3232503 - DNA, 18 bp, Homo sapiens
atctttcgcacagcagtt

SEQ ID NO: 3232504 - DNA, 23 bp, Homo sapiens
atctttcgcacagcagttccgga

SEQ ID NO: 3232505 - DNA, 18 bp, Homo sapiens
atctttctatagccaact

SEQ ID NO: 3232506 - DNA, 16 bp, Homo sapiens
atctttctattccaaa

SEQ ID NO: 3232507 - DNA, 18 bp, Homo sapiens
atctttctttacctgaga

SEQ ID NO: 3232508 - DNA, 22 bp, Homo sapiens
atctttctttccaaaacatttc

SEQ ID NO: 3232509 - DNA, 21 bp, Homo sapiens
atctttgaacttctgactact

SEQ ID NO: 3232510 - DNA, 17 bp, Homo sapiens
atctttgcagacaggca

SEQ ID NO: 3232511 - DNA, 20 bp, Homo sapiens
atctttgccttgggctgctc

SEQ ID NO: 3232512 - DNA, 14 bp, Homo sapiens
atctttgtataaat

SEQ ID NO: 3232513 - DNA, 22 bp, Homo sapiens
atcttttacaactgcctcgaaa

SEQ ID NO: 3232514 - DNA, 13 bp, Homo sapiens
atcttttcattct

SEQ ID NO: 3232515 - DNA, 17 bp, Homo sapiens
atcttttgaagcataga

SEQ ID NO: 3232516 - DNA, 21 bp, Homo sapiens
atcttttgaagggagaagaca

SEQ ID NO: 3232517 - DNA, 23 bp, Homo sapiens
atcttttgtgagatgtaattgtt

SEQ ID NO: 3232518 - DNA, 22 bp, Homo sapiens
atctttttaaaaactcttcagt

SEQ ID NO: 3232519 - DNA, 15 bp, Homo sapiens
atctttttatcatga

SEQ ID NO: 3232520 - DNA, 15 bp, Homo sapiens
atcttttttaaatga

SEQ ID NO: 3232521 - DNA, 16 bp, Homo sapiens
atcttttttagcataa

SEQ ID NO: 3232522 - DNA, 18 bp, Homo sapiens
atgaaaaattggggagga

SEQ ID NO: 3232523 - DNA, 16 bp, Homo sapiens
atgaaaaatttaagca

SEQ ID NO: 3232524 - DNA, 17 bp, Homo sapiens
atgaaaaatttaagcat

SEQ ID NO: 3232525 - DNA, 20 bp, Homo sapiens
atgaaaaatttaagcattgt

SEQ ID NO: 3232526 - DNA, 21 bp, Homo sapiens
atgaaaaatttaagcattgtt

SEQ ID NO: 3232527 - DNA, 13 bp, Homo sapiens
atgaaaacatgta

SEQ ID NO: 3232528 - DNA, 22 bp, Homo sapiens
atgaaaacattttatttttaaa

SEQ ID NO: 3232529 - DNA, 18 bp, Homo sapiens
atgaaaacgttttattgt

SEQ ID NO: 3232530 - DNA, 12 bp, Homo sapiens
atgaaaactcat

SEQ ID NO: 3232531 - DNA, 12 bp, Homo sapiens
atgaaaacttat

SEQ ID NO: 3232532 - DNA, 13 bp, Homo sapiens
atgaaaagattta

SEQ ID NO: 3232533 - DNA, 18 bp, Homo sapiens
atgaaaataactgaacca

SEQ ID NO: 3232534 - DNA, 17 bp, Homo sapiens
atgaaaatacaacttaa

SEQ ID NO: 3232535 - DNA, 24 bp, Homo sapiens
atgaaaataccatttagtaagaat

SEQ ID NO: 3232536 - DNA, 20 bp, Homo sapiens
atgaaaatccttttaaccat

SEQ ID NO: 3232537 - DNA, 18 bp, Homo sapiens
atgaaaatgagttgtgaa

SEQ ID NO: 3232538 - DNA, 21 bp, Homo sapiens
atgaaaatgagttgtgaaagt

SEQ ID NO: 3232539 - DNA, 15 bp, Homo sapiens
atgaaaattgtatta

SEQ ID NO: 3232540 - DNA, 20 bp, Homo sapiens
atgaaacactcagttgttca

SEQ ID NO: 3232541 - DNA, 18 bp, Homo sapiens
atgaaactctacatttaa

SEQ ID NO: 3232542 - DNA, 12 bp, Homo sapiens
atgaaagaaaat

SEQ ID NO: 3232543 - DNA, 15 bp, Homo sapiens
atgaaagaatatatt

SEQ ID NO: 3232544 - DNA, 17 bp, Homo sapiens
atgaaagactgtacaaa

SEQ ID NO: 3232545 - DNA, 20 bp, Homo sapiens
atgaaagactgtacaaagta

SEQ ID NO: 3232546 - DNA, 19 bp, Homo sapiens
atgaaagatggctgtgcct

SEQ ID NO: 3232547 - DNA, 13 bp, Homo sapiens
atgaaagattaaa

SEQ ID NO: 3232548 - DNA, 18 bp, Homo sapiens
atgaaagattaaacagat

SEQ ID NO: 3232549 - DNA, 20 bp, Homo sapiens
atgaaagcagggaatttcta

SEQ ID NO: 3232550 - DNA, 21 bp, Homo sapiens
atgaaagcagggaatttctat

SEQ ID NO: 3232551 - DNA, 17 bp, Homo sapiens
atgcattgttggctatt

SEQ ID NO: 3232552 - DNA, 18 bp, Homo sapiens
atgcattgttggctattt

SEQ ID NO: 3232553 - DNA, 12 bp, Homo sapiens
atgcatttaata

SEQ ID NO: 3232554 - DNA, 13 bp, Homo sapiens
atgcatttaataa

SEQ ID NO: 3232555 - DNA, 21 bp, Homo sapiens
atgcatttaataaagatgagt

SEQ ID NO: 3232556 - DNA, 14 bp, Homo sapiens
atgcatttcaaatg

SEQ ID NO: 3232557 - DNA, 13 bp, Homo sapiens
atgcatttcaagc

SEQ ID NO: 3232558 - DNA, 13 bp, Homo sapiens
atgcatttgaggt

SEQ ID NO: 3232559 - DNA, 18 bp, Homo sapiens
atgccaaagctagggtgg

SEQ ID NO: 3232560 - DNA, 16 bp, Homo sapiens
atgccaaggagcccct

SEQ ID NO: 3232561 - DNA, 22 bp, Homo sapiens
atgccaattagcaattgactgt

SEQ ID NO: 3232562 - DNA, 17 bp, Homo sapiens
atgccacacctggcctt

SEQ ID NO: 3232563 - DNA, 14 bp, Homo sapiens
atgccaccctagcc

SEQ ID NO: 3232564 - DNA, 14 bp, Homo sapiens
atgccaccctcaca

SEQ ID NO: 3232565 - DNA, 23 bp, Homo sapiens
atgccaccctcacacacacagct

SEQ ID NO: 3232566 - DNA, 17 bp, Homo sapiens
atgccacgggaagttta

SEQ ID NO: 3232567 - DNA, 20 bp, Homo sapiens
atgccacgtggtcactgtgc

SEQ ID NO: 3232568 - DNA, 21 bp, Homo sapiens
atgccacgtggtcactgtgca

SEQ ID NO: 3232569 - DNA, 15 bp, Homo sapiens
atgccactgccaggc

SEQ ID NO: 3232570 - DNA, 21 bp, Homo sapiens
atgccactgccaggcacctgg

SEQ ID NO: 3232571 - DNA, 21 bp, Homo sapiens
atgccactgctttccagcctg

SEQ ID NO: 3232572 - DNA, 21 bp, Homo sapiens
atgccagaaggaatcttctca

SEQ ID NO: 3232573 - DNA, 22 bp, Homo sapiens
atgccagaaggaatcttctcat

SEQ ID NO: 3232574 - DNA, 13 bp, Homo sapiens
atgccagcccctg

SEQ ID NO: 3232575 - DNA, 19 bp, Homo sapiens
atgccagcccctgcctggg

SEQ ID NO: 3232576 - DNA, 21 bp, Homo sapiens
atgccagcccctgcctgggtt

SEQ ID NO: 3232577 - DNA, 23 bp, Homo sapiens
atgccagcccttcaggaagcagg

SEQ ID NO: 3232578 - DNA, 13 bp, Homo sapiens
atgccagtatttt

SEQ ID NO: 3232579 - DNA, 19 bp, Homo sapiens
atgccatttagcaataaat

SEQ ID NO: 3232580 - DNA, 17 bp, Homo sapiens
atgcccaagccctgaga

SEQ ID NO: 3232581 - DNA, 17 bp, Homo sapiens
atgcccaccccctgccc

SEQ ID NO: 3232582 - DNA, 18 bp, Homo sapiens
atgcccaccccctgccct

SEQ ID NO: 3232583 - DNA, 21 bp, Homo sapiens
atgcccacctgcccatcacag

SEQ ID NO: 3232584 - DNA, 16 bp, Homo sapiens
atgcccagtgagactg

SEQ ID NO: 3232585 - DNA, 15 bp, Homo sapiens
atgccccggccacct

SEQ ID NO: 3232586 - DNA, 19 bp, Homo sapiens
atgccccttcttgggcccc

SEQ ID NO: 3232587 - DNA, 16 bp, Homo sapiens
atgccctcaagtaaaa

SEQ ID NO: 3232588 - DNA, 19 bp, Homo sapiens
atgccctcaagtaaaagaa

SEQ ID NO: 3232589 - DNA, 22 bp, Homo sapiens
atgccctgccttgtccctctca

SEQ ID NO: 3232590 - DNA, 16 bp, Homo sapiens
atgcccttctgattcc

SEQ ID NO: 3232591 - DNA, 23 bp, Homo sapiens
atgccgagacctcaagccctgag

SEQ ID NO: 3232592 - DNA, 20 bp, Homo sapiens
atgcctacaaccatccctgc

SEQ ID NO: 3232593 - DNA, 23 bp, Homo sapiens
atgcctagacttcccaacagcct

SEQ ID NO: 3232594 - DNA, 19 bp, Homo sapiens
atgcctagcacaagtacca

SEQ ID NO: 3232595 - DNA, 18 bp, Homo sapiens
atgcctagtttttagtaa

SEQ ID NO: 3232596 - DNA, 16 bp, Homo sapiens
atgcctatggtggatc

SEQ ID NO: 3232597 - DNA, 21 bp, Homo sapiens
atgcctatggtggatccaaac

SEQ ID NO: 3232598 - DNA, 22 bp, Homo sapiens
atgcctcaattcacatagattt

SEQ ID NO: 3232599 - DNA, 16 bp, Homo sapiens
atgcctcacgagattt

SEQ ID NO: 3232600 - DNA, 21 bp, Homo sapiens
atgcctcagcccaggtcagct

SEQ ID NO: 3232601 - DNA, 22 bp, Homo sapiens
atgcctccctatccctcacaca

SEQ ID NO: 3232602 - DNA, 15 bp, Homo sapiens
atgcctcctgtgggg

SEQ ID NO: 3232603 - DNA, 15 bp, Homo sapiens
atgcctcgctccctt

SEQ ID NO: 3232604 - DNA, 16 bp, Homo sapiens
atgcctcgctcccttc

SEQ ID NO: 3232605 - DNA, 18 bp, Homo sapiens
atgcctctgccaaaggat

SEQ ID NO: 3232606 - DNA, 20 bp, Homo sapiens
atgcctctggaggcctctgg

SEQ ID NO: 3232607 - DNA, 12 bp, Homo sapiens
atgcctgacccc

SEQ ID NO: 3232608 - DNA, 19 bp, Homo sapiens
atgcctgaccccttgctcc

SEQ ID NO: 3232609 - DNA, 19 bp, Homo sapiens
atgcctgccccaaacaaat

SEQ ID NO: 3232610 - DNA, 16 bp, Homo sapiens
atgcctgctgagagag

SEQ ID NO: 3232611 - DNA, 23 bp, Homo sapiens
atgcctgctttttggaaagtcag

SEQ ID NO: 3232612 - DNA, 12 bp, Homo sapiens
atgcctggtggc

SEQ ID NO: 3232613 - DNA, 16 bp, Homo sapiens
atgcctggtggcagct

SEQ ID NO: 3232614 - DNA, 21 bp, Homo sapiens
atgcctggtggcagctgcggt

SEQ ID NO: 3232615 - DNA, 12 bp, Homo sapiens
atgcctgtaatc

SEQ ID NO: 3232616 - DNA, 21 bp, Homo sapiens
atgcctgtagctttcctggtc

SEQ ID NO: 3232617 - DNA, 22 bp, Homo sapiens
atgcctgtagctttcctggtcc

SEQ ID NO: 3232618 - DNA, 13 bp, Homo sapiens
atgcctgtctctg

SEQ ID NO: 3232619 - DNA, 13 bp, Homo sapiens
atgccttctgtat

SEQ ID NO: 3232620 - DNA, 14 bp, Homo sapiens
atgccttcttattg

SEQ ID NO: 3232621 - DNA, 22 bp, Homo sapiens
atgccttgataaatatatatga

SEQ ID NO: 3232622 - DNA, 22 bp, Homo sapiens
atgccttggggaggacaaaact

SEQ ID NO: 3232623 - DNA, 23 bp, Homo sapiens
atgccttgtataaaatccaaaat

SEQ ID NO: 3232624 - DNA, 21 bp, Homo sapiens
atgccttgtataatattgaaa

SEQ ID NO: 3232625 - DNA, 21 bp, Homo sapiens
atgcctttctagtcctattct

SEQ ID NO: 3232626 - DNA, 18 bp, Homo sapiens
atgcctttctctcctagt

SEQ ID NO: 3232627 - DNA, 12 bp, Homo sapiens
atgcctttgaga

SEQ ID NO: 3232628 - DNA, 14 bp, Homo sapiens
atgcctttgagaca

SEQ ID NO: 3232629 - DNA, 20 bp, Homo sapiens
atgcctttgagacagtttct

SEQ ID NO: 3232630 - DNA, 21 bp, Homo sapiens
atgcctttgagacagtttctt

SEQ ID NO: 3232631 - DNA, 21 bp, Homo sapiens
atgcgaaccacccaaaacacg

SEQ ID NO: 3232632 - DNA, 15 bp, Homo sapiens
atgcgcaatgtggca

SEQ ID NO: 3232633 - DNA, 16 bp, Homo sapiens
atgcgcaatgtggcat

SEQ ID NO: 3232634 - DNA, 13 bp, Homo sapiens
atgcgccccctcc

SEQ ID NO: 3232635 - DNA, 21 bp, Homo sapiens
atgcgccttgctgatggcttg

SEQ ID NO: 3232636 - DNA, 21 bp, Homo sapiens
atgcgcggaggagctagcctg

SEQ ID NO: 3232637 - DNA, 15 bp, Homo sapiens
atgcggatcctgctg

SEQ ID NO: 3232638 - DNA, 15 bp, Homo sapiens
atgcggtctggtctc

SEQ ID NO: 3232639 - DNA, 18 bp, Homo sapiens
atgcgtgccgcctgctcc

SEQ ID NO: 3232640 - DNA, 17 bp, Homo sapiens
atgcgtgtttctgactc

SEQ ID NO: 3232641 - DNA, 17 bp, Homo sapiens
atgctaacatctaaaaa

SEQ ID NO: 3232642 - DNA, 19 bp, Homo sapiens
atgctaacatctaaaaata

SEQ ID NO: 3232643 - DNA, 21 bp, Homo sapiens
atgctaagaatgcattattga

SEQ ID NO: 3232644 - DNA, 17 bp, Homo sapiens
atgctacaattttaaga

SEQ ID NO: 3232645 - DNA, 20 bp, Homo sapiens
atgctactgtctcactgaaa

SEQ ID NO: 3232646 - DNA, 23 bp, Homo sapiens
atgctactgtctcactgaaacat

SEQ ID NO: 3232647 - DNA, 14 bp, Homo sapiens
atgctagaaaaggc

SEQ ID NO: 3232648 - DNA, 22 bp, Homo sapiens
atgctagaaaatcgagttggca

SEQ ID NO: 3232649 - DNA, 16 bp, Homo sapiens
atgctagaactccctt

SEQ ID NO: 3232650 - DNA, 14 bp, Homo sapiens
atgctagccccaga

SEQ ID NO: 3232651 - DNA, 23 bp, Homo sapiens
atgctagccccagagatgccagc

SEQ ID NO: 3232652 - DNA, 13 bp, Homo sapiens
atgctataaattt

SEQ ID NO: 3232653 - DNA, 19 bp, Homo sapiens
atgctataaattttttgaa

SEQ ID NO: 3232654 - DNA, 22 bp, Homo sapiens
atgctataaattttttgaaaca

SEQ ID NO: 3232655 - DNA, 13 bp, Homo sapiens
atgctatctctgt

SEQ ID NO: 3232656 - DNA, 17 bp, Homo sapiens
atgctatggtcaggtta

SEQ ID NO: 3232657 - DNA, 18 bp, Homo sapiens
atgctattgttgtgggct

SEQ ID NO: 3232658 - DNA, 14 bp, Homo sapiens
atgctatttatgca

SEQ ID NO: 3232659 - DNA, 12 bp, Homo sapiens
atgctcacctct

SEQ ID NO: 3232660 - DNA, 14 bp, Homo sapiens
atgctcacctctag

SEQ ID NO: 3232661 - DNA, 14 bp, Homo sapiens
atgctcatctgctg

SEQ ID NO: 3232662 - DNA, 15 bp, Homo sapiens
atgctccaagattct

SEQ ID NO: 3232663 - DNA, 19 bp, Homo sapiens
atgctccaagattctagat

SEQ ID NO: 3232664 - DNA, 14 bp, Homo sapiens
atgctccaggatct

SEQ ID NO: 3232665 - DNA, 12 bp, Homo sapiens
atgctcccagct

SEQ ID NO: 3232666 - DNA, 12 bp, Homo sapiens
atgctccccaca

SEQ ID NO: 3232667 - DNA, 13 bp, Homo sapiens
atgctccccacag

SEQ ID NO: 3232668 - DNA, 23 bp, Homo sapiens
atgctccccacagcgtccctggc

SEQ ID NO: 3232669 - DNA, 19 bp, Homo sapiens
atgctccctcccctgccct

SEQ ID NO: 3232670 - DNA, 20 bp, Homo sapiens
atgctccctcccctgccctg

SEQ ID NO: 3232671 - DNA, 17 bp, Homo sapiens
atgctctatgtttgtat

SEQ ID NO: 3232672 - DNA, 12 bp, Homo sapiens
atgctctatttt

SEQ ID NO: 3232673 - DNA, 18 bp, Homo sapiens
atgctctgcatgttacat

SEQ ID NO: 3232674 - DNA, 19 bp, Homo sapiens
atgctctgcatgttacata

SEQ ID NO: 3232675 - DNA, 12 bp, Homo sapiens
atgctctgcccc

SEQ ID NO: 3232676 - DNA, 21 bp, Homo sapiens
atgtacttgatactgaatgca

SEQ ID NO: 3232677 - DNA, 19 bp, Homo sapiens
atgtagaaattcttcatga

SEQ ID NO: 3232678 - DNA, 20 bp, Homo sapiens
atgtagactatatacatgtg

SEQ ID NO: 3232679 - DNA, 23 bp, Homo sapiens
atgtagatattgtgaagtacata

SEQ ID NO: 3232680 - DNA, 20 bp, Homo sapiens
atgtagatatttggcttaaa

SEQ ID NO: 3232681 - DNA, 21 bp, Homo sapiens
atgtagatatttggcttaaat

SEQ ID NO: 3232682 - DNA, 19 bp, Homo sapiens
atgtagattaaggtgatgt

SEQ ID NO: 3232683 - DNA, 20 bp, Homo sapiens
atgtagatttgtacaggagt

SEQ ID NO: 3232684 - DNA, 17 bp, Homo sapiens
atgtagcaaaacgcatg

SEQ ID NO: 3232685 - DNA, 17 bp, Homo sapiens
atgtagccagcagaact

SEQ ID NO: 3232686 - DNA, 19 bp, Homo sapiens
atgtagccagcagaactga

SEQ ID NO: 3232687 - DNA, 16 bp, Homo sapiens
atgtagccagctgtgc

SEQ ID NO: 3232688 - DNA, 20 bp, Homo sapiens
atgtagcccatccttccctt

SEQ ID NO: 3232689 - DNA, 18 bp, Homo sapiens
atgtagccccctggcctc

SEQ ID NO: 3232690 - DNA, 16 bp, Homo sapiens
atgtagcctttactgt

SEQ ID NO: 3232691 - DNA, 21 bp, Homo sapiens
atgtagcgtgtttacatgtgt

SEQ ID NO: 3232692 - DNA, 22 bp, Homo sapiens
atgtagcgtgtttacatgtgta

SEQ ID NO: 3232693 - DNA, 21 bp, Homo sapiens
atgtagctgaaacaaaaatgc

SEQ ID NO: 3232694 - DNA, 15 bp, Homo sapiens
atgtagctggtttcc

SEQ ID NO: 3232695 - DNA, 18 bp, Homo sapiens
atgtaggtaagactgtag

SEQ ID NO: 3232696 - DNA, 19 bp, Homo sapiens
atgtaggtaagactgtaga

SEQ ID NO: 3232697 - DNA, 22 bp, Homo sapiens
atgtagtattttttgtataatt

SEQ ID NO: 3232698 - DNA, 12 bp, Homo sapiens
atgtataaagat

SEQ ID NO: 3232699 - DNA, 13 bp, Homo sapiens
atgtataaagatt

SEQ ID NO: 3232700 - DNA, 20 bp, Homo sapiens
atgtataaagattgtactta

SEQ ID NO: 3232701 - DNA, 22 bp, Homo sapiens
atgtataaagcaactgttatga

SEQ ID NO: 3232702 - DNA, 16 bp, Homo sapiens
atgtatagttttgaat

SEQ ID NO: 3232703 - DNA, 14 bp, Homo sapiens
atgtatataaaaat

SEQ ID NO: 3232704 - DNA, 16 bp, Homo sapiens
atgtatatacacatat

SEQ ID NO: 3232705 - DNA, 17 bp, Homo sapiens
atgtatatacacatata

SEQ ID NO: 3232706 - DNA, 23 bp, Homo sapiens
atgtatatcattctacagaataa

SEQ ID NO: 3232707 - DNA, 18 bp, Homo sapiens
atgtatatttttttaatt

SEQ ID NO: 3232708 - DNA, 15 bp, Homo sapiens
atgtatcaatgagta

SEQ ID NO: 3232709 - DNA, 16 bp, Homo sapiens
atgtatcatagaaatg

SEQ ID NO: 3232710 - DNA, 17 bp, Homo sapiens
atgtatcatagaaatgt

SEQ ID NO: 3232711 - DNA, 16 bp, Homo sapiens
atgtatctaagaataa

SEQ ID NO: 3232712 - DNA, 14 bp, Homo sapiens
atgtatgattacat

SEQ ID NO: 3232713 - DNA, 15 bp, Homo sapiens
atgtatgctttttac

SEQ ID NO: 3232714 - DNA, 18 bp, Homo sapiens
atgtatggaatacagtgt

SEQ ID NO: 3232715 - DNA, 20 bp, Homo sapiens
atgtatgtgtgaaacaatgt

SEQ ID NO: 3232716 - DNA, 13 bp, Homo sapiens
atgtatgttaatt

SEQ ID NO: 3232717 - DNA, 13 bp, Homo sapiens
atgtatgtttaca

SEQ ID NO: 3232718 - DNA, 14 bp, Homo sapiens
atgtatgtttacat

SEQ ID NO: 3232719 - DNA, 13 bp, Homo sapiens
atgtattattctg

SEQ ID NO: 3232720 - DNA, 20 bp, Homo sapiens
atgtattattctgcagcatg

SEQ ID NO: 3232721 - DNA, 21 bp, Homo sapiens
atgtattcaagcaaacatcaa

SEQ ID NO: 3232722 - DNA, 16 bp, Homo sapiens
atgtattcccttgtat

SEQ ID NO: 3232723 - DNA, 14 bp, Homo sapiens
atgtattgactgta

SEQ ID NO: 3232724 - DNA, 16 bp, Homo sapiens
atgtattgcacattgt

SEQ ID NO: 3232725 - DNA, 22 bp, Homo sapiens
atgtattgcacattgtaaaaag

SEQ ID NO: 3232726 - DNA, 14 bp, Homo sapiens
atgtattgtaatct

SEQ ID NO: 3232727 - DNA, 12 bp, Homo sapiens
atgtattttaca

SEQ ID NO: 3232728 - DNA, 14 bp, Homo sapiens
atgtattttacaca

SEQ ID NO: 3232729 - DNA, 16 bp, Homo sapiens
atgtattttgaagaat

SEQ ID NO: 3232730 - DNA, 17 bp, Homo sapiens
atgtattttgaagaata

SEQ ID NO: 3232731 - DNA, 18 bp, Homo sapiens
atgtattttgaagaatat

SEQ ID NO: 3232732 - DNA, 23 bp, Homo sapiens
atgtattttgaagaatatttaag

SEQ ID NO: 3232733 - DNA, 16 bp, Homo sapiens
atgtatttttctacat

SEQ ID NO: 3232734 - DNA, 20 bp, Homo sapiens
atgtcaaagagaaaacttat

SEQ ID NO: 3232735 - DNA, 23 bp, Homo sapiens
atgtcaaccaggtccagatgtgc

SEQ ID NO: 3232736 - DNA, 17 bp, Homo sapiens
atgtcaacttctggctc

SEQ ID NO: 3232737 - DNA, 19 bp, Homo sapiens
atgtcaacttctggctcct

SEQ ID NO: 3232738 - DNA, 19 bp, Homo sapiens
atgtcaataaacaacagct

SEQ ID NO: 3232739 - DNA, 23 bp, Homo sapiens
atgtcaataaacaacagctgaag

SEQ ID NO: 3232740 - DNA, 16 bp, Homo sapiens
atgtcaatttctgtgt

SEQ ID NO: 3232741 - DNA, 14 bp, Homo sapiens
atgtcacaacctct

SEQ ID NO: 3232742 - DNA, 19 bp, Homo sapiens
atgtcacaggcaggtccag

SEQ ID NO: 3232743 - DNA, 21 bp, Homo sapiens
atgtcaccggtcagtgccttt

SEQ ID NO: 3232744 - DNA, 14 bp, Homo sapiens
atgtcagcttccca

SEQ ID NO: 3232745 - DNA, 17 bp, Homo sapiens
atgtcagcttcccagcc

SEQ ID NO: 3232746 - DNA, 18 bp, Homo sapiens
atgtcagcttcccagcca

SEQ ID NO: 3232747 - DNA, 21 bp, Homo sapiens
atgtcagcttcccagccatgc

SEQ ID NO: 3232748 - DNA, 19 bp, Homo sapiens
atgtcagtatttcaactgc

SEQ ID NO: 3232749 - DNA, 22 bp, Homo sapiens
atgtcagtatttcaactgctgt

SEQ ID NO: 3232750 - DNA, 16 bp, Homo sapiens
atgtcagtatttcagt

SEQ ID NO: 3232751 - DNA, 22 bp, Homo sapiens
atgtcatatactgccatgtact

SEQ ID NO: 3232752 - DNA, 22 bp, Homo sapiens
atgtcatcaaatattaccaaaa

SEQ ID NO: 3232753 - DNA, 21 bp, Homo sapiens
atgtcatcagagctcctctgt

SEQ ID NO: 3232754 - DNA, 20 bp, Homo sapiens
atgtcatctaaccattaagt

SEQ ID NO: 3232755 - DNA, 19 bp, Homo sapiens
atgtcatggccttgaaaca

SEQ ID NO: 3232756 - DNA, 15 bp, Homo sapiens
atgtcattaatgtgt

SEQ ID NO: 3232757 - DNA, 18 bp, Homo sapiens
atgtcattgagtaatata

SEQ ID NO: 3232758 - DNA, 15 bp, Homo sapiens
atgtccaaagaggct

SEQ ID NO: 3232759 - DNA, 19 bp, Homo sapiens
atgtccaaagaggctgccc

SEQ ID NO: 3232760 - DNA, 17 bp, Homo sapiens
atgtccaagttcttcac

SEQ ID NO: 3232761 - DNA, 18 bp, Homo sapiens
atgtccaccacttcaggg

SEQ ID NO: 3232762 - DNA, 16 bp, Homo sapiens
atgtccactgtgtata

SEQ ID NO: 3232763 - DNA, 17 bp, Homo sapiens
atgtccactgtgtatag

SEQ ID NO: 3232764 - DNA, 20 bp, Homo sapiens
atgtccatagccataattcc

SEQ ID NO: 3232765 - DNA, 14 bp, Homo sapiens
atgtccatcccttt

SEQ ID NO: 3232766 - DNA, 21 bp, Homo sapiens
atgtccatcccttttcctgtc

SEQ ID NO: 3232767 - DNA, 19 bp, Homo sapiens
atgtccatttatatcattt

SEQ ID NO: 3232768 - DNA, 22 bp, Homo sapiens
atgtcccctcaaactcattgca

SEQ ID NO: 3232769 - DNA, 13 bp, Homo sapiens
atgtcccctgcgg

SEQ ID NO: 3232770 - DNA, 24 bp, Homo sapiens
atgtccctaccgagtctcttctcc

SEQ ID NO: 3232771 - DNA, 15 bp, Homo sapiens
atgtccctgggccag

SEQ ID NO: 3232772 - DNA, 18 bp, Homo sapiens
atgtcctaaggacacact

SEQ ID NO: 3232773 - DNA, 21 bp, Homo sapiens
atgtcctaaggacacactaat

SEQ ID NO: 3232774 - DNA, 19 bp, Homo sapiens
atgtcctaattcttctgtc

SEQ ID NO: 3232775 - DNA, 16 bp, Homo sapiens
atgtcctgcctattat

SEQ ID NO: 3232776 - DNA, 22 bp, Homo sapiens
atgtcctgcctattatctgtca

SEQ ID NO: 3232777 - DNA, 15 bp, Homo sapiens
atgtccttgggttgc

SEQ ID NO: 3232778 - DNA, 14 bp, Homo sapiens
atgtcgattaaaat

SEQ ID NO: 3232779 - DNA, 13 bp, Homo sapiens
atgtcgcacaatg

SEQ ID NO: 3232780 - DNA, 14 bp, Homo sapiens
atgtcgcacaatgt

SEQ ID NO: 3232781 - DNA, 15 bp, Homo sapiens
atgtcgcctctgcat

SEQ ID NO: 3232782 - DNA, 19 bp, Homo sapiens
atgtcgtgaccaactagac

SEQ ID NO: 3232783 - DNA, 21 bp, Homo sapiens
atgtcgtgaccaactagacat

SEQ ID NO: 3232784 - DNA, 22 bp, Homo sapiens
atgtcgtgaccaactagacatt

SEQ ID NO: 3232785 - DNA, 12 bp, Homo sapiens
atgtctaaaatt

SEQ ID NO: 3232786 - DNA, 15 bp, Homo sapiens
atgtctagaaagtaa

SEQ ID NO: 3232787 - DNA, 12 bp, Homo sapiens
atgtctatgaca

SEQ ID NO: 3232788 - DNA, 14 bp, Homo sapiens
atgtctattcagct

SEQ ID NO: 3232789 - DNA, 14 bp, Homo sapiens
atgtctatttaagc

SEQ ID NO: 3232790 - DNA, 17 bp, Homo sapiens
atgtctcactgttctgc

SEQ ID NO: 3232791 - DNA, 21 bp, Homo sapiens
atgtctcactgttctgcaaag

SEQ ID NO: 3232792 - DNA, 23 bp, Homo sapiens
atgtctcaggtttgttttgtgaa

SEQ ID NO: 3232793 - DNA, 13 bp, Homo sapiens
atgtctcctcccc

SEQ ID NO: 3232794 - DNA, 15 bp, Homo sapiens
atgtctcctttgctc

SEQ ID NO: 3232795 - DNA, 19 bp, Homo sapiens
atgtctcctttgctcttgc

SEQ ID NO: 3232796 - DNA, 20 bp, Homo sapiens
atgtctcctttgctcttgcc

SEQ ID NO: 3232797 - DNA, 11 bp, Homo sapiens
atgtctctggg

SEQ ID NO: 3232798 - DNA, 17 bp, Homo sapiens
atgtctcttctgagcta

SEQ ID NO: 3232799 - DNA, 16 bp, Homo sapiens
atgtctgagtgaacct

SEQ ID NO: 3232800 - DNA, 14 bp, Homo sapiens
atgtctggagtggt

SEQ ID NO: 3232801 - DNA, 23 bp, Homo sapiens
attaagacagtgtacaaaactgt

SEQ ID NO: 3232802 - DNA, 14 bp, Homo sapiens
attaagatacaaat

SEQ ID NO: 3232803 - DNA, 15 bp, Homo sapiens
attaagattttacaa

SEQ ID NO: 3232804 - DNA, 17 bp, Homo sapiens
attaagcaaatgttaaa

SEQ ID NO: 3232805 - DNA, 15 bp, Homo sapiens
attaagcagtaaaaa

SEQ ID NO: 3232806 - DNA, 19 bp, Homo sapiens
attaagcagtaaaaactgt

SEQ ID NO: 3232807 - DNA, 16 bp, Homo sapiens
attaagcatatgtgtt

SEQ ID NO: 3232808 - DNA, 18 bp, Homo sapiens
attaagctttttggaatc

SEQ ID NO: 3232809 - DNA, 15 bp, Homo sapiens
attaaggggaagaat

SEQ ID NO: 3232810 - DNA, 14 bp, Homo sapiens
attaagtagaacaa

SEQ ID NO: 3232811 - DNA, 13 bp, Homo sapiens
attaagtcatgtg

SEQ ID NO: 3232812 - DNA, 14 bp, Homo sapiens
attaagtcatgtgt

SEQ ID NO: 3232813 - DNA, 13 bp, Homo sapiens
attaataaaaaga

SEQ ID NO: 3232814 - DNA, 11 bp, Homo sapiens
attaataaagc

SEQ ID NO: 3232815 - DNA, 14 bp, Homo sapiens
attaataaagcatt

SEQ ID NO: 3232816 - DNA, 18 bp, Homo sapiens
attaatagcagcctttct

SEQ ID NO: 3232817 - DNA, 23 bp, Homo sapiens
attaatagcttttattgtataaa

SEQ ID NO: 3232818 - DNA, 21 bp, Homo sapiens
attaatatatgtattatttat

SEQ ID NO: 3232819 - DNA, 12 bp, Homo sapiens
attaatatatta

SEQ ID NO: 3232820 - DNA, 16 bp, Homo sapiens
attaatatatttaata

SEQ ID NO: 3232821 - DNA, 20 bp, Homo sapiens
attaatatccctacatgtat

SEQ ID NO: 3232822 - DNA, 19 bp, Homo sapiens
attaatatctttctgcaca

SEQ ID NO: 3232823 - DNA, 12 bp, Homo sapiens
attaatatgaaa

SEQ ID NO: 3232824 - DNA, 11 bp, Homo sapiens
attaatcaaaa

SEQ ID NO: 3232825 - DNA, 18 bp, Homo sapiens
attaatcaccttctttgt

SEQ ID NO: 3232826 - DNA, 19 bp, Homo sapiens
attaatcaccttctttgta

SEQ ID NO: 3232827 - DNA, 14 bp, Homo sapiens
attaatcatctata

SEQ ID NO: 3232828 - DNA, 20 bp, Homo sapiens
attaatcttagtgtatgatt

SEQ ID NO: 3232829 - DNA, 18 bp, Homo sapiens
attaatctttaataacaa

SEQ ID NO: 3232830 - DNA, 17 bp, Homo sapiens
attaatgcctgcttttt

SEQ ID NO: 3232831 - DNA, 22 bp, Homo sapiens
attaatgtttctatctgatttt

SEQ ID NO: 3232832 - DNA, 14 bp, Homo sapiens
attaattaagtatc

SEQ ID NO: 3232833 - DNA, 17 bp, Homo sapiens
attaattcttcacctgt

SEQ ID NO: 3232834 - DNA, 13 bp, Homo sapiens
attaattgtaatc

SEQ ID NO: 3232835 - DNA, 20 bp, Homo sapiens
attaattgttttgcactttt

SEQ ID NO: 3232836 - DNA, 16 bp, Homo sapiens
attaatttagaatggt

SEQ ID NO: 3232837 - DNA, 16 bp, Homo sapiens
attaatttatttaatt

SEQ ID NO: 3232838 - DNA, 16 bp, Homo sapiens
attaatttgattaaca

SEQ ID NO: 3232839 - DNA, 20 bp, Homo sapiens
attaatttgattaacaaata

SEQ ID NO: 3232840 - DNA, 22 bp, Homo sapiens
attaatttgattaacaaatatg

SEQ ID NO: 3232841 - DNA, 14 bp, Homo sapiens
attacaaatcagaa

SEQ ID NO: 3232842 - DNA, 18 bp, Homo sapiens
attacaaatcagaagtca

SEQ ID NO: 3232843 - DNA, 21 bp, Homo sapiens
attacaaatcagaagtcatct

SEQ ID NO: 3232844 - DNA, 17 bp, Homo sapiens
attacaatggaaacaat

SEQ ID NO: 3232845 - DNA, 14 bp, Homo sapiens
attacaatttgtat

SEQ ID NO: 3232846 - DNA, 18 bp, Homo sapiens
attacaattttatctgtt

SEQ ID NO: 3232847 - DNA, 12 bp, Homo sapiens
attacaattttt

SEQ ID NO: 3232848 - DNA, 13 bp, Homo sapiens
attacaattttta

SEQ ID NO: 3232849 - DNA, 18 bp, Homo sapiens
attacaatttttaataaa

SEQ ID NO: 3232850 - DNA, 12 bp, Homo sapiens
attacacagtca

SEQ ID NO: 3232851 - DNA, 22 bp, Homo sapiens
attacacagtcaaatttacatt

SEQ ID NO: 3232852 - DNA, 15 bp, Homo sapiens
attacacatttgtac

SEQ ID NO: 3232853 - DNA, 19 bp, Homo sapiens
attacactgtgccttttcc

SEQ ID NO: 3232854 - DNA, 17 bp, Homo sapiens
attacagaaactgatgc

SEQ ID NO: 3232855 - DNA, 15 bp, Homo sapiens
attacagagaggaga

SEQ ID NO: 3232856 - DNA, 22 bp, Homo sapiens
attacagagaggagaaacacat

SEQ ID NO: 3232857 - DNA, 15 bp, Homo sapiens
attacagaggaagtt

SEQ ID NO: 3232858 - DNA, 14 bp, Homo sapiens
attacagatgtgaa

SEQ ID NO: 3232859 - DNA, 15 bp, Homo sapiens
attacagctggagaa

SEQ ID NO: 3232860 - DNA, 19 bp, Homo sapiens
attacaggaatgaagaact

SEQ ID NO: 3232861 - DNA, 20 bp, Homo sapiens
attacaggcacctgccacca

SEQ ID NO: 3232862 - DNA, 22 bp, Homo sapiens
attacaggcacctgccaccatg

SEQ ID NO: 3232863 - DNA, 16 bp, Homo sapiens
attacagggtgactca

SEQ ID NO: 3232864 - DNA, 21 bp, Homo sapiens
attacagtgaaattttggtga

SEQ ID NO: 3232865 - DNA, 15 bp, Homo sapiens
attacagttcataat

SEQ ID NO: 3232866 - DNA, 15 bp, Homo sapiens
attacataatttagt

SEQ ID NO: 3232867 - DNA, 23 bp, Homo sapiens
attacatattgcaggagacattt

SEQ ID NO: 3232868 - DNA, 14 bp, Homo sapiens
attacatctctaat

SEQ ID NO: 3232869 - DNA, 23 bp, Homo sapiens
attacatgctgctatacacaagc

SEQ ID NO: 3232870 - DNA, 16 bp, Homo sapiens
attacatgtaaaacat

SEQ ID NO: 3232871 - DNA, 15 bp, Homo sapiens
attacatttaaatcc

SEQ ID NO: 3232872 - DNA, 17 bp, Homo sapiens
attaccaaaaaagtatt

SEQ ID NO: 3232873 - DNA, 20 bp, Homo sapiens
attaccagatataaaataat

SEQ ID NO: 3232874 - DNA, 16 bp, Homo sapiens
attaccaggtccattt

SEQ ID NO: 3232875 - DNA, 20 bp, Homo sapiens
attaccatgagaagagggcc

SEQ ID NO: 3232876 - DNA, 15 bp, Homo sapiens
attaccatggagaca

SEQ ID NO: 3232877 - DNA, 17 bp, Homo sapiens
attaccattaattacat

SEQ ID NO: 3232878 - DNA, 22 bp, Homo sapiens
attaccattaattacatacaga

SEQ ID NO: 3232879 - DNA, 18 bp, Homo sapiens
attaccctctgcagaaca

SEQ ID NO: 3232880 - DNA, 16 bp, Homo sapiens
attacctagaaatcta

SEQ ID NO: 3232881 - DNA, 12 bp, Homo sapiens
attacctgccaa

SEQ ID NO: 3232882 - DNA, 14 bp, Homo sapiens
attacctgtggata

SEQ ID NO: 3232883 - DNA, 16 bp, Homo sapiens
attacctgtggatatt

SEQ ID NO: 3232884 - DNA, 19 bp, Homo sapiens
attacctgtggatatttgt

SEQ ID NO: 3232885 - DNA, 19 bp, Homo sapiens
attaccttctattggtctc

SEQ ID NO: 3232886 - DNA, 15 bp, Homo sapiens
attacgtttgttatt

SEQ ID NO: 3232887 - DNA, 20 bp, Homo sapiens
attactaattttacacatta

SEQ ID NO: 3232888 - DNA, 20 bp, Homo sapiens
attactacaaaatttgaaat

SEQ ID NO: 3232889 - DNA, 18 bp, Homo sapiens
attactatgactgctccc

SEQ ID NO: 3232890 - DNA, 20 bp, Homo sapiens
attactcctatttttgtaaa

SEQ ID NO: 3232891 - DNA, 13 bp, Homo sapiens
attactgacattt

SEQ ID NO: 3232892 - DNA, 15 bp, Homo sapiens
attactgacatttct

SEQ ID NO: 3232893 - DNA, 21 bp, Homo sapiens
attactgacatttcttctagt

SEQ ID NO: 3232894 - DNA, 21 bp, Homo sapiens
attactggcctttttcattta

SEQ ID NO: 3232895 - DNA, 15 bp, Homo sapiens
attactgtctttatt

SEQ ID NO: 3232896 - DNA, 15 bp, Homo sapiens
attactgtgtaaata

SEQ ID NO: 3232897 - DNA, 15 bp, Homo sapiens
attactgttccagat

SEQ ID NO: 3232898 - DNA, 21 bp, Homo sapiens
attactgttgcatttactttt

SEQ ID NO: 3232899 - DNA, 16 bp, Homo sapiens
attactgtttatttct

SEQ ID NO: 3232900 - DNA, 17 bp, Homo sapiens
attactgtttatttctg

SEQ ID NO: 3232901 - DNA, 18 bp, Homo sapiens
attactgtttatttctgt

SEQ ID NO: 3232902 - DNA, 22 bp, Homo sapiens
attacttaggttattttgcttt

SEQ ID NO: 3232903 - DNA, 23 bp, Homo sapiens
attacttaggttattttgctttg

SEQ ID NO: 3232904 - DNA, 18 bp, Homo sapiens
attacttatttttgacag

SEQ ID NO: 3232905 - DNA, 12 bp, Homo sapiens
attacttctgct

SEQ ID NO: 3232906 - DNA, 13 bp, Homo sapiens
attacttctgcta

SEQ ID NO: 3232907 - DNA, 23 bp, Homo sapiens
attacttgctttcaattgacaaa

SEQ ID NO: 3232908 - DNA, 23 bp, Homo sapiens
attactttggggctaatttaaca

SEQ ID NO: 3232909 - DNA, 17 bp, Homo sapiens
attagaaaaattcctaa

SEQ ID NO: 3232910 - DNA, 13 bp, Homo sapiens
attagaaaatatt

SEQ ID NO: 3232911 - DNA, 17 bp, Homo sapiens
attagaaaatattctct

SEQ ID NO: 3232912 - DNA, 20 bp, Homo sapiens
attagaaacccaaattggga

SEQ ID NO: 3232913 - DNA, 11 bp, Homo sapiens
attagaaatga

SEQ ID NO: 3232914 - DNA, 13 bp, Homo sapiens
attagaaatttaa

SEQ ID NO: 3232915 - DNA, 13 bp, Homo sapiens
attagaattattt

SEQ ID NO: 3232916 - DNA, 14 bp, Homo sapiens
attagaattattta

SEQ ID NO: 3232917 - DNA, 18 bp, Homo sapiens
attagacactttggaaga

SEQ ID NO: 3232918 - DNA, 22 bp, Homo sapiens
attagactgtaggaagagtagc

SEQ ID NO: 3232919 - DNA, 22 bp, Homo sapiens
attagagggaggtgtttaaaga

SEQ ID NO: 3232920 - DNA, 19 bp, Homo sapiens
attagatcctaagatgtgt

SEQ ID NO: 3232921 - DNA, 22 bp, Homo sapiens
attagattttattttactattg

SEQ ID NO: 3232922 - DNA, 18 bp, Homo sapiens
attagcaaggtcatttct

SEQ ID NO: 3232923 - DNA, 21 bp, Homo sapiens
attagcaaggtcatttcttca

SEQ ID NO: 3232924 - DNA, 22 bp, Homo sapiens
attagcaattgactgtcactgt

SEQ ID NO: 3232925 - DNA, 17 bp, Homo sapiens
attagcacagattttaa

SEQ ID NO: 3232926 - DNA, 14 bp, Homo sapiens
attagccaggatca

SEQ ID NO: 3232927 - DNA, 18 bp, Homo sapiens
attctattgtattatttg

SEQ ID NO: 3232928 - DNA, 22 bp, Homo sapiens
attctatttatatgtacatgag

SEQ ID NO: 3232929 - DNA, 14 bp, Homo sapiens
attctcaaagcagg

SEQ ID NO: 3232930 - DNA, 14 bp, Homo sapiens
attctcaaagttaa

SEQ ID NO: 3232931 - DNA, 19 bp, Homo sapiens
attctcaaagttaaaagta

SEQ ID NO: 3232932 - DNA, 23 bp, Homo sapiens
attctcaaagttaaaagtaaaat

SEQ ID NO: 3232933 - DNA, 14 bp, Homo sapiens
attctcaaagtttt

SEQ ID NO: 3232934 - DNA, 16 bp, Homo sapiens
attctcaaagttttat

SEQ ID NO: 3232935 - DNA, 21 bp, Homo sapiens
attctcataatccttctgcaa

SEQ ID NO: 3232936 - DNA, 16 bp, Homo sapiens
attctcataggagact

SEQ ID NO: 3232937 - DNA, 18 bp, Homo sapiens
attctcataggagactgc

SEQ ID NO: 3232938 - DNA, 20 bp, Homo sapiens
attctcccaggtaccagctg

SEQ ID NO: 3232939 - DNA, 11 bp, Homo sapiens
attctcctgcc

SEQ ID NO: 3232940 - DNA, 13 bp, Homo sapiens
attctcctgtgct

SEQ ID NO: 3232941 - DNA, 19 bp, Homo sapiens
attctccttttatgtgtag

SEQ ID NO: 3232942 - DNA, 19 bp, Homo sapiens
attctctggctgtaaggct

SEQ ID NO: 3232943 - DNA, 17 bp, Homo sapiens
attctctgtgtctaaga

SEQ ID NO: 3232944 - DNA, 20 bp, Homo sapiens
attctctgtgtctaagattc

SEQ ID NO: 3232945 - DNA, 21 bp, Homo sapiens
attctctgtgtctaagattct

SEQ ID NO: 3232946 - DNA, 22 bp, Homo sapiens
attctcttgtataagatcctag

SEQ ID NO: 3232947 - DNA, 17 bp, Homo sapiens
attctctttaaaaaaga

SEQ ID NO: 3232948 - DNA, 21 bp, Homo sapiens
attctctttaaaaaagactga

SEQ ID NO: 3232949 - DNA, 19 bp, Homo sapiens
attctgaaaggaaatacac

SEQ ID NO: 3232950 - DNA, 16 bp, Homo sapiens
attctgacatttatat

SEQ ID NO: 3232951 - DNA, 18 bp, Homo sapiens
attctgacatttatattt

SEQ ID NO: 3232952 - DNA, 18 bp, Homo sapiens
attctgaggccctgccca

SEQ ID NO: 3232953 - DNA, 22 bp, Homo sapiens
attctgataaaaataatattaa

SEQ ID NO: 3232954 - DNA, 13 bp, Homo sapiens
attctgattcttt

SEQ ID NO: 3232955 - DNA, 22 bp, Homo sapiens
attctgatttcagtttttcatt

SEQ ID NO: 3232956 - DNA, 14 bp, Homo sapiens
attctgatttgtat

SEQ ID NO: 3232957 - DNA, 19 bp, Homo sapiens
attctgcaagcacatctgc

SEQ ID NO: 3232958 - DNA, 14 bp, Homo sapiens
attctgcaagtata

SEQ ID NO: 3232959 - DNA, 13 bp, Homo sapiens
attctgcagcatg

SEQ ID NO: 3232960 - DNA, 15 bp, Homo sapiens
attctgcagcatgac

SEQ ID NO: 3232961 - DNA, 22 bp, Homo sapiens
attctgcagcatgacctgtgac

SEQ ID NO: 3232962 - DNA, 17 bp, Homo sapiens
attctgcctagagtgta

SEQ ID NO: 3232963 - DNA, 15 bp, Homo sapiens
attctgcctctctag

SEQ ID NO: 3232964 - DNA, 13 bp, Homo sapiens
attctgcctgccc

SEQ ID NO: 3232965 - DNA, 18 bp, Homo sapiens
attctgcctgcccaggcc

SEQ ID NO: 3232966 - DNA, 21 bp, Homo sapiens
attctgcctgcccaggcccct

SEQ ID NO: 3232967 - DNA, 21 bp, Homo sapiens
attctgggaagcttgagcctc

SEQ ID NO: 3232968 - DNA, 22 bp, Homo sapiens
attctgggcaccacaaaatata

SEQ ID NO: 3232969 - DNA, 12 bp, Homo sapiens
attctgtacata

SEQ ID NO: 3232970 - DNA, 20 bp, Homo sapiens
attctgtatctttcatcctt

SEQ ID NO: 3232971 - DNA, 18 bp, Homo sapiens
attctgtcgccttagcat

SEQ ID NO: 3232972 - DNA, 20 bp, Homo sapiens
attctgtctttcaaaaggta

SEQ ID NO: 3232973 - DNA, 21 bp, Homo sapiens
attctgtctttcaaaaggtaa

SEQ ID NO: 3232974 - DNA, 17 bp, Homo sapiens
attctgtggaacaagcc

SEQ ID NO: 3232975 - DNA, 22 bp, Homo sapiens
attctgtgtgttttcataataa

SEQ ID NO: 3232976 - DNA, 14 bp, Homo sapiens
attctgtgttgcat

SEQ ID NO: 3232977 - DNA, 18 bp, Homo sapiens
attctgtgttgcattatt

SEQ ID NO: 3232978 - DNA, 22 bp, Homo sapiens
attctgttaaaatctattctgt

SEQ ID NO: 3232979 - DNA, 16 bp, Homo sapiens
attctgttgttccatt

SEQ ID NO: 3232980 - DNA, 23 bp, Homo sapiens
attcttaaaaggcccatagcagc

SEQ ID NO: 3232981 - DNA, 14 bp, Homo sapiens
attcttaagtcttt

SEQ ID NO: 3232982 - DNA, 17 bp, Homo sapiens
attcttaagtcttttgt

SEQ ID NO: 3232983 - DNA, 19 bp, Homo sapiens
attcttacaattgcactgc

SEQ ID NO: 3232984 - DNA, 19 bp, Homo sapiens
attcttacactgcctgtat

SEQ ID NO: 3232985 - DNA, 22 bp, Homo sapiens
attcttacactgcctgtatact

SEQ ID NO: 3232986 - DNA, 16 bp, Homo sapiens
attcttagtaaaatgc

SEQ ID NO: 3232987 - DNA, 22 bp, Homo sapiens
attcttatgtagcaggaaataa

SEQ ID NO: 3232988 - DNA, 14 bp, Homo sapiens
attcttatgttatc

SEQ ID NO: 3232989 - DNA, 19 bp, Homo sapiens
attcttcacctttgtaaga

SEQ ID NO: 3232990 - DNA, 22 bp, Homo sapiens
attcttcaggcttcctgcaatt

SEQ ID NO: 3232991 - DNA, 22 bp, Homo sapiens
attcttccaagctgagagtcta

SEQ ID NO: 3232992 - DNA, 14 bp, Homo sapiens
attcttctagagtt

SEQ ID NO: 3232993 - DNA, 15 bp, Homo sapiens
attcttctctagctg

SEQ ID NO: 3232994 - DNA, 15 bp, Homo sapiens
attcttctctgttgt

SEQ ID NO: 3232995 - DNA, 12 bp, Homo sapiens
attcttctgctt

SEQ ID NO: 3232996 - DNA, 19 bp, Homo sapiens
attcttctgcttcagcctc

SEQ ID NO: 3232997 - DNA, 16 bp, Homo sapiens
attcttctgtatttct

SEQ ID NO: 3232998 - DNA, 18 bp, Homo sapiens
attcttctgtatttctag

SEQ ID NO: 3232999 - DNA, 19 bp, Homo sapiens
attcttctgtatttctagg

SEQ ID NO: 3233000 - DNA, 18 bp, Homo sapiens
attcttgaaggaaaatga

SEQ ID NO: 3233001 - DNA, 22 bp, Homo sapiens
attcttgctgggcatactttct

SEQ ID NO: 3233002 - DNA, 18 bp, Homo sapiens
attcttgtgcttttcctg

SEQ ID NO: 3233003 - DNA, 20 bp, Homo sapiens
attctttatttatttatatt

SEQ ID NO: 3233004 - DNA, 15 bp, Homo sapiens
attctttcagttctt

SEQ ID NO: 3233005 - DNA, 12 bp, Homo sapiens
attctttcccag

SEQ ID NO: 3233006 - DNA, 12 bp, Homo sapiens
attctttgaaaa

SEQ ID NO: 3233007 - DNA, 20 bp, Homo sapiens
attctttgcttgaacacagt

SEQ ID NO: 3233008 - DNA, 14 bp, Homo sapiens
attcttttaaatta

SEQ ID NO: 3233009 - DNA, 20 bp, Homo sapiens
attcttttctgcaaaataga

SEQ ID NO: 3233010 - DNA, 14 bp, Homo sapiens
attgaaaaaaaaaa

SEQ ID NO: 3233011 - DNA, 15 bp, Homo sapiens
attgaaaaaaaaaat

SEQ ID NO: 3233012 - DNA, 21 bp, Homo sapiens
attgaaaaattatcagttata

SEQ ID NO: 3233013 - DNA, 13 bp, Homo sapiens
attgaaaacttca

SEQ ID NO: 3233014 - DNA, 14 bp, Homo sapiens
attgaaaacttcaa

SEQ ID NO: 3233015 - DNA, 19 bp, Homo sapiens
attgaaaacttcaaagctg

SEQ ID NO: 3233016 - DNA, 19 bp, Homo sapiens
attgaaaagtttttgtttg

SEQ ID NO: 3233017 - DNA, 23 bp, Homo sapiens
attgaaaagtttttgtttggaga

SEQ ID NO: 3233018 - DNA, 14 bp, Homo sapiens
attgaaatactttt

SEQ ID NO: 3233019 - DNA, 13 bp, Homo sapiens
attgaaattctga

SEQ ID NO: 3233020 - DNA, 17 bp, Homo sapiens
attgaaattctgagaaa

SEQ ID NO: 3233021 - DNA, 15 bp, Homo sapiens
attgaacacaaactg

SEQ ID NO: 3233022 - DNA, 17 bp, Homo sapiens
attgaagaaacagatac

SEQ ID NO: 3233023 - DNA, 23 bp, Homo sapiens
attgaagagatttcaacatatca

SEQ ID NO: 3233024 - DNA, 22 bp, Homo sapiens
attgaagccgactctggccctg

SEQ ID NO: 3233025 - DNA, 21 bp, Homo sapiens
attgaaggaagccaaatttat

SEQ ID NO: 3233026 - DNA, 20 bp, Homo sapiens
attgaaggaatttgggagga

SEQ ID NO: 3233027 - DNA, 20 bp, Homo sapiens
attgaaggtgataagggaaa

SEQ ID NO: 3233028 - DNA, 22 bp, Homo sapiens
attgaaggtgataagggaaaag

SEQ ID NO: 3233029 - DNA, 15 bp, Homo sapiens
attgaagtaaacttt

SEQ ID NO: 3233030 - DNA, 14 bp, Homo sapiens
attgaagtaatgaa

SEQ ID NO: 3233031 - DNA, 15 bp, Homo sapiens
attgaagtaatgaat

SEQ ID NO: 3233032 - DNA, 16 bp, Homo sapiens
attgaagtaatgaatt

SEQ ID NO: 3233033 - DNA, 14 bp, Homo sapiens
attgaatattgtgt

SEQ ID NO: 3233034 - DNA, 13 bp, Homo sapiens
attgaatcagtat

SEQ ID NO: 3233035 - DNA, 21 bp, Homo sapiens
attgaatcatgtaggatcttg

SEQ ID NO: 3233036 - DNA, 13 bp, Homo sapiens
attgaattatctt

SEQ ID NO: 3233037 - DNA, 21 bp, Homo sapiens
attgaattatcttggttgaaa

SEQ ID NO: 3233038 - DNA, 18 bp, Homo sapiens
attgacaaatctgtgtat

SEQ ID NO: 3233039 - DNA, 15 bp, Homo sapiens
attgacaagaactga

SEQ ID NO: 3233040 - DNA, 20 bp, Homo sapiens
attgacacacagaaatgtgt

SEQ ID NO: 3233041 - DNA, 12 bp, Homo sapiens
attgacacagaa

SEQ ID NO: 3233042 - DNA, 14 bp, Homo sapiens
attgacacagaaaa

SEQ ID NO: 3233043 - DNA, 19 bp, Homo sapiens
attgacacatccgcctttt

SEQ ID NO: 3233044 - DNA, 15 bp, Homo sapiens
attgaccaagaactg

SEQ ID NO: 3233045 - DNA, 17 bp, Homo sapiens
attgaccaagaactgca

SEQ ID NO: 3233046 - DNA, 15 bp, Homo sapiens
attgaccatctgctt

SEQ ID NO: 3233047 - DNA, 13 bp, Homo sapiens
attgaccattttt

SEQ ID NO: 3233048 - DNA, 22 bp, Homo sapiens
attgaccattttttaatttact

SEQ ID NO: 3233049 - DNA, 17 bp, Homo sapiens
attgaccgcgactaatt

SEQ ID NO: 3233050 - DNA, 20 bp, Homo sapiens
attgaccgcgactaatttca

SEQ ID NO: 3233051 - DNA, 13 bp, Homo sapiens
attgacctctcag

SEQ ID NO: 3233052 - DNA, 14 bp, Homo sapiens
attgacctctcagg

SEQ ID NO: 3233053 - DNA, 17 bp, Homo sapiens
atttagagatgaattaa

SEQ ID NO: 3233054 - DNA, 22 bp, Homo sapiens
atttagagatgaattaaattta

SEQ ID NO: 3233055 - DNA, 23 bp, Homo sapiens
atttagagatgaattaaatttaa

SEQ ID NO: 3233056 - DNA, 16 bp, Homo sapiens
atttagagatgctgta

SEQ ID NO: 3233057 - DNA, 17 bp, Homo sapiens
atttagatcttatattg

SEQ ID NO: 3233058 - DNA, 20 bp, Homo sapiens
atttagatcttatattggtt

SEQ ID NO: 3233059 - DNA, 21 bp, Homo sapiens
atttagatcttatattggttt

SEQ ID NO: 3233060 - DNA, 17 bp, Homo sapiens
atttagatgataaagag

SEQ ID NO: 3233061 - DNA, 13 bp, Homo sapiens
atttagcacaaaa

SEQ ID NO: 3233062 - DNA, 15 bp, Homo sapiens
atttaggagcagaaa

SEQ ID NO: 3233063 - DNA, 20 bp, Homo sapiens
atttagggagaaatgttgtt

SEQ ID NO: 3233064 - DNA, 22 bp, Homo sapiens
atttagggagaaatgttgttca

SEQ ID NO: 3233065 - DNA, 17 bp, Homo sapiens
atttaggtttttattag

SEQ ID NO: 3233066 - DNA, 18 bp, Homo sapiens
atttaggtttttattagt

SEQ ID NO: 3233067 - DNA, 23 bp, Homo sapiens
atttaggtttttgtttgtttcct

SEQ ID NO: 3233068 - DNA, 21 bp, Homo sapiens
atttagtgagttattccttga

SEQ ID NO: 3233069 - DNA, 21 bp, Homo sapiens
atttagtgatcaaattgtgca

SEQ ID NO: 3233070 - DNA, 19 bp, Homo sapiens
atttagtgctaaacaagta

SEQ ID NO: 3233071 - DNA, 13 bp, Homo sapiens
atttagttatagt

SEQ ID NO: 3233072 - DNA, 16 bp, Homo sapiens
atttagttatagtttc

SEQ ID NO: 3233073 - DNA, 17 bp, Homo sapiens
atttagtttttaacaat

SEQ ID NO: 3233074 - DNA, 15 bp, Homo sapiens
atttataaaacttct

SEQ ID NO: 3233075 - DNA, 19 bp, Homo sapiens
atttataaaattagaaagc

SEQ ID NO: 3233076 - DNA, 15 bp, Homo sapiens
atttataactcatca

SEQ ID NO: 3233077 - DNA, 22 bp, Homo sapiens
atttataactcatcataaaata

SEQ ID NO: 3233078 - DNA, 14 bp, Homo sapiens
atttataagcagat

SEQ ID NO: 3233079 - DNA, 15 bp, Homo sapiens
atttataatacagaa

SEQ ID NO: 3233080 - DNA, 14 bp, Homo sapiens
atttataattccta

SEQ ID NO: 3233081 - DNA, 11 bp, Homo sapiens
atttataattg

SEQ ID NO: 3233082 - DNA, 17 bp, Homo sapiens
atttataattgcatcta

SEQ ID NO: 3233083 - DNA, 14 bp, Homo sapiens
atttatacaaatta

SEQ ID NO: 3233084 - DNA, 15 bp, Homo sapiens
atttatacaagattg

SEQ ID NO: 3233085 - DNA, 22 bp, Homo sapiens
atttatactttgcaatccaaat

SEQ ID NO: 3233086 - DNA, 16 bp, Homo sapiens
atttatagtatgtgac

SEQ ID NO: 3233087 - DNA, 12 bp, Homo sapiens
atttatagtttg

SEQ ID NO: 3233088 - DNA, 12 bp, Homo sapiens
atttatatactt

SEQ ID NO: 3233089 - DNA, 14 bp, Homo sapiens
atttatatactttt

SEQ ID NO: 3233090 - DNA, 12 bp, Homo sapiens
atttatatattt

SEQ ID NO: 3233091 - DNA, 19 bp, Homo sapiens
atttatatatttataactc

SEQ ID NO: 3233092 - DNA, 15 bp, Homo sapiens
atttatatgtacatg

SEQ ID NO: 3233093 - DNA, 16 bp, Homo sapiens
atttatatgtacatga

SEQ ID NO: 3233094 - DNA, 17 bp, Homo sapiens
atttatatgtacatgag

SEQ ID NO: 3233095 - DNA, 14 bp, Homo sapiens
atttatatttggaa

SEQ ID NO: 3233096 - DNA, 17 bp, Homo sapiens
atttatatttggaaaga

SEQ ID NO: 3233097 - DNA, 18 bp, Homo sapiens
atttatatttggaaagag

SEQ ID NO: 3233098 - DNA, 18 bp, Homo sapiens
atttatatttgtgtattt

SEQ ID NO: 3233099 - DNA, 13 bp, Homo sapiens
atttatcaaagca

SEQ ID NO: 3233100 - DNA, 20 bp, Homo sapiens
atttatcaaagcatagatgt

SEQ ID NO: 3233101 - DNA, 22 bp, Homo sapiens
atttatcaaagcatagatgttt

SEQ ID NO: 3233102 - DNA, 14 bp, Homo sapiens
atttatcagtgaca

SEQ ID NO: 3233103 - DNA, 18 bp, Homo sapiens
atttatcagtgacagagt

SEQ ID NO: 3233104 - DNA, 13 bp, Homo sapiens
atttatcattctt

SEQ ID NO: 3233105 - DNA, 19 bp, Homo sapiens
atttatccaaaatgtgtat

SEQ ID NO: 3233106 - DNA, 15 bp, Homo sapiens
atttatccatttgta

SEQ ID NO: 3233107 - DNA, 16 bp, Homo sapiens
atttatccatttgtaa

SEQ ID NO: 3233108 - DNA, 17 bp, Homo sapiens
atttatccctttacaat

SEQ ID NO: 3233109 - DNA, 16 bp, Homo sapiens
atttatctattaaaat

SEQ ID NO: 3233110 - DNA, 21 bp, Homo sapiens
atttatctattaaaattgcca

SEQ ID NO: 3233111 - DNA, 22 bp, Homo sapiens
atttatctcccttagaagagag

SEQ ID NO: 3233112 - DNA, 23 bp, Homo sapiens
atttatctcccttagaagagagc

SEQ ID NO: 3233113 - DNA, 14 bp, Homo sapiens
atttatctctattt

SEQ ID NO: 3233114 - DNA, 16 bp, Homo sapiens
atttatctctatttaa

SEQ ID NO: 3233115 - DNA, 22 bp, Homo sapiens
atttatctctatttaatattta

SEQ ID NO: 3233116 - DNA, 20 bp, Homo sapiens
atttatctgtgtttttgaaa

SEQ ID NO: 3233117 - DNA, 19 bp, Homo sapiens
atttatctttatacagatt

SEQ ID NO: 3233118 - DNA, 13 bp, Homo sapiens
atttatgaaaaga

SEQ ID NO: 3233119 - DNA, 17 bp, Homo sapiens
atttatgaagcagattt

SEQ ID NO: 3233120 - DNA, 18 bp, Homo sapiens
atttatgagtttttgata

SEQ ID NO: 3233121 - DNA, 15 bp, Homo sapiens
atttatgatttaata

SEQ ID NO: 3233122 - DNA, 16 bp, Homo sapiens
atttatgcaaggtatt

SEQ ID NO: 3233123 - DNA, 13 bp, Homo sapiens
atttatgcacatt

SEQ ID NO: 3233124 - DNA, 17 bp, Homo sapiens
atttatgcacattcacg

SEQ ID NO: 3233125 - DNA, 15 bp, Homo sapiens
atttatgcactgtgg

SEQ ID NO: 3233126 - DNA, 19 bp, Homo sapiens
atttatgcatggaaacctg

SEQ ID NO: 3233127 - DNA, 13 bp, Homo sapiens
atttatggaccac

SEQ ID NO: 3233128 - DNA, 12 bp, Homo sapiens
atttatggagga

SEQ ID NO: 3233129 - DNA, 18 bp, Homo sapiens
atttatggtcaacactta

SEQ ID NO: 3233130 - DNA, 23 bp, Homo sapiens
atttatgtaaactgcattagaaa

SEQ ID NO: 3233131 - DNA, 21 bp, Homo sapiens
atttatgtaatgaagtaaagc

SEQ ID NO: 3233132 - DNA, 22 bp, Homo sapiens
atttatgtctatttaagcctca

SEQ ID NO: 3233133 - DNA, 12 bp, Homo sapiens
atttatgtgcta

SEQ ID NO: 3233134 - DNA, 16 bp, Homo sapiens
atttatgtgtatatgg

SEQ ID NO: 3233135 - DNA, 17 bp, Homo sapiens
atttatgtgtatatttg

SEQ ID NO: 3233136 - DNA, 20 bp, Homo sapiens
atttatgtgtatatttgtag

SEQ ID NO: 3233137 - DNA, 21 bp, Homo sapiens
atttatgtgtatatttgtaga

SEQ ID NO: 3233138 - DNA, 19 bp, Homo sapiens
atttatgtgtgaggagctg

SEQ ID NO: 3233139 - DNA, 22 bp, Homo sapiens
atttatgtgtgaggagctgctg

SEQ ID NO: 3233140 - DNA, 19 bp, Homo sapiens
atttattaaaaatgttctc

SEQ ID NO: 3233141 - DNA, 23 bp, Homo sapiens
atttattaaaaatgttctcaaat

SEQ ID NO: 3233142 - DNA, 22 bp, Homo sapiens
atttattaaacagatttttaca

SEQ ID NO: 3233143 - DNA, 15 bp, Homo sapiens
atttattaagatgga

SEQ ID NO: 3233144 - DNA, 23 bp, Homo sapiens
atttattaagatggattctcaga

SEQ ID NO: 3233145 - DNA, 17 bp, Homo sapiens
atttattaatttgaaac

SEQ ID NO: 3233146 - DNA, 16 bp, Homo sapiens
atttattattgaaatt

SEQ ID NO: 3233147 - DNA, 14 bp, Homo sapiens
atttattattttca

SEQ ID NO: 3233148 - DNA, 20 bp, Homo sapiens
atttattcataatgaattat

SEQ ID NO: 3233149 - DNA, 15 bp, Homo sapiens
atttattcatagata

SEQ ID NO: 3233150 - DNA, 14 bp, Homo sapiens
atttattctgctca

SEQ ID NO: 3233151 - DNA, 14 bp, Homo sapiens
atttattctgcttc

SEQ ID NO: 3233152 - DNA, 20 bp, Homo sapiens
atttattgaatatttatact

SEQ ID NO: 3233153 - DNA, 16 bp, Homo sapiens
atttattgcattgctg

SEQ ID NO: 3233154 - DNA, 18 bp, Homo sapiens
atttattgttagaaaatg

SEQ ID NO: 3233155 - DNA, 22 bp, Homo sapiens
atttattgtttatttatcagtg

SEQ ID NO: 3233156 - DNA, 11 bp, Homo sapiens
atttatttaat

SEQ ID NO: 3233157 - DNA, 16 bp, Homo sapiens
atttatttaataacaa

SEQ ID NO: 3233158 - DNA, 17 bp, Homo sapiens
atttatttaatgttatg

SEQ ID NO: 3233159 - DNA, 13 bp, Homo sapiens
atttatttaatta

SEQ ID NO: 3233160 - DNA, 15 bp, Homo sapiens
atttatttatgaaaa

SEQ ID NO: 3233161 - DNA, 14 bp, Homo sapiens
atttatttatgtgt

SEQ ID NO: 3233162 - DNA, 14 bp, Homo sapiens
atttatttatttat

SEQ ID NO: 3233163 - DNA, 21 bp, Homo sapiens
atttatttccactaaaaatat

SEQ ID NO: 3233164 - DNA, 11 bp, Homo sapiens
atttatttcta

SEQ ID NO: 3233165 - DNA, 17 bp, Homo sapiens
atttattttaaacgctt

SEQ ID NO: 3233166 - DNA, 22 bp, Homo sapiens
atttattttcagtatactgtgt

SEQ ID NO: 3233167 - DNA, 15 bp, Homo sapiens
atttattttcctaaa

SEQ ID NO: 3233168 - DNA, 18 bp, Homo sapiens
atttatttttacaagaag

SEQ ID NO: 3233169 - DNA, 15 bp, Homo sapiens
atttcaaaaatataa

SEQ ID NO: 3233170 - DNA, 14 bp, Homo sapiens
atttcaaaagacat

SEQ ID NO: 3233171 - DNA, 13 bp, Homo sapiens
atttcaaaatata

SEQ ID NO: 3233172 - DNA, 13 bp, Homo sapiens
atttcaaaatgct

SEQ ID NO: 3233173 - DNA, 15 bp, Homo sapiens
atttcaaaatgcttt

SEQ ID NO: 3233174 - DNA, 23 bp, Homo sapiens
atttcaaacagtctcccttccta

SEQ ID NO: 3233175 - DNA, 22 bp, Homo sapiens
atttcaaatgttagatattgct

SEQ ID NO: 3233176 - DNA, 15 bp, Homo sapiens
atttcaacaagaata

SEQ ID NO: 3233177 - DNA, 16 bp, Homo sapiens
atttcaactgctgtaa

SEQ ID NO: 3233178 - DNA, 21 bp, Homo sapiens
atttcaagaaaaaataaatgg

SEQ ID NO: 3233179 - DNA, 12 bp, Homo sapiens
attttcatttgt

SEQ ID NO: 3233180 - DNA, 22 bp, Homo sapiens
attttcatttgtacaaggtaat

SEQ ID NO: 3233181 - DNA, 20 bp, Homo sapiens
attttcccactcattctgaa

SEQ ID NO: 3233182 - DNA, 22 bp, Homo sapiens
attttcccactcattctgaatt

SEQ ID NO: 3233183 - DNA, 18 bp, Homo sapiens
attttcccatcatccttt

SEQ ID NO: 3233184 - DNA, 21 bp, Homo sapiens
attttcccccactactgcagc

SEQ ID NO: 3233185 - DNA, 21 bp, Homo sapiens
attttccctcttggtgtgatt

SEQ ID NO: 3233186 - DNA, 14 bp, Homo sapiens
attttcctcatttt

SEQ ID NO: 3233187 - DNA, 12 bp, Homo sapiens
attttcctctga

SEQ ID NO: 3233188 - DNA, 17 bp, Homo sapiens
attttcctggatttata

SEQ ID NO: 3233189 - DNA, 20 bp, Homo sapiens
attttcctggatttatagta

SEQ ID NO: 3233190 - DNA, 14 bp, Homo sapiens
attttcctttagat

SEQ ID NO: 3233191 - DNA, 16 bp, Homo sapiens
attttcgtatgaaaat

SEQ ID NO: 3233192 - DNA, 19 bp, Homo sapiens
attttctagactttctgtt

SEQ ID NO: 3233193 - DNA, 16 bp, Homo sapiens
attttctattgttact

SEQ ID NO: 3233194 - DNA, 20 bp, Homo sapiens
attttctattgttactctgg

SEQ ID NO: 3233195 - DNA, 23 bp, Homo sapiens
attttctcaaaagcatttatcat

SEQ ID NO: 3233196 - DNA, 22 bp, Homo sapiens
attttctccaaataaaaattag

SEQ ID NO: 3233197 - DNA, 17 bp, Homo sapiens
attttctctgtactttt

SEQ ID NO: 3233198 - DNA, 22 bp, Homo sapiens
attttctctgtgtttgttccta

SEQ ID NO: 3233199 - DNA, 17 bp, Homo sapiens
attttctgacatgcatt

SEQ ID NO: 3233200 - DNA, 13 bp, Homo sapiens
attttctggattc

SEQ ID NO: 3233201 - DNA, 18 bp, Homo sapiens
attttctggtagatagaa

SEQ ID NO: 3233202 - DNA, 12 bp, Homo sapiens
attttctgtcag

SEQ ID NO: 3233203 - DNA, 13 bp, Homo sapiens
attttctgtcaga

SEQ ID NO: 3233204 - DNA, 22 bp, Homo sapiens
attttctgtcagatgagaacaa

SEQ ID NO: 3233205 - DNA, 18 bp, Homo sapiens
attttctgtgcctgaata

SEQ ID NO: 3233206 - DNA, 20 bp, Homo sapiens
attttctgtgcctgaatatt

SEQ ID NO: 3233207 - DNA, 15 bp, Homo sapiens
attttcttaaaccaa

SEQ ID NO: 3233208 - DNA, 17 bp, Homo sapiens
attttcttcagttggtg

SEQ ID NO: 3233209 - DNA, 18 bp, Homo sapiens
attttcttcatgcaatga

SEQ ID NO: 3233210 - DNA, 21 bp, Homo sapiens
attttcttcatgcaatgacat

SEQ ID NO: 3233211 - DNA, 18 bp, Homo sapiens
attttctttaatgctttt

SEQ ID NO: 3233212 - DNA, 14 bp, Homo sapiens
attttctttgtttc

SEQ ID NO: 3233213 - DNA, 15 bp, Homo sapiens
attttgaaaagtatc

SEQ ID NO: 3233214 - DNA, 18 bp, Homo sapiens
attttgaagaatatttaa

SEQ ID NO: 3233215 - DNA, 22 bp, Homo sapiens
attttgaagtgctgtttattaa

SEQ ID NO: 3233216 - DNA, 12 bp, Homo sapiens
attttgaatacc

SEQ ID NO: 3233217 - DNA, 14 bp, Homo sapiens
attttgaataccat

SEQ ID NO: 3233218 - DNA, 15 bp, Homo sapiens
attttgaataccatt

SEQ ID NO: 3233219 - DNA, 22 bp, Homo sapiens
attttgaatgtcacaaattgat

SEQ ID NO: 3233220 - DNA, 18 bp, Homo sapiens
attttgacctactctcat

SEQ ID NO: 3233221 - DNA, 16 bp, Homo sapiens
attttgagcaaagaaa

SEQ ID NO: 3233222 - DNA, 18 bp, Homo sapiens
attttgagcaaagaaact

SEQ ID NO: 3233223 - DNA, 17 bp, Homo sapiens
attttgaggtaaagata

SEQ ID NO: 3233224 - DNA, 13 bp, Homo sapiens
attttgataataa

SEQ ID NO: 3233225 - DNA, 15 bp, Homo sapiens
attttgataataaat

SEQ ID NO: 3233226 - DNA, 17 bp, Homo sapiens
attttgatatacattgt

SEQ ID NO: 3233227 - DNA, 18 bp, Homo sapiens
attttgatatacattgtg

SEQ ID NO: 3233228 - DNA, 18 bp, Homo sapiens
attttgatccaagctggt

SEQ ID NO: 3233229 - DNA, 19 bp, Homo sapiens
attttgatccaagctggtc

SEQ ID NO: 3233230 - DNA, 21 bp, Homo sapiens
attttgatgagatattaaatt

SEQ ID NO: 3233231 - DNA, 22 bp, Homo sapiens
attttgatgagatattaaattc

SEQ ID NO: 3233232 - DNA, 23 bp, Homo sapiens
attttgatgagatattaaattct

SEQ ID NO: 3233233 - DNA, 19 bp, Homo sapiens
attttgatgtgacaataat

SEQ ID NO: 3233234 - DNA, 16 bp, Homo sapiens
attttgattattgtat

SEQ ID NO: 3233235 - DNA, 18 bp, Homo sapiens
attttgattattgtattt

SEQ ID NO: 3233236 - DNA, 18 bp, Homo sapiens
attttgcaaggtgcattt

SEQ ID NO: 3233237 - DNA, 22 bp, Homo sapiens
attttgcatatatgttcttcat

SEQ ID NO: 3233238 - DNA, 18 bp, Homo sapiens
attttgcctcttttctct

SEQ ID NO: 3233239 - DNA, 13 bp, Homo sapiens
attttgcctgtgt

SEQ ID NO: 3233240 - DNA, 19 bp, Homo sapiens
attttgctatcaacaataa

SEQ ID NO: 3233241 - DNA, 16 bp, Homo sapiens
attttgctgagttgtt

SEQ ID NO: 3233242 - DNA, 19 bp, Homo sapiens
attttgctggaattcctaa

SEQ ID NO: 3233243 - DNA, 18 bp, Homo sapiens
attttggaaactgctaaa

SEQ ID NO: 3233244 - DNA, 18 bp, Homo sapiens
attttggaaagatgttaa

SEQ ID NO: 3233245 - DNA, 17 bp, Homo sapiens
attttggaagattttca

SEQ ID NO: 3233246 - DNA, 14 bp, Homo sapiens
attttggaatttgc

SEQ ID NO: 3233247 - DNA, 21 bp, Homo sapiens
attttggagaaattatttaat

SEQ ID NO: 3233248 - DNA, 12 bp, Homo sapiens
attttggatata

SEQ ID NO: 3233249 - DNA, 21 bp, Homo sapiens
attttggatatattattgtaa

SEQ ID NO: 3233250 - DNA, 22 bp, Homo sapiens
attttggcgaatctcaaaatta

SEQ ID NO: 3233251 - DNA, 16 bp, Homo sapiens
attttggcttcatttc

SEQ ID NO: 3233252 - DNA, 22 bp, Homo sapiens
attttgggacaattgttttaat

SEQ ID NO: 3233253 - DNA, 21 bp, Homo sapiens
attttggggtacccactgctc

SEQ ID NO: 3233254 - DNA, 22 bp, Homo sapiens
attttggggtacccactgctct

SEQ ID NO: 3233255 - DNA, 11 bp, Homo sapiens
attttggggtc

SEQ ID NO: 3233256 - DNA, 13 bp, Homo sapiens
attttggggtctc

SEQ ID NO: 3233257 - DNA, 17 bp, Homo sapiens
attttggggtctctttt

SEQ ID NO: 3233258 - DNA, 19 bp, Homo sapiens
attttgggttttgggtctt

SEQ ID NO: 3233259 - DNA, 22 bp, Homo sapiens
attttggtaaaatacttcttga

SEQ ID NO: 3233260 - DNA, 21 bp, Homo sapiens
attttggtaagagacagaatg

SEQ ID NO: 3233261 - DNA, 21 bp, Homo sapiens
attttggtttatttttgtaat

SEQ ID NO: 3233262 - DNA, 17 bp, Homo sapiens
attttgtaaactcaaaa

SEQ ID NO: 3233263 - DNA, 19 bp, Homo sapiens
attttgtaaactcaaaata

SEQ ID NO: 3233264 - DNA, 23 bp, Homo sapiens
attttgtcatataagattcatat

SEQ ID NO: 3233265 - DNA, 15 bp, Homo sapiens
attttgtcttattct

SEQ ID NO: 3233266 - DNA, 17 bp, Homo sapiens
attttgtgcattctttg

SEQ ID NO: 3233267 - DNA, 22 bp, Homo sapiens
attttgtgcattctttggtaat

SEQ ID NO: 3233268 - DNA, 13 bp, Homo sapiens
attttgtgtgacc

SEQ ID NO: 3233269 - DNA, 14 bp, Homo sapiens
attttgtgtgacca

SEQ ID NO: 3233270 - DNA, 15 bp, Homo sapiens
attttgtgtgaccaa

SEQ ID NO: 3233271 - DNA, 20 bp, Homo sapiens
attttgtgtgaccaactgtg

SEQ ID NO: 3233272 - DNA, 22 bp, Homo sapiens
attttgtgtgaccaactgtgtt

SEQ ID NO: 3233273 - DNA, 18 bp, Homo sapiens
attttgtgttgctaaaaa

SEQ ID NO: 3233274 - DNA, 21 bp, Homo sapiens
attttgttaaagctggaacat

SEQ ID NO: 3233275 - DNA, 14 bp, Homo sapiens
attttgttcttaca

SEQ ID NO: 3233276 - DNA, 18 bp, Homo sapiens
attttgttcttacacata

SEQ ID NO: 3233277 - DNA, 13 bp, Homo sapiens
attttgttgtaaa

SEQ ID NO: 3233278 - DNA, 14 bp, Homo sapiens
attttgttgtaaaa

SEQ ID NO: 3233279 - DNA, 12 bp, Homo sapiens
attttgtttcaa

SEQ ID NO: 3233280 - DNA, 17 bp, Homo sapiens
attttgtttcaatctct

SEQ ID NO: 3233281 - DNA, 16 bp, Homo sapiens
atttttaaaacccatt

SEQ ID NO: 3233282 - DNA, 17 bp, Homo sapiens
atttttaaaacccattt

SEQ ID NO: 3233283 - DNA, 16 bp, Homo sapiens
atttttaaaatattta

SEQ ID NO: 3233284 - DNA, 21 bp, Homo sapiens
atttttaaacaggtggtgaga

SEQ ID NO: 3233285 - DNA, 13 bp, Homo sapiens
atttttaaagatc

SEQ ID NO: 3233286 - DNA, 15 bp, Homo sapiens
atttttaaaggcatt

SEQ ID NO: 3233287 - DNA, 19 bp, Homo sapiens
atttttaaagtagaagagg

SEQ ID NO: 3233288 - DNA, 17 bp, Homo sapiens
atttttaaagtatatat

SEQ ID NO: 3233289 - DNA, 16 bp, Homo sapiens
atttttaaagttttgt

SEQ ID NO: 3233290 - DNA, 19 bp, Homo sapiens
atttttaaatgtaaaacat

SEQ ID NO: 3233291 - DNA, 23 bp, Homo sapiens
atttttaagtcaacactatatat

SEQ ID NO: 3233292 - DNA, 12 bp, Homo sapiens
atttttaatgat

SEQ ID NO: 3233293 - DNA, 23 bp, Homo sapiens
atttttaatgggggtagcagctg

SEQ ID NO: 3233294 - DNA, 16 bp, Homo sapiens
atttttaatttaacaa

SEQ ID NO: 3233295 - DNA, 22 bp, Homo sapiens
atttttagccataattttgcat

SEQ ID NO: 3233296 - DNA, 12 bp, Homo sapiens
atttttataatt

SEQ ID NO: 3233297 - DNA, 13 bp, Homo sapiens
atttttatagcaa

SEQ ID NO: 3233298 - DNA, 13 bp, Homo sapiens
atttttatatcat

SEQ ID NO: 3233299 - DNA, 11 bp, Homo sapiens
atttttatcag

SEQ ID NO: 3233300 - DNA, 15 bp, Homo sapiens
atttttatctatata

SEQ ID NO: 3233301 - DNA, 16 bp, Homo sapiens
atttttatctatataa

SEQ ID NO: 3233302 - DNA, 14 bp, Homo sapiens
atttttatttatat

SEQ ID NO: 3233303 - DNA, 12 bp, Homo sapiens
atttttatttct

SEQ ID NO: 3233304 - DNA, 13 bp, Homo sapiens
atttttatttctt

SEQ ID NO: 3233305 - DNA, 17 bp, Homo sapiens
caaacgcctagattgct

SEQ ID NO: 3233306 - DNA, 11 bp, Homo sapiens
caaactaaaaa

SEQ ID NO: 3233307 - DNA, 20 bp, Homo sapiens
caaactaaaagacatttgtt

SEQ ID NO: 3233308 - DNA, 17 bp, Homo sapiens
caaactacagaataatg

SEQ ID NO: 3233309 - DNA, 20 bp, Homo sapiens
caaactacagacctgctttt

SEQ ID NO: 3233310 - DNA, 13 bp, Homo sapiens
caaactacctctg

SEQ ID NO: 3233311 - DNA, 23 bp, Homo sapiens
caaactacgcgatagtctctgtt

SEQ ID NO: 3233312 - DNA, 21 bp, Homo sapiens
caaactactgaatgaagcagt

SEQ ID NO: 3233313 - DNA, 11 bp, Homo sapiens
caaactcccta

SEQ ID NO: 3233314 - DNA, 19 bp, Homo sapiens
caaactcttgacctcaggt

SEQ ID NO: 3233315 - DNA, 21 bp, Homo sapiens
caaactcttgacctcaggtga

SEQ ID NO: 3233316 - DNA, 17 bp, Homo sapiens
caaactgactcaacagt

SEQ ID NO: 3233317 - DNA, 23 bp, Homo sapiens
caaactgatggaccgggtgggcc

SEQ ID NO: 3233318 - DNA, 15 bp, Homo sapiens
caaactgcaatagag

SEQ ID NO: 3233319 - DNA, 18 bp, Homo sapiens
caaactgcacacacagct

SEQ ID NO: 3233320 - DNA, 15 bp, Homo sapiens
caaactgcactttta

SEQ ID NO: 3233321 - DNA, 22 bp, Homo sapiens
caaactgctggacgtctttctt

SEQ ID NO: 3233322 - DNA, 15 bp, Homo sapiens
caaactggggcctcc

SEQ ID NO: 3233323 - DNA, 17 bp, Homo sapiens
caaactggggcctccct

SEQ ID NO: 3233324 - DNA, 21 bp, Homo sapiens
caaactggtattctgttctgg

SEQ ID NO: 3233325 - DNA, 20 bp, Homo sapiens
caaactgtaaataaaaagaa

SEQ ID NO: 3233326 - DNA, 19 bp, Homo sapiens
caaactgtgggattctgat

SEQ ID NO: 3233327 - DNA, 12 bp, Homo sapiens
caaactgttctg

SEQ ID NO: 3233328 - DNA, 19 bp, Homo sapiens
caaacttaagaaacactga

SEQ ID NO: 3233329 - DNA, 15 bp, Homo sapiens
caaacttactatttt

SEQ ID NO: 3233330 - DNA, 16 bp, Homo sapiens
caaacttactattttg

SEQ ID NO: 3233331 - DNA, 14 bp, Homo sapiens
caaacttgttcatt

SEQ ID NO: 3233332 - DNA, 16 bp, Homo sapiens
caaacttgttcattta

SEQ ID NO: 3233333 - DNA, 22 bp, Homo sapiens
caaacttgttcatttagataat

SEQ ID NO: 3233334 - DNA, 23 bp, Homo sapiens
caaactttaggtttttttaatga

SEQ ID NO: 3233335 - DNA, 16 bp, Homo sapiens
caaacttttattagcc

SEQ ID NO: 3233336 - DNA, 13 bp, Homo sapiens
caaagaaacaagc

SEQ ID NO: 3233337 - DNA, 18 bp, Homo sapiens
caaagaaacaagctgtgc

SEQ ID NO: 3233338 - DNA, 22 bp, Homo sapiens
caaagaaacttgaagctttgta

SEQ ID NO: 3233339 - DNA, 19 bp, Homo sapiens
caaagaaagaaagtttaga

SEQ ID NO: 3233340 - DNA, 13 bp, Homo sapiens
caaagaaagtgta

SEQ ID NO: 3233341 - DNA, 13 bp, Homo sapiens
caaagaaatgaac

SEQ ID NO: 3233342 - DNA, 17 bp, Homo sapiens
caaagaaatgaacattc

SEQ ID NO: 3233343 - DNA, 19 bp, Homo sapiens
caaagaaatgaacattcca

SEQ ID NO: 3233344 - DNA, 20 bp, Homo sapiens
caaagaaatgaacattccaa

SEQ ID NO: 3233345 - DNA, 15 bp, Homo sapiens
caaagaaccatgcag

SEQ ID NO: 3233346 - DNA, 18 bp, Homo sapiens
caaagaaccatgcaggaa

SEQ ID NO: 3233347 - DNA, 19 bp, Homo sapiens
caaagaacttgatttgcat

SEQ ID NO: 3233348 - DNA, 13 bp, Homo sapiens
caaagaattacag

SEQ ID NO: 3233349 - DNA, 14 bp, Homo sapiens
caaagaattacagt

SEQ ID NO: 3233350 - DNA, 20 bp, Homo sapiens
caaagacgtaataaaattaa

SEQ ID NO: 3233351 - DNA, 13 bp, Homo sapiens
caaagactgtact

SEQ ID NO: 3233352 - DNA, 16 bp, Homo sapiens
caaagactgtactggc

SEQ ID NO: 3233353 - DNA, 14 bp, Homo sapiens
caaagagatattga

SEQ ID NO: 3233354 - DNA, 17 bp, Homo sapiens
caaagagcacaaacatt

SEQ ID NO: 3233355 - DNA, 19 bp, Homo sapiens
caaagagcacaaacatttt

SEQ ID NO: 3233356 - DNA, 22 bp, Homo sapiens
caaagaggactcgcttgtaaat

SEQ ID NO: 3233357 - DNA, 15 bp, Homo sapiens
caaagagggcttcct

SEQ ID NO: 3233358 - DNA, 18 bp, Homo sapiens
caaagagggcttcctcta

SEQ ID NO: 3233359 - DNA, 22 bp, Homo sapiens
caaagagggcttcctctagaag

SEQ ID NO: 3233360 - DNA, 14 bp, Homo sapiens
caaagagtagaatt

SEQ ID NO: 3233361 - DNA, 24 bp, Homo sapiens
caaagagttctggaaaagaactgt

SEQ ID NO: 3233362 - DNA, 21 bp, Homo sapiens
caaagataaaaggtttctttt

SEQ ID NO: 3233363 - DNA, 22 bp, Homo sapiens
caaagataaaaggtttcttttt

SEQ ID NO: 3233364 - DNA, 13 bp, Homo sapiens
caaagatcaaaat

SEQ ID NO: 3233365 - DNA, 14 bp, Homo sapiens
caaagatcaaaata

SEQ ID NO: 3233366 - DNA, 20 bp, Homo sapiens
caaagatcaaaataaaaagt

SEQ ID NO: 3233367 - DNA, 22 bp, Homo sapiens
caaagatctgaattaaataaat

SEQ ID NO: 3233368 - DNA, 22 bp, Homo sapiens
caaagatgtgggttctttttct

SEQ ID NO: 3233369 - DNA, 22 bp, Homo sapiens
caaagatgtttgtcagatatga

SEQ ID NO: 3233370 - DNA, 17 bp, Homo sapiens
caaagattgagaagcca

SEQ ID NO: 3233371 - DNA, 15 bp, Homo sapiens
caaagattttctaag

SEQ ID NO: 3233372 - DNA, 17 bp, Homo sapiens
caaagattttctaagga

SEQ ID NO: 3233373 - DNA, 11 bp, Homo sapiens
caaagcaaggg

SEQ ID NO: 3233374 - DNA, 13 bp, Homo sapiens
caaagcaagggct

SEQ ID NO: 3233375 - DNA, 11 bp, Homo sapiens
caaagcacatg

SEQ ID NO: 3233376 - DNA, 21 bp, Homo sapiens
caaagcacccatttcaatgtg

SEQ ID NO: 3233377 - DNA, 13 bp, Homo sapiens
caaagcatagatg

SEQ ID NO: 3233378 - DNA, 17 bp, Homo sapiens
caaagcatggacattta

SEQ ID NO: 3233379 - DNA, 15 bp, Homo sapiens
caaagccaaacaaaa

SEQ ID NO: 3233380 - DNA, 21 bp, Homo sapiens
caaagccaaagctaggcctgg

SEQ ID NO: 3233381 - DNA, 22 bp, Homo sapiens
caaagccaaagctaggcctggc

SEQ ID NO: 3233382 - DNA, 18 bp, Homo sapiens
caaagccacaaggctggc

SEQ ID NO: 3233383 - DNA, 21 bp, Homo sapiens
caaagccacaaggctggccag

SEQ ID NO: 3233384 - DNA, 22 bp, Homo sapiens
caaagccacaaggctggccagc

SEQ ID NO: 3233385 - DNA, 22 bp, Homo sapiens
caaagccagggtctctccctca

SEQ ID NO: 3233386 - DNA, 15 bp, Homo sapiens
caaagccctggtaaa

SEQ ID NO: 3233387 - DNA, 13 bp, Homo sapiens
caaagcctggcct

SEQ ID NO: 3233388 - DNA, 18 bp, Homo sapiens
caaagccttatcaagtgt

SEQ ID NO: 3233389 - DNA, 23 bp, Homo sapiens
caaagcggtttaaccacattaat

SEQ ID NO: 3233390 - DNA, 18 bp, Homo sapiens
caaagctaggatggttct

SEQ ID NO: 3233391 - DNA, 23 bp, Homo sapiens
caaagctaggatggttctgtgac

SEQ ID NO: 3233392 - DNA, 14 bp, Homo sapiens
caaagctaggcctg

SEQ ID NO: 3233393 - DNA, 16 bp, Homo sapiens
caaagctaggcctggc

SEQ ID NO: 3233394 - DNA, 18 bp, Homo sapiens
caaagctaggcctggcca

SEQ ID NO: 3233395 - DNA, 23 bp, Homo sapiens
caaagctgaagaccatggatttc

SEQ ID NO: 3233396 - DNA, 15 bp, Homo sapiens
caaagctgaatattt

SEQ ID NO: 3233397 - DNA, 16 bp, Homo sapiens
caaagctgaatatttt

SEQ ID NO: 3233398 - DNA, 16 bp, Homo sapiens
caaagctgctaaatct

SEQ ID NO: 3233399 - DNA, 17 bp, Homo sapiens
caaagctgctaaatctc

SEQ ID NO: 3233400 - DNA, 19 bp, Homo sapiens
caaagctgttaaactgtta

SEQ ID NO: 3233401 - DNA, 22 bp, Homo sapiens
caaagctgttaaactgttagca

SEQ ID NO: 3233402 - DNA, 21 bp, Homo sapiens
caaagcttctatcccaggagg

SEQ ID NO: 3233403 - DNA, 20 bp, Homo sapiens
caaaggaagtgccccctccc

SEQ ID NO: 3233404 - DNA, 20 bp, Homo sapiens
caaaggaataacctttctgg

SEQ ID NO: 3233405 - DNA, 17 bp, Homo sapiens
caaaggacattatgtgt

SEQ ID NO: 3233406 - DNA, 12 bp, Homo sapiens
caaaggatgaag

SEQ ID NO: 3233407 - DNA, 14 bp, Homo sapiens
caaaggatgaagaa

SEQ ID NO: 3233408 - DNA, 14 bp, Homo sapiens
caaaggatgtgata

SEQ ID NO: 3233409 - DNA, 21 bp, Homo sapiens
caaaggatgtgatatataagt

SEQ ID NO: 3233410 - DNA, 15 bp, Homo sapiens
caaaggccaaactgc

SEQ ID NO: 3233411 - DNA, 16 bp, Homo sapiens
caaaggccaaactgct

SEQ ID NO: 3233412 - DNA, 19 bp, Homo sapiens
caaaggccaaactgctgga

SEQ ID NO: 3233413 - DNA, 19 bp, Homo sapiens
caaaggccacatacctctc

SEQ ID NO: 3233414 - DNA, 18 bp, Homo sapiens
caaaggccagtggaagaa

SEQ ID NO: 3233415 - DNA, 15 bp, Homo sapiens
caaaggctggtggca

SEQ ID NO: 3233416 - DNA, 15 bp, Homo sapiens
caaagggagggagca

SEQ ID NO: 3233417 - DNA, 16 bp, Homo sapiens
caaagggagggagcaa

SEQ ID NO: 3233418 - DNA, 17 bp, Homo sapiens
caaagggagggagcaag

SEQ ID NO: 3233419 - DNA, 20 bp, Homo sapiens
caaaggggctgctggggcat

SEQ ID NO: 3233420 - DNA, 20 bp, Homo sapiens
caaagggtatcaggtgctgc

SEQ ID NO: 3233421 - DNA, 11 bp, Homo sapiens
caaagggtctt

SEQ ID NO: 3233422 - DNA, 14 bp, Homo sapiens
caaaggtataattt

SEQ ID NO: 3233423 - DNA, 13 bp, Homo sapiens
caaaggtcttttt

SEQ ID NO: 3233424 - DNA, 21 bp, Homo sapiens
caaaggttctaggtttcaaag

SEQ ID NO: 3233425 - DNA, 11 bp, Homo sapiens
caaaggttttc

SEQ ID NO: 3233426 - DNA, 18 bp, Homo sapiens
caaagtaaaggcctcctc

SEQ ID NO: 3233427 - DNA, 23 bp, Homo sapiens
caaagtaaaggcctcctccccca

SEQ ID NO: 3233428 - DNA, 20 bp, Homo sapiens
caaagtaaataaaagtacaa

SEQ ID NO: 3233429 - DNA, 20 bp, Homo sapiens
caaagtaaatacaagactgt

SEQ ID NO: 3233430 - DNA, 15 bp, Homo sapiens
caacccaaaccatga

SEQ ID NO: 3233431 - DNA, 20 bp, Homo sapiens
caacccacaccgtcttcctt

SEQ ID NO: 3233432 - DNA, 17 bp, Homo sapiens
caacccacctctggccc

SEQ ID NO: 3233433 - DNA, 19 bp, Homo sapiens
caacccacctctggccctg

SEQ ID NO: 3233434 - DNA, 23 bp, Homo sapiens
caacccacctctggccctgtgta

SEQ ID NO: 3233435 - DNA, 21 bp, Homo sapiens
caacccagccgtcgtctccct

SEQ ID NO: 3233436 - DNA, 18 bp, Homo sapiens
caacccattcactacagg

SEQ ID NO: 3233437 - DNA, 18 bp, Homo sapiens
caaccccaaacccaagtg

SEQ ID NO: 3233438 - DNA, 12 bp, Homo sapiens
caaccccagccg

SEQ ID NO: 3233439 - DNA, 14 bp, Homo sapiens
caaccccagccgct

SEQ ID NO: 3233440 - DNA, 14 bp, Homo sapiens
caacccccacccca

SEQ ID NO: 3233441 - DNA, 17 bp, Homo sapiens
caacccccaccccacac

SEQ ID NO: 3233442 - DNA, 23 bp, Homo sapiens
caacccccaccccacacttgttc

SEQ ID NO: 3233443 - DNA, 15 bp, Homo sapiens
caacccccagcctgc

SEQ ID NO: 3233444 - DNA, 16 bp, Homo sapiens
caacccccagcctgct

SEQ ID NO: 3233445 - DNA, 16 bp, Homo sapiens
caacccccatttctat

SEQ ID NO: 3233446 - DNA, 15 bp, Homo sapiens
caacccccctcctgc

SEQ ID NO: 3233447 - DNA, 16 bp, Homo sapiens
caacccccctcctgct

SEQ ID NO: 3233448 - DNA, 17 bp, Homo sapiens
caacccccctcctgctc

SEQ ID NO: 3233449 - DNA, 21 bp, Homo sapiens
caacccccctcctgctcctcc

SEQ ID NO: 3233450 - DNA, 22 bp, Homo sapiens
caacccccctcctgctcctccc

SEQ ID NO: 3233451 - DNA, 23 bp, Homo sapiens
caacccccgccacctcagggcac

SEQ ID NO: 3233452 - DNA, 10 bp, Homo sapiens
caacccctga

SEQ ID NO: 3233453 - DNA, 13 bp, Homo sapiens
caacccctgagga

SEQ ID NO: 3233454 - DNA, 16 bp, Homo sapiens
caacccctgaggaaga

SEQ ID NO: 3233455 - DNA, 17 bp, Homo sapiens
caaccccttcgctcctg

SEQ ID NO: 3233456 - DNA, 18 bp, Homo sapiens
caaccccttcgctcctgt

SEQ ID NO: 3233457 - DNA, 19 bp, Homo sapiens
caaccctaggttccctgtt

SEQ ID NO: 3233458 - DNA, 19 bp, Homo sapiens
caaccctatctcctgacag

SEQ ID NO: 3233459 - DNA, 13 bp, Homo sapiens
caaccctcagagc

SEQ ID NO: 3233460 - DNA, 23 bp, Homo sapiens
caaccctggggaaggagccagtt

SEQ ID NO: 3233461 - DNA, 15 bp, Homo sapiens
caacccttacccctt

SEQ ID NO: 3233462 - DNA, 18 bp, Homo sapiens
caaccgacagctcttact

SEQ ID NO: 3233463 - DNA, 18 bp, Homo sapiens
caaccgttggaaacataa

SEQ ID NO: 3233464 - DNA, 13 bp, Homo sapiens
caacctaaatttg

SEQ ID NO: 3233465 - DNA, 14 bp, Homo sapiens
caacctcattgaca

SEQ ID NO: 3233466 - DNA, 15 bp, Homo sapiens
caacctccctcttgt

SEQ ID NO: 3233467 - DNA, 18 bp, Homo sapiens
caacctccctcttgtttt

SEQ ID NO: 3233468 - DNA, 17 bp, Homo sapiens
caacctctcactcccca

SEQ ID NO: 3233469 - DNA, 15 bp, Homo sapiens
caacctctctgatct

SEQ ID NO: 3233470 - DNA, 23 bp, Homo sapiens
caacctctctgatcttgtgctca

SEQ ID NO: 3233471 - DNA, 14 bp, Homo sapiens
caacctctgcctcc

SEQ ID NO: 3233472 - DNA, 15 bp, Homo sapiens
caacctctgcctccc

SEQ ID NO: 3233473 - DNA, 13 bp, Homo sapiens
caacctgaaagac

SEQ ID NO: 3233474 - DNA, 12 bp, Homo sapiens
caacctgcactc

SEQ ID NO: 3233475 - DNA, 14 bp, Homo sapiens
caacctgggtccaa

SEQ ID NO: 3233476 - DNA, 17 bp, Homo sapiens
caacctgggtccaaata

SEQ ID NO: 3233477 - DNA, 14 bp, Homo sapiens
caacctggtggcac

SEQ ID NO: 3233478 - DNA, 14 bp, Homo sapiens
caaccttcggctcc

SEQ ID NO: 3233479 - DNA, 16 bp, Homo sapiens
caaccttctgtggctc

SEQ ID NO: 3233480 - DNA, 19 bp, Homo sapiens
caaccttctgtggctcaca

SEQ ID NO: 3233481 - DNA, 14 bp, Homo sapiens
caacctttaaaatt

SEQ ID NO: 3233482 - DNA, 13 bp, Homo sapiens
caacgaagaaaaa

SEQ ID NO: 3233483 - DNA, 20 bp, Homo sapiens
caacgaagaaaaaaaataac

SEQ ID NO: 3233484 - DNA, 15 bp, Homo sapiens
caacgcacaaatgac

SEQ ID NO: 3233485 - DNA, 20 bp, Homo sapiens
caacggccctgcagccagct

SEQ ID NO: 3233486 - DNA, 23 bp, Homo sapiens
caacgggattgaagggtcctgcc

SEQ ID NO: 3233487 - DNA, 15 bp, Homo sapiens
caacgtagcttctac

SEQ ID NO: 3233488 - DNA, 15 bp, Homo sapiens
caacgttactcaggg

SEQ ID NO: 3233489 - DNA, 22 bp, Homo sapiens
caacgttactcagggctcctcc

SEQ ID NO: 3233490 - DNA, 16 bp, Homo sapiens
caacgttcgatttcta

SEQ ID NO: 3233491 - DNA, 17 bp, Homo sapiens
caacgttcgatttctac

SEQ ID NO: 3233492 - DNA, 23 bp, Homo sapiens
caacgtttacaccgactagccag

SEQ ID NO: 3233493 - DNA, 22 bp, Homo sapiens
caactaaatgagattatatgtg

SEQ ID NO: 3233494 - DNA, 16 bp, Homo sapiens
caactaagcagtccct

SEQ ID NO: 3233495 - DNA, 14 bp, Homo sapiens
caactaagccctcg

SEQ ID NO: 3233496 - DNA, 18 bp, Homo sapiens
caactacacaaagcaggc

SEQ ID NO: 3233497 - DNA, 15 bp, Homo sapiens
caactacctgagcta

SEQ ID NO: 3233498 - DNA, 21 bp, Homo sapiens
caactacctgagctaaataaa

SEQ ID NO: 3233499 - DNA, 22 bp, Homo sapiens
caactacggttgggagaatgag

SEQ ID NO: 3233500 - DNA, 21 bp, Homo sapiens
caactactaatagaataaagg

SEQ ID NO: 3233501 - DNA, 14 bp, Homo sapiens
caactactcagaag

SEQ ID NO: 3233502 - DNA, 15 bp, Homo sapiens
caactagacattacc

SEQ ID NO: 3233503 - DNA, 15 bp, Homo sapiens
caactagacattctg

SEQ ID NO: 3233504 - DNA, 17 bp, Homo sapiens
caactagacattctgtc

SEQ ID NO: 3233505 - DNA, 12 bp, Homo sapiens
caactagatttg

SEQ ID NO: 3233506 - DNA, 13 bp, Homo sapiens
caactagccaagg

SEQ ID NO: 3233507 - DNA, 12 bp, Homo sapiens
caactattttat

SEQ ID NO: 3233508 - DNA, 15 bp, Homo sapiens
caactatttttccaa

SEQ ID NO: 3233509 - DNA, 18 bp, Homo sapiens
caactcaaaaaacattgt

SEQ ID NO: 3233510 - DNA, 13 bp, Homo sapiens
caactccaaaacc

SEQ ID NO: 3233511 - DNA, 23 bp, Homo sapiens
caactccaccagatagcagaggg

SEQ ID NO: 3233512 - DNA, 22 bp, Homo sapiens
caactccagcaacttcttctcc

SEQ ID NO: 3233513 - DNA, 13 bp, Homo sapiens
caactcccttgca

SEQ ID NO: 3233514 - DNA, 14 bp, Homo sapiens
caactcgctttagg

SEQ ID NO: 3233515 - DNA, 16 bp, Homo sapiens
caactctaacaggcac

SEQ ID NO: 3233516 - DNA, 17 bp, Homo sapiens
caactctaacaggcact

SEQ ID NO: 3233517 - DNA, 13 bp, Homo sapiens
caactctgagccc

SEQ ID NO: 3233518 - DNA, 14 bp, Homo sapiens
caactctgagccca

SEQ ID NO: 3233519 - DNA, 15 bp, Homo sapiens
caactctgagcccat

SEQ ID NO: 3233520 - DNA, 16 bp, Homo sapiens
caactctgagcccata

SEQ ID NO: 3233521 - DNA, 19 bp, Homo sapiens
caactcttcgaagccttgc

SEQ ID NO: 3233522 - DNA, 19 bp, Homo sapiens
caactgaacgacaaagcat

SEQ ID NO: 3233523 - DNA, 11 bp, Homo sapiens
caactgacaca

SEQ ID NO: 3233524 - DNA, 18 bp, Homo sapiens
caactgcaaaaaaagcct

SEQ ID NO: 3233525 - DNA, 20 bp, Homo sapiens
caactgcaaaaaaagcctcc

SEQ ID NO: 3233526 - DNA, 23 bp, Homo sapiens
caactgcaaagaaagtgggaggt

SEQ ID NO: 3233527 - DNA, 14 bp, Homo sapiens
caactgcctactcc

SEQ ID NO: 3233528 - DNA, 21 bp, Homo sapiens
caactgcctcgaaacacagaa

SEQ ID NO: 3233529 - DNA, 13 bp, Homo sapiens
caactgcctgcct

SEQ ID NO: 3233530 - DNA, 14 bp, Homo sapiens
caactgctgctttt

SEQ ID NO: 3233531 - DNA, 18 bp, Homo sapiens
caactggccctatttaga

SEQ ID NO: 3233532 - DNA, 19 bp, Homo sapiens
caactggccctatttagat

SEQ ID NO: 3233533 - DNA, 23 bp, Homo sapiens
caactggccctatttagatgata

SEQ ID NO: 3233534 - DNA, 13 bp, Homo sapiens
caactgggcccaa

SEQ ID NO: 3233535 - DNA, 16 bp, Homo sapiens
caactgtgttcattag

SEQ ID NO: 3233536 - DNA, 15 bp, Homo sapiens
caactgtgttgtatt

SEQ ID NO: 3233537 - DNA, 15 bp, Homo sapiens
caactgtttccctgc

SEQ ID NO: 3233538 - DNA, 16 bp, Homo sapiens
caactgtttccctgct

SEQ ID NO: 3233539 - DNA, 15 bp, Homo sapiens
caacttatttaaaaa

SEQ ID NO: 3233540 - DNA, 20 bp, Homo sapiens
caacttcagttttatttttg

SEQ ID NO: 3233541 - DNA, 19 bp, Homo sapiens
caacttcatgtcaacttct

SEQ ID NO: 3233542 - DNA, 13 bp, Homo sapiens
caacttgagggcc

SEQ ID NO: 3233543 - DNA, 20 bp, Homo sapiens
caacttgagggcccagagca

SEQ ID NO: 3233544 - DNA, 18 bp, Homo sapiens
caacttggttctgcttca

SEQ ID NO: 3233545 - DNA, 19 bp, Homo sapiens
caacttggttctgcttcaa

SEQ ID NO: 3233546 - DNA, 19 bp, Homo sapiens
caacttgtctttttctgga

SEQ ID NO: 3233547 - DNA, 21 bp, Homo sapiens
caacttgttgtggctcttatt

SEQ ID NO: 3233548 - DNA, 21 bp, Homo sapiens
caactttaagcagctcttgct

SEQ ID NO: 3233549 - DNA, 12 bp, Homo sapiens
caactttactgt

SEQ ID NO: 3233550 - DNA, 19 bp, Homo sapiens
caactttatcatggaattt

SEQ ID NO: 3233551 - DNA, 12 bp, Homo sapiens
caactttctgta

SEQ ID NO: 3233552 - DNA, 14 bp, Homo sapiens
caacttttaaagct

SEQ ID NO: 3233553 - DNA, 17 bp, Homo sapiens
caacttttaattactgt

SEQ ID NO: 3233554 - DNA, 21 bp, Homo sapiens
caacttttaattactgttttc

SEQ ID NO: 3233555 - DNA, 21 bp, Homo sapiens
caacttttgtgtaatgaaaat

SEQ ID NO: 3233556 - DNA, 12 bp, Homo sapiens
caagaaaatctt

SEQ ID NO: 3233557 - DNA, 18 bp, Homo sapiens
caataaagtgccttctgg

SEQ ID NO: 3233558 - DNA, 15 bp, Homo sapiens
caataaataacactt

SEQ ID NO: 3233559 - DNA, 18 bp, Homo sapiens
caataaatgctctatttt

SEQ ID NO: 3233560 - DNA, 14 bp, Homo sapiens
caataaatgtctgt

SEQ ID NO: 3233561 - DNA, 16 bp, Homo sapiens
caataaatgtctgttg

SEQ ID NO: 3233562 - DNA, 16 bp, Homo sapiens
caataacccagttact

SEQ ID NO: 3233563 - DNA, 15 bp, Homo sapiens
caataactactgtgt

SEQ ID NO: 3233564 - DNA, 17 bp, Homo sapiens
caataactactgtgttc

SEQ ID NO: 3233565 - DNA, 22 bp, Homo sapiens
caataactactgtgttcctggc

SEQ ID NO: 3233566 - DNA, 16 bp, Homo sapiens
caataacttctgacct

SEQ ID NO: 3233567 - DNA, 21 bp, Homo sapiens
caataatattgttgtataatt

SEQ ID NO: 3233568 - DNA, 14 bp, Homo sapiens
caataatatttcaa

SEQ ID NO: 3233569 - DNA, 19 bp, Homo sapiens
caataatatttcaagtgcc

SEQ ID NO: 3233570 - DNA, 20 bp, Homo sapiens
caataatatttcaagtgcct

SEQ ID NO: 3233571 - DNA, 15 bp, Homo sapiens
caataatcagaaaag

SEQ ID NO: 3233572 - DNA, 16 bp, Homo sapiens
caatacaaatggattt

SEQ ID NO: 3233573 - DNA, 22 bp, Homo sapiens
caatacacataagaccgtgtcc

SEQ ID NO: 3233574 - DNA, 11 bp, Homo sapiens
caatactacct

SEQ ID NO: 3233575 - DNA, 17 bp, Homo sapiens
caatactagtcacccca

SEQ ID NO: 3233576 - DNA, 21 bp, Homo sapiens
caatactgtatgccttctgta

SEQ ID NO: 3233577 - DNA, 15 bp, Homo sapiens
caatagagactgtag

SEQ ID NO: 3233578 - DNA, 15 bp, Homo sapiens
caatagatctccagc

SEQ ID NO: 3233579 - DNA, 16 bp, Homo sapiens
caatagatctccagcg

SEQ ID NO: 3233580 - DNA, 21 bp, Homo sapiens
caatagatttaggagcagaaa

SEQ ID NO: 3233581 - DNA, 21 bp, Homo sapiens
caatagcactttcattgccag

SEQ ID NO: 3233582 - DNA, 23 bp, Homo sapiens
caatagcactttcattgccagtg

SEQ ID NO: 3233583 - DNA, 16 bp, Homo sapiens
caatagcagttataac

SEQ ID NO: 3233584 - DNA, 18 bp, Homo sapiens
caatagctttaccctcag

SEQ ID NO: 3233585 - DNA, 21 bp, Homo sapiens
caatagctttaccctcaggca

SEQ ID NO: 3233586 - DNA, 23 bp, Homo sapiens
caatagctttaccctcaggcata

SEQ ID NO: 3233587 - DNA, 17 bp, Homo sapiens
caataggcaaattaatc

SEQ ID NO: 3233588 - DNA, 15 bp, Homo sapiens
caataggctgttccc

SEQ ID NO: 3233589 - DNA, 16 bp, Homo sapiens
caatagggtagaatga

SEQ ID NO: 3233590 - DNA, 18 bp, Homo sapiens
caataggtctttctctca

SEQ ID NO: 3233591 - DNA, 18 bp, Homo sapiens
caatagtatttctccttt

SEQ ID NO: 3233592 - DNA, 16 bp, Homo sapiens
caatagtgggccctcc

SEQ ID NO: 3233593 - DNA, 14 bp, Homo sapiens
caatagtgtgttct

SEQ ID NO: 3233594 - DNA, 22 bp, Homo sapiens
caatatagaaaaataaaaatct

SEQ ID NO: 3233595 - DNA, 15 bp, Homo sapiens
caatatctaatatat

SEQ ID NO: 3233596 - DNA, 21 bp, Homo sapiens
caatatgaattcaagaaagga

SEQ ID NO: 3233597 - DNA, 19 bp, Homo sapiens
caatatgcaagcagctttt

SEQ ID NO: 3233598 - DNA, 11 bp, Homo sapiens
caatatgctta

SEQ ID NO: 3233599 - DNA, 12 bp, Homo sapiens
caatatgcttac

SEQ ID NO: 3233600 - DNA, 14 bp, Homo sapiens
caatatgtatgctt

SEQ ID NO: 3233601 - DNA, 17 bp, Homo sapiens
caatatgtgagtgcctt

SEQ ID NO: 3233602 - DNA, 21 bp, Homo sapiens
caatattaaagggtctggaaa

SEQ ID NO: 3233603 - DNA, 22 bp, Homo sapiens
caatattaaatacagacactaa

SEQ ID NO: 3233604 - DNA, 14 bp, Homo sapiens
caatattaaatctg

SEQ ID NO: 3233605 - DNA, 15 bp, Homo sapiens
caatattaaatctgc

SEQ ID NO: 3233606 - DNA, 23 bp, Homo sapiens
caatattaccttaagatttttct

SEQ ID NO: 3233607 - DNA, 22 bp, Homo sapiens
caatattataatttttttcaat

SEQ ID NO: 3233608 - DNA, 19 bp, Homo sapiens
caatattatactaagaaaa

SEQ ID NO: 3233609 - DNA, 23 bp, Homo sapiens
caatattatactaagaaaagata

SEQ ID NO: 3233610 - DNA, 19 bp, Homo sapiens
caatattcaatcaaaattt

SEQ ID NO: 3233611 - DNA, 19 bp, Homo sapiens
caatattccagatctttca

SEQ ID NO: 3233612 - DNA, 12 bp, Homo sapiens
caatattgtata

SEQ ID NO: 3233613 - DNA, 14 bp, Homo sapiens
caatattgtatatt

SEQ ID NO: 3233614 - DNA, 19 bp, Homo sapiens
caatatttattattttcac

SEQ ID NO: 3233615 - DNA, 15 bp, Homo sapiens
caatatttgaatttt

SEQ ID NO: 3233616 - DNA, 16 bp, Homo sapiens
caatatttgttactgt

SEQ ID NO: 3233617 - DNA, 14 bp, Homo sapiens
caatatttttagat

SEQ ID NO: 3233618 - DNA, 20 bp, Homo sapiens
caatatttttatatcatgca

SEQ ID NO: 3233619 - DNA, 22 bp, Homo sapiens
caatatttttatatcatgcaaa

SEQ ID NO: 3233620 - DNA, 23 bp, Homo sapiens
caatatttttatatcatgcaaaa

SEQ ID NO: 3233621 - DNA, 19 bp, Homo sapiens
caatcaaagaattacagta

SEQ ID NO: 3233622 - DNA, 15 bp, Homo sapiens
caatcaactttactg

SEQ ID NO: 3233623 - DNA, 23 bp, Homo sapiens
caatcactgaaacaaaaattgtc

SEQ ID NO: 3233624 - DNA, 11 bp, Homo sapiens
caatcactgtc

SEQ ID NO: 3233625 - DNA, 12 bp, Homo sapiens
caatcagcactg

SEQ ID NO: 3233626 - DNA, 15 bp, Homo sapiens
caatcagcactgaaa

SEQ ID NO: 3233627 - DNA, 11 bp, Homo sapiens
caatcagctcc

SEQ ID NO: 3233628 - DNA, 17 bp, Homo sapiens
caatcagctccttttcc

SEQ ID NO: 3233629 - DNA, 16 bp, Homo sapiens
caatcagtcccctccc

SEQ ID NO: 3233630 - DNA, 17 bp, Homo sapiens
caatcatcaaaaagtaa

SEQ ID NO: 3233631 - DNA, 19 bp, Homo sapiens
caatcatctgtgtgaaaat

SEQ ID NO: 3233632 - DNA, 21 bp, Homo sapiens
caatcatgaacagctctgaga

SEQ ID NO: 3233633 - DNA, 12 bp, Homo sapiens
caatcattgaag

SEQ ID NO: 3233634 - DNA, 12 bp, Homo sapiens
caatcattgttt

SEQ ID NO: 3233635 - DNA, 17 bp, Homo sapiens
caatcattgttttgaat

SEQ ID NO: 3233636 - DNA, 19 bp, Homo sapiens
caatcattgttttgaatat

SEQ ID NO: 3233637 - DNA, 12 bp, Homo sapiens
caatcatttctc

SEQ ID NO: 3233638 - DNA, 17 bp, Homo sapiens
caatcattttaattatt

SEQ ID NO: 3233639 - DNA, 22 bp, Homo sapiens
caatccatgttagtttttactt

SEQ ID NO: 3233640 - DNA, 18 bp, Homo sapiens
caatcccaaaagtcacca

SEQ ID NO: 3233641 - DNA, 17 bp, Homo sapiens
caatcccaatctttcta

SEQ ID NO: 3233642 - DNA, 17 bp, Homo sapiens
caatcccaattctgtcc

SEQ ID NO: 3233643 - DNA, 19 bp, Homo sapiens
caatcccacctagcccagg

SEQ ID NO: 3233644 - DNA, 16 bp, Homo sapiens
caatcccctccttggg

SEQ ID NO: 3233645 - DNA, 17 bp, Homo sapiens
caatcctaacacattat

SEQ ID NO: 3233646 - DNA, 19 bp, Homo sapiens
caatcctaatttctcctcc

SEQ ID NO: 3233647 - DNA, 14 bp, Homo sapiens
caatcctcactggg

SEQ ID NO: 3233648 - DNA, 19 bp, Homo sapiens
caatcctggctctgtggct

SEQ ID NO: 3233649 - DNA, 21 bp, Homo sapiens
caatccttcttatgtttgctt

SEQ ID NO: 3233650 - DNA, 15 bp, Homo sapiens
caatcctttgagtta

SEQ ID NO: 3233651 - DNA, 19 bp, Homo sapiens
caatctaacaataatattt

SEQ ID NO: 3233652 - DNA, 13 bp, Homo sapiens
caatctattctca

SEQ ID NO: 3233653 - DNA, 14 bp, Homo sapiens
caatctcaaggaat

SEQ ID NO: 3233654 - DNA, 19 bp, Homo sapiens
caatctctacccctttctt

SEQ ID NO: 3233655 - DNA, 14 bp, Homo sapiens
caatctctggtgcc

SEQ ID NO: 3233656 - DNA, 15 bp, Homo sapiens
caatctctggtgcct

SEQ ID NO: 3233657 - DNA, 23 bp, Homo sapiens
caatctctgttctgtttggcact

SEQ ID NO: 3233658 - DNA, 20 bp, Homo sapiens
caatctggatgcctcattat

SEQ ID NO: 3233659 - DNA, 18 bp, Homo sapiens
caatctggcttagtgcca

SEQ ID NO: 3233660 - DNA, 16 bp, Homo sapiens
caatctggtaatggtg

SEQ ID NO: 3233661 - DNA, 12 bp, Homo sapiens
caatctgtaaac

SEQ ID NO: 3233662 - DNA, 17 bp, Homo sapiens
caatctgtaaactgtgt

SEQ ID NO: 3233663 - DNA, 20 bp, Homo sapiens
caatctgtgtaagaaaacaa

SEQ ID NO: 3233664 - DNA, 16 bp, Homo sapiens
caatcttaaacataat

SEQ ID NO: 3233665 - DNA, 20 bp, Homo sapiens
caatcttaccagatgctact

SEQ ID NO: 3233666 - DNA, 12 bp, Homo sapiens
caatctttctat

SEQ ID NO: 3233667 - DNA, 13 bp, Homo sapiens
caatctttctata

SEQ ID NO: 3233668 - DNA, 13 bp, Homo sapiens
caatctttgctgt

SEQ ID NO: 3233669 - DNA, 16 bp, Homo sapiens
caatcttttttactct

SEQ ID NO: 3233670 - DNA, 19 bp, Homo sapiens
caatgaaaactctttgctg

SEQ ID NO: 3233671 - DNA, 20 bp, Homo sapiens
caatgaaaagtcgttttcca

SEQ ID NO: 3233672 - DNA, 23 bp, Homo sapiens
caatgaaatacacaagtaaacat

SEQ ID NO: 3233673 - DNA, 19 bp, Homo sapiens
caatgaaatgaattaaagt

SEQ ID NO: 3233674 - DNA, 19 bp, Homo sapiens
caatgaactgcttttcctc

SEQ ID NO: 3233675 - DNA, 20 bp, Homo sapiens
caatgaactgcttttcctca

SEQ ID NO: 3233676 - DNA, 23 bp, Homo sapiens
caatgaattttataatctgcagc

SEQ ID NO: 3233677 - DNA, 16 bp, Homo sapiens
caatgacatctcaggg

SEQ ID NO: 3233678 - DNA, 22 bp, Homo sapiens
caatgacatctcaggggccaga

SEQ ID NO: 3233679 - DNA, 15 bp, Homo sapiens
caatgacatcttcaa

SEQ ID NO: 3233680 - DNA, 18 bp, Homo sapiens
caatgactagtcacctgg

SEQ ID NO: 3233681 - DNA, 17 bp, Homo sapiens
caatgactgtgctactg

SEQ ID NO: 3233682 - DNA, 19 bp, Homo sapiens
caatgatgatgataatgat

SEQ ID NO: 3233683 - DNA, 12 bp, Homo sapiens
cacaggaaaagg

SEQ ID NO: 3233684 - DNA, 19 bp, Homo sapiens
cacaggaagtttggagcct

SEQ ID NO: 3233685 - DNA, 15 bp, Homo sapiens
cacaggactctgcct

SEQ ID NO: 3233686 - DNA, 21 bp, Homo sapiens
cacaggactgattctgggatg

SEQ ID NO: 3233687 - DNA, 15 bp, Homo sapiens
cacaggagacactgt

SEQ ID NO: 3233688 - DNA, 19 bp, Homo sapiens
cacaggaggcaagcaagct

SEQ ID NO: 3233689 - DNA, 20 bp, Homo sapiens
cacaggaggcaagcaagctc

SEQ ID NO: 3233690 - DNA, 13 bp, Homo sapiens
cacaggaggccag

SEQ ID NO: 3233691 - DNA, 18 bp, Homo sapiens
cacaggaggccagtgggc

SEQ ID NO: 3233692 - DNA, 17 bp, Homo sapiens
cacaggatcagtctgat

SEQ ID NO: 3233693 - DNA, 15 bp, Homo sapiens
cacaggatgccagcc

SEQ ID NO: 3233694 - DNA, 20 bp, Homo sapiens
cacaggatgccagcccctgc

SEQ ID NO: 3233695 - DNA, 22 bp, Homo sapiens
cacaggatgccagcccctgcct

SEQ ID NO: 3233696 - DNA, 24 bp, Homo sapiens
cacaggatgccagcccctgcctgg

SEQ ID NO: 3233697 - DNA, 18 bp, Homo sapiens
cacaggcacacagggccc

SEQ ID NO: 3233698 - DNA, 20 bp, Homo sapiens
cacaggcacacaggtctcat

SEQ ID NO: 3233699 - DNA, 15 bp, Homo sapiens
cacaggcagctttct

SEQ ID NO: 3233700 - DNA, 18 bp, Homo sapiens
cacaggcagctttctaga

SEQ ID NO: 3233701 - DNA, 19 bp, Homo sapiens
cacaggcagctttctagaa

SEQ ID NO: 3233702 - DNA, 11 bp, Homo sapiens
cacaggcaggt

SEQ ID NO: 3233703 - DNA, 19 bp, Homo sapiens
cacaggcaggtccagggtt

SEQ ID NO: 3233704 - DNA, 13 bp, Homo sapiens
cacaggcagtgca

SEQ ID NO: 3233705 - DNA, 16 bp, Homo sapiens
cacaggcagtgcatgt

SEQ ID NO: 3233706 - DNA, 17 bp, Homo sapiens
cacaggcccggctccag

SEQ ID NO: 3233707 - DNA, 19 bp, Homo sapiens
cacaggcccggctccaggc

SEQ ID NO: 3233708 - DNA, 17 bp, Homo sapiens
cacaggccctggagaag

SEQ ID NO: 3233709 - DNA, 16 bp, Homo sapiens
cacaggcccttcctct

SEQ ID NO: 3233710 - DNA, 17 bp, Homo sapiens
cacaggcccttcctctc

SEQ ID NO: 3233711 - DNA, 14 bp, Homo sapiens
cacaggcctccctg

SEQ ID NO: 3233712 - DNA, 11 bp, Homo sapiens
cacaggcctct

SEQ ID NO: 3233713 - DNA, 13 bp, Homo sapiens
cacaggcctctct

SEQ ID NO: 3233714 - DNA, 21 bp, Homo sapiens
cacaggcctctcttttccccg

SEQ ID NO: 3233715 - DNA, 19 bp, Homo sapiens
cacaggctgtaaattgaac

SEQ ID NO: 3233716 - DNA, 20 bp, Homo sapiens
cacagggagtgcacatatcc

SEQ ID NO: 3233717 - DNA, 14 bp, Homo sapiens
cacagggcaccaga

SEQ ID NO: 3233718 - DNA, 16 bp, Homo sapiens
cacagggccagaggga

SEQ ID NO: 3233719 - DNA, 17 bp, Homo sapiens
cacagggccagagggag

SEQ ID NO: 3233720 - DNA, 22 bp, Homo sapiens
cacagggccccagaaggcaggg

SEQ ID NO: 3233721 - DNA, 22 bp, Homo sapiens
cacagggcccggccacacccag

SEQ ID NO: 3233722 - DNA, 13 bp, Homo sapiens
cacagggcgagac

SEQ ID NO: 3233723 - DNA, 14 bp, Homo sapiens
cacagggcggtacc

SEQ ID NO: 3233724 - DNA, 13 bp, Homo sapiens
cacagggctcttt

SEQ ID NO: 3233725 - DNA, 16 bp, Homo sapiens
cacagggctctttgat

SEQ ID NO: 3233726 - DNA, 13 bp, Homo sapiens
cacaggggcaggc

SEQ ID NO: 3233727 - DNA, 14 bp, Homo sapiens
cacaggggcaggcc

SEQ ID NO: 3233728 - DNA, 18 bp, Homo sapiens
cacaggggcaggcctggg

SEQ ID NO: 3233729 - DNA, 19 bp, Homo sapiens
cacaggggcaggcctggga

SEQ ID NO: 3233730 - DNA, 14 bp, Homo sapiens
cacaggggccccag

SEQ ID NO: 3233731 - DNA, 18 bp, Homo sapiens
cacaggggccccagatct

SEQ ID NO: 3233732 - DNA, 23 bp, Homo sapiens
cacaggggccccagatctgcctg

SEQ ID NO: 3233733 - DNA, 18 bp, Homo sapiens
cacaggggcggggcagga

SEQ ID NO: 3233734 - DNA, 19 bp, Homo sapiens
cacaggggtggagtttctg

SEQ ID NO: 3233735 - DNA, 16 bp, Homo sapiens
cacagggttgggccca

SEQ ID NO: 3233736 - DNA, 18 bp, Homo sapiens
cacagggttgggcccaga

SEQ ID NO: 3233737 - DNA, 14 bp, Homo sapiens
cacaggtcccacct

SEQ ID NO: 3233738 - DNA, 21 bp, Homo sapiens
cacaggtcccacctccagccc

SEQ ID NO: 3233739 - DNA, 21 bp, Homo sapiens
cacaggttggaagagaatcac

SEQ ID NO: 3233740 - DNA, 18 bp, Homo sapiens
cacagtacagcatgtgcc

SEQ ID NO: 3233741 - DNA, 20 bp, Homo sapiens
cacagtacagcatgtgcctt

SEQ ID NO: 3233742 - DNA, 15 bp, Homo sapiens
cacagtagagccagc

SEQ ID NO: 3233743 - DNA, 16 bp, Homo sapiens
cacagtagagccagct

SEQ ID NO: 3233744 - DNA, 13 bp, Homo sapiens
cacagtagtcttg

SEQ ID NO: 3233745 - DNA, 16 bp, Homo sapiens
cacagtattacttctg

SEQ ID NO: 3233746 - DNA, 18 bp, Homo sapiens
cacagtattacttctgct

SEQ ID NO: 3233747 - DNA, 21 bp, Homo sapiens
cacagtattacttctgctaca

SEQ ID NO: 3233748 - DNA, 16 bp, Homo sapiens
cacagtcaaaataatt

SEQ ID NO: 3233749 - DNA, 17 bp, Homo sapiens
cacagtcaaaataattc

SEQ ID NO: 3233750 - DNA, 19 bp, Homo sapiens
cacagtcaaatttacattt

SEQ ID NO: 3233751 - DNA, 15 bp, Homo sapiens
cacagtcacattcga

SEQ ID NO: 3233752 - DNA, 19 bp, Homo sapiens
cacagtcactgatgtacaa

SEQ ID NO: 3233753 - DNA, 13 bp, Homo sapiens
cacagtcagcatg

SEQ ID NO: 3233754 - DNA, 12 bp, Homo sapiens
cacagtgaaacg

SEQ ID NO: 3233755 - DNA, 21 bp, Homo sapiens
cacagtgagtcgaggacaggg

SEQ ID NO: 3233756 - DNA, 14 bp, Homo sapiens
cacagtgatttttt

SEQ ID NO: 3233757 - DNA, 17 bp, Homo sapiens
cacagtgcatctcagcc

SEQ ID NO: 3233758 - DNA, 18 bp, Homo sapiens
cacagtgcatctcagccc

SEQ ID NO: 3233759 - DNA, 19 bp, Homo sapiens
cacagtgcatctcagccca

SEQ ID NO: 3233760 - DNA, 17 bp, Homo sapiens
cacagtgctgcttctct

SEQ ID NO: 3233761 - DNA, 21 bp, Homo sapiens
cacagtggactcagcagtgac

SEQ ID NO: 3233762 - DNA, 13 bp, Homo sapiens
cacagtgggagct

SEQ ID NO: 3233763 - DNA, 20 bp, Homo sapiens
cacagtgtaatccaggggtg

SEQ ID NO: 3233764 - DNA, 12 bp, Homo sapiens
cacagtgtgtga

SEQ ID NO: 3233765 - DNA, 19 bp, Homo sapiens
cacagtgttttataggaga

SEQ ID NO: 3233766 - DNA, 18 bp, Homo sapiens
cacagttcttggtgactg

SEQ ID NO: 3233767 - DNA, 22 bp, Homo sapiens
cacagttcttggtgactgtccc

SEQ ID NO: 3233768 - DNA, 18 bp, Homo sapiens
cacagttgaagggagggg

SEQ ID NO: 3233769 - DNA, 12 bp, Homo sapiens
cacagttgccac

SEQ ID NO: 3233770 - DNA, 12 bp, Homo sapiens
cacagttggcct

SEQ ID NO: 3233771 - DNA, 21 bp, Homo sapiens
cacagttgtctattctgagcc

SEQ ID NO: 3233772 - DNA, 13 bp, Homo sapiens
cacagttgtgttc

SEQ ID NO: 3233773 - DNA, 20 bp, Homo sapiens
cacagttgtgttcatgctga

SEQ ID NO: 3233774 - DNA, 12 bp, Homo sapiens
cacagtttcatt

SEQ ID NO: 3233775 - DNA, 20 bp, Homo sapiens
cacataaaaaagaagcactt

SEQ ID NO: 3233776 - DNA, 17 bp, Homo sapiens
cacatacagttttatgc

SEQ ID NO: 3233777 - DNA, 23 bp, Homo sapiens
cacatacagttttatgctctttt

SEQ ID NO: 3233778 - DNA, 15 bp, Homo sapiens
cacataccctccccc

SEQ ID NO: 3233779 - DNA, 18 bp, Homo sapiens
cacatagattaatggcac

SEQ ID NO: 3233780 - DNA, 21 bp, Homo sapiens
cacatagattaatggcactga

SEQ ID NO: 3233781 - DNA, 13 bp, Homo sapiens
cacatagatttct

SEQ ID NO: 3233782 - DNA, 19 bp, Homo sapiens
cacatagcgccgtgctgta

SEQ ID NO: 3233783 - DNA, 22 bp, Homo sapiens
cacatagctacccaaaagagaa

SEQ ID NO: 3233784 - DNA, 18 bp, Homo sapiens
cacatatacctataatgt

SEQ ID NO: 3233785 - DNA, 23 bp, Homo sapiens
cacatatacctataatgtgtgta

SEQ ID NO: 3233786 - DNA, 15 bp, Homo sapiens
cacatatccaggcac

SEQ ID NO: 3233787 - DNA, 20 bp, Homo sapiens
cacatatgcaccttgtgtct

SEQ ID NO: 3233788 - DNA, 14 bp, Homo sapiens
cacatcaaaccttt

SEQ ID NO: 3233789 - DNA, 15 bp, Homo sapiens
cacatcaagcttttc

SEQ ID NO: 3233790 - DNA, 20 bp, Homo sapiens
cacatcacaagactatgcca

SEQ ID NO: 3233791 - DNA, 13 bp, Homo sapiens
cacatccattccc

SEQ ID NO: 3233792 - DNA, 14 bp, Homo sapiens
cacatccattccca

SEQ ID NO: 3233793 - DNA, 14 bp, Homo sapiens
cacatccccagaat

SEQ ID NO: 3233794 - DNA, 20 bp, Homo sapiens
cacatcccggcctcttccac

SEQ ID NO: 3233795 - DNA, 21 bp, Homo sapiens
cacatccgccttttgtataca

SEQ ID NO: 3233796 - DNA, 14 bp, Homo sapiens
cacatcctgtgtca

SEQ ID NO: 3233797 - DNA, 21 bp, Homo sapiens
cacatctctgaaagcacagga

SEQ ID NO: 3233798 - DNA, 21 bp, Homo sapiens
cacatctgcattttcacccca

SEQ ID NO: 3233799 - DNA, 15 bp, Homo sapiens
cacatctgccagacc

SEQ ID NO: 3233800 - DNA, 16 bp, Homo sapiens
cacatctgccagacct

SEQ ID NO: 3233801 - DNA, 12 bp, Homo sapiens
cacatctgcctt

SEQ ID NO: 3233802 - DNA, 22 bp, Homo sapiens
cacatcttccctagagggttcc

SEQ ID NO: 3233803 - DNA, 13 bp, Homo sapiens
cacatcttgctct

SEQ ID NO: 3233804 - DNA, 16 bp, Homo sapiens
cacatcttgctctgct

SEQ ID NO: 3233805 - DNA, 19 bp, Homo sapiens
cacatcttgctctgctgac

SEQ ID NO: 3233806 - DNA, 22 bp, Homo sapiens
cacatcttgctctgctgacaga

SEQ ID NO: 3233807 - DNA, 24 bp, Homo sapiens
cacatgaatcccacccacatgtga

SEQ ID NO: 3233808 - DNA, 21 bp, Homo sapiens
cacatgacaactttgccagct

SEQ ID NO: 3233809 - DNA, 14 bp, Homo sapiens
cacctcctcatgta

SEQ ID NO: 3233810 - DNA, 13 bp, Homo sapiens
cacctcctccccc

SEQ ID NO: 3233811 - DNA, 13 bp, Homo sapiens
cacctcggaggga

SEQ ID NO: 3233812 - DNA, 20 bp, Homo sapiens
cacctcggagggatggagaa

SEQ ID NO: 3233813 - DNA, 18 bp, Homo sapiens
cacctcggggacaccaga

SEQ ID NO: 3233814 - DNA, 20 bp, Homo sapiens
cacctcggggacaccagagc

SEQ ID NO: 3233815 - DNA, 15 bp, Homo sapiens
cacctctacccaaac

SEQ ID NO: 3233816 - DNA, 16 bp, Homo sapiens
cacctctacccaaacc

SEQ ID NO: 3233817 - DNA, 18 bp, Homo sapiens
cacctctacccaaaccct

SEQ ID NO: 3233818 - DNA, 22 bp, Homo sapiens
cacctctacccaaaccctaggt

SEQ ID NO: 3233819 - DNA, 14 bp, Homo sapiens
cacctctagcctta

SEQ ID NO: 3233820 - DNA, 11 bp, Homo sapiens
cacctctccaa

SEQ ID NO: 3233821 - DNA, 15 bp, Homo sapiens
cacctctccaagggc

SEQ ID NO: 3233822 - DNA, 23 bp, Homo sapiens
cacctctccaagtctctctgtga

SEQ ID NO: 3233823 - DNA, 12 bp, Homo sapiens
cacctctccctc

SEQ ID NO: 3233824 - DNA, 13 bp, Homo sapiens
cacctctctcaga

SEQ ID NO: 3233825 - DNA, 14 bp, Homo sapiens
cacctctctcagag

SEQ ID NO: 3233826 - DNA, 20 bp, Homo sapiens
cacctctctcagagcatctg

SEQ ID NO: 3233827 - DNA, 18 bp, Homo sapiens
cacctctgcggaccccag

SEQ ID NO: 3233828 - DNA, 19 bp, Homo sapiens
cacctctgcggaccccagc

SEQ ID NO: 3233829 - DNA, 19 bp, Homo sapiens
cacctctggactggctaga

SEQ ID NO: 3233830 - DNA, 17 bp, Homo sapiens
cacctctggtccacact

SEQ ID NO: 3233831 - DNA, 18 bp, Homo sapiens
cacctctggtccacacta

SEQ ID NO: 3233832 - DNA, 13 bp, Homo sapiens
cacctctgtaatt

SEQ ID NO: 3233833 - DNA, 13 bp, Homo sapiens
cacctctgtgacc

SEQ ID NO: 3233834 - DNA, 14 bp, Homo sapiens
cacctctgtgacct

SEQ ID NO: 3233835 - DNA, 22 bp, Homo sapiens
cacctctgtgacctcaggcact

SEQ ID NO: 3233836 - DNA, 23 bp, Homo sapiens
cacctgaaccccatgggcttgga

SEQ ID NO: 3233837 - DNA, 19 bp, Homo sapiens
cacctgacaatggcagcta

SEQ ID NO: 3233838 - DNA, 20 bp, Homo sapiens
cacctgacaatggcagctag

SEQ ID NO: 3233839 - DNA, 16 bp, Homo sapiens
cacctgacacaccagg

SEQ ID NO: 3233840 - DNA, 20 bp, Homo sapiens
cacctgactctgaaatctga

SEQ ID NO: 3233841 - DNA, 23 bp, Homo sapiens
cacctgactctgaaatctgaaga

SEQ ID NO: 3233842 - DNA, 23 bp, Homo sapiens
cacctgagcccggatgcttctcc

SEQ ID NO: 3233843 - DNA, 19 bp, Homo sapiens
cacctgagtcaccctacct

SEQ ID NO: 3233844 - DNA, 23 bp, Homo sapiens
cacctgagtcaccctacctgtgc

SEQ ID NO: 3233845 - DNA, 14 bp, Homo sapiens
cacctgcaagcccc

SEQ ID NO: 3233846 - DNA, 19 bp, Homo sapiens
cacctgcaagccccagggc

SEQ ID NO: 3233847 - DNA, 18 bp, Homo sapiens
cacctgccaccacacaca

SEQ ID NO: 3233848 - DNA, 13 bp, Homo sapiens
cacctgccagcct

SEQ ID NO: 3233849 - DNA, 14 bp, Homo sapiens
cacctgccagcctg

SEQ ID NO: 3233850 - DNA, 16 bp, Homo sapiens
cacctgccagcctggc

SEQ ID NO: 3233851 - DNA, 17 bp, Homo sapiens
cacctgccagcctggct

SEQ ID NO: 3233852 - DNA, 22 bp, Homo sapiens
cacctgccatttgcaccctccg

SEQ ID NO: 3233853 - DNA, 19 bp, Homo sapiens
cacctgcccaacctgctct

SEQ ID NO: 3233854 - DNA, 14 bp, Homo sapiens
cacctgccccctgg

SEQ ID NO: 3233855 - DNA, 22 bp, Homo sapiens
cacctgcctaggtttttcctac

SEQ ID NO: 3233856 - DNA, 19 bp, Homo sapiens
cacctgctgcgtccccact

SEQ ID NO: 3233857 - DNA, 20 bp, Homo sapiens
cacctgcttccacccgtctc

SEQ ID NO: 3233858 - DNA, 19 bp, Homo sapiens
cacctggatctatccctgc

SEQ ID NO: 3233859 - DNA, 23 bp, Homo sapiens
cacctggcatcgcaccattctga

SEQ ID NO: 3233860 - DNA, 14 bp, Homo sapiens
cacctggccacctg

SEQ ID NO: 3233861 - DNA, 17 bp, Homo sapiens
cacctggccacctgagg

SEQ ID NO: 3233862 - DNA, 21 bp, Homo sapiens
cacctggccacctgaggtggg

SEQ ID NO: 3233863 - DNA, 14 bp, Homo sapiens
cacctggcctgctg

SEQ ID NO: 3233864 - DNA, 15 bp, Homo sapiens
cacctggcctgctgg

SEQ ID NO: 3233865 - DNA, 16 bp, Homo sapiens
cacctggcctgctggg

SEQ ID NO: 3233866 - DNA, 18 bp, Homo sapiens
cacctggcctgctgggaa

SEQ ID NO: 3233867 - DNA, 19 bp, Homo sapiens
cacctggctgaggttcctc

SEQ ID NO: 3233868 - DNA, 22 bp, Homo sapiens
cacctggctgaggttcctctgc

SEQ ID NO: 3233869 - DNA, 23 bp, Homo sapiens
cacctggctgaggttcctctgcc

SEQ ID NO: 3233870 - DNA, 15 bp, Homo sapiens
cacctgggccctgga

SEQ ID NO: 3233871 - DNA, 14 bp, Homo sapiens
cacctgtaagaaac

SEQ ID NO: 3233872 - DNA, 23 bp, Homo sapiens
cacctgtactcaggaggctgagg

SEQ ID NO: 3233873 - DNA, 16 bp, Homo sapiens
cacctgtagccatctg

SEQ ID NO: 3233874 - DNA, 22 bp, Homo sapiens
cacctgtagtcccagctacttg

SEQ ID NO: 3233875 - DNA, 15 bp, Homo sapiens
cacctgtctcagcct

SEQ ID NO: 3233876 - DNA, 18 bp, Homo sapiens
cacctgtctcagcctccc

SEQ ID NO: 3233877 - DNA, 19 bp, Homo sapiens
cacctgtctcagcctccca

SEQ ID NO: 3233878 - DNA, 13 bp, Homo sapiens
cacctgtgagatc

SEQ ID NO: 3233879 - DNA, 23 bp, Homo sapiens
cacctgtgcagcgaagcttagcg

SEQ ID NO: 3233880 - DNA, 10 bp, Homo sapiens
cacctgtggg

SEQ ID NO: 3233881 - DNA, 22 bp, Homo sapiens
cacctgtgggtgtagccaggta

SEQ ID NO: 3233882 - DNA, 15 bp, Homo sapiens
cacctgttatgtatg

SEQ ID NO: 3233883 - DNA, 19 bp, Homo sapiens
cacctgttcacagaaaaag

SEQ ID NO: 3233884 - DNA, 20 bp, Homo sapiens
cacctgtttttaagctgttt

SEQ ID NO: 3233885 - DNA, 18 bp, Homo sapiens
caccttaccaactttctg

SEQ ID NO: 3233886 - DNA, 13 bp, Homo sapiens
caccttagctggc

SEQ ID NO: 3233887 - DNA, 18 bp, Homo sapiens
caccttagggtggcttta

SEQ ID NO: 3233888 - DNA, 17 bp, Homo sapiens
caccttcaattcctggg

SEQ ID NO: 3233889 - DNA, 22 bp, Homo sapiens
caccttcattttgaggggagga

SEQ ID NO: 3233890 - DNA, 15 bp, Homo sapiens
caccttccagggccc

SEQ ID NO: 3233891 - DNA, 15 bp, Homo sapiens
caccttccgacatcc

SEQ ID NO: 3233892 - DNA, 16 bp, Homo sapiens
caccttcctcctgcag

SEQ ID NO: 3233893 - DNA, 20 bp, Homo sapiens
caccttctcacctgctccag

SEQ ID NO: 3233894 - DNA, 16 bp, Homo sapiens
caccttctttctggac

SEQ ID NO: 3233895 - DNA, 17 bp, Homo sapiens
caccttctttctggact

SEQ ID NO: 3233896 - DNA, 22 bp, Homo sapiens
caccttgaagaacctctcactt

SEQ ID NO: 3233897 - DNA, 15 bp, Homo sapiens
caccttgacagggca

SEQ ID NO: 3233898 - DNA, 16 bp, Homo sapiens
caccttgacagggcac

SEQ ID NO: 3233899 - DNA, 17 bp, Homo sapiens
caccttgccaaagcact

SEQ ID NO: 3233900 - DNA, 13 bp, Homo sapiens
caccttgccttgc

SEQ ID NO: 3233901 - DNA, 21 bp, Homo sapiens
caccttggacatcctcctccc

SEQ ID NO: 3233902 - DNA, 22 bp, Homo sapiens
caccttggacatcctcctccca

SEQ ID NO: 3233903 - DNA, 17 bp, Homo sapiens
caccttggctctgccag

SEQ ID NO: 3233904 - DNA, 19 bp, Homo sapiens
caccttggctctgccagtg

SEQ ID NO: 3233905 - DNA, 22 bp, Homo sapiens
caccttgtaaccagtgcagaaa

SEQ ID NO: 3233906 - DNA, 17 bp, Homo sapiens
caccttgtgtctgtaca

SEQ ID NO: 3233907 - DNA, 21 bp, Homo sapiens
caccttgtgtctgtacacgtg

SEQ ID NO: 3233908 - DNA, 22 bp, Homo sapiens
caccttgtgtgttccaagtttc

SEQ ID NO: 3233909 - DNA, 13 bp, Homo sapiens
cacctttactgtg

SEQ ID NO: 3233910 - DNA, 20 bp, Homo sapiens
cacctttactgtgcttattt

SEQ ID NO: 3233911 - DNA, 22 bp, Homo sapiens
cacctttgtaagacatttgtat

SEQ ID NO: 3233912 - DNA, 13 bp, Homo sapiens
cacgaaatgttat

SEQ ID NO: 3233913 - DNA, 15 bp, Homo sapiens
cacgaaatgttattt

SEQ ID NO: 3233914 - DNA, 12 bp, Homo sapiens
cacgaagcctta

SEQ ID NO: 3233915 - DNA, 18 bp, Homo sapiens
cacgaagccttaagccat

SEQ ID NO: 3233916 - DNA, 14 bp, Homo sapiens
cacgaccagcccct

SEQ ID NO: 3233917 - DNA, 14 bp, Homo sapiens
cacgaccggggcca

SEQ ID NO: 3233918 - DNA, 18 bp, Homo sapiens
cacgaccggggccagcac

SEQ ID NO: 3233919 - DNA, 16 bp, Homo sapiens
cacgaggatggcctgg

SEQ ID NO: 3233920 - DNA, 17 bp, Homo sapiens
cacgagggctggctggc

SEQ ID NO: 3233921 - DNA, 22 bp, Homo sapiens
cacgagggctggctggcctcac

SEQ ID NO: 3233922 - DNA, 17 bp, Homo sapiens
cacgagtcacctgcaag

SEQ ID NO: 3233923 - DNA, 14 bp, Homo sapiens
cacgatcccctccc

SEQ ID NO: 3233924 - DNA, 17 bp, Homo sapiens
cacgatcccctccccca

SEQ ID NO: 3233925 - DNA, 20 bp, Homo sapiens
cacgatgcatttaataaaga

SEQ ID NO: 3233926 - DNA, 17 bp, Homo sapiens
cacgatgccgagacctc

SEQ ID NO: 3233927 - DNA, 14 bp, Homo sapiens
cacgattagcttta

SEQ ID NO: 3233928 - DNA, 13 bp, Homo sapiens
cacgattggccac

SEQ ID NO: 3233929 - DNA, 16 bp, Homo sapiens
cacgattggccacctg

SEQ ID NO: 3233930 - DNA, 17 bp, Homo sapiens
cacgattggccacctgt

SEQ ID NO: 3233931 - DNA, 19 bp, Homo sapiens
cacgattttctccagctca

SEQ ID NO: 3233932 - DNA, 23 bp, Homo sapiens
cacgattttctccagctcagaac

SEQ ID NO: 3233933 - DNA, 17 bp, Homo sapiens
cacgcaagggcatcagg

SEQ ID NO: 3233934 - DNA, 18 bp, Homo sapiens
cacgcaagggcatcaggc

SEQ ID NO: 3233935 - DNA, 22 bp, Homo sapiens
cactggagttacattaatgtta

SEQ ID NO: 3233936 - DNA, 16 bp, Homo sapiens
cactggcaatgaaaaa

SEQ ID NO: 3233937 - DNA, 19 bp, Homo sapiens
cactggcattgtccctgtg

SEQ ID NO: 3233938 - DNA, 22 bp, Homo sapiens
cactggcattgtccctgtgcct

SEQ ID NO: 3233939 - DNA, 19 bp, Homo sapiens
cactggccaccaggctggc

SEQ ID NO: 3233940 - DNA, 24 bp, Homo sapiens
cactggccaccaggctggcgcagc

SEQ ID NO: 3233941 - DNA, 20 bp, Homo sapiens
cactggccacccctccccag

SEQ ID NO: 3233942 - DNA, 14 bp, Homo sapiens
cactggccagagag

SEQ ID NO: 3233943 - DNA, 20 bp, Homo sapiens
cactggccagagagggccca

SEQ ID NO: 3233944 - DNA, 21 bp, Homo sapiens
cactggccagagagggcccag

SEQ ID NO: 3233945 - DNA, 23 bp, Homo sapiens
cactggccagagagggcccagct

SEQ ID NO: 3233946 - DNA, 21 bp, Homo sapiens
cactggctccatgattctctg

SEQ ID NO: 3233947 - DNA, 12 bp, Homo sapiens
cactggctctcc

SEQ ID NO: 3233948 - DNA, 14 bp, Homo sapiens
cactggctctccaa

SEQ ID NO: 3233949 - DNA, 18 bp, Homo sapiens
cactggctctctccagga

SEQ ID NO: 3233950 - DNA, 15 bp, Homo sapiens
cactggctggctcct

SEQ ID NO: 3233951 - DNA, 15 bp, Homo sapiens
cactggctggggcag

SEQ ID NO: 3233952 - DNA, 18 bp, Homo sapiens
cactggctggggcagagg

SEQ ID NO: 3233953 - DNA, 22 bp, Homo sapiens
cactggctggggcagaggggca

SEQ ID NO: 3233954 - DNA, 22 bp, Homo sapiens
cactggcttggaacaccttggg

SEQ ID NO: 3233955 - DNA, 15 bp, Homo sapiens
cactgggccacggag

SEQ ID NO: 3233956 - DNA, 16 bp, Homo sapiens
cactgggccacggagg

SEQ ID NO: 3233957 - DNA, 19 bp, Homo sapiens
cactgggccacggaggagg

SEQ ID NO: 3233958 - DNA, 21 bp, Homo sapiens
cactgggccagccctgcagcc

SEQ ID NO: 3233959 - DNA, 16 bp, Homo sapiens
cactggggaaaactcc

SEQ ID NO: 3233960 - DNA, 16 bp, Homo sapiens
cactggggaatgctcc

SEQ ID NO: 3233961 - DNA, 18 bp, Homo sapiens
cactggggactttattta

SEQ ID NO: 3233962 - DNA, 23 bp, Homo sapiens
cactggggactttatttatttct

SEQ ID NO: 3233963 - DNA, 21 bp, Homo sapiens
cactggggagcccgtctcagt

SEQ ID NO: 3233964 - DNA, 14 bp, Homo sapiens
cactggggcctaca

SEQ ID NO: 3233965 - DNA, 16 bp, Homo sapiens
cactggggcctacagc

SEQ ID NO: 3233966 - DNA, 13 bp, Homo sapiens
cactgggtgagag

SEQ ID NO: 3233967 - DNA, 15 bp, Homo sapiens
cactgggtggggtga

SEQ ID NO: 3233968 - DNA, 14 bp, Homo sapiens
cactgggtggtggc

SEQ ID NO: 3233969 - DNA, 13 bp, Homo sapiens
cactggtggcccg

SEQ ID NO: 3233970 - DNA, 15 bp, Homo sapiens
cactggttttactta

SEQ ID NO: 3233971 - DNA, 14 bp, Homo sapiens
cactgtaaaatgaa

SEQ ID NO: 3233972 - DNA, 17 bp, Homo sapiens
cactgtaaaatgaaatt

SEQ ID NO: 3233973 - DNA, 22 bp, Homo sapiens
cactgtaagactcattccctag

SEQ ID NO: 3233974 - DNA, 20 bp, Homo sapiens
cactgtacaaggtacccctt

SEQ ID NO: 3233975 - DNA, 16 bp, Homo sapiens
cactgtagttctaaga

SEQ ID NO: 3233976 - DNA, 17 bp, Homo sapiens
cactgtagttctaagac

SEQ ID NO: 3233977 - DNA, 15 bp, Homo sapiens
cactgtataaatagg

SEQ ID NO: 3233978 - DNA, 22 bp, Homo sapiens
cactgtatgatttataaacaga

SEQ ID NO: 3233979 - DNA, 14 bp, Homo sapiens
cactgtatttgtat

SEQ ID NO: 3233980 - DNA, 20 bp, Homo sapiens
cactgtcaccctccacctct

SEQ ID NO: 3233981 - DNA, 16 bp, Homo sapiens
cactgtcactttgctc

SEQ ID NO: 3233982 - DNA, 17 bp, Homo sapiens
cactgtcactttgctct

SEQ ID NO: 3233983 - DNA, 19 bp, Homo sapiens
cactgtcactttgctctgg

SEQ ID NO: 3233984 - DNA, 20 bp, Homo sapiens
cactgtcactttgctctggg

SEQ ID NO: 3233985 - DNA, 16 bp, Homo sapiens
cactgtcatgcttcat

SEQ ID NO: 3233986 - DNA, 19 bp, Homo sapiens
cactgtccccctacccacc

SEQ ID NO: 3233987 - DNA, 20 bp, Homo sapiens
cactgtccccctacccaccg

SEQ ID NO: 3233988 - DNA, 12 bp, Homo sapiens
cactgtcccttg

SEQ ID NO: 3233989 - DNA, 17 bp, Homo sapiens
cactgtcccttgcctca

SEQ ID NO: 3233990 - DNA, 18 bp, Homo sapiens
cactgtcccttgcctcaa

SEQ ID NO: 3233991 - DNA, 22 bp, Homo sapiens
cactgtcctaccagttgcccta

SEQ ID NO: 3233992 - DNA, 19 bp, Homo sapiens
cactgtcgcccaggctgga

SEQ ID NO: 3233993 - DNA, 18 bp, Homo sapiens
cactgtctgttctgcaca

SEQ ID NO: 3233994 - DNA, 18 bp, Homo sapiens
cactgtctttaattctgt

SEQ ID NO: 3233995 - DNA, 12 bp, Homo sapiens
cactgtcttttt

SEQ ID NO: 3233996 - DNA, 21 bp, Homo sapiens
cactgtgatcaatatttttat

SEQ ID NO: 3233997 - DNA, 15 bp, Homo sapiens
cactgtgccatgtgc

SEQ ID NO: 3233998 - DNA, 16 bp, Homo sapiens
cactgtgccatgtgcc

SEQ ID NO: 3233999 - DNA, 18 bp, Homo sapiens
cactgtgccatgtgccag

SEQ ID NO: 3234000 - DNA, 12 bp, Homo sapiens
cactgtgccctg

SEQ ID NO: 3234001 - DNA, 13 bp, Homo sapiens
cactgtgccctgg

SEQ ID NO: 3234002 - DNA, 17 bp, Homo sapiens
cactgtgccttttcccc

SEQ ID NO: 3234003 - DNA, 16 bp, Homo sapiens
cactgtggcactggcc

SEQ ID NO: 3234004 - DNA, 15 bp, Homo sapiens
cactgtggccacagc

SEQ ID NO: 3234005 - DNA, 16 bp, Homo sapiens
cactgtggccacagcc

SEQ ID NO: 3234006 - DNA, 17 bp, Homo sapiens
cactgtggccacagccc

SEQ ID NO: 3234007 - DNA, 19 bp, Homo sapiens
cactgtggccacagccccc

SEQ ID NO: 3234008 - DNA, 20 bp, Homo sapiens
cactgtggccacagccccct

SEQ ID NO: 3234009 - DNA, 19 bp, Homo sapiens
cactgtggccagagctgga

SEQ ID NO: 3234010 - DNA, 14 bp, Homo sapiens
cactgtgggaaggc

SEQ ID NO: 3234011 - DNA, 13 bp, Homo sapiens
cactgtggtggca

SEQ ID NO: 3234012 - DNA, 15 bp, Homo sapiens
cactgtgtatttaac

SEQ ID NO: 3234013 - DNA, 22 bp, Homo sapiens
cactgttaatacacagtacttt

SEQ ID NO: 3234014 - DNA, 13 bp, Homo sapiens
cactgttagaaca

SEQ ID NO: 3234015 - DNA, 18 bp, Homo sapiens
cactgttagaacactatt

SEQ ID NO: 3234016 - DNA, 19 bp, Homo sapiens
cactgttagaacactattt

SEQ ID NO: 3234017 - DNA, 23 bp, Homo sapiens
cactgttagaacactattttcag

SEQ ID NO: 3234018 - DNA, 23 bp, Homo sapiens
cactgttagctttttaaaacatt

SEQ ID NO: 3234019 - DNA, 16 bp, Homo sapiens
cactgttccctctgct

SEQ ID NO: 3234020 - DNA, 22 bp, Homo sapiens
cactgttccctctgctcctgga

SEQ ID NO: 3234021 - DNA, 17 bp, Homo sapiens
cactgttgaaaattatt

SEQ ID NO: 3234022 - DNA, 14 bp, Homo sapiens
cactgttgatgtat

SEQ ID NO: 3234023 - DNA, 15 bp, Homo sapiens
cactgttgatgtatc

SEQ ID NO: 3234024 - DNA, 16 bp, Homo sapiens
cactgttgatgtatct

SEQ ID NO: 3234025 - DNA, 15 bp, Homo sapiens
cactgttgcccaggc

SEQ ID NO: 3234026 - DNA, 13 bp, Homo sapiens
cactgttgccttt

SEQ ID NO: 3234027 - DNA, 16 bp, Homo sapiens
cactgttgccttttaa

SEQ ID NO: 3234028 - DNA, 23 bp, Homo sapiens
cactgttgccttttaaaacctct

SEQ ID NO: 3234029 - DNA, 15 bp, Homo sapiens
cactgttgtgaatca

SEQ ID NO: 3234030 - DNA, 14 bp, Homo sapiens
cactgtttctctgc

SEQ ID NO: 3234031 - DNA, 17 bp, Homo sapiens
cactgtttctcttgagc

SEQ ID NO: 3234032 - DNA, 18 bp, Homo sapiens
cactgtttctcttgagct

SEQ ID NO: 3234033 - DNA, 15 bp, Homo sapiens
cactgtttttaatct

SEQ ID NO: 3234034 - DNA, 14 bp, Homo sapiens
cactgtttttagac

SEQ ID NO: 3234035 - DNA, 14 bp, Homo sapiens
cacttaaaaaatgt

SEQ ID NO: 3234036 - DNA, 13 bp, Homo sapiens
cacttaacagatg

SEQ ID NO: 3234037 - DNA, 23 bp, Homo sapiens
cacttaaccaagacaaaaagcca

SEQ ID NO: 3234038 - DNA, 17 bp, Homo sapiens
cacttaagtgcactttt

SEQ ID NO: 3234039 - DNA, 18 bp, Homo sapiens
cacttaagtgcacttttt

SEQ ID NO: 3234040 - DNA, 19 bp, Homo sapiens
cacttaagtgcactttttt

SEQ ID NO: 3234041 - DNA, 17 bp, Homo sapiens
cacttaagttagcctcc

SEQ ID NO: 3234042 - DNA, 12 bp, Homo sapiens
cacttaatagca

SEQ ID NO: 3234043 - DNA, 23 bp, Homo sapiens
cacttaattacagttaaagaagc

SEQ ID NO: 3234044 - DNA, 14 bp, Homo sapiens
cacttaatttgtaa

SEQ ID NO: 3234045 - DNA, 15 bp, Homo sapiens
cacttaatttgtaaa

SEQ ID NO: 3234046 - DNA, 15 bp, Homo sapiens
cacttactgtttctg

SEQ ID NO: 3234047 - DNA, 16 bp, Homo sapiens
cacttactgtttctgt

SEQ ID NO: 3234048 - DNA, 20 bp, Homo sapiens
cacttactgtttctgtcagg

SEQ ID NO: 3234049 - DNA, 20 bp, Homo sapiens
cacttagaaattgcatttcc

SEQ ID NO: 3234050 - DNA, 21 bp, Homo sapiens
cacttagcaggcaccgccacg

SEQ ID NO: 3234051 - DNA, 23 bp, Homo sapiens
cacttagcaggcaccgccacgtc

SEQ ID NO: 3234052 - DNA, 16 bp, Homo sapiens
cacttagcccaagagg

SEQ ID NO: 3234053 - DNA, 23 bp, Homo sapiens
cacttagcccaagaggtctgagc

SEQ ID NO: 3234054 - DNA, 15 bp, Homo sapiens
cacttagccgcaccc

SEQ ID NO: 3234055 - DNA, 22 bp, Homo sapiens
cacttagccgtccatggcacca

SEQ ID NO: 3234056 - DNA, 15 bp, Homo sapiens
cacttagtgatcatt

SEQ ID NO: 3234057 - DNA, 11 bp, Homo sapiens
cacttatatat

SEQ ID NO: 3234058 - DNA, 14 bp, Homo sapiens
cacttatcttctgg

SEQ ID NO: 3234059 - DNA, 15 bp, Homo sapiens
cacttatcttctgga

SEQ ID NO: 3234060 - DNA, 13 bp, Homo sapiens
cacttatggtaat

SEQ ID NO: 3234061 - DNA, 15 bp, Homo sapiens
cagaggggccaggcc

SEQ ID NO: 3234062 - DNA, 19 bp, Homo sapiens
cagaggggccaggcccagg

SEQ ID NO: 3234063 - DNA, 21 bp, Homo sapiens
cagaggggccaggcccaggca

SEQ ID NO: 3234064 - DNA, 22 bp, Homo sapiens
cagaggggccaggcccaggcag

SEQ ID NO: 3234065 - DNA, 18 bp, Homo sapiens
cagaggggctttctggag

SEQ ID NO: 3234066 - DNA, 19 bp, Homo sapiens
cagagggggagtagccaag

SEQ ID NO: 3234067 - DNA, 19 bp, Homo sapiens
cagaggggtaagagaggat

SEQ ID NO: 3234068 - DNA, 16 bp, Homo sapiens
cagagggtgtcaaaca

SEQ ID NO: 3234069 - DNA, 16 bp, Homo sapiens
cagaggtaacagaaca

SEQ ID NO: 3234070 - DNA, 22 bp, Homo sapiens
cagaggtagtctcactgcttga

SEQ ID NO: 3234071 - DNA, 22 bp, Homo sapiens
cagaggtattaaaactaaattt

SEQ ID NO: 3234072 - DNA, 23 bp, Homo sapiens
cagaggtattaaaactaaatttc

SEQ ID NO: 3234073 - DNA, 15 bp, Homo sapiens
cagaggtccagccca

SEQ ID NO: 3234074 - DNA, 16 bp, Homo sapiens
cagaggtccagcccat

SEQ ID NO: 3234075 - DNA, 17 bp, Homo sapiens
cagaggtctagattaat

SEQ ID NO: 3234076 - DNA, 19 bp, Homo sapiens
cagaggtctctgccggctc

SEQ ID NO: 3234077 - DNA, 20 bp, Homo sapiens
cagaggtctctgccggctct

SEQ ID NO: 3234078 - DNA, 21 bp, Homo sapiens
cagaggtggccagagctggga

SEQ ID NO: 3234079 - DNA, 20 bp, Homo sapiens
cagaggtgggatcctccctc

SEQ ID NO: 3234080 - DNA, 23 bp, Homo sapiens
cagaggtgggcaggtggtggcac

SEQ ID NO: 3234081 - DNA, 14 bp, Homo sapiens
cagaggtgtacact

SEQ ID NO: 3234082 - DNA, 22 bp, Homo sapiens
cagaggttatctgcctggcctg

SEQ ID NO: 3234083 - DNA, 17 bp, Homo sapiens
cagaggttgcagtgtgg

SEQ ID NO: 3234084 - DNA, 13 bp, Homo sapiens
cagagtagaaata

SEQ ID NO: 3234085 - DNA, 19 bp, Homo sapiens
cagagtcagaggagaagag

SEQ ID NO: 3234086 - DNA, 20 bp, Homo sapiens
cagagtccttattcttctca

SEQ ID NO: 3234087 - DNA, 20 bp, Homo sapiens
cagagtcgttggagactgaa

SEQ ID NO: 3234088 - DNA, 19 bp, Homo sapiens
cagagtctcactgttgccc

SEQ ID NO: 3234089 - DNA, 20 bp, Homo sapiens
cagagtctcactgttgccca

SEQ ID NO: 3234090 - DNA, 18 bp, Homo sapiens
cagagtctgggcctctga

SEQ ID NO: 3234091 - DNA, 15 bp, Homo sapiens
cagagtgaaagggct

SEQ ID NO: 3234092 - DNA, 20 bp, Homo sapiens
cagagtgaaagggctatggc

SEQ ID NO: 3234093 - DNA, 20 bp, Homo sapiens
cagagtgagaccctgtctct

SEQ ID NO: 3234094 - DNA, 17 bp, Homo sapiens
cagagtgagactctgtc

SEQ ID NO: 3234095 - DNA, 14 bp, Homo sapiens
cagagtgccactgc

SEQ ID NO: 3234096 - DNA, 15 bp, Homo sapiens
cagagtgcttttctg

SEQ ID NO: 3234097 - DNA, 18 bp, Homo sapiens
cagagtggactgcattta

SEQ ID NO: 3234098 - DNA, 16 bp, Homo sapiens
cagagtggcctccctg

SEQ ID NO: 3234099 - DNA, 23 bp, Homo sapiens
cagagtggcctccctgctgtgcc

SEQ ID NO: 3234100 - DNA, 22 bp, Homo sapiens
cagagtgggccccgggctggag

SEQ ID NO: 3234101 - DNA, 21 bp, Homo sapiens
cagagtggtctttctggagag

SEQ ID NO: 3234102 - DNA, 20 bp, Homo sapiens
cagagttaaatatgcatctg

SEQ ID NO: 3234103 - DNA, 14 bp, Homo sapiens
cagagttacagttc

SEQ ID NO: 3234104 - DNA, 16 bp, Homo sapiens
cagagttacagttctg

SEQ ID NO: 3234105 - DNA, 18 bp, Homo sapiens
cagagttacagttctgtg

SEQ ID NO: 3234106 - DNA, 16 bp, Homo sapiens
cagagttattgaatct

SEQ ID NO: 3234107 - DNA, 21 bp, Homo sapiens
cagagttattgaatcttaatt

SEQ ID NO: 3234108 - DNA, 12 bp, Homo sapiens
cagagttcacag

SEQ ID NO: 3234109 - DNA, 15 bp, Homo sapiens
cagagttcacaggag

SEQ ID NO: 3234110 - DNA, 14 bp, Homo sapiens
cagagttcactata

SEQ ID NO: 3234111 - DNA, 22 bp, Homo sapiens
cagagttcctgcggagtgaaga

SEQ ID NO: 3234112 - DNA, 15 bp, Homo sapiens
cagagttctgtgaag

SEQ ID NO: 3234113 - DNA, 19 bp, Homo sapiens
cagagttctgtgaagagga

SEQ ID NO: 3234114 - DNA, 23 bp, Homo sapiens
cagagtttacattctaatttgca

SEQ ID NO: 3234115 - DNA, 16 bp, Homo sapiens
cagagtttgccttcct

SEQ ID NO: 3234116 - DNA, 17 bp, Homo sapiens
cagagtttgccttcctt

SEQ ID NO: 3234117 - DNA, 22 bp, Homo sapiens
cagagtttgccttcctttctcc

SEQ ID NO: 3234118 - DNA, 18 bp, Homo sapiens
cagagtttgtgtgtattt

SEQ ID NO: 3234119 - DNA, 22 bp, Homo sapiens
cagagttttcattaaatccttt

SEQ ID NO: 3234120 - DNA, 16 bp, Homo sapiens
cagataaaatgttcag

SEQ ID NO: 3234121 - DNA, 17 bp, Homo sapiens
cagataaaatgttcagt

SEQ ID NO: 3234122 - DNA, 22 bp, Homo sapiens
cagataacaatgcagcaaggcc

SEQ ID NO: 3234123 - DNA, 22 bp, Homo sapiens
cagataacttttttgagtcatt

SEQ ID NO: 3234124 - DNA, 19 bp, Homo sapiens
cagataagaatgctggttt

SEQ ID NO: 3234125 - DNA, 20 bp, Homo sapiens
cagataagacatatctctaa

SEQ ID NO: 3234126 - DNA, 15 bp, Homo sapiens
cagataatcagcctc

SEQ ID NO: 3234127 - DNA, 18 bp, Homo sapiens
cagataatcagcctctta

SEQ ID NO: 3234128 - DNA, 15 bp, Homo sapiens
cagataattctggac

SEQ ID NO: 3234129 - DNA, 23 bp, Homo sapiens
cagatacaggaaaagctgctgac

SEQ ID NO: 3234130 - DNA, 14 bp, Homo sapiens
cagatacatcactg

SEQ ID NO: 3234131 - DNA, 18 bp, Homo sapiens
cagataccttatcttaca

SEQ ID NO: 3234132 - DNA, 19 bp, Homo sapiens
cagataccttatcttacaa

SEQ ID NO: 3234133 - DNA, 13 bp, Homo sapiens
cagatagagctgg

SEQ ID NO: 3234134 - DNA, 14 bp, Homo sapiens
cagatagagctggg

SEQ ID NO: 3234135 - DNA, 16 bp, Homo sapiens
cagatagagctgggtg

SEQ ID NO: 3234136 - DNA, 19 bp, Homo sapiens
cagatagatatatgctctg

SEQ ID NO: 3234137 - DNA, 20 bp, Homo sapiens
cagatagtgtagctgaggag

SEQ ID NO: 3234138 - DNA, 18 bp, Homo sapiens
cagatataaatggctggt

SEQ ID NO: 3234139 - DNA, 20 bp, Homo sapiens
cagatataaatggctggttt

SEQ ID NO: 3234140 - DNA, 18 bp, Homo sapiens
cagatatatttaagcctt

SEQ ID NO: 3234141 - DNA, 13 bp, Homo sapiens
cagatatattttt

SEQ ID NO: 3234142 - DNA, 14 bp, Homo sapiens
cagatatatttttc

SEQ ID NO: 3234143 - DNA, 15 bp, Homo sapiens
cagatatcaaaattc

SEQ ID NO: 3234144 - DNA, 16 bp, Homo sapiens
cagatatcaaaattct

SEQ ID NO: 3234145 - DNA, 17 bp, Homo sapiens
cagatatcaaaattcta

SEQ ID NO: 3234146 - DNA, 24 bp, Homo sapiens
cagatatcaaaattctagctgtat

SEQ ID NO: 3234147 - DNA, 22 bp, Homo sapiens
cagatatcatactgatttttaa

SEQ ID NO: 3234148 - DNA, 12 bp, Homo sapiens
cagatatttata

SEQ ID NO: 3234149 - DNA, 15 bp, Homo sapiens
cagatatttgtcatg

SEQ ID NO: 3234150 - DNA, 20 bp, Homo sapiens
cagatattttttcagaaata

SEQ ID NO: 3234151 - DNA, 13 bp, Homo sapiens
cagatcaaattct

SEQ ID NO: 3234152 - DNA, 18 bp, Homo sapiens
cagatcaagagttttgga

SEQ ID NO: 3234153 - DNA, 14 bp, Homo sapiens
cagatcacgaggtc

SEQ ID NO: 3234154 - DNA, 22 bp, Homo sapiens
cagatccagactgtaagatgtt

SEQ ID NO: 3234155 - DNA, 17 bp, Homo sapiens
cagatcccactggaaga

SEQ ID NO: 3234156 - DNA, 17 bp, Homo sapiens
cagatcctttttccatc

SEQ ID NO: 3234157 - DNA, 16 bp, Homo sapiens
cagatcgctcactgtt

SEQ ID NO: 3234158 - DNA, 21 bp, Homo sapiens
cagatcgctcactgttgtgaa

SEQ ID NO: 3234159 - DNA, 20 bp, Homo sapiens
cagatctatagcagagtcct

SEQ ID NO: 3234160 - DNA, 13 bp, Homo sapiens
cagatctcccact

SEQ ID NO: 3234161 - DNA, 14 bp, Homo sapiens
cagatctgaacaca

SEQ ID NO: 3234162 - DNA, 19 bp, Homo sapiens
cagatctgcctgggcctgt

SEQ ID NO: 3234163 - DNA, 15 bp, Homo sapiens
cagatctgtctccaa

SEQ ID NO: 3234164 - DNA, 16 bp, Homo sapiens
cagatctgtctccaag

SEQ ID NO: 3234165 - DNA, 15 bp, Homo sapiens
cagatctgtgcccca

SEQ ID NO: 3234166 - DNA, 23 bp, Homo sapiens
cagatctgttttgtggtttggaa

SEQ ID NO: 3234167 - DNA, 21 bp, Homo sapiens
cagatcttccgtggtcagagt

SEQ ID NO: 3234168 - DNA, 17 bp, Homo sapiens
cagatctttcagaaata

SEQ ID NO: 3234169 - DNA, 14 bp, Homo sapiens
cagatgaaaatttg

SEQ ID NO: 3234170 - DNA, 20 bp, Homo sapiens
cagatgaactcttagaaatg

SEQ ID NO: 3234171 - DNA, 14 bp, Homo sapiens
cagatgaataaact

SEQ ID NO: 3234172 - DNA, 17 bp, Homo sapiens
cagatgaatgccgtgga

SEQ ID NO: 3234173 - DNA, 22 bp, Homo sapiens
cagatgacacgcgctctccacc

SEQ ID NO: 3234174 - DNA, 14 bp, Homo sapiens
cagatgagaacaaa

SEQ ID NO: 3234175 - DNA, 16 bp, Homo sapiens
cagatgagaacaaagc

SEQ ID NO: 3234176 - DNA, 19 bp, Homo sapiens
cagatgatgagaatttcta

SEQ ID NO: 3234177 - DNA, 23 bp, Homo sapiens
cagatgatgccaacctctggagc

SEQ ID NO: 3234178 - DNA, 13 bp, Homo sapiens
cagatgcaacctc

SEQ ID NO: 3234179 - DNA, 14 bp, Homo sapiens
cagatgcaccagcc

SEQ ID NO: 3234180 - DNA, 16 bp, Homo sapiens
cagatgcaccagccct

SEQ ID NO: 3234181 - DNA, 13 bp, Homo sapiens
cagatgcaggaca

SEQ ID NO: 3234182 - DNA, 18 bp, Homo sapiens
cagatgcaggacaggagg

SEQ ID NO: 3234183 - DNA, 21 bp, Homo sapiens
cagatgcaggacaggaggcgg

SEQ ID NO: 3234184 - DNA, 18 bp, Homo sapiens
cagatgccaccctagcca

SEQ ID NO: 3234185 - DNA, 20 bp, Homo sapiens
cagatgccaccctagccaat

SEQ ID NO: 3234186 - DNA, 20 bp, Homo sapiens
cagcgggcacagggcaccag

SEQ ID NO: 3234187 - DNA, 14 bp, Homo sapiens
cagcgggcagatgg

SEQ ID NO: 3234188 - DNA, 20 bp, Homo sapiens
cagcgggcaggttctgcctg

SEQ ID NO: 3234189 - DNA, 12 bp, Homo sapiens
cagcgggccagg

SEQ ID NO: 3234190 - DNA, 14 bp, Homo sapiens
cagcgggccaggcc

SEQ ID NO: 3234191 - DNA, 19 bp, Homo sapiens
cagcgggccaggcccgcac

SEQ ID NO: 3234192 - DNA, 16 bp, Homo sapiens
cagcgggcccaggcct

SEQ ID NO: 3234193 - DNA, 14 bp, Homo sapiens
cagcgggcggaggg

SEQ ID NO: 3234194 - DNA, 21 bp, Homo sapiens
cagcgggctaacgggaggctg

SEQ ID NO: 3234195 - DNA, 16 bp, Homo sapiens
cagcggggacagctcc

SEQ ID NO: 3234196 - DNA, 18 bp, Homo sapiens
cagcggggccccagggct

SEQ ID NO: 3234197 - DNA, 22 bp, Homo sapiens
cagcggggtggggggggagaga

SEQ ID NO: 3234198 - DNA, 14 bp, Homo sapiens
cagcgtcccctgct

SEQ ID NO: 3234199 - DNA, 22 bp, Homo sapiens
cagcgtcccctgctactcctgt

SEQ ID NO: 3234200 - DNA, 17 bp, Homo sapiens
cagcgtccctagcagtg

SEQ ID NO: 3234201 - DNA, 21 bp, Homo sapiens
cagcgtcctcgttcaaaacat

SEQ ID NO: 3234202 - DNA, 12 bp, Homo sapiens
cagcgtgtgtat

SEQ ID NO: 3234203 - DNA, 18 bp, Homo sapiens
cagctaagctaggaatga

SEQ ID NO: 3234204 - DNA, 21 bp, Homo sapiens
cagctaatctgtagggctgga

SEQ ID NO: 3234205 - DNA, 18 bp, Homo sapiens
cagctaccaggtgttcta

SEQ ID NO: 3234206 - DNA, 13 bp, Homo sapiens
cagctaccccttc

SEQ ID NO: 3234207 - DNA, 14 bp, Homo sapiens
cagctacctgagac

SEQ ID NO: 3234208 - DNA, 23 bp, Homo sapiens
cagctactcagaagcctgaggct

SEQ ID NO: 3234209 - DNA, 23 bp, Homo sapiens
cagctactctccccacgagggct

SEQ ID NO: 3234210 - DNA, 19 bp, Homo sapiens
cagctactctgtccaggcc

SEQ ID NO: 3234211 - DNA, 21 bp, Homo sapiens
cagctactctgtccaggccac

SEQ ID NO: 3234212 - DNA, 22 bp, Homo sapiens
cagctactctgtccaggccact

SEQ ID NO: 3234213 - DNA, 23 bp, Homo sapiens
cagctactctgtccaggccactg

SEQ ID NO: 3234214 - DNA, 15 bp, Homo sapiens
cagctacttcctcct

SEQ ID NO: 3234215 - DNA, 17 bp, Homo sapiens
cagctacttcctcctcc

SEQ ID NO: 3234216 - DNA, 21 bp, Homo sapiens
cagctacttcctcctccccac

SEQ ID NO: 3234217 - DNA, 15 bp, Homo sapiens
cagctacttgggagg

SEQ ID NO: 3234218 - DNA, 16 bp, Homo sapiens
cagctacttgggaggc

SEQ ID NO: 3234219 - DNA, 19 bp, Homo sapiens
cagctacttgggaggctga

SEQ ID NO: 3234220 - DNA, 19 bp, Homo sapiens
cagctacttggtttgtgtt

SEQ ID NO: 3234221 - DNA, 16 bp, Homo sapiens
cagctactttccattt

SEQ ID NO: 3234222 - DNA, 14 bp, Homo sapiens
cagctagactggag

SEQ ID NO: 3234223 - DNA, 16 bp, Homo sapiens
cagctagactggagtg

SEQ ID NO: 3234224 - DNA, 18 bp, Homo sapiens
cagctagactggagtgag

SEQ ID NO: 3234225 - DNA, 21 bp, Homo sapiens
cagctagactggagtgaggct

SEQ ID NO: 3234226 - DNA, 12 bp, Homo sapiens
cagctaggactg

SEQ ID NO: 3234227 - DNA, 17 bp, Homo sapiens
cagctaggactgaggag

SEQ ID NO: 3234228 - DNA, 13 bp, Homo sapiens
cagctagggggcg

SEQ ID NO: 3234229 - DNA, 19 bp, Homo sapiens
cagctaggtggggcctaga

SEQ ID NO: 3234230 - DNA, 22 bp, Homo sapiens
cagctatctgtcatctctctgg

SEQ ID NO: 3234231 - DNA, 21 bp, Homo sapiens
cagctatgcgcaatgtggcat

SEQ ID NO: 3234232 - DNA, 13 bp, Homo sapiens
cagctatgctggt

SEQ ID NO: 3234233 - DNA, 18 bp, Homo sapiens
cagctatgggagccccag

SEQ ID NO: 3234234 - DNA, 20 bp, Homo sapiens
cagctatgggagccccaggg

SEQ ID NO: 3234235 - DNA, 22 bp, Homo sapiens
cagctatgggagccccagggtc

SEQ ID NO: 3234236 - DNA, 13 bp, Homo sapiens
cagctatttaagg

SEQ ID NO: 3234237 - DNA, 13 bp, Homo sapiens
cagctcaagtctt

SEQ ID NO: 3234238 - DNA, 16 bp, Homo sapiens
cagctcaatggactgg

SEQ ID NO: 3234239 - DNA, 20 bp, Homo sapiens
cagctcaatggactggaagg

SEQ ID NO: 3234240 - DNA, 16 bp, Homo sapiens
cagctcaccagcccca

SEQ ID NO: 3234241 - DNA, 17 bp, Homo sapiens
cagctcaccagccccag

SEQ ID NO: 3234242 - DNA, 16 bp, Homo sapiens
cagctcacccctgggc

SEQ ID NO: 3234243 - DNA, 21 bp, Homo sapiens
cagctcacccctgggcaggcg

SEQ ID NO: 3234244 - DNA, 16 bp, Homo sapiens
cagctcacctctgaag

SEQ ID NO: 3234245 - DNA, 19 bp, Homo sapiens
cagctcacctctgaaggca

SEQ ID NO: 3234246 - DNA, 12 bp, Homo sapiens
cagctcagaacc

SEQ ID NO: 3234247 - DNA, 18 bp, Homo sapiens
cagctcagaacccagggc

SEQ ID NO: 3234248 - DNA, 20 bp, Homo sapiens
cagctcagaacccagggctc

SEQ ID NO: 3234249 - DNA, 18 bp, Homo sapiens
cagctcagcgccagcctg

SEQ ID NO: 3234250 - DNA, 16 bp, Homo sapiens
cagctcataaaatgga

SEQ ID NO: 3234251 - DNA, 17 bp, Homo sapiens
cagctcataaaatggaa

SEQ ID NO: 3234252 - DNA, 16 bp, Homo sapiens
cagctcatctccaagg

SEQ ID NO: 3234253 - DNA, 18 bp, Homo sapiens
cagctccaagacctgttg

SEQ ID NO: 3234254 - DNA, 15 bp, Homo sapiens
cagctccagctcacc

SEQ ID NO: 3234255 - DNA, 13 bp, Homo sapiens
cagctccaggggc

SEQ ID NO: 3234256 - DNA, 16 bp, Homo sapiens
cagctccaggggccct

SEQ ID NO: 3234257 - DNA, 21 bp, Homo sapiens
cagctccaggggcccttggga

SEQ ID NO: 3234258 - DNA, 14 bp, Homo sapiens
cagctccattttct

SEQ ID NO: 3234259 - DNA, 12 bp, Homo sapiens
cagctccccaag

SEQ ID NO: 3234260 - DNA, 17 bp, Homo sapiens
cagctccccccgcccac

SEQ ID NO: 3234261 - DNA, 14 bp, Homo sapiens
cagctccccctgtc

SEQ ID NO: 3234262 - DNA, 21 bp, Homo sapiens
cagctccccctgtcccctcag

SEQ ID NO: 3234263 - DNA, 13 bp, Homo sapiens
cagctccctagac

SEQ ID NO: 3234264 - DNA, 14 bp, Homo sapiens
cagctccctagact

SEQ ID NO: 3234265 - DNA, 13 bp, Homo sapiens
cagctcccttccc

SEQ ID NO: 3234266 - DNA, 18 bp, Homo sapiens
cagctcctcagcggctcc

SEQ ID NO: 3234267 - DNA, 14 bp, Homo sapiens
cagctcctcccaca

SEQ ID NO: 3234268 - DNA, 14 bp, Homo sapiens
cagctcctctcctt

SEQ ID NO: 3234269 - DNA, 18 bp, Homo sapiens
cagctcctctccttgggc

SEQ ID NO: 3234270 - DNA, 19 bp, Homo sapiens
cagctcctctccttgggct

SEQ ID NO: 3234271 - DNA, 22 bp, Homo sapiens
cagctcctctccttgggctcct

SEQ ID NO: 3234272 - DNA, 23 bp, Homo sapiens
cagctccttctgtcctactctgt

SEQ ID NO: 3234273 - DNA, 16 bp, Homo sapiens
cagctcctttctcctg

SEQ ID NO: 3234274 - DNA, 18 bp, Homo sapiens
cagctcctttctcctgtg

SEQ ID NO: 3234275 - DNA, 21 bp, Homo sapiens
cagctcctttctcctgtgaat

SEQ ID NO: 3234276 - DNA, 22 bp, Homo sapiens
cagctcctttctcctgtgaatg

SEQ ID NO: 3234277 - DNA, 19 bp, Homo sapiens
cagctccttttgtccccag

SEQ ID NO: 3234278 - DNA, 22 bp, Homo sapiens
cagctccttttgtccccagggc

SEQ ID NO: 3234279 - DNA, 19 bp, Homo sapiens
cagctcgaattaagaatat

SEQ ID NO: 3234280 - DNA, 15 bp, Homo sapiens
cagctctaataaaac

SEQ ID NO: 3234281 - DNA, 15 bp, Homo sapiens
cagctctactggtct

SEQ ID NO: 3234282 - DNA, 14 bp, Homo sapiens
cagctctcctggct

SEQ ID NO: 3234283 - DNA, 16 bp, Homo sapiens
cagctctcctggctcc

SEQ ID NO: 3234284 - DNA, 20 bp, Homo sapiens
cagctctctgggacctcctt

SEQ ID NO: 3234285 - DNA, 15 bp, Homo sapiens
cagctctgacatccc

SEQ ID NO: 3234286 - DNA, 16 bp, Homo sapiens
cagctctgacatccct

SEQ ID NO: 3234287 - DNA, 19 bp, Homo sapiens
cagctctgacatcccttcc

SEQ ID NO: 3234288 - DNA, 22 bp, Homo sapiens
cagctctgacatcccttcctgg

SEQ ID NO: 3234289 - DNA, 14 bp, Homo sapiens
cagctctgagccag

SEQ ID NO: 3234290 - DNA, 22 bp, Homo sapiens
cagctctgagccagattacagg

SEQ ID NO: 3234291 - DNA, 14 bp, Homo sapiens
cagctctgagggga

SEQ ID NO: 3234292 - DNA, 15 bp, Homo sapiens
cagctctgaggggag

SEQ ID NO: 3234293 - DNA, 12 bp, Homo sapiens
cagctctggaga

SEQ ID NO: 3234294 - DNA, 12 bp, Homo sapiens
cagctctggctt

SEQ ID NO: 3234295 - DNA, 15 bp, Homo sapiens
cagctctgggagagg

SEQ ID NO: 3234296 - DNA, 13 bp, Homo sapiens
cagctctgtcctg

SEQ ID NO: 3234297 - DNA, 13 bp, Homo sapiens
cagctctgtggcc

SEQ ID NO: 3234298 - DNA, 14 bp, Homo sapiens
cagctctgtggcct

SEQ ID NO: 3234299 - DNA, 16 bp, Homo sapiens
cagctctgtggcctgt

SEQ ID NO: 3234300 - DNA, 18 bp, Homo sapiens
cagctctgtggcctgtgt

SEQ ID NO: 3234301 - DNA, 12 bp, Homo sapiens
cagctcttcatt

SEQ ID NO: 3234302 - DNA, 16 bp, Homo sapiens
cagctcttctccaggc

SEQ ID NO: 3234303 - DNA, 18 bp, Homo sapiens
cagctcttgcccttccct

SEQ ID NO: 3234304 - DNA, 14 bp, Homo sapiens
cagctcttgctaat

SEQ ID NO: 3234305 - DNA, 20 bp, Homo sapiens
cagctcttgctaatcagtgt

SEQ ID NO: 3234306 - DNA, 20 bp, Homo sapiens
cagctgaagaaaaaatcaga

SEQ ID NO: 3234307 - DNA, 15 bp, Homo sapiens
cagctgaaggcagtg

SEQ ID NO: 3234308 - DNA, 19 bp, Homo sapiens
cagctgaaggcagtggcag

SEQ ID NO: 3234309 - DNA, 13 bp, Homo sapiens
cagctgactgtgg

SEQ ID NO: 3234310 - DNA, 19 bp, Homo sapiens
cagctgactgtggccccct

SEQ ID NO: 3234311 - DNA, 22 bp, Homo sapiens
cagctgagaaaatgagtgacta

SEQ ID NO: 3234312 - DNA, 20 bp, Homo sapiens
caggggattgaagccctcca

SEQ ID NO: 3234313 - DNA, 12 bp, Homo sapiens
caggggcagctc

SEQ ID NO: 3234314 - DNA, 14 bp, Homo sapiens
caggggcaggcctg

SEQ ID NO: 3234315 - DNA, 16 bp, Homo sapiens
caggggccccagatct

SEQ ID NO: 3234316 - DNA, 21 bp, Homo sapiens
caggggccccagatctgcctg

SEQ ID NO: 3234317 - DNA, 22 bp, Homo sapiens
caggggccccagatctgcctgg

SEQ ID NO: 3234318 - DNA, 19 bp, Homo sapiens
caggggcccttgggacagc

SEQ ID NO: 3234319 - DNA, 13 bp, Homo sapiens
caggggcctgcag

SEQ ID NO: 3234320 - DNA, 22 bp, Homo sapiens
caggggcctggagatcctcctg

SEQ ID NO: 3234321 - DNA, 19 bp, Homo sapiens
caggggctacaagagggaa

SEQ ID NO: 3234322 - DNA, 13 bp, Homo sapiens
caggggctccagc

SEQ ID NO: 3234323 - DNA, 17 bp, Homo sapiens
caggggctccagcacct

SEQ ID NO: 3234324 - DNA, 14 bp, Homo sapiens
caggggctctggag

SEQ ID NO: 3234325 - DNA, 18 bp, Homo sapiens
caggggctgcttcctcct

SEQ ID NO: 3234326 - DNA, 12 bp, Homo sapiens
cagggggccccg

SEQ ID NO: 3234327 - DNA, 14 bp, Homo sapiens
caggggggcctcct

SEQ ID NO: 3234328 - DNA, 15 bp, Homo sapiens
caggggggcctcctc

SEQ ID NO: 3234329 - DNA, 14 bp, Homo sapiens
caggggggctgtgc

SEQ ID NO: 3234330 - DNA, 15 bp, Homo sapiens
caggggggctgtgcc

SEQ ID NO: 3234331 - DNA, 21 bp, Homo sapiens
cagggggtggacaaactggag

SEQ ID NO: 3234332 - DNA, 16 bp, Homo sapiens
cagggggtgtgtctgc

SEQ ID NO: 3234333 - DNA, 21 bp, Homo sapiens
caggggtcgtcaccacctctc

SEQ ID NO: 3234334 - DNA, 18 bp, Homo sapiens
caggggtctccctggctc

SEQ ID NO: 3234335 - DNA, 23 bp, Homo sapiens
caggggtgccccctcctctccca

SEQ ID NO: 3234336 - DNA, 22 bp, Homo sapiens
caggggtgggggtggaggcttc

SEQ ID NO: 3234337 - DNA, 17 bp, Homo sapiens
caggggttcgagaccag

SEQ ID NO: 3234338 - DNA, 22 bp, Homo sapiens
caggggttgcagtgagcggaga

SEQ ID NO: 3234339 - DNA, 21 bp, Homo sapiens
cagggtaccctttggggagca

SEQ ID NO: 3234340 - DNA, 13 bp, Homo sapiens
cagggtaggaaag

SEQ ID NO: 3234341 - DNA, 14 bp, Homo sapiens
cagggtaggaaagg

SEQ ID NO: 3234342 - DNA, 18 bp, Homo sapiens
cagggtcatgtttgcagg

SEQ ID NO: 3234343 - DNA, 17 bp, Homo sapiens
cagggtccgcaccagct

SEQ ID NO: 3234344 - DNA, 18 bp, Homo sapiens
cagggtccgcaccagctg

SEQ ID NO: 3234345 - DNA, 14 bp, Homo sapiens
cagggtccttttga

SEQ ID NO: 3234346 - DNA, 22 bp, Homo sapiens
cagggtctcactatgttgccca

SEQ ID NO: 3234347 - DNA, 18 bp, Homo sapiens
cagggtctcactctgtcg

SEQ ID NO: 3234348 - DNA, 21 bp, Homo sapiens
cagggtctcactctgtcgccc

SEQ ID NO: 3234349 - DNA, 23 bp, Homo sapiens
cagggtctcactctgtcgcccag

SEQ ID NO: 3234350 - DNA, 15 bp, Homo sapiens
cagggtctctccctc

SEQ ID NO: 3234351 - DNA, 20 bp, Homo sapiens
cagggtctctccctcaggtg

SEQ ID NO: 3234352 - DNA, 23 bp, Homo sapiens
cagggtctgctctttctctgcca

SEQ ID NO: 3234353 - DNA, 23 bp, Homo sapiens
cagggtctgtgtgaatgtgggca

SEQ ID NO: 3234354 - DNA, 20 bp, Homo sapiens
cagggtcttgggctactggc

SEQ ID NO: 3234355 - DNA, 22 bp, Homo sapiens
cagggtcttgggctactggcag

SEQ ID NO: 3234356 - DNA, 20 bp, Homo sapiens
cagggtcttttttcatttct

SEQ ID NO: 3234357 - DNA, 13 bp, Homo sapiens
cagggtgcagagg

SEQ ID NO: 3234358 - DNA, 17 bp, Homo sapiens
cagggtggacttagaaa

SEQ ID NO: 3234359 - DNA, 17 bp, Homo sapiens
cagggtgggaagaaaga

SEQ ID NO: 3234360 - DNA, 14 bp, Homo sapiens
cagggtgggagagc

SEQ ID NO: 3234361 - DNA, 17 bp, Homo sapiens
cagggtgggcaaactct

SEQ ID NO: 3234362 - DNA, 18 bp, Homo sapiens
cagggtgggcagcctatg

SEQ ID NO: 3234363 - DNA, 11 bp, Homo sapiens
cagggtggggg

SEQ ID NO: 3234364 - DNA, 20 bp, Homo sapiens
cagggtgtgagcgccacatc

SEQ ID NO: 3234365 - DNA, 18 bp, Homo sapiens
cagggttcaaaatgtctg

SEQ ID NO: 3234366 - DNA, 17 bp, Homo sapiens
cagggttggcccctgcc

SEQ ID NO: 3234367 - DNA, 21 bp, Homo sapiens
cagggttgggcccagatctgg

SEQ ID NO: 3234368 - DNA, 19 bp, Homo sapiens
cagggtttacccagtggga

SEQ ID NO: 3234369 - DNA, 22 bp, Homo sapiens
cagggtttacccagtgggacag

SEQ ID NO: 3234370 - DNA, 16 bp, Homo sapiens
cagggttttgccatgt

SEQ ID NO: 3234371 - DNA, 15 bp, Homo sapiens
caggtaacaggcaga

SEQ ID NO: 3234372 - DNA, 20 bp, Homo sapiens
caggtaacaggcagatacag

SEQ ID NO: 3234373 - DNA, 21 bp, Homo sapiens
caggtaacaggcagatacagg

SEQ ID NO: 3234374 - DNA, 17 bp, Homo sapiens
caggtaagtctggtttt

SEQ ID NO: 3234375 - DNA, 13 bp, Homo sapiens
caggtaatgtgaa

SEQ ID NO: 3234376 - DNA, 15 bp, Homo sapiens
caggtacaggagagg

SEQ ID NO: 3234377 - DNA, 20 bp, Homo sapiens
caggtacaggagaggcagca

SEQ ID NO: 3234378 - DNA, 16 bp, Homo sapiens
caggtaccaaggaaat

SEQ ID NO: 3234379 - DNA, 14 bp, Homo sapiens
caggtaccagctgc

SEQ ID NO: 3234380 - DNA, 15 bp, Homo sapiens
caggtaccagctgcg

SEQ ID NO: 3234381 - DNA, 16 bp, Homo sapiens
caggtaccagctgcgc

SEQ ID NO: 3234382 - DNA, 21 bp, Homo sapiens
caggtaccagctgcgcttgct

SEQ ID NO: 3234383 - DNA, 15 bp, Homo sapiens
caggtacggagaaga

SEQ ID NO: 3234384 - DNA, 17 bp, Homo sapiens
caggtacggagaagaat

SEQ ID NO: 3234385 - DNA, 16 bp, Homo sapiens
caggtacttcctcctg

SEQ ID NO: 3234386 - DNA, 23 bp, Homo sapiens
caggtacttcctcctgatggcca

SEQ ID NO: 3234387 - DNA, 22 bp, Homo sapiens
caggtagaaggttgacacagtt

SEQ ID NO: 3234388 - DNA, 22 bp, Homo sapiens
caggtagatcgcttgagcccag

SEQ ID NO: 3234389 - DNA, 23 bp, Homo sapiens
caggtagatcgcttgagcccagg

SEQ ID NO: 3234390 - DNA, 12 bp, Homo sapiens
caggtagccagg

SEQ ID NO: 3234391 - DNA, 22 bp, Homo sapiens
caggtaggcccttgtcctgcca

SEQ ID NO: 3234392 - DNA, 23 bp, Homo sapiens
caggtagttgcaattgaattaaa

SEQ ID NO: 3234393 - DNA, 15 bp, Homo sapiens
caggtatatactttg

SEQ ID NO: 3234394 - DNA, 14 bp, Homo sapiens
caggtatggctctg

SEQ ID NO: 3234395 - DNA, 16 bp, Homo sapiens
caggtcaataaactta

SEQ ID NO: 3234396 - DNA, 16 bp, Homo sapiens
caggtcagctgttact

SEQ ID NO: 3234397 - DNA, 15 bp, Homo sapiens
caggtcaggatgcac

SEQ ID NO: 3234398 - DNA, 15 bp, Homo sapiens
caggtcagggacttg

SEQ ID NO: 3234399 - DNA, 13 bp, Homo sapiens
caggtcatgcagt

SEQ ID NO: 3234400 - DNA, 19 bp, Homo sapiens
caggtcatgcagttcctgg

SEQ ID NO: 3234401 - DNA, 23 bp, Homo sapiens
caggtcatgcagttcctggccca

SEQ ID NO: 3234402 - DNA, 14 bp, Homo sapiens
caggtccagctctg

SEQ ID NO: 3234403 - DNA, 19 bp, Homo sapiens
caggtccagctctggaggg

SEQ ID NO: 3234404 - DNA, 17 bp, Homo sapiens
caggtcccacctccagc

SEQ ID NO: 3234405 - DNA, 18 bp, Homo sapiens
caggtcccacctccagcc

SEQ ID NO: 3234406 - DNA, 23 bp, Homo sapiens
caggtcccacctccagcccggga

SEQ ID NO: 3234407 - DNA, 20 bp, Homo sapiens
caggtcccacgtctggccag

SEQ ID NO: 3234408 - DNA, 16 bp, Homo sapiens
caggtccctccccttc

SEQ ID NO: 3234409 - DNA, 23 bp, Homo sapiens
caggtccctccgcggctggagcg

SEQ ID NO: 3234410 - DNA, 12 bp, Homo sapiens
caggtcctgccc

SEQ ID NO: 3234411 - DNA, 13 bp, Homo sapiens
caggtcctgccca

SEQ ID NO: 3234412 - DNA, 23 bp, Homo sapiens
caggtcctgcccatgtgtcccct

SEQ ID NO: 3234413 - DNA, 16 bp, Homo sapiens
caggtcgggcgcagga

SEQ ID NO: 3234414 - DNA, 14 bp, Homo sapiens
caggtctcacgggc

SEQ ID NO: 3234415 - DNA, 17 bp, Homo sapiens
caggtctcattgcttct

SEQ ID NO: 3234416 - DNA, 19 bp, Homo sapiens
caggtctcccacgtgggag

SEQ ID NO: 3234417 - DNA, 18 bp, Homo sapiens
caggtcttcatatttttg

SEQ ID NO: 3234418 - DNA, 15 bp, Homo sapiens
caggtcttccagacc

SEQ ID NO: 3234419 - DNA, 19 bp, Homo sapiens
caggtcttgaactcctggc

SEQ ID NO: 3234420 - DNA, 13 bp, Homo sapiens
caggtgaaaatgt

SEQ ID NO: 3234421 - DNA, 18 bp, Homo sapiens
caggtgaacacttagtga

SEQ ID NO: 3234422 - DNA, 21 bp, Homo sapiens
caggtgacatgtgaaaccttt

SEQ ID NO: 3234423 - DNA, 18 bp, Homo sapiens
caggtgagctctgaccct

SEQ ID NO: 3234424 - DNA, 16 bp, Homo sapiens
caggtgatccacccac

SEQ ID NO: 3234425 - DNA, 20 bp, Homo sapiens
caggtgattggaccaggcca

SEQ ID NO: 3234426 - DNA, 18 bp, Homo sapiens
caggtgcagatgggctgt

SEQ ID NO: 3234427 - DNA, 13 bp, Homo sapiens
caggtgcagtggc

SEQ ID NO: 3234428 - DNA, 16 bp, Homo sapiens
caggtgccactccctg

SEQ ID NO: 3234429 - DNA, 14 bp, Homo sapiens
caggtgcctccagg

SEQ ID NO: 3234430 - DNA, 21 bp, Homo sapiens
caggtgcctccaggtgtgcac

SEQ ID NO: 3234431 - DNA, 19 bp, Homo sapiens
caggtgctacaacatgtga

SEQ ID NO: 3234432 - DNA, 21 bp, Homo sapiens
caggtgctcaataaacacttg

SEQ ID NO: 3234433 - DNA, 14 bp, Homo sapiens
caggtgctcccctg

SEQ ID NO: 3234434 - DNA, 13 bp, Homo sapiens
caggtgctgccat

SEQ ID NO: 3234435 - DNA, 14 bp, Homo sapiens
caggtgctggtccc

SEQ ID NO: 3234436 - DNA, 22 bp, Homo sapiens
caggtggatctatttcatgttt

SEQ ID NO: 3234437 - DNA, 21 bp, Homo sapiens
cagttactccctacactgatg

SEQ ID NO: 3234438 - DNA, 16 bp, Homo sapiens
cagttacttttttaca

SEQ ID NO: 3234439 - DNA, 19 bp, Homo sapiens
cagttagggttttgcaata

SEQ ID NO: 3234440 - DNA, 22 bp, Homo sapiens
cagttagggttttgcaataact

SEQ ID NO: 3234441 - DNA, 19 bp, Homo sapiens
cagttagttgtgaaagaaa

SEQ ID NO: 3234442 - DNA, 20 bp, Homo sapiens
cagttagttgtgaaagaaag

SEQ ID NO: 3234443 - DNA, 17 bp, Homo sapiens
cagttataaaattaaaa

SEQ ID NO: 3234444 - DNA, 20 bp, Homo sapiens
cagttataacagatgtgaaa

SEQ ID NO: 3234445 - DNA, 22 bp, Homo sapiens
cagttatatttttgtgttttct

SEQ ID NO: 3234446 - DNA, 16 bp, Homo sapiens
cagttatcctttgtga

SEQ ID NO: 3234447 - DNA, 23 bp, Homo sapiens
cagttatcctttgtgagcctatg

SEQ ID NO: 3234448 - DNA, 20 bp, Homo sapiens
cagttatcttagctggatat

SEQ ID NO: 3234449 - DNA, 22 bp, Homo sapiens
cagttatgatttttttttcata

SEQ ID NO: 3234450 - DNA, 18 bp, Homo sapiens
cagttatgtgaatgatct

SEQ ID NO: 3234451 - DNA, 15 bp, Homo sapiens
cagttattactgttt

SEQ ID NO: 3234452 - DNA, 17 bp, Homo sapiens
cagttattcattctgtg

SEQ ID NO: 3234453 - DNA, 21 bp, Homo sapiens
cagttattcattctgtgatca

SEQ ID NO: 3234454 - DNA, 14 bp, Homo sapiens
cagttatttatagt

SEQ ID NO: 3234455 - DNA, 14 bp, Homo sapiens
cagttattttgata

SEQ ID NO: 3234456 - DNA, 21 bp, Homo sapiens
cagttattttggatatattat

SEQ ID NO: 3234457 - DNA, 17 bp, Homo sapiens
cagttcaacctggtggc

SEQ ID NO: 3234458 - DNA, 15 bp, Homo sapiens
cagttcaactttcag

SEQ ID NO: 3234459 - DNA, 22 bp, Homo sapiens
cagttcaataaacttaacttta

SEQ ID NO: 3234460 - DNA, 15 bp, Homo sapiens
cagttcacaccctgc

SEQ ID NO: 3234461 - DNA, 19 bp, Homo sapiens
cagttcacaccctgcaagg

SEQ ID NO: 3234462 - DNA, 21 bp, Homo sapiens
cagttcagagttgtacactgt

SEQ ID NO: 3234463 - DNA, 23 bp, Homo sapiens
cagttcagtaataaactgtgttt

SEQ ID NO: 3234464 - DNA, 18 bp, Homo sapiens
cagttcattattttgtgg

SEQ ID NO: 3234465 - DNA, 13 bp, Homo sapiens
cagttccaagaaa

SEQ ID NO: 3234466 - DNA, 22 bp, Homo sapiens
cagttccatttatgctggttaa

SEQ ID NO: 3234467 - DNA, 12 bp, Homo sapiens
cagttcccagct

SEQ ID NO: 3234468 - DNA, 14 bp, Homo sapiens
cagttcccagctcc

SEQ ID NO: 3234469 - DNA, 22 bp, Homo sapiens
cagttcccccagtacctccaag

SEQ ID NO: 3234470 - DNA, 19 bp, Homo sapiens
cagttcccggagcacagcc

SEQ ID NO: 3234471 - DNA, 18 bp, Homo sapiens
cagttcccttggcctcag

SEQ ID NO: 3234472 - DNA, 19 bp, Homo sapiens
cagttcccttggcctcaga

SEQ ID NO: 3234473 - DNA, 22 bp, Homo sapiens
cagttccggattggcttgtgtg

SEQ ID NO: 3234474 - DNA, 17 bp, Homo sapiens
cagttctcactcctagg

SEQ ID NO: 3234475 - DNA, 23 bp, Homo sapiens
cagttctctcccttcctctctcc

SEQ ID NO: 3234476 - DNA, 16 bp, Homo sapiens
cagttctgctcctctc

SEQ ID NO: 3234477 - DNA, 18 bp, Homo sapiens
cagttctgctcctctcca

SEQ ID NO: 3234478 - DNA, 15 bp, Homo sapiens
cagttctttttgtac

SEQ ID NO: 3234479 - DNA, 20 bp, Homo sapiens
cagttgaatgacaacagaag

SEQ ID NO: 3234480 - DNA, 18 bp, Homo sapiens
cagttgacggggcagtca

SEQ ID NO: 3234481 - DNA, 20 bp, Homo sapiens
cagttgagtcgtcatcactt

SEQ ID NO: 3234482 - DNA, 12 bp, Homo sapiens
cagttgccacca

SEQ ID NO: 3234483 - DNA, 18 bp, Homo sapiens
cagttgccaccacctctg

SEQ ID NO: 3234484 - DNA, 12 bp, Homo sapiens
cagttgcccaga

SEQ ID NO: 3234485 - DNA, 20 bp, Homo sapiens
cagttgccctagcccagact

SEQ ID NO: 3234486 - DNA, 22 bp, Homo sapiens
cagttgccttttatcccaaagt

SEQ ID NO: 3234487 - DNA, 23 bp, Homo sapiens
cagttgctcaaaaagaaatcaat

SEQ ID NO: 3234488 - DNA, 21 bp, Homo sapiens
cagttggaaataataaaagat

SEQ ID NO: 3234489 - DNA, 18 bp, Homo sapiens
cagttggactctcaggga

SEQ ID NO: 3234490 - DNA, 18 bp, Homo sapiens
cagttggatcttttgaag

SEQ ID NO: 3234491 - DNA, 16 bp, Homo sapiens
cagttggccagagagc

SEQ ID NO: 3234492 - DNA, 16 bp, Homo sapiens
cagttgggagcactgg

SEQ ID NO: 3234493 - DNA, 16 bp, Homo sapiens
cagttgggtggatgcc

SEQ ID NO: 3234494 - DNA, 18 bp, Homo sapiens
cagttgggtggatgcctg

SEQ ID NO: 3234495 - DNA, 14 bp, Homo sapiens
cagttggtaacttt

SEQ ID NO: 3234496 - DNA, 19 bp, Homo sapiens
cagttggtggggccaggcc

SEQ ID NO: 3234497 - DNA, 22 bp, Homo sapiens
cagttggtggggccaggccagg

SEQ ID NO: 3234498 - DNA, 21 bp, Homo sapiens
cagttgtagggttacagagac

SEQ ID NO: 3234499 - DNA, 23 bp, Homo sapiens
cagttgtagggttacagagacct

SEQ ID NO: 3234500 - DNA, 19 bp, Homo sapiens
cagttgtctattctgagcc

SEQ ID NO: 3234501 - DNA, 14 bp, Homo sapiens
cagttgtgttcatg

SEQ ID NO: 3234502 - DNA, 18 bp, Homo sapiens
cagtttaaaaaaattggt

SEQ ID NO: 3234503 - DNA, 23 bp, Homo sapiens
cagtttaaaggggtcccatcagt

SEQ ID NO: 3234504 - DNA, 23 bp, Homo sapiens
cagtttaccagttgccttttatc

SEQ ID NO: 3234505 - DNA, 18 bp, Homo sapiens
cagtttataccctagtta

SEQ ID NO: 3234506 - DNA, 22 bp, Homo sapiens
cagtttcaggtgtttagttgca

SEQ ID NO: 3234507 - DNA, 15 bp, Homo sapiens
cagtttcattattct

SEQ ID NO: 3234508 - DNA, 14 bp, Homo sapiens
cagtttccatgaaa

SEQ ID NO: 3234509 - DNA, 15 bp, Homo sapiens
cagtttcttagcttt

SEQ ID NO: 3234510 - DNA, 21 bp, Homo sapiens
cagtttcttgcttggaagcca

SEQ ID NO: 3234511 - DNA, 23 bp, Homo sapiens
cagtttcttgcttggaagccagg

SEQ ID NO: 3234512 - DNA, 13 bp, Homo sapiens
cagtttgaacaaa

SEQ ID NO: 3234513 - DNA, 16 bp, Homo sapiens
cagtttgagacaggag

SEQ ID NO: 3234514 - DNA, 21 bp, Homo sapiens
cagtttgaggaagtggctgtc

SEQ ID NO: 3234515 - DNA, 18 bp, Homo sapiens
cagtttgcacctgtcccc

SEQ ID NO: 3234516 - DNA, 14 bp, Homo sapiens
cagtttgctttgta

SEQ ID NO: 3234517 - DNA, 22 bp, Homo sapiens
cagtttgggtaaaatactttta

SEQ ID NO: 3234518 - DNA, 19 bp, Homo sapiens
cagtttggtttatattctt

SEQ ID NO: 3234519 - DNA, 13 bp, Homo sapiens
cagtttgtcagac

SEQ ID NO: 3234520 - DNA, 12 bp, Homo sapiens
cagttttaactg

SEQ ID NO: 3234521 - DNA, 18 bp, Homo sapiens
cagttttaactgtggata

SEQ ID NO: 3234522 - DNA, 20 bp, Homo sapiens
cagttttaactgtggatatt

SEQ ID NO: 3234523 - DNA, 14 bp, Homo sapiens
cagttttccatgaa

SEQ ID NO: 3234524 - DNA, 16 bp, Homo sapiens
cagttttccatgaaaa

SEQ ID NO: 3234525 - DNA, 18 bp, Homo sapiens
cagttttccatgaaaacg

SEQ ID NO: 3234526 - DNA, 14 bp, Homo sapiens
cagttttcccctgg

SEQ ID NO: 3234527 - DNA, 20 bp, Homo sapiens
cagtttttcattttaaaaag

SEQ ID NO: 3234528 - DNA, 20 bp, Homo sapiens
cagtttttgtttttgcatga

SEQ ID NO: 3234529 - DNA, 23 bp, Homo sapiens
cagtttttgtttttgcatgaaat

SEQ ID NO: 3234530 - DNA, 21 bp, Homo sapiens
cataaaaaagaagcactttga

SEQ ID NO: 3234531 - DNA, 13 bp, Homo sapiens
cataaaaaccaaa

SEQ ID NO: 3234532 - DNA, 21 bp, Homo sapiens
cataaaaagcagaattttaat

SEQ ID NO: 3234533 - DNA, 12 bp, Homo sapiens
cataaaacaggt

SEQ ID NO: 3234534 - DNA, 19 bp, Homo sapiens
cataaaataaagtatatat

SEQ ID NO: 3234535 - DNA, 12 bp, Homo sapiens
cataaaatctgt

SEQ ID NO: 3234536 - DNA, 17 bp, Homo sapiens
cataaaatctgtgaatt

SEQ ID NO: 3234537 - DNA, 13 bp, Homo sapiens
cataaactgactt

SEQ ID NO: 3234538 - DNA, 20 bp, Homo sapiens
cataaagctcaaatgaaatg

SEQ ID NO: 3234539 - DNA, 20 bp, Homo sapiens
cataaagggttgaaaatgtg

SEQ ID NO: 3234540 - DNA, 14 bp, Homo sapiens
cataaataaaactg

SEQ ID NO: 3234541 - DNA, 17 bp, Homo sapiens
cataaatagtagaaaaa

SEQ ID NO: 3234542 - DNA, 12 bp, Homo sapiens
cataaatatgca

SEQ ID NO: 3234543 - DNA, 13 bp, Homo sapiens
cataaatgaagca

SEQ ID NO: 3234544 - DNA, 17 bp, Homo sapiens
cataaattatgagattt

SEQ ID NO: 3234545 - DNA, 16 bp, Homo sapiens
cataaattcaactttg

SEQ ID NO: 3234546 - DNA, 19 bp, Homo sapiens
cataaccttaaaaaggact

SEQ ID NO: 3234547 - DNA, 22 bp, Homo sapiens
cataacggaaaaataattgcca

SEQ ID NO: 3234548 - DNA, 16 bp, Homo sapiens
cataacgtttttcctt

SEQ ID NO: 3234549 - DNA, 16 bp, Homo sapiens
cataactaaatttgat

SEQ ID NO: 3234550 - DNA, 18 bp, Homo sapiens
cataactctgtaaaaaca

SEQ ID NO: 3234551 - DNA, 22 bp, Homo sapiens
cataactctgtaaaaacactga

SEQ ID NO: 3234552 - DNA, 13 bp, Homo sapiens
cataacttcctgt

SEQ ID NO: 3234553 - DNA, 11 bp, Homo sapiens
cataagattaa

SEQ ID NO: 3234554 - DNA, 12 bp, Homo sapiens
cataagattaaa

SEQ ID NO: 3234555 - DNA, 21 bp, Homo sapiens
cataagcctccatttagttct

SEQ ID NO: 3234556 - DNA, 23 bp, Homo sapiens
cataagcctccatttagttcttt

SEQ ID NO: 3234557 - DNA, 19 bp, Homo sapiens
cataagcggcgtaagttta

SEQ ID NO: 3234558 - DNA, 17 bp, Homo sapiens
cataagcttccatttta

SEQ ID NO: 3234559 - DNA, 19 bp, Homo sapiens
cataagcttccattttaat

SEQ ID NO: 3234560 - DNA, 21 bp, Homo sapiens
cataaggccagtatgatttat

SEQ ID NO: 3234561 - DNA, 15 bp, Homo sapiens
cataaggcttcaaaa

SEQ ID NO: 3234562 - DNA, 12 bp, Homo sapiens
catcctgagccc

SEQ ID NO: 3234563 - DNA, 19 bp, Homo sapiens
catcctgagccccgccctc

SEQ ID NO: 3234564 - DNA, 21 bp, Homo sapiens
catcctgagccccgccctctt

SEQ ID NO: 3234565 - DNA, 22 bp, Homo sapiens
catcctgagccccgccctcttc

SEQ ID NO: 3234566 - DNA, 18 bp, Homo sapiens
catcctgaggctccactt

SEQ ID NO: 3234567 - DNA, 13 bp, Homo sapiens
catcctgccagcc

SEQ ID NO: 3234568 - DNA, 15 bp, Homo sapiens
catcctgccagcccc

SEQ ID NO: 3234569 - DNA, 22 bp, Homo sapiens
catcctgccagccccacacagc

SEQ ID NO: 3234570 - DNA, 12 bp, Homo sapiens
catcctgcctgg

SEQ ID NO: 3234571 - DNA, 23 bp, Homo sapiens
catcctgcctgggtgggacagcc

SEQ ID NO: 3234572 - DNA, 22 bp, Homo sapiens
catcctggcacccggcccctgc

SEQ ID NO: 3234573 - DNA, 11 bp, Homo sapiens
catcctggctg

SEQ ID NO: 3234574 - DNA, 19 bp, Homo sapiens
catcctggggcagcactcc

SEQ ID NO: 3234575 - DNA, 11 bp, Homo sapiens
catcctgtgaa

SEQ ID NO: 3234576 - DNA, 12 bp, Homo sapiens
catcctgtgtca

SEQ ID NO: 3234577 - DNA, 11 bp, Homo sapiens
catccttaaag

SEQ ID NO: 3234578 - DNA, 12 bp, Homo sapiens
catccttcccca

SEQ ID NO: 3234579 - DNA, 13 bp, Homo sapiens
catccttcccttt

SEQ ID NO: 3234580 - DNA, 16 bp, Homo sapiens
catcctttgcactgtc

SEQ ID NO: 3234581 - DNA, 18 bp, Homo sapiens
catcgcaccattctgact

SEQ ID NO: 3234582 - DNA, 17 bp, Homo sapiens
catcgcaggagtctctg

SEQ ID NO: 3234583 - DNA, 21 bp, Homo sapiens
catcgcaggagtctctgccac

SEQ ID NO: 3234584 - DNA, 23 bp, Homo sapiens
catcgcaggagtctctgccaccc

SEQ ID NO: 3234585 - DNA, 18 bp, Homo sapiens
catcgccaaggactgact

SEQ ID NO: 3234586 - DNA, 20 bp, Homo sapiens
catcggacaagacccccagc

SEQ ID NO: 3234587 - DNA, 21 bp, Homo sapiens
catcggactaaactatctgta

SEQ ID NO: 3234588 - DNA, 17 bp, Homo sapiens
catcggaggctgggccc

SEQ ID NO: 3234589 - DNA, 21 bp, Homo sapiens
catcggccaagaatacttgaa

SEQ ID NO: 3234590 - DNA, 17 bp, Homo sapiens
catcgggaaagaagaaa

SEQ ID NO: 3234591 - DNA, 19 bp, Homo sapiens
catcgggagcacccagagc

SEQ ID NO: 3234592 - DNA, 14 bp, Homo sapiens
catcgggggcagag

SEQ ID NO: 3234593 - DNA, 20 bp, Homo sapiens
catcgtgaaaccctgtctct

SEQ ID NO: 3234594 - DNA, 23 bp, Homo sapiens
catctaaaaatagacttaaatct

SEQ ID NO: 3234595 - DNA, 16 bp, Homo sapiens
catctaaagcagcagg

SEQ ID NO: 3234596 - DNA, 15 bp, Homo sapiens
catctaattctgatt

SEQ ID NO: 3234597 - DNA, 15 bp, Homo sapiens
catctacttaataaa

SEQ ID NO: 3234598 - DNA, 18 bp, Homo sapiens
catctaggtaatttttac

SEQ ID NO: 3234599 - DNA, 14 bp, Homo sapiens
catctataaattgt

SEQ ID NO: 3234600 - DNA, 20 bp, Homo sapiens
catctatgagggtgtttcct

SEQ ID NO: 3234601 - DNA, 23 bp, Homo sapiens
catctatgagggtgtttcctcta

SEQ ID NO: 3234602 - DNA, 21 bp, Homo sapiens
catctcaaaacagagggctgc

SEQ ID NO: 3234603 - DNA, 14 bp, Homo sapiens
catctcaaaattat

SEQ ID NO: 3234604 - DNA, 19 bp, Homo sapiens
catctcactggatgcaaag

SEQ ID NO: 3234605 - DNA, 19 bp, Homo sapiens
catctcagcctcctgagcc

SEQ ID NO: 3234606 - DNA, 20 bp, Homo sapiens
catctcagcctcctgagcct

SEQ ID NO: 3234607 - DNA, 22 bp, Homo sapiens
catctcagcctcctgagcctgt

SEQ ID NO: 3234608 - DNA, 12 bp, Homo sapiens
catctcaggggc

SEQ ID NO: 3234609 - DNA, 12 bp, Homo sapiens
catctcaggtgc

SEQ ID NO: 3234610 - DNA, 13 bp, Homo sapiens
catctcaggtgcc

SEQ ID NO: 3234611 - DNA, 21 bp, Homo sapiens
catctccaagataagcctgag

SEQ ID NO: 3234612 - DNA, 14 bp, Homo sapiens
catctccactccag

SEQ ID NO: 3234613 - DNA, 16 bp, Homo sapiens
catctcccaccctgta

SEQ ID NO: 3234614 - DNA, 16 bp, Homo sapiens
catctccccaggcctc

SEQ ID NO: 3234615 - DNA, 14 bp, Homo sapiens
catctccctgcctg

SEQ ID NO: 3234616 - DNA, 18 bp, Homo sapiens
catctccctgcctggccc

SEQ ID NO: 3234617 - DNA, 14 bp, Homo sapiens
catctcccttcatt

SEQ ID NO: 3234618 - DNA, 22 bp, Homo sapiens
catctcccttcattagctgctc

SEQ ID NO: 3234619 - DNA, 19 bp, Homo sapiens
catctcctataatctgtca

SEQ ID NO: 3234620 - DNA, 20 bp, Homo sapiens
catctcctataatctgtcaa

SEQ ID NO: 3234621 - DNA, 20 bp, Homo sapiens
catctcctccatactcagga

SEQ ID NO: 3234622 - DNA, 13 bp, Homo sapiens
catctcctggcta

SEQ ID NO: 3234623 - DNA, 21 bp, Homo sapiens
catctcctggctaagcctctg

SEQ ID NO: 3234624 - DNA, 22 bp, Homo sapiens
catctcctggctaagcctctgc

SEQ ID NO: 3234625 - DNA, 12 bp, Homo sapiens
catctcctgtcc

SEQ ID NO: 3234626 - DNA, 15 bp, Homo sapiens
catctcctgtgcatg

SEQ ID NO: 3234627 - DNA, 20 bp, Homo sapiens
catctcctgtgcatgggtga

SEQ ID NO: 3234628 - DNA, 15 bp, Homo sapiens
catctcggagcatcc

SEQ ID NO: 3234629 - DNA, 20 bp, Homo sapiens
catctcggagcatcccggag

SEQ ID NO: 3234630 - DNA, 22 bp, Homo sapiens
catctcgggagtcctctagcag

SEQ ID NO: 3234631 - DNA, 20 bp, Homo sapiens
catctcggttctgcgccact

SEQ ID NO: 3234632 - DNA, 17 bp, Homo sapiens
catctctcatcctccag

SEQ ID NO: 3234633 - DNA, 13 bp, Homo sapiens
catctctccccaa

SEQ ID NO: 3234634 - DNA, 15 bp, Homo sapiens
catctctccctcccc

SEQ ID NO: 3234635 - DNA, 16 bp, Homo sapiens
catctctccctcccct

SEQ ID NO: 3234636 - DNA, 21 bp, Homo sapiens
catctctctactcctacctca

SEQ ID NO: 3234637 - DNA, 22 bp, Homo sapiens
catctctctactcctacctcag

SEQ ID NO: 3234638 - DNA, 14 bp, Homo sapiens
catctctctggggc

SEQ ID NO: 3234639 - DNA, 22 bp, Homo sapiens
catctctgcagctcaaagatgt

SEQ ID NO: 3234640 - DNA, 13 bp, Homo sapiens
catctcttcaggt

SEQ ID NO: 3234641 - DNA, 23 bp, Homo sapiens
catctcttcctacccaaccactc

SEQ ID NO: 3234642 - DNA, 16 bp, Homo sapiens
catctgaaacccacag

SEQ ID NO: 3234643 - DNA, 18 bp, Homo sapiens
catctgaatgaaaataac

SEQ ID NO: 3234644 - DNA, 14 bp, Homo sapiens
catctgacacaaaa

SEQ ID NO: 3234645 - DNA, 11 bp, Homo sapiens
catctgaggag

SEQ ID NO: 3234646 - DNA, 18 bp, Homo sapiens
catctgatgccgtgatcc

SEQ ID NO: 3234647 - DNA, 20 bp, Homo sapiens
catctgcaaaaggcctcttg

SEQ ID NO: 3234648 - DNA, 17 bp, Homo sapiens
catctgcaatatgaatt

SEQ ID NO: 3234649 - DNA, 21 bp, Homo sapiens
catctgcacacacctccgaga

SEQ ID NO: 3234650 - DNA, 23 bp, Homo sapiens
catctgcacacacctccgagaca

SEQ ID NO: 3234651 - DNA, 19 bp, Homo sapiens
catctgcaccccttctctc

SEQ ID NO: 3234652 - DNA, 23 bp, Homo sapiens
catctgcaccccttctctcctcc

SEQ ID NO: 3234653 - DNA, 23 bp, Homo sapiens
catctgcaccctcgatgaagccc

SEQ ID NO: 3234654 - DNA, 20 bp, Homo sapiens
catctgcattttcaccccac

SEQ ID NO: 3234655 - DNA, 13 bp, Homo sapiens
catctgccagacc

SEQ ID NO: 3234656 - DNA, 11 bp, Homo sapiens
catctgcccag

SEQ ID NO: 3234657 - DNA, 16 bp, Homo sapiens
catctgcccaggggtg

SEQ ID NO: 3234658 - DNA, 23 bp, Homo sapiens
catctgcccaggggtgccccctc

SEQ ID NO: 3234659 - DNA, 13 bp, Homo sapiens
catctgcccctcc

SEQ ID NO: 3234660 - DNA, 20 bp, Homo sapiens
catctgcctgttctgaggat

SEQ ID NO: 3234661 - DNA, 18 bp, Homo sapiens
catctgccttaaaaccaa

SEQ ID NO: 3234662 - DNA, 14 bp, Homo sapiens
catctgctctaggg

SEQ ID NO: 3234663 - DNA, 16 bp, Homo sapiens
catctgctctagggaa

SEQ ID NO: 3234664 - DNA, 22 bp, Homo sapiens
catctgctctagggaatctgga

SEQ ID NO: 3234665 - DNA, 19 bp, Homo sapiens
catctgctggtccgtggga

SEQ ID NO: 3234666 - DNA, 18 bp, Homo sapiens
catctgcttggttggctg

SEQ ID NO: 3234667 - DNA, 16 bp, Homo sapiens
catctgcttttattaa

SEQ ID NO: 3234668 - DNA, 20 bp, Homo sapiens
catctggcctggcctggccc

SEQ ID NO: 3234669 - DNA, 17 bp, Homo sapiens
catctggctgtttagca

SEQ ID NO: 3234670 - DNA, 18 bp, Homo sapiens
catctggcttattttaat

SEQ ID NO: 3234671 - DNA, 19 bp, Homo sapiens
catctggcttattttaatg

SEQ ID NO: 3234672 - DNA, 23 bp, Homo sapiens
catctggcttattttaatgtgat

SEQ ID NO: 3234673 - DNA, 18 bp, Homo sapiens
catctgggagtccccttt

SEQ ID NO: 3234674 - DNA, 19 bp, Homo sapiens
catctgggagtcccctttt

SEQ ID NO: 3234675 - DNA, 17 bp, Homo sapiens
catctggggatgacaat

SEQ ID NO: 3234676 - DNA, 13 bp, Homo sapiens
catctggggtggg

SEQ ID NO: 3234677 - DNA, 19 bp, Homo sapiens
catctggggttggcaacag

SEQ ID NO: 3234678 - DNA, 22 bp, Homo sapiens
catctggttgaactctggtggc

SEQ ID NO: 3234679 - DNA, 22 bp, Homo sapiens
catctggttgaatggcttttct

SEQ ID NO: 3234680 - DNA, 18 bp, Homo sapiens
catctgtataccctctgt

SEQ ID NO: 3234681 - DNA, 19 bp, Homo sapiens
catctgtataccctctgtt

SEQ ID NO: 3234682 - DNA, 20 bp, Homo sapiens
catctgtcaccaattggtta

SEQ ID NO: 3234683 - DNA, 12 bp, Homo sapiens
catctgtcatta

SEQ ID NO: 3234684 - DNA, 14 bp, Homo sapiens
catctgtcattata

SEQ ID NO: 3234685 - DNA, 19 bp, Homo sapiens
catctgtccatggcctttc

SEQ ID NO: 3234686 - DNA, 14 bp, Homo sapiens
catctgtggagctg

SEQ ID NO: 3234687 - DNA, 16 bp, Homo sapiens
catggctcaggcaagc

SEQ ID NO: 3234688 - DNA, 17 bp, Homo sapiens
catggctccagaaatgt

SEQ ID NO: 3234689 - DNA, 18 bp, Homo sapiens
catggctgctgttgctta

SEQ ID NO: 3234690 - DNA, 17 bp, Homo sapiens
catggctgtgtttgcag

SEQ ID NO: 3234691 - DNA, 23 bp, Homo sapiens
catgggaaactgttgtgggcgct

SEQ ID NO: 3234692 - DNA, 18 bp, Homo sapiens
catgggaaagccacctct

SEQ ID NO: 3234693 - DNA, 20 bp, Homo sapiens
catgggaaatgtcaacaagt

SEQ ID NO: 3234694 - DNA, 23 bp, Homo sapiens
catgggacagggaggacgctctc

SEQ ID NO: 3234695 - DNA, 21 bp, Homo sapiens
catgggaggtgaaaggggcac

SEQ ID NO: 3234696 - DNA, 20 bp, Homo sapiens
catgggagtaagttcttcaa

SEQ ID NO: 3234697 - DNA, 22 bp, Homo sapiens
catgggatacaacctccctctt

SEQ ID NO: 3234698 - DNA, 17 bp, Homo sapiens
catgggcattgggttct

SEQ ID NO: 3234699 - DNA, 22 bp, Homo sapiens
catgggccagagcctcggccct

SEQ ID NO: 3234700 - DNA, 12 bp, Homo sapiens
catgggccagcc

SEQ ID NO: 3234701 - DNA, 16 bp, Homo sapiens
catgggcctcctgtgt

SEQ ID NO: 3234702 - DNA, 12 bp, Homo sapiens
catgggcctggg

SEQ ID NO: 3234703 - DNA, 14 bp, Homo sapiens
catgggcctgggcc

SEQ ID NO: 3234704 - DNA, 19 bp, Homo sapiens
catgggcctgggcctgctt

SEQ ID NO: 3234705 - DNA, 17 bp, Homo sapiens
catgggcgcaggcccag

SEQ ID NO: 3234706 - DNA, 23 bp, Homo sapiens
catgggctagtgtgagtggcagc

SEQ ID NO: 3234707 - DNA, 14 bp, Homo sapiens
catgggcttcactg

SEQ ID NO: 3234708 - DNA, 15 bp, Homo sapiens
catgggcttcactgt

SEQ ID NO: 3234709 - DNA, 17 bp, Homo sapiens
catgggcttcactgtat

SEQ ID NO: 3234710 - DNA, 23 bp, Homo sapiens
catgggcttcactgtataaatag

SEQ ID NO: 3234711 - DNA, 12 bp, Homo sapiens
catgggcttgga

SEQ ID NO: 3234712 - DNA, 20 bp, Homo sapiens
catggggagggattctggtt

SEQ ID NO: 3234713 - DNA, 21 bp, Homo sapiens
catggggatcaattttcatta

SEQ ID NO: 3234714 - DNA, 23 bp, Homo sapiens
catgggggcaccgggctccatgc

SEQ ID NO: 3234715 - DNA, 18 bp, Homo sapiens
catgggggtgaccccacg

SEQ ID NO: 3234716 - DNA, 19 bp, Homo sapiens
catgggtccaagagacatg

SEQ ID NO: 3234717 - DNA, 23 bp, Homo sapiens
catgggtgaagggagagccagct

SEQ ID NO: 3234718 - DNA, 21 bp, Homo sapiens
catggtacccccttctgggca

SEQ ID NO: 3234719 - DNA, 20 bp, Homo sapiens
catggtagagaatctctccc

SEQ ID NO: 3234720 - DNA, 16 bp, Homo sapiens
catggtcaaccctcag

SEQ ID NO: 3234721 - DNA, 17 bp, Homo sapiens
catggtcaaccctcagg

SEQ ID NO: 3234722 - DNA, 16 bp, Homo sapiens
catggtcacacactga

SEQ ID NO: 3234723 - DNA, 21 bp, Homo sapiens
catggtcacacactgatgctt

SEQ ID NO: 3234724 - DNA, 17 bp, Homo sapiens
catggtctagaaatgcg

SEQ ID NO: 3234725 - DNA, 18 bp, Homo sapiens
catggtgaaaatgtactg

SEQ ID NO: 3234726 - DNA, 17 bp, Homo sapiens
catggtgaaaccccatt

SEQ ID NO: 3234727 - DNA, 19 bp, Homo sapiens
catggtgaaaccccgtctc

SEQ ID NO: 3234728 - DNA, 21 bp, Homo sapiens
catggtgcctgagaggcaggc

SEQ ID NO: 3234729 - DNA, 21 bp, Homo sapiens
catggtggatatggtgcagag

SEQ ID NO: 3234730 - DNA, 19 bp, Homo sapiens
catggtggctcatgcctgt

SEQ ID NO: 3234731 - DNA, 18 bp, Homo sapiens
catggtgtaataagacat

SEQ ID NO: 3234732 - DNA, 21 bp, Homo sapiens
catggtgtaataagacataac

SEQ ID NO: 3234733 - DNA, 21 bp, Homo sapiens
catggtgttttcattccccct

SEQ ID NO: 3234734 - DNA, 23 bp, Homo sapiens
catggtgtttttataaagaattc

SEQ ID NO: 3234735 - DNA, 19 bp, Homo sapiens
catggttaagagtccaaga

SEQ ID NO: 3234736 - DNA, 17 bp, Homo sapiens
catggtttccatttact

SEQ ID NO: 3234737 - DNA, 18 bp, Homo sapiens
catgtaaacaaaatttag

SEQ ID NO: 3234738 - DNA, 22 bp, Homo sapiens
catgtaaataccagactgcagg

SEQ ID NO: 3234739 - DNA, 21 bp, Homo sapiens
catgtaaatccccactgggac

SEQ ID NO: 3234740 - DNA, 9 bp, Homo sapiens
catgtaaca

SEQ ID NO: 3234741 - DNA, 22 bp, Homo sapiens
catgtaacattggtgaaggatc

SEQ ID NO: 3234742 - DNA, 17 bp, Homo sapiens
catgtaaccggcatgtt

SEQ ID NO: 3234743 - DNA, 22 bp, Homo sapiens
catgtaaccggcatgtttccag

SEQ ID NO: 3234744 - DNA, 12 bp, Homo sapiens
catgtaataaaa

SEQ ID NO: 3234745 - DNA, 16 bp, Homo sapiens
catgtaataaattcaa

SEQ ID NO: 3234746 - DNA, 19 bp, Homo sapiens
catgtaataaattcaaaac

SEQ ID NO: 3234747 - DNA, 19 bp, Homo sapiens
catgtaatgttaatgttat

SEQ ID NO: 3234748 - DNA, 23 bp, Homo sapiens
catgtaatgttaatgttatatca

SEQ ID NO: 3234749 - DNA, 18 bp, Homo sapiens
catgtaattaagtactat

SEQ ID NO: 3234750 - DNA, 19 bp, Homo sapiens
catgtacctaatccaaata

SEQ ID NO: 3234751 - DNA, 19 bp, Homo sapiens
catgtactttggcatcttt

SEQ ID NO: 3234752 - DNA, 22 bp, Homo sapiens
catgtactttttagtaatttct

SEQ ID NO: 3234753 - DNA, 12 bp, Homo sapiens
catgtagagaaa

SEQ ID NO: 3234754 - DNA, 13 bp, Homo sapiens
catgtagagaaaa

SEQ ID NO: 3234755 - DNA, 15 bp, Homo sapiens
catgtagccagcaga

SEQ ID NO: 3234756 - DNA, 21 bp, Homo sapiens
catgtagccccctggcctctg

SEQ ID NO: 3234757 - DNA, 22 bp, Homo sapiens
catgtagccccctggcctctgt

SEQ ID NO: 3234758 - DNA, 13 bp, Homo sapiens
catgtatgatgag

SEQ ID NO: 3234759 - DNA, 20 bp, Homo sapiens
catgtatggttactaaaaag

SEQ ID NO: 3234760 - DNA, 21 bp, Homo sapiens
catgtatgtcttggacactgt

SEQ ID NO: 3234761 - DNA, 22 bp, Homo sapiens
catgtatgtcttggacactgta

SEQ ID NO: 3234762 - DNA, 23 bp, Homo sapiens
catgtatgttatgatattgttta

SEQ ID NO: 3234763 - DNA, 18 bp, Homo sapiens
catgtattgcacattgta

SEQ ID NO: 3234764 - DNA, 15 bp, Homo sapiens
catgtatttatctct

SEQ ID NO: 3234765 - DNA, 23 bp, Homo sapiens
catgtatttatctctatttaata

SEQ ID NO: 3234766 - DNA, 14 bp, Homo sapiens
catgtatttgagca

SEQ ID NO: 3234767 - DNA, 13 bp, Homo sapiens
catgtattttaca

SEQ ID NO: 3234768 - DNA, 22 bp, Homo sapiens
catgtcaacaatccacatcaga

SEQ ID NO: 3234769 - DNA, 18 bp, Homo sapiens
catgtcaacttctggctc

SEQ ID NO: 3234770 - DNA, 21 bp, Homo sapiens
catgtcaagaggaaaagctgt

SEQ ID NO: 3234771 - DNA, 14 bp, Homo sapiens
catgtcactgtggt

SEQ ID NO: 3234772 - DNA, 12 bp, Homo sapiens
catgtccaaaga

SEQ ID NO: 3234773 - DNA, 15 bp, Homo sapiens
catgtccaaagaggc

SEQ ID NO: 3234774 - DNA, 16 bp, Homo sapiens
catgtccaaagaggct

SEQ ID NO: 3234775 - DNA, 19 bp, Homo sapiens
catgtccaaagaggctgcc

SEQ ID NO: 3234776 - DNA, 15 bp, Homo sapiens
catgtccaagttctt

SEQ ID NO: 3234777 - DNA, 13 bp, Homo sapiens
catgtccatccct

SEQ ID NO: 3234778 - DNA, 16 bp, Homo sapiens
catgtccctaccgagt

SEQ ID NO: 3234779 - DNA, 22 bp, Homo sapiens
catgtccctaccgagtctcttc

SEQ ID NO: 3234780 - DNA, 14 bp, Homo sapiens
catgtcctatgtgt

SEQ ID NO: 3234781 - DNA, 22 bp, Homo sapiens
catgtcctgcctattatctgtc

SEQ ID NO: 3234782 - DNA, 17 bp, Homo sapiens
catgtcctgctggcttc

SEQ ID NO: 3234783 - DNA, 22 bp, Homo sapiens
catgtcctgctggcttccagct

SEQ ID NO: 3234784 - DNA, 15 bp, Homo sapiens
catgtcctgtaaagg

SEQ ID NO: 3234785 - DNA, 16 bp, Homo sapiens
catgtcgcacaatgtt

SEQ ID NO: 3234786 - DNA, 14 bp, Homo sapiens
catgtcgcctctgc

SEQ ID NO: 3234787 - DNA, 14 bp, Homo sapiens
catgtcgtgaccaa

SEQ ID NO: 3234788 - DNA, 17 bp, Homo sapiens
catgtctattcagcttc

SEQ ID NO: 3234789 - DNA, 20 bp, Homo sapiens
catgtctgcagtgtgccccc

SEQ ID NO: 3234790 - DNA, 14 bp, Homo sapiens
catgtcttgtacat

SEQ ID NO: 3234791 - DNA, 14 bp, Homo sapiens
catgtctttactgg

SEQ ID NO: 3234792 - DNA, 13 bp, Homo sapiens
catgtgaaacctt

SEQ ID NO: 3234793 - DNA, 21 bp, Homo sapiens
catgtgaagcatgctttgctg

SEQ ID NO: 3234794 - DNA, 14 bp, Homo sapiens
catgtgacacatat

SEQ ID NO: 3234795 - DNA, 16 bp, Homo sapiens
catgtgacacatatgc

SEQ ID NO: 3234796 - DNA, 14 bp, Homo sapiens
catgtgacacccac

SEQ ID NO: 3234797 - DNA, 18 bp, Homo sapiens
catgtgacacccacaatc

SEQ ID NO: 3234798 - DNA, 23 bp, Homo sapiens
catgtgagccaccgctgccagca

SEQ ID NO: 3234799 - DNA, 14 bp, Homo sapiens
catgtgaggaggaa

SEQ ID NO: 3234800 - DNA, 15 bp, Homo sapiens
catgtgaggaggaaa

SEQ ID NO: 3234801 - DNA, 16 bp, Homo sapiens
catgtgaggaggaaaa

SEQ ID NO: 3234802 - DNA, 15 bp, Homo sapiens
catgtgatacatttt

SEQ ID NO: 3234803 - DNA, 14 bp, Homo sapiens
catgtgcacatgca

SEQ ID NO: 3234804 - DNA, 22 bp, Homo sapiens
catgtgccagggcaatgatgaa

SEQ ID NO: 3234805 - DNA, 22 bp, Homo sapiens
catgtgccaggtttttggtctg

SEQ ID NO: 3234806 - DNA, 22 bp, Homo sapiens
catgtgcctctgcggggcaggg

SEQ ID NO: 3234807 - DNA, 15 bp, Homo sapiens
catgtgcctgcacca

SEQ ID NO: 3234808 - DNA, 18 bp, Homo sapiens
catgtgcctgcaccagga

SEQ ID NO: 3234809 - DNA, 19 bp, Homo sapiens
catgtgctgtgaccattta

SEQ ID NO: 3234810 - DNA, 16 bp, Homo sapiens
catgtggaaagtgaat

SEQ ID NO: 3234811 - DNA, 18 bp, Homo sapiens
catgtggaaagtgaattt

SEQ ID NO: 3234812 - DNA, 19 bp, Homo sapiens
cattgcccccacctctggt

SEQ ID NO: 3234813 - DNA, 22 bp, Homo sapiens
cattgcctaactactagttttt

SEQ ID NO: 3234814 - DNA, 16 bp, Homo sapiens
cattgcctcctgttct

SEQ ID NO: 3234815 - DNA, 15 bp, Homo sapiens
cattgcggccccagg

SEQ ID NO: 3234816 - DNA, 23 bp, Homo sapiens
cattgcgtttgaccttttatgta

SEQ ID NO: 3234817 - DNA, 11 bp, Homo sapiens
cattgctctct

SEQ ID NO: 3234818 - DNA, 16 bp, Homo sapiens
cattgctctctgggct

SEQ ID NO: 3234819 - DNA, 16 bp, Homo sapiens
cattgctgagcctctg

SEQ ID NO: 3234820 - DNA, 22 bp, Homo sapiens
cattgctgctgctaccagcgcc

SEQ ID NO: 3234821 - DNA, 20 bp, Homo sapiens
cattgctggtagagaccccc

SEQ ID NO: 3234822 - DNA, 15 bp, Homo sapiens
cattgctggttctat

SEQ ID NO: 3234823 - DNA, 21 bp, Homo sapiens
cattgctggttctatttaatg

SEQ ID NO: 3234824 - DNA, 12 bp, Homo sapiens
cattgctttctg

SEQ ID NO: 3234825 - DNA, 22 bp, Homo sapiens
cattgctttgaagcagttgtgt

SEQ ID NO: 3234826 - DNA, 23 bp, Homo sapiens
cattgctttgaagcagttgtgtc

SEQ ID NO: 3234827 - DNA, 17 bp, Homo sapiens
cattgcttttattttga

SEQ ID NO: 3234828 - DNA, 20 bp, Homo sapiens
cattgcttttattttgaaaa

SEQ ID NO: 3234829 - DNA, 11 bp, Homo sapiens
cattgcttttc

SEQ ID NO: 3234830 - DNA, 13 bp, Homo sapiens
cattggaagccat

SEQ ID NO: 3234831 - DNA, 18 bp, Homo sapiens
cattggaatgttctcaga

SEQ ID NO: 3234832 - DNA, 19 bp, Homo sapiens
cattggagctgactgttct

SEQ ID NO: 3234833 - DNA, 14 bp, Homo sapiens
cattggatttttgt

SEQ ID NO: 3234834 - DNA, 19 bp, Homo sapiens
cattggccagctcataaaa

SEQ ID NO: 3234835 - DNA, 11 bp, Homo sapiens
cattggctcct

SEQ ID NO: 3234836 - DNA, 15 bp, Homo sapiens
cattgggctgacacc

SEQ ID NO: 3234837 - DNA, 21 bp, Homo sapiens
cattggggttccgcactttcc

SEQ ID NO: 3234838 - DNA, 18 bp, Homo sapiens
cattgggtgggtaaattc

SEQ ID NO: 3234839 - DNA, 23 bp, Homo sapiens
cattgggttgtagccaaaggttc

SEQ ID NO: 3234840 - DNA, 14 bp, Homo sapiens
cattggtccaagat

SEQ ID NO: 3234841 - DNA, 13 bp, Homo sapiens
cattggtgttgtc

SEQ ID NO: 3234842 - DNA, 18 bp, Homo sapiens
cattgtaaacaaactctt

SEQ ID NO: 3234843 - DNA, 15 bp, Homo sapiens
cattgtaatgttact

SEQ ID NO: 3234844 - DNA, 17 bp, Homo sapiens
cattgtaatgttactga

SEQ ID NO: 3234845 - DNA, 21 bp, Homo sapiens
cattgtaatgttactgatcat

SEQ ID NO: 3234846 - DNA, 17 bp, Homo sapiens
cattgtagagcttctgg

SEQ ID NO: 3234847 - DNA, 21 bp, Homo sapiens
cattgtagagcttctggcact

SEQ ID NO: 3234848 - DNA, 19 bp, Homo sapiens
cattgtatagatataatga

SEQ ID NO: 3234849 - DNA, 24 bp, Homo sapiens
cattgtatagatataatgaacaaa

SEQ ID NO: 3234850 - DNA, 17 bp, Homo sapiens
cattgtatgatgtgttg

SEQ ID NO: 3234851 - DNA, 22 bp, Homo sapiens
cattgtatgatgtgttgtgata

SEQ ID NO: 3234852 - DNA, 16 bp, Homo sapiens
cattgtcaaaattaat

SEQ ID NO: 3234853 - DNA, 18 bp, Homo sapiens
cattgtcaaaattaatat

SEQ ID NO: 3234854 - DNA, 21 bp, Homo sapiens
cattgtcaaaattaatatgat

SEQ ID NO: 3234855 - DNA, 15 bp, Homo sapiens
cattgtcataagtaa

SEQ ID NO: 3234856 - DNA, 16 bp, Homo sapiens
cattgtcttgttctgt

SEQ ID NO: 3234857 - DNA, 18 bp, Homo sapiens
cattgtcttgttctgtcc

SEQ ID NO: 3234858 - DNA, 15 bp, Homo sapiens
cattgtctttatatg

SEQ ID NO: 3234859 - DNA, 21 bp, Homo sapiens
cattgtctttgctgtactctt

SEQ ID NO: 3234860 - DNA, 21 bp, Homo sapiens
cattgtgggatgttcagcact

SEQ ID NO: 3234861 - DNA, 16 bp, Homo sapiens
cattgtgttgacatta

SEQ ID NO: 3234862 - DNA, 19 bp, Homo sapiens
cattgttcttattctggca

SEQ ID NO: 3234863 - DNA, 13 bp, Homo sapiens
cattgttgagcta

SEQ ID NO: 3234864 - DNA, 20 bp, Homo sapiens
cattgttgagctattgctgt

SEQ ID NO: 3234865 - DNA, 16 bp, Homo sapiens
cattgttgaggtggtc

SEQ ID NO: 3234866 - DNA, 18 bp, Homo sapiens
cattgttgaggtggtctg

SEQ ID NO: 3234867 - DNA, 17 bp, Homo sapiens
cattgttggccaaagcc

SEQ ID NO: 3234868 - DNA, 15 bp, Homo sapiens
cattgttggctattt

SEQ ID NO: 3234869 - DNA, 19 bp, Homo sapiens
cattgtttaggggtgaagg

SEQ ID NO: 3234870 - DNA, 17 bp, Homo sapiens
cattgtttgcttattgt

SEQ ID NO: 3234871 - DNA, 21 bp, Homo sapiens
cattgttttcttttacagact

SEQ ID NO: 3234872 - DNA, 12 bp, Homo sapiens
cattgttttgaa

SEQ ID NO: 3234873 - DNA, 22 bp, Homo sapiens
cattgttttgaatattactcct

SEQ ID NO: 3234874 - DNA, 15 bp, Homo sapiens
catttaaaaaaatca

SEQ ID NO: 3234875 - DNA, 18 bp, Homo sapiens
catttaaaacagacactg

SEQ ID NO: 3234876 - DNA, 13 bp, Homo sapiens
catttaaaatgat

SEQ ID NO: 3234877 - DNA, 14 bp, Homo sapiens
catttaaaatgatt

SEQ ID NO: 3234878 - DNA, 16 bp, Homo sapiens
catttaaaattgctat

SEQ ID NO: 3234879 - DNA, 19 bp, Homo sapiens
catttaaaattgctatgtt

SEQ ID NO: 3234880 - DNA, 15 bp, Homo sapiens
catttaaacaagtat

SEQ ID NO: 3234881 - DNA, 19 bp, Homo sapiens
catttaaagttgtataaaa

SEQ ID NO: 3234882 - DNA, 23 bp, Homo sapiens
catttaaagttgtataaaaacat

SEQ ID NO: 3234883 - DNA, 13 bp, Homo sapiens
catttaaatcctt

SEQ ID NO: 3234884 - DNA, 18 bp, Homo sapiens
catttaaatgtaacttat

SEQ ID NO: 3234885 - DNA, 17 bp, Homo sapiens
catttaaatttgatttc

SEQ ID NO: 3234886 - DNA, 18 bp, Homo sapiens
catttaaatttgatttcc

SEQ ID NO: 3234887 - DNA, 12 bp, Homo sapiens
catttaaatttt

SEQ ID NO: 3234888 - DNA, 23 bp, Homo sapiens
catttaaattttaccctttagac

SEQ ID NO: 3234889 - DNA, 17 bp, Homo sapiens
catttaaattttttggc

SEQ ID NO: 3234890 - DNA, 17 bp, Homo sapiens
catttaaggaaactaga

SEQ ID NO: 3234891 - DNA, 18 bp, Homo sapiens
catttaataaagatgagt

SEQ ID NO: 3234892 - DNA, 22 bp, Homo sapiens
catttaatggcagctagtgcct

SEQ ID NO: 3234893 - DNA, 12 bp, Homo sapiens
catttaatttag

SEQ ID NO: 3234894 - DNA, 19 bp, Homo sapiens
catttaatttagtgatctt

SEQ ID NO: 3234895 - DNA, 19 bp, Homo sapiens
catttacacttttgagact

SEQ ID NO: 3234896 - DNA, 20 bp, Homo sapiens
catttacagtctctttcttc

SEQ ID NO: 3234897 - DNA, 15 bp, Homo sapiens
catttagaaaagtga

SEQ ID NO: 3234898 - DNA, 21 bp, Homo sapiens
catttagaactttctgctttg

SEQ ID NO: 3234899 - DNA, 20 bp, Homo sapiens
catttagataatttgaaaaa

SEQ ID NO: 3234900 - DNA, 22 bp, Homo sapiens
catttagctaaacggattccaa

SEQ ID NO: 3234901 - DNA, 17 bp, Homo sapiens
catttaggccatgggac

SEQ ID NO: 3234902 - DNA, 20 bp, Homo sapiens
catttataaccccagcctga

SEQ ID NO: 3234903 - DNA, 15 bp, Homo sapiens
catttataattgcat

SEQ ID NO: 3234904 - DNA, 17 bp, Homo sapiens
catttataattgcatct

SEQ ID NO: 3234905 - DNA, 17 bp, Homo sapiens
catttatacaaattaga

SEQ ID NO: 3234906 - DNA, 13 bp, Homo sapiens
catttatatattg

SEQ ID NO: 3234907 - DNA, 22 bp, Homo sapiens
catttatatattgaattaatat

SEQ ID NO: 3234908 - DNA, 17 bp, Homo sapiens
catttatatttgtgtat

SEQ ID NO: 3234909 - DNA, 12 bp, Homo sapiens
catttatcattc

SEQ ID NO: 3234910 - DNA, 18 bp, Homo sapiens
catttatccacaggaaag

SEQ ID NO: 3234911 - DNA, 23 bp, Homo sapiens
catttatctacccaagggcagaa

SEQ ID NO: 3234912 - DNA, 15 bp, Homo sapiens
catttatctattaaa

SEQ ID NO: 3234913 - DNA, 16 bp, Homo sapiens
catttatctattaaaa

SEQ ID NO: 3234914 - DNA, 21 bp, Homo sapiens
catttatctattaaaattgcc

SEQ ID NO: 3234915 - DNA, 23 bp, Homo sapiens
catttatctattaaaattgccat

SEQ ID NO: 3234916 - DNA, 23 bp, Homo sapiens
catttatgagtaactattattat

SEQ ID NO: 3234917 - DNA, 16 bp, Homo sapiens
catttatgatttaata

SEQ ID NO: 3234918 - DNA, 21 bp, Homo sapiens
catttatgatttaataaaata

SEQ ID NO: 3234919 - DNA, 13 bp, Homo sapiens
catttattctgct

SEQ ID NO: 3234920 - DNA, 18 bp, Homo sapiens
catttattgtttatgtaa

SEQ ID NO: 3234921 - DNA, 20 bp, Homo sapiens
catttatttatacagtgcct

SEQ ID NO: 3234922 - DNA, 21 bp, Homo sapiens
catttattttaagcactctta

SEQ ID NO: 3234923 - DNA, 18 bp, Homo sapiens
catttatttttagttaaa

SEQ ID NO: 3234924 - DNA, 18 bp, Homo sapiens
catttcaatgtgtataaa

SEQ ID NO: 3234925 - DNA, 12 bp, Homo sapiens
catttcacatta

SEQ ID NO: 3234926 - DNA, 18 bp, Homo sapiens
catttcacctgtgacaaa

SEQ ID NO: 3234927 - DNA, 22 bp, Homo sapiens
catttcagggagaaactccaaa

SEQ ID NO: 3234928 - DNA, 17 bp, Homo sapiens
catttcatcattgtttc

SEQ ID NO: 3234929 - DNA, 21 bp, Homo sapiens
catttcatcattgtttctgca

SEQ ID NO: 3234930 - DNA, 16 bp, Homo sapiens
catttcattcaaatca

SEQ ID NO: 3234931 - DNA, 18 bp, Homo sapiens
catttcattcctaacaca

SEQ ID NO: 3234932 - DNA, 23 bp, Homo sapiens
catttcattgtatgatgtgttgt

SEQ ID NO: 3234933 - DNA, 13 bp, Homo sapiens
catttccaacacc

SEQ ID NO: 3234934 - DNA, 18 bp, Homo sapiens
catttccaacaccacaga

SEQ ID NO: 3234935 - DNA, 19 bp, Homo sapiens
catttccaacaccacagac

SEQ ID NO: 3234936 - DNA, 17 bp, Homo sapiens
catttccaactcaggtt

SEQ ID NO: 3234937 - DNA, 23 bp, Homo sapiens
ccaaggaaataaggacagtctag

SEQ ID NO: 3234938 - DNA, 19 bp, Homo sapiens
ccaaggaagctccagatcc

SEQ ID NO: 3234939 - DNA, 16 bp, Homo sapiens
ccaaggactgactgag

SEQ ID NO: 3234940 - DNA, 14 bp, Homo sapiens
ccaaggagaaacag

SEQ ID NO: 3234941 - DNA, 18 bp, Homo sapiens
ccaaggagaaacagagac

SEQ ID NO: 3234942 - DNA, 19 bp, Homo sapiens
ccaaggagaaacagagaca

SEQ ID NO: 3234943 - DNA, 12 bp, Homo sapiens
ccaaggagcaca

SEQ ID NO: 3234944 - DNA, 17 bp, Homo sapiens
ccaaggagcacaggtcc

SEQ ID NO: 3234945 - DNA, 21 bp, Homo sapiens
ccaaggagctgatttccaggc

SEQ ID NO: 3234946 - DNA, 14 bp, Homo sapiens
ccaaggaggcctgg

SEQ ID NO: 3234947 - DNA, 20 bp, Homo sapiens
ccaaggatcctctccactcc

SEQ ID NO: 3234948 - DNA, 22 bp, Homo sapiens
ccaaggatcctctccactccat

SEQ ID NO: 3234949 - DNA, 13 bp, Homo sapiens
ccaaggcaaacaa

SEQ ID NO: 3234950 - DNA, 15 bp, Homo sapiens
ccaaggcaaggcagg

SEQ ID NO: 3234951 - DNA, 15 bp, Homo sapiens
ccaaggcagcctcca

SEQ ID NO: 3234952 - DNA, 18 bp, Homo sapiens
ccaaggcagcctccagag

SEQ ID NO: 3234953 - DNA, 19 bp, Homo sapiens
ccaaggcagcctccagagc

SEQ ID NO: 3234954 - DNA, 20 bp, Homo sapiens
ccaaggcagcctccagagcc

SEQ ID NO: 3234955 - DNA, 11 bp, Homo sapiens
ccaaggcaggt

SEQ ID NO: 3234956 - DNA, 15 bp, Homo sapiens
ccaaggccagagtgg

SEQ ID NO: 3234957 - DNA, 19 bp, Homo sapiens
ccaaggccagagtggcctg

SEQ ID NO: 3234958 - DNA, 17 bp, Homo sapiens
ccaaggccgaagctctg

SEQ ID NO: 3234959 - DNA, 20 bp, Homo sapiens
ccaaggccgaagctctggct

SEQ ID NO: 3234960 - DNA, 17 bp, Homo sapiens
ccaaggctgcgtctgga

SEQ ID NO: 3234961 - DNA, 19 bp, Homo sapiens
ccaaggctgcgtctggagg

SEQ ID NO: 3234962 - DNA, 19 bp, Homo sapiens
ccaagggaacctgtgtccg

SEQ ID NO: 3234963 - DNA, 13 bp, Homo sapiens
ccaagggccctgg

SEQ ID NO: 3234964 - DNA, 16 bp, Homo sapiens
ccaagggccctggcac

SEQ ID NO: 3234965 - DNA, 21 bp, Homo sapiens
ccaagggccctggcaccccca

SEQ ID NO: 3234966 - DNA, 20 bp, Homo sapiens
ccaagggcctcccaccagag

SEQ ID NO: 3234967 - DNA, 19 bp, Homo sapiens
ccaagggcttctgcaccct

SEQ ID NO: 3234968 - DNA, 20 bp, Homo sapiens
ccaagggcttctgcaccctc

SEQ ID NO: 3234969 - DNA, 21 bp, Homo sapiens
ccaagggcttctgcaccctcc

SEQ ID NO: 3234970 - DNA, 15 bp, Homo sapiens
ccaagggtttcgact

SEQ ID NO: 3234971 - DNA, 21 bp, Homo sapiens
ccaagggtttcgactggtcca

SEQ ID NO: 3234972 - DNA, 23 bp, Homo sapiens
ccaagggtttcgactggtccagc

SEQ ID NO: 3234973 - DNA, 15 bp, Homo sapiens
ccaaggtcccctcca

SEQ ID NO: 3234974 - DNA, 16 bp, Homo sapiens
ccaaggtcccctccac

SEQ ID NO: 3234975 - DNA, 15 bp, Homo sapiens
ccaaggtcctgctca

SEQ ID NO: 3234976 - DNA, 21 bp, Homo sapiens
ccaaggtgctgatgtcaaagt

SEQ ID NO: 3234977 - DNA, 17 bp, Homo sapiens
ccaaggtgggctgagcc

SEQ ID NO: 3234978 - DNA, 20 bp, Homo sapiens
ccaaggtgggctgagccctg

SEQ ID NO: 3234979 - DNA, 20 bp, Homo sapiens
ccaaggtgggtagatcacga

SEQ ID NO: 3234980 - DNA, 19 bp, Homo sapiens
ccaaggtttaaagagtcta

SEQ ID NO: 3234981 - DNA, 14 bp, Homo sapiens
ccaagtatttatta

SEQ ID NO: 3234982 - DNA, 16 bp, Homo sapiens
ccaagtcactcttttt

SEQ ID NO: 3234983 - DNA, 13 bp, Homo sapiens
ccaagtcagacag

SEQ ID NO: 3234984 - DNA, 15 bp, Homo sapiens
ccaagtccctgtttt

SEQ ID NO: 3234985 - DNA, 15 bp, Homo sapiens
ccaagtcctgaagag

SEQ ID NO: 3234986 - DNA, 16 bp, Homo sapiens
ccaagtctcagaagag

SEQ ID NO: 3234987 - DNA, 14 bp, Homo sapiens
ccaagtctctctgt

SEQ ID NO: 3234988 - DNA, 19 bp, Homo sapiens
ccaagtctctctgtgaata

SEQ ID NO: 3234989 - DNA, 17 bp, Homo sapiens
ccaagtgcactttctaa

SEQ ID NO: 3234990 - DNA, 14 bp, Homo sapiens
ccaagtgccagagg

SEQ ID NO: 3234991 - DNA, 16 bp, Homo sapiens
ccaagtgccagaggtg

SEQ ID NO: 3234992 - DNA, 17 bp, Homo sapiens
ccaagtgccagaggtgg

SEQ ID NO: 3234993 - DNA, 18 bp, Homo sapiens
ccaagtgccagaggtggg

SEQ ID NO: 3234994 - DNA, 23 bp, Homo sapiens
ccaagtgccagaggtgggcaggt

SEQ ID NO: 3234995 - DNA, 20 bp, Homo sapiens
ccaagtggaccttgagacca

SEQ ID NO: 3234996 - DNA, 16 bp, Homo sapiens
ccaagtggctcccaca

SEQ ID NO: 3234997 - DNA, 15 bp, Homo sapiens
ccaagtggggtgctg

SEQ ID NO: 3234998 - DNA, 16 bp, Homo sapiens
ccaagtggggtgctgg

SEQ ID NO: 3234999 - DNA, 22 bp, Homo sapiens
ccaagtggggtgctgggaggag

SEQ ID NO: 3235000 - DNA, 17 bp, Homo sapiens
ccaagttcttcacctct

SEQ ID NO: 3235001 - DNA, 18 bp, Homo sapiens
ccaagttcttcacctcta

SEQ ID NO: 3235002 - DNA, 17 bp, Homo sapiens
ccaagttgctgtcactg

SEQ ID NO: 3235003 - DNA, 17 bp, Homo sapiens
ccaagtttccatagcaa

SEQ ID NO: 3235004 - DNA, 9 bp, Homo sapiens
ccaataaaa

SEQ ID NO: 3235005 - DNA, 10 bp, Homo sapiens
ccaataaaaa

SEQ ID NO: 3235006 - DNA, 13 bp, Homo sapiens
ccaataaaaagtt

SEQ ID NO: 3235007 - DNA, 22 bp, Homo sapiens
ccaataaaagctcttctttttt

SEQ ID NO: 3235008 - DNA, 12 bp, Homo sapiens
ccaataaagctt

SEQ ID NO: 3235009 - DNA, 18 bp, Homo sapiens
ccaataaaggcagctgcc

SEQ ID NO: 3235010 - DNA, 21 bp, Homo sapiens
ccaataaaggcagctgcctct

SEQ ID NO: 3235011 - DNA, 22 bp, Homo sapiens
ccaataaaggcagctgcctctg

SEQ ID NO: 3235012 - DNA, 22 bp, Homo sapiens
ccaataaagtgccttctgggct

SEQ ID NO: 3235013 - DNA, 22 bp, Homo sapiens
ccaataataaatgccctcttct

SEQ ID NO: 3235014 - DNA, 18 bp, Homo sapiens
ccaatagggctgagctct

SEQ ID NO: 3235015 - DNA, 22 bp, Homo sapiens
ccaatattggagcatatcaaaa

SEQ ID NO: 3235016 - DNA, 13 bp, Homo sapiens
ccaatcagcactg

SEQ ID NO: 3235017 - DNA, 14 bp, Homo sapiens
ccaatcagcactga

SEQ ID NO: 3235018 - DNA, 16 bp, Homo sapiens
ccaatcagcactgaaa

SEQ ID NO: 3235019 - DNA, 18 bp, Homo sapiens
ccaatcagcactgaaaat

SEQ ID NO: 3235020 - DNA, 13 bp, Homo sapiens
ccaatcccagggc

SEQ ID NO: 3235021 - DNA, 17 bp, Homo sapiens
ccaatcccagggctggc

SEQ ID NO: 3235022 - DNA, 19 bp, Homo sapiens
ccaatcccagggctggctc

SEQ ID NO: 3235023 - DNA, 18 bp, Homo sapiens
ccaatcctcactgggtgg

SEQ ID NO: 3235024 - DNA, 19 bp, Homo sapiens
ccaatctattgcttcacca

SEQ ID NO: 3235025 - DNA, 23 bp, Homo sapiens
ccaatctctacccctttcttctc

SEQ ID NO: 3235026 - DNA, 16 bp, Homo sapiens
ccaatctctgctctct

SEQ ID NO: 3235027 - DNA, 19 bp, Homo sapiens
ccaatctcttggtggggag

SEQ ID NO: 3235028 - DNA, 22 bp, Homo sapiens
ccaatctttctatataaaatgt

SEQ ID NO: 3235029 - DNA, 20 bp, Homo sapiens
ccaatgattcataacaatgt

SEQ ID NO: 3235030 - DNA, 17 bp, Homo sapiens
ccaatgcatagagccct

SEQ ID NO: 3235031 - DNA, 18 bp, Homo sapiens
ccaatgcatagagccctg

SEQ ID NO: 3235032 - DNA, 14 bp, Homo sapiens
ccaatgcccagcag

SEQ ID NO: 3235033 - DNA, 15 bp, Homo sapiens
ccaatgctgctccac

SEQ ID NO: 3235034 - DNA, 17 bp, Homo sapiens
ccaatgctttgggaggc

SEQ ID NO: 3235035 - DNA, 19 bp, Homo sapiens
ccaatggtgatcctctatt

SEQ ID NO: 3235036 - DNA, 20 bp, Homo sapiens
ccaatggtgatcctctattt

SEQ ID NO: 3235037 - DNA, 22 bp, Homo sapiens
ccaatggtgatcctctattttg

SEQ ID NO: 3235038 - DNA, 23 bp, Homo sapiens
ccaatggtgatcctctattttgt

SEQ ID NO: 3235039 - DNA, 21 bp, Homo sapiens
ccaattataacttattagcag

SEQ ID NO: 3235040 - DNA, 16 bp, Homo sapiens
ccaattatcatctttt

SEQ ID NO: 3235041 - DNA, 18 bp, Homo sapiens
ccaattattgatatatat

SEQ ID NO: 3235042 - DNA, 21 bp, Homo sapiens
ccaattattgatatatattat

SEQ ID NO: 3235043 - DNA, 22 bp, Homo sapiens
ccaattattgatatatattata

SEQ ID NO: 3235044 - DNA, 10 bp, Homo sapiens
ccaatttaag

SEQ ID NO: 3235045 - DNA, 22 bp, Homo sapiens
ccaatttcccacccccacccac

SEQ ID NO: 3235046 - DNA, 22 bp, Homo sapiens
ccacaaaaacaggtatatactt

SEQ ID NO: 3235047 - DNA, 22 bp, Homo sapiens
ccacaaaggccaaactgctgga

SEQ ID NO: 3235048 - DNA, 17 bp, Homo sapiens
ccacaaataaatgacaa

SEQ ID NO: 3235049 - DNA, 18 bp, Homo sapiens
ccacaaccctgttttata

SEQ ID NO: 3235050 - DNA, 15 bp, Homo sapiens
ccacaactgacacag

SEQ ID NO: 3235051 - DNA, 23 bp, Homo sapiens
ccacaactttgtcgtggttctta

SEQ ID NO: 3235052 - DNA, 15 bp, Homo sapiens
ccacaagaaatttga

SEQ ID NO: 3235053 - DNA, 15 bp, Homo sapiens
ccacaagcctgagaa

SEQ ID NO: 3235054 - DNA, 16 bp, Homo sapiens
ccacaagcctgagaac

SEQ ID NO: 3235055 - DNA, 17 bp, Homo sapiens
ccacaagctgtccctgc

SEQ ID NO: 3235056 - DNA, 19 bp, Homo sapiens
ccacaagctgtccctgcag

SEQ ID NO: 3235057 - DNA, 22 bp, Homo sapiens
ccacaagctgtccctgcagggc

SEQ ID NO: 3235058 - DNA, 16 bp, Homo sapiens
ccacaaggctggccag

SEQ ID NO: 3235059 - DNA, 17 bp, Homo sapiens
ccacaaggtccactccc

SEQ ID NO: 3235060 - DNA, 22 bp, Homo sapiens
ccacaagtcttccagaggatgc

SEQ ID NO: 3235061 - DNA, 20 bp, Homo sapiens
ccacaagtgccctccaggct

SEQ ID NO: 3235062 - DNA, 15 bp, Homo sapiens
ccactgcctcaggtt

SEQ ID NO: 3235063 - DNA, 13 bp, Homo sapiens
ccactgcctctgc

SEQ ID NO: 3235064 - DNA, 14 bp, Homo sapiens
ccactgcctctgcc

SEQ ID NO: 3235065 - DNA, 17 bp, Homo sapiens
ccactgcctctgcctta

SEQ ID NO: 3235066 - DNA, 21 bp, Homo sapiens
ccactgccttcgatacaccgg

SEQ ID NO: 3235067 - DNA, 18 bp, Homo sapiens
ccactgccttcgcttctt

SEQ ID NO: 3235068 - DNA, 22 bp, Homo sapiens
ccactgccttcgcttcttgcct

SEQ ID NO: 3235069 - DNA, 23 bp, Homo sapiens
ccactgccttcgcttcttgcctc

SEQ ID NO: 3235070 - DNA, 23 bp, Homo sapiens
ccactgcgggagctctgtatggt

SEQ ID NO: 3235071 - DNA, 23 bp, Homo sapiens
ccactgcggggagacagaagcct

SEQ ID NO: 3235072 - DNA, 13 bp, Homo sapiens
ccactgctctggt

SEQ ID NO: 3235073 - DNA, 15 bp, Homo sapiens
ccactgctctggtta

SEQ ID NO: 3235074 - DNA, 18 bp, Homo sapiens
ccactgctgcagtagggg

SEQ ID NO: 3235075 - DNA, 14 bp, Homo sapiens
ccactggacagacc

SEQ ID NO: 3235076 - DNA, 17 bp, Homo sapiens
ccactggacagacccag

SEQ ID NO: 3235077 - DNA, 20 bp, Homo sapiens
ccactggacagacccaggtc

SEQ ID NO: 3235078 - DNA, 21 bp, Homo sapiens
ccactggacagacccaggtct

SEQ ID NO: 3235079 - DNA, 12 bp, Homo sapiens
ccactggccacc

SEQ ID NO: 3235080 - DNA, 19 bp, Homo sapiens
ccactggccaccaggctgg

SEQ ID NO: 3235081 - DNA, 23 bp, Homo sapiens
ccactgggaccaaccctggggaa

SEQ ID NO: 3235082 - DNA, 11 bp, Homo sapiens
ccactgggagg

SEQ ID NO: 3235083 - DNA, 20 bp, Homo sapiens
ccactgggccagccctgcag

SEQ ID NO: 3235084 - DNA, 22 bp, Homo sapiens
ccactgggccagccctgcagcc

SEQ ID NO: 3235085 - DNA, 20 bp, Homo sapiens
ccactggggaatgctcccag

SEQ ID NO: 3235086 - DNA, 18 bp, Homo sapiens
ccactggggactttattt

SEQ ID NO: 3235087 - DNA, 16 bp, Homo sapiens
ccactggttccttctt

SEQ ID NO: 3235088 - DNA, 14 bp, Homo sapiens
ccactgtaaaatga

SEQ ID NO: 3235089 - DNA, 21 bp, Homo sapiens
ccactgtatgatttataaaca

SEQ ID NO: 3235090 - DNA, 24 bp, Homo sapiens
ccactgtcactgtttctctgctgt

SEQ ID NO: 3235091 - DNA, 21 bp, Homo sapiens
ccactgtccccctacccaccg

SEQ ID NO: 3235092 - DNA, 16 bp, Homo sapiens
ccactgtgccatgtgc

SEQ ID NO: 3235093 - DNA, 15 bp, Homo sapiens
ccactgtgcctttgc

SEQ ID NO: 3235094 - DNA, 12 bp, Homo sapiens
ccactgtggcca

SEQ ID NO: 3235095 - DNA, 12 bp, Homo sapiens
ccactgtgtata

SEQ ID NO: 3235096 - DNA, 18 bp, Homo sapiens
ccactgtttctcttgagc

SEQ ID NO: 3235097 - DNA, 21 bp, Homo sapiens
ccactgtttctcttgagctgg

SEQ ID NO: 3235098 - DNA, 22 bp, Homo sapiens
ccactgtttctcttgagctggc

SEQ ID NO: 3235099 - DNA, 23 bp, Homo sapiens
ccactgtttctcttgagctggcc

SEQ ID NO: 3235100 - DNA, 17 bp, Homo sapiens
ccacttaatgtatgtta

SEQ ID NO: 3235101 - DNA, 13 bp, Homo sapiens
ccacttcaataga

SEQ ID NO: 3235102 - DNA, 23 bp, Homo sapiens
ccacttcaggggatgggtgtgga

SEQ ID NO: 3235103 - DNA, 23 bp, Homo sapiens
ccacttccccctcttcttctgaa

SEQ ID NO: 3235104 - DNA, 18 bp, Homo sapiens
ccacttcctgctacagga

SEQ ID NO: 3235105 - DNA, 20 bp, Homo sapiens
ccacttcctgctacaggagg

SEQ ID NO: 3235106 - DNA, 15 bp, Homo sapiens
ccacttcctttgtgt

SEQ ID NO: 3235107 - DNA, 15 bp, Homo sapiens
ccacttctcatctta

SEQ ID NO: 3235108 - DNA, 13 bp, Homo sapiens
ccacttctcccca

SEQ ID NO: 3235109 - DNA, 23 bp, Homo sapiens
ccacttcttaaaggcctggaacc

SEQ ID NO: 3235110 - DNA, 15 bp, Homo sapiens
ccacttcttcctttc

SEQ ID NO: 3235111 - DNA, 19 bp, Homo sapiens
ccacttcttgttccccact

SEQ ID NO: 3235112 - DNA, 18 bp, Homo sapiens
ccacttgcaacttctttc

SEQ ID NO: 3235113 - DNA, 12 bp, Homo sapiens
ccacttgcctct

SEQ ID NO: 3235114 - DNA, 17 bp, Homo sapiens
ccacttgcctcttcctt

SEQ ID NO: 3235115 - DNA, 19 bp, Homo sapiens
ccacttgcctcttccttga

SEQ ID NO: 3235116 - DNA, 16 bp, Homo sapiens
ccacttgggtcttccc

SEQ ID NO: 3235117 - DNA, 17 bp, Homo sapiens
ccacttgggtcttccct

SEQ ID NO: 3235118 - DNA, 15 bp, Homo sapiens
ccacttggtctgtga

SEQ ID NO: 3235119 - DNA, 16 bp, Homo sapiens
ccacttggtctgtgag

SEQ ID NO: 3235120 - DNA, 22 bp, Homo sapiens
ccacttggtctgtgagatgcta

SEQ ID NO: 3235121 - DNA, 18 bp, Homo sapiens
ccacttgtcactgacaca

SEQ ID NO: 3235122 - DNA, 18 bp, Homo sapiens
ccactttacccacctaga

SEQ ID NO: 3235123 - DNA, 19 bp, Homo sapiens
ccactttacccacctagaa

SEQ ID NO: 3235124 - DNA, 15 bp, Homo sapiens
ccactttgactcaga

SEQ ID NO: 3235125 - DNA, 21 bp, Homo sapiens
ccactttggagactggggtgg

SEQ ID NO: 3235126 - DNA, 21 bp, Homo sapiens
ccactttggtacatggccagt

SEQ ID NO: 3235127 - DNA, 20 bp, Homo sapiens
ccactttgttctttaggaga

SEQ ID NO: 3235128 - DNA, 21 bp, Homo sapiens
ccagaaacagtgggagccctg

SEQ ID NO: 3235129 - DNA, 16 bp, Homo sapiens
ccagaaaggagactag

SEQ ID NO: 3235130 - DNA, 16 bp, Homo sapiens
ccagaaaggatattta

SEQ ID NO: 3235131 - DNA, 20 bp, Homo sapiens
ccagaaaggatatttaagaa

SEQ ID NO: 3235132 - DNA, 22 bp, Homo sapiens
ccagaaatgtctaaatgctgaa

SEQ ID NO: 3235133 - DNA, 17 bp, Homo sapiens
ccagaacaaaaagaaat

SEQ ID NO: 3235134 - DNA, 17 bp, Homo sapiens
ccagaacaacaactatc

SEQ ID NO: 3235135 - DNA, 22 bp, Homo sapiens
ccagaacacccctaatgagggt

SEQ ID NO: 3235136 - DNA, 16 bp, Homo sapiens
ccagaactgcccccac

SEQ ID NO: 3235137 - DNA, 16 bp, Homo sapiens
ccagaagaatattcag

SEQ ID NO: 3235138 - DNA, 18 bp, Homo sapiens
ccagaagaatattcagga

SEQ ID NO: 3235139 - DNA, 17 bp, Homo sapiens
ccagaaggaatcttctc

SEQ ID NO: 3235140 - DNA, 21 bp, Homo sapiens
ccagaaggaatcttctcatct

SEQ ID NO: 3235141 - DNA, 23 bp, Homo sapiens
ccagaaggagggcagagccatgg

SEQ ID NO: 3235142 - DNA, 19 bp, Homo sapiens
ccagaatccataaatgtgt

SEQ ID NO: 3235143 - DNA, 23 bp, Homo sapiens
ccagaatccataaatgtgttcct

SEQ ID NO: 3235144 - DNA, 14 bp, Homo sapiens
ccagaatcccagcc

SEQ ID NO: 3235145 - DNA, 15 bp, Homo sapiens
ccagaatctgctgtt

SEQ ID NO: 3235146 - DNA, 17 bp, Homo sapiens
ccagaatctgctgttgc

SEQ ID NO: 3235147 - DNA, 21 bp, Homo sapiens
ccagaatgtcagattcctttc

SEQ ID NO: 3235148 - DNA, 23 bp, Homo sapiens
ccagaatgtcagattcctttccc

SEQ ID NO: 3235149 - DNA, 15 bp, Homo sapiens
ccagaattgtcctca

SEQ ID NO: 3235150 - DNA, 18 bp, Homo sapiens
ccagaatttggaaatcct

SEQ ID NO: 3235151 - DNA, 20 bp, Homo sapiens
ccagacaaaaaaatttaaaa

SEQ ID NO: 3235152 - DNA, 18 bp, Homo sapiens
ccagacacagactggcaa

SEQ ID NO: 3235153 - DNA, 22 bp, Homo sapiens
ccagacacagactggcaataaa

SEQ ID NO: 3235154 - DNA, 23 bp, Homo sapiens
ccagacacagactggcaataaac

SEQ ID NO: 3235155 - DNA, 14 bp, Homo sapiens
ccagacacagccca

SEQ ID NO: 3235156 - DNA, 19 bp, Homo sapiens
ccagacaccttgacagggc

SEQ ID NO: 3235157 - DNA, 20 bp, Homo sapiens
ccagacaccttgacagggca

SEQ ID NO: 3235158 - DNA, 13 bp, Homo sapiens
ccagacagcacag

SEQ ID NO: 3235159 - DNA, 15 bp, Homo sapiens
ccagacagcacaggg

SEQ ID NO: 3235160 - DNA, 20 bp, Homo sapiens
ccagacatacgaaacacaaa

SEQ ID NO: 3235161 - DNA, 22 bp, Homo sapiens
ccagacatacgaaacacaaacc

SEQ ID NO: 3235162 - DNA, 15 bp, Homo sapiens
ccagaccccagggca

SEQ ID NO: 3235163 - DNA, 18 bp, Homo sapiens
ccagacccctctggccag

SEQ ID NO: 3235164 - DNA, 14 bp, Homo sapiens
ccagacccctggct

SEQ ID NO: 3235165 - DNA, 15 bp, Homo sapiens
ccagacccctggctt

SEQ ID NO: 3235166 - DNA, 18 bp, Homo sapiens
ccagacccctggcttttc

SEQ ID NO: 3235167 - DNA, 15 bp, Homo sapiens
ccagacccggctgcg

SEQ ID NO: 3235168 - DNA, 16 bp, Homo sapiens
ccagacccggctgcgt

SEQ ID NO: 3235169 - DNA, 18 bp, Homo sapiens
ccagacctgcttcctgaa

SEQ ID NO: 3235170 - DNA, 21 bp, Homo sapiens
ccagacctgcttcctgaaata

SEQ ID NO: 3235171 - DNA, 18 bp, Homo sapiens
ccagacgtggtggctcac

SEQ ID NO: 3235172 - DNA, 16 bp, Homo sapiens
ccagactacttgggag

SEQ ID NO: 3235173 - DNA, 22 bp, Homo sapiens
ccagactcagctggaagtctac

SEQ ID NO: 3235174 - DNA, 17 bp, Homo sapiens
ccagactctaggttata

SEQ ID NO: 3235175 - DNA, 22 bp, Homo sapiens
ccagactgcttccaattttctg

SEQ ID NO: 3235176 - DNA, 17 bp, Homo sapiens
ccagactggaagacact

SEQ ID NO: 3235177 - DNA, 17 bp, Homo sapiens
ccagactgtaagatgtt

SEQ ID NO: 3235178 - DNA, 18 bp, Homo sapiens
ccagactgtaagatgttg

SEQ ID NO: 3235179 - DNA, 19 bp, Homo sapiens
ccagacttcaaaaataaaa

SEQ ID NO: 3235180 - DNA, 17 bp, Homo sapiens
ccagacttcaaaaggaa

SEQ ID NO: 3235181 - DNA, 18 bp, Homo sapiens
ccagacttcaaaaggaat

SEQ ID NO: 3235182 - DNA, 16 bp, Homo sapiens
ccagacttctggagga

SEQ ID NO: 3235183 - DNA, 17 bp, Homo sapiens
ccagactttagtgccct

SEQ ID NO: 3235184 - DNA, 20 bp, Homo sapiens
ccagactttagtgccctgcc

SEQ ID NO: 3235185 - DNA, 20 bp, Homo sapiens
ccagagaccaggctgtgtcc

SEQ ID NO: 3235186 - DNA, 21 bp, Homo sapiens
ccaggacaccacacccagcct

SEQ ID NO: 3235187 - DNA, 15 bp, Homo sapiens
ccaggacatctcctg

SEQ ID NO: 3235188 - DNA, 16 bp, Homo sapiens
ccaggaccacacagtc

SEQ ID NO: 3235189 - DNA, 18 bp, Homo sapiens
ccaggaccacacagtccc

SEQ ID NO: 3235190 - DNA, 22 bp, Homo sapiens
ccaggaccacacagtccccaga

SEQ ID NO: 3235191 - DNA, 15 bp, Homo sapiens
ccaggaccagctggg

SEQ ID NO: 3235192 - DNA, 16 bp, Homo sapiens
ccaggaccagctgggg

SEQ ID NO: 3235193 - DNA, 21 bp, Homo sapiens
ccaggaccctgacctccgccc

SEQ ID NO: 3235194 - DNA, 22 bp, Homo sapiens
ccaggacgcttctgaatgctgc

SEQ ID NO: 3235195 - DNA, 17 bp, Homo sapiens
ccaggacgtcctatctc

SEQ ID NO: 3235196 - DNA, 14 bp, Homo sapiens
ccaggactccactg

SEQ ID NO: 3235197 - DNA, 17 bp, Homo sapiens
ccaggactccactggac

SEQ ID NO: 3235198 - DNA, 22 bp, Homo sapiens
ccaggactccactggacagacc

SEQ ID NO: 3235199 - DNA, 16 bp, Homo sapiens
ccaggactccctcctc

SEQ ID NO: 3235200 - DNA, 15 bp, Homo sapiens
ccaggactgagcccc

SEQ ID NO: 3235201 - DNA, 17 bp, Homo sapiens
ccaggacttggggtcag

SEQ ID NO: 3235202 - DNA, 18 bp, Homo sapiens
ccaggacttggggtcagg

SEQ ID NO: 3235203 - DNA, 19 bp, Homo sapiens
ccaggagaaccactacatg

SEQ ID NO: 3235204 - DNA, 21 bp, Homo sapiens
ccaggagaaccactacatgca

SEQ ID NO: 3235205 - DNA, 16 bp, Homo sapiens
ccaggagacagacaga

SEQ ID NO: 3235206 - DNA, 17 bp, Homo sapiens
ccaggagacagaccact

SEQ ID NO: 3235207 - DNA, 22 bp, Homo sapiens
ccaggagacagaccacttgcca

SEQ ID NO: 3235208 - DNA, 14 bp, Homo sapiens
ccaggagagacaga

SEQ ID NO: 3235209 - DNA, 15 bp, Homo sapiens
ccaggagagagccag

SEQ ID NO: 3235210 - DNA, 17 bp, Homo sapiens
ccaggagagagccagga

SEQ ID NO: 3235211 - DNA, 15 bp, Homo sapiens
ccaggagcaggcacg

SEQ ID NO: 3235212 - DNA, 16 bp, Homo sapiens
ccaggagccccgaggc

SEQ ID NO: 3235213 - DNA, 20 bp, Homo sapiens
ccaggagggcatccatacca

SEQ ID NO: 3235214 - DNA, 16 bp, Homo sapiens
ccaggaggtagtttct

SEQ ID NO: 3235215 - DNA, 22 bp, Homo sapiens
ccaggaggtgggagtgaggagc

SEQ ID NO: 3235216 - DNA, 14 bp, Homo sapiens
ccaggagtctgtgc

SEQ ID NO: 3235217 - DNA, 18 bp, Homo sapiens
ccaggagtctgtgctctt

SEQ ID NO: 3235218 - DNA, 17 bp, Homo sapiens
ccaggagtttgagacaa

SEQ ID NO: 3235219 - DNA, 22 bp, Homo sapiens
ccaggagtttgagacaagccct

SEQ ID NO: 3235220 - DNA, 23 bp, Homo sapiens
ccaggagtttgagacaagccctg

SEQ ID NO: 3235221 - DNA, 21 bp, Homo sapiens
ccaggataaggagactgaggc

SEQ ID NO: 3235222 - DNA, 21 bp, Homo sapiens
ccaggatactggcacagaggt

SEQ ID NO: 3235223 - DNA, 17 bp, Homo sapiens
ccaggatcatggtgtaa

SEQ ID NO: 3235224 - DNA, 17 bp, Homo sapiens
ccaggatccagaagggg

SEQ ID NO: 3235225 - DNA, 19 bp, Homo sapiens
ccaggatcccaagcctcct

SEQ ID NO: 3235226 - DNA, 15 bp, Homo sapiens
ccaggatcctgcagg

SEQ ID NO: 3235227 - DNA, 17 bp, Homo sapiens
ccaggatcctgcaggaa

SEQ ID NO: 3235228 - DNA, 17 bp, Homo sapiens
ccaggatggactcttct

SEQ ID NO: 3235229 - DNA, 20 bp, Homo sapiens
ccaggattttaacaaaagca

SEQ ID NO: 3235230 - DNA, 21 bp, Homo sapiens
ccaggcaacttcagtcctggg

SEQ ID NO: 3235231 - DNA, 11 bp, Homo sapiens
ccaggcacagg

SEQ ID NO: 3235232 - DNA, 12 bp, Homo sapiens
ccaggcacaggg

SEQ ID NO: 3235233 - DNA, 14 bp, Homo sapiens
ccaggcacagggcc

SEQ ID NO: 3235234 - DNA, 16 bp, Homo sapiens
ccaggcacagggcccg

SEQ ID NO: 3235235 - DNA, 18 bp, Homo sapiens
ccaggcacagggcccgca

SEQ ID NO: 3235236 - DNA, 17 bp, Homo sapiens
ccaggcaccaggactag

SEQ ID NO: 3235237 - DNA, 13 bp, Homo sapiens
ccaggcacccttc

SEQ ID NO: 3235238 - DNA, 16 bp, Homo sapiens
ccaggcacctcttcct

SEQ ID NO: 3235239 - DNA, 12 bp, Homo sapiens
ccaggcacctgg

SEQ ID NO: 3235240 - DNA, 14 bp, Homo sapiens
ccaggcacctggcc

SEQ ID NO: 3235241 - DNA, 17 bp, Homo sapiens
ccaggcacctggcctgc

SEQ ID NO: 3235242 - DNA, 18 bp, Homo sapiens
ccaggcagatctgtgccc

SEQ ID NO: 3235243 - DNA, 20 bp, Homo sapiens
ccaggcagatctgtgcccca

SEQ ID NO: 3235244 - DNA, 21 bp, Homo sapiens
ccaggcagatctgtgccccat

SEQ ID NO: 3235245 - DNA, 21 bp, Homo sapiens
ccaggcaggggtgggggtgga

SEQ ID NO: 3235246 - DNA, 12 bp, Homo sapiens
ccaggcaggtct

SEQ ID NO: 3235247 - DNA, 20 bp, Homo sapiens
ccaggcagtcgggggctggc

SEQ ID NO: 3235248 - DNA, 22 bp, Homo sapiens
ccaggcagtcgggggctggcct

SEQ ID NO: 3235249 - DNA, 24 bp, Homo sapiens
ccaggcagtcgggggctggcctag

SEQ ID NO: 3235250 - DNA, 15 bp, Homo sapiens
ccaggcatggcgagg

SEQ ID NO: 3235251 - DNA, 19 bp, Homo sapiens
ccaggcatggcgaggctga

SEQ ID NO: 3235252 - DNA, 18 bp, Homo sapiens
ccaggcattggctcagcc

SEQ ID NO: 3235253 - DNA, 13 bp, Homo sapiens
ccaggccacagcc

SEQ ID NO: 3235254 - DNA, 17 bp, Homo sapiens
ccaggccacctccccag

SEQ ID NO: 3235255 - DNA, 21 bp, Homo sapiens
ccaggccacctccccagcatt

SEQ ID NO: 3235256 - DNA, 16 bp, Homo sapiens
ccaggccactgtggcc

SEQ ID NO: 3235257 - DNA, 20 bp, Homo sapiens
ccaggccactgtggccagag

SEQ ID NO: 3235258 - DNA, 19 bp, Homo sapiens
ccaggccagagggcagtgg

SEQ ID NO: 3235259 - DNA, 14 bp, Homo sapiens
ccaggccagcctcc

SEQ ID NO: 3235260 - DNA, 15 bp, Homo sapiens
ccaggccagcctccg

SEQ ID NO: 3235261 - DNA, 13 bp, Homo sapiens
ccaggccaggacc

SEQ ID NO: 3235262 - DNA, 16 bp, Homo sapiens
ccaggccaggaccaca

SEQ ID NO: 3235263 - DNA, 18 bp, Homo sapiens
ccaggccaggtgaggtcc

SEQ ID NO: 3235264 - DNA, 15 bp, Homo sapiens
ccaggcccaaggctc

SEQ ID NO: 3235265 - DNA, 19 bp, Homo sapiens
ccaggcccaaggctcccgg

SEQ ID NO: 3235266 - DNA, 15 bp, Homo sapiens
ccaggcccagccagt

SEQ ID NO: 3235267 - DNA, 18 bp, Homo sapiens
ccaggcccagccagttgg

SEQ ID NO: 3235268 - DNA, 13 bp, Homo sapiens
ccaggcccaggca

SEQ ID NO: 3235269 - DNA, 16 bp, Homo sapiens
ccaggcccatctcagg

SEQ ID NO: 3235270 - DNA, 19 bp, Homo sapiens
ccaggcccatctcaggtgc

SEQ ID NO: 3235271 - DNA, 16 bp, Homo sapiens
ccaggcccctgaggac

SEQ ID NO: 3235272 - DNA, 19 bp, Homo sapiens
ccaggcccctgaggactgg

SEQ ID NO: 3235273 - DNA, 22 bp, Homo sapiens
ccaggcccctgaggactggaga

SEQ ID NO: 3235274 - DNA, 15 bp, Homo sapiens
ccaggcccctgccac

SEQ ID NO: 3235275 - DNA, 22 bp, Homo sapiens
ccaggcccgcaccccggcctca

SEQ ID NO: 3235276 - DNA, 16 bp, Homo sapiens
ccaggccctccagtgg

SEQ ID NO: 3235277 - DNA, 14 bp, Homo sapiens
ccaggccctccatg

SEQ ID NO: 3235278 - DNA, 15 bp, Homo sapiens
ccaggccctccatgg

SEQ ID NO: 3235279 - DNA, 18 bp, Homo sapiens
ccaggccctccatgggct

SEQ ID NO: 3235280 - DNA, 19 bp, Homo sapiens
ccaggccctccatgggcta

SEQ ID NO: 3235281 - DNA, 21 bp, Homo sapiens
ccaggccctccatgggctagt

SEQ ID NO: 3235282 - DNA, 18 bp, Homo sapiens
ccaggccctcctctccca

SEQ ID NO: 3235283 - DNA, 21 bp, Homo sapiens
ccaggccgcagctcttgccct

SEQ ID NO: 3235284 - DNA, 17 bp, Homo sapiens
ccaggccggccagcctc

SEQ ID NO: 3235285 - DNA, 15 bp, Homo sapiens
ccaggcctccagcct

SEQ ID NO: 3235286 - DNA, 19 bp, Homo sapiens
ccaggcctccagcctctcc

SEQ ID NO: 3235287 - DNA, 20 bp, Homo sapiens
ccaggcctccagcctctccc

SEQ ID NO: 3235288 - DNA, 13 bp, Homo sapiens
ccaggcctctgtg

SEQ ID NO: 3235289 - DNA, 19 bp, Homo sapiens
ccaggcctcttggcagtca

SEQ ID NO: 3235290 - DNA, 12 bp, Homo sapiens
ccaggcctgggt

SEQ ID NO: 3235291 - DNA, 16 bp, Homo sapiens
ccaggcctgggtctgt

SEQ ID NO: 3235292 - DNA, 20 bp, Homo sapiens
ccaggcctgggtctgtgtct

SEQ ID NO: 3235293 - DNA, 15 bp, Homo sapiens
ccaggcctgtccacc

SEQ ID NO: 3235294 - DNA, 19 bp, Homo sapiens
ccaggcctgtccaccctgc

SEQ ID NO: 3235295 - DNA, 14 bp, Homo sapiens
ccaggcgggctcaa

SEQ ID NO: 3235296 - DNA, 17 bp, Homo sapiens
ccaggcgggctcaagga

SEQ ID NO: 3235297 - DNA, 18 bp, Homo sapiens
ccaggcgggctcaaggaa

SEQ ID NO: 3235298 - DNA, 16 bp, Homo sapiens
ccaggcgttggtgcca

SEQ ID NO: 3235299 - DNA, 20 bp, Homo sapiens
ccaggctatggttgccaccc

SEQ ID NO: 3235300 - DNA, 14 bp, Homo sapiens
ccaggctccgccct

SEQ ID NO: 3235301 - DNA, 20 bp, Homo sapiens
ccaggctcctttagcgccca

SEQ ID NO: 3235302 - DNA, 12 bp, Homo sapiens
ccaggctcttcc

SEQ ID NO: 3235303 - DNA, 17 bp, Homo sapiens
ccaggctcttcctggac

SEQ ID NO: 3235304 - DNA, 23 bp, Homo sapiens
ccaggctcttcctggacctgagt

SEQ ID NO: 3235305 - DNA, 19 bp, Homo sapiens
ccaggctgaattacagtga

SEQ ID NO: 3235306 - DNA, 14 bp, Homo sapiens
ccaggctgcactgc

SEQ ID NO: 3235307 - DNA, 13 bp, Homo sapiens
ccaggctgccaag

SEQ ID NO: 3235308 - DNA, 12 bp, Homo sapiens
ccaggctgcccc

SEQ ID NO: 3235309 - DNA, 22 bp, Homo sapiens
ccaggctgcccccaacactcca

SEQ ID NO: 3235310 - DNA, 23 bp, Homo sapiens
ccaggctgcccccaacactccag

SEQ ID NO: 3235311 - DNA, 15 bp, Homo sapiens
ccaggctgccgtggg

SEQ ID NO: 3235312 - DNA, 20 bp, Homo sapiens
ccatgacaggcctgaagata

SEQ ID NO: 3235313 - DNA, 12 bp, Homo sapiens
ccatgacccacc

SEQ ID NO: 3235314 - DNA, 21 bp, Homo sapiens
ccatgactgcacccagctcca

SEQ ID NO: 3235315 - DNA, 13 bp, Homo sapiens
ccatgagaagagg

SEQ ID NO: 3235316 - DNA, 17 bp, Homo sapiens
ccatgagaagagggcct

SEQ ID NO: 3235317 - DNA, 23 bp, Homo sapiens
ccatgagaccctggtgcctggct

SEQ ID NO: 3235318 - DNA, 13 bp, Homo sapiens
ccatgagcctcag

SEQ ID NO: 3235319 - DNA, 23 bp, Homo sapiens
ccatgagcctgcccgctgcaatg

SEQ ID NO: 3235320 - DNA, 18 bp, Homo sapiens
ccatgagggacagggtct

SEQ ID NO: 3235321 - DNA, 17 bp, Homo sapiens
ccatgagtccttgaaaa

SEQ ID NO: 3235322 - DNA, 17 bp, Homo sapiens
ccatgagtttgccctgg

SEQ ID NO: 3235323 - DNA, 12 bp, Homo sapiens
ccatgatctgta

SEQ ID NO: 3235324 - DNA, 15 bp, Homo sapiens
ccatgatctgtattt

SEQ ID NO: 3235325 - DNA, 23 bp, Homo sapiens
ccatgattctatttatatgtaca

SEQ ID NO: 3235326 - DNA, 16 bp, Homo sapiens
ccatgatttgtcccag

SEQ ID NO: 3235327 - DNA, 22 bp, Homo sapiens
ccatgatttgtcccagcctggg

SEQ ID NO: 3235328 - DNA, 15 bp, Homo sapiens
ccatgcagccttggg

SEQ ID NO: 3235329 - DNA, 19 bp, Homo sapiens
ccatgcagccttggggcat

SEQ ID NO: 3235330 - DNA, 13 bp, Homo sapiens
ccatgccacgttc

SEQ ID NO: 3235331 - DNA, 12 bp, Homo sapiens
ccatgccactgc

SEQ ID NO: 3235332 - DNA, 14 bp, Homo sapiens
ccatgccactgcca

SEQ ID NO: 3235333 - DNA, 20 bp, Homo sapiens
ccatgccactgccaggcacc

SEQ ID NO: 3235334 - DNA, 14 bp, Homo sapiens
ccatgccaggaacc

SEQ ID NO: 3235335 - DNA, 17 bp, Homo sapiens
ccatgcccacctgccca

SEQ ID NO: 3235336 - DNA, 18 bp, Homo sapiens
ccatgcccacctgcccat

SEQ ID NO: 3235337 - DNA, 14 bp, Homo sapiens
ccatgcccaggacg

SEQ ID NO: 3235338 - DNA, 13 bp, Homo sapiens
ccatgcctcatgc

SEQ ID NO: 3235339 - DNA, 22 bp, Homo sapiens
ccatgcctctggaggcctctgg

SEQ ID NO: 3235340 - DNA, 14 bp, Homo sapiens
ccatgcctgagggt

SEQ ID NO: 3235341 - DNA, 23 bp, Homo sapiens
ccatgcctgtagctttcctggtc

SEQ ID NO: 3235342 - DNA, 22 bp, Homo sapiens
ccatgcgccccctccgccctgc

SEQ ID NO: 3235343 - DNA, 16 bp, Homo sapiens
ccatgcgctcagggcc

SEQ ID NO: 3235344 - DNA, 20 bp, Homo sapiens
ccatgcgtgccgcctgctcc

SEQ ID NO: 3235345 - DNA, 16 bp, Homo sapiens
ccatgctcatctgctg

SEQ ID NO: 3235346 - DNA, 17 bp, Homo sapiens
ccatgctcatctgctgg

SEQ ID NO: 3235347 - DNA, 21 bp, Homo sapiens
ccatgctcctcactgcccgca

SEQ ID NO: 3235348 - DNA, 16 bp, Homo sapiens
ccatgctgaggcctgg

SEQ ID NO: 3235349 - DNA, 18 bp, Homo sapiens
ccatgctgaggcctgggc

SEQ ID NO: 3235350 - DNA, 20 bp, Homo sapiens
ccatgctgctttttggcaca

SEQ ID NO: 3235351 - DNA, 21 bp, Homo sapiens
ccatgctgggaagacgcctga

SEQ ID NO: 3235352 - DNA, 19 bp, Homo sapiens
ccatgcttacgtgatcctc

SEQ ID NO: 3235353 - DNA, 14 bp, Homo sapiens
ccatggagccagct

SEQ ID NO: 3235354 - DNA, 20 bp, Homo sapiens
ccatggatttttacaagatc

SEQ ID NO: 3235355 - DNA, 18 bp, Homo sapiens
ccatggcaccagccccct

SEQ ID NO: 3235356 - DNA, 19 bp, Homo sapiens
ccatggcaccagccccctg

SEQ ID NO: 3235357 - DNA, 22 bp, Homo sapiens
ccatggcaccagccccctggat

SEQ ID NO: 3235358 - DNA, 23 bp, Homo sapiens
ccatggcaccttcagactttgct

SEQ ID NO: 3235359 - DNA, 18 bp, Homo sapiens
ccatggcagcatggagag

SEQ ID NO: 3235360 - DNA, 15 bp, Homo sapiens
ccatggccccaggcc

SEQ ID NO: 3235361 - DNA, 16 bp, Homo sapiens
ccatggccccaggccc

SEQ ID NO: 3235362 - DNA, 17 bp, Homo sapiens
ccatggcccccaataaa

SEQ ID NO: 3235363 - DNA, 18 bp, Homo sapiens
ccatggcccccaataaag

SEQ ID NO: 3235364 - DNA, 24 bp, Homo sapiens
ccatggcccccaataaaggcagct

SEQ ID NO: 3235365 - DNA, 14 bp, Homo sapiens
ccatggccttatga

SEQ ID NO: 3235366 - DNA, 14 bp, Homo sapiens
ccatggcctttcta

SEQ ID NO: 3235367 - DNA, 19 bp, Homo sapiens
ccatggcgtgtccctctcg

SEQ ID NO: 3235368 - DNA, 16 bp, Homo sapiens
ccatggctcaggcaag

SEQ ID NO: 3235369 - DNA, 13 bp, Homo sapiens
ccatgggagccag

SEQ ID NO: 3235370 - DNA, 19 bp, Homo sapiens
ccatgggagccagctgctt

SEQ ID NO: 3235371 - DNA, 24 bp, Homo sapiens
ccatgggatacaacctccctcttg

SEQ ID NO: 3235372 - DNA, 17 bp, Homo sapiens
ccatgggatatgtggtg

SEQ ID NO: 3235373 - DNA, 13 bp, Homo sapiens
ccatgggccagcc

SEQ ID NO: 3235374 - DNA, 19 bp, Homo sapiens
ccatgggccagcctagccc

SEQ ID NO: 3235375 - DNA, 15 bp, Homo sapiens
ccatgggcctcctgt

SEQ ID NO: 3235376 - DNA, 13 bp, Homo sapiens
ccatgggcctggg

SEQ ID NO: 3235377 - DNA, 14 bp, Homo sapiens
ccatgggcctgggc

SEQ ID NO: 3235378 - DNA, 15 bp, Homo sapiens
ccatgggcctgggcc

SEQ ID NO: 3235379 - DNA, 19 bp, Homo sapiens
ccatgggcctgggcctgct

SEQ ID NO: 3235380 - DNA, 13 bp, Homo sapiens
ccatgggcttcac

SEQ ID NO: 3235381 - DNA, 16 bp, Homo sapiens
ccatgggcttcactgt

SEQ ID NO: 3235382 - DNA, 19 bp, Homo sapiens
ccatgggcttcactgtata

SEQ ID NO: 3235383 - DNA, 18 bp, Homo sapiens
ccatggggagggattctg

SEQ ID NO: 3235384 - DNA, 16 bp, Homo sapiens
ccatggtacccccttc

SEQ ID NO: 3235385 - DNA, 18 bp, Homo sapiens
ccatggtacccccttctg

SEQ ID NO: 3235386 - DNA, 19 bp, Homo sapiens
ccatggtacccccttctgg

SEQ ID NO: 3235387 - DNA, 16 bp, Homo sapiens
ccatggtctttccact

SEQ ID NO: 3235388 - DNA, 13 bp, Homo sapiens
ccatgtactgtag

SEQ ID NO: 3235389 - DNA, 22 bp, Homo sapiens
ccatgtactgtagtttttcttc

SEQ ID NO: 3235390 - DNA, 20 bp, Homo sapiens
ccatgtagccccctggcctc

SEQ ID NO: 3235391 - DNA, 23 bp, Homo sapiens
ccatgtatggaatcccactgtat

SEQ ID NO: 3235392 - DNA, 20 bp, Homo sapiens
ccatgtcaccggtcagtgcc

SEQ ID NO: 3235393 - DNA, 13 bp, Homo sapiens
ccatgtcactgtg

SEQ ID NO: 3235394 - DNA, 23 bp, Homo sapiens
ccatgtccaaagaggctgcccct

SEQ ID NO: 3235395 - DNA, 15 bp, Homo sapiens
ccatgtccaagttct

SEQ ID NO: 3235396 - DNA, 23 bp, Homo sapiens
ccatgtccaagttcttcacctct

SEQ ID NO: 3235397 - DNA, 16 bp, Homo sapiens
ccatgtcctatgtgtg

SEQ ID NO: 3235398 - DNA, 17 bp, Homo sapiens
ccatgtcctatgtgtga

SEQ ID NO: 3235399 - DNA, 15 bp, Homo sapiens
ccatgtcgcctctgc

SEQ ID NO: 3235400 - DNA, 17 bp, Homo sapiens
ccatgtgattaatgttt

SEQ ID NO: 3235401 - DNA, 22 bp, Homo sapiens
ccatgtgattaatgttttcatt

SEQ ID NO: 3235402 - DNA, 14 bp, Homo sapiens
ccatgtggctgaag

SEQ ID NO: 3235403 - DNA, 15 bp, Homo sapiens
ccatgtggctgaaga

SEQ ID NO: 3235404 - DNA, 18 bp, Homo sapiens
ccatgtggtggcacaggc

SEQ ID NO: 3235405 - DNA, 12 bp, Homo sapiens
ccatgtgtcccc

SEQ ID NO: 3235406 - DNA, 18 bp, Homo sapiens
ccatgtgtcccctcactc

SEQ ID NO: 3235407 - DNA, 17 bp, Homo sapiens
ccatgtgtcctggttcc

SEQ ID NO: 3235408 - DNA, 15 bp, Homo sapiens
ccatgtgtggactca

SEQ ID NO: 3235409 - DNA, 18 bp, Homo sapiens
ccatgttagtttttactt

SEQ ID NO: 3235410 - DNA, 22 bp, Homo sapiens
ccatgttcacaccgctgcactc

SEQ ID NO: 3235411 - DNA, 15 bp, Homo sapiens
ccatgttcattataa

SEQ ID NO: 3235412 - DNA, 16 bp, Homo sapiens
ccatgttcattataat

SEQ ID NO: 3235413 - DNA, 18 bp, Homo sapiens
ccatgttctgcccccagc

SEQ ID NO: 3235414 - DNA, 19 bp, Homo sapiens
ccatgttctgcccccagcc

SEQ ID NO: 3235415 - DNA, 21 bp, Homo sapiens
ccatgttctgcccccagccca

SEQ ID NO: 3235416 - DNA, 13 bp, Homo sapiens
ccatgttggccag

SEQ ID NO: 3235417 - DNA, 16 bp, Homo sapiens
ccatgttggccaggct

SEQ ID NO: 3235418 - DNA, 18 bp, Homo sapiens
ccatgttggccaggctgg

SEQ ID NO: 3235419 - DNA, 16 bp, Homo sapiens
ccatgttgtaatgctg

SEQ ID NO: 3235420 - DNA, 17 bp, Homo sapiens
ccatgttgtaatgctgc

SEQ ID NO: 3235421 - DNA, 22 bp, Homo sapiens
ccatgttgtaatgctgcacttc

SEQ ID NO: 3235422 - DNA, 13 bp, Homo sapiens
ccatgtttagtga

SEQ ID NO: 3235423 - DNA, 23 bp, Homo sapiens
ccatgtttggtgtttgtctgtgt

SEQ ID NO: 3235424 - DNA, 16 bp, Homo sapiens
ccattaaaactgcttt

SEQ ID NO: 3235425 - DNA, 17 bp, Homo sapiens
ccattaaatgaatattt

SEQ ID NO: 3235426 - DNA, 15 bp, Homo sapiens
ccattaaggggaaga

SEQ ID NO: 3235427 - DNA, 12 bp, Homo sapiens
ccattaattaca

SEQ ID NO: 3235428 - DNA, 16 bp, Homo sapiens
ccattagagtcagcct

SEQ ID NO: 3235429 - DNA, 22 bp, Homo sapiens
ccattaggacaatcagtcccct

SEQ ID NO: 3235430 - DNA, 13 bp, Homo sapiens
ccattattttctg

SEQ ID NO: 3235431 - DNA, 16 bp, Homo sapiens
ccattattttctgtca

SEQ ID NO: 3235432 - DNA, 19 bp, Homo sapiens
ccattattttctgtcagat

SEQ ID NO: 3235433 - DNA, 12 bp, Homo sapiens
ccattattttgt

SEQ ID NO: 3235434 - DNA, 14 bp, Homo sapiens
ccattcacttcccc

SEQ ID NO: 3235435 - DNA, 15 bp, Homo sapiens
ccattcacttctgca

SEQ ID NO: 3235436 - DNA, 21 bp, Homo sapiens
ccattcacttctgcattcctg

SEQ ID NO: 3235437 - DNA, 16 bp, Homo sapiens
ccattccagaatatct

SEQ ID NO: 3235438 - DNA, 14 bp, Homo sapiens
cccagcccctagaa

SEQ ID NO: 3235439 - DNA, 16 bp, Homo sapiens
cccagcccctagaaac

SEQ ID NO: 3235440 - DNA, 15 bp, Homo sapiens
cccagcccctccacg

SEQ ID NO: 3235441 - DNA, 18 bp, Homo sapiens
cccagcccctcccccatc

SEQ ID NO: 3235442 - DNA, 18 bp, Homo sapiens
cccagccctggctctgca

SEQ ID NO: 3235443 - DNA, 22 bp, Homo sapiens
cccagccctgggaaccactccc

SEQ ID NO: 3235444 - DNA, 20 bp, Homo sapiens
cccagccctgtcctggttcc

SEQ ID NO: 3235445 - DNA, 16 bp, Homo sapiens
cccagccggcctctct

SEQ ID NO: 3235446 - DNA, 17 bp, Homo sapiens
cccagccggcctctctg

SEQ ID NO: 3235447 - DNA, 18 bp, Homo sapiens
cccagccggcctctctgg

SEQ ID NO: 3235448 - DNA, 19 bp, Homo sapiens
cccagccggcctctctggc

SEQ ID NO: 3235449 - DNA, 23 bp, Homo sapiens
cccagccggcctctctggcctcc

SEQ ID NO: 3235450 - DNA, 17 bp, Homo sapiens
cccagcctacccttcct

SEQ ID NO: 3235451 - DNA, 18 bp, Homo sapiens
cccagcctacccttcctg

SEQ ID NO: 3235452 - DNA, 15 bp, Homo sapiens
cccagcctatgagca

SEQ ID NO: 3235453 - DNA, 23 bp, Homo sapiens
cccagcctatgagcatcctgagc

SEQ ID NO: 3235454 - DNA, 16 bp, Homo sapiens
cccagcctcagtcctc

SEQ ID NO: 3235455 - DNA, 22 bp, Homo sapiens
cccagcctcagtcctcccctca

SEQ ID NO: 3235456 - DNA, 16 bp, Homo sapiens
cccagcctgacctgag

SEQ ID NO: 3235457 - DNA, 20 bp, Homo sapiens
cccagcctgacctgagactg

SEQ ID NO: 3235458 - DNA, 12 bp, Homo sapiens
cccagcctgcta

SEQ ID NO: 3235459 - DNA, 15 bp, Homo sapiens
cccagcctgctgaga

SEQ ID NO: 3235460 - DNA, 19 bp, Homo sapiens
cccagcctgctgagagccc

SEQ ID NO: 3235461 - DNA, 20 bp, Homo sapiens
cccagcctgctgagagcccc

SEQ ID NO: 3235462 - DNA, 20 bp, Homo sapiens
cccagcctgggagcccagag

SEQ ID NO: 3235463 - DNA, 14 bp, Homo sapiens
cccagcctggggct

SEQ ID NO: 3235464 - DNA, 15 bp, Homo sapiens
cccagcgagccctgg

SEQ ID NO: 3235465 - DNA, 17 bp, Homo sapiens
cccagcgagccctggtg

SEQ ID NO: 3235466 - DNA, 23 bp, Homo sapiens
cccagcgcggccagcgtcccagg

SEQ ID NO: 3235467 - DNA, 15 bp, Homo sapiens
cccagcgctctgcct

SEQ ID NO: 3235468 - DNA, 16 bp, Homo sapiens
cccagcgctctgcctc

SEQ ID NO: 3235469 - DNA, 19 bp, Homo sapiens
cccagcggccccccgcaca

SEQ ID NO: 3235470 - DNA, 12 bp, Homo sapiens
cccagcgggcag

SEQ ID NO: 3235471 - DNA, 16 bp, Homo sapiens
cccagcgggcagatgg

SEQ ID NO: 3235472 - DNA, 20 bp, Homo sapiens
cccagcgtgtgtatccgact

SEQ ID NO: 3235473 - DNA, 18 bp, Homo sapiens
cccagctaatctgtaggg

SEQ ID NO: 3235474 - DNA, 13 bp, Homo sapiens
cccagctacccct

SEQ ID NO: 3235475 - DNA, 22 bp, Homo sapiens
cccagctaccctttttctccag

SEQ ID NO: 3235476 - DNA, 18 bp, Homo sapiens
cccagctactctgtccag

SEQ ID NO: 3235477 - DNA, 19 bp, Homo sapiens
cccagctactctgtccagg

SEQ ID NO: 3235478 - DNA, 20 bp, Homo sapiens
cccagctactctgtccaggc

SEQ ID NO: 3235479 - DNA, 17 bp, Homo sapiens
cccagctacttgggagg

SEQ ID NO: 3235480 - DNA, 23 bp, Homo sapiens
cccagctacttgggaggctgagg

SEQ ID NO: 3235481 - DNA, 17 bp, Homo sapiens
cccagctcaggggcagc

SEQ ID NO: 3235482 - DNA, 13 bp, Homo sapiens
cccagctcccccc

SEQ ID NO: 3235483 - DNA, 21 bp, Homo sapiens
cccagctccccccgcccaccc

SEQ ID NO: 3235484 - DNA, 21 bp, Homo sapiens
cccagctcctttctcctgtga

SEQ ID NO: 3235485 - DNA, 22 bp, Homo sapiens
cccagctcctttctcctgtgaa

SEQ ID NO: 3235486 - DNA, 23 bp, Homo sapiens
cccagctcctttctcctgtgaat

SEQ ID NO: 3235487 - DNA, 14 bp, Homo sapiens
cccagctctgaccc

SEQ ID NO: 3235488 - DNA, 20 bp, Homo sapiens
cccagctctgaggggagggg

SEQ ID NO: 3235489 - DNA, 20 bp, Homo sapiens
cccagctctggtgagtcttg

SEQ ID NO: 3235490 - DNA, 22 bp, Homo sapiens
cccagctctggtgagtcttggc

SEQ ID NO: 3235491 - DNA, 14 bp, Homo sapiens
cccagctgactgtg

SEQ ID NO: 3235492 - DNA, 17 bp, Homo sapiens
cccagctgactgtggcc

SEQ ID NO: 3235493 - DNA, 12 bp, Homo sapiens
cccagctgcacc

SEQ ID NO: 3235494 - DNA, 20 bp, Homo sapiens
cccagctgcctggagagggt

SEQ ID NO: 3235495 - DNA, 11 bp, Homo sapiens
cccagctggga

SEQ ID NO: 3235496 - DNA, 21 bp, Homo sapiens
cccagctgggaggcaagaggg

SEQ ID NO: 3235497 - DNA, 16 bp, Homo sapiens
cccagctgtagccatg

SEQ ID NO: 3235498 - DNA, 19 bp, Homo sapiens
cccagctgtagccatggct

SEQ ID NO: 3235499 - DNA, 20 bp, Homo sapiens
cccagctgtagccatggctc

SEQ ID NO: 3235500 - DNA, 22 bp, Homo sapiens
cccagctgtagccatggctcag

SEQ ID NO: 3235501 - DNA, 16 bp, Homo sapiens
cccagctgtgagcctt

SEQ ID NO: 3235502 - DNA, 21 bp, Homo sapiens
cccagctgtgctctggacagg

SEQ ID NO: 3235503 - DNA, 21 bp, Homo sapiens
cccagctgtgctgtggagaga

SEQ ID NO: 3235504 - DNA, 15 bp, Homo sapiens
cccagcttcctggtg

SEQ ID NO: 3235505 - DNA, 16 bp, Homo sapiens
cccaggaaaggcccag

SEQ ID NO: 3235506 - DNA, 15 bp, Homo sapiens
cccaggaactgggcc

SEQ ID NO: 3235507 - DNA, 15 bp, Homo sapiens
cccaggaagcccaca

SEQ ID NO: 3235508 - DNA, 22 bp, Homo sapiens
cccaggaaggcctaggctagga

SEQ ID NO: 3235509 - DNA, 20 bp, Homo sapiens
cccaggacaccacacccagc

SEQ ID NO: 3235510 - DNA, 15 bp, Homo sapiens
cccaggacatctcct

SEQ ID NO: 3235511 - DNA, 16 bp, Homo sapiens
cccaggacatctcctg

SEQ ID NO: 3235512 - DNA, 16 bp, Homo sapiens
cccaggaccagctggg

SEQ ID NO: 3235513 - DNA, 21 bp, Homo sapiens
cccaggagacagaccacttgc

SEQ ID NO: 3235514 - DNA, 20 bp, Homo sapiens
cccaggagaccacggggagc

SEQ ID NO: 3235515 - DNA, 13 bp, Homo sapiens
cccaggagagaga

SEQ ID NO: 3235516 - DNA, 14 bp, Homo sapiens
cccaggagagagaa

SEQ ID NO: 3235517 - DNA, 15 bp, Homo sapiens
cccaggagagagaaa

SEQ ID NO: 3235518 - DNA, 13 bp, Homo sapiens
cccaggagccccg

SEQ ID NO: 3235519 - DNA, 18 bp, Homo sapiens
cccaggagccccgaggcc

SEQ ID NO: 3235520 - DNA, 13 bp, Homo sapiens
cccaggaggggaa

SEQ ID NO: 3235521 - DNA, 23 bp, Homo sapiens
cccaggagtttgagacaagccct

SEQ ID NO: 3235522 - DNA, 22 bp, Homo sapiens
cccaggagtttgaggctgcagc

SEQ ID NO: 3235523 - DNA, 23 bp, Homo sapiens
cccaggagtttgaggctgcagcg

SEQ ID NO: 3235524 - DNA, 15 bp, Homo sapiens
cccaggattccccca

SEQ ID NO: 3235525 - DNA, 22 bp, Homo sapiens
cccaggcagcacagtgtgtgaa

SEQ ID NO: 3235526 - DNA, 23 bp, Homo sapiens
cccaggcaggtcttgaactcctg

SEQ ID NO: 3235527 - DNA, 13 bp, Homo sapiens
cccaggccacagc

SEQ ID NO: 3235528 - DNA, 14 bp, Homo sapiens
cccaggccacagcc

SEQ ID NO: 3235529 - DNA, 20 bp, Homo sapiens
cccaggccaggtgaggtcca

SEQ ID NO: 3235530 - DNA, 18 bp, Homo sapiens
cccaggcccaccatcacc

SEQ ID NO: 3235531 - DNA, 22 bp, Homo sapiens
cccaggcccctgccaccctggg

SEQ ID NO: 3235532 - DNA, 12 bp, Homo sapiens
cccaggccctcc

SEQ ID NO: 3235533 - DNA, 16 bp, Homo sapiens
cccaggccctccatgg

SEQ ID NO: 3235534 - DNA, 15 bp, Homo sapiens
cccaggccctccctg

SEQ ID NO: 3235535 - DNA, 13 bp, Homo sapiens
cccaggcccttca

SEQ ID NO: 3235536 - DNA, 14 bp, Homo sapiens
cccaggcccttcag

SEQ ID NO: 3235537 - DNA, 17 bp, Homo sapiens
cccaggccgcagctctt

SEQ ID NO: 3235538 - DNA, 20 bp, Homo sapiens
cccaggcctacctcactctc

SEQ ID NO: 3235539 - DNA, 17 bp, Homo sapiens
cccaggcctccagcctc

SEQ ID NO: 3235540 - DNA, 13 bp, Homo sapiens
cccaggcctctgt

SEQ ID NO: 3235541 - DNA, 18 bp, Homo sapiens
cccaggcgccccttcccc

SEQ ID NO: 3235542 - DNA, 21 bp, Homo sapiens
cccaggctccgcccttagtcc

SEQ ID NO: 3235543 - DNA, 13 bp, Homo sapiens
cccaggctgcact

SEQ ID NO: 3235544 - DNA, 14 bp, Homo sapiens
cccaggctgcactg

SEQ ID NO: 3235545 - DNA, 19 bp, Homo sapiens
cccaggctgcactgcagtg

SEQ ID NO: 3235546 - DNA, 20 bp, Homo sapiens
cccaggctgcactgcagtga

SEQ ID NO: 3235547 - DNA, 21 bp, Homo sapiens
cccaggctggacatgctgact

SEQ ID NO: 3235548 - DNA, 19 bp, Homo sapiens
cccaggctggagtgcagtg

SEQ ID NO: 3235549 - DNA, 19 bp, Homo sapiens
cccaggctggcgtgcagtg

SEQ ID NO: 3235550 - DNA, 13 bp, Homo sapiens
cccaggctgggaa

SEQ ID NO: 3235551 - DNA, 22 bp, Homo sapiens
cccagggaatcagggaccagct

SEQ ID NO: 3235552 - DNA, 14 bp, Homo sapiens
cccagggagggaag

SEQ ID NO: 3235553 - DNA, 19 bp, Homo sapiens
cccagggagggaagtgtga

SEQ ID NO: 3235554 - DNA, 22 bp, Homo sapiens
cccagggagggaagtgtgagcg

SEQ ID NO: 3235555 - DNA, 23 bp, Homo sapiens
cccagggcagggtgggcagccta

SEQ ID NO: 3235556 - DNA, 17 bp, Homo sapiens
cccagggccagggccct

SEQ ID NO: 3235557 - DNA, 21 bp, Homo sapiens
cccagggccagggccctgcag

SEQ ID NO: 3235558 - DNA, 13 bp, Homo sapiens
cccagggcccctc

SEQ ID NO: 3235559 - DNA, 17 bp, Homo sapiens
cccagggcccctccctc

SEQ ID NO: 3235560 - DNA, 20 bp, Homo sapiens
cccagggcccctccctctgc

SEQ ID NO: 3235561 - DNA, 15 bp, Homo sapiens
cccagggccctggat

SEQ ID NO: 3235562 - DNA, 16 bp, Homo sapiens
cccagggcctgggggc

SEQ ID NO: 3235563 - DNA, 22 bp, Homo sapiens
ccccaggtccagctctggaggg

SEQ ID NO: 3235564 - DNA, 14 bp, Homo sapiens
ccccagtacctcca

SEQ ID NO: 3235565 - DNA, 18 bp, Homo sapiens
ccccagtacctccaagca

SEQ ID NO: 3235566 - DNA, 11 bp, Homo sapiens
ccccagtccca

SEQ ID NO: 3235567 - DNA, 19 bp, Homo sapiens
ccccagtccccacccctgc

SEQ ID NO: 3235568 - DNA, 23 bp, Homo sapiens
ccccagttctaggggagaagagc

SEQ ID NO: 3235569 - DNA, 14 bp, Homo sapiens
ccccagttctgctc

SEQ ID NO: 3235570 - DNA, 16 bp, Homo sapiens
ccccagttctgctcct

SEQ ID NO: 3235571 - DNA, 18 bp, Homo sapiens
ccccagttctgctcctct

SEQ ID NO: 3235572 - DNA, 23 bp, Homo sapiens
ccccagttctgctcctctccagg

SEQ ID NO: 3235573 - DNA, 13 bp, Homo sapiens
ccccagtttcttc

SEQ ID NO: 3235574 - DNA, 12 bp, Homo sapiens
ccccatagccac

SEQ ID NO: 3235575 - DNA, 16 bp, Homo sapiens
ccccatcccacaccct

SEQ ID NO: 3235576 - DNA, 14 bp, Homo sapiens
ccccatccccacca

SEQ ID NO: 3235577 - DNA, 19 bp, Homo sapiens
ccccatccccttcctaaat

SEQ ID NO: 3235578 - DNA, 16 bp, Homo sapiens
ccccatcctcatccct

SEQ ID NO: 3235579 - DNA, 16 bp, Homo sapiens
ccccatcctccagctt

SEQ ID NO: 3235580 - DNA, 15 bp, Homo sapiens
ccccatcggccaaga

SEQ ID NO: 3235581 - DNA, 19 bp, Homo sapiens
ccccatctcatcctggcac

SEQ ID NO: 3235582 - DNA, 21 bp, Homo sapiens
ccccatctccaagataagcct

SEQ ID NO: 3235583 - DNA, 18 bp, Homo sapiens
ccccatctccctgcctgg

SEQ ID NO: 3235584 - DNA, 15 bp, Homo sapiens
ccccatctctcatcc

SEQ ID NO: 3235585 - DNA, 19 bp, Homo sapiens
ccccatctgggtccttgca

SEQ ID NO: 3235586 - DNA, 12 bp, Homo sapiens
ccccatcttgct

SEQ ID NO: 3235587 - DNA, 15 bp, Homo sapiens
ccccatgaggaagga

SEQ ID NO: 3235588 - DNA, 18 bp, Homo sapiens
ccccatgcctgtccagcc

SEQ ID NO: 3235589 - DNA, 21 bp, Homo sapiens
ccccatgcctgtccagcctgg

SEQ ID NO: 3235590 - DNA, 15 bp, Homo sapiens
ccccatgctctgccc

SEQ ID NO: 3235591 - DNA, 21 bp, Homo sapiens
ccccatgctctgccccaagcc

SEQ ID NO: 3235592 - DNA, 22 bp, Homo sapiens
ccccatgctctgccccaagccc

SEQ ID NO: 3235593 - DNA, 19 bp, Homo sapiens
ccccatggagctgggctaa

SEQ ID NO: 3235594 - DNA, 13 bp, Homo sapiens
ccccatgggcttg

SEQ ID NO: 3235595 - DNA, 15 bp, Homo sapiens
ccccatgggcttgga

SEQ ID NO: 3235596 - DNA, 22 bp, Homo sapiens
ccccatgggcttggacttcctg

SEQ ID NO: 3235597 - DNA, 15 bp, Homo sapiens
ccccatgtgccttta

SEQ ID NO: 3235598 - DNA, 14 bp, Homo sapiens
ccccattctgcctg

SEQ ID NO: 3235599 - DNA, 16 bp, Homo sapiens
ccccatttcctcacac

SEQ ID NO: 3235600 - DNA, 21 bp, Homo sapiens
ccccatttcctgtacaatcat

SEQ ID NO: 3235601 - DNA, 19 bp, Homo sapiens
cccccaaccatcttcactg

SEQ ID NO: 3235602 - DNA, 12 bp, Homo sapiens
cccccaacccac

SEQ ID NO: 3235603 - DNA, 14 bp, Homo sapiens
cccccaacctcagg

SEQ ID NO: 3235604 - DNA, 19 bp, Homo sapiens
cccccaaggttctggttcc

SEQ ID NO: 3235605 - DNA, 18 bp, Homo sapiens
cccccaaggttttggagt

SEQ ID NO: 3235606 - DNA, 17 bp, Homo sapiens
cccccaataaaggcagc

SEQ ID NO: 3235607 - DNA, 21 bp, Homo sapiens
cccccaataaaggcagctgcc

SEQ ID NO: 3235608 - DNA, 23 bp, Homo sapiens
cccccaataaaggcagctgcctc

SEQ ID NO: 3235609 - DNA, 22 bp, Homo sapiens
cccccacaagctgtccctgcag

SEQ ID NO: 3235610 - DNA, 12 bp, Homo sapiens
cccccacccacc

SEQ ID NO: 3235611 - DNA, 13 bp, Homo sapiens
cccccaccctcca

SEQ ID NO: 3235612 - DNA, 18 bp, Homo sapiens
cccccaccggtccagctg

SEQ ID NO: 3235613 - DNA, 20 bp, Homo sapiens
cccccaccggtccagctggc

SEQ ID NO: 3235614 - DNA, 12 bp, Homo sapiens
cccccacctctg

SEQ ID NO: 3235615 - DNA, 16 bp, Homo sapiens
cccccacctctggtcc

SEQ ID NO: 3235616 - DNA, 14 bp, Homo sapiens
cccccaccttgatc

SEQ ID NO: 3235617 - DNA, 22 bp, Homo sapiens
cccccacttgcctcttccttga

SEQ ID NO: 3235618 - DNA, 18 bp, Homo sapiens
cccccagacacagcccag

SEQ ID NO: 3235619 - DNA, 16 bp, Homo sapiens
cccccagatagagctg

SEQ ID NO: 3235620 - DNA, 23 bp, Homo sapiens
cccccagcactaaggccgtgtct

SEQ ID NO: 3235621 - DNA, 12 bp, Homo sapiens
cccccagccagg

SEQ ID NO: 3235622 - DNA, 15 bp, Homo sapiens
cccccagcccaaagg

SEQ ID NO: 3235623 - DNA, 23 bp, Homo sapiens
cccccagcctatgagcatcctga

SEQ ID NO: 3235624 - DNA, 13 bp, Homo sapiens
cccccagcctggc

SEQ ID NO: 3235625 - DNA, 13 bp, Homo sapiens
cccccaggaagcc

SEQ ID NO: 3235626 - DNA, 15 bp, Homo sapiens
cccccagtacctcca

SEQ ID NO: 3235627 - DNA, 15 bp, Homo sapiens
cccccagtccccacc

SEQ ID NO: 3235628 - DNA, 22 bp, Homo sapiens
cccccagtccccacccctgccc

SEQ ID NO: 3235629 - DNA, 18 bp, Homo sapiens
cccccatctccccaggcc

SEQ ID NO: 3235630 - DNA, 22 bp, Homo sapiens
cccccatgttgtaatgctgcac

SEQ ID NO: 3235631 - DNA, 23 bp, Homo sapiens
cccccatgttgtaatgctgcact

SEQ ID NO: 3235632 - DNA, 12 bp, Homo sapiens
ccccccagcctc

SEQ ID NO: 3235633 - DNA, 13 bp, Homo sapiens
ccccccagcctct

SEQ ID NO: 3235634 - DNA, 13 bp, Homo sapiens
cccccctcctgct

SEQ ID NO: 3235635 - DNA, 12 bp, Homo sapiens
cccccctctgtc

SEQ ID NO: 3235636 - DNA, 14 bp, Homo sapiens
cccccgagctcttg

SEQ ID NO: 3235637 - DNA, 15 bp, Homo sapiens
cccccgaggctgcta

SEQ ID NO: 3235638 - DNA, 16 bp, Homo sapiens
cccccgcacagccacc

SEQ ID NO: 3235639 - DNA, 21 bp, Homo sapiens
cccccgcacagccacccgtgg

SEQ ID NO: 3235640 - DNA, 12 bp, Homo sapiens
cccccgccatgc

SEQ ID NO: 3235641 - DNA, 13 bp, Homo sapiens
cccccgcctgcca

SEQ ID NO: 3235642 - DNA, 19 bp, Homo sapiens
cccccgcgctcgcccagca

SEQ ID NO: 3235643 - DNA, 19 bp, Homo sapiens
ccccctaaacccctgtccc

SEQ ID NO: 3235644 - DNA, 13 bp, Homo sapiens
ccccctaagagac

SEQ ID NO: 3235645 - DNA, 16 bp, Homo sapiens
ccccctatccttggca

SEQ ID NO: 3235646 - DNA, 22 bp, Homo sapiens
ccccctccaggagagagccagg

SEQ ID NO: 3235647 - DNA, 18 bp, Homo sapiens
ccccctcccctcccagtc

SEQ ID NO: 3235648 - DNA, 23 bp, Homo sapiens
ccccctctgccggtcgggcagcc

SEQ ID NO: 3235649 - DNA, 16 bp, Homo sapiens
ccccctctgtcttgtg

SEQ ID NO: 3235650 - DNA, 12 bp, Homo sapiens
ccccctgcatct

SEQ ID NO: 3235651 - DNA, 19 bp, Homo sapiens
ccccctgccctcgtggcca

SEQ ID NO: 3235652 - DNA, 20 bp, Homo sapiens
ccccctgccctcgtggccag

SEQ ID NO: 3235653 - DNA, 14 bp, Homo sapiens
ccccctgccctgca

SEQ ID NO: 3235654 - DNA, 18 bp, Homo sapiens
ccccctgctccaccagca

SEQ ID NO: 3235655 - DNA, 15 bp, Homo sapiens
ccccctggcctctgt

SEQ ID NO: 3235656 - DNA, 22 bp, Homo sapiens
ccccctggcctctgtgccttct

SEQ ID NO: 3235657 - DNA, 13 bp, Homo sapiens
ccccctggctgac

SEQ ID NO: 3235658 - DNA, 15 bp, Homo sapiens
ccccctggctgactg

SEQ ID NO: 3235659 - DNA, 13 bp, Homo sapiens
ccccctgggctct

SEQ ID NO: 3235660 - DNA, 19 bp, Homo sapiens
ccccctggggcttctcctg

SEQ ID NO: 3235661 - DNA, 19 bp, Homo sapiens
ccccctggtggacagtcct

SEQ ID NO: 3235662 - DNA, 20 bp, Homo sapiens
ccccctggtggacagtcctg

SEQ ID NO: 3235663 - DNA, 21 bp, Homo sapiens
ccccctggtggacagtcctgg

SEQ ID NO: 3235664 - DNA, 15 bp, Homo sapiens
ccccctgtcccctca

SEQ ID NO: 3235665 - DNA, 21 bp, Homo sapiens
ccccctgtcccctcagctcca

SEQ ID NO: 3235666 - DNA, 16 bp, Homo sapiens
cccccttcaagcctgt

SEQ ID NO: 3235667 - DNA, 13 bp, Homo sapiens
cccccttcctagt

SEQ ID NO: 3235668 - DNA, 14 bp, Homo sapiens
cccccttcctagtg

SEQ ID NO: 3235669 - DNA, 11 bp, Homo sapiens
cccccttcctt

SEQ ID NO: 3235670 - DNA, 16 bp, Homo sapiens
cccccttctctgctcc

SEQ ID NO: 3235671 - DNA, 17 bp, Homo sapiens
cccccttctctgctcca

SEQ ID NO: 3235672 - DNA, 14 bp, Homo sapiens
cccccttctgggca

SEQ ID NO: 3235673 - DNA, 22 bp, Homo sapiens
cccccttctgggcatctgttct

SEQ ID NO: 3235674 - DNA, 19 bp, Homo sapiens
cccccttgccctccgcctg

SEQ ID NO: 3235675 - DNA, 12 bp, Homo sapiens
ccccctttcctg

SEQ ID NO: 3235676 - DNA, 18 bp, Homo sapiens
ccccgacactgctgcacc

SEQ ID NO: 3235677 - DNA, 17 bp, Homo sapiens
ccccgaggagctgggcc

SEQ ID NO: 3235678 - DNA, 14 bp, Homo sapiens
ccccgatgtcccct

SEQ ID NO: 3235679 - DNA, 15 bp, Homo sapiens
ccccgcacagccacc

SEQ ID NO: 3235680 - DNA, 23 bp, Homo sapiens
ccccgcagacctccccagcccct

SEQ ID NO: 3235681 - DNA, 12 bp, Homo sapiens
ccccgcagtccc

SEQ ID NO: 3235682 - DNA, 18 bp, Homo sapiens
ccccgcagtccccagccc

SEQ ID NO: 3235683 - DNA, 19 bp, Homo sapiens
ccccgcagtccccagccct

SEQ ID NO: 3235684 - DNA, 23 bp, Homo sapiens
ccccgcccagctgcacctgccag

SEQ ID NO: 3235685 - DNA, 16 bp, Homo sapiens
ccccgcccccagtccc

SEQ ID NO: 3235686 - DNA, 14 bp, Homo sapiens
ccccgcctgcagtc

SEQ ID NO: 3235687 - DNA, 14 bp, Homo sapiens
ccccgcctgccacc

SEQ ID NO: 3235688 - DNA, 13 bp, Homo sapiens
ccccgcctggcca

SEQ ID NO: 3235689 - DNA, 17 bp, Homo sapiens
ccccgcctggccaggag

SEQ ID NO: 3235690 - DNA, 15 bp, Homo sapiens
cccgtttccatacag

SEQ ID NO: 3235691 - DNA, 13 bp, Homo sapiens
cccgttttgtcac

SEQ ID NO: 3235692 - DNA, 12 bp, Homo sapiens
ccctaaactgta

SEQ ID NO: 3235693 - DNA, 17 bp, Homo sapiens
ccctaaccccttccaga

SEQ ID NO: 3235694 - DNA, 12 bp, Homo sapiens
ccctaagagact

SEQ ID NO: 3235695 - DNA, 21 bp, Homo sapiens
ccctaagtaagtttcttcctg

SEQ ID NO: 3235696 - DNA, 14 bp, Homo sapiens
ccctaagtgcccaa

SEQ ID NO: 3235697 - DNA, 16 bp, Homo sapiens
ccctaagtgcccaaag

SEQ ID NO: 3235698 - DNA, 15 bp, Homo sapiens
ccctaatctatggtc

SEQ ID NO: 3235699 - DNA, 23 bp, Homo sapiens
ccctaatctttcacttgaaagat

SEQ ID NO: 3235700 - DNA, 14 bp, Homo sapiens
ccctacatgtattg

SEQ ID NO: 3235701 - DNA, 12 bp, Homo sapiens
ccctacccaccg

SEQ ID NO: 3235702 - DNA, 13 bp, Homo sapiens
ccctacccaccga

SEQ ID NO: 3235703 - DNA, 18 bp, Homo sapiens
ccctaccgagtctcttct

SEQ ID NO: 3235704 - DNA, 14 bp, Homo sapiens
ccctactccactgc

SEQ ID NO: 3235705 - DNA, 21 bp, Homo sapiens
ccctactccactgccctggca

SEQ ID NO: 3235706 - DNA, 23 bp, Homo sapiens
ccctactcggatggggcacggac

SEQ ID NO: 3235707 - DNA, 22 bp, Homo sapiens
ccctacttgataatattagtga

SEQ ID NO: 3235708 - DNA, 15 bp, Homo sapiens
ccctactttgcttcc

SEQ ID NO: 3235709 - DNA, 17 bp, Homo sapiens
ccctagaaacccaagct

SEQ ID NO: 3235710 - DNA, 19 bp, Homo sapiens
ccctagagggttcctgtag

SEQ ID NO: 3235711 - DNA, 18 bp, Homo sapiens
ccctagatagtttattat

SEQ ID NO: 3235712 - DNA, 20 bp, Homo sapiens
ccctagccaatgtctcctcc

SEQ ID NO: 3235713 - DNA, 17 bp, Homo sapiens
ccctagccagcacttgt

SEQ ID NO: 3235714 - DNA, 18 bp, Homo sapiens
ccctagccattcctggta

SEQ ID NO: 3235715 - DNA, 14 bp, Homo sapiens
ccctagccttgctt

SEQ ID NO: 3235716 - DNA, 20 bp, Homo sapiens
ccctagcggcagaaaggaaa

SEQ ID NO: 3235717 - DNA, 18 bp, Homo sapiens
ccctagctttagaccctg

SEQ ID NO: 3235718 - DNA, 21 bp, Homo sapiens
ccctagctttagaccctgggt

SEQ ID NO: 3235719 - DNA, 20 bp, Homo sapiens
ccctaggagtatatttccgc

SEQ ID NO: 3235720 - DNA, 16 bp, Homo sapiens
ccctaggatgctgcag

SEQ ID NO: 3235721 - DNA, 21 bp, Homo sapiens
ccctaggatgctgcagcagag

SEQ ID NO: 3235722 - DNA, 17 bp, Homo sapiens
ccctaggttcccggtcc

SEQ ID NO: 3235723 - DNA, 15 bp, Homo sapiens
ccctaggttccctgt

SEQ ID NO: 3235724 - DNA, 22 bp, Homo sapiens
ccctagtcccttcccctccctg

SEQ ID NO: 3235725 - DNA, 16 bp, Homo sapiens
ccctagttccctctgc

SEQ ID NO: 3235726 - DNA, 18 bp, Homo sapiens
ccctagttccctctgctc

SEQ ID NO: 3235727 - DNA, 21 bp, Homo sapiens
ccctagttccctctgctcagc

SEQ ID NO: 3235728 - DNA, 18 bp, Homo sapiens
ccctatagagagggggct

SEQ ID NO: 3235729 - DNA, 23 bp, Homo sapiens
ccctatcaagcactaaaaagttg

SEQ ID NO: 3235730 - DNA, 17 bp, Homo sapiens
ccctatctaaccctccc

SEQ ID NO: 3235731 - DNA, 18 bp, Homo sapiens
ccctatggggatggtcca

SEQ ID NO: 3235732 - DNA, 20 bp, Homo sapiens
ccctatttagatgataaaga

SEQ ID NO: 3235733 - DNA, 15 bp, Homo sapiens
ccctcaaacctcctc

SEQ ID NO: 3235734 - DNA, 21 bp, Homo sapiens
ccctcaaacctcctcttctga

SEQ ID NO: 3235735 - DNA, 24 bp, Homo sapiens
ccctcaaacctcctcttctgacgt

SEQ ID NO: 3235736 - DNA, 21 bp, Homo sapiens
ccctcaacaggcccagggagg

SEQ ID NO: 3235737 - DNA, 15 bp, Homo sapiens
ccctcaagccccagc

SEQ ID NO: 3235738 - DNA, 17 bp, Homo sapiens
ccctcaagccccagcag

SEQ ID NO: 3235739 - DNA, 14 bp, Homo sapiens
ccctcacacacaca

SEQ ID NO: 3235740 - DNA, 12 bp, Homo sapiens
ccctcacagcct

SEQ ID NO: 3235741 - DNA, 15 bp, Homo sapiens
ccctcacagcctctg

SEQ ID NO: 3235742 - DNA, 16 bp, Homo sapiens
ccctcacagcctctga

SEQ ID NO: 3235743 - DNA, 13 bp, Homo sapiens
ccctcacattcct

SEQ ID NO: 3235744 - DNA, 14 bp, Homo sapiens
ccctcaccaccaca

SEQ ID NO: 3235745 - DNA, 21 bp, Homo sapiens
ccctcacctgtagcagccagt

SEQ ID NO: 3235746 - DNA, 15 bp, Homo sapiens
ccctcactctgccag

SEQ ID NO: 3235747 - DNA, 20 bp, Homo sapiens
ccctcactctgccagggcag

SEQ ID NO: 3235748 - DNA, 9 bp, Homo sapiens
ccctcagaa

SEQ ID NO: 3235749 - DNA, 14 bp, Homo sapiens
ccctcagagccctg

SEQ ID NO: 3235750 - DNA, 19 bp, Homo sapiens
ccctcagagccctgccctg

SEQ ID NO: 3235751 - DNA, 18 bp, Homo sapiens
ccctcagatgatctctcc

SEQ ID NO: 3235752 - DNA, 17 bp, Homo sapiens
ccctcagcaccccttcc

SEQ ID NO: 3235753 - DNA, 19 bp, Homo sapiens
ccctcagcaccccttccat

SEQ ID NO: 3235754 - DNA, 13 bp, Homo sapiens
ccctcagcccttg

SEQ ID NO: 3235755 - DNA, 14 bp, Homo sapiens
ccctcagcccttgc

SEQ ID NO: 3235756 - DNA, 17 bp, Homo sapiens
ccctcagcctcagagga

SEQ ID NO: 3235757 - DNA, 22 bp, Homo sapiens
ccctcagcctcagaggagctct

SEQ ID NO: 3235758 - DNA, 12 bp, Homo sapiens
ccctcagctcca

SEQ ID NO: 3235759 - DNA, 13 bp, Homo sapiens
ccctcagctcctg

SEQ ID NO: 3235760 - DNA, 15 bp, Homo sapiens
ccctcagctctctgg

SEQ ID NO: 3235761 - DNA, 15 bp, Homo sapiens
ccctcaggaattcag

SEQ ID NO: 3235762 - DNA, 20 bp, Homo sapiens
ccctcaggcataggcctggg

SEQ ID NO: 3235763 - DNA, 22 bp, Homo sapiens
ccctcaggcataggcctgggtg

SEQ ID NO: 3235764 - DNA, 17 bp, Homo sapiens
ccctcaggcctatgcaa

SEQ ID NO: 3235765 - DNA, 21 bp, Homo sapiens
ccctcatcttgaagggcccag

SEQ ID NO: 3235766 - DNA, 15 bp, Homo sapiens
ccctccaaaagcact

SEQ ID NO: 3235767 - DNA, 17 bp, Homo sapiens
ccctccaaaagcactta

SEQ ID NO: 3235768 - DNA, 12 bp, Homo sapiens
ccctccaaagag

SEQ ID NO: 3235769 - DNA, 15 bp, Homo sapiens
ccctccaccccacag

SEQ ID NO: 3235770 - DNA, 16 bp, Homo sapiens
ccctccaccccacaga

SEQ ID NO: 3235771 - DNA, 14 bp, Homo sapiens
ccctccaccctgtc

SEQ ID NO: 3235772 - DNA, 16 bp, Homo sapiens
ccctccaccctgtccc

SEQ ID NO: 3235773 - DNA, 21 bp, Homo sapiens
ccctccacgcctcctggccag

SEQ ID NO: 3235774 - DNA, 12 bp, Homo sapiens
ccctccactgtc

SEQ ID NO: 3235775 - DNA, 19 bp, Homo sapiens
ccctccagaacacggctca

SEQ ID NO: 3235776 - DNA, 13 bp, Homo sapiens
ccctccagagaca

SEQ ID NO: 3235777 - DNA, 12 bp, Homo sapiens
ccctccagcctt

SEQ ID NO: 3235778 - DNA, 11 bp, Homo sapiens
ccctccaggaa

SEQ ID NO: 3235779 - DNA, 19 bp, Homo sapiens
ccctccaggagagagccag

SEQ ID NO: 3235780 - DNA, 12 bp, Homo sapiens
ccctccatccct

SEQ ID NO: 3235781 - DNA, 13 bp, Homo sapiens
ccctccatgggct

SEQ ID NO: 3235782 - DNA, 22 bp, Homo sapiens
ccctcccagggccagggccctg

SEQ ID NO: 3235783 - DNA, 13 bp, Homo sapiens
ccctcccagtcct

SEQ ID NO: 3235784 - DNA, 14 bp, Homo sapiens
ccctcccatctggg

SEQ ID NO: 3235785 - DNA, 21 bp, Homo sapiens
ccctccccacacctccctact

SEQ ID NO: 3235786 - DNA, 15 bp, Homo sapiens
ccctccccagagcac

SEQ ID NO: 3235787 - DNA, 16 bp, Homo sapiens
ccctccccagagcact

SEQ ID NO: 3235788 - DNA, 16 bp, Homo sapiens
ccctccccatcccatg

SEQ ID NO: 3235789 - DNA, 21 bp, Homo sapiens
ccctcccccgccactcctgaa

SEQ ID NO: 3235790 - DNA, 13 bp, Homo sapiens
ccctccccctgag

SEQ ID NO: 3235791 - DNA, 14 bp, Homo sapiens
ccctccccctgcca

SEQ ID NO: 3235792 - DNA, 13 bp, Homo sapiens
ccctcccccttgt

SEQ ID NO: 3235793 - DNA, 17 bp, Homo sapiens
ccctccccgcacccccc

SEQ ID NO: 3235794 - DNA, 22 bp, Homo sapiens
ccctccccgcctggccagggca

SEQ ID NO: 3235795 - DNA, 21 bp, Homo sapiens
ccctccccggcaccctctggc

SEQ ID NO: 3235796 - DNA, 18 bp, Homo sapiens
ccctcccctcccagtcct

SEQ ID NO: 3235797 - DNA, 14 bp, Homo sapiens
ccctcccctccttg

SEQ ID NO: 3235798 - DNA, 14 bp, Homo sapiens
ccctcccctgctgc

SEQ ID NO: 3235799 - DNA, 14 bp, Homo sapiens
ccctccctctccca

SEQ ID NO: 3235800 - DNA, 14 bp, Homo sapiens
ccctccctctgccc

SEQ ID NO: 3235801 - DNA, 21 bp, Homo sapiens
ccctccgccttcactccggtg

SEQ ID NO: 3235802 - DNA, 18 bp, Homo sapiens
ccctccggactggtgccc

SEQ ID NO: 3235803 - DNA, 15 bp, Homo sapiens
ccctcctcactggcc

SEQ ID NO: 3235804 - DNA, 19 bp, Homo sapiens
ccctcctcactggccatcc

SEQ ID NO: 3235805 - DNA, 21 bp, Homo sapiens
ccctcctccagcccctgtccc

SEQ ID NO: 3235806 - DNA, 15 bp, Homo sapiens
ccctcctccaggcct

SEQ ID NO: 3235807 - DNA, 16 bp, Homo sapiens
ccctcctgacaaatat

SEQ ID NO: 3235808 - DNA, 13 bp, Homo sapiens
ccctcctgctcct

SEQ ID NO: 3235809 - DNA, 16 bp, Homo sapiens
ccctcctgctcctccc

SEQ ID NO: 3235810 - DNA, 21 bp, Homo sapiens
ccctcctgctcctccctgccc

SEQ ID NO: 3235811 - DNA, 13 bp, Homo sapiens
ccctcctggctct

SEQ ID NO: 3235812 - DNA, 19 bp, Homo sapiens
ccctcctgtgctgggggaa

SEQ ID NO: 3235813 - DNA, 12 bp, Homo sapiens
ccctccttcaga

SEQ ID NO: 3235814 - DNA, 15 bp, Homo sapiens
ccctccttccacatg

SEQ ID NO: 3235815 - DNA, 15 bp, Homo sapiens
ccctcgaagcgcgcc

SEQ ID NO: 3235816 - DNA, 19 bp, Homo sapiens
ccctcgaagcgcgccactc

SEQ ID NO: 3235817 - DNA, 19 bp, Homo sapiens
cccttggggcctggcttgc

SEQ ID NO: 3235818 - DNA, 16 bp, Homo sapiens
cccttgggttctgata

SEQ ID NO: 3235819 - DNA, 14 bp, Homo sapiens
cccttgtccctttt

SEQ ID NO: 3235820 - DNA, 14 bp, Homo sapiens
cccttgtcctgcca

SEQ ID NO: 3235821 - DNA, 21 bp, Homo sapiens
cccttgtcctgccagctgcct

SEQ ID NO: 3235822 - DNA, 14 bp, Homo sapiens
cccttgtgtcaaga

SEQ ID NO: 3235823 - DNA, 17 bp, Homo sapiens
ccctttacaatgtgaat

SEQ ID NO: 3235824 - DNA, 22 bp, Homo sapiens
ccctttccccagcatcactccc

SEQ ID NO: 3235825 - DNA, 11 bp, Homo sapiens
ccctttcccct

SEQ ID NO: 3235826 - DNA, 15 bp, Homo sapiens
ccctttccctacctt

SEQ ID NO: 3235827 - DNA, 19 bp, Homo sapiens
ccctttccggcacactgcc

SEQ ID NO: 3235828 - DNA, 21 bp, Homo sapiens
ccctttccggcacactgccaa

SEQ ID NO: 3235829 - DNA, 11 bp, Homo sapiens
ccctttcctaa

SEQ ID NO: 3235830 - DNA, 17 bp, Homo sapiens
ccctttcctcctcaggc

SEQ ID NO: 3235831 - DNA, 13 bp, Homo sapiens
ccctttccttcca

SEQ ID NO: 3235832 - DNA, 15 bp, Homo sapiens
ccctttccttccatc

SEQ ID NO: 3235833 - DNA, 18 bp, Homo sapiens
ccctttccttccatccct

SEQ ID NO: 3235834 - DNA, 23 bp, Homo sapiens
ccctttctctctcctctctgctt

SEQ ID NO: 3235835 - DNA, 12 bp, Homo sapiens
ccctttctgtgt

SEQ ID NO: 3235836 - DNA, 16 bp, Homo sapiens
ccctttcttggccagt

SEQ ID NO: 3235837 - DNA, 16 bp, Homo sapiens
ccctttgaagataata

SEQ ID NO: 3235838 - DNA, 15 bp, Homo sapiens
ccctttgaagcctca

SEQ ID NO: 3235839 - DNA, 18 bp, Homo sapiens
ccctttgaagcctcagct

SEQ ID NO: 3235840 - DNA, 15 bp, Homo sapiens
ccctttgacttcagc

SEQ ID NO: 3235841 - DNA, 19 bp, Homo sapiens
ccctttgtttcttgtttat

SEQ ID NO: 3235842 - DNA, 12 bp, Homo sapiens
cccttttacttt

SEQ ID NO: 3235843 - DNA, 18 bp, Homo sapiens
cccttttcagctgagccc

SEQ ID NO: 3235844 - DNA, 11 bp, Homo sapiens
cccttttcctg

SEQ ID NO: 3235845 - DNA, 14 bp, Homo sapiens
ccctttttcaatga

SEQ ID NO: 3235846 - DNA, 18 bp, Homo sapiens
ccctttttttacatttca

SEQ ID NO: 3235847 - DNA, 24 bp, Homo sapiens
ccgaaacaggctactctcctcggc

SEQ ID NO: 3235848 - DNA, 23 bp, Homo sapiens
ccgaaagggttaatcatatttga

SEQ ID NO: 3235849 - DNA, 22 bp, Homo sapiens
ccgaacccgagtccgcgctggg

SEQ ID NO: 3235850 - DNA, 19 bp, Homo sapiens
ccgaagctctggctgaacc

SEQ ID NO: 3235851 - DNA, 21 bp, Homo sapiens
ccgaagctctggctgaaccct

SEQ ID NO: 3235852 - DNA, 21 bp, Homo sapiens
ccgaagctgcaggggcaggag

SEQ ID NO: 3235853 - DNA, 15 bp, Homo sapiens
ccgaaggtgcctcag

SEQ ID NO: 3235854 - DNA, 17 bp, Homo sapiens
ccgaaggtgcctcagac

SEQ ID NO: 3235855 - DNA, 16 bp, Homo sapiens
ccgaatagctgggact

SEQ ID NO: 3235856 - DNA, 13 bp, Homo sapiens
ccgaatcccccag

SEQ ID NO: 3235857 - DNA, 13 bp, Homo sapiens
ccgaatgtgcagg

SEQ ID NO: 3235858 - DNA, 12 bp, Homo sapiens
ccgacagcctgg

SEQ ID NO: 3235859 - DNA, 15 bp, Homo sapiens
ccgacagcctggcac

SEQ ID NO: 3235860 - DNA, 22 bp, Homo sapiens
ccgacagcctggcacagggcag

SEQ ID NO: 3235861 - DNA, 15 bp, Homo sapiens
ccgacaggccctggc

SEQ ID NO: 3235862 - DNA, 13 bp, Homo sapiens
ccgacatcagcat

SEQ ID NO: 3235863 - DNA, 13 bp, Homo sapiens
ccgaccagacacc

SEQ ID NO: 3235864 - DNA, 16 bp, Homo sapiens
ccgaccctctgggaac

SEQ ID NO: 3235865 - DNA, 19 bp, Homo sapiens
ccgaccctctgggaacctc

SEQ ID NO: 3235866 - DNA, 23 bp, Homo sapiens
ccgaccttccctccgccttctcc

SEQ ID NO: 3235867 - DNA, 23 bp, Homo sapiens
ccgacggtgggcatttgtgaggc

SEQ ID NO: 3235868 - DNA, 15 bp, Homo sapiens
ccgactaccccagtc

SEQ ID NO: 3235869 - DNA, 14 bp, Homo sapiens
ccgactctggccct

SEQ ID NO: 3235870 - DNA, 16 bp, Homo sapiens
ccgactgctttggacc

SEQ ID NO: 3235871 - DNA, 17 bp, Homo sapiens
ccgacttggagactcct

SEQ ID NO: 3235872 - DNA, 22 bp, Homo sapiens
ccgactttgtaccccccaaccc

SEQ ID NO: 3235873 - DNA, 22 bp, Homo sapiens
ccgagatgtgacccaccagtgc

SEQ ID NO: 3235874 - DNA, 22 bp, Homo sapiens
ccgagccaggttcacactcaga

SEQ ID NO: 3235875 - DNA, 14 bp, Homo sapiens
ccgagctcttggcc

SEQ ID NO: 3235876 - DNA, 15 bp, Homo sapiens
ccgagctcttggcct

SEQ ID NO: 3235877 - DNA, 16 bp, Homo sapiens
ccgagctcttggcctt

SEQ ID NO: 3235878 - DNA, 16 bp, Homo sapiens
ccgagctgaggactct

SEQ ID NO: 3235879 - DNA, 20 bp, Homo sapiens
ccgagctggtgcattacaga

SEQ ID NO: 3235880 - DNA, 15 bp, Homo sapiens
ccgaggaggtgcctg

SEQ ID NO: 3235881 - DNA, 16 bp, Homo sapiens
ccgaggcccagcgggc

SEQ ID NO: 3235882 - DNA, 14 bp, Homo sapiens
ccgaggccttctct

SEQ ID NO: 3235883 - DNA, 17 bp, Homo sapiens
ccgaggggggccccggg

SEQ ID NO: 3235884 - DNA, 17 bp, Homo sapiens
ccgagggtcctggctcc

SEQ ID NO: 3235885 - DNA, 16 bp, Homo sapiens
ccgagtagctgggact

SEQ ID NO: 3235886 - DNA, 20 bp, Homo sapiens
ccgagtagctgggactacag

SEQ ID NO: 3235887 - DNA, 14 bp, Homo sapiens
ccgagtctcttctc

SEQ ID NO: 3235888 - DNA, 16 bp, Homo sapiens
ccgagtctcttctcca

SEQ ID NO: 3235889 - DNA, 22 bp, Homo sapiens
ccgagtctcttctccactggat

SEQ ID NO: 3235890 - DNA, 13 bp, Homo sapiens
ccgagtctgggac

SEQ ID NO: 3235891 - DNA, 11 bp, Homo sapiens
ccgagtcttgc

SEQ ID NO: 3235892 - DNA, 16 bp, Homo sapiens
ccgagtgaacctacct

SEQ ID NO: 3235893 - DNA, 13 bp, Homo sapiens
ccgatgctgcttt

SEQ ID NO: 3235894 - DNA, 17 bp, Homo sapiens
ccgatgctgctttcccc

SEQ ID NO: 3235895 - DNA, 21 bp, Homo sapiens
ccgatgctgctttcccctgtg

SEQ ID NO: 3235896 - DNA, 23 bp, Homo sapiens
ccgatgctgctttcccctgtggg

SEQ ID NO: 3235897 - DNA, 12 bp, Homo sapiens
ccgatggagccc

SEQ ID NO: 3235898 - DNA, 19 bp, Homo sapiens
ccgatgtcgacatgttttt

SEQ ID NO: 3235899 - DNA, 12 bp, Homo sapiens
ccgcaaggagca

SEQ ID NO: 3235900 - DNA, 19 bp, Homo sapiens
ccgcacaccctcactctgc

SEQ ID NO: 3235901 - DNA, 21 bp, Homo sapiens
ccgcacaccctcactctgcca

SEQ ID NO: 3235902 - DNA, 22 bp, Homo sapiens
ccgcacaccctcactctgccag

SEQ ID NO: 3235903 - DNA, 13 bp, Homo sapiens
ccgcacagcagcc

SEQ ID NO: 3235904 - DNA, 14 bp, Homo sapiens
ccgcacagcagcct

SEQ ID NO: 3235905 - DNA, 22 bp, Homo sapiens
ccgcacagcagcctgcttccca

SEQ ID NO: 3235906 - DNA, 12 bp, Homo sapiens
ccgcacagctca

SEQ ID NO: 3235907 - DNA, 14 bp, Homo sapiens
ccgcacagctcagg

SEQ ID NO: 3235908 - DNA, 18 bp, Homo sapiens
ccgcacagctcaggaggc

SEQ ID NO: 3235909 - DNA, 14 bp, Homo sapiens
ccgcaccagctgct

SEQ ID NO: 3235910 - DNA, 17 bp, Homo sapiens
ccgcaccagctgctctg

SEQ ID NO: 3235911 - DNA, 17 bp, Homo sapiens
ccgcaccccggcctcag

SEQ ID NO: 3235912 - DNA, 18 bp, Homo sapiens
ccgcaccctgcacctgct

SEQ ID NO: 3235913 - DNA, 14 bp, Homo sapiens
ccgcactaggggat

SEQ ID NO: 3235914 - DNA, 14 bp, Homo sapiens
ccgcactctgcccc

SEQ ID NO: 3235915 - DNA, 22 bp, Homo sapiens
ccgcactttccacttcttcctt

SEQ ID NO: 3235916 - DNA, 14 bp, Homo sapiens
ccgcagaagccctg

SEQ ID NO: 3235917 - DNA, 13 bp, Homo sapiens
ccgcagacctccc

SEQ ID NO: 3235918 - DNA, 18 bp, Homo sapiens
ccgcagacgggcacagac

SEQ ID NO: 3235919 - DNA, 22 bp, Homo sapiens
ccgcagccagccggtgcctggc

SEQ ID NO: 3235920 - DNA, 20 bp, Homo sapiens
ccgcagcccgtgaagcagtg

SEQ ID NO: 3235921 - DNA, 23 bp, Homo sapiens
ccgcagcccgtgaagcagtgcct

SEQ ID NO: 3235922 - DNA, 17 bp, Homo sapiens
ccgcagctcttgccctt

SEQ ID NO: 3235923 - DNA, 20 bp, Homo sapiens
ccgcagctcttgcccttccc

SEQ ID NO: 3235924 - DNA, 18 bp, Homo sapiens
ccgcaggaactgggctgg

SEQ ID NO: 3235925 - DNA, 21 bp, Homo sapiens
ccgcaggtgggtgctgccctg

SEQ ID NO: 3235926 - DNA, 18 bp, Homo sapiens
ccgcagtccccagccctt

SEQ ID NO: 3235927 - DNA, 19 bp, Homo sapiens
ccgcagtcgtcgcacagtc

SEQ ID NO: 3235928 - DNA, 22 bp, Homo sapiens
ccgcagtcgtcgcacagtctct

SEQ ID NO: 3235929 - DNA, 15 bp, Homo sapiens
ccgcagtgctgggac

SEQ ID NO: 3235930 - DNA, 19 bp, Homo sapiens
ccgcagtgctgggaccaga

SEQ ID NO: 3235931 - DNA, 21 bp, Homo sapiens
ccgcagtgctgggaccagagc

SEQ ID NO: 3235932 - DNA, 21 bp, Homo sapiens
ccgccaagatctacaggacaa

SEQ ID NO: 3235933 - DNA, 20 bp, Homo sapiens
ccgccaatgcacggcctcgc

SEQ ID NO: 3235934 - DNA, 23 bp, Homo sapiens
ccgccacctatctcgtgggagag

SEQ ID NO: 3235935 - DNA, 14 bp, Homo sapiens
ccgccacctcaggg

SEQ ID NO: 3235936 - DNA, 15 bp, Homo sapiens
ccgccacctcagggc

SEQ ID NO: 3235937 - DNA, 21 bp, Homo sapiens
ccgccacgtcccagcatccct

SEQ ID NO: 3235938 - DNA, 16 bp, Homo sapiens
ccgccactcctgaacc

SEQ ID NO: 3235939 - DNA, 13 bp, Homo sapiens
ccgccagggctgg

SEQ ID NO: 3235940 - DNA, 15 bp, Homo sapiens
ccgccagggctgggg

SEQ ID NO: 3235941 - DNA, 16 bp, Homo sapiens
ccgccagggctgggga

SEQ ID NO: 3235942 - DNA, 17 bp, Homo sapiens
ccgccagggctggggac

SEQ ID NO: 3235943 - DNA, 22 bp, Homo sapiens
cctcactgcccgcacaccctca

SEQ ID NO: 3235944 - DNA, 16 bp, Homo sapiens
cctcactgctccctga

SEQ ID NO: 3235945 - DNA, 19 bp, Homo sapiens
cctcactgctccctgaagc

SEQ ID NO: 3235946 - DNA, 15 bp, Homo sapiens
cctcactggaggagc

SEQ ID NO: 3235947 - DNA, 15 bp, Homo sapiens
cctcactggccatcc

SEQ ID NO: 3235948 - DNA, 22 bp, Homo sapiens
cctcactggccatccctcgtgg

SEQ ID NO: 3235949 - DNA, 17 bp, Homo sapiens
cctcactggctggggca

SEQ ID NO: 3235950 - DNA, 14 bp, Homo sapiens
cctcactgggggct

SEQ ID NO: 3235951 - DNA, 19 bp, Homo sapiens
cctcacttccatacagctc

SEQ ID NO: 3235952 - DNA, 14 bp, Homo sapiens
cctcacttgaatgt

SEQ ID NO: 3235953 - DNA, 21 bp, Homo sapiens
cctcagaaagtcaccaggact

SEQ ID NO: 3235954 - DNA, 22 bp, Homo sapiens
cctcagaaagtcaccaggactt

SEQ ID NO: 3235955 - DNA, 19 bp, Homo sapiens
cctcagaccccaggtcagc

SEQ ID NO: 3235956 - DNA, 23 bp, Homo sapiens
cctcagacgagacccaagggcag

SEQ ID NO: 3235957 - DNA, 22 bp, Homo sapiens
cctcagacttaccaggaagcag

SEQ ID NO: 3235958 - DNA, 16 bp, Homo sapiens
cctcagagaagtccag

SEQ ID NO: 3235959 - DNA, 16 bp, Homo sapiens
cctcagagccacccct

SEQ ID NO: 3235960 - DNA, 17 bp, Homo sapiens
cctcagaggagctctac

SEQ ID NO: 3235961 - DNA, 22 bp, Homo sapiens
cctcagaggagctctaccctgc

SEQ ID NO: 3235962 - DNA, 11 bp, Homo sapiens
cctcagaggca

SEQ ID NO: 3235963 - DNA, 16 bp, Homo sapiens
cctcagaggcagcttc

SEQ ID NO: 3235964 - DNA, 23 bp, Homo sapiens
cctcagaggcagcttcaagtgcc

SEQ ID NO: 3235965 - DNA, 19 bp, Homo sapiens
cctcagaggcgtgctggtc

SEQ ID NO: 3235966 - DNA, 15 bp, Homo sapiens
cctcagagtatcttt

SEQ ID NO: 3235967 - DNA, 14 bp, Homo sapiens
cctcagatgatctc

SEQ ID NO: 3235968 - DNA, 19 bp, Homo sapiens
cctcagatgatctctccac

SEQ ID NO: 3235969 - DNA, 13 bp, Homo sapiens
cctcagcccccag

SEQ ID NO: 3235970 - DNA, 14 bp, Homo sapiens
cctcagcccccagg

SEQ ID NO: 3235971 - DNA, 19 bp, Homo sapiens
cctcagcccccaggccagg

SEQ ID NO: 3235972 - DNA, 20 bp, Homo sapiens
cctcagcccccaggccaggt

SEQ ID NO: 3235973 - DNA, 13 bp, Homo sapiens
cctcagccctcag

SEQ ID NO: 3235974 - DNA, 16 bp, Homo sapiens
cctcagccctcagaac

SEQ ID NO: 3235975 - DNA, 17 bp, Homo sapiens
cctcagcccttgccccc

SEQ ID NO: 3235976 - DNA, 19 bp, Homo sapiens
cctcagcctagaccctcct

SEQ ID NO: 3235977 - DNA, 19 bp, Homo sapiens
cctcagcctcccaaagtgc

SEQ ID NO: 3235978 - DNA, 13 bp, Homo sapiens
cctcagctaccca

SEQ ID NO: 3235979 - DNA, 15 bp, Homo sapiens
cctcagctctctggg

SEQ ID NO: 3235980 - DNA, 16 bp, Homo sapiens
cctcagctctctggga

SEQ ID NO: 3235981 - DNA, 13 bp, Homo sapiens
cctcagctctggg

SEQ ID NO: 3235982 - DNA, 15 bp, Homo sapiens
cctcagctctgggag

SEQ ID NO: 3235983 - DNA, 17 bp, Homo sapiens
cctcagctctgggagag

SEQ ID NO: 3235984 - DNA, 19 bp, Homo sapiens
cctcagctgcctcacttcc

SEQ ID NO: 3235985 - DNA, 13 bp, Homo sapiens
cctcagctggctg

SEQ ID NO: 3235986 - DNA, 21 bp, Homo sapiens
cctcagcttcttcacaggcac

SEQ ID NO: 3235987 - DNA, 15 bp, Homo sapiens
cctcaggcagctcaa

SEQ ID NO: 3235988 - DNA, 19 bp, Homo sapiens
cctcaggcaggaagggcag

SEQ ID NO: 3235989 - DNA, 14 bp, Homo sapiens
cctcaggctctgca

SEQ ID NO: 3235990 - DNA, 15 bp, Homo sapiens
cctcaggctctgcac

SEQ ID NO: 3235991 - DNA, 19 bp, Homo sapiens
cctcaggctctgcacagac

SEQ ID NO: 3235992 - DNA, 16 bp, Homo sapiens
cctcaggcttccttgg

SEQ ID NO: 3235993 - DNA, 23 bp, Homo sapiens
cctcagggagcagggaaggcctg

SEQ ID NO: 3235994 - DNA, 15 bp, Homo sapiens
cctcagggccaggaa

SEQ ID NO: 3235995 - DNA, 14 bp, Homo sapiens
cctcagggctccca

SEQ ID NO: 3235996 - DNA, 15 bp, Homo sapiens
cctcagggctcccag

SEQ ID NO: 3235997 - DNA, 16 bp, Homo sapiens
cctcagggctcccagg

SEQ ID NO: 3235998 - DNA, 23 bp, Homo sapiens
cctcaggtggccagcctggatct

SEQ ID NO: 3235999 - DNA, 15 bp, Homo sapiens
cctcaggttcctatg

SEQ ID NO: 3236000 - DNA, 20 bp, Homo sapiens
cctcaggttctattttctta

SEQ ID NO: 3236001 - DNA, 17 bp, Homo sapiens
cctcaggttgctggttg

SEQ ID NO: 3236002 - DNA, 22 bp, Homo sapiens
cctcaggttgctggttgctgtg

SEQ ID NO: 3236003 - DNA, 20 bp, Homo sapiens
cctcagtaacatttctgttc

SEQ ID NO: 3236004 - DNA, 15 bp, Homo sapiens
cctcagtcagttccc

SEQ ID NO: 3236005 - DNA, 21 bp, Homo sapiens
cctcagtcagttcccggagca

SEQ ID NO: 3236006 - DNA, 11 bp, Homo sapiens
cctcagtcctc

SEQ ID NO: 3236007 - DNA, 12 bp, Homo sapiens
cctcagtcctcc

SEQ ID NO: 3236008 - DNA, 20 bp, Homo sapiens
cctcagtcctcccctcacag

SEQ ID NO: 3236009 - DNA, 21 bp, Homo sapiens
cctcagtcctcccctcacagc

SEQ ID NO: 3236010 - DNA, 22 bp, Homo sapiens
cctcagtcctcccctcacagcc

SEQ ID NO: 3236011 - DNA, 23 bp, Homo sapiens
cctcagtcctcccctcacagcct

SEQ ID NO: 3236012 - DNA, 11 bp, Homo sapiens
cctcagtgcca

SEQ ID NO: 3236013 - DNA, 18 bp, Homo sapiens
cctcagtggatcttcaga

SEQ ID NO: 3236014 - DNA, 21 bp, Homo sapiens
cctcagtggatcttcagaact

SEQ ID NO: 3236015 - DNA, 11 bp, Homo sapiens
cctcagtgtca

SEQ ID NO: 3236016 - DNA, 23 bp, Homo sapiens
cctcagtgtcatttatgaaaaga

SEQ ID NO: 3236017 - DNA, 15 bp, Homo sapiens
cctcagttcaacctg

SEQ ID NO: 3236018 - DNA, 22 bp, Homo sapiens
cctcagttcaacctggtggcac

SEQ ID NO: 3236019 - DNA, 22 bp, Homo sapiens
cctcagttcccagctccccccg

SEQ ID NO: 3236020 - DNA, 21 bp, Homo sapiens
cctcagttcccttggcctcag

SEQ ID NO: 3236021 - DNA, 22 bp, Homo sapiens
cctcagttcccttggcctcaga

SEQ ID NO: 3236022 - DNA, 15 bp, Homo sapiens
cctcatcaggatgaa

SEQ ID NO: 3236023 - DNA, 18 bp, Homo sapiens
cctcatccaccaatctct

SEQ ID NO: 3236024 - DNA, 22 bp, Homo sapiens
cctcatccaccccatccctccc

SEQ ID NO: 3236025 - DNA, 12 bp, Homo sapiens
cctcatcctttc

SEQ ID NO: 3236026 - DNA, 16 bp, Homo sapiens
cctcatctatgaggaa

SEQ ID NO: 3236027 - DNA, 18 bp, Homo sapiens
cctcatctgtggagctgc

SEQ ID NO: 3236028 - DNA, 22 bp, Homo sapiens
cctcatcttgaagggcccagga

SEQ ID NO: 3236029 - DNA, 21 bp, Homo sapiens
cctcatgaaaacacacataca

SEQ ID NO: 3236030 - DNA, 15 bp, Homo sapiens
cctcatgccacacct

SEQ ID NO: 3236031 - DNA, 13 bp, Homo sapiens
cctcatgcccacc

SEQ ID NO: 3236032 - DNA, 14 bp, Homo sapiens
cctcatgcccaccc

SEQ ID NO: 3236033 - DNA, 23 bp, Homo sapiens
cctcatgcccaccccctgccctg

SEQ ID NO: 3236034 - DNA, 16 bp, Homo sapiens
cctcatgcctgctgag

SEQ ID NO: 3236035 - DNA, 15 bp, Homo sapiens
cctcatggcccccag

SEQ ID NO: 3236036 - DNA, 18 bp, Homo sapiens
cctcatggcccccagggg

SEQ ID NO: 3236037 - DNA, 23 bp, Homo sapiens
cctcatggcccccaggggcagga

SEQ ID NO: 3236038 - DNA, 20 bp, Homo sapiens
cctcatgtaacattggtgaa

SEQ ID NO: 3236039 - DNA, 13 bp, Homo sapiens
cctcatgtggctg

SEQ ID NO: 3236040 - DNA, 15 bp, Homo sapiens
cctcatgtggctgga

SEQ ID NO: 3236041 - DNA, 17 bp, Homo sapiens
cctcatgtggctggaag

SEQ ID NO: 3236042 - DNA, 16 bp, Homo sapiens
cctcattactgggcct

SEQ ID NO: 3236043 - DNA, 21 bp, Homo sapiens
cctcattccaccttcccatgc

SEQ ID NO: 3236044 - DNA, 14 bp, Homo sapiens
cctcattgcctcct

SEQ ID NO: 3236045 - DNA, 15 bp, Homo sapiens
cctcattgcctcctg

SEQ ID NO: 3236046 - DNA, 13 bp, Homo sapiens
cctcatttaaaag

SEQ ID NO: 3236047 - DNA, 19 bp, Homo sapiens
cctccaacgcccctgtggc

SEQ ID NO: 3236048 - DNA, 20 bp, Homo sapiens
cctccaacgcccctgtggcc

SEQ ID NO: 3236049 - DNA, 17 bp, Homo sapiens
cctccaagccattcact

SEQ ID NO: 3236050 - DNA, 21 bp, Homo sapiens
cctccaagctccatctccact

SEQ ID NO: 3236051 - DNA, 22 bp, Homo sapiens
cctccaagggtttcgactggtc

SEQ ID NO: 3236052 - DNA, 16 bp, Homo sapiens
cctccaataaagtgcc

SEQ ID NO: 3236053 - DNA, 22 bp, Homo sapiens
cctccaatcccaccaaccctca

SEQ ID NO: 3236054 - DNA, 23 bp, Homo sapiens
cctccacaccagtggcctcgtgg

SEQ ID NO: 3236055 - DNA, 16 bp, Homo sapiens
cctccacagccgcagc

SEQ ID NO: 3236056 - DNA, 14 bp, Homo sapiens
cctccacagcgagg

SEQ ID NO: 3236057 - DNA, 22 bp, Homo sapiens
cctccacagcgagggcagctgc

SEQ ID NO: 3236058 - DNA, 17 bp, Homo sapiens
cctccacagtgctgctt

SEQ ID NO: 3236059 - DNA, 17 bp, Homo sapiens
cctccacagttcagtgg

SEQ ID NO: 3236060 - DNA, 19 bp, Homo sapiens
cctccacatcccagcagcc

SEQ ID NO: 3236061 - DNA, 17 bp, Homo sapiens
cctccacatcctgtgtc

SEQ ID NO: 3236062 - DNA, 20 bp, Homo sapiens
cctccaccaccactggccac

SEQ ID NO: 3236063 - DNA, 23 bp, Homo sapiens
cctccaccaccactggccaccag

SEQ ID NO: 3236064 - DNA, 14 bp, Homo sapiens
cctccacccagccc

SEQ ID NO: 3236065 - DNA, 15 bp, Homo sapiens
cctccaccctgtccc

SEQ ID NO: 3236066 - DNA, 23 bp, Homo sapiens
cctccacctcttcaccccccact

SEQ ID NO: 3236067 - DNA, 15 bp, Homo sapiens
cctccacctgtgaga

SEQ ID NO: 3236068 - DNA, 18 bp, Homo sapiens
cctgagcaactcttgatt

SEQ ID NO: 3236069 - DNA, 13 bp, Homo sapiens
cctgagccaagga

SEQ ID NO: 3236070 - DNA, 14 bp, Homo sapiens
cctgagccccgccc

SEQ ID NO: 3236071 - DNA, 18 bp, Homo sapiens
cctgagccccgccctctt

SEQ ID NO: 3236072 - DNA, 23 bp, Homo sapiens
cctgagccccgccctcttcctga

SEQ ID NO: 3236073 - DNA, 11 bp, Homo sapiens
cctgagcctta

SEQ ID NO: 3236074 - DNA, 19 bp, Homo sapiens
cctgagccttagctcccag

SEQ ID NO: 3236075 - DNA, 23 bp, Homo sapiens
cctgagccttagctcccagctag

SEQ ID NO: 3236076 - DNA, 12 bp, Homo sapiens
cctgagctgggg

SEQ ID NO: 3236077 - DNA, 21 bp, Homo sapiens
cctgaggaaggaggggaagct

SEQ ID NO: 3236078 - DNA, 19 bp, Homo sapiens
cctgaggactgatttcaga

SEQ ID NO: 3236079 - DNA, 14 bp, Homo sapiens
cctgaggagacatc

SEQ ID NO: 3236080 - DNA, 21 bp, Homo sapiens
cctgaggccaggacgtctggg

SEQ ID NO: 3236081 - DNA, 15 bp, Homo sapiens
cctgaggcctgtgcc

SEQ ID NO: 3236082 - DNA, 17 bp, Homo sapiens
cctgaggctccacttgg

SEQ ID NO: 3236083 - DNA, 18 bp, Homo sapiens
cctgaggctccacttggt

SEQ ID NO: 3236084 - DNA, 20 bp, Homo sapiens
cctgaggctccacttggtct

SEQ ID NO: 3236085 - DNA, 21 bp, Homo sapiens
cctgaggctgagactgcggga

SEQ ID NO: 3236086 - DNA, 16 bp, Homo sapiens
cctgaggctgtggtca

SEQ ID NO: 3236087 - DNA, 22 bp, Homo sapiens
cctgaggctttggatttgacat

SEQ ID NO: 3236088 - DNA, 22 bp, Homo sapiens
cctgaggggcatctgcccctcc

SEQ ID NO: 3236089 - DNA, 23 bp, Homo sapiens
cctgaggggcatctgcccctccc

SEQ ID NO: 3236090 - DNA, 16 bp, Homo sapiens
cctgaggtgggcccag

SEQ ID NO: 3236091 - DNA, 17 bp, Homo sapiens
cctgaggtgggcccagg

SEQ ID NO: 3236092 - DNA, 18 bp, Homo sapiens
cctgaggtgggcccagga

SEQ ID NO: 3236093 - DNA, 19 bp, Homo sapiens
cctgaggtgggctggggct

SEQ ID NO: 3236094 - DNA, 17 bp, Homo sapiens
cctgaggtgtgggggct

SEQ ID NO: 3236095 - DNA, 19 bp, Homo sapiens
cctgaggtgtgggggctgc

SEQ ID NO: 3236096 - DNA, 18 bp, Homo sapiens
cctgagtcagggcccaga

SEQ ID NO: 3236097 - DNA, 23 bp, Homo sapiens
cctgagtcagggcccagaggctg

SEQ ID NO: 3236098 - DNA, 19 bp, Homo sapiens
cctgagtcctggtccctct

SEQ ID NO: 3236099 - DNA, 21 bp, Homo sapiens
cctgagtcctggtccctctga

SEQ ID NO: 3236100 - DNA, 15 bp, Homo sapiens
cctgagtcggcccca

SEQ ID NO: 3236101 - DNA, 18 bp, Homo sapiens
cctgagtcggccccacat

SEQ ID NO: 3236102 - DNA, 22 bp, Homo sapiens
cctgagtcggccccacatggga

SEQ ID NO: 3236103 - DNA, 21 bp, Homo sapiens
cctgagtcgtacagaaagctg

SEQ ID NO: 3236104 - DNA, 14 bp, Homo sapiens
cctgagtggtgcca

SEQ ID NO: 3236105 - DNA, 16 bp, Homo sapiens
cctgagttggagctca

SEQ ID NO: 3236106 - DNA, 17 bp, Homo sapiens
cctgataataattgatc

SEQ ID NO: 3236107 - DNA, 20 bp, Homo sapiens
cctgatcaagtcaccggagc

SEQ ID NO: 3236108 - DNA, 17 bp, Homo sapiens
cctgatcactcccagca

SEQ ID NO: 3236109 - DNA, 15 bp, Homo sapiens
cctgatctcttcctg

SEQ ID NO: 3236110 - DNA, 14 bp, Homo sapiens
cctgatctgtgata

SEQ ID NO: 3236111 - DNA, 17 bp, Homo sapiens
cctgatcttacagaaaa

SEQ ID NO: 3236112 - DNA, 21 bp, Homo sapiens
cctgatgacacccaccctgtg

SEQ ID NO: 3236113 - DNA, 13 bp, Homo sapiens
cctgatgctccct

SEQ ID NO: 3236114 - DNA, 14 bp, Homo sapiens
cctgatgctccctc

SEQ ID NO: 3236115 - DNA, 13 bp, Homo sapiens
cctgatgctgccc

SEQ ID NO: 3236116 - DNA, 23 bp, Homo sapiens
cctgatgctgccccgttccctgt

SEQ ID NO: 3236117 - DNA, 13 bp, Homo sapiens
cctgatggccaag

SEQ ID NO: 3236118 - DNA, 19 bp, Homo sapiens
cctgatggccaagagcatc

SEQ ID NO: 3236119 - DNA, 21 bp, Homo sapiens
cctgatggtacaggaaagctc

SEQ ID NO: 3236120 - DNA, 20 bp, Homo sapiens
cctgatggtcagctcccttc

SEQ ID NO: 3236121 - DNA, 21 bp, Homo sapiens
cctgatgtgtcctcagggagc

SEQ ID NO: 3236122 - DNA, 17 bp, Homo sapiens
cctgattgacctgctcc

SEQ ID NO: 3236123 - DNA, 22 bp, Homo sapiens
cctgattgtattttttttttaa

SEQ ID NO: 3236124 - DNA, 15 bp, Homo sapiens
cctgattgtttacag

SEQ ID NO: 3236125 - DNA, 15 bp, Homo sapiens
cctgattttgtagtt

SEQ ID NO: 3236126 - DNA, 17 bp, Homo sapiens
cctgcaaaccttcctgg

SEQ ID NO: 3236127 - DNA, 16 bp, Homo sapiens
cctgcaaactcactgc

SEQ ID NO: 3236128 - DNA, 22 bp, Homo sapiens
cctgcaaactcactgctcaaga

SEQ ID NO: 3236129 - DNA, 17 bp, Homo sapiens
cctgcaactcaaggact

SEQ ID NO: 3236130 - DNA, 20 bp, Homo sapiens
cctgcaacttccgctgaggg

SEQ ID NO: 3236131 - DNA, 13 bp, Homo sapiens
cctgcaagcccca

SEQ ID NO: 3236132 - DNA, 19 bp, Homo sapiens
cctgcaagccccagggcct

SEQ ID NO: 3236133 - DNA, 23 bp, Homo sapiens
cctgcaagccccagggcctgggg

SEQ ID NO: 3236134 - DNA, 16 bp, Homo sapiens
cctgcaaggcccacag

SEQ ID NO: 3236135 - DNA, 17 bp, Homo sapiens
cctgcaagtcagtccag

SEQ ID NO: 3236136 - DNA, 16 bp, Homo sapiens
cctgcaatatttgaat

SEQ ID NO: 3236137 - DNA, 14 bp, Homo sapiens
cctgcaatcccagc

SEQ ID NO: 3236138 - DNA, 15 bp, Homo sapiens
cctgcaatcccagca

SEQ ID NO: 3236139 - DNA, 19 bp, Homo sapiens
cctgcaatgtatcccttct

SEQ ID NO: 3236140 - DNA, 19 bp, Homo sapiens
cctgcaatttcatatgctg

SEQ ID NO: 3236141 - DNA, 20 bp, Homo sapiens
cctgcacaaagcccttccat

SEQ ID NO: 3236142 - DNA, 22 bp, Homo sapiens
cctgcacaaagcccttccatgt

SEQ ID NO: 3236143 - DNA, 19 bp, Homo sapiens
cctgcacaataaaaatgtt

SEQ ID NO: 3236144 - DNA, 11 bp, Homo sapiens
cctgcacacaa

SEQ ID NO: 3236145 - DNA, 20 bp, Homo sapiens
cctgcacaggcacacagggc

SEQ ID NO: 3236146 - DNA, 14 bp, Homo sapiens
cctgcaccaggaga

SEQ ID NO: 3236147 - DNA, 15 bp, Homo sapiens
cctgcaccctggaaa

SEQ ID NO: 3236148 - DNA, 12 bp, Homo sapiens
cctgcacctgct

SEQ ID NO: 3236149 - DNA, 16 bp, Homo sapiens
cctgcacctgctgcgt

SEQ ID NO: 3236150 - DNA, 21 bp, Homo sapiens
cctgcacgtatacacccagat

SEQ ID NO: 3236151 - DNA, 23 bp, Homo sapiens
cctgcacgtcatgggagggggct

SEQ ID NO: 3236152 - DNA, 14 bp, Homo sapiens
cctgcactaaagcc

SEQ ID NO: 3236153 - DNA, 20 bp, Homo sapiens
cctgcactaaagccagcctg

SEQ ID NO: 3236154 - DNA, 14 bp, Homo sapiens
cctgcactggggag

SEQ ID NO: 3236155 - DNA, 18 bp, Homo sapiens
cctgcacttgcagactct

SEQ ID NO: 3236156 - DNA, 17 bp, Homo sapiens
cctgcagaaggaaagaa

SEQ ID NO: 3236157 - DNA, 17 bp, Homo sapiens
cctgcagacacctggac

SEQ ID NO: 3236158 - DNA, 23 bp, Homo sapiens
cctgcagacacctggactgagcc

SEQ ID NO: 3236159 - DNA, 19 bp, Homo sapiens
cctgcagaggaccacagtg

SEQ ID NO: 3236160 - DNA, 20 bp, Homo sapiens
cctgcagatgccaccctagc

SEQ ID NO: 3236161 - DNA, 18 bp, Homo sapiens
cctgcagcaaacactcca

SEQ ID NO: 3236162 - DNA, 19 bp, Homo sapiens
cctgcagcaaacactccac

SEQ ID NO: 3236163 - DNA, 15 bp, Homo sapiens
cctgcagcacggaca

SEQ ID NO: 3236164 - DNA, 21 bp, Homo sapiens
cctgcagcacggacaataaac

SEQ ID NO: 3236165 - DNA, 23 bp, Homo sapiens
cctgcagcacggacaataaacct

SEQ ID NO: 3236166 - DNA, 18 bp, Homo sapiens
cctgcagcatggtccctg

SEQ ID NO: 3236167 - DNA, 13 bp, Homo sapiens
cctgcagccagct

SEQ ID NO: 3236168 - DNA, 19 bp, Homo sapiens
cctgcagccccagaagaaa

SEQ ID NO: 3236169 - DNA, 19 bp, Homo sapiens
cctgcagcctcctcctgac

SEQ ID NO: 3236170 - DNA, 22 bp, Homo sapiens
cctgcaggaacgagcactggcc

SEQ ID NO: 3236171 - DNA, 23 bp, Homo sapiens
cctgcaggcaggaacaaacaggg

SEQ ID NO: 3236172 - DNA, 19 bp, Homo sapiens
cctgcagggcgcccctggg

SEQ ID NO: 3236173 - DNA, 14 bp, Homo sapiens
cctgcaggggagca

SEQ ID NO: 3236174 - DNA, 18 bp, Homo sapiens
cctgcagtactttacctc

SEQ ID NO: 3236175 - DNA, 20 bp, Homo sapiens
cctgcagtactttacctcct

SEQ ID NO: 3236176 - DNA, 19 bp, Homo sapiens
cctgcagtcttctgggctg

SEQ ID NO: 3236177 - DNA, 19 bp, Homo sapiens
cctgcagtgttcgcttggc

SEQ ID NO: 3236178 - DNA, 18 bp, Homo sapiens
cctgcatccccttggctg

SEQ ID NO: 3236179 - DNA, 24 bp, Homo sapiens
cctgcatccccttggctgtgaggc

SEQ ID NO: 3236180 - DNA, 14 bp, Homo sapiens
cctgcatctggggc

SEQ ID NO: 3236181 - DNA, 14 bp, Homo sapiens
cctgcatttctgag

SEQ ID NO: 3236182 - DNA, 15 bp, Homo sapiens
cctgccaagactcct

SEQ ID NO: 3236183 - DNA, 20 bp, Homo sapiens
cctgccacatacaggtgctc

SEQ ID NO: 3236184 - DNA, 16 bp, Homo sapiens
cctgccacatggagcc

SEQ ID NO: 3236185 - DNA, 17 bp, Homo sapiens
cctgccacatggagccc

SEQ ID NO: 3236186 - DNA, 14 bp, Homo sapiens
cctgccaccacaca

SEQ ID NO: 3236187 - DNA, 16 bp, Homo sapiens
cctgccaccctgggga

SEQ ID NO: 3236188 - DNA, 16 bp, Homo sapiens
cctgccaccctgtagc

SEQ ID NO: 3236189 - DNA, 16 bp, Homo sapiens
cctgccactcactagg

SEQ ID NO: 3236190 - DNA, 14 bp, Homo sapiens
cctgccagagggga

SEQ ID NO: 3236191 - DNA, 11 bp, Homo sapiens
cctgccagcag

SEQ ID NO: 3236192 - DNA, 14 bp, Homo sapiens
cctgccagcagggg

SEQ ID NO: 3236193 - DNA, 21 bp, Homo sapiens
cctgtcctaaggaaccttcct

SEQ ID NO: 3236194 - DNA, 14 bp, Homo sapiens
cctgtcctcactgc

SEQ ID NO: 3236195 - DNA, 15 bp, Homo sapiens
cctgtcctcactgct

SEQ ID NO: 3236196 - DNA, 23 bp, Homo sapiens
cctgtcctcccatcccctggact

SEQ ID NO: 3236197 - DNA, 15 bp, Homo sapiens
cctgtcctcctggaa

SEQ ID NO: 3236198 - DNA, 14 bp, Homo sapiens
cctgtcctggttcc

SEQ ID NO: 3236199 - DNA, 21 bp, Homo sapiens
cctgtcgagttcggctctggg

SEQ ID NO: 3236200 - DNA, 18 bp, Homo sapiens
cctgtcgtgccagtcctg

SEQ ID NO: 3236201 - DNA, 14 bp, Homo sapiens
cctgtctcagcctc

SEQ ID NO: 3236202 - DNA, 16 bp, Homo sapiens
cctgtctcagcctccc

SEQ ID NO: 3236203 - DNA, 23 bp, Homo sapiens
cctgtctccactgtgcctttgca

SEQ ID NO: 3236204 - DNA, 15 bp, Homo sapiens
cctgtctctgcatct

SEQ ID NO: 3236205 - DNA, 16 bp, Homo sapiens
cctgtctctgcatctg

SEQ ID NO: 3236206 - DNA, 15 bp, Homo sapiens
cctgtcttcacctgc

SEQ ID NO: 3236207 - DNA, 14 bp, Homo sapiens
cctgtcttccaagg

SEQ ID NO: 3236208 - DNA, 15 bp, Homo sapiens
cctgtcttctgggca

SEQ ID NO: 3236209 - DNA, 20 bp, Homo sapiens
cctgtcttggggccactttc

SEQ ID NO: 3236210 - DNA, 19 bp, Homo sapiens
cctgtgaatgccactgcct

SEQ ID NO: 3236211 - DNA, 15 bp, Homo sapiens
cctgtgaatggaggc

SEQ ID NO: 3236212 - DNA, 23 bp, Homo sapiens
cctgtgaatggaggcagagacct

SEQ ID NO: 3236213 - DNA, 14 bp, Homo sapiens
cctgtgacaaaatt

SEQ ID NO: 3236214 - DNA, 17 bp, Homo sapiens
cctgtgacaaaggatga

SEQ ID NO: 3236215 - DNA, 16 bp, Homo sapiens
cctgtgaccagcactg

SEQ ID NO: 3236216 - DNA, 20 bp, Homo sapiens
cctgtgatccacccaaccct

SEQ ID NO: 3236217 - DNA, 22 bp, Homo sapiens
cctgtgcacacacacacacatg

SEQ ID NO: 3236218 - DNA, 15 bp, Homo sapiens
cctgtgcagcagccc

SEQ ID NO: 3236219 - DNA, 18 bp, Homo sapiens
cctgtgcagcagcccagc

SEQ ID NO: 3236220 - DNA, 12 bp, Homo sapiens
cctgtgccaata

SEQ ID NO: 3236221 - DNA, 19 bp, Homo sapiens
cctgtgccacccaccaggg

SEQ ID NO: 3236222 - DNA, 21 bp, Homo sapiens
cctgtgccacccaccagggcg

SEQ ID NO: 3236223 - DNA, 14 bp, Homo sapiens
cctgtgccactttg

SEQ ID NO: 3236224 - DNA, 24 bp, Homo sapiens
cctgtgccactttgactcagaggc

SEQ ID NO: 3236225 - DNA, 15 bp, Homo sapiens
cctgtgccaggctga

SEQ ID NO: 3236226 - DNA, 23 bp, Homo sapiens
cctgtgcccacatcccaggcttc

SEQ ID NO: 3236227 - DNA, 20 bp, Homo sapiens
cctgtgcccatggcttctgg

SEQ ID NO: 3236228 - DNA, 15 bp, Homo sapiens
cctgtgccctgcacg

SEQ ID NO: 3236229 - DNA, 15 bp, Homo sapiens
cctgtgcctgaccct

SEQ ID NO: 3236230 - DNA, 15 bp, Homo sapiens
cctgtgcctgccatg

SEQ ID NO: 3236231 - DNA, 21 bp, Homo sapiens
cctgtgcctgccatgggccag

SEQ ID NO: 3236232 - DNA, 19 bp, Homo sapiens
cctgtgctaagtctttccc

SEQ ID NO: 3236233 - DNA, 20 bp, Homo sapiens
cctgtgctaagtctttccca

SEQ ID NO: 3236234 - DNA, 16 bp, Homo sapiens
cctgtgctagaagctc

SEQ ID NO: 3236235 - DNA, 17 bp, Homo sapiens
cctgtgctccgtgcctc

SEQ ID NO: 3236236 - DNA, 12 bp, Homo sapiens
cctgtgctggtg

SEQ ID NO: 3236237 - DNA, 17 bp, Homo sapiens
cctgtgctggtgtcctg

SEQ ID NO: 3236238 - DNA, 22 bp, Homo sapiens
cctgtggaacccagcagttctg

SEQ ID NO: 3236239 - DNA, 19 bp, Homo sapiens
cctgtggagctcagccccg

SEQ ID NO: 3236240 - DNA, 21 bp, Homo sapiens
cctgtggcagaaaagaggaga

SEQ ID NO: 3236241 - DNA, 23 bp, Homo sapiens
cctgtggcagaaaagaggagacc

SEQ ID NO: 3236242 - DNA, 14 bp, Homo sapiens
cctgtggcaggcag

SEQ ID NO: 3236243 - DNA, 19 bp, Homo sapiens
cctgtggcaggcagcgcca

SEQ ID NO: 3236244 - DNA, 22 bp, Homo sapiens
cctgtggcaggcagcgccaagc

SEQ ID NO: 3236245 - DNA, 18 bp, Homo sapiens
cctgtggcataaattgca

SEQ ID NO: 3236246 - DNA, 12 bp, Homo sapiens
cctgtggccagg

SEQ ID NO: 3236247 - DNA, 16 bp, Homo sapiens
cctgtggccaggaggt

SEQ ID NO: 3236248 - DNA, 22 bp, Homo sapiens
cctgtggccccaccctgggccc

SEQ ID NO: 3236249 - DNA, 18 bp, Homo sapiens
cctgtggccgccacctga

SEQ ID NO: 3236250 - DNA, 13 bp, Homo sapiens
cctgtggcctgtg

SEQ ID NO: 3236251 - DNA, 18 bp, Homo sapiens
cctgtggcctgtgtccca

SEQ ID NO: 3236252 - DNA, 20 bp, Homo sapiens
cctgtggggatctcaggggc

SEQ ID NO: 3236253 - DNA, 18 bp, Homo sapiens
cctgtgggggtggccatc

SEQ ID NO: 3236254 - DNA, 21 bp, Homo sapiens
cctgtgggggtggccatccct

SEQ ID NO: 3236255 - DNA, 17 bp, Homo sapiens
cctgtgggtccccactc

SEQ ID NO: 3236256 - DNA, 16 bp, Homo sapiens
cctgtggttacagtgc

SEQ ID NO: 3236257 - DNA, 19 bp, Homo sapiens
cctgtggttacagtgcaga

SEQ ID NO: 3236258 - DNA, 22 bp, Homo sapiens
cctgtggttacagtgcagacag

SEQ ID NO: 3236259 - DNA, 23 bp, Homo sapiens
cctgtggttacagtgcagacagg

SEQ ID NO: 3236260 - DNA, 17 bp, Homo sapiens
cctgtgtccacctgtgg

SEQ ID NO: 3236261 - DNA, 19 bp, Homo sapiens
cctgtgtccacctgtgggt

SEQ ID NO: 3236262 - DNA, 11 bp, Homo sapiens
cctgtgtccca

SEQ ID NO: 3236263 - DNA, 13 bp, Homo sapiens
cctgtgtcccatg

SEQ ID NO: 3236264 - DNA, 18 bp, Homo sapiens
cctgtgtcccatgaccca

SEQ ID NO: 3236265 - DNA, 19 bp, Homo sapiens
cctgtgtcccatgacccac

SEQ ID NO: 3236266 - DNA, 21 bp, Homo sapiens
cctgtgtcccatgacccaccc

SEQ ID NO: 3236267 - DNA, 23 bp, Homo sapiens
cctgtgtcccatgacccacccct

SEQ ID NO: 3236268 - DNA, 22 bp, Homo sapiens
cctgtgtcttgcaatggcagcc

SEQ ID NO: 3236269 - DNA, 14 bp, Homo sapiens
cctgtgtgactggc

SEQ ID NO: 3236270 - DNA, 17 bp, Homo sapiens
cctgtgtggtactctga

SEQ ID NO: 3236271 - DNA, 16 bp, Homo sapiens
cctgtgtgtaggctgg

SEQ ID NO: 3236272 - DNA, 20 bp, Homo sapiens
cctgtgttgtctctagagca

SEQ ID NO: 3236273 - DNA, 12 bp, Homo sapiens
cctgttaaacag

SEQ ID NO: 3236274 - DNA, 14 bp, Homo sapiens
cctgttaaacagta

SEQ ID NO: 3236275 - DNA, 22 bp, Homo sapiens
cctgttaaacagtagttgtatt

SEQ ID NO: 3236276 - DNA, 15 bp, Homo sapiens
cctgttacccagaga

SEQ ID NO: 3236277 - DNA, 21 bp, Homo sapiens
cctgttcactctacttagcat

SEQ ID NO: 3236278 - DNA, 12 bp, Homo sapiens
cctgttcagcat

SEQ ID NO: 3236279 - DNA, 13 bp, Homo sapiens
cctgttcagctcc

SEQ ID NO: 3236280 - DNA, 17 bp, Homo sapiens
cctgttcatgtgcctct

SEQ ID NO: 3236281 - DNA, 12 bp, Homo sapiens
cctgttcccatt

SEQ ID NO: 3236282 - DNA, 21 bp, Homo sapiens
cctgttctaagggggagggga

SEQ ID NO: 3236283 - DNA, 12 bp, Homo sapiens
cctgttcttcct

SEQ ID NO: 3236284 - DNA, 20 bp, Homo sapiens
cctgttcttcctccagctgc

SEQ ID NO: 3236285 - DNA, 23 bp, Homo sapiens
cctgttgacgaagtctcttttct

SEQ ID NO: 3236286 - DNA, 16 bp, Homo sapiens
cctgtttaatatttaa

SEQ ID NO: 3236287 - DNA, 13 bp, Homo sapiens
cctgttttatata

SEQ ID NO: 3236288 - DNA, 22 bp, Homo sapiens
cctgttttatatattatgtgaa

SEQ ID NO: 3236289 - DNA, 14 bp, Homo sapiens
cctgttttctctgt

SEQ ID NO: 3236290 - DNA, 16 bp, Homo sapiens
cctgttttctgagccc

SEQ ID NO: 3236291 - DNA, 19 bp, Homo sapiens
cctgttttctgtttcttct

SEQ ID NO: 3236292 - DNA, 18 bp, Homo sapiens
cctgtttttaagctgttt

SEQ ID NO: 3236293 - DNA, 16 bp, Homo sapiens
cctgtttttcacattt

SEQ ID NO: 3236294 - DNA, 15 bp, Homo sapiens
cctgtttttctgggt

SEQ ID NO: 3236295 - DNA, 16 bp, Homo sapiens
cctgtttttttttcat

SEQ ID NO: 3236296 - DNA, 13 bp, Homo sapiens
ccttaaaaatcac

SEQ ID NO: 3236297 - DNA, 15 bp, Homo sapiens
ccttaaaaccaaaga

SEQ ID NO: 3236298 - DNA, 16 bp, Homo sapiens
ccttaaaaccaaagag

SEQ ID NO: 3236299 - DNA, 23 bp, Homo sapiens
ccttaaagaaagtcgaattaata

SEQ ID NO: 3236300 - DNA, 23 bp, Homo sapiens
ccttaacatccctcctgctttta

SEQ ID NO: 3236301 - DNA, 12 bp, Homo sapiens
ccttaactgaca

SEQ ID NO: 3236302 - DNA, 22 bp, Homo sapiens
ccttaagacctactgttctaaa

SEQ ID NO: 3236303 - DNA, 23 bp, Homo sapiens
ccttaagacctactgttctaaag

SEQ ID NO: 3236304 - DNA, 17 bp, Homo sapiens
ccttaagagtcatccag

SEQ ID NO: 3236305 - DNA, 16 bp, Homo sapiens
ccttaagatttttctt

SEQ ID NO: 3236306 - DNA, 18 bp, Homo sapiens
ccttaagatttttctttt

SEQ ID NO: 3236307 - DNA, 22 bp, Homo sapiens
ccttaagccataggcccaggat

SEQ ID NO: 3236308 - DNA, 18 bp, Homo sapiens
ccttaatgacaacactta

SEQ ID NO: 3236309 - DNA, 22 bp, Homo sapiens
ccttaatgcttcatatgaggag

SEQ ID NO: 3236310 - DNA, 22 bp, Homo sapiens
ccttaatgtatggctcatttgc

SEQ ID NO: 3236311 - DNA, 16 bp, Homo sapiens
ccttaatttgcacagt

SEQ ID NO: 3236312 - DNA, 22 bp, Homo sapiens
ccttacaagttagaaaacataa

SEQ ID NO: 3236313 - DNA, 22 bp, Homo sapiens
ccttacacgtacctctcatcag

SEQ ID NO: 3236314 - DNA, 15 bp, Homo sapiens
ccttaccaactttct

SEQ ID NO: 3236315 - DNA, 19 bp, Homo sapiens
ccttaccaactttctgtaa

SEQ ID NO: 3236316 - DNA, 19 bp, Homo sapiens
ccttaccataccactttga

SEQ ID NO: 3236317 - DNA, 15 bp, Homo sapiens
ccttaccccttagcc

SEQ ID NO: 3236318 - DNA, 16 bp, Homo sapiens
cgactccgttggccac

SEQ ID NO: 3236319 - DNA, 20 bp, Homo sapiens
cgactctatagactctagga

SEQ ID NO: 3236320 - DNA, 16 bp, Homo sapiens
cgactctggccctggc

SEQ ID NO: 3236321 - DNA, 18 bp, Homo sapiens
cgactctggccctggccc

SEQ ID NO: 3236322 - DNA, 20 bp, Homo sapiens
cgactgcacagcggcccctg

SEQ ID NO: 3236323 - DNA, 23 bp, Homo sapiens
cgactgcccctgctgtgctgctc

SEQ ID NO: 3236324 - DNA, 17 bp, Homo sapiens
cgactggccagggccac

SEQ ID NO: 3236325 - DNA, 12 bp, Homo sapiens
cgactggtccag

SEQ ID NO: 3236326 - DNA, 14 bp, Homo sapiens
cgactggtccagct

SEQ ID NO: 3236327 - DNA, 15 bp, Homo sapiens
cgactggtccagctc

SEQ ID NO: 3236328 - DNA, 17 bp, Homo sapiens
cgactggtccagctctg

SEQ ID NO: 3236329 - DNA, 19 bp, Homo sapiens
cgacttggagactcctggt

SEQ ID NO: 3236330 - DNA, 13 bp, Homo sapiens
cgactttctgcct

SEQ ID NO: 3236331 - DNA, 23 bp, Homo sapiens
cgactttgtaccccccaacccct

SEQ ID NO: 3236332 - DNA, 20 bp, Homo sapiens
cgagacacaggcacgggtcc

SEQ ID NO: 3236333 - DNA, 12 bp, Homo sapiens
cgagacagtcca

SEQ ID NO: 3236334 - DNA, 14 bp, Homo sapiens
cgagacagtccagt

SEQ ID NO: 3236335 - DNA, 22 bp, Homo sapiens
cgagacagtccagtgtcacctc

SEQ ID NO: 3236336 - DNA, 15 bp, Homo sapiens
cgagactctgtctca

SEQ ID NO: 3236337 - DNA, 17 bp, Homo sapiens
cgagagatcaaagatga

SEQ ID NO: 3236338 - DNA, 19 bp, Homo sapiens
cgagaggccaaaggctggt

SEQ ID NO: 3236339 - DNA, 13 bp, Homo sapiens
cgagagggagaga

SEQ ID NO: 3236340 - DNA, 16 bp, Homo sapiens
cgagagggagagagag

SEQ ID NO: 3236341 - DNA, 18 bp, Homo sapiens
cgagaggtgagctacttt

SEQ ID NO: 3236342 - DNA, 14 bp, Homo sapiens
cgagagtctgtctc

SEQ ID NO: 3236343 - DNA, 15 bp, Homo sapiens
cgagagtctgtctca

SEQ ID NO: 3236344 - DNA, 18 bp, Homo sapiens
cgagatgtgacccaccag

SEQ ID NO: 3236345 - DNA, 21 bp, Homo sapiens
cgagatgtgacccaccagtgc

SEQ ID NO: 3236346 - DNA, 16 bp, Homo sapiens
cgagattgcaccactg

SEQ ID NO: 3236347 - DNA, 16 bp, Homo sapiens
cgagattgcgccactg

SEQ ID NO: 3236348 - DNA, 15 bp, Homo sapiens
cgagcactggccaga

SEQ ID NO: 3236349 - DNA, 18 bp, Homo sapiens
cgagcactggccagagag

SEQ ID NO: 3236350 - DNA, 18 bp, Homo sapiens
cgagccctggtggcagtg

SEQ ID NO: 3236351 - DNA, 17 bp, Homo sapiens
cgagccgggcctggggc

SEQ ID NO: 3236352 - DNA, 18 bp, Homo sapiens
cgagccggggagtttctt

SEQ ID NO: 3236353 - DNA, 15 bp, Homo sapiens
cgagcctaatgaaag

SEQ ID NO: 3236354 - DNA, 19 bp, Homo sapiens
cgagcgctatcttcacata

SEQ ID NO: 3236355 - DNA, 19 bp, Homo sapiens
cgagcgttcccagcagggg

SEQ ID NO: 3236356 - DNA, 16 bp, Homo sapiens
cgagctgaggactctg

SEQ ID NO: 3236357 - DNA, 17 bp, Homo sapiens
cgagctgaggactctgc

SEQ ID NO: 3236358 - DNA, 18 bp, Homo sapiens
cgaggaaaggattttacc

SEQ ID NO: 3236359 - DNA, 13 bp, Homo sapiens
cgaggacagggag

SEQ ID NO: 3236360 - DNA, 14 bp, Homo sapiens
cgaggaccactttg

SEQ ID NO: 3236361 - DNA, 12 bp, Homo sapiens
cgaggagtaaca

SEQ ID NO: 3236362 - DNA, 13 bp, Homo sapiens
cgaggagtaacaa

SEQ ID NO: 3236363 - DNA, 16 bp, Homo sapiens
cgaggcaccggcgctg

SEQ ID NO: 3236364 - DNA, 15 bp, Homo sapiens
cgaggcccagcgggc

SEQ ID NO: 3236365 - DNA, 12 bp, Homo sapiens
cgaggctgctag

SEQ ID NO: 3236366 - DNA, 13 bp, Homo sapiens
cgaggctggtgcc

SEQ ID NO: 3236367 - DNA, 15 bp, Homo sapiens
cgaggctggtgccag

SEQ ID NO: 3236368 - DNA, 19 bp, Homo sapiens
cgaggctggtgccaggcgc

SEQ ID NO: 3236369 - DNA, 18 bp, Homo sapiens
cgagggaggaacacctga

SEQ ID NO: 3236370 - DNA, 19 bp, Homo sapiens
cgagggaggaacacctgat

SEQ ID NO: 3236371 - DNA, 11 bp, Homo sapiens
cgagggctggc

SEQ ID NO: 3236372 - DNA, 14 bp, Homo sapiens
cgagggctggctgg

SEQ ID NO: 3236373 - DNA, 12 bp, Homo sapiens
cgaggggcaggg

SEQ ID NO: 3236374 - DNA, 22 bp, Homo sapiens
cgaggggccggggaagctgcca

SEQ ID NO: 3236375 - DNA, 18 bp, Homo sapiens
cgaggggtgtcttgggca

SEQ ID NO: 3236376 - DNA, 19 bp, Homo sapiens
cgaggggtgtcttgggcag

SEQ ID NO: 3236377 - DNA, 14 bp, Homo sapiens
cgagggtcctggct

SEQ ID NO: 3236378 - DNA, 23 bp, Homo sapiens
cgagggtcctggctcctgagggg

SEQ ID NO: 3236379 - DNA, 16 bp, Homo sapiens
cgaggtcagccaggct

SEQ ID NO: 3236380 - DNA, 16 bp, Homo sapiens
cgagtagagaggcccg

SEQ ID NO: 3236381 - DNA, 19 bp, Homo sapiens
cgagtagagaggcccgccc

SEQ ID NO: 3236382 - DNA, 15 bp, Homo sapiens
cgagtagctgggact

SEQ ID NO: 3236383 - DNA, 16 bp, Homo sapiens
cgagtagctgggacta

SEQ ID NO: 3236384 - DNA, 22 bp, Homo sapiens
cgagtcacacccggtggctctg

SEQ ID NO: 3236385 - DNA, 14 bp, Homo sapiens
cgagtcaccttcca

SEQ ID NO: 3236386 - DNA, 17 bp, Homo sapiens
cgagtcctaaggcctta

SEQ ID NO: 3236387 - DNA, 18 bp, Homo sapiens
cgagtctcttctccactg

SEQ ID NO: 3236388 - DNA, 17 bp, Homo sapiens
cgagttcctcgctctgg

SEQ ID NO: 3236389 - DNA, 22 bp, Homo sapiens
cgagttgtggaaagcctctgct

SEQ ID NO: 3236390 - DNA, 20 bp, Homo sapiens
cgatacaccgggcctggaga

SEQ ID NO: 3236391 - DNA, 23 bp, Homo sapiens
cgatactgcgactttctgcctgg

SEQ ID NO: 3236392 - DNA, 15 bp, Homo sapiens
cgatatacagatgaa

SEQ ID NO: 3236393 - DNA, 18 bp, Homo sapiens
cgatatacagatgaaaat

SEQ ID NO: 3236394 - DNA, 19 bp, Homo sapiens
cgatcatatttccccttgg

SEQ ID NO: 3236395 - DNA, 22 bp, Homo sapiens
cgatccacctgtctcagcctcc

SEQ ID NO: 3236396 - DNA, 12 bp, Homo sapiens
cgatcccctccc

SEQ ID NO: 3236397 - DNA, 15 bp, Homo sapiens
cgatcccctccccca

SEQ ID NO: 3236398 - DNA, 13 bp, Homo sapiens
cgatcctgccacc

SEQ ID NO: 3236399 - DNA, 18 bp, Homo sapiens
cgatcctgccaccctgta

SEQ ID NO: 3236400 - DNA, 20 bp, Homo sapiens
cgatcctggggccctcagct

SEQ ID NO: 3236401 - DNA, 16 bp, Homo sapiens
cgatctcattcagtat

SEQ ID NO: 3236402 - DNA, 11 bp, Homo sapiens
cgatctcctga

SEQ ID NO: 3236403 - DNA, 13 bp, Homo sapiens
cgatctctcctgg

SEQ ID NO: 3236404 - DNA, 15 bp, Homo sapiens
cgatctctcctggcc

SEQ ID NO: 3236405 - DNA, 15 bp, Homo sapiens
cgatgcatttaataa

SEQ ID NO: 3236406 - DNA, 19 bp, Homo sapiens
cgatgctccctcagcctca

SEQ ID NO: 3236407 - DNA, 18 bp, Homo sapiens
cgatgctgctttcccctg

SEQ ID NO: 3236408 - DNA, 17 bp, Homo sapiens
cgatggagcccccagat

SEQ ID NO: 3236409 - DNA, 23 bp, Homo sapiens
cgatgtggacctctactttccag

SEQ ID NO: 3236410 - DNA, 19 bp, Homo sapiens
cgattcttctgcttcagcc

SEQ ID NO: 3236411 - DNA, 14 bp, Homo sapiens
cgattggccacctg

SEQ ID NO: 3236412 - DNA, 15 bp, Homo sapiens
cgattggctttaaac

SEQ ID NO: 3236413 - DNA, 21 bp, Homo sapiens
cgatttcctcccacctccgtg

SEQ ID NO: 3236414 - DNA, 14 bp, Homo sapiens
cgatttgtcccagg

SEQ ID NO: 3236415 - DNA, 17 bp, Homo sapiens
cgattttctccagctca

SEQ ID NO: 3236416 - DNA, 14 bp, Homo sapiens
cgattttgtctacc

SEQ ID NO: 3236417 - DNA, 13 bp, Homo sapiens
cgatttttgtatg

SEQ ID NO: 3236418 - DNA, 17 bp, Homo sapiens
cgcaaccaagtgtgcta

SEQ ID NO: 3236419 - DNA, 14 bp, Homo sapiens
cgcaactctccagc

SEQ ID NO: 3236420 - DNA, 11 bp, Homo sapiens
cgcaagctgag

SEQ ID NO: 3236421 - DNA, 18 bp, Homo sapiens
cgcaagggcatcaggcac

SEQ ID NO: 3236422 - DNA, 21 bp, Homo sapiens
cgcaagggcatcaggcactgg

SEQ ID NO: 3236423 - DNA, 15 bp, Homo sapiens
cgcaagtctgcagcc

SEQ ID NO: 3236424 - DNA, 13 bp, Homo sapiens
cgcacacacacaa

SEQ ID NO: 3236425 - DNA, 18 bp, Homo sapiens
cgcacaccctgcccctgg

SEQ ID NO: 3236426 - DNA, 12 bp, Homo sapiens
cgcacagcagcc

SEQ ID NO: 3236427 - DNA, 20 bp, Homo sapiens
cgcacagcagcctgcttccc

SEQ ID NO: 3236428 - DNA, 13 bp, Homo sapiens
cgcacagtctctc

SEQ ID NO: 3236429 - DNA, 18 bp, Homo sapiens
cgcaccaatgcccagcag

SEQ ID NO: 3236430 - DNA, 20 bp, Homo sapiens
cgcaccagctgctctgcccc

SEQ ID NO: 3236431 - DNA, 23 bp, Homo sapiens
cgcaccagctgctctgccccttg

SEQ ID NO: 3236432 - DNA, 14 bp, Homo sapiens
cgcaccattctgac

SEQ ID NO: 3236433 - DNA, 15 bp, Homo sapiens
cgcaccccggcctca

SEQ ID NO: 3236434 - DNA, 18 bp, Homo sapiens
cgcaccccggcctcaggg

SEQ ID NO: 3236435 - DNA, 19 bp, Homo sapiens
cgcaccccggcctcagggc

SEQ ID NO: 3236436 - DNA, 21 bp, Homo sapiens
cgcaccccggcctcagggcgc

SEQ ID NO: 3236437 - DNA, 13 bp, Homo sapiens
cgcaccctgcacc

SEQ ID NO: 3236438 - DNA, 14 bp, Homo sapiens
cgcaccctgcacct

SEQ ID NO: 3236439 - DNA, 18 bp, Homo sapiens
cgcaccctgcacctgctg

SEQ ID NO: 3236440 - DNA, 15 bp, Homo sapiens
cgcaccgccgccacc

SEQ ID NO: 3236441 - DNA, 19 bp, Homo sapiens
cgcacctaccatcagggac

SEQ ID NO: 3236442 - DNA, 16 bp, Homo sapiens
cgcacctgccccctgg

SEQ ID NO: 3236443 - DNA, 11 bp, Homo sapiens
cgcacgcacac

SEQ ID NO: 3236444 - DNA, 13 bp, Homo sapiens
cgcacgcacacac

SEQ ID NO: 3236445 - DNA, 15 bp, Homo sapiens
cgttggagactgaag

SEQ ID NO: 3236446 - DNA, 11 bp, Homo sapiens
cgttggagcca

SEQ ID NO: 3236447 - DNA, 12 bp, Homo sapiens
cgttggagccac

SEQ ID NO: 3236448 - DNA, 22 bp, Homo sapiens
cgttggcctcagggccaggaag

SEQ ID NO: 3236449 - DNA, 13 bp, Homo sapiens
cgttgggagccta

SEQ ID NO: 3236450 - DNA, 15 bp, Homo sapiens
cgtttaaagttctgt

SEQ ID NO: 3236451 - DNA, 17 bp, Homo sapiens
cgtttaaagttctgtgt

SEQ ID NO: 3236452 - DNA, 14 bp, Homo sapiens
cgtttaactgcagt

SEQ ID NO: 3236453 - DNA, 15 bp, Homo sapiens
cgtttacctagaaga

SEQ ID NO: 3236454 - DNA, 13 bp, Homo sapiens
cgtttagaccaag

SEQ ID NO: 3236455 - DNA, 16 bp, Homo sapiens
cgtttagaccaaggaa

SEQ ID NO: 3236456 - DNA, 18 bp, Homo sapiens
cgtttataaacagaaatg

SEQ ID NO: 3236457 - DNA, 18 bp, Homo sapiens
cgtttcagtaataaaaca

SEQ ID NO: 3236458 - DNA, 22 bp, Homo sapiens
cgtttcatttagtcatgtgacc

SEQ ID NO: 3236459 - DNA, 16 bp, Homo sapiens
cgtttccaagctgcgg

SEQ ID NO: 3236460 - DNA, 20 bp, Homo sapiens
cgtttccaggtgtttatagt

SEQ ID NO: 3236461 - DNA, 15 bp, Homo sapiens
cgtttccctgaactt

SEQ ID NO: 3236462 - DNA, 11 bp, Homo sapiens
cgtttctggcc

SEQ ID NO: 3236463 - DNA, 14 bp, Homo sapiens
cgtttgtatgtgtg

SEQ ID NO: 3236464 - DNA, 19 bp, Homo sapiens
cgtttgtttgtttgtttaa

SEQ ID NO: 3236465 - DNA, 13 bp, Homo sapiens
cgttttgaagcta

SEQ ID NO: 3236466 - DNA, 13 bp, Homo sapiens
cgttttgggccag

SEQ ID NO: 3236467 - DNA, 22 bp, Homo sapiens
cgttttgtctgtgttgctgttt

SEQ ID NO: 3236468 - DNA, 18 bp, Homo sapiens
cgtttttgtgctgtgggc

SEQ ID NO: 3236469 - DNA, 19 bp, Homo sapiens
cgtttttgtgctgtgggca

SEQ ID NO: 3236470 - DNA, 16 bp, Homo sapiens
cgttttttcctcagtg

SEQ ID NO: 3236471 - DNA, 15 bp, Homo sapiens
ctaaaaaaaaaaagg

SEQ ID NO: 3236472 - DNA, 22 bp, Homo sapiens
ctaaaaacccaagtttatttct

SEQ ID NO: 3236473 - DNA, 16 bp, Homo sapiens
ctaaaaagattagcaa

SEQ ID NO: 3236474 - DNA, 11 bp, Homo sapiens
ctaaaaataaa

SEQ ID NO: 3236475 - DNA, 22 bp, Homo sapiens
ctaaaaatacttaaatttggtt

SEQ ID NO: 3236476 - DNA, 21 bp, Homo sapiens
ctaaaaatagacttaaatctc

SEQ ID NO: 3236477 - DNA, 15 bp, Homo sapiens
ctaaaaatatagcaa

SEQ ID NO: 3236478 - DNA, 20 bp, Homo sapiens
ctaaaaatattcctccaaat

SEQ ID NO: 3236479 - DNA, 16 bp, Homo sapiens
ctaaaacattcccctc

SEQ ID NO: 3236480 - DNA, 17 bp, Homo sapiens
ctaaaacattcccctcc

SEQ ID NO: 3236481 - DNA, 11 bp, Homo sapiens
ctaaaaccatt

SEQ ID NO: 3236482 - DNA, 17 bp, Homo sapiens
ctaaaaccattccattt

SEQ ID NO: 3236483 - DNA, 16 bp, Homo sapiens
ctaaaagacaaattta

SEQ ID NO: 3236484 - DNA, 17 bp, Homo sapiens
ctaaaagacatttgtta

SEQ ID NO: 3236485 - DNA, 15 bp, Homo sapiens
ctaaaagcaaatcta

SEQ ID NO: 3236486 - DNA, 23 bp, Homo sapiens
ctaaaagtgggcttgattctgca

SEQ ID NO: 3236487 - DNA, 17 bp, Homo sapiens
ctaaaatcttatagttc

SEQ ID NO: 3236488 - DNA, 22 bp, Homo sapiens
ctaaaatcttatagttctaggc

SEQ ID NO: 3236489 - DNA, 14 bp, Homo sapiens
ctaaaatcttggaa

SEQ ID NO: 3236490 - DNA, 14 bp, Homo sapiens
ctaaaatgatttta

SEQ ID NO: 3236491 - DNA, 13 bp, Homo sapiens
ctaaaatgcttca

SEQ ID NO: 3236492 - DNA, 19 bp, Homo sapiens
ctaaaatgtgatgttctaa

SEQ ID NO: 3236493 - DNA, 20 bp, Homo sapiens
ctaaaatgtgatgttctaag

SEQ ID NO: 3236494 - DNA, 23 bp, Homo sapiens
ctaaaatgtgatgttctaaggct

SEQ ID NO: 3236495 - DNA, 15 bp, Homo sapiens
ctaaaattgggcttg

SEQ ID NO: 3236496 - DNA, 17 bp, Homo sapiens
ctaaaattgtatgaaaa

SEQ ID NO: 3236497 - DNA, 21 bp, Homo sapiens
ctaaacaagaatcagtctatc

SEQ ID NO: 3236498 - DNA, 17 bp, Homo sapiens
ctaaacatatgatttca

SEQ ID NO: 3236499 - DNA, 16 bp, Homo sapiens
ctaaacccaatccaaa

SEQ ID NO: 3236500 - DNA, 19 bp, Homo sapiens
ctaaacccaatccaaatgg

SEQ ID NO: 3236501 - DNA, 12 bp, Homo sapiens
ctaaacctcagt

SEQ ID NO: 3236502 - DNA, 13 bp, Homo sapiens
ctaaacctcagtt

SEQ ID NO: 3236503 - DNA, 19 bp, Homo sapiens
ctaaaccttacatgtgtaa

SEQ ID NO: 3236504 - DNA, 15 bp, Homo sapiens
ctaaacggattccaa

SEQ ID NO: 3236505 - DNA, 16 bp, Homo sapiens
ctaaacgtggtcacct

SEQ ID NO: 3236506 - DNA, 17 bp, Homo sapiens
ctaaacgtggtcacctt

SEQ ID NO: 3236507 - DNA, 16 bp, Homo sapiens
ctaaactggtacaatt

SEQ ID NO: 3236508 - DNA, 16 bp, Homo sapiens
ctaaacttccccatct

SEQ ID NO: 3236509 - DNA, 15 bp, Homo sapiens
ctaaactttatttgt

SEQ ID NO: 3236510 - DNA, 15 bp, Homo sapiens
ctaaagaccaaactt

SEQ ID NO: 3236511 - DNA, 16 bp, Homo sapiens
ctaaagaccaaacttc

SEQ ID NO: 3236512 - DNA, 19 bp, Homo sapiens
ctaaagagcacttactgta

SEQ ID NO: 3236513 - DNA, 15 bp, Homo sapiens
ctaaagagcccttgc

SEQ ID NO: 3236514 - DNA, 20 bp, Homo sapiens
ctaaagagcccttgcctccc

SEQ ID NO: 3236515 - DNA, 18 bp, Homo sapiens
ctaaagaggctgaaagag

SEQ ID NO: 3236516 - DNA, 19 bp, Homo sapiens
ctaaagatatcagagctct

SEQ ID NO: 3236517 - DNA, 20 bp, Homo sapiens
ctaaagatatcagagctctt

SEQ ID NO: 3236518 - DNA, 17 bp, Homo sapiens
ctaaagatggagtttct

SEQ ID NO: 3236519 - DNA, 12 bp, Homo sapiens
ctaaagattcta

SEQ ID NO: 3236520 - DNA, 14 bp, Homo sapiens
ctaaagattctata

SEQ ID NO: 3236521 - DNA, 22 bp, Homo sapiens
ctaaagattctatagttctaga

SEQ ID NO: 3236522 - DNA, 23 bp, Homo sapiens
ctaaagattctatagttctagac

SEQ ID NO: 3236523 - DNA, 14 bp, Homo sapiens
ctaaagcactttgc

SEQ ID NO: 3236524 - DNA, 16 bp, Homo sapiens
ctaaagctatgttaca

SEQ ID NO: 3236525 - DNA, 17 bp, Homo sapiens
ctaaaggatagatcaaa

SEQ ID NO: 3236526 - DNA, 19 bp, Homo sapiens
ctaaaggatagatcaaagt

SEQ ID NO: 3236527 - DNA, 17 bp, Homo sapiens
ctaaagggagaaggaag

SEQ ID NO: 3236528 - DNA, 17 bp, Homo sapiens
ctaaagggatctgctta

SEQ ID NO: 3236529 - DNA, 13 bp, Homo sapiens
ctaaagggcaggg

SEQ ID NO: 3236530 - DNA, 15 bp, Homo sapiens
ctaaaggtccacagg

SEQ ID NO: 3236531 - DNA, 21 bp, Homo sapiens
ctaaaggtccacaggtctaga

SEQ ID NO: 3236532 - DNA, 23 bp, Homo sapiens
ctaaaggtccacaggtctagact

SEQ ID NO: 3236533 - DNA, 17 bp, Homo sapiens
ctaaaggtgtatttaaa

SEQ ID NO: 3236534 - DNA, 18 bp, Homo sapiens
ctaaagtgcctaccccag

SEQ ID NO: 3236535 - DNA, 9 bp, Homo sapiens
ctaaagtgt

SEQ ID NO: 3236536 - DNA, 19 bp, Homo sapiens
ctaaagtgtgttgttgctt

SEQ ID NO: 3236537 - DNA, 11 bp, Homo sapiens
ctaaagttcta

SEQ ID NO: 3236538 - DNA, 12 bp, Homo sapiens
ctaaagttctaa

SEQ ID NO: 3236539 - DNA, 17 bp, Homo sapiens
ctaaagttctaagattc

SEQ ID NO: 3236540 - DNA, 23 bp, Homo sapiens
ctaaataaagcttgcaacaaaat

SEQ ID NO: 3236541 - DNA, 13 bp, Homo sapiens
ctaaatatccaaa

SEQ ID NO: 3236542 - DNA, 19 bp, Homo sapiens
ctaaatatccaaagactgt

SEQ ID NO: 3236543 - DNA, 20 bp, Homo sapiens
ctaaatatccaaagactgta

SEQ ID NO: 3236544 - DNA, 14 bp, Homo sapiens
ctaaatcctcatgt

SEQ ID NO: 3236545 - DNA, 21 bp, Homo sapiens
ctaaatcctttactgttagtc

SEQ ID NO: 3236546 - DNA, 21 bp, Homo sapiens
ctaaatgaatctcgttcccaa

SEQ ID NO: 3236547 - DNA, 12 bp, Homo sapiens
ctaaatgaatgt

SEQ ID NO: 3236548 - DNA, 20 bp, Homo sapiens
ctaaatgcctagtttttagt

SEQ ID NO: 3236549 - DNA, 21 bp, Homo sapiens
ctaaatgcctagtttttagta

SEQ ID NO: 3236550 - DNA, 15 bp, Homo sapiens
ctaaatgctgaaaaa

SEQ ID NO: 3236551 - DNA, 17 bp, Homo sapiens
ctaaatggcctcatgtg

SEQ ID NO: 3236552 - DNA, 19 bp, Homo sapiens
ctaaatggcctcatgtggc

SEQ ID NO: 3236553 - DNA, 19 bp, Homo sapiens
ctaaatggtgctgcagatt

SEQ ID NO: 3236554 - DNA, 21 bp, Homo sapiens
ctaaatgtatatgttgattta

SEQ ID NO: 3236555 - DNA, 24 bp, Homo sapiens
ctaaatgttaactacatattgtct

SEQ ID NO: 3236556 - DNA, 15 bp, Homo sapiens
ctaaattaacctaaa

SEQ ID NO: 3236557 - DNA, 14 bp, Homo sapiens
ctaaattatttact

SEQ ID NO: 3236558 - DNA, 15 bp, Homo sapiens
ctaaattatttactg

SEQ ID NO: 3236559 - DNA, 17 bp, Homo sapiens
ctaaattctttatttct

SEQ ID NO: 3236560 - DNA, 18 bp, Homo sapiens
ctaaattgtaaactcctg

SEQ ID NO: 3236561 - DNA, 14 bp, Homo sapiens
ctaaattgtataca

SEQ ID NO: 3236562 - DNA, 15 bp, Homo sapiens
ctaaatttaaattta

SEQ ID NO: 3236563 - DNA, 19 bp, Homo sapiens
ctaaatttaaatttaaaga

SEQ ID NO: 3236564 - DNA, 13 bp, Homo sapiens
ctaaatttaatgc

SEQ ID NO: 3236565 - DNA, 15 bp, Homo sapiens
ctaaatttaatgctg

SEQ ID NO: 3236566 - DNA, 20 bp, Homo sapiens
ctaaatttgatacttatatt

SEQ ID NO: 3236567 - DNA, 14 bp, Homo sapiens
ctaaattttaaagc

SEQ ID NO: 3236568 - DNA, 15 bp, Homo sapiens
ctaaatttttaactg

SEQ ID NO: 3236569 - DNA, 20 bp, Homo sapiens
ctaacaaaagatgaaagcag

SEQ ID NO: 3236570 - DNA, 18 bp, Homo sapiens
ctaacaagaatgtaactc

SEQ ID NO: 3236571 - DNA, 15 bp, Homo sapiens
ctaacaagatttgta

SEQ ID NO: 3236572 - DNA, 17 bp, Homo sapiens
ctagaactccctttcaa

SEQ ID NO: 3236573 - DNA, 10 bp, Homo sapiens
ctagaacttt

SEQ ID NO: 3236574 - DNA, 17 bp, Homo sapiens
ctagaacttttttaaat

SEQ ID NO: 3236575 - DNA, 17 bp, Homo sapiens
ctagaagaaaagcccat

SEQ ID NO: 3236576 - DNA, 18 bp, Homo sapiens
ctagaagaaaagcccatt

SEQ ID NO: 3236577 - DNA, 11 bp, Homo sapiens
ctagaagcaca

SEQ ID NO: 3236578 - DNA, 18 bp, Homo sapiens
ctagaagcctaagaactg

SEQ ID NO: 3236579 - DNA, 23 bp, Homo sapiens
ctagaagggccagtcctgcctgg

SEQ ID NO: 3236580 - DNA, 19 bp, Homo sapiens
ctagaatctgcaattcaaa

SEQ ID NO: 3236581 - DNA, 19 bp, Homo sapiens
ctagaattagtatgtctgt

SEQ ID NO: 3236582 - DNA, 12 bp, Homo sapiens
ctagaatttatt

SEQ ID NO: 3236583 - DNA, 13 bp, Homo sapiens
ctagaatttattc

SEQ ID NO: 3236584 - DNA, 23 bp, Homo sapiens
ctagaatttattcaattcctctg

SEQ ID NO: 3236585 - DNA, 19 bp, Homo sapiens
ctagaattttaagtgcttt

SEQ ID NO: 3236586 - DNA, 16 bp, Homo sapiens
ctagacaccaaagttc

SEQ ID NO: 3236587 - DNA, 16 bp, Homo sapiens
ctagacaggaaccctt

SEQ ID NO: 3236588 - DNA, 18 bp, Homo sapiens
ctagacatggaggttcta

SEQ ID NO: 3236589 - DNA, 20 bp, Homo sapiens
ctagacatggaggttctaag

SEQ ID NO: 3236590 - DNA, 21 bp, Homo sapiens
ctagacatggaggttctaagg

SEQ ID NO: 3236591 - DNA, 22 bp, Homo sapiens
ctagacatggaggttctaaggc

SEQ ID NO: 3236592 - DNA, 15 bp, Homo sapiens
ctagacattctgtcg

SEQ ID NO: 3236593 - DNA, 15 bp, Homo sapiens
ctagacccaggtgga

SEQ ID NO: 3236594 - DNA, 20 bp, Homo sapiens
ctagactgcatcccgtacct

SEQ ID NO: 3236595 - DNA, 14 bp, Homo sapiens
ctagactggagtga

SEQ ID NO: 3236596 - DNA, 16 bp, Homo sapiens
ctagactggagtgagg

SEQ ID NO: 3236597 - DNA, 16 bp, Homo sapiens
ctagacttgaaagttt

SEQ ID NO: 3236598 - DNA, 17 bp, Homo sapiens
ctagagaagataattgt

SEQ ID NO: 3236599 - DNA, 14 bp, Homo sapiens
ctagagcaacccct

SEQ ID NO: 3236600 - DNA, 22 bp, Homo sapiens
ctagagcaacccctgtacccag

SEQ ID NO: 3236601 - DNA, 19 bp, Homo sapiens
ctagagcgcggctggctct

SEQ ID NO: 3236602 - DNA, 20 bp, Homo sapiens
ctagagcgcggctggctctg

SEQ ID NO: 3236603 - DNA, 14 bp, Homo sapiens
ctagaggcagggag

SEQ ID NO: 3236604 - DNA, 18 bp, Homo sapiens
ctagaggccagccccacc

SEQ ID NO: 3236605 - DNA, 20 bp, Homo sapiens
ctagaggccagccccaccca

SEQ ID NO: 3236606 - DNA, 12 bp, Homo sapiens
ctagaggcctca

SEQ ID NO: 3236607 - DNA, 15 bp, Homo sapiens
ctagaggtgggcagc

SEQ ID NO: 3236608 - DNA, 18 bp, Homo sapiens
ctagagtcatgtgagcct

SEQ ID NO: 3236609 - DNA, 19 bp, Homo sapiens
ctagagtcatgtgagcctc

SEQ ID NO: 3236610 - DNA, 20 bp, Homo sapiens
ctagagtcatgtgagcctcg

SEQ ID NO: 3236611 - DNA, 15 bp, Homo sapiens
ctagagtccaaggtt

SEQ ID NO: 3236612 - DNA, 23 bp, Homo sapiens
ctagagtccaaggtttaaagagt

SEQ ID NO: 3236613 - DNA, 15 bp, Homo sapiens
ctagagtcctcactc

SEQ ID NO: 3236614 - DNA, 16 bp, Homo sapiens
ctagagtctgaacagc

SEQ ID NO: 3236615 - DNA, 22 bp, Homo sapiens
ctagagtgtagcctaaagggca

SEQ ID NO: 3236616 - DNA, 23 bp, Homo sapiens
ctagataaaaagatggcctttgc

SEQ ID NO: 3236617 - DNA, 17 bp, Homo sapiens
ctagatagctattaaga

SEQ ID NO: 3236618 - DNA, 17 bp, Homo sapiens
ctagatcactgtgctta

SEQ ID NO: 3236619 - DNA, 15 bp, Homo sapiens
ctagatcagatgctc

SEQ ID NO: 3236620 - DNA, 18 bp, Homo sapiens
ctagatcagatgctccaa

SEQ ID NO: 3236621 - DNA, 20 bp, Homo sapiens
ctagatcagatgctccaaga

SEQ ID NO: 3236622 - DNA, 18 bp, Homo sapiens
ctagatccacacacagag

SEQ ID NO: 3236623 - DNA, 23 bp, Homo sapiens
ctagatgagcccagccctgttct

SEQ ID NO: 3236624 - DNA, 14 bp, Homo sapiens
ctagatgatttttt

SEQ ID NO: 3236625 - DNA, 17 bp, Homo sapiens
ctagatgattttttgaa

SEQ ID NO: 3236626 - DNA, 20 bp, Homo sapiens
ctagatgattttttgaaagt

SEQ ID NO: 3236627 - DNA, 20 bp, Homo sapiens
ctagatgtagtattttttgt

SEQ ID NO: 3236628 - DNA, 23 bp, Homo sapiens
ctagatgtagtattttttgtata

SEQ ID NO: 3236629 - DNA, 13 bp, Homo sapiens
ctagatgtcttta

SEQ ID NO: 3236630 - DNA, 12 bp, Homo sapiens
ctagatttgtcc

SEQ ID NO: 3236631 - DNA, 18 bp, Homo sapiens
ctagattttaatttattt

SEQ ID NO: 3236632 - DNA, 14 bp, Homo sapiens
ctagcaagctggcc

SEQ ID NO: 3236633 - DNA, 15 bp, Homo sapiens
ctagcaagctggcct

SEQ ID NO: 3236634 - DNA, 22 bp, Homo sapiens
ctagcaattttctttgtttctt

SEQ ID NO: 3236635 - DNA, 17 bp, Homo sapiens
ctagcagacagaaactg

SEQ ID NO: 3236636 - DNA, 23 bp, Homo sapiens
ctagcagagcaggggcagggtga

SEQ ID NO: 3236637 - DNA, 14 bp, Homo sapiens
ctagcaggcctaag

SEQ ID NO: 3236638 - DNA, 21 bp, Homo sapiens
ctagcagggaaggtgaagatg

SEQ ID NO: 3236639 - DNA, 23 bp, Homo sapiens
ctagccaaggctagttcctttca

SEQ ID NO: 3236640 - DNA, 17 bp, Homo sapiens
ctagccagagcccttca

SEQ ID NO: 3236641 - DNA, 23 bp, Homo sapiens
ctagccaggaagtacttccacct

SEQ ID NO: 3236642 - DNA, 17 bp, Homo sapiens
ctagccaggagtctgtg

SEQ ID NO: 3236643 - DNA, 21 bp, Homo sapiens
ctagccaggagtctgtgctct

SEQ ID NO: 3236644 - DNA, 14 bp, Homo sapiens
ctagccattcctgg

SEQ ID NO: 3236645 - DNA, 17 bp, Homo sapiens
ctagccattcctggtac

SEQ ID NO: 3236646 - DNA, 20 bp, Homo sapiens
ctagccattcctggtaccca

SEQ ID NO: 3236647 - DNA, 17 bp, Homo sapiens
ctagcccaccctgctgc

SEQ ID NO: 3236648 - DNA, 21 bp, Homo sapiens
ctagcccaccctgctgccttc

SEQ ID NO: 3236649 - DNA, 14 bp, Homo sapiens
ctagcccagactct

SEQ ID NO: 3236650 - DNA, 19 bp, Homo sapiens
ctagcccagactctgagct

SEQ ID NO: 3236651 - DNA, 20 bp, Homo sapiens
ctagccccagagatgccagc

SEQ ID NO: 3236652 - DNA, 21 bp, Homo sapiens
ctagcccctgtggagactggg

SEQ ID NO: 3236653 - DNA, 20 bp, Homo sapiens
ctagcctgatgagattttta

SEQ ID NO: 3236654 - DNA, 17 bp, Homo sapiens
ctagcctgggccagaga

SEQ ID NO: 3236655 - DNA, 19 bp, Homo sapiens
ctagcctgtgcctctggga

SEQ ID NO: 3236656 - DNA, 19 bp, Homo sapiens
ctagccttgaggagtgtga

SEQ ID NO: 3236657 - DNA, 11 bp, Homo sapiens
ctagccttgct

SEQ ID NO: 3236658 - DNA, 22 bp, Homo sapiens
ctagccttggcctctttcctca

SEQ ID NO: 3236659 - DNA, 15 bp, Homo sapiens
ctagcctttggctct

SEQ ID NO: 3236660 - DNA, 18 bp, Homo sapiens
ctagcgatctctcctggc

SEQ ID NO: 3236661 - DNA, 17 bp, Homo sapiens
ctagcgatttcagacct

SEQ ID NO: 3236662 - DNA, 15 bp, Homo sapiens
ctagctatgtgacct

SEQ ID NO: 3236663 - DNA, 21 bp, Homo sapiens
ctagctctctaggcctctcca

SEQ ID NO: 3236664 - DNA, 21 bp, Homo sapiens
ctagctctttggtctattttc

SEQ ID NO: 3236665 - DNA, 20 bp, Homo sapiens
ctagctgcctagcaagctgg

SEQ ID NO: 3236666 - DNA, 12 bp, Homo sapiens
ctagctggcagg

SEQ ID NO: 3236667 - DNA, 15 bp, Homo sapiens
ctagctggcaggaca

SEQ ID NO: 3236668 - DNA, 22 bp, Homo sapiens
ctagctggcaggacacatcccg

SEQ ID NO: 3236669 - DNA, 17 bp, Homo sapiens
ctagctggtagcataaa

SEQ ID NO: 3236670 - DNA, 17 bp, Homo sapiens
ctagctgtatgatttgt

SEQ ID NO: 3236671 - DNA, 23 bp, Homo sapiens
ctagctgtgtgaatacctgctca

SEQ ID NO: 3236672 - DNA, 15 bp, Homo sapiens
ctagcttctgctttt

SEQ ID NO: 3236673 - DNA, 22 bp, Homo sapiens
ctagcttctgcttttctgccct

SEQ ID NO: 3236674 - DNA, 23 bp, Homo sapiens
ctagcttctgcttttctgccctg

SEQ ID NO: 3236675 - DNA, 15 bp, Homo sapiens
ctagctttagaccct

SEQ ID NO: 3236676 - DNA, 15 bp, Homo sapiens
ctagcttttaggaaa

SEQ ID NO: 3236677 - DNA, 14 bp, Homo sapiens
ctaggaaactcaca

SEQ ID NO: 3236678 - DNA, 19 bp, Homo sapiens
ctaggaagagcaggactcc

SEQ ID NO: 3236679 - DNA, 15 bp, Homo sapiens
ctaggacacagttcc

SEQ ID NO: 3236680 - DNA, 20 bp, Homo sapiens
ctaggaccactcagccccta

SEQ ID NO: 3236681 - DNA, 12 bp, Homo sapiens
ctaggactctga

SEQ ID NO: 3236682 - DNA, 16 bp, Homo sapiens
ctaggactctgaggct

SEQ ID NO: 3236683 - DNA, 13 bp, Homo sapiens
ctaggagagccaa

SEQ ID NO: 3236684 - DNA, 22 bp, Homo sapiens
ctaggagagccaacctcggctt

SEQ ID NO: 3236685 - DNA, 18 bp, Homo sapiens
ctaggagatatctgaggg

SEQ ID NO: 3236686 - DNA, 19 bp, Homo sapiens
ctaggagatatctgaggga

SEQ ID NO: 3236687 - DNA, 19 bp, Homo sapiens
ctaggaggctgtgggtttt

SEQ ID NO: 3236688 - DNA, 22 bp, Homo sapiens
ctaggagggagacactggcccc

SEQ ID NO: 3236689 - DNA, 23 bp, Homo sapiens
ctaggagggagacactggcccct

SEQ ID NO: 3236690 - DNA, 19 bp, Homo sapiens
ctaggagggagccttgtga

SEQ ID NO: 3236691 - DNA, 20 bp, Homo sapiens
ctaggatacagaaatgcaaa

SEQ ID NO: 3236692 - DNA, 18 bp, Homo sapiens
ctaggatagttgatgcat

SEQ ID NO: 3236693 - DNA, 18 bp, Homo sapiens
ctaggatgcggaaatccc

SEQ ID NO: 3236694 - DNA, 21 bp, Homo sapiens
ctaggatgctgcagcagagtg

SEQ ID NO: 3236695 - DNA, 20 bp, Homo sapiens
ctaggatgttgctcagaagt

SEQ ID NO: 3236696 - DNA, 13 bp, Homo sapiens
ctaggattctaaa

SEQ ID NO: 3236697 - DNA, 21 bp, Homo sapiens
ctcaagcaataattgtttcca

SEQ ID NO: 3236698 - DNA, 18 bp, Homo sapiens
ctcaagccaatcccctcc

SEQ ID NO: 3236699 - DNA, 16 bp, Homo sapiens
ctcaagccccagcagc

SEQ ID NO: 3236700 - DNA, 17 bp, Homo sapiens
ctcaagccccatttcct

SEQ ID NO: 3236701 - DNA, 15 bp, Homo sapiens
ctcaagccctgaggg

SEQ ID NO: 3236702 - DNA, 21 bp, Homo sapiens
ctcaagctatgatcagaagac

SEQ ID NO: 3236703 - DNA, 19 bp, Homo sapiens
ctcaaggacttgaaagcat

SEQ ID NO: 3236704 - DNA, 14 bp, Homo sapiens
ctcaaggttttagg

SEQ ID NO: 3236705 - DNA, 16 bp, Homo sapiens
ctcaagtaaaagaaaa

SEQ ID NO: 3236706 - DNA, 19 bp, Homo sapiens
ctcaagtagaaaagcagtc

SEQ ID NO: 3236707 - DNA, 20 bp, Homo sapiens
ctcaagtagaaaagcagtcc

SEQ ID NO: 3236708 - DNA, 19 bp, Homo sapiens
ctcaagtatcttctatttt

SEQ ID NO: 3236709 - DNA, 15 bp, Homo sapiens
ctcaagtctggcaga

SEQ ID NO: 3236710 - DNA, 17 bp, Homo sapiens
ctcaagtcttccctgat

SEQ ID NO: 3236711 - DNA, 15 bp, Homo sapiens
ctcaagttctaagat

SEQ ID NO: 3236712 - DNA, 16 bp, Homo sapiens
ctcaataaatgattct

SEQ ID NO: 3236713 - DNA, 15 bp, Homo sapiens
ctcaataaattgcaa

SEQ ID NO: 3236714 - DNA, 16 bp, Homo sapiens
ctcaatactacctctg

SEQ ID NO: 3236715 - DNA, 16 bp, Homo sapiens
ctcaatagatctccag

SEQ ID NO: 3236716 - DNA, 12 bp, Homo sapiens
ctcaatgagctc

SEQ ID NO: 3236717 - DNA, 15 bp, Homo sapiens
ctcaatgcactgaca

SEQ ID NO: 3236718 - DNA, 19 bp, Homo sapiens
ctcaatgcctggagacaga

SEQ ID NO: 3236719 - DNA, 22 bp, Homo sapiens
ctcaatggcctaaaactggcct

SEQ ID NO: 3236720 - DNA, 13 bp, Homo sapiens
ctcaattgttttt

SEQ ID NO: 3236721 - DNA, 20 bp, Homo sapiens
ctcacaagcgctcccagcct

SEQ ID NO: 3236722 - DNA, 18 bp, Homo sapiens
ctcacacacacagctggg

SEQ ID NO: 3236723 - DNA, 20 bp, Homo sapiens
ctcacacacacagctgggca

SEQ ID NO: 3236724 - DNA, 21 bp, Homo sapiens
ctcacacacacagctgggcaa

SEQ ID NO: 3236725 - DNA, 13 bp, Homo sapiens
ctcacacccaccg

SEQ ID NO: 3236726 - DNA, 22 bp, Homo sapiens
ctcacacccaccgtccgccctg

SEQ ID NO: 3236727 - DNA, 18 bp, Homo sapiens
ctcacactcccctagggg

SEQ ID NO: 3236728 - DNA, 14 bp, Homo sapiens
ctcacagacctgga

SEQ ID NO: 3236729 - DNA, 21 bp, Homo sapiens
ctcacagcacatgctggccag

SEQ ID NO: 3236730 - DNA, 17 bp, Homo sapiens
ctcacagccgcattggt

SEQ ID NO: 3236731 - DNA, 14 bp, Homo sapiens
ctcacagcctctga

SEQ ID NO: 3236732 - DNA, 15 bp, Homo sapiens
ctcacagccttggct

SEQ ID NO: 3236733 - DNA, 22 bp, Homo sapiens
ctcacagccttggctcctgaga

SEQ ID NO: 3236734 - DNA, 16 bp, Homo sapiens
ctcacagctgtaataa

SEQ ID NO: 3236735 - DNA, 16 bp, Homo sapiens
ctcacaggcctctctt

SEQ ID NO: 3236736 - DNA, 18 bp, Homo sapiens
ctcacaggttggaagaga

SEQ ID NO: 3236737 - DNA, 22 bp, Homo sapiens
ctcacaggttggaagagaatca

SEQ ID NO: 3236738 - DNA, 20 bp, Homo sapiens
ctcacagtctctttaatctt

SEQ ID NO: 3236739 - DNA, 16 bp, Homo sapiens
ctcacagtgacccttc

SEQ ID NO: 3236740 - DNA, 18 bp, Homo sapiens
ctcacagtgacccttccc

SEQ ID NO: 3236741 - DNA, 17 bp, Homo sapiens
ctcacagtgttgcccag

SEQ ID NO: 3236742 - DNA, 15 bp, Homo sapiens
ctcacataaaaaaga

SEQ ID NO: 3236743 - DNA, 19 bp, Homo sapiens
ctcaccagccccactgcca

SEQ ID NO: 3236744 - DNA, 21 bp, Homo sapiens
ctcaccagccccactgccagc

SEQ ID NO: 3236745 - DNA, 15 bp, Homo sapiens
ctcaccagccccagt

SEQ ID NO: 3236746 - DNA, 17 bp, Homo sapiens
ctcaccagccccagtgc

SEQ ID NO: 3236747 - DNA, 20 bp, Homo sapiens
ctcaccagtgtcccctccac

SEQ ID NO: 3236748 - DNA, 24 bp, Homo sapiens
ctcaccagtgtcccctccactgtc

SEQ ID NO: 3236749 - DNA, 17 bp, Homo sapiens
ctcaccattgtgaagca

SEQ ID NO: 3236750 - DNA, 12 bp, Homo sapiens
ctcaccccatcc

SEQ ID NO: 3236751 - DNA, 19 bp, Homo sapiens
ctcaccccatcccacaccc

SEQ ID NO: 3236752 - DNA, 17 bp, Homo sapiens
ctcacccccagctttgc

SEQ ID NO: 3236753 - DNA, 18 bp, Homo sapiens
ctcaccccctcctggcaa

SEQ ID NO: 3236754 - DNA, 14 bp, Homo sapiens
ctcacccctcgcca

SEQ ID NO: 3236755 - DNA, 14 bp, Homo sapiens
ctcaccctgcctta

SEQ ID NO: 3236756 - DNA, 15 bp, Homo sapiens
ctcaccctgccttat

SEQ ID NO: 3236757 - DNA, 23 bp, Homo sapiens
ctcaccctgggagccagtcctcc

SEQ ID NO: 3236758 - DNA, 16 bp, Homo sapiens
ctcaccgcccatcagg

SEQ ID NO: 3236759 - DNA, 21 bp, Homo sapiens
ctcaccgtgcagagctgcact

SEQ ID NO: 3236760 - DNA, 15 bp, Homo sapiens
ctcaccgtgctgtct

SEQ ID NO: 3236761 - DNA, 12 bp, Homo sapiens
ctcacctagagc

SEQ ID NO: 3236762 - DNA, 13 bp, Homo sapiens
ctcacctagagcc

SEQ ID NO: 3236763 - DNA, 14 bp, Homo sapiens
ctcacctagagcca

SEQ ID NO: 3236764 - DNA, 20 bp, Homo sapiens
ctcacctagagccagaccaa

SEQ ID NO: 3236765 - DNA, 14 bp, Homo sapiens
ctcacctcatgccc

SEQ ID NO: 3236766 - DNA, 17 bp, Homo sapiens
ctcacctcatgcccacc

SEQ ID NO: 3236767 - DNA, 19 bp, Homo sapiens
ctcacctcccgaagccacc

SEQ ID NO: 3236768 - DNA, 19 bp, Homo sapiens
ctcacctctacccaaaccc

SEQ ID NO: 3236769 - DNA, 15 bp, Homo sapiens
ctcacctctggactg

SEQ ID NO: 3236770 - DNA, 20 bp, Homo sapiens
ctcacctgcactaacagagt

SEQ ID NO: 3236771 - DNA, 21 bp, Homo sapiens
ctcaccttctgagtacagagt

SEQ ID NO: 3236772 - DNA, 17 bp, Homo sapiens
ctcacctttcccatctt

SEQ ID NO: 3236773 - DNA, 18 bp, Homo sapiens
ctcacgagatttgccagg

SEQ ID NO: 3236774 - DNA, 20 bp, Homo sapiens
ctcacgcctatgatcccagc

SEQ ID NO: 3236775 - DNA, 21 bp, Homo sapiens
ctcacgcctgtaatcccagca

SEQ ID NO: 3236776 - DNA, 21 bp, Homo sapiens
ctcacgctcccccgcagtccc

SEQ ID NO: 3236777 - DNA, 14 bp, Homo sapiens
ctcacgctgggtcc

SEQ ID NO: 3236778 - DNA, 22 bp, Homo sapiens
ctcacggaccactcgaggcctg

SEQ ID NO: 3236779 - DNA, 17 bp, Homo sapiens
ctcacggggcctccaac

SEQ ID NO: 3236780 - DNA, 16 bp, Homo sapiens
ctcacgtccaggttca

SEQ ID NO: 3236781 - DNA, 15 bp, Homo sapiens
ctcactaatttttgt

SEQ ID NO: 3236782 - DNA, 18 bp, Homo sapiens
ctcactaggcccccactt

SEQ ID NO: 3236783 - DNA, 21 bp, Homo sapiens
ctcactatggtatgctggcca

SEQ ID NO: 3236784 - DNA, 18 bp, Homo sapiens
ctcactatgttgcccagg

SEQ ID NO: 3236785 - DNA, 19 bp, Homo sapiens
ctcactatgttgcccaggc

SEQ ID NO: 3236786 - DNA, 13 bp, Homo sapiens
ctcactcacattt

SEQ ID NO: 3236787 - DNA, 15 bp, Homo sapiens
ctcactcacattttc

SEQ ID NO: 3236788 - DNA, 18 bp, Homo sapiens
ctcactccacagagtgag

SEQ ID NO: 3236789 - DNA, 14 bp, Homo sapiens
ctcactcccacctg

SEQ ID NO: 3236790 - DNA, 16 bp, Homo sapiens
ctcactcctacctggt

SEQ ID NO: 3236791 - DNA, 19 bp, Homo sapiens
ctcactcctacctggtaat

SEQ ID NO: 3236792 - DNA, 23 bp, Homo sapiens
ctcactcctaggagagccaacct

SEQ ID NO: 3236793 - DNA, 12 bp, Homo sapiens
ctcactcctgcc

SEQ ID NO: 3236794 - DNA, 14 bp, Homo sapiens
ctcactctggcctc

SEQ ID NO: 3236795 - DNA, 12 bp, Homo sapiens
ctcactctgggc

SEQ ID NO: 3236796 - DNA, 15 bp, Homo sapiens
ctcactctgggctgt

SEQ ID NO: 3236797 - DNA, 14 bp, Homo sapiens
ctcactctgtccct

SEQ ID NO: 3236798 - DNA, 12 bp, Homo sapiens
ctcactctgtcg

SEQ ID NO: 3236799 - DNA, 14 bp, Homo sapiens
ctcactgaaaggca

SEQ ID NO: 3236800 - DNA, 23 bp, Homo sapiens
ctcactgaagcctgcgttggtcc

SEQ ID NO: 3236801 - DNA, 22 bp, Homo sapiens
ctcactgagaagattgtgaata

SEQ ID NO: 3236802 - DNA, 22 bp, Homo sapiens
ctcactgcaacctccgcctccc

SEQ ID NO: 3236803 - DNA, 18 bp, Homo sapiens
ctcactgcaaccttcacc

SEQ ID NO: 3236804 - DNA, 12 bp, Homo sapiens
ctcactgcagcc

SEQ ID NO: 3236805 - DNA, 15 bp, Homo sapiens
ctcactgccaggcca

SEQ ID NO: 3236806 - DNA, 18 bp, Homo sapiens
ctcactgccaggccagcc

SEQ ID NO: 3236807 - DNA, 12 bp, Homo sapiens
ctcactgctcaa

SEQ ID NO: 3236808 - DNA, 20 bp, Homo sapiens
ctcactgctcaagaagacat

SEQ ID NO: 3236809 - DNA, 15 bp, Homo sapiens
ctcactgctccctga

SEQ ID NO: 3236810 - DNA, 19 bp, Homo sapiens
ctcactgctccctgaagcc

SEQ ID NO: 3236811 - DNA, 18 bp, Homo sapiens
ctcactggaggagcagct

SEQ ID NO: 3236812 - DNA, 20 bp, Homo sapiens
ctcactggaggagcagcttc

SEQ ID NO: 3236813 - DNA, 16 bp, Homo sapiens
ctcactggccatccct

SEQ ID NO: 3236814 - DNA, 21 bp, Homo sapiens
ctcactggccatccctcgtgg

SEQ ID NO: 3236815 - DNA, 13 bp, Homo sapiens
ctcactggctggg

SEQ ID NO: 3236816 - DNA, 17 bp, Homo sapiens
ctcactggctggggcag

SEQ ID NO: 3236817 - DNA, 22 bp, Homo sapiens
ctcactggctggggcagagggg

SEQ ID NO: 3236818 - DNA, 13 bp, Homo sapiens
ctcactggggcct

SEQ ID NO: 3236819 - DNA, 16 bp, Homo sapiens
ctcactggggcctaca

SEQ ID NO: 3236820 - DNA, 18 bp, Homo sapiens
ctcactggggcctacagc

SEQ ID NO: 3236821 - DNA, 12 bp, Homo sapiens
ctcactgtgatc

SEQ ID NO: 3236822 - DNA, 22 bp, Homo sapiens
ctcactgtgatcaatattttta

SEQ ID NO: 3236823 - DNA, 23 bp, Homo sapiens
ctccctgccccccaaggttctgg

SEQ ID NO: 3236824 - DNA, 13 bp, Homo sapiens
ctccctgcccctc

SEQ ID NO: 3236825 - DNA, 16 bp, Homo sapiens
ctccctgcctggcccc

SEQ ID NO: 3236826 - DNA, 19 bp, Homo sapiens
ctccctgctcagtgcttgg

SEQ ID NO: 3236827 - DNA, 15 bp, Homo sapiens
ctccctgctgtgcca

SEQ ID NO: 3236828 - DNA, 15 bp, Homo sapiens
ctccctggagccctg

SEQ ID NO: 3236829 - DNA, 22 bp, Homo sapiens
ctccctggcaggatgctgagct

SEQ ID NO: 3236830 - DNA, 14 bp, Homo sapiens
ctccctggctccca

SEQ ID NO: 3236831 - DNA, 15 bp, Homo sapiens
ctccctggctcccat

SEQ ID NO: 3236832 - DNA, 16 bp, Homo sapiens
ctccctggctctcaga

SEQ ID NO: 3236833 - DNA, 14 bp, Homo sapiens
ctccctggctgccc

SEQ ID NO: 3236834 - DNA, 17 bp, Homo sapiens
ctccctggctgccctgg

SEQ ID NO: 3236835 - DNA, 18 bp, Homo sapiens
ctccctggctgccctggc

SEQ ID NO: 3236836 - DNA, 20 bp, Homo sapiens
ctccctggctgccctggccc

SEQ ID NO: 3236837 - DNA, 22 bp, Homo sapiens
ctccctggctgccctggccctg

SEQ ID NO: 3236838 - DNA, 18 bp, Homo sapiens
ctccctgtagctctgcct

SEQ ID NO: 3236839 - DNA, 19 bp, Homo sapiens
ctccctgtagctctgcctc

SEQ ID NO: 3236840 - DNA, 18 bp, Homo sapiens
ctccctgtctctgcatct

SEQ ID NO: 3236841 - DNA, 22 bp, Homo sapiens
ctccctgtggcactcagggagc

SEQ ID NO: 3236842 - DNA, 19 bp, Homo sapiens
ctccctgttgacgaagtct

SEQ ID NO: 3236843 - DNA, 15 bp, Homo sapiens
ctcccttatgtccac

SEQ ID NO: 3236844 - DNA, 19 bp, Homo sapiens
ctcccttcaaccattcccc

SEQ ID NO: 3236845 - DNA, 22 bp, Homo sapiens
ctcccttcaagacgaggggcag

SEQ ID NO: 3236846 - DNA, 16 bp, Homo sapiens
ctcccttcagccccca

SEQ ID NO: 3236847 - DNA, 19 bp, Homo sapiens
ctcccttccgaccctctgg

SEQ ID NO: 3236848 - DNA, 21 bp, Homo sapiens
ctcccttccgaccctctggga

SEQ ID NO: 3236849 - DNA, 14 bp, Homo sapiens
ctcccttcctggcc

SEQ ID NO: 3236850 - DNA, 19 bp, Homo sapiens
ctcccttccttttccctgc

SEQ ID NO: 3236851 - DNA, 18 bp, Homo sapiens
ctcccttgctggccccag

SEQ ID NO: 3236852 - DNA, 17 bp, Homo sapiens
ctcccttgggttctgat

SEQ ID NO: 3236853 - DNA, 20 bp, Homo sapiens
ctcccttggtggcaagagcc

SEQ ID NO: 3236854 - DNA, 21 bp, Homo sapiens
ctcccttggtggcaagagccc

SEQ ID NO: 3236855 - DNA, 12 bp, Homo sapiens
ctccctttcaac

SEQ ID NO: 3236856 - DNA, 15 bp, Homo sapiens
ctccctttcccttct

SEQ ID NO: 3236857 - DNA, 16 bp, Homo sapiens
ctccctttctcttctt

SEQ ID NO: 3236858 - DNA, 13 bp, Homo sapiens
ctccgaagaaaag

SEQ ID NO: 3236859 - DNA, 15 bp, Homo sapiens
ctccgaagaaaagaa

SEQ ID NO: 3236860 - DNA, 14 bp, Homo sapiens
ctccgagagggaga

SEQ ID NO: 3236861 - DNA, 14 bp, Homo sapiens
ctccgagaggtggg

SEQ ID NO: 3236862 - DNA, 22 bp, Homo sapiens
ctccgagaggtgggccagtctg

SEQ ID NO: 3236863 - DNA, 20 bp, Homo sapiens
ctccgccagcctcctctgga

SEQ ID NO: 3236864 - DNA, 15 bp, Homo sapiens
ctccgccattgagaa

SEQ ID NO: 3236865 - DNA, 16 bp, Homo sapiens
ctccgcccccagccta

SEQ ID NO: 3236866 - DNA, 20 bp, Homo sapiens
ctccgcccccagcctatgag

SEQ ID NO: 3236867 - DNA, 16 bp, Homo sapiens
ctccgcccgctcctgc

SEQ ID NO: 3236868 - DNA, 23 bp, Homo sapiens
ctccgcccgctcctgccgcagac

SEQ ID NO: 3236869 - DNA, 16 bp, Homo sapiens
ctccgccctcctcggg

SEQ ID NO: 3236870 - DNA, 17 bp, Homo sapiens
ctccgccctcctcgggc

SEQ ID NO: 3236871 - DNA, 13 bp, Homo sapiens
ctccgccctgcca

SEQ ID NO: 3236872 - DNA, 17 bp, Homo sapiens
ctccgccctgccactca

SEQ ID NO: 3236873 - DNA, 21 bp, Homo sapiens
ctccgccttcactccggtgtg

SEQ ID NO: 3236874 - DNA, 13 bp, Homo sapiens
ctccgcggctgga

SEQ ID NO: 3236875 - DNA, 15 bp, Homo sapiens
ctccgcggctggagc

SEQ ID NO: 3236876 - DNA, 16 bp, Homo sapiens
ctccgcggctggagcg

SEQ ID NO: 3236877 - DNA, 21 bp, Homo sapiens
ctccgctttctacccagcgag

SEQ ID NO: 3236878 - DNA, 15 bp, Homo sapiens
ctccggactggtgcc

SEQ ID NO: 3236879 - DNA, 13 bp, Homo sapiens
ctccggggtctgt

SEQ ID NO: 3236880 - DNA, 15 bp, Homo sapiens
ctccggggtctgtgc

SEQ ID NO: 3236881 - DNA, 18 bp, Homo sapiens
ctccggggtggccacagg

SEQ ID NO: 3236882 - DNA, 19 bp, Homo sapiens
ctccgggtgtggcctcagc

SEQ ID NO: 3236883 - DNA, 20 bp, Homo sapiens
ctccgggtgtggcctcagcc

SEQ ID NO: 3236884 - DNA, 22 bp, Homo sapiens
ctccgggtgtggcctcagccct

SEQ ID NO: 3236885 - DNA, 13 bp, Homo sapiens
ctccggtgtgcct

SEQ ID NO: 3236886 - DNA, 17 bp, Homo sapiens
ctccgtccacccaggct

SEQ ID NO: 3236887 - DNA, 18 bp, Homo sapiens
ctccgtccaggagcctgg

SEQ ID NO: 3236888 - DNA, 19 bp, Homo sapiens
ctccgtccaggagcctggc

SEQ ID NO: 3236889 - DNA, 20 bp, Homo sapiens
ctccgtccaggagcctgtgc

SEQ ID NO: 3236890 - DNA, 22 bp, Homo sapiens
ctccgtccaggagcctgtgcct

SEQ ID NO: 3236891 - DNA, 15 bp, Homo sapiens
ctccgtgatccatcc

SEQ ID NO: 3236892 - DNA, 21 bp, Homo sapiens
ctccgtgatccatccatctcc

SEQ ID NO: 3236893 - DNA, 13 bp, Homo sapiens
ctccgtgcctcca

SEQ ID NO: 3236894 - DNA, 15 bp, Homo sapiens
ctccgttagctcctg

SEQ ID NO: 3236895 - DNA, 15 bp, Homo sapiens
ctccgtttatgggcc

SEQ ID NO: 3236896 - DNA, 19 bp, Homo sapiens
ctccgtttatgggccttgc

SEQ ID NO: 3236897 - DNA, 17 bp, Homo sapiens
ctcctaactccaccgcc

SEQ ID NO: 3236898 - DNA, 18 bp, Homo sapiens
ctcctacctgccctggaa

SEQ ID NO: 3236899 - DNA, 13 bp, Homo sapiens
ctcctagacccag

SEQ ID NO: 3236900 - DNA, 23 bp, Homo sapiens
ctcctagagacagaagcaggctg

SEQ ID NO: 3236901 - DNA, 17 bp, Homo sapiens
ctcctagaggtgggcag

SEQ ID NO: 3236902 - DNA, 22 bp, Homo sapiens
ctcctagaggtgggcagctggg

SEQ ID NO: 3236903 - DNA, 23 bp, Homo sapiens
ctcctagaggtgggcagctgggc

SEQ ID NO: 3236904 - DNA, 21 bp, Homo sapiens
ctcctagcagacagaaactgg

SEQ ID NO: 3236905 - DNA, 21 bp, Homo sapiens
ctcctaggggaacagaccagt

SEQ ID NO: 3236906 - DNA, 14 bp, Homo sapiens
ctcctataatctgt

SEQ ID NO: 3236907 - DNA, 15 bp, Homo sapiens
ctcctataatctgtc

SEQ ID NO: 3236908 - DNA, 21 bp, Homo sapiens
ctcctataatctgtcaaaaca

SEQ ID NO: 3236909 - DNA, 23 bp, Homo sapiens
ctcctataatctgtcaaaacact

SEQ ID NO: 3236910 - DNA, 13 bp, Homo sapiens
ctcctatctgtgt

SEQ ID NO: 3236911 - DNA, 14 bp, Homo sapiens
ctcctatctgtgtt

SEQ ID NO: 3236912 - DNA, 20 bp, Homo sapiens
ctcctattctataaaactct

SEQ ID NO: 3236913 - DNA, 16 bp, Homo sapiens
ctcctatttttgtaaa

SEQ ID NO: 3236914 - DNA, 15 bp, Homo sapiens
ctcctcaacccctcc

SEQ ID NO: 3236915 - DNA, 21 bp, Homo sapiens
ctcctcaatttttgtctcaga

SEQ ID NO: 3236916 - DNA, 15 bp, Homo sapiens
ctcctcacacaccct

SEQ ID NO: 3236917 - DNA, 15 bp, Homo sapiens
ctcctcacccccagc

SEQ ID NO: 3236918 - DNA, 21 bp, Homo sapiens
ctcctcacccccagctttgct

SEQ ID NO: 3236919 - DNA, 16 bp, Homo sapiens
ctcctcacctcatgcc

SEQ ID NO: 3236920 - DNA, 19 bp, Homo sapiens
ctcctcacctcatgcccac

SEQ ID NO: 3236921 - DNA, 17 bp, Homo sapiens
ctcctcactctgtccct

SEQ ID NO: 3236922 - DNA, 18 bp, Homo sapiens
ctcctcactgcccgcaca

SEQ ID NO: 3236923 - DNA, 14 bp, Homo sapiens
ctcctcactgtatc

SEQ ID NO: 3236924 - DNA, 19 bp, Homo sapiens
ctcctcactgtatccaggt

SEQ ID NO: 3236925 - DNA, 14 bp, Homo sapiens
ctcctcagccccca

SEQ ID NO: 3236926 - DNA, 20 bp, Homo sapiens
ctcctcagcccccaggccag

SEQ ID NO: 3236927 - DNA, 17 bp, Homo sapiens
ctcctcaggcacacagc

SEQ ID NO: 3236928 - DNA, 14 bp, Homo sapiens
ctcctcagggtggg

SEQ ID NO: 3236929 - DNA, 15 bp, Homo sapiens
ctcctcagggtgggg

SEQ ID NO: 3236930 - DNA, 20 bp, Homo sapiens
ctcctcatggcagcctactc

SEQ ID NO: 3236931 - DNA, 17 bp, Homo sapiens
ctcctccacagtgctgc

SEQ ID NO: 3236932 - DNA, 18 bp, Homo sapiens
ctcctccacagtgctgct

SEQ ID NO: 3236933 - DNA, 20 bp, Homo sapiens
ctcctccacagtgctgcttc

SEQ ID NO: 3236934 - DNA, 18 bp, Homo sapiens
ctcctccagcccctgtcc

SEQ ID NO: 3236935 - DNA, 20 bp, Homo sapiens
ctcctccagcccctgtccca

SEQ ID NO: 3236936 - DNA, 13 bp, Homo sapiens
ctcctccaggcct

SEQ ID NO: 3236937 - DNA, 17 bp, Homo sapiens
ctcctccaggcctgcct

SEQ ID NO: 3236938 - DNA, 21 bp, Homo sapiens
ctcctccaggcctgcctccca

SEQ ID NO: 3236939 - DNA, 17 bp, Homo sapiens
ctcctccagtgtgggct

SEQ ID NO: 3236940 - DNA, 13 bp, Homo sapiens
ctcctcccagcgt

SEQ ID NO: 3236941 - DNA, 21 bp, Homo sapiens
ctcctcccagcgtgtgtatcc

SEQ ID NO: 3236942 - DNA, 12 bp, Homo sapiens
ctcctcccagga

SEQ ID NO: 3236943 - DNA, 13 bp, Homo sapiens
ctcctcccccacc

SEQ ID NO: 3236944 - DNA, 16 bp, Homo sapiens
ctcctcccccacccct

SEQ ID NO: 3236945 - DNA, 17 bp, Homo sapiens
ctcctcccccacccctt

SEQ ID NO: 3236946 - DNA, 16 bp, Homo sapiens
ctcctccccctgttct

SEQ ID NO: 3236947 - DNA, 22 bp, Homo sapiens
ctcctccctcagctctctggga

SEQ ID NO: 3236948 - DNA, 13 bp, Homo sapiens
ctcctccctgccc

SEQ ID NO: 3236949 - DNA, 15 bp, Homo sapiens
ctctcccctccagcc

SEQ ID NO: 3236950 - DNA, 18 bp, Homo sapiens
ctctcccctccagccttt

SEQ ID NO: 3236951 - DNA, 18 bp, Homo sapiens
ctctcccctcccagtctc

SEQ ID NO: 3236952 - DNA, 14 bp, Homo sapiens
ctctcccctccctt

SEQ ID NO: 3236953 - DNA, 16 bp, Homo sapiens
ctctcccctgccctgc

SEQ ID NO: 3236954 - DNA, 23 bp, Homo sapiens
ctctcccggaggttgggtgggcc

SEQ ID NO: 3236955 - DNA, 14 bp, Homo sapiens
ctctcccggctgcc

SEQ ID NO: 3236956 - DNA, 16 bp, Homo sapiens
ctctcccgtcagggcc

SEQ ID NO: 3236957 - DNA, 23 bp, Homo sapiens
ctctccctcaacaagggagagac

SEQ ID NO: 3236958 - DNA, 14 bp, Homo sapiens
ctctccctctctct

SEQ ID NO: 3236959 - DNA, 17 bp, Homo sapiens
ctctccctctctctttt

SEQ ID NO: 3236960 - DNA, 13 bp, Homo sapiens
ctctccctgccaa

SEQ ID NO: 3236961 - DNA, 21 bp, Homo sapiens
ctctccctgccaagtctcaga

SEQ ID NO: 3236962 - DNA, 16 bp, Homo sapiens
ctctccgaccagacac

SEQ ID NO: 3236963 - DNA, 15 bp, Homo sapiens
ctctcctccccaaat

SEQ ID NO: 3236964 - DNA, 20 bp, Homo sapiens
ctctcctcggccccctccat

SEQ ID NO: 3236965 - DNA, 13 bp, Homo sapiens
ctctcctctctgc

SEQ ID NO: 3236966 - DNA, 14 bp, Homo sapiens
ctctcctcttgcca

SEQ ID NO: 3236967 - DNA, 17 bp, Homo sapiens
ctctcctcttgccactg

SEQ ID NO: 3236968 - DNA, 18 bp, Homo sapiens
ctctcctgcccagatgcc

SEQ ID NO: 3236969 - DNA, 20 bp, Homo sapiens
ctctcctggcctatccgctg

SEQ ID NO: 3236970 - DNA, 23 bp, Homo sapiens
ctctcctggcctatccgctgcca

SEQ ID NO: 3236971 - DNA, 19 bp, Homo sapiens
ctctcctgggggtggcagg

SEQ ID NO: 3236972 - DNA, 23 bp, Homo sapiens
ctctcctgggggtggcaggcaca

SEQ ID NO: 3236973 - DNA, 20 bp, Homo sapiens
ctctcctgtctgccctctgg

SEQ ID NO: 3236974 - DNA, 13 bp, Homo sapiens
ctctccttgggct

SEQ ID NO: 3236975 - DNA, 13 bp, Homo sapiens
ctctcctttgaaa

SEQ ID NO: 3236976 - DNA, 21 bp, Homo sapiens
ctctcctttgaaacctgctct

SEQ ID NO: 3236977 - DNA, 19 bp, Homo sapiens
ctctcctttggccattcca

SEQ ID NO: 3236978 - DNA, 10 bp, Homo sapiens
ctctcctttt

SEQ ID NO: 3236979 - DNA, 13 bp, Homo sapiens
ctctccttttctt

SEQ ID NO: 3236980 - DNA, 16 bp, Homo sapiens
ctctccttttgaggct

SEQ ID NO: 3236981 - DNA, 22 bp, Homo sapiens
ctctccttttgaggcttctcct

SEQ ID NO: 3236982 - DNA, 17 bp, Homo sapiens
ctctcgcacctttccaa

SEQ ID NO: 3236983 - DNA, 16 bp, Homo sapiens
ctctcggaaggctggc

SEQ ID NO: 3236984 - DNA, 19 bp, Homo sapiens
ctctcggaaggctggctgg

SEQ ID NO: 3236985 - DNA, 14 bp, Homo sapiens
ctctcggccaggca

SEQ ID NO: 3236986 - DNA, 15 bp, Homo sapiens
ctctcggctccccat

SEQ ID NO: 3236987 - DNA, 16 bp, Homo sapiens
ctctcggctccccatg

SEQ ID NO: 3236988 - DNA, 18 bp, Homo sapiens
ctctcggctccccatgtg

SEQ ID NO: 3236989 - DNA, 21 bp, Homo sapiens
ctctcggttccacgtccccct

SEQ ID NO: 3236990 - DNA, 13 bp, Homo sapiens
ctctctacagtgc

SEQ ID NO: 3236991 - DNA, 19 bp, Homo sapiens
ctctctactcctacctcag

SEQ ID NO: 3236992 - DNA, 22 bp, Homo sapiens
ctctctactcctacctcagcct

SEQ ID NO: 3236993 - DNA, 12 bp, Homo sapiens
ctctctcagagc

SEQ ID NO: 3236994 - DNA, 17 bp, Homo sapiens
ctctctcagagcatctg

SEQ ID NO: 3236995 - DNA, 20 bp, Homo sapiens
ctctctcagagcatctggct

SEQ ID NO: 3236996 - DNA, 23 bp, Homo sapiens
ctctctcagagcatctggctgtt

SEQ ID NO: 3236997 - DNA, 17 bp, Homo sapiens
ctctctcccatttcagg

SEQ ID NO: 3236998 - DNA, 12 bp, Homo sapiens
ctctctcctctc

SEQ ID NO: 3236999 - DNA, 16 bp, Homo sapiens
ctctctcctctctgct

SEQ ID NO: 3237000 - DNA, 22 bp, Homo sapiens
ctctctcctgtttcccttccct

SEQ ID NO: 3237001 - DNA, 15 bp, Homo sapiens
ctctctctcttcctc

SEQ ID NO: 3237002 - DNA, 9 bp, Homo sapiens
ctctctctt

SEQ ID NO: 3237003 - DNA, 12 bp, Homo sapiens
ctctctcttcct

SEQ ID NO: 3237004 - DNA, 15 bp, Homo sapiens
ctctctcttttcatt

SEQ ID NO: 3237005 - DNA, 23 bp, Homo sapiens
ctctctgagactctttagagcag

SEQ ID NO: 3237006 - DNA, 22 bp, Homo sapiens
ctctctgatcttgtgctcagca

SEQ ID NO: 3237007 - DNA, 12 bp, Homo sapiens
ctctctgcccct

SEQ ID NO: 3237008 - DNA, 15 bp, Homo sapiens
ctctctgcccctgat

SEQ ID NO: 3237009 - DNA, 19 bp, Homo sapiens
ctctctgcccctgatcact

SEQ ID NO: 3237010 - DNA, 12 bp, Homo sapiens
ctctctgctcct

SEQ ID NO: 3237011 - DNA, 21 bp, Homo sapiens
ctctctgctgagctgggccca

SEQ ID NO: 3237012 - DNA, 15 bp, Homo sapiens
ctctctggcctccca

SEQ ID NO: 3237013 - DNA, 16 bp, Homo sapiens
ctctctggcctcccac

SEQ ID NO: 3237014 - DNA, 17 bp, Homo sapiens
ctctctggcctcccacc

SEQ ID NO: 3237015 - DNA, 20 bp, Homo sapiens
ctctctggcctcccacccga

SEQ ID NO: 3237016 - DNA, 14 bp, Homo sapiens
ctctctggccttcg

SEQ ID NO: 3237017 - DNA, 12 bp, Homo sapiens
ctctctgggcct

SEQ ID NO: 3237018 - DNA, 19 bp, Homo sapiens
ctctctggggccctgggcc

SEQ ID NO: 3237019 - DNA, 18 bp, Homo sapiens
ctctctgtataaacatta

SEQ ID NO: 3237020 - DNA, 23 bp, Homo sapiens
ctctctgtcccttgctgtatgct

SEQ ID NO: 3237021 - DNA, 16 bp, Homo sapiens
ctctctgtgaatacaa

SEQ ID NO: 3237022 - DNA, 17 bp, Homo sapiens
ctctctgtgaatacaat

SEQ ID NO: 3237023 - DNA, 18 bp, Homo sapiens
ctctcttatagaatattt

SEQ ID NO: 3237024 - DNA, 21 bp, Homo sapiens
ctctcttatagaatatttatt

SEQ ID NO: 3237025 - DNA, 13 bp, Homo sapiens
ctctcttccctca

SEQ ID NO: 3237026 - DNA, 22 bp, Homo sapiens
ctctcttcctaccctccttcca

SEQ ID NO: 3237027 - DNA, 16 bp, Homo sapiens
ctctcttctctccagc

SEQ ID NO: 3237028 - DNA, 14 bp, Homo sapiens
ctctcttctgctcc

SEQ ID NO: 3237029 - DNA, 15 bp, Homo sapiens
ctctcttctgctcca

SEQ ID NO: 3237030 - DNA, 14 bp, Homo sapiens
ctctcttgcacccg

SEQ ID NO: 3237031 - DNA, 20 bp, Homo sapiens
ctctcttgccgaggagccag

SEQ ID NO: 3237032 - DNA, 14 bp, Homo sapiens
ctctctttgttctc

SEQ ID NO: 3237033 - DNA, 15 bp, Homo sapiens
ctctctttgttctca

SEQ ID NO: 3237034 - DNA, 20 bp, Homo sapiens
ctctctttgttctcagctcc

SEQ ID NO: 3237035 - DNA, 22 bp, Homo sapiens
ctctctttgttctcagctcccc

SEQ ID NO: 3237036 - DNA, 19 bp, Homo sapiens
ctctcttttcattgtgtat

SEQ ID NO: 3237037 - DNA, 14 bp, Homo sapiens
ctctcttttccccg

SEQ ID NO: 3237038 - DNA, 21 bp, Homo sapiens
ctctcttttccccgcctgcag

SEQ ID NO: 3237039 - DNA, 17 bp, Homo sapiens
ctctcttttctgtactt

SEQ ID NO: 3237040 - DNA, 20 bp, Homo sapiens
ctctctttttggaggtgctt

SEQ ID NO: 3237041 - DNA, 15 bp, Homo sapiens
ctctgaaataaaatg

SEQ ID NO: 3237042 - DNA, 16 bp, Homo sapiens
ctctgaacacaggcag

SEQ ID NO: 3237043 - DNA, 19 bp, Homo sapiens
ctctgaagaactctctgga

SEQ ID NO: 3237044 - DNA, 16 bp, Homo sapiens
ctctgacaagggctga

SEQ ID NO: 3237045 - DNA, 18 bp, Homo sapiens
ctctgacaagggctgacc

SEQ ID NO: 3237046 - DNA, 14 bp, Homo sapiens
ctctgacacacagc

SEQ ID NO: 3237047 - DNA, 16 bp, Homo sapiens
ctctgacatcccttcc

SEQ ID NO: 3237048 - DNA, 18 bp, Homo sapiens
ctctgacatcccttcctg

SEQ ID NO: 3237049 - DNA, 15 bp, Homo sapiens
ctctgacccttgggc

SEQ ID NO: 3237050 - DNA, 21 bp, Homo sapiens
ctctgacccttgggcctgggc

SEQ ID NO: 3237051 - DNA, 15 bp, Homo sapiens
ctctgacctgcactg

SEQ ID NO: 3237052 - DNA, 15 bp, Homo sapiens
ctctgacctgcaggc

SEQ ID NO: 3237053 - DNA, 23 bp, Homo sapiens
ctctgactagtagatttctatga

SEQ ID NO: 3237054 - DNA, 13 bp, Homo sapiens
ctctgactctgag

SEQ ID NO: 3237055 - DNA, 14 bp, Homo sapiens
ctctgactctgagt

SEQ ID NO: 3237056 - DNA, 16 bp, Homo sapiens
ctctgactctgagtcc

SEQ ID NO: 3237057 - DNA, 13 bp, Homo sapiens
ctctgacttctgc

SEQ ID NO: 3237058 - DNA, 15 bp, Homo sapiens
ctctgacttctgcct

SEQ ID NO: 3237059 - DNA, 17 bp, Homo sapiens
ctctgacttctgcctgg

SEQ ID NO: 3237060 - DNA, 18 bp, Homo sapiens
ctctgagaagaggagccc

SEQ ID NO: 3237061 - DNA, 16 bp, Homo sapiens
ctctgagaagctctga

SEQ ID NO: 3237062 - DNA, 15 bp, Homo sapiens
ctctgagaccacaga

SEQ ID NO: 3237063 - DNA, 18 bp, Homo sapiens
ctctgagactctttagag

SEQ ID NO: 3237064 - DNA, 22 bp, Homo sapiens
ctctgagactctttagagcagc

SEQ ID NO: 3237065 - DNA, 21 bp, Homo sapiens
ctctgagactggcagatcgct

SEQ ID NO: 3237066 - DNA, 21 bp, Homo sapiens
ctctgagatctaaggatgtca

SEQ ID NO: 3237067 - DNA, 22 bp, Homo sapiens
ctctgagatctaaggatgtcac

SEQ ID NO: 3237068 - DNA, 14 bp, Homo sapiens
ctctgagcagtcag

SEQ ID NO: 3237069 - DNA, 20 bp, Homo sapiens
ctctgagccagattacagga

SEQ ID NO: 3237070 - DNA, 11 bp, Homo sapiens
ctctgagccca

SEQ ID NO: 3237071 - DNA, 13 bp, Homo sapiens
ctctgagcccaag

SEQ ID NO: 3237072 - DNA, 18 bp, Homo sapiens
ctctgagcccagctgcct

SEQ ID NO: 3237073 - DNA, 19 bp, Homo sapiens
ctctgagcccagctgcctg

SEQ ID NO: 3237074 - DNA, 14 bp, Homo sapiens
ctctgagcccaggc

SEQ ID NO: 3237075 - DNA, 13 bp, Homo sapiens
ctctgagcccatg

SEQ ID NO: 3237076 - DNA, 15 bp, Homo sapiens
ctgaattaaataaat

SEQ ID NO: 3237077 - DNA, 16 bp, Homo sapiens
ctgaattaattaattt

SEQ ID NO: 3237078 - DNA, 14 bp, Homo sapiens
ctgaattacagtga

SEQ ID NO: 3237079 - DNA, 18 bp, Homo sapiens
ctgaattatctatttcat

SEQ ID NO: 3237080 - DNA, 21 bp, Homo sapiens
ctgaattgtcagatgtggagt

SEQ ID NO: 3237081 - DNA, 18 bp, Homo sapiens
ctgacaaaaagtttccat

SEQ ID NO: 3237082 - DNA, 22 bp, Homo sapiens
ctgacaaatattttagaagcta

SEQ ID NO: 3237083 - DNA, 18 bp, Homo sapiens
ctgacaaccactggtctg

SEQ ID NO: 3237084 - DNA, 12 bp, Homo sapiens
ctgacaagggct

SEQ ID NO: 3237085 - DNA, 19 bp, Homo sapiens
ctgacaagggctgacctgc

SEQ ID NO: 3237086 - DNA, 22 bp, Homo sapiens
ctgacaagggctgacctgcctc

SEQ ID NO: 3237087 - DNA, 13 bp, Homo sapiens
ctgacaatcaact

SEQ ID NO: 3237088 - DNA, 17 bp, Homo sapiens
ctgacaatggcagctag

SEQ ID NO: 3237089 - DNA, 18 bp, Homo sapiens
ctgacaatggcagctaga

SEQ ID NO: 3237090 - DNA, 17 bp, Homo sapiens
ctgacacacagctctgt

SEQ ID NO: 3237091 - DNA, 18 bp, Homo sapiens
ctgacacacagctctgtc

SEQ ID NO: 3237092 - DNA, 22 bp, Homo sapiens
ctgacacacagctctgtcctgg

SEQ ID NO: 3237093 - DNA, 19 bp, Homo sapiens
ctgacacctaccatgctgc

SEQ ID NO: 3237094 - DNA, 18 bp, Homo sapiens
ctgacactaaccagagtc

SEQ ID NO: 3237095 - DNA, 14 bp, Homo sapiens
ctgacactgagccc

SEQ ID NO: 3237096 - DNA, 16 bp, Homo sapiens
ctgacactgagcccca

SEQ ID NO: 3237097 - DNA, 17 bp, Homo sapiens
ctgacactgagccccac

SEQ ID NO: 3237098 - DNA, 14 bp, Homo sapiens
ctgacagacacagg

SEQ ID NO: 3237099 - DNA, 15 bp, Homo sapiens
ctgacagacacaggc

SEQ ID NO: 3237100 - DNA, 11 bp, Homo sapiens
ctgacaggcaa

SEQ ID NO: 3237101 - DNA, 17 bp, Homo sapiens
ctgacaggcaatgctgg

SEQ ID NO: 3237102 - DNA, 15 bp, Homo sapiens
ctgacagtcttgtgc

SEQ ID NO: 3237103 - DNA, 13 bp, Homo sapiens
ctgacatcacagc

SEQ ID NO: 3237104 - DNA, 13 bp, Homo sapiens
ctgacatcccttc

SEQ ID NO: 3237105 - DNA, 15 bp, Homo sapiens
ctgacatcccttcct

SEQ ID NO: 3237106 - DNA, 16 bp, Homo sapiens
ctgacatcccttcctg

SEQ ID NO: 3237107 - DNA, 22 bp, Homo sapiens
ctgacatcccttcctggaaaca

SEQ ID NO: 3237108 - DNA, 23 bp, Homo sapiens
ctgacatgcatattgattctgaa

SEQ ID NO: 3237109 - DNA, 13 bp, Homo sapiens
ctgacatggctct

SEQ ID NO: 3237110 - DNA, 17 bp, Homo sapiens
ctgacatggctctggac

SEQ ID NO: 3237111 - DNA, 18 bp, Homo sapiens
ctgacattaacagttttc

SEQ ID NO: 3237112 - DNA, 23 bp, Homo sapiens
ctgacattaacagttttccatga

SEQ ID NO: 3237113 - DNA, 20 bp, Homo sapiens
ctgacatttatatttgtgta

SEQ ID NO: 3237114 - DNA, 14 bp, Homo sapiens
ctgaccaacaggct

SEQ ID NO: 3237115 - DNA, 21 bp, Homo sapiens
ctgaccagcctccatgctgcc

SEQ ID NO: 3237116 - DNA, 15 bp, Homo sapiens
ctgaccatccactct

SEQ ID NO: 3237117 - DNA, 19 bp, Homo sapiens
ctgaccatccactctaccc

SEQ ID NO: 3237118 - DNA, 22 bp, Homo sapiens
ctgaccatccactctaccctcc

SEQ ID NO: 3237119 - DNA, 23 bp, Homo sapiens
ctgaccatccactctaccctccc

SEQ ID NO: 3237120 - DNA, 16 bp, Homo sapiens
ctgacccagagtggag

SEQ ID NO: 3237121 - DNA, 23 bp, Homo sapiens
ctgacccagagtggagtctgagt

SEQ ID NO: 3237122 - DNA, 14 bp, Homo sapiens
ctgacccagcatct

SEQ ID NO: 3237123 - DNA, 21 bp, Homo sapiens
ctgacccagcatctcccagca

SEQ ID NO: 3237124 - DNA, 12 bp, Homo sapiens
ctgacccaggcc

SEQ ID NO: 3237125 - DNA, 14 bp, Homo sapiens
ctgacccaggccgc

SEQ ID NO: 3237126 - DNA, 23 bp, Homo sapiens
ctgacccaggccgcagctcttgc

SEQ ID NO: 3237127 - DNA, 20 bp, Homo sapiens
ctgaccccaaacaccttcca

SEQ ID NO: 3237128 - DNA, 21 bp, Homo sapiens
ctgaccccaaacaccttccag

SEQ ID NO: 3237129 - DNA, 20 bp, Homo sapiens
ctgaccccagtggaaaacaa

SEQ ID NO: 3237130 - DNA, 15 bp, Homo sapiens
ctgaccccctcccct

SEQ ID NO: 3237131 - DNA, 16 bp, Homo sapiens
ctgaccccctcccctg

SEQ ID NO: 3237132 - DNA, 20 bp, Homo sapiens
ctgacccctcctcactggcc

SEQ ID NO: 3237133 - DNA, 13 bp, Homo sapiens
ctgaccccttgct

SEQ ID NO: 3237134 - DNA, 13 bp, Homo sapiens
ctgacctcccagc

SEQ ID NO: 3237135 - DNA, 16 bp, Homo sapiens
ctgacctcccagccct

SEQ ID NO: 3237136 - DNA, 18 bp, Homo sapiens
ctgacctccctctaattt

SEQ ID NO: 3237137 - DNA, 20 bp, Homo sapiens
ctgacctccctctaatttat

SEQ ID NO: 3237138 - DNA, 18 bp, Homo sapiens
ctgacctccgcccctgcc

SEQ ID NO: 3237139 - DNA, 16 bp, Homo sapiens
ctgacctcttgctgtc

SEQ ID NO: 3237140 - DNA, 17 bp, Homo sapiens
ctgacctcttgctgtct

SEQ ID NO: 3237141 - DNA, 19 bp, Homo sapiens
ctgacctcttgctgtctct

SEQ ID NO: 3237142 - DNA, 21 bp, Homo sapiens
ctgacctcttgctgtctctgc

SEQ ID NO: 3237143 - DNA, 23 bp, Homo sapiens
ctgacctcttgctgtctctgctc

SEQ ID NO: 3237144 - DNA, 23 bp, Homo sapiens
ctgacctggcatctaattctgat

SEQ ID NO: 3237145 - DNA, 13 bp, Homo sapiens
ctgaccttccttc

SEQ ID NO: 3237146 - DNA, 18 bp, Homo sapiens
ctgaccttggctgactgg

SEQ ID NO: 3237147 - DNA, 13 bp, Homo sapiens
ctgacgaaggtcc

SEQ ID NO: 3237148 - DNA, 18 bp, Homo sapiens
ctgacgcaatgaaaagtc

SEQ ID NO: 3237149 - DNA, 21 bp, Homo sapiens
ctgacgccctgcgttggagcc

SEQ ID NO: 3237150 - DNA, 13 bp, Homo sapiens
ctgacggccctgc

SEQ ID NO: 3237151 - DNA, 16 bp, Homo sapiens
ctgacggccctgcaat

SEQ ID NO: 3237152 - DNA, 16 bp, Homo sapiens
ctgacgggaggcccca

SEQ ID NO: 3237153 - DNA, 17 bp, Homo sapiens
ctgacgggaggccccag

SEQ ID NO: 3237154 - DNA, 14 bp, Homo sapiens
ctgacgtgcctttt

SEQ ID NO: 3237155 - DNA, 22 bp, Homo sapiens
ctgacgtgccttttgcacccct

SEQ ID NO: 3237156 - DNA, 19 bp, Homo sapiens
ctgactaaactttttttct

SEQ ID NO: 3237157 - DNA, 22 bp, Homo sapiens
ctgactagaagggccagtcctg

SEQ ID NO: 3237158 - DNA, 23 bp, Homo sapiens
ctgactagaagggccagtcctgc

SEQ ID NO: 3237159 - DNA, 22 bp, Homo sapiens
ctgactcacacctgaactgaac

SEQ ID NO: 3237160 - DNA, 18 bp, Homo sapiens
ctgactcaggcgcctggc

SEQ ID NO: 3237161 - DNA, 12 bp, Homo sapiens
ctgactccagag

SEQ ID NO: 3237162 - DNA, 15 bp, Homo sapiens
ctgactccagagtct

SEQ ID NO: 3237163 - DNA, 16 bp, Homo sapiens
ctgactccctgtgggg

SEQ ID NO: 3237164 - DNA, 13 bp, Homo sapiens
ctgactctctgtg

SEQ ID NO: 3237165 - DNA, 19 bp, Homo sapiens
ctgactctgagtccactgc

SEQ ID NO: 3237166 - DNA, 15 bp, Homo sapiens
ctgactgaaggaaaa

SEQ ID NO: 3237167 - DNA, 22 bp, Homo sapiens
ctgactgcccgctcctcgggaa

SEQ ID NO: 3237168 - DNA, 12 bp, Homo sapiens
ctgactggcaaa

SEQ ID NO: 3237169 - DNA, 18 bp, Homo sapiens
ctgactggcaaaggacca

SEQ ID NO: 3237170 - DNA, 21 bp, Homo sapiens
ctgactggccaaacccttgct

SEQ ID NO: 3237171 - DNA, 23 bp, Homo sapiens
ctgactggccagttgcccagagc

SEQ ID NO: 3237172 - DNA, 16 bp, Homo sapiens
ctgactggggctgggg

SEQ ID NO: 3237173 - DNA, 14 bp, Homo sapiens
ctgactgtcctctc

SEQ ID NO: 3237174 - DNA, 16 bp, Homo sapiens
ctgactgtcctctccc

SEQ ID NO: 3237175 - DNA, 18 bp, Homo sapiens
ctgacttaagcaaaagaa

SEQ ID NO: 3237176 - DNA, 14 bp, Homo sapiens
ctgacttcatctgg

SEQ ID NO: 3237177 - DNA, 17 bp, Homo sapiens
ctgacttcatctggggt

SEQ ID NO: 3237178 - DNA, 18 bp, Homo sapiens
ctgacttctaatatcatt

SEQ ID NO: 3237179 - DNA, 12 bp, Homo sapiens
ctgacttctgcc

SEQ ID NO: 3237180 - DNA, 15 bp, Homo sapiens
ctgacttggcactta

SEQ ID NO: 3237181 - DNA, 13 bp, Homo sapiens
ctgacttggggga

SEQ ID NO: 3237182 - DNA, 20 bp, Homo sapiens
ctgacttgtttgtcttccat

SEQ ID NO: 3237183 - DNA, 18 bp, Homo sapiens
ctgactttctgattactg

SEQ ID NO: 3237184 - DNA, 14 bp, Homo sapiens
ctgactttgcttgc

SEQ ID NO: 3237185 - DNA, 15 bp, Homo sapiens
ctgactttgcttgct

SEQ ID NO: 3237186 - DNA, 18 bp, Homo sapiens
ctgactttgcttgctttg

SEQ ID NO: 3237187 - DNA, 19 bp, Homo sapiens
ctgactttgcttgctttga

SEQ ID NO: 3237188 - DNA, 13 bp, Homo sapiens
ctgagaactcctg

SEQ ID NO: 3237189 - DNA, 22 bp, Homo sapiens
ctgagaactgaattttgggact

SEQ ID NO: 3237190 - DNA, 20 bp, Homo sapiens
ctgagaagaatgaaaatgca

SEQ ID NO: 3237191 - DNA, 13 bp, Homo sapiens
ctgagaagctctg

SEQ ID NO: 3237192 - DNA, 14 bp, Homo sapiens
ctgagaagctgctc

SEQ ID NO: 3237193 - DNA, 15 bp, Homo sapiens
ctgagaagctgctcc

SEQ ID NO: 3237194 - DNA, 21 bp, Homo sapiens
ctgagaagctgctccaggcct

SEQ ID NO: 3237195 - DNA, 23 bp, Homo sapiens
ctgagaagctgctccaggcctgc

SEQ ID NO: 3237196 - DNA, 12 bp, Homo sapiens
ctgagaccacag

SEQ ID NO: 3237197 - DNA, 14 bp, Homo sapiens
ctgagaccagtgta

SEQ ID NO: 3237198 - DNA, 19 bp, Homo sapiens
ctgagaccagttgggagca

SEQ ID NO: 3237199 - DNA, 22 bp, Homo sapiens
ctgagaccagttgggagcactg

SEQ ID NO: 3237200 - DNA, 17 bp, Homo sapiens
ctgagacgggcatcgca

SEQ ID NO: 3237201 - DNA, 21 bp, Homo sapiens
ctgagacgggcatcgcaggag

SEQ ID NO: 3237202 - DNA, 22 bp, Homo sapiens
ctgattggcttgtagaattgtt

SEQ ID NO: 3237203 - DNA, 17 bp, Homo sapiens
ctgattggtgcaaccct

SEQ ID NO: 3237204 - DNA, 12 bp, Homo sapiens
ctgattgtaaac

SEQ ID NO: 3237205 - DNA, 16 bp, Homo sapiens
ctgattgtaaacttca

SEQ ID NO: 3237206 - DNA, 16 bp, Homo sapiens
ctgatttacatgtatg

SEQ ID NO: 3237207 - DNA, 15 bp, Homo sapiens
ctgatttcagttttt

SEQ ID NO: 3237208 - DNA, 18 bp, Homo sapiens
ctgatttcagtttttcat

SEQ ID NO: 3237209 - DNA, 22 bp, Homo sapiens
ctgatttcagtttttcatttgt

SEQ ID NO: 3237210 - DNA, 13 bp, Homo sapiens
ctgatttccaggc

SEQ ID NO: 3237211 - DNA, 18 bp, Homo sapiens
ctgatttccaggcccctg

SEQ ID NO: 3237212 - DNA, 19 bp, Homo sapiens
ctgatttctatggctttca

SEQ ID NO: 3237213 - DNA, 20 bp, Homo sapiens
ctgatttctatggctttcaa

SEQ ID NO: 3237214 - DNA, 22 bp, Homo sapiens
ctgatttctatggctttcaaag

SEQ ID NO: 3237215 - DNA, 19 bp, Homo sapiens
ctgattttaaaggcagaga

SEQ ID NO: 3237216 - DNA, 23 bp, Homo sapiens
ctgattttaaaggcagagaagtt

SEQ ID NO: 3237217 - DNA, 13 bp, Homo sapiens
ctgattttaacaa

SEQ ID NO: 3237218 - DNA, 22 bp, Homo sapiens
ctgattttaacaataactactg

SEQ ID NO: 3237219 - DNA, 21 bp, Homo sapiens
ctgattttaggagctaaggct

SEQ ID NO: 3237220 - DNA, 23 bp, Homo sapiens
ctgattttaggagctaaggctct

SEQ ID NO: 3237221 - DNA, 18 bp, Homo sapiens
ctgattttcaaagctttt

SEQ ID NO: 3237222 - DNA, 20 bp, Homo sapiens
ctgattttttttccttttaa

SEQ ID NO: 3237223 - DNA, 18 bp, Homo sapiens
ctgcaaaaaaagcctcca

SEQ ID NO: 3237224 - DNA, 21 bp, Homo sapiens
ctgcaaaaaaagcctccaagg

SEQ ID NO: 3237225 - DNA, 14 bp, Homo sapiens
ctgcaaaaagaaaa

SEQ ID NO: 3237226 - DNA, 21 bp, Homo sapiens
ctgcaaaaatatttataaaac

SEQ ID NO: 3237227 - DNA, 13 bp, Homo sapiens
ctgcaaaaatgga

SEQ ID NO: 3237228 - DNA, 15 bp, Homo sapiens
ctgcaaaaggcctct

SEQ ID NO: 3237229 - DNA, 12 bp, Homo sapiens
ctgcaaaataga

SEQ ID NO: 3237230 - DNA, 15 bp, Homo sapiens
ctgcaaacagaacag

SEQ ID NO: 3237231 - DNA, 21 bp, Homo sapiens
ctgcaaacagaacagggtcat

SEQ ID NO: 3237232 - DNA, 18 bp, Homo sapiens
ctgcaaacctgacccctg

SEQ ID NO: 3237233 - DNA, 20 bp, Homo sapiens
ctgcaaacctgacccctgct

SEQ ID NO: 3237234 - DNA, 18 bp, Homo sapiens
ctgcaaaccttcctggga

SEQ ID NO: 3237235 - DNA, 16 bp, Homo sapiens
ctgcaaactcactgct

SEQ ID NO: 3237236 - DNA, 16 bp, Homo sapiens
ctgcaaagacagtatt

SEQ ID NO: 3237237 - DNA, 20 bp, Homo sapiens
ctgcaaaggtggcaatgctt

SEQ ID NO: 3237238 - DNA, 23 bp, Homo sapiens
ctgcaaagtgattcactgtgctt

SEQ ID NO: 3237239 - DNA, 14 bp, Homo sapiens
ctgcaaataaagcc

SEQ ID NO: 3237240 - DNA, 21 bp, Homo sapiens
ctgcaacaacgcctggtgccc

SEQ ID NO: 3237241 - DNA, 20 bp, Homo sapiens
ctgcaacctccgcctcttgg

SEQ ID NO: 3237242 - DNA, 15 bp, Homo sapiens
ctgcaacctctgcct

SEQ ID NO: 3237243 - DNA, 16 bp, Homo sapiens
ctgcaactagccaagg

SEQ ID NO: 3237244 - DNA, 16 bp, Homo sapiens
ctgcaacttccgctga

SEQ ID NO: 3237245 - DNA, 17 bp, Homo sapiens
ctgcaacttccgctgag

SEQ ID NO: 3237246 - DNA, 18 bp, Homo sapiens
ctgcaacttccgctgagg

SEQ ID NO: 3237247 - DNA, 20 bp, Homo sapiens
ctgcaactttaagcagctct

SEQ ID NO: 3237248 - DNA, 14 bp, Homo sapiens
ctgcaagccccagg

SEQ ID NO: 3237249 - DNA, 16 bp, Homo sapiens
ctgcaagccccagggc

SEQ ID NO: 3237250 - DNA, 17 bp, Homo sapiens
ctgcaagccccagggcc

SEQ ID NO: 3237251 - DNA, 21 bp, Homo sapiens
ctgcaagccccagggcctggg

SEQ ID NO: 3237252 - DNA, 22 bp, Homo sapiens
ctgcaagccccagggcctgggg

SEQ ID NO: 3237253 - DNA, 18 bp, Homo sapiens
ctgcaaggcccacaggag

SEQ ID NO: 3237254 - DNA, 16 bp, Homo sapiens
ctgcaaggtactctgg

SEQ ID NO: 3237255 - DNA, 19 bp, Homo sapiens
ctgcaaggtactctggtga

SEQ ID NO: 3237256 - DNA, 13 bp, Homo sapiens
ctgcaagtcagag

SEQ ID NO: 3237257 - DNA, 15 bp, Homo sapiens
ctgcaagtcagagga

SEQ ID NO: 3237258 - DNA, 16 bp, Homo sapiens
ctgcaagtcagaggat

SEQ ID NO: 3237259 - DNA, 19 bp, Homo sapiens
ctgcaagtcagaggatggc

SEQ ID NO: 3237260 - DNA, 19 bp, Homo sapiens
ctgcaagtgaggtgtgtca

SEQ ID NO: 3237261 - DNA, 16 bp, Homo sapiens
ctgcaagtgtctggag

SEQ ID NO: 3237262 - DNA, 14 bp, Homo sapiens
ctgcaataacttct

SEQ ID NO: 3237263 - DNA, 15 bp, Homo sapiens
ctgcaataacttctg

SEQ ID NO: 3237264 - DNA, 18 bp, Homo sapiens
ctgcaataacttctgacc

SEQ ID NO: 3237265 - DNA, 19 bp, Homo sapiens
ctgcaataacttctgacct

SEQ ID NO: 3237266 - DNA, 14 bp, Homo sapiens
ctgcaatagagact

SEQ ID NO: 3237267 - DNA, 18 bp, Homo sapiens
ctgcaatagagactgtag

SEQ ID NO: 3237268 - DNA, 18 bp, Homo sapiens
ctgcaatatttgaatttt

SEQ ID NO: 3237269 - DNA, 15 bp, Homo sapiens
ctgcaatcctgtctt

SEQ ID NO: 3237270 - DNA, 16 bp, Homo sapiens
ctgcaatcctgtcttt

SEQ ID NO: 3237271 - DNA, 15 bp, Homo sapiens
ctgcaatgcttctgt

SEQ ID NO: 3237272 - DNA, 21 bp, Homo sapiens
ctgcaatgggcactgggatga

SEQ ID NO: 3237273 - DNA, 22 bp, Homo sapiens
ctgcaattcaaaagttccaaga

SEQ ID NO: 3237274 - DNA, 13 bp, Homo sapiens
ctgcacaaagccc

SEQ ID NO: 3237275 - DNA, 18 bp, Homo sapiens
ctgcacaaagcccttcca

SEQ ID NO: 3237276 - DNA, 20 bp, Homo sapiens
ctgcacaaagcccttccatg

SEQ ID NO: 3237277 - DNA, 21 bp, Homo sapiens
ctgcacaaagcccttccatgt

SEQ ID NO: 3237278 - DNA, 11 bp, Homo sapiens
ctgcacacaag

SEQ ID NO: 3237279 - DNA, 22 bp, Homo sapiens
ctgcacacaagcccacagcaca

SEQ ID NO: 3237280 - DNA, 17 bp, Homo sapiens
ctgcacacacagctcct

SEQ ID NO: 3237281 - DNA, 17 bp, Homo sapiens
ctgcacacacctccgag

SEQ ID NO: 3237282 - DNA, 18 bp, Homo sapiens
ctgcacacacctccgaga

SEQ ID NO: 3237283 - DNA, 13 bp, Homo sapiens
ctgcacagaaggg

SEQ ID NO: 3237284 - DNA, 19 bp, Homo sapiens
ctgcacagacaagcagccc

SEQ ID NO: 3237285 - DNA, 11 bp, Homo sapiens
ctgcacagagc

SEQ ID NO: 3237286 - DNA, 21 bp, Homo sapiens
ctgcacagagctctccagctc

SEQ ID NO: 3237287 - DNA, 13 bp, Homo sapiens
ctgcacagcggcc

SEQ ID NO: 3237288 - DNA, 13 bp, Homo sapiens
ctgcacagggtcc

SEQ ID NO: 3237289 - DNA, 12 bp, Homo sapiens
ctgcacagtgct

SEQ ID NO: 3237290 - DNA, 16 bp, Homo sapiens
ctgcacatgtcttgta

SEQ ID NO: 3237291 - DNA, 17 bp, Homo sapiens
ctgcaccaggagacaga

SEQ ID NO: 3237292 - DNA, 12 bp, Homo sapiens
ctgcaccctcca

SEQ ID NO: 3237293 - DNA, 18 bp, Homo sapiens
ctgcaccctccaccctgt

SEQ ID NO: 3237294 - DNA, 12 bp, Homo sapiens
ctgcaccgggcc

SEQ ID NO: 3237295 - DNA, 18 bp, Homo sapiens
ctgcaccgggccacagag

SEQ ID NO: 3237296 - DNA, 23 bp, Homo sapiens
ctgcaccgggccacagagaaagt

SEQ ID NO: 3237297 - DNA, 16 bp, Homo sapiens
ctgcacctgccagcct

SEQ ID NO: 3237298 - DNA, 23 bp, Homo sapiens
ctgcacctgctgcgtccccactc

SEQ ID NO: 3237299 - DNA, 13 bp, Homo sapiens
ctgcacctgtgca

SEQ ID NO: 3237300 - DNA, 14 bp, Homo sapiens
ctgcacctgtgcag

SEQ ID NO: 3237301 - DNA, 18 bp, Homo sapiens
ctgcactaaagccagcct

SEQ ID NO: 3237302 - DNA, 16 bp, Homo sapiens
ctgcactactcctctg

SEQ ID NO: 3237303 - DNA, 18 bp, Homo sapiens
ctgcactactcctctgca

SEQ ID NO: 3237304 - DNA, 19 bp, Homo sapiens
ctgcactactcctctgcag

SEQ ID NO: 3237305 - DNA, 20 bp, Homo sapiens
ctgcactactcctctgcagt

SEQ ID NO: 3237306 - DNA, 14 bp, Homo sapiens
ctgcactactgaca

SEQ ID NO: 3237307 - DNA, 17 bp, Homo sapiens
ctgcactatagcctagg

SEQ ID NO: 3237308 - DNA, 20 bp, Homo sapiens
ctgcactatagcctaggtga

SEQ ID NO: 3237309 - DNA, 14 bp, Homo sapiens
ctgcactcaagctt

SEQ ID NO: 3237310 - DNA, 20 bp, Homo sapiens
ctgcactccaatctgggtga

SEQ ID NO: 3237311 - DNA, 14 bp, Homo sapiens
ctgcactccagcct

SEQ ID NO: 3237312 - DNA, 18 bp, Homo sapiens
ctgcactccagcctgggc

SEQ ID NO: 3237313 - DNA, 20 bp, Homo sapiens
ctgcactccagcctgggcga

SEQ ID NO: 3237314 - DNA, 14 bp, Homo sapiens
ctgcactgaaaagg

SEQ ID NO: 3237315 - DNA, 13 bp, Homo sapiens
ctgcactgcagtg

SEQ ID NO: 3237316 - DNA, 16 bp, Homo sapiens
ctgcactggggagccc

SEQ ID NO: 3237317 - DNA, 15 bp, Homo sapiens
ctgcacttacttgct

SEQ ID NO: 3237318 - DNA, 16 bp, Homo sapiens
ctgcacttacttgctt

SEQ ID NO: 3237319 - DNA, 16 bp, Homo sapiens
ctgcacttcagacacc

SEQ ID NO: 3237320 - DNA, 16 bp, Homo sapiens
ctgcacttgcagactc

SEQ ID NO: 3237321 - DNA, 17 bp, Homo sapiens
ctgcacttgcagactct

SEQ ID NO: 3237322 - DNA, 15 bp, Homo sapiens
ctgcacttggcctca

SEQ ID NO: 3237323 - DNA, 17 bp, Homo sapiens
ctgcacttggcctcagc

SEQ ID NO: 3237324 - DNA, 23 bp, Homo sapiens
ctgcacttggcctcagctggctg

SEQ ID NO: 3237325 - DNA, 16 bp, Homo sapiens
ctgcagaacagtgaaa

SEQ ID NO: 3237326 - DNA, 22 bp, Homo sapiens
ctgcagaacatcgatatgtata

SEQ ID NO: 3237327 - DNA, 13 bp, Homo sapiens
ctgcagaaggaaa

SEQ ID NO: 3237328 - DNA, 13 bp, Homo sapiens
ctgctcctcatgg

SEQ ID NO: 3237329 - DNA, 14 bp, Homo sapiens
ctgctcctcatggt

SEQ ID NO: 3237330 - DNA, 11 bp, Homo sapiens
ctgctcctcca

SEQ ID NO: 3237331 - DNA, 11 bp, Homo sapiens
ctgctcctccc

SEQ ID NO: 3237332 - DNA, 17 bp, Homo sapiens
ctgctcctccctggctg

SEQ ID NO: 3237333 - DNA, 20 bp, Homo sapiens
ctgctcctccctggctgccc

SEQ ID NO: 3237334 - DNA, 23 bp, Homo sapiens
ctgctcctccctggctgccctgg

SEQ ID NO: 3237335 - DNA, 23 bp, Homo sapiens
ctgctcctctccccagcaagtga

SEQ ID NO: 3237336 - DNA, 13 bp, Homo sapiens
ctgctcctgcagc

SEQ ID NO: 3237337 - DNA, 14 bp, Homo sapiens
ctgctcctgcagca

SEQ ID NO: 3237338 - DNA, 20 bp, Homo sapiens
ctgctcctggagcctttgaa

SEQ ID NO: 3237339 - DNA, 22 bp, Homo sapiens
ctgctccttcactgttccctct

SEQ ID NO: 3237340 - DNA, 20 bp, Homo sapiens
ctgctccttggcttacctga

SEQ ID NO: 3237341 - DNA, 23 bp, Homo sapiens
ctgctccttttgtatcttccttt

SEQ ID NO: 3237342 - DNA, 18 bp, Homo sapiens
ctgctcgcccaggaaggc

SEQ ID NO: 3237343 - DNA, 23 bp, Homo sapiens
ctgctcgcccaggaaggcctagg

SEQ ID NO: 3237344 - DNA, 15 bp, Homo sapiens
ctgctcgccctcctt

SEQ ID NO: 3237345 - DNA, 19 bp, Homo sapiens
ctgctcgccctcctttctg

SEQ ID NO: 3237346 - DNA, 22 bp, Homo sapiens
ctgctcgccctcctttctgtgc

SEQ ID NO: 3237347 - DNA, 15 bp, Homo sapiens
ctgctctaacacctg

SEQ ID NO: 3237348 - DNA, 20 bp, Homo sapiens
ctgctctagctggcaggaca

SEQ ID NO: 3237349 - DNA, 17 bp, Homo sapiens
ctgctctagtgggacag

SEQ ID NO: 3237350 - DNA, 17 bp, Homo sapiens
ctgctctcccctcccag

SEQ ID NO: 3237351 - DNA, 19 bp, Homo sapiens
ctgctctccgaccagacac

SEQ ID NO: 3237352 - DNA, 21 bp, Homo sapiens
ctgctctcctcttgccactgc

SEQ ID NO: 3237353 - DNA, 14 bp, Homo sapiens
ctgctctgagcatc

SEQ ID NO: 3237354 - DNA, 23 bp, Homo sapiens
ctgctctgagttatgttaaaatc

SEQ ID NO: 3237355 - DNA, 13 bp, Homo sapiens
ctgctctgcccct

SEQ ID NO: 3237356 - DNA, 14 bp, Homo sapiens
ctgctctgcccctt

SEQ ID NO: 3237357 - DNA, 23 bp, Homo sapiens
ctgctctggaataaagttgcaga

SEQ ID NO: 3237358 - DNA, 15 bp, Homo sapiens
ctgctcttagtgccc

SEQ ID NO: 3237359 - DNA, 17 bp, Homo sapiens
ctgctcttagtgcccgc

SEQ ID NO: 3237360 - DNA, 14 bp, Homo sapiens
ctgctcttgaacat

SEQ ID NO: 3237361 - DNA, 17 bp, Homo sapiens
ctgctcttgaacattgt

SEQ ID NO: 3237362 - DNA, 20 bp, Homo sapiens
ctgctgaaaaccatctggcc

SEQ ID NO: 3237363 - DNA, 22 bp, Homo sapiens
ctgctgaaaaccatctggcctg

SEQ ID NO: 3237364 - DNA, 23 bp, Homo sapiens
ctgctgaaaaccatctggcctgg

SEQ ID NO: 3237365 - DNA, 18 bp, Homo sapiens
ctgctgaaggaataaatt

SEQ ID NO: 3237366 - DNA, 19 bp, Homo sapiens
ctgctgacagacacaggcc

SEQ ID NO: 3237367 - DNA, 20 bp, Homo sapiens
ctgctgagagcccccacctt

SEQ ID NO: 3237368 - DNA, 13 bp, Homo sapiens
ctgctgagccact

SEQ ID NO: 3237369 - DNA, 18 bp, Homo sapiens
ctgctgagctgggcccag

SEQ ID NO: 3237370 - DNA, 20 bp, Homo sapiens
ctgctgagctgggcccagcc

SEQ ID NO: 3237371 - DNA, 20 bp, Homo sapiens
ctgctgagtcagactgtcag

SEQ ID NO: 3237372 - DNA, 13 bp, Homo sapiens
ctgctgataaaat

SEQ ID NO: 3237373 - DNA, 17 bp, Homo sapiens
ctgctgcaccagagtga

SEQ ID NO: 3237374 - DNA, 18 bp, Homo sapiens
ctgctgcacccaactact

SEQ ID NO: 3237375 - DNA, 19 bp, Homo sapiens
ctgctgcacccaactactg

SEQ ID NO: 3237376 - DNA, 14 bp, Homo sapiens
ctgctgcaggggct

SEQ ID NO: 3237377 - DNA, 17 bp, Homo sapiens
ctgctgcaggggctctg

SEQ ID NO: 3237378 - DNA, 16 bp, Homo sapiens
ctgctgcatagctcta

SEQ ID NO: 3237379 - DNA, 14 bp, Homo sapiens
ctgctgccagtgca

SEQ ID NO: 3237380 - DNA, 22 bp, Homo sapiens
ctgctgccatggcgtgtccctc

SEQ ID NO: 3237381 - DNA, 14 bp, Homo sapiens
ctgctgcccaatct

SEQ ID NO: 3237382 - DNA, 15 bp, Homo sapiens
ctgctgcccaggcca

SEQ ID NO: 3237383 - DNA, 19 bp, Homo sapiens
ctgctgcccaggccacagc

SEQ ID NO: 3237384 - DNA, 17 bp, Homo sapiens
ctgctgcccatgtttca

SEQ ID NO: 3237385 - DNA, 14 bp, Homo sapiens
ctgctgccccagct

SEQ ID NO: 3237386 - DNA, 14 bp, Homo sapiens
ctgctgccgcctcc

SEQ ID NO: 3237387 - DNA, 21 bp, Homo sapiens
ctgctgccgcctcccagcctg

SEQ ID NO: 3237388 - DNA, 17 bp, Homo sapiens
ctgctgcctctttccct

SEQ ID NO: 3237389 - DNA, 21 bp, Homo sapiens
ctgctgcctctttccctagga

SEQ ID NO: 3237390 - DNA, 23 bp, Homo sapiens
ctgctgccttctgacggccctgc

SEQ ID NO: 3237391 - DNA, 17 bp, Homo sapiens
ctgctgcggaggagctg

SEQ ID NO: 3237392 - DNA, 14 bp, Homo sapiens
ctgctgctaccagc

SEQ ID NO: 3237393 - DNA, 12 bp, Homo sapiens
ctgctgctgcac

SEQ ID NO: 3237394 - DNA, 13 bp, Homo sapiens
ctgctgctgcacc

SEQ ID NO: 3237395 - DNA, 14 bp, Homo sapiens
ctgctgctgcaccc

SEQ ID NO: 3237396 - DNA, 19 bp, Homo sapiens
ctgctgctgccagggcttc

SEQ ID NO: 3237397 - DNA, 22 bp, Homo sapiens
ctgctgctgtaactgctgagcc

SEQ ID NO: 3237398 - DNA, 22 bp, Homo sapiens
ctgctgctttttgaggtggcac

SEQ ID NO: 3237399 - DNA, 16 bp, Homo sapiens
ctgctggacagcctcc

SEQ ID NO: 3237400 - DNA, 19 bp, Homo sapiens
ctgctggacagcctccgcc

SEQ ID NO: 3237401 - DNA, 18 bp, Homo sapiens
ctgctggagtctggcttt

SEQ ID NO: 3237402 - DNA, 20 bp, Homo sapiens
ctgctggagtctggctttac

SEQ ID NO: 3237403 - DNA, 21 bp, Homo sapiens
ctgctggagtctggctttacc

SEQ ID NO: 3237404 - DNA, 17 bp, Homo sapiens
ctgctggcacccaccgt

SEQ ID NO: 3237405 - DNA, 15 bp, Homo sapiens
ctgctggcatcaaga

SEQ ID NO: 3237406 - DNA, 12 bp, Homo sapiens
ctgctggcctgg

SEQ ID NO: 3237407 - DNA, 19 bp, Homo sapiens
ctgctggctgcggccccct

SEQ ID NO: 3237408 - DNA, 20 bp, Homo sapiens
ctgctggcttccagcttcag

SEQ ID NO: 3237409 - DNA, 19 bp, Homo sapiens
ctgctgggaaccccgcagc

SEQ ID NO: 3237410 - DNA, 16 bp, Homo sapiens
ctgctgggagttctag

SEQ ID NO: 3237411 - DNA, 17 bp, Homo sapiens
ctgctgggagttctaga

SEQ ID NO: 3237412 - DNA, 14 bp, Homo sapiens
ctgctggggcatgt

SEQ ID NO: 3237413 - DNA, 19 bp, Homo sapiens
ctgctggggcatgtgtgcc

SEQ ID NO: 3237414 - DNA, 22 bp, Homo sapiens
ctgctggggcatgtgtgcctgt

SEQ ID NO: 3237415 - DNA, 18 bp, Homo sapiens
ctgctggtacctgccctc

SEQ ID NO: 3237416 - DNA, 23 bp, Homo sapiens
ctgctggttcagggttggcccct

SEQ ID NO: 3237417 - DNA, 15 bp, Homo sapiens
ctgctgtaaatacag

SEQ ID NO: 3237418 - DNA, 17 bp, Homo sapiens
ctgctgtaactgctgag

SEQ ID NO: 3237419 - DNA, 18 bp, Homo sapiens
ctgctgtaactgctgagc

SEQ ID NO: 3237420 - DNA, 23 bp, Homo sapiens
ctgctgtaactgctgagccactc

SEQ ID NO: 3237421 - DNA, 19 bp, Homo sapiens
ctgctgtacccagatgcct

SEQ ID NO: 3237422 - DNA, 18 bp, Homo sapiens
ctgctgtcgctctcagtt

SEQ ID NO: 3237423 - DNA, 12 bp, Homo sapiens
ctgctgtcttcc

SEQ ID NO: 3237424 - DNA, 14 bp, Homo sapiens
ctgctgtcttccaa

SEQ ID NO: 3237425 - DNA, 17 bp, Homo sapiens
ctgctgtcttccccacc

SEQ ID NO: 3237426 - DNA, 21 bp, Homo sapiens
ctgctgtcttccccaccgcag

SEQ ID NO: 3237427 - DNA, 16 bp, Homo sapiens
ctgctgtgattccact

SEQ ID NO: 3237428 - DNA, 22 bp, Homo sapiens
ctgctgtgattccactacacct

SEQ ID NO: 3237429 - DNA, 16 bp, Homo sapiens
ctgctgtgcagcatgg

SEQ ID NO: 3237430 - DNA, 17 bp, Homo sapiens
ctgctgtgccatgctgg

SEQ ID NO: 3237431 - DNA, 21 bp, Homo sapiens
ctgctgtgccatgctgggcca

SEQ ID NO: 3237432 - DNA, 14 bp, Homo sapiens
ctgctgtgctgctc

SEQ ID NO: 3237433 - DNA, 22 bp, Homo sapiens
ctgcttaatcttcaaagccttc

SEQ ID NO: 3237434 - DNA, 16 bp, Homo sapiens
ctgcttaggagagacc

SEQ ID NO: 3237435 - DNA, 14 bp, Homo sapiens
ctgcttcaaatatt

SEQ ID NO: 3237436 - DNA, 13 bp, Homo sapiens
ctgcttcacttcc

SEQ ID NO: 3237437 - DNA, 13 bp, Homo sapiens
ctgcttcagcctc

SEQ ID NO: 3237438 - DNA, 24 bp, Homo sapiens
ctgcttccaattttctggaataca

SEQ ID NO: 3237439 - DNA, 11 bp, Homo sapiens
ctgcttccagg

SEQ ID NO: 3237440 - DNA, 14 bp, Homo sapiens
ctgcttcccatcct

SEQ ID NO: 3237441 - DNA, 15 bp, Homo sapiens
ctgcttccccttcct

SEQ ID NO: 3237442 - DNA, 17 bp, Homo sapiens
ctgcttccccttcctaa

SEQ ID NO: 3237443 - DNA, 19 bp, Homo sapiens
ctgcttccggtagggaggc

SEQ ID NO: 3237444 - DNA, 23 bp, Homo sapiens
ctgcttccggtagggaggcagcc

SEQ ID NO: 3237445 - DNA, 12 bp, Homo sapiens
ctgcttcctcct

SEQ ID NO: 3237446 - DNA, 13 bp, Homo sapiens
ctgcttcctcctg

SEQ ID NO: 3237447 - DNA, 14 bp, Homo sapiens
ctgcttcctcctgg

SEQ ID NO: 3237448 - DNA, 15 bp, Homo sapiens
ctgcttcctcctgga

SEQ ID NO: 3237449 - DNA, 16 bp, Homo sapiens
ctgcttcctcctggaa

SEQ ID NO: 3237450 - DNA, 17 bp, Homo sapiens
ctgcttcctgaaataaa

SEQ ID NO: 3237451 - DNA, 20 bp, Homo sapiens
ctgcttcctgaaataaacac

SEQ ID NO: 3237452 - DNA, 15 bp, Homo sapiens
ctgcttctccagcct

SEQ ID NO: 3237453 - DNA, 16 bp, Homo sapiens
ctgcttctccagcctg

SEQ ID NO: 3237454 - DNA, 15 bp, Homo sapiens
cttaaaataagcagg

SEQ ID NO: 3237455 - DNA, 23 bp, Homo sapiens
cttaaaataattaaataaatgaa

SEQ ID NO: 3237456 - DNA, 24 bp, Homo sapiens
cttaaaataattaaataaatgaat

SEQ ID NO: 3237457 - DNA, 18 bp, Homo sapiens
cttaaaatattcctgcat

SEQ ID NO: 3237458 - DNA, 20 bp, Homo sapiens
cttaaaatattcctgcattt

SEQ ID NO: 3237459 - DNA, 13 bp, Homo sapiens
cttaaacaatgta

SEQ ID NO: 3237460 - DNA, 17 bp, Homo sapiens
cttaaacaatgtataaa

SEQ ID NO: 3237461 - DNA, 15 bp, Homo sapiens
cttaaactaaataat

SEQ ID NO: 3237462 - DNA, 16 bp, Homo sapiens
cttaaactaaataatg

SEQ ID NO: 3237463 - DNA, 16 bp, Homo sapiens
cttaaagaaacagctt

SEQ ID NO: 3237464 - DNA, 17 bp, Homo sapiens
cttaaagaaacagcttt

SEQ ID NO: 3237465 - DNA, 23 bp, Homo sapiens
cttaaagaaacagctttcaagtg

SEQ ID NO: 3237466 - DNA, 12 bp, Homo sapiens
cttaaagaaagt

SEQ ID NO: 3237467 - DNA, 21 bp, Homo sapiens
cttaaagaaagtcgaattaat

SEQ ID NO: 3237468 - DNA, 22 bp, Homo sapiens
cttaaagagggacaggctgaag

SEQ ID NO: 3237469 - DNA, 13 bp, Homo sapiens
cttaaaggcctgg

SEQ ID NO: 3237470 - DNA, 14 bp, Homo sapiens
cttaaaggcctgga

SEQ ID NO: 3237471 - DNA, 22 bp, Homo sapiens
cttaaagggcccaatgaattat

SEQ ID NO: 3237472 - DNA, 14 bp, Homo sapiens
cttaaatacagata

SEQ ID NO: 3237473 - DNA, 19 bp, Homo sapiens
cttaaatacagataattca

SEQ ID NO: 3237474 - DNA, 15 bp, Homo sapiens
cttaaataggaaagt

SEQ ID NO: 3237475 - DNA, 13 bp, Homo sapiens
cttaaatatagtt

SEQ ID NO: 3237476 - DNA, 22 bp, Homo sapiens
cttaaatatagttcctaagaag

SEQ ID NO: 3237477 - DNA, 20 bp, Homo sapiens
cttaaatatatgatttatat

SEQ ID NO: 3237478 - DNA, 16 bp, Homo sapiens
cttaaatggaattatt

SEQ ID NO: 3237479 - DNA, 21 bp, Homo sapiens
cttaaatggaattattttgaa

SEQ ID NO: 3237480 - DNA, 12 bp, Homo sapiens
cttaaatgttta

SEQ ID NO: 3237481 - DNA, 16 bp, Homo sapiens
cttaaatgtttatact

SEQ ID NO: 3237482 - DNA, 20 bp, Homo sapiens
cttaaatgtttatactgtat

SEQ ID NO: 3237483 - DNA, 17 bp, Homo sapiens
cttaaattatgttttaa

SEQ ID NO: 3237484 - DNA, 14 bp, Homo sapiens
cttaaattcctcaa

SEQ ID NO: 3237485 - DNA, 20 bp, Homo sapiens
cttaaattcctcaacagtgt

SEQ ID NO: 3237486 - DNA, 22 bp, Homo sapiens
cttaaattcctcaacagtgttt

SEQ ID NO: 3237487 - DNA, 18 bp, Homo sapiens
cttaaattttaactaaat

SEQ ID NO: 3237488 - DNA, 23 bp, Homo sapiens
cttaaattttaactaaattttaa

SEQ ID NO: 3237489 - DNA, 17 bp, Homo sapiens
cttaacaaaccaacatc

SEQ ID NO: 3237490 - DNA, 19 bp, Homo sapiens
cttaacaaaccaacatctt

SEQ ID NO: 3237491 - DNA, 17 bp, Homo sapiens
cttaacaacctggccgc

SEQ ID NO: 3237492 - DNA, 15 bp, Homo sapiens
cttaacatccctcct

SEQ ID NO: 3237493 - DNA, 13 bp, Homo sapiens
cttaacatgggct

SEQ ID NO: 3237494 - DNA, 14 bp, Homo sapiens
cttaacattctgta

SEQ ID NO: 3237495 - DNA, 16 bp, Homo sapiens
cttaacccaaggagca

SEQ ID NO: 3237496 - DNA, 21 bp, Homo sapiens
cttaacctactaatagtttgt

SEQ ID NO: 3237497 - DNA, 18 bp, Homo sapiens
cttaacctttccgctgtc

SEQ ID NO: 3237498 - DNA, 14 bp, Homo sapiens
cttaacggctccag

SEQ ID NO: 3237499 - DNA, 16 bp, Homo sapiens
cttaacggctccagga

SEQ ID NO: 3237500 - DNA, 14 bp, Homo sapiens
cttaacttcttgct

SEQ ID NO: 3237501 - DNA, 16 bp, Homo sapiens
cttaagagaaatggca

SEQ ID NO: 3237502 - DNA, 22 bp, Homo sapiens
cttaagatttttcttttccgca

SEQ ID NO: 3237503 - DNA, 14 bp, Homo sapiens
cttaagcaaaagaa

SEQ ID NO: 3237504 - DNA, 17 bp, Homo sapiens
cttaagcaaaagaaaaa

SEQ ID NO: 3237505 - DNA, 11 bp, Homo sapiens
cttaagcacaa

SEQ ID NO: 3237506 - DNA, 14 bp, Homo sapiens
cttaagcagcatgg

SEQ ID NO: 3237507 - DNA, 15 bp, Homo sapiens
cttaagcagcatgga

SEQ ID NO: 3237508 - DNA, 21 bp, Homo sapiens
cttaagcagcatggaaaaatg

SEQ ID NO: 3237509 - DNA, 15 bp, Homo sapiens
cttaagcatctggct

SEQ ID NO: 3237510 - DNA, 23 bp, Homo sapiens
cttaagctttggacccaaggaaa

SEQ ID NO: 3237511 - DNA, 21 bp, Homo sapiens
cttaaggatggagccagctct

SEQ ID NO: 3237512 - DNA, 22 bp, Homo sapiens
cttaagtcccagtatacctcat

SEQ ID NO: 3237513 - DNA, 17 bp, Homo sapiens
cttaataaaaatgacag

SEQ ID NO: 3237514 - DNA, 20 bp, Homo sapiens
cttaataaaaatgacagact

SEQ ID NO: 3237515 - DNA, 21 bp, Homo sapiens
cttaataaaaatgacagactg

SEQ ID NO: 3237516 - DNA, 18 bp, Homo sapiens
cttaatactaccttgaaa

SEQ ID NO: 3237517 - DNA, 14 bp, Homo sapiens
cttaatagcaacag

SEQ ID NO: 3237518 - DNA, 17 bp, Homo sapiens
cttaatagtatttatga

SEQ ID NO: 3237519 - DNA, 14 bp, Homo sapiens
cttaatatgttaac

SEQ ID NO: 3237520 - DNA, 14 bp, Homo sapiens
cttaatgacaacac

SEQ ID NO: 3237521 - DNA, 18 bp, Homo sapiens
cttaatgacattcccctc

SEQ ID NO: 3237522 - DNA, 17 bp, Homo sapiens
cttaatggagttcttgt

SEQ ID NO: 3237523 - DNA, 18 bp, Homo sapiens
cttaatggagttcttgtg

SEQ ID NO: 3237524 - DNA, 20 bp, Homo sapiens
cttaatgtgattactgctct

SEQ ID NO: 3237525 - DNA, 22 bp, Homo sapiens
cttaatgtgattactgctctat

SEQ ID NO: 3237526 - DNA, 15 bp, Homo sapiens
cttaattaatttgat

SEQ ID NO: 3237527 - DNA, 17 bp, Homo sapiens
cttaattaatttgatta

SEQ ID NO: 3237528 - DNA, 18 bp, Homo sapiens
cttaattattatttgtgt

SEQ ID NO: 3237529 - DNA, 19 bp, Homo sapiens
cttaattcctttctcatcc

SEQ ID NO: 3237530 - DNA, 18 bp, Homo sapiens
cttaattctttgttctgt

SEQ ID NO: 3237531 - DNA, 20 bp, Homo sapiens
cttaattctttgttctgttt

SEQ ID NO: 3237532 - DNA, 23 bp, Homo sapiens
cttaatttatttcttaacctttg

SEQ ID NO: 3237533 - DNA, 12 bp, Homo sapiens
cttaatttctaa

SEQ ID NO: 3237534 - DNA, 13 bp, Homo sapiens
cttaatttgcaca

SEQ ID NO: 3237535 - DNA, 13 bp, Homo sapiens
cttaatttgtaaa

SEQ ID NO: 3237536 - DNA, 15 bp, Homo sapiens
cttaatttgtaaact

SEQ ID NO: 3237537 - DNA, 23 bp, Homo sapiens
cttaatttgtaaacttctgaaga

SEQ ID NO: 3237538 - DNA, 14 bp, Homo sapiens
cttaattttcagta

SEQ ID NO: 3237539 - DNA, 13 bp, Homo sapiens
cttacaaaaatgg

SEQ ID NO: 3237540 - DNA, 14 bp, Homo sapiens
cttacaatcaaatc

SEQ ID NO: 3237541 - DNA, 15 bp, Homo sapiens
cttacaatctttatt

SEQ ID NO: 3237542 - DNA, 16 bp, Homo sapiens
cttacaattgcactgc

SEQ ID NO: 3237543 - DNA, 21 bp, Homo sapiens
cttacaattgcactgctgttc

SEQ ID NO: 3237544 - DNA, 17 bp, Homo sapiens
cttacacatacagtttt

SEQ ID NO: 3237545 - DNA, 22 bp, Homo sapiens
cttacaccagtttgactgtgct

SEQ ID NO: 3237546 - DNA, 20 bp, Homo sapiens
cttacactgcctgtatactt

SEQ ID NO: 3237547 - DNA, 18 bp, Homo sapiens
cttacacttggagcccgt

SEQ ID NO: 3237548 - DNA, 23 bp, Homo sapiens
cttacacttggagcccgtgcagt

SEQ ID NO: 3237549 - DNA, 16 bp, Homo sapiens
cttacataatttttta

SEQ ID NO: 3237550 - DNA, 14 bp, Homo sapiens
cttacatgcatttg

SEQ ID NO: 3237551 - DNA, 22 bp, Homo sapiens
cttacattagcagtttgctttg

SEQ ID NO: 3237552 - DNA, 12 bp, Homo sapiens
cttacatttgtg

SEQ ID NO: 3237553 - DNA, 14 bp, Homo sapiens
cttacatttttaca

SEQ ID NO: 3237554 - DNA, 15 bp, Homo sapiens
cttaccaactttctg

SEQ ID NO: 3237555 - DNA, 16 bp, Homo sapiens
cttaccaactttctgt

SEQ ID NO: 3237556 - DNA, 17 bp, Homo sapiens
cttaccaactttctgta

SEQ ID NO: 3237557 - DNA, 13 bp, Homo sapiens
cttaccagaagct

SEQ ID NO: 3237558 - DNA, 22 bp, Homo sapiens
cttaccagatgctactggactt

SEQ ID NO: 3237559 - DNA, 22 bp, Homo sapiens
cttacccaaactgttcaagaaa

SEQ ID NO: 3237560 - DNA, 15 bp, Homo sapiens
cttacccaatttccc

SEQ ID NO: 3237561 - DNA, 19 bp, Homo sapiens
cttacctgacctcttgctg

SEQ ID NO: 3237562 - DNA, 19 bp, Homo sapiens
cttacctgggcattcttgt

SEQ ID NO: 3237563 - DNA, 20 bp, Homo sapiens
cttacctgtatgtctccagt

SEQ ID NO: 3237564 - DNA, 13 bp, Homo sapiens
cttacctttttat

SEQ ID NO: 3237565 - DNA, 16 bp, Homo sapiens
cttactacactgagga

SEQ ID NO: 3237566 - DNA, 22 bp, Homo sapiens
cttactattttgacagttattt

SEQ ID NO: 3237567 - DNA, 19 bp, Homo sapiens
cttactcattactgcaaat

SEQ ID NO: 3237568 - DNA, 20 bp, Homo sapiens
cttactctaagatcttagat

SEQ ID NO: 3237569 - DNA, 22 bp, Homo sapiens
cttactctgagcccaggccgtt

SEQ ID NO: 3237570 - DNA, 18 bp, Homo sapiens
cttactgaagaaatcttt

SEQ ID NO: 3237571 - DNA, 22 bp, Homo sapiens
cttactgaagaaatctttccag

SEQ ID NO: 3237572 - DNA, 15 bp, Homo sapiens
cttactgatatattt

SEQ ID NO: 3237573 - DNA, 14 bp, Homo sapiens
cttactgatattat

SEQ ID NO: 3237574 - DNA, 15 bp, Homo sapiens
cttactgtacctgtt

SEQ ID NO: 3237575 - DNA, 18 bp, Homo sapiens
cttactgtacctgttcct

SEQ ID NO: 3237576 - DNA, 16 bp, Homo sapiens
cttactgtatatgtat

SEQ ID NO: 3237577 - DNA, 19 bp, Homo sapiens
cttactgtatatgtattcc

SEQ ID NO: 3237578 - DNA, 18 bp, Homo sapiens
cttactgtggaggaagga

SEQ ID NO: 3237579 - DNA, 17 bp, Homo sapiens
cttactgtgtttcagca

SEQ ID NO: 3237580 - DNA, 14 bp, Homo sapiens
cttctccccacagc

SEQ ID NO: 3237581 - DNA, 16 bp, Homo sapiens
cttctccccacagcct

SEQ ID NO: 3237582 - DNA, 18 bp, Homo sapiens
cttctccccacagcctct

SEQ ID NO: 3237583 - DNA, 13 bp, Homo sapiens
cttctccccagaa

SEQ ID NO: 3237584 - DNA, 17 bp, Homo sapiens
cttctcccctccccgcc

SEQ ID NO: 3237585 - DNA, 18 bp, Homo sapiens
cttctccctattccctct

SEQ ID NO: 3237586 - DNA, 14 bp, Homo sapiens
cttctccgccagcc

SEQ ID NO: 3237587 - DNA, 16 bp, Homo sapiens
cttctccgccagcctc

SEQ ID NO: 3237588 - DNA, 17 bp, Homo sapiens
cttctccgccagcctcc

SEQ ID NO: 3237589 - DNA, 23 bp, Homo sapiens
cttctccgccagcctcctctgga

SEQ ID NO: 3237590 - DNA, 15 bp, Homo sapiens
cttctcctcccagcg

SEQ ID NO: 3237591 - DNA, 19 bp, Homo sapiens
cttctcctcccagcgtgtg

SEQ ID NO: 3237592 - DNA, 21 bp, Homo sapiens
cttctcctgcgccccgcccac

SEQ ID NO: 3237593 - DNA, 14 bp, Homo sapiens
cttctccttcccca

SEQ ID NO: 3237594 - DNA, 15 bp, Homo sapiens
cttctcggctcaggc

SEQ ID NO: 3237595 - DNA, 16 bp, Homo sapiens
cttctcggctcaggct

SEQ ID NO: 3237596 - DNA, 22 bp, Homo sapiens
cttctcggctcaggctctgctg

SEQ ID NO: 3237597 - DNA, 11 bp, Homo sapiens
cttctctacag

SEQ ID NO: 3237598 - DNA, 13 bp, Homo sapiens
cttctctacagac

SEQ ID NO: 3237599 - DNA, 14 bp, Homo sapiens
cttctctccagctg

SEQ ID NO: 3237600 - DNA, 16 bp, Homo sapiens
cttctctccagctgac

SEQ ID NO: 3237601 - DNA, 17 bp, Homo sapiens
cttctctccagctgact

SEQ ID NO: 3237602 - DNA, 13 bp, Homo sapiens
cttctctcctccc

SEQ ID NO: 3237603 - DNA, 15 bp, Homo sapiens
cttctctcctcccca

SEQ ID NO: 3237604 - DNA, 17 bp, Homo sapiens
cttctctgaacacaggc

SEQ ID NO: 3237605 - DNA, 20 bp, Homo sapiens
cttctctgaacacaggcagc

SEQ ID NO: 3237606 - DNA, 15 bp, Homo sapiens
cttctctgcaatgct

SEQ ID NO: 3237607 - DNA, 21 bp, Homo sapiens
cttctctgcagtaaaacacat

SEQ ID NO: 3237608 - DNA, 22 bp, Homo sapiens
cttctctgcagtaaaacacatt

SEQ ID NO: 3237609 - DNA, 13 bp, Homo sapiens
cttctctgctaga

SEQ ID NO: 3237610 - DNA, 18 bp, Homo sapiens
cttctctgctagatttct

SEQ ID NO: 3237611 - DNA, 13 bp, Homo sapiens
cttctctgctcca

SEQ ID NO: 3237612 - DNA, 21 bp, Homo sapiens
cttctctgctccaccacatcc

SEQ ID NO: 3237613 - DNA, 14 bp, Homo sapiens
cttctctgtctcag

SEQ ID NO: 3237614 - DNA, 21 bp, Homo sapiens
cttctctgttcccttgcaggg

SEQ ID NO: 3237615 - DNA, 16 bp, Homo sapiens
cttctcttaaacttgt

SEQ ID NO: 3237616 - DNA, 19 bp, Homo sapiens
cttctcttaaacttgtgaa

SEQ ID NO: 3237617 - DNA, 12 bp, Homo sapiens
cttctcttaatt

SEQ ID NO: 3237618 - DNA, 16 bp, Homo sapiens
cttctcttaatttaat

SEQ ID NO: 3237619 - DNA, 15 bp, Homo sapiens
cttctcttctctgca

SEQ ID NO: 3237620 - DNA, 15 bp, Homo sapiens
cttctgaaatgaaac

SEQ ID NO: 3237621 - DNA, 18 bp, Homo sapiens
cttctgaaccgcaaggag

SEQ ID NO: 3237622 - DNA, 18 bp, Homo sapiens
cttctgaactcaaactga

SEQ ID NO: 3237623 - DNA, 21 bp, Homo sapiens
cttctgaagactgagaacttt

SEQ ID NO: 3237624 - DNA, 19 bp, Homo sapiens
cttctgaagatcagaacat

SEQ ID NO: 3237625 - DNA, 14 bp, Homo sapiens
cttctgacggccct

SEQ ID NO: 3237626 - DNA, 18 bp, Homo sapiens
cttctgacggccctgcaa

SEQ ID NO: 3237627 - DNA, 22 bp, Homo sapiens
cttctgacgtgccttttgcacc

SEQ ID NO: 3237628 - DNA, 15 bp, Homo sapiens
cttctgactacttgt

SEQ ID NO: 3237629 - DNA, 18 bp, Homo sapiens
cttctgagctatttcatc

SEQ ID NO: 3237630 - DNA, 16 bp, Homo sapiens
cttctgcaactgaaat

SEQ ID NO: 3237631 - DNA, 17 bp, Homo sapiens
cttctgcaccctccacc

SEQ ID NO: 3237632 - DNA, 20 bp, Homo sapiens
cttctgcaccctccaccctg

SEQ ID NO: 3237633 - DNA, 22 bp, Homo sapiens
cttctgcaccctccaccctgtc

SEQ ID NO: 3237634 - DNA, 17 bp, Homo sapiens
cttctgcagcaggaact

SEQ ID NO: 3237635 - DNA, 22 bp, Homo sapiens
cttctgcagcaggaactctgga

SEQ ID NO: 3237636 - DNA, 17 bp, Homo sapiens
cttctgccatattctgt

SEQ ID NO: 3237637 - DNA, 16 bp, Homo sapiens
cttctgccctttccta

SEQ ID NO: 3237638 - DNA, 23 bp, Homo sapiens
cttctgccctttcctaggcccag

SEQ ID NO: 3237639 - DNA, 12 bp, Homo sapiens
cttctgcctgca

SEQ ID NO: 3237640 - DNA, 19 bp, Homo sapiens
cttctgccttagtctcagt

SEQ ID NO: 3237641 - DNA, 10 bp, Homo sapiens
cttctgctcc

SEQ ID NO: 3237642 - DNA, 15 bp, Homo sapiens
cttctgctgcccagg

SEQ ID NO: 3237643 - DNA, 15 bp, Homo sapiens
cttctgctggataaa

SEQ ID NO: 3237644 - DNA, 16 bp, Homo sapiens
cttctgcttcagcctc

SEQ ID NO: 3237645 - DNA, 14 bp, Homo sapiens
cttctgcttttcaa

SEQ ID NO: 3237646 - DNA, 16 bp, Homo sapiens
cttctgcttttctgcc

SEQ ID NO: 3237647 - DNA, 18 bp, Homo sapiens
cttctgcttttctgccct

SEQ ID NO: 3237648 - DNA, 23 bp, Homo sapiens
cttctgcttttctgccctggctg

SEQ ID NO: 3237649 - DNA, 18 bp, Homo sapiens
cttctggaaggctggctg

SEQ ID NO: 3237650 - DNA, 13 bp, Homo sapiens
cttctggagccct

SEQ ID NO: 3237651 - DNA, 14 bp, Homo sapiens
cttctggagccctt

SEQ ID NO: 3237652 - DNA, 12 bp, Homo sapiens
cttctggctcaa

SEQ ID NO: 3237653 - DNA, 17 bp, Homo sapiens
cttctgggactggacag

SEQ ID NO: 3237654 - DNA, 22 bp, Homo sapiens
cttctgggcttcatctggcaac

SEQ ID NO: 3237655 - DNA, 14 bp, Homo sapiens
cttctggggcaggc

SEQ ID NO: 3237656 - DNA, 15 bp, Homo sapiens
cttctggggcaggct

SEQ ID NO: 3237657 - DNA, 20 bp, Homo sapiens
cttctggggcaggctgggcc

SEQ ID NO: 3237658 - DNA, 15 bp, Homo sapiens
cttctggtactctcc

SEQ ID NO: 3237659 - DNA, 19 bp, Homo sapiens
cttctggtactctcctaga

SEQ ID NO: 3237660 - DNA, 15 bp, Homo sapiens
cttctggtactttct

SEQ ID NO: 3237661 - DNA, 15 bp, Homo sapiens
cttctggtctgtgtg

SEQ ID NO: 3237662 - DNA, 21 bp, Homo sapiens
cttctggtgctactccatgca

SEQ ID NO: 3237663 - DNA, 19 bp, Homo sapiens
cttctggttgtatttctat

SEQ ID NO: 3237664 - DNA, 15 bp, Homo sapiens
cttctgtacgtctga

SEQ ID NO: 3237665 - DNA, 21 bp, Homo sapiens
cttctgtagtactccttaaga

SEQ ID NO: 3237666 - DNA, 22 bp, Homo sapiens
cttctgtatttttttttctaag

SEQ ID NO: 3237667 - DNA, 15 bp, Homo sapiens
cttctgtccccagcc

SEQ ID NO: 3237668 - DNA, 19 bp, Homo sapiens
cttctgtgaaatataattg

SEQ ID NO: 3237669 - DNA, 15 bp, Homo sapiens
cttctgtgatgagct

SEQ ID NO: 3237670 - DNA, 17 bp, Homo sapiens
cttctgtgatgagctga

SEQ ID NO: 3237671 - DNA, 19 bp, Homo sapiens
cttctgtgatgagctgatc

SEQ ID NO: 3237672 - DNA, 13 bp, Homo sapiens
cttctgtggctca

SEQ ID NO: 3237673 - DNA, 13 bp, Homo sapiens
cttctgtgggccc

SEQ ID NO: 3237674 - DNA, 19 bp, Homo sapiens
cttctgtgggcccctcaac

SEQ ID NO: 3237675 - DNA, 20 bp, Homo sapiens
cttctgtggtccctctgtgt

SEQ ID NO: 3237676 - DNA, 16 bp, Homo sapiens
cttctgtgttcatttt

SEQ ID NO: 3237677 - DNA, 13 bp, Homo sapiens
cttctgtttctag

SEQ ID NO: 3237678 - DNA, 16 bp, Homo sapiens
cttctgtttctagttg

SEQ ID NO: 3237679 - DNA, 13 bp, Homo sapiens
cttcttaaagagt

SEQ ID NO: 3237680 - DNA, 14 bp, Homo sapiens
cttcttaaaggcct

SEQ ID NO: 3237681 - DNA, 15 bp, Homo sapiens
cttcttaaaggcctg

SEQ ID NO: 3237682 - DNA, 19 bp, Homo sapiens
cttcttaaaggcctggaac

SEQ ID NO: 3237683 - DNA, 16 bp, Homo sapiens
cttcttacacttctta

SEQ ID NO: 3237684 - DNA, 14 bp, Homo sapiens
cttcttacatgcat

SEQ ID NO: 3237685 - DNA, 22 bp, Homo sapiens
cttcttagctatcattgcttcc

SEQ ID NO: 3237686 - DNA, 14 bp, Homo sapiens
cttcttcaaataca

SEQ ID NO: 3237687 - DNA, 19 bp, Homo sapiens
cttcttcaaatacaaagta

SEQ ID NO: 3237688 - DNA, 23 bp, Homo sapiens
cttcttcaaatacaaagtaaata

SEQ ID NO: 3237689 - DNA, 14 bp, Homo sapiens
cttcttccatccca

SEQ ID NO: 3237690 - DNA, 15 bp, Homo sapiens
cttcttcctttctct

SEQ ID NO: 3237691 - DNA, 19 bp, Homo sapiens
cttcttcctttctctttct

SEQ ID NO: 3237692 - DNA, 12 bp, Homo sapiens
cttcttctccat

SEQ ID NO: 3237693 - DNA, 14 bp, Homo sapiens
cttcttcttcagaa

SEQ ID NO: 3237694 - DNA, 17 bp, Homo sapiens
cttcttctttttgctgt

SEQ ID NO: 3237695 - DNA, 19 bp, Homo sapiens
cttcttgaatataaaaaat

SEQ ID NO: 3237696 - DNA, 13 bp, Homo sapiens
cttcttgcttctc

SEQ ID NO: 3237697 - DNA, 11 bp, Homo sapiens
cttcttgggat

SEQ ID NO: 3237698 - DNA, 13 bp, Homo sapiens
cttcttgggcccc

SEQ ID NO: 3237699 - DNA, 15 bp, Homo sapiens
cttcttgggccccag

SEQ ID NO: 3237700 - DNA, 19 bp, Homo sapiens
cttcttgggccccagaccc

SEQ ID NO: 3237701 - DNA, 16 bp, Homo sapiens
cttcttgtcagacata

SEQ ID NO: 3237702 - DNA, 19 bp, Homo sapiens
cttcttgtcagacataaag

SEQ ID NO: 3237703 - DNA, 15 bp, Homo sapiens
cttcttgtgttttac

SEQ ID NO: 3237704 - DNA, 21 bp, Homo sapiens
cttctttagaccctcgggccc

SEQ ID NO: 3237705 - DNA, 22 bp, Homo sapiens
cttctttataattctactttga

SEQ ID NO: 3237706 - DNA, 20 bp, Homo sapiens
cttctttatactgtaattta

SEQ ID NO: 3237707 - DNA, 23 bp, Homo sapiens
ctttaatgcatctagattatgga

SEQ ID NO: 3237708 - DNA, 23 bp, Homo sapiens
ctttaatgtcacaggcaggtcca

SEQ ID NO: 3237709 - DNA, 21 bp, Homo sapiens
ctttaatgttttttgccacag

SEQ ID NO: 3237710 - DNA, 19 bp, Homo sapiens
ctttaattaccaacctgtt

SEQ ID NO: 3237711 - DNA, 22 bp, Homo sapiens
ctttaattatatattttcatcc

SEQ ID NO: 3237712 - DNA, 19 bp, Homo sapiens
ctttaattctctttcaaag

SEQ ID NO: 3237713 - DNA, 23 bp, Homo sapiens
ctttacaggaaaaaaaattctgt

SEQ ID NO: 3237714 - DNA, 16 bp, Homo sapiens
ctttacatgctgtgct

SEQ ID NO: 3237715 - DNA, 17 bp, Homo sapiens
ctttacattcaactttt

SEQ ID NO: 3237716 - DNA, 18 bp, Homo sapiens
ctttacccacctagaaca

SEQ ID NO: 3237717 - DNA, 15 bp, Homo sapiens
ctttacctatggaag

SEQ ID NO: 3237718 - DNA, 22 bp, Homo sapiens
ctttacctatggaagtggttct

SEQ ID NO: 3237719 - DNA, 14 bp, Homo sapiens
ctttacctttttgt

SEQ ID NO: 3237720 - DNA, 19 bp, Homo sapiens
ctttacctttttgtatgtg

SEQ ID NO: 3237721 - DNA, 21 bp, Homo sapiens
ctttacctttttgtatgtgaa

SEQ ID NO: 3237722 - DNA, 21 bp, Homo sapiens
ctttacgtgtttaaaaaaaag

SEQ ID NO: 3237723 - DNA, 19 bp, Homo sapiens
ctttactatcattctcagt

SEQ ID NO: 3237724 - DNA, 16 bp, Homo sapiens
ctttactattaaaata

SEQ ID NO: 3237725 - DNA, 13 bp, Homo sapiens
ctttactcccaag

SEQ ID NO: 3237726 - DNA, 14 bp, Homo sapiens
ctttagaagcctgc

SEQ ID NO: 3237727 - DNA, 20 bp, Homo sapiens
ctttagaagtgcatttctga

SEQ ID NO: 3237728 - DNA, 20 bp, Homo sapiens
ctttagaccctcgggcccca

SEQ ID NO: 3237729 - DNA, 23 bp, Homo sapiens
ctttagaccctgggtgggctctg

SEQ ID NO: 3237730 - DNA, 19 bp, Homo sapiens
ctttagagaagtatacata

SEQ ID NO: 3237731 - DNA, 23 bp, Homo sapiens
ctttagagcattgccattccctg

SEQ ID NO: 3237732 - DNA, 12 bp, Homo sapiens
ctttagatgctg

SEQ ID NO: 3237733 - DNA, 19 bp, Homo sapiens
ctttagcacgtttaaagtt

SEQ ID NO: 3237734 - DNA, 15 bp, Homo sapiens
ctttagccaaaccct

SEQ ID NO: 3237735 - DNA, 16 bp, Homo sapiens
ctttagggcagcttgc

SEQ ID NO: 3237736 - DNA, 18 bp, Homo sapiens
ctttaggtttttttaatg

SEQ ID NO: 3237737 - DNA, 15 bp, Homo sapiens
ctttagtgccctgcc

SEQ ID NO: 3237738 - DNA, 17 bp, Homo sapiens
ctttagtgccctgcccc

SEQ ID NO: 3237739 - DNA, 23 bp, Homo sapiens
ctttagtgccctgccccctggct

SEQ ID NO: 3237740 - DNA, 18 bp, Homo sapiens
ctttagtgccggctgtgg

SEQ ID NO: 3237741 - DNA, 14 bp, Homo sapiens
ctttagtttttggt

SEQ ID NO: 3237742 - DNA, 13 bp, Homo sapiens
ctttataaacttt

SEQ ID NO: 3237743 - DNA, 13 bp, Homo sapiens
ctttataattcta

SEQ ID NO: 3237744 - DNA, 23 bp, Homo sapiens
ctttatacagctgtattgtctga

SEQ ID NO: 3237745 - DNA, 18 bp, Homo sapiens
ctttatacgtgtagctat

SEQ ID NO: 3237746 - DNA, 19 bp, Homo sapiens
ctttatacgtgtagctata

SEQ ID NO: 3237747 - DNA, 19 bp, Homo sapiens
ctttatatgaacatagact

SEQ ID NO: 3237748 - DNA, 13 bp, Homo sapiens
ctttatatgaaga

SEQ ID NO: 3237749 - DNA, 19 bp, Homo sapiens
ctttatcacattatttgca

SEQ ID NO: 3237750 - DNA, 13 bp, Homo sapiens
ctttatcactttt

SEQ ID NO: 3237751 - DNA, 17 bp, Homo sapiens
ctttatcactttttgaa

SEQ ID NO: 3237752 - DNA, 18 bp, Homo sapiens
ctttatcactttttgaac

SEQ ID NO: 3237753 - DNA, 22 bp, Homo sapiens
ctttatcagggaaactaagatt

SEQ ID NO: 3237754 - DNA, 21 bp, Homo sapiens
ctttatcatgaatgcttttag

SEQ ID NO: 3237755 - DNA, 15 bp, Homo sapiens
ctttatcattgctaa

SEQ ID NO: 3237756 - DNA, 16 bp, Homo sapiens
ctttatctctgaggct

SEQ ID NO: 3237757 - DNA, 13 bp, Homo sapiens
ctttatctgttct

SEQ ID NO: 3237758 - DNA, 14 bp, Homo sapiens
ctttatcttgacat

SEQ ID NO: 3237759 - DNA, 23 bp, Homo sapiens
ctttatctttccatgggagccag

SEQ ID NO: 3237760 - DNA, 22 bp, Homo sapiens
ctttatgagctaaaaatatgca

SEQ ID NO: 3237761 - DNA, 15 bp, Homo sapiens
ctttatgctgtattt

SEQ ID NO: 3237762 - DNA, 23 bp, Homo sapiens
ctttatgtggaaaacagaacatc

SEQ ID NO: 3237763 - DNA, 12 bp, Homo sapiens
ctttatgttgta

SEQ ID NO: 3237764 - DNA, 14 bp, Homo sapiens
ctttatgtttttct

SEQ ID NO: 3237765 - DNA, 15 bp, Homo sapiens
ctttattaatcacta

SEQ ID NO: 3237766 - DNA, 20 bp, Homo sapiens
ctttattaatcactattgtt

SEQ ID NO: 3237767 - DNA, 20 bp, Homo sapiens
ctttattacaatttgtatta

SEQ ID NO: 3237768 - DNA, 18 bp, Homo sapiens
ctttattatgcattctta

SEQ ID NO: 3237769 - DNA, 15 bp, Homo sapiens
ctttattatggcttg

SEQ ID NO: 3237770 - DNA, 16 bp, Homo sapiens
ctttattatggcttgt

SEQ ID NO: 3237771 - DNA, 18 bp, Homo sapiens
ctttattatggcttgtga

SEQ ID NO: 3237772 - DNA, 19 bp, Homo sapiens
ctttattatggcttgtgaa

SEQ ID NO: 3237773 - DNA, 20 bp, Homo sapiens
ctttattatggcttgtgaac

SEQ ID NO: 3237774 - DNA, 24 bp, Homo sapiens
ctttattatggcttgtgaactgct

SEQ ID NO: 3237775 - DNA, 11 bp, Homo sapiens
ctttattcaaa

SEQ ID NO: 3237776 - DNA, 14 bp, Homo sapiens
ctttattcttgctg

SEQ ID NO: 3237777 - DNA, 13 bp, Homo sapiens
ctttattctttgt

SEQ ID NO: 3237778 - DNA, 17 bp, Homo sapiens
ctttattgatatctcca

SEQ ID NO: 3237779 - DNA, 18 bp, Homo sapiens
ctttattgcccatgggat

SEQ ID NO: 3237780 - DNA, 14 bp, Homo sapiens
ctttattgcttttt

SEQ ID NO: 3237781 - DNA, 12 bp, Homo sapiens
ctttattggaaa

SEQ ID NO: 3237782 - DNA, 20 bp, Homo sapiens
ctttattgtacagactgttt

SEQ ID NO: 3237783 - DNA, 22 bp, Homo sapiens
ctttatttacttcgttttggtt

SEQ ID NO: 3237784 - DNA, 13 bp, Homo sapiens
ctttatttgtaaa

SEQ ID NO: 3237785 - DNA, 23 bp, Homo sapiens
ctttattttttaagtatttatat

SEQ ID NO: 3237786 - DNA, 14 bp, Homo sapiens
ctttcaaaaacatg

SEQ ID NO: 3237787 - DNA, 15 bp, Homo sapiens
ctttcaaaagggaag

SEQ ID NO: 3237788 - DNA, 14 bp, Homo sapiens
ctttcaaaatatat

SEQ ID NO: 3237789 - DNA, 15 bp, Homo sapiens
ctttcaaaatatatt

SEQ ID NO: 3237790 - DNA, 19 bp, Homo sapiens
ctttcaaaattaaatctgt

SEQ ID NO: 3237791 - DNA, 16 bp, Homo sapiens
ctttcaaagctaaaat

SEQ ID NO: 3237792 - DNA, 20 bp, Homo sapiens
ctttcaaagctaaaatatat

SEQ ID NO: 3237793 - DNA, 13 bp, Homo sapiens
ctttcaaatcggt

SEQ ID NO: 3237794 - DNA, 14 bp, Homo sapiens
ctttcaaatttcac

SEQ ID NO: 3237795 - DNA, 15 bp, Homo sapiens
ctttcaaatttcaca

SEQ ID NO: 3237796 - DNA, 20 bp, Homo sapiens
ctttcaagcagtcgtgcctg

SEQ ID NO: 3237797 - DNA, 20 bp, Homo sapiens
ctttcaagtctgactctcca

SEQ ID NO: 3237798 - DNA, 14 bp, Homo sapiens
ctttcaagtgcctt

SEQ ID NO: 3237799 - DNA, 20 bp, Homo sapiens
ctttcactaaaacacacagg

SEQ ID NO: 3237800 - DNA, 20 bp, Homo sapiens
ctttcagagaggtctcaggt

SEQ ID NO: 3237801 - DNA, 18 bp, Homo sapiens
ctttcagagccagtgaag

SEQ ID NO: 3237802 - DNA, 18 bp, Homo sapiens
ctttcagagcccccagcc

SEQ ID NO: 3237803 - DNA, 19 bp, Homo sapiens
ctttcagatacatggttgt

SEQ ID NO: 3237804 - DNA, 19 bp, Homo sapiens
ctttcagatgtcttctgcc

SEQ ID NO: 3237805 - DNA, 12 bp, Homo sapiens
ctttcagatgtt

SEQ ID NO: 3237806 - DNA, 17 bp, Homo sapiens
ctttcagcactcagaaa

SEQ ID NO: 3237807 - DNA, 15 bp, Homo sapiens
ctttcatctggggat

SEQ ID NO: 3237808 - DNA, 17 bp, Homo sapiens
ctttcatctggggtggg

SEQ ID NO: 3237809 - DNA, 15 bp, Homo sapiens
ctttcattcagctaa

SEQ ID NO: 3237810 - DNA, 21 bp, Homo sapiens
ctttcattcagctaacaaact

SEQ ID NO: 3237811 - DNA, 15 bp, Homo sapiens
ctttcattgccagtg

SEQ ID NO: 3237812 - DNA, 15 bp, Homo sapiens
ctttccaaggcttct

SEQ ID NO: 3237813 - DNA, 22 bp, Homo sapiens
ctttccacatttgtcacagaaa

SEQ ID NO: 3237814 - DNA, 15 bp, Homo sapiens
ctttccaccacagcc

SEQ ID NO: 3237815 - DNA, 13 bp, Homo sapiens
ctttccactttca

SEQ ID NO: 3237816 - DNA, 22 bp, Homo sapiens
ctttccatgggagccagctgct

SEQ ID NO: 3237817 - DNA, 24 bp, Homo sapiens
ctttccatgggagccagctgcttt

SEQ ID NO: 3237818 - DNA, 15 bp, Homo sapiens
ctttccatttacagt

SEQ ID NO: 3237819 - DNA, 13 bp, Homo sapiens
ctttcccaccatt

SEQ ID NO: 3237820 - DNA, 16 bp, Homo sapiens
ctttcccaccattcct

SEQ ID NO: 3237821 - DNA, 22 bp, Homo sapiens
ctttcccaccattcctgccttt

SEQ ID NO: 3237822 - DNA, 22 bp, Homo sapiens
ctttcccaccccacgccttatc

SEQ ID NO: 3237823 - DNA, 16 bp, Homo sapiens
ctttcccaccctgttc

SEQ ID NO: 3237824 - DNA, 20 bp, Homo sapiens
ctttcccagtgagtctctgg

SEQ ID NO: 3237825 - DNA, 23 bp, Homo sapiens
ctttccccaattacagggtgact

SEQ ID NO: 3237826 - DNA, 16 bp, Homo sapiens
ctttccccagatcaaa

SEQ ID NO: 3237827 - DNA, 22 bp, Homo sapiens
ctttccccagcatcactcccca

SEQ ID NO: 3237828 - DNA, 17 bp, Homo sapiens
ctttccccagcccaggg

SEQ ID NO: 3237829 - DNA, 18 bp, Homo sapiens
ctttcccccctccctcca

SEQ ID NO: 3237830 - DNA, 21 bp, Homo sapiens
ctttccccgggggaggaaggg

SEQ ID NO: 3237831 - DNA, 15 bp, Homo sapiens
ctttccccttcccct

SEQ ID NO: 3237832 - DNA, 20 bp, Homo sapiens
gaaaaatggttgatggaaaa

SEQ ID NO: 3237833 - DNA, 21 bp, Homo sapiens
gaaaaatggttgatggaaaat

SEQ ID NO: 3237834 - DNA, 16 bp, Homo sapiens
gaaaaattacagcttc

SEQ ID NO: 3237835 - DNA, 19 bp, Homo sapiens
gaaaaatttaagcattgtt

SEQ ID NO: 3237836 - DNA, 17 bp, Homo sapiens
gaaaaatttgaagtatt

SEQ ID NO: 3237837 - DNA, 18 bp, Homo sapiens
gaaaacaacttggcattt

SEQ ID NO: 3237838 - DNA, 20 bp, Homo sapiens
gaaaacaacttggcatttct

SEQ ID NO: 3237839 - DNA, 17 bp, Homo sapiens
gaaaacagagcctgcct

SEQ ID NO: 3237840 - DNA, 22 bp, Homo sapiens
gaaaacagatgaccataatttt

SEQ ID NO: 3237841 - DNA, 16 bp, Homo sapiens
gaaaacatgttaatga

SEQ ID NO: 3237842 - DNA, 20 bp, Homo sapiens
gaaaacatgttaatgacaat

SEQ ID NO: 3237843 - DNA, 16 bp, Homo sapiens
gaaaacattgcttttg

SEQ ID NO: 3237844 - DNA, 18 bp, Homo sapiens
gaaaacatttcaaagctg

SEQ ID NO: 3237845 - DNA, 14 bp, Homo sapiens
gaaaacattttatt

SEQ ID NO: 3237846 - DNA, 20 bp, Homo sapiens
gaaaaccaggaaaagggagc

SEQ ID NO: 3237847 - DNA, 21 bp, Homo sapiens
gaaaaccatctggcctggcct

SEQ ID NO: 3237848 - DNA, 14 bp, Homo sapiens
gaaaaccccagcat

SEQ ID NO: 3237849 - DNA, 12 bp, Homo sapiens
gaaaacctacca

SEQ ID NO: 3237850 - DNA, 18 bp, Homo sapiens
gaaaactccaccttccca

SEQ ID NO: 3237851 - DNA, 18 bp, Homo sapiens
gaaaactgaaaatctaat

SEQ ID NO: 3237852 - DNA, 21 bp, Homo sapiens
gaaaactgggtatgcgtttca

SEQ ID NO: 3237853 - DNA, 12 bp, Homo sapiens
gaaaactgtgtt

SEQ ID NO: 3237854 - DNA, 11 bp, Homo sapiens
gaaaactgtta

SEQ ID NO: 3237855 - DNA, 12 bp, Homo sapiens
gaaaacttcaaa

SEQ ID NO: 3237856 - DNA, 13 bp, Homo sapiens
gaaaacttcaaag

SEQ ID NO: 3237857 - DNA, 16 bp, Homo sapiens
gaaaacttcttttaaa

SEQ ID NO: 3237858 - DNA, 13 bp, Homo sapiens
gaaaactttaaaa

SEQ ID NO: 3237859 - DNA, 19 bp, Homo sapiens
gaaaactttaaaaaatatt

SEQ ID NO: 3237860 - DNA, 15 bp, Homo sapiens
gaaaagaaaacaaaa

SEQ ID NO: 3237861 - DNA, 19 bp, Homo sapiens
gaaaagaacgtattttaaa

SEQ ID NO: 3237862 - DNA, 19 bp, Homo sapiens
gaaaagaactgtttactgc

SEQ ID NO: 3237863 - DNA, 15 bp, Homo sapiens
gaaaagaaggaaaga

SEQ ID NO: 3237864 - DNA, 22 bp, Homo sapiens
gaaaagaccctgagactccaga

SEQ ID NO: 3237865 - DNA, 12 bp, Homo sapiens
gaaaagagaaac

SEQ ID NO: 3237866 - DNA, 20 bp, Homo sapiens
gaaaagataaagaccagaaa

SEQ ID NO: 3237867 - DNA, 22 bp, Homo sapiens
gaaaagatacgactttattttc

SEQ ID NO: 3237868 - DNA, 14 bp, Homo sapiens
gaaaagatttaagc

SEQ ID NO: 3237869 - DNA, 13 bp, Homo sapiens
gaaaagattttaa

SEQ ID NO: 3237870 - DNA, 17 bp, Homo sapiens
gaaaagattttaatcaa

SEQ ID NO: 3237871 - DNA, 15 bp, Homo sapiens
gaaaagcacttttgt

SEQ ID NO: 3237872 - DNA, 10 bp, Homo sapiens
gaaaagcata

SEQ ID NO: 3237873 - DNA, 19 bp, Homo sapiens
gaaaagcatacatgcaaaa

SEQ ID NO: 3237874 - DNA, 12 bp, Homo sapiens
gaaaagccaagc

SEQ ID NO: 3237875 - DNA, 23 bp, Homo sapiens
gaaaagcgtctttaagagactca

SEQ ID NO: 3237876 - DNA, 11 bp, Homo sapiens
gaaaagctatt

SEQ ID NO: 3237877 - DNA, 14 bp, Homo sapiens
gaaaagctattagc

SEQ ID NO: 3237878 - DNA, 19 bp, Homo sapiens
gaaaagctattagccagga

SEQ ID NO: 3237879 - DNA, 22 bp, Homo sapiens
gaaaagctgtacgcgtttgtct

SEQ ID NO: 3237880 - DNA, 14 bp, Homo sapiens
gaaaagcttcttaa

SEQ ID NO: 3237881 - DNA, 18 bp, Homo sapiens
gaaaagcttcttaattaa

SEQ ID NO: 3237882 - DNA, 22 bp, Homo sapiens
gaaaagcttcttaattaatttg

SEQ ID NO: 3237883 - DNA, 12 bp, Homo sapiens
gaaaaggaaaaa

SEQ ID NO: 3237884 - DNA, 15 bp, Homo sapiens
gaaaaggaagactag

SEQ ID NO: 3237885 - DNA, 18 bp, Homo sapiens
gaaaagggaatcattttt

SEQ ID NO: 3237886 - DNA, 14 bp, Homo sapiens
gaaaagggagaaaa

SEQ ID NO: 3237887 - DNA, 16 bp, Homo sapiens
gaaaagggagaaaaag

SEQ ID NO: 3237888 - DNA, 22 bp, Homo sapiens
gaaaagggagtttaaaaatggt

SEQ ID NO: 3237889 - DNA, 23 bp, Homo sapiens
gaaaaggtagaggagtcacgtta

SEQ ID NO: 3237890 - DNA, 23 bp, Homo sapiens
gaaaaggtagcttacctgacaca

SEQ ID NO: 3237891 - DNA, 16 bp, Homo sapiens
gaaaaggttgaataat

SEQ ID NO: 3237892 - DNA, 14 bp, Homo sapiens
gaaaagtaattttg

SEQ ID NO: 3237893 - DNA, 19 bp, Homo sapiens
gaaaagtatcactctaaaa

SEQ ID NO: 3237894 - DNA, 23 bp, Homo sapiens
gaaaagtatcactctaaaaaaca

SEQ ID NO: 3237895 - DNA, 16 bp, Homo sapiens
gaaaagtgaattgaag

SEQ ID NO: 3237896 - DNA, 20 bp, Homo sapiens
gaaaagtgcatatttatcca

SEQ ID NO: 3237897 - DNA, 18 bp, Homo sapiens
gaaaagtggcaagaccaa

SEQ ID NO: 3237898 - DNA, 19 bp, Homo sapiens
gaaaagtggcaagaccaaa

SEQ ID NO: 3237899 - DNA, 12 bp, Homo sapiens
gaaaagttattt

SEQ ID NO: 3237900 - DNA, 12 bp, Homo sapiens
gaaaagttcata

SEQ ID NO: 3237901 - DNA, 17 bp, Homo sapiens
gaaaataaacatcagtt

SEQ ID NO: 3237902 - DNA, 17 bp, Homo sapiens
gaaaataaagcagaagc

SEQ ID NO: 3237903 - DNA, 18 bp, Homo sapiens
gaaaataaagcagaagca

SEQ ID NO: 3237904 - DNA, 15 bp, Homo sapiens
gaaaataactgaacc

SEQ ID NO: 3237905 - DNA, 16 bp, Homo sapiens
gaaaataactgaacca

SEQ ID NO: 3237906 - DNA, 17 bp, Homo sapiens
gaaaataattgttccaa

SEQ ID NO: 3237907 - DNA, 13 bp, Homo sapiens
gaaaatacaataa

SEQ ID NO: 3237908 - DNA, 23 bp, Homo sapiens
gaaaataccacctcgagatgggt

SEQ ID NO: 3237909 - DNA, 19 bp, Homo sapiens
gaaaatacctattttatat

SEQ ID NO: 3237910 - DNA, 19 bp, Homo sapiens
gaaaataggcaggaagccc

SEQ ID NO: 3237911 - DNA, 16 bp, Homo sapiens
gaaaatagttcccttt

SEQ ID NO: 3237912 - DNA, 18 bp, Homo sapiens
gaaaatagtttaggagaa

SEQ ID NO: 3237913 - DNA, 15 bp, Homo sapiens
gaaaatatacatttg

SEQ ID NO: 3237914 - DNA, 18 bp, Homo sapiens
gaaaatcactttgtctaa

SEQ ID NO: 3237915 - DNA, 19 bp, Homo sapiens
gaaaatcgagttggcaaaa

SEQ ID NO: 3237916 - DNA, 23 bp, Homo sapiens
gaaaatctaatattaaaaatatg

SEQ ID NO: 3237917 - DNA, 20 bp, Homo sapiens
gaaaatgaatatctattaat

SEQ ID NO: 3237918 - DNA, 17 bp, Homo sapiens
gaaaatgacttatttct

SEQ ID NO: 3237919 - DNA, 21 bp, Homo sapiens
gaaaatgagttgtgaaagttt

SEQ ID NO: 3237920 - DNA, 23 bp, Homo sapiens
gaaaatgatgtgtacccaaacgt

SEQ ID NO: 3237921 - DNA, 12 bp, Homo sapiens
gaaaatgcaaag

SEQ ID NO: 3237922 - DNA, 22 bp, Homo sapiens
gaaaatgcctcaattcacatag

SEQ ID NO: 3237923 - DNA, 17 bp, Homo sapiens
gaaaatgtaaaggaggg

SEQ ID NO: 3237924 - DNA, 20 bp, Homo sapiens
gaaaatgtaaaggagggaga

SEQ ID NO: 3237925 - DNA, 22 bp, Homo sapiens
gaaaatgtcagaaaccagttat

SEQ ID NO: 3237926 - DNA, 19 bp, Homo sapiens
gaaaatgtgtcctatctat

SEQ ID NO: 3237927 - DNA, 14 bp, Homo sapiens
gaaaatgttcatca

SEQ ID NO: 3237928 - DNA, 21 bp, Homo sapiens
gaaaatgttgagaatcccaaa

SEQ ID NO: 3237929 - DNA, 20 bp, Homo sapiens
gaaaatgtttttctgccagg

SEQ ID NO: 3237930 - DNA, 17 bp, Homo sapiens
gaaaattattttaaaca

SEQ ID NO: 3237931 - DNA, 21 bp, Homo sapiens
gaaaattcaaaaagtgtttat

SEQ ID NO: 3237932 - DNA, 22 bp, Homo sapiens
gaaaattcatttcacattaatg

SEQ ID NO: 3237933 - DNA, 14 bp, Homo sapiens
gaaaattccagaaa

SEQ ID NO: 3237934 - DNA, 12 bp, Homo sapiens
gaaaattctgtt

SEQ ID NO: 3237935 - DNA, 16 bp, Homo sapiens
gaaaattcttaaaagg

SEQ ID NO: 3237936 - DNA, 21 bp, Homo sapiens
gaaaattgaggtttggaagag

SEQ ID NO: 3237937 - DNA, 12 bp, Homo sapiens
gaaaattgagtt

SEQ ID NO: 3237938 - DNA, 14 bp, Homo sapiens
gaaaattgcactaa

SEQ ID NO: 3237939 - DNA, 16 bp, Homo sapiens
gaaaattgcactaaat

SEQ ID NO: 3237940 - DNA, 16 bp, Homo sapiens
gaaaattgcctttaaa

SEQ ID NO: 3237941 - DNA, 20 bp, Homo sapiens
gaaaatttagccctttaaaa

SEQ ID NO: 3237942 - DNA, 14 bp, Homo sapiens
gaaaattttaaaaa

SEQ ID NO: 3237943 - DNA, 19 bp, Homo sapiens
gaaaattttaccagcagaa

SEQ ID NO: 3237944 - DNA, 20 bp, Homo sapiens
gaaaattttaccagcagaag

SEQ ID NO: 3237945 - DNA, 14 bp, Homo sapiens
gaaaattttacttc

SEQ ID NO: 3237946 - DNA, 14 bp, Homo sapiens
gaaacaaaaacact

SEQ ID NO: 3237947 - DNA, 23 bp, Homo sapiens
gaaacaaaaacactaaaaataaa

SEQ ID NO: 3237948 - DNA, 17 bp, Homo sapiens
gaaacaaataatcacat

SEQ ID NO: 3237949 - DNA, 22 bp, Homo sapiens
gaaacaatgttgtccaacaata

SEQ ID NO: 3237950 - DNA, 21 bp, Homo sapiens
gaaacacaatacctacaataa

SEQ ID NO: 3237951 - DNA, 14 bp, Homo sapiens
gaaacacaatattt

SEQ ID NO: 3237952 - DNA, 15 bp, Homo sapiens
gaaacacaatatttt

SEQ ID NO: 3237953 - DNA, 18 bp, Homo sapiens
gaaacacacaagcaacaa

SEQ ID NO: 3237954 - DNA, 17 bp, Homo sapiens
gaaacacaccaggctgt

SEQ ID NO: 3237955 - DNA, 13 bp, Homo sapiens
gaaacacagaaac

SEQ ID NO: 3237956 - DNA, 23 bp, Homo sapiens
gaaacacagctgttcttctgttc

SEQ ID NO: 3237957 - DNA, 17 bp, Homo sapiens
gaaacacgaaacttgtt

SEQ ID NO: 3237958 - DNA, 16 bp, Homo sapiens
gaaggcatgagaaaga

SEQ ID NO: 3237959 - DNA, 23 bp, Homo sapiens
gaaggcatttgcagggtcctctt

SEQ ID NO: 3237960 - DNA, 23 bp, Homo sapiens
gaaggcccaagagcagagtctgg

SEQ ID NO: 3237961 - DNA, 21 bp, Homo sapiens
gaaggcctcttgtgctcacgc

SEQ ID NO: 3237962 - DNA, 13 bp, Homo sapiens
gaaggcgaggaga

SEQ ID NO: 3237963 - DNA, 17 bp, Homo sapiens
gaaggctctcaccccca

SEQ ID NO: 3237964 - DNA, 22 bp, Homo sapiens
gaaggctgaactcttcagaaca

SEQ ID NO: 3237965 - DNA, 14 bp, Homo sapiens
gaaggctggctgag

SEQ ID NO: 3237966 - DNA, 15 bp, Homo sapiens
gaaggctggctgagt

SEQ ID NO: 3237967 - DNA, 20 bp, Homo sapiens
gaaggcttgggatttgctgt

SEQ ID NO: 3237968 - DNA, 21 bp, Homo sapiens
gaaggcttgggatttgctgtg

SEQ ID NO: 3237969 - DNA, 18 bp, Homo sapiens
gaagggaaacaaagaagt

SEQ ID NO: 3237970 - DNA, 15 bp, Homo sapiens
gaagggaccaaggca

SEQ ID NO: 3237971 - DNA, 20 bp, Homo sapiens
gaagggaccaaggcaaggca

SEQ ID NO: 3237972 - DNA, 16 bp, Homo sapiens
gaagggagaagaaagg

SEQ ID NO: 3237973 - DNA, 16 bp, Homo sapiens
gaagggagagccagct

SEQ ID NO: 3237974 - DNA, 14 bp, Homo sapiens
gaagggccagtcct

SEQ ID NO: 3237975 - DNA, 20 bp, Homo sapiens
gaagggccagtctgggctgc

SEQ ID NO: 3237976 - DNA, 13 bp, Homo sapiens
gaagggcccagga

SEQ ID NO: 3237977 - DNA, 12 bp, Homo sapiens
gaaggggccatc

SEQ ID NO: 3237978 - DNA, 21 bp, Homo sapiens
gaaggggccccggggctggca

SEQ ID NO: 3237979 - DNA, 23 bp, Homo sapiens
gaaggggccccggggctggcaag

SEQ ID NO: 3237980 - DNA, 13 bp, Homo sapiens
gaaggggccttgc

SEQ ID NO: 3237981 - DNA, 15 bp, Homo sapiens
gaagggggccctgct

SEQ ID NO: 3237982 - DNA, 16 bp, Homo sapiens
gaagggggccctgcta

SEQ ID NO: 3237983 - DNA, 15 bp, Homo sapiens
gaagggtagctgggc

SEQ ID NO: 3237984 - DNA, 17 bp, Homo sapiens
gaaggtctattggccaa

SEQ ID NO: 3237985 - DNA, 15 bp, Homo sapiens
gaaggtctttgttat

SEQ ID NO: 3237986 - DNA, 19 bp, Homo sapiens
gaaggtctttgttatgaca

SEQ ID NO: 3237987 - DNA, 14 bp, Homo sapiens
gaaggtgctgagct

SEQ ID NO: 3237988 - DNA, 15 bp, Homo sapiens
gaaggtgctgagctt

SEQ ID NO: 3237989 - DNA, 22 bp, Homo sapiens
gaaggtgctgagcttagccttg

SEQ ID NO: 3237990 - DNA, 14 bp, Homo sapiens
gaaggtgctggagg

SEQ ID NO: 3237991 - DNA, 16 bp, Homo sapiens
gaaggtgctggaggtg

SEQ ID NO: 3237992 - DNA, 20 bp, Homo sapiens
gaaggtggaggttgcggtga

SEQ ID NO: 3237993 - DNA, 22 bp, Homo sapiens
gaaggtggatggccccagcaca

SEQ ID NO: 3237994 - DNA, 14 bp, Homo sapiens
gaaggtggggccct

SEQ ID NO: 3237995 - DNA, 17 bp, Homo sapiens
gaaggtggggccctgcc

SEQ ID NO: 3237996 - DNA, 21 bp, Homo sapiens
gaaggtggggccctgccccta

SEQ ID NO: 3237997 - DNA, 20 bp, Homo sapiens
gaaggttaggatttaacagt

SEQ ID NO: 3237998 - DNA, 22 bp, Homo sapiens
gaaggttggtgaatttcacaag

SEQ ID NO: 3237999 - DNA, 12 bp, Homo sapiens
gaaggttgtaag

SEQ ID NO: 3238000 - DNA, 15 bp, Homo sapiens
gaaggtttgtatatt

SEQ ID NO: 3238001 - DNA, 22 bp, Homo sapiens
gaaggtttgtgttttctctgga

SEQ ID NO: 3238002 - DNA, 15 bp, Homo sapiens
gaagtaaagccatta

SEQ ID NO: 3238003 - DNA, 19 bp, Homo sapiens
gaagtaaagccattaaatg

SEQ ID NO: 3238004 - DNA, 17 bp, Homo sapiens
gaagtaagcaaacaaat

SEQ ID NO: 3238005 - DNA, 17 bp, Homo sapiens
gaagtaagtggggttgc

SEQ ID NO: 3238006 - DNA, 16 bp, Homo sapiens
gaagtacatgaataca

SEQ ID NO: 3238007 - DNA, 18 bp, Homo sapiens
gaagtagcttgctccctg

SEQ ID NO: 3238008 - DNA, 19 bp, Homo sapiens
gaagtagtttgtataactt

SEQ ID NO: 3238009 - DNA, 20 bp, Homo sapiens
gaagtcactcaattgttttt

SEQ ID NO: 3238010 - DNA, 14 bp, Homo sapiens
gaagtctacctgct

SEQ ID NO: 3238011 - DNA, 16 bp, Homo sapiens
gaagtctacctgctgg

SEQ ID NO: 3238012 - DNA, 14 bp, Homo sapiens
gaagtgaacatttc

SEQ ID NO: 3238013 - DNA, 16 bp, Homo sapiens
gaagtgactgttgtac

SEQ ID NO: 3238014 - DNA, 16 bp, Homo sapiens
gaagtgagggaggaag

SEQ ID NO: 3238015 - DNA, 13 bp, Homo sapiens
gaagtgccttctc

SEQ ID NO: 3238016 - DNA, 23 bp, Homo sapiens
gaagtgccttctccttccccagg

SEQ ID NO: 3238017 - DNA, 21 bp, Homo sapiens
gaagtgcgtgaatgtatgtaa

SEQ ID NO: 3238018 - DNA, 16 bp, Homo sapiens
gaagtggtactagtgt

SEQ ID NO: 3238019 - DNA, 20 bp, Homo sapiens
gaagtgtccgagaactaaag

SEQ ID NO: 3238020 - DNA, 16 bp, Homo sapiens
gaagtgtgagcgcctt

SEQ ID NO: 3238021 - DNA, 18 bp, Homo sapiens
gaagtgtgagcgccttgg

SEQ ID NO: 3238022 - DNA, 14 bp, Homo sapiens
gaagtgtgctgtga

SEQ ID NO: 3238023 - DNA, 21 bp, Homo sapiens
gaagtgtgggataaagattat

SEQ ID NO: 3238024 - DNA, 19 bp, Homo sapiens
gaagtgttcaagaaataaa

SEQ ID NO: 3238025 - DNA, 14 bp, Homo sapiens
gaagtgttgattgc

SEQ ID NO: 3238026 - DNA, 12 bp, Homo sapiens
gaagttactttg

SEQ ID NO: 3238027 - DNA, 17 bp, Homo sapiens
gaagttactttgtaatt

SEQ ID NO: 3238028 - DNA, 12 bp, Homo sapiens
gaagttatttat

SEQ ID NO: 3238029 - DNA, 15 bp, Homo sapiens
gaagttcatacctaa

SEQ ID NO: 3238030 - DNA, 20 bp, Homo sapiens
gaagttcatacctaagtact

SEQ ID NO: 3238031 - DNA, 23 bp, Homo sapiens
gaagttcatacctaagtactgta

SEQ ID NO: 3238032 - DNA, 17 bp, Homo sapiens
gaagttgaagtttagga

SEQ ID NO: 3238033 - DNA, 17 bp, Homo sapiens
gaagttgcagtgagctg

SEQ ID NO: 3238034 - DNA, 13 bp, Homo sapiens
gaagtttgtagcc

SEQ ID NO: 3238035 - DNA, 15 bp, Homo sapiens
gaagtttgtagccag

SEQ ID NO: 3238036 - DNA, 13 bp, Homo sapiens
gaagttttacatt

SEQ ID NO: 3238037 - DNA, 13 bp, Homo sapiens
gaagttttcagga

SEQ ID NO: 3238038 - DNA, 23 bp, Homo sapiens
gaagttttcaggacttggtctga

SEQ ID NO: 3238039 - DNA, 14 bp, Homo sapiens
gaataaaagctata

SEQ ID NO: 3238040 - DNA, 23 bp, Homo sapiens
gaataaaatcctaagacacaaat

SEQ ID NO: 3238041 - DNA, 14 bp, Homo sapiens
gaataaacattaat

SEQ ID NO: 3238042 - DNA, 13 bp, Homo sapiens
gaataaactgaat

SEQ ID NO: 3238043 - DNA, 14 bp, Homo sapiens
gaataaactgaata

SEQ ID NO: 3238044 - DNA, 16 bp, Homo sapiens
gaataaactgaatatt

SEQ ID NO: 3238045 - DNA, 19 bp, Homo sapiens
gaataaaggcagttttcta

SEQ ID NO: 3238046 - DNA, 21 bp, Homo sapiens
gaataaagttctgttttctgt

SEQ ID NO: 3238047 - DNA, 14 bp, Homo sapiens
gaataaagttgcag

SEQ ID NO: 3238048 - DNA, 13 bp, Homo sapiens
gaataaatgcctt

SEQ ID NO: 3238049 - DNA, 15 bp, Homo sapiens
gaataaatgccttta

SEQ ID NO: 3238050 - DNA, 19 bp, Homo sapiens
gaataacatgtaattaagt

SEQ ID NO: 3238051 - DNA, 22 bp, Homo sapiens
gaataaccacttaaaaaatgtc

SEQ ID NO: 3238052 - DNA, 15 bp, Homo sapiens
gaataacctttctgg

SEQ ID NO: 3238053 - DNA, 17 bp, Homo sapiens
gaataactcagaatatt

SEQ ID NO: 3238054 - DNA, 13 bp, Homo sapiens
gaataacttgaag

SEQ ID NO: 3238055 - DNA, 16 bp, Homo sapiens
gaataagaatggagca

SEQ ID NO: 3238056 - DNA, 23 bp, Homo sapiens
gaataagctctagttcttaacaa

SEQ ID NO: 3238057 - DNA, 21 bp, Homo sapiens
gaataaggaggaggagggaga

SEQ ID NO: 3238058 - DNA, 21 bp, Homo sapiens
gaataatcacgctttcctgaa

SEQ ID NO: 3238059 - DNA, 14 bp, Homo sapiens
gaataatgtaaaat

SEQ ID NO: 3238060 - DNA, 18 bp, Homo sapiens
gaataattatttatttaa

SEQ ID NO: 3238061 - DNA, 12 bp, Homo sapiens
gaataattgcat

SEQ ID NO: 3238062 - DNA, 21 bp, Homo sapiens
gaataattgctttttcacagt

SEQ ID NO: 3238063 - DNA, 13 bp, Homo sapiens
gaataattttatt

SEQ ID NO: 3238064 - DNA, 15 bp, Homo sapiens
gaatacaattaaagg

SEQ ID NO: 3238065 - DNA, 23 bp, Homo sapiens
gaatacagggcatgcattttgca

SEQ ID NO: 3238066 - DNA, 13 bp, Homo sapiens
gaatacagtgtta

SEQ ID NO: 3238067 - DNA, 15 bp, Homo sapiens
gaatacttattttca

SEQ ID NO: 3238068 - DNA, 21 bp, Homo sapiens
gaatacttattttcagtgcat

SEQ ID NO: 3238069 - DNA, 20 bp, Homo sapiens
gaatactttttacaattaaa

SEQ ID NO: 3238070 - DNA, 16 bp, Homo sapiens
gaatagaggtcctcat

SEQ ID NO: 3238071 - DNA, 19 bp, Homo sapiens
gaatagatatgaaagctga

SEQ ID NO: 3238072 - DNA, 20 bp, Homo sapiens
gaatagatcagtatttcact

SEQ ID NO: 3238073 - DNA, 18 bp, Homo sapiens
gaatagccacatttggaa

SEQ ID NO: 3238074 - DNA, 23 bp, Homo sapiens
gaatagccacatttggaatactt

SEQ ID NO: 3238075 - DNA, 15 bp, Homo sapiens
gaatagctgggacta

SEQ ID NO: 3238076 - DNA, 23 bp, Homo sapiens
gaatagctgggactacaggtgtg

SEQ ID NO: 3238077 - DNA, 20 bp, Homo sapiens
gaataggcattaacacaaag

SEQ ID NO: 3238078 - DNA, 16 bp, Homo sapiens
gaataggtagtatcat

SEQ ID NO: 3238079 - DNA, 16 bp, Homo sapiens
gaatagttgagcccca

SEQ ID NO: 3238080 - DNA, 14 bp, Homo sapiens
gaatataaatattt

SEQ ID NO: 3238081 - DNA, 13 bp, Homo sapiens
gaatataattatc

SEQ ID NO: 3238082 - DNA, 14 bp, Homo sapiens
gaatatagcctgcc

SEQ ID NO: 3238083 - DNA, 19 bp, Homo sapiens
gaatatagcctgcctcagt

SEQ ID NO: 3238084 - DNA, 17 bp, Homo sapiens
gacagcctcttcagccc

SEQ ID NO: 3238085 - DNA, 19 bp, Homo sapiens
gacagcctcttcagcccct

SEQ ID NO: 3238086 - DNA, 21 bp, Homo sapiens
gacagcctcttcagccccttc

SEQ ID NO: 3238087 - DNA, 13 bp, Homo sapiens
gacagcctggcac

SEQ ID NO: 3238088 - DNA, 13 bp, Homo sapiens
gacagcgcccctg

SEQ ID NO: 3238089 - DNA, 16 bp, Homo sapiens
gacagcgcccctgctg

SEQ ID NO: 3238090 - DNA, 11 bp, Homo sapiens
gacagctcctt

SEQ ID NO: 3238091 - DNA, 14 bp, Homo sapiens
gacagctccttctg

SEQ ID NO: 3238092 - DNA, 18 bp, Homo sapiens
gacagctgactgaatgca

SEQ ID NO: 3238093 - DNA, 17 bp, Homo sapiens
gacagctttgctccgct

SEQ ID NO: 3238094 - DNA, 19 bp, Homo sapiens
gacaggaaagccctccccc

SEQ ID NO: 3238095 - DNA, 14 bp, Homo sapiens
gacaggacagtgct

SEQ ID NO: 3238096 - DNA, 17 bp, Homo sapiens
gacaggaccctcaggaa

SEQ ID NO: 3238097 - DNA, 18 bp, Homo sapiens
gacaggaccctcaggaat

SEQ ID NO: 3238098 - DNA, 23 bp, Homo sapiens
gacaggaggaggagatggccata

SEQ ID NO: 3238099 - DNA, 17 bp, Homo sapiens
gacaggaggattgcctg

SEQ ID NO: 3238100 - DNA, 15 bp, Homo sapiens
gacaggaggcggccc

SEQ ID NO: 3238101 - DNA, 22 bp, Homo sapiens
gacaggagtcagtgtctggctt

SEQ ID NO: 3238102 - DNA, 19 bp, Homo sapiens
gacaggcaatgctggctgt

SEQ ID NO: 3238103 - DNA, 23 bp, Homo sapiens
gacaggcaatgctggctgttggc

SEQ ID NO: 3238104 - DNA, 24 bp, Homo sapiens
gacaggcaatgctggctgttggct

SEQ ID NO: 3238105 - DNA, 21 bp, Homo sapiens
gacaggcaggccagatggccc

SEQ ID NO: 3238106 - DNA, 22 bp, Homo sapiens
gacaggcaggccagatggcccc

SEQ ID NO: 3238107 - DNA, 18 bp, Homo sapiens
gacaggcatgttctctga

SEQ ID NO: 3238108 - DNA, 18 bp, Homo sapiens
gacaggccatgtgagcca

SEQ ID NO: 3238109 - DNA, 11 bp, Homo sapiens
gacaggcccaa

SEQ ID NO: 3238110 - DNA, 15 bp, Homo sapiens
gacaggcccaagaga

SEQ ID NO: 3238111 - DNA, 15 bp, Homo sapiens
gacaggcctcacctc

SEQ ID NO: 3238112 - DNA, 15 bp, Homo sapiens
gacaggcctgaagat

SEQ ID NO: 3238113 - DNA, 23 bp, Homo sapiens
gacaggcgagagaggagccagac

SEQ ID NO: 3238114 - DNA, 15 bp, Homo sapiens
gacaggcgcctgcca

SEQ ID NO: 3238115 - DNA, 13 bp, Homo sapiens
gacaggctcttag

SEQ ID NO: 3238116 - DNA, 19 bp, Homo sapiens
gacaggctcttagcagctt

SEQ ID NO: 3238117 - DNA, 15 bp, Homo sapiens
gacagggaagagcag

SEQ ID NO: 3238118 - DNA, 23 bp, Homo sapiens
gacagggcacaccgggcactcag

SEQ ID NO: 3238119 - DNA, 10 bp, Homo sapiens
gacagggcca

SEQ ID NO: 3238120 - DNA, 11 bp, Homo sapiens
gacagggccag

SEQ ID NO: 3238121 - DNA, 13 bp, Homo sapiens
gacagggccagtg

SEQ ID NO: 3238122 - DNA, 16 bp, Homo sapiens
gacagggccagtgggg

SEQ ID NO: 3238123 - DNA, 19 bp, Homo sapiens
gacagggccagtggggcct

SEQ ID NO: 3238124 - DNA, 16 bp, Homo sapiens
gacagggcctggagcc

SEQ ID NO: 3238125 - DNA, 12 bp, Homo sapiens
gacagggtttca

SEQ ID NO: 3238126 - DNA, 17 bp, Homo sapiens
gacagggtttcgccatg

SEQ ID NO: 3238127 - DNA, 17 bp, Homo sapiens
gacagtacctgattgta

SEQ ID NO: 3238128 - DNA, 21 bp, Homo sapiens
gacagtatcccacatccaact

SEQ ID NO: 3238129 - DNA, 21 bp, Homo sapiens
gacagtatgagtcaatgtgca

SEQ ID NO: 3238130 - DNA, 22 bp, Homo sapiens
gacagtcactgccactttgcac

SEQ ID NO: 3238131 - DNA, 19 bp, Homo sapiens
gacagtcatcatcagggcc

SEQ ID NO: 3238132 - DNA, 15 bp, Homo sapiens
gacagtccagtgtca

SEQ ID NO: 3238133 - DNA, 13 bp, Homo sapiens
gacagtcctggga

SEQ ID NO: 3238134 - DNA, 23 bp, Homo sapiens
gacagtcctgggagaacctcagg

SEQ ID NO: 3238135 - DNA, 15 bp, Homo sapiens
gacagtcctttccca

SEQ ID NO: 3238136 - DNA, 19 bp, Homo sapiens
gacagtcggaaaagcgtct

SEQ ID NO: 3238137 - DNA, 13 bp, Homo sapiens
gacagtctcactt

SEQ ID NO: 3238138 - DNA, 15 bp, Homo sapiens
gacagtcttgtgctt

SEQ ID NO: 3238139 - DNA, 22 bp, Homo sapiens
gacagtgacctctctaggtgtg

SEQ ID NO: 3238140 - DNA, 18 bp, Homo sapiens
gacagtgagacagtctgg

SEQ ID NO: 3238141 - DNA, 19 bp, Homo sapiens
gacagtgagacagtctgga

SEQ ID NO: 3238142 - DNA, 19 bp, Homo sapiens
gacagtgatattggaactt

SEQ ID NO: 3238143 - DNA, 16 bp, Homo sapiens
gacagtgcctatactg

SEQ ID NO: 3238144 - DNA, 21 bp, Homo sapiens
gacagtgcctgggaatgtatt

SEQ ID NO: 3238145 - DNA, 16 bp, Homo sapiens
gacagtgcttcagcct

SEQ ID NO: 3238146 - DNA, 20 bp, Homo sapiens
gacagtggattgcatttctt

SEQ ID NO: 3238147 - DNA, 23 bp, Homo sapiens
gacagtgttgaaaatgttcagaa

SEQ ID NO: 3238148 - DNA, 17 bp, Homo sapiens
gacagttcacaccctgc

SEQ ID NO: 3238149 - DNA, 15 bp, Homo sapiens
gacagttcatatgta

SEQ ID NO: 3238150 - DNA, 20 bp, Homo sapiens
gacagtttcttagcttttta

SEQ ID NO: 3238151 - DNA, 15 bp, Homo sapiens
gacataaatgttcac

SEQ ID NO: 3238152 - DNA, 22 bp, Homo sapiens
gacataacgtttttcctttaaa

SEQ ID NO: 3238153 - DNA, 23 bp, Homo sapiens
gacataatatattctatttttat

SEQ ID NO: 3238154 - DNA, 20 bp, Homo sapiens
gacatacatattatctcatt

SEQ ID NO: 3238155 - DNA, 19 bp, Homo sapiens
gacatacatgctacttttt

SEQ ID NO: 3238156 - DNA, 19 bp, Homo sapiens
gacatactctctgcctggt

SEQ ID NO: 3238157 - DNA, 14 bp, Homo sapiens
gacatagagaaaag

SEQ ID NO: 3238158 - DNA, 20 bp, Homo sapiens
gacatagcatccaagtggca

SEQ ID NO: 3238159 - DNA, 18 bp, Homo sapiens
gacatagcccatccctgc

SEQ ID NO: 3238160 - DNA, 23 bp, Homo sapiens
gacataggccatgaaaaaaatga

SEQ ID NO: 3238161 - DNA, 16 bp, Homo sapiens
gacatattatgcctga

SEQ ID NO: 3238162 - DNA, 18 bp, Homo sapiens
gacatcaaagcctggcct

SEQ ID NO: 3238163 - DNA, 14 bp, Homo sapiens
gacatccaaatcta

SEQ ID NO: 3238164 - DNA, 22 bp, Homo sapiens
gacatccatgtttgtaaaacta

SEQ ID NO: 3238165 - DNA, 23 bp, Homo sapiens
gacatccatgtttgtaaaactac

SEQ ID NO: 3238166 - DNA, 16 bp, Homo sapiens
gacatcccttcctgga

SEQ ID NO: 3238167 - DNA, 19 bp, Homo sapiens
gacatcccttcctggaaac

SEQ ID NO: 3238168 - DNA, 22 bp, Homo sapiens
gacatcccttcctggaaacagc

SEQ ID NO: 3238169 - DNA, 22 bp, Homo sapiens
gacatccgtcattgctgctgct

SEQ ID NO: 3238170 - DNA, 15 bp, Homo sapiens
gacatcctcctccca

SEQ ID NO: 3238171 - DNA, 14 bp, Homo sapiens
gacatcctgtataa

SEQ ID NO: 3238172 - DNA, 15 bp, Homo sapiens
gacatctcaggattt

SEQ ID NO: 3238173 - DNA, 16 bp, Homo sapiens
gacatctcaggggcca

SEQ ID NO: 3238174 - DNA, 12 bp, Homo sapiens
gacatctcctgg

SEQ ID NO: 3238175 - DNA, 22 bp, Homo sapiens
gacatctggaatctggagacca

SEQ ID NO: 3238176 - DNA, 15 bp, Homo sapiens
gacatgaaaagttat

SEQ ID NO: 3238177 - DNA, 16 bp, Homo sapiens
gacatgatttccttga

SEQ ID NO: 3238178 - DNA, 15 bp, Homo sapiens
gacatgcaataaaat

SEQ ID NO: 3238179 - DNA, 19 bp, Homo sapiens
gacatgcaataaaatttaa

SEQ ID NO: 3238180 - DNA, 16 bp, Homo sapiens
gacatgcattgttggc

SEQ ID NO: 3238181 - DNA, 22 bp, Homo sapiens
gacatgcattgttggctatttg

SEQ ID NO: 3238182 - DNA, 15 bp, Homo sapiens
gacatgctcacctct

SEQ ID NO: 3238183 - DNA, 17 bp, Homo sapiens
gacatgctcacctctag

SEQ ID NO: 3238184 - DNA, 20 bp, Homo sapiens
gacatgctcacctctagcct

SEQ ID NO: 3238185 - DNA, 21 bp, Homo sapiens
gacatgctgactgtcctctcc

SEQ ID NO: 3238186 - DNA, 18 bp, Homo sapiens
gacatggaagagagagcc

SEQ ID NO: 3238187 - DNA, 17 bp, Homo sapiens
gacatggagactcctgc

SEQ ID NO: 3238188 - DNA, 19 bp, Homo sapiens
gacatggaggttctaaggc

SEQ ID NO: 3238189 - DNA, 21 bp, Homo sapiens
gacatggaggttctaaggcct

SEQ ID NO: 3238190 - DNA, 20 bp, Homo sapiens
gacatggatgcgaggaccac

SEQ ID NO: 3238191 - DNA, 16 bp, Homo sapiens
gacatggtgcctgaga

SEQ ID NO: 3238192 - DNA, 21 bp, Homo sapiens
gacatggtgcctgagaggcag

SEQ ID NO: 3238193 - DNA, 15 bp, Homo sapiens
gacatgtctgttcta

SEQ ID NO: 3238194 - DNA, 17 bp, Homo sapiens
gacatgtctgttctaca

SEQ ID NO: 3238195 - DNA, 15 bp, Homo sapiens
gacatgtgaaacctt

SEQ ID NO: 3238196 - DNA, 12 bp, Homo sapiens
gacatgtgacat

SEQ ID NO: 3238197 - DNA, 21 bp, Homo sapiens
gacatgtgcaattgtgaggga

SEQ ID NO: 3238198 - DNA, 22 bp, Homo sapiens
gacatgtgcaattgtgagggac

SEQ ID NO: 3238199 - DNA, 13 bp, Homo sapiens
gacatgtggaaag

SEQ ID NO: 3238200 - DNA, 18 bp, Homo sapiens
gacatgtggaaagtgaat

SEQ ID NO: 3238201 - DNA, 19 bp, Homo sapiens
gacatgtggaaagtgaatt

SEQ ID NO: 3238202 - DNA, 15 bp, Homo sapiens
gacatgttgtaaatt

SEQ ID NO: 3238203 - DNA, 12 bp, Homo sapiens
gacattaacagt

SEQ ID NO: 3238204 - DNA, 18 bp, Homo sapiens
gacattaacagttttcca

SEQ ID NO: 3238205 - DNA, 21 bp, Homo sapiens
gacattatgtgtgcatgtgtg

SEQ ID NO: 3238206 - DNA, 23 bp, Homo sapiens
gacattatgtgtgcatgtgtgta

SEQ ID NO: 3238207 - DNA, 19 bp, Homo sapiens
gacattctgtctttcaaaa

SEQ ID NO: 3238208 - DNA, 14 bp, Homo sapiens
gacattgcggacag

SEQ ID NO: 3238209 - DNA, 23 bp, Homo sapiens
gacttaaagggcccaatgaatta

SEQ ID NO: 3238210 - DNA, 20 bp, Homo sapiens
gacttaactgcatttttaga

SEQ ID NO: 3238211 - DNA, 14 bp, Homo sapiens
gacttaatgtgatt

SEQ ID NO: 3238212 - DNA, 13 bp, Homo sapiens
gacttactgggtg

SEQ ID NO: 3238213 - DNA, 16 bp, Homo sapiens
gacttagaaagcaggg

SEQ ID NO: 3238214 - DNA, 18 bp, Homo sapiens
gacttatcaacactataa

SEQ ID NO: 3238215 - DNA, 16 bp, Homo sapiens
gacttattcttttata

SEQ ID NO: 3238216 - DNA, 15 bp, Homo sapiens
gacttatttctgctc

SEQ ID NO: 3238217 - DNA, 17 bp, Homo sapiens
gacttatttctgctctg

SEQ ID NO: 3238218 - DNA, 18 bp, Homo sapiens
gacttatttcttcaaatc

SEQ ID NO: 3238219 - DNA, 22 bp, Homo sapiens
gacttattttgtcttattctta

SEQ ID NO: 3238220 - DNA, 20 bp, Homo sapiens
gacttcaaaaggaatgaact

SEQ ID NO: 3238221 - DNA, 14 bp, Homo sapiens
gacttcagctctgt

SEQ ID NO: 3238222 - DNA, 17 bp, Homo sapiens
gacttcagctgcctgaa

SEQ ID NO: 3238223 - DNA, 15 bp, Homo sapiens
gacttcagtcttgcc

SEQ ID NO: 3238224 - DNA, 23 bp, Homo sapiens
gacttccacatttttgcacagat

SEQ ID NO: 3238225 - DNA, 12 bp, Homo sapiens
gacttcccagct

SEQ ID NO: 3238226 - DNA, 18 bp, Homo sapiens
gacttcccagctaggaag

SEQ ID NO: 3238227 - DNA, 22 bp, Homo sapiens
gacttcctggggccccgctggg

SEQ ID NO: 3238228 - DNA, 16 bp, Homo sapiens
gacttccttgagacac

SEQ ID NO: 3238229 - DNA, 20 bp, Homo sapiens
gacttccttgagacacggag

SEQ ID NO: 3238230 - DNA, 16 bp, Homo sapiens
gacttccttgctctcc

SEQ ID NO: 3238231 - DNA, 13 bp, Homo sapiens
gacttctgcctgg

SEQ ID NO: 3238232 - DNA, 16 bp, Homo sapiens
gacttctgcctggaga

SEQ ID NO: 3238233 - DNA, 17 bp, Homo sapiens
gacttctgcctggagac

SEQ ID NO: 3238234 - DNA, 13 bp, Homo sapiens
gacttctggaagg

SEQ ID NO: 3238235 - DNA, 14 bp, Homo sapiens
gacttctggaaggc

SEQ ID NO: 3238236 - DNA, 17 bp, Homo sapiens
gacttcttacccaaagc

SEQ ID NO: 3238237 - DNA, 13 bp, Homo sapiens
gacttgaaagaaa

SEQ ID NO: 3238238 - DNA, 16 bp, Homo sapiens
gacttgaaagcatcca

SEQ ID NO: 3238239 - DNA, 19 bp, Homo sapiens
gacttgaaagcatccatgt

SEQ ID NO: 3238240 - DNA, 21 bp, Homo sapiens
gacttgcaaagacctacctcc

SEQ ID NO: 3238241 - DNA, 11 bp, Homo sapiens
gacttgcttta

SEQ ID NO: 3238242 - DNA, 15 bp, Homo sapiens
gacttggaagctccg

SEQ ID NO: 3238243 - DNA, 19 bp, Homo sapiens
gacttggagactcctggtc

SEQ ID NO: 3238244 - DNA, 22 bp, Homo sapiens
gacttggcacttaagtgcactt

SEQ ID NO: 3238245 - DNA, 14 bp, Homo sapiens
gacttggcaggtgc

SEQ ID NO: 3238246 - DNA, 18 bp, Homo sapiens
gacttggcaggtgcctgt

SEQ ID NO: 3238247 - DNA, 20 bp, Homo sapiens
gacttggggagatggagttc

SEQ ID NO: 3238248 - DNA, 17 bp, Homo sapiens
gacttggttggtagggt

SEQ ID NO: 3238249 - DNA, 18 bp, Homo sapiens
gacttgtagcatattctt

SEQ ID NO: 3238250 - DNA, 18 bp, Homo sapiens
gacttgtatatttgtaca

SEQ ID NO: 3238251 - DNA, 19 bp, Homo sapiens
gacttgtatatttgtacaa

SEQ ID NO: 3238252 - DNA, 16 bp, Homo sapiens
gacttgtgtctctgtg

SEQ ID NO: 3238253 - DNA, 15 bp, Homo sapiens
gactttaaaagaaaa

SEQ ID NO: 3238254 - DNA, 19 bp, Homo sapiens
gactttacttgtggtgtga

SEQ ID NO: 3238255 - DNA, 13 bp, Homo sapiens
gactttagaaata

SEQ ID NO: 3238256 - DNA, 15 bp, Homo sapiens
gactttagtgccctg

SEQ ID NO: 3238257 - DNA, 16 bp, Homo sapiens
gactttagtgccctgc

SEQ ID NO: 3238258 - DNA, 23 bp, Homo sapiens
gactttagtgccctgccccctgg

SEQ ID NO: 3238259 - DNA, 22 bp, Homo sapiens
gactttatctaatacctctgtg

SEQ ID NO: 3238260 - DNA, 16 bp, Homo sapiens
gactttatctcctgct

SEQ ID NO: 3238261 - DNA, 18 bp, Homo sapiens
gactttatctcctgctct

SEQ ID NO: 3238262 - DNA, 19 bp, Homo sapiens
gactttatttatttctagt

SEQ ID NO: 3238263 - DNA, 18 bp, Homo sapiens
gactttctgcctggagtg

SEQ ID NO: 3238264 - DNA, 17 bp, Homo sapiens
gactttgacaattactc

SEQ ID NO: 3238265 - DNA, 12 bp, Homo sapiens
gactttgcttgc

SEQ ID NO: 3238266 - DNA, 15 bp, Homo sapiens
gactttgcttgcttt

SEQ ID NO: 3238267 - DNA, 15 bp, Homo sapiens
gactttgtagatcct

SEQ ID NO: 3238268 - DNA, 17 bp, Homo sapiens
gacttttattaataaaa

SEQ ID NO: 3238269 - DNA, 18 bp, Homo sapiens
gacttttcgttaacattg

SEQ ID NO: 3238270 - DNA, 13 bp, Homo sapiens
gacttttctgatt

SEQ ID NO: 3238271 - DNA, 22 bp, Homo sapiens
gacttttctgattaatatattt

SEQ ID NO: 3238272 - DNA, 16 bp, Homo sapiens
gactttttagccagtg

SEQ ID NO: 3238273 - DNA, 16 bp, Homo sapiens
gactttttataaaatg

SEQ ID NO: 3238274 - DNA, 16 bp, Homo sapiens
gagaaaaaaaaaatag

SEQ ID NO: 3238275 - DNA, 23 bp, Homo sapiens
gagaaaaaaaaccttgtaaaaaa

SEQ ID NO: 3238276 - DNA, 13 bp, Homo sapiens
gagaaaaaaacaa

SEQ ID NO: 3238277 - DNA, 14 bp, Homo sapiens
gagaaaaaagaagt

SEQ ID NO: 3238278 - DNA, 16 bp, Homo sapiens
gagaaaataaatttaa

SEQ ID NO: 3238279 - DNA, 18 bp, Homo sapiens
gagaaaatgtaaaggagg

SEQ ID NO: 3238280 - DNA, 19 bp, Homo sapiens
gagaaaatgtaaaggaggg

SEQ ID NO: 3238281 - DNA, 17 bp, Homo sapiens
gagaaaattgcactaaa

SEQ ID NO: 3238282 - DNA, 19 bp, Homo sapiens
gagaaacactgaaaagaag

SEQ ID NO: 3238283 - DNA, 19 bp, Homo sapiens
gagaaacagctcagccagt

SEQ ID NO: 3238284 - DNA, 18 bp, Homo sapiens
gagaaacagttggtaact

SEQ ID NO: 3238285 - DNA, 15 bp, Homo sapiens
gagaaaccgggagaa

SEQ ID NO: 3238286 - DNA, 23 bp, Homo sapiens
gagaaaccttattgtacctctct

SEQ ID NO: 3238287 - DNA, 15 bp, Homo sapiens
gagaaactccaaagt

SEQ ID NO: 3238288 - DNA, 17 bp, Homo sapiens
gagaaactgaaagtgtt

SEQ ID NO: 3238289 - DNA, 18 bp, Homo sapiens
gagaaagaagtaggcatg

SEQ ID NO: 3238290 - DNA, 18 bp, Homo sapiens
gagaaagagagaagccag

SEQ ID NO: 3238291 - DNA, 23 bp, Homo sapiens
gagaaagagagaagccagccaca

SEQ ID NO: 3238292 - DNA, 15 bp, Homo sapiens
gagaaagagctgcct

SEQ ID NO: 3238293 - DNA, 15 bp, Homo sapiens
gagaaagccaggcag

SEQ ID NO: 3238294 - DNA, 19 bp, Homo sapiens
gagaaaggcctgcacacaa

SEQ ID NO: 3238295 - DNA, 16 bp, Homo sapiens
gagaaatcacaggggc

SEQ ID NO: 3238296 - DNA, 17 bp, Homo sapiens
gagaaatcacaggggcg

SEQ ID NO: 3238297 - DNA, 20 bp, Homo sapiens
gagaaatgaataagctttct

SEQ ID NO: 3238298 - DNA, 12 bp, Homo sapiens
gagaaattagaa

SEQ ID NO: 3238299 - DNA, 16 bp, Homo sapiens
gagaaattctgttaaa

SEQ ID NO: 3238300 - DNA, 13 bp, Homo sapiens
gagaaatttttat

SEQ ID NO: 3238301 - DNA, 12 bp, Homo sapiens
gagaacaaagct

SEQ ID NO: 3238302 - DNA, 23 bp, Homo sapiens
gagaacaagtcacagctgcagct

SEQ ID NO: 3238303 - DNA, 18 bp, Homo sapiens
gagaaccaaatctggaag

SEQ ID NO: 3238304 - DNA, 16 bp, Homo sapiens
gagaacccagtttccc

SEQ ID NO: 3238305 - DNA, 20 bp, Homo sapiens
gagaaccgagcaaagatcaa

SEQ ID NO: 3238306 - DNA, 21 bp, Homo sapiens
gagaacctcaggtacggagaa

SEQ ID NO: 3238307 - DNA, 23 bp, Homo sapiens
gagaacctcaggtacggagaaga

SEQ ID NO: 3238308 - DNA, 18 bp, Homo sapiens
gagaacgccagtctccca

SEQ ID NO: 3238309 - DNA, 15 bp, Homo sapiens
gagaactcctgactg

SEQ ID NO: 3238310 - DNA, 16 bp, Homo sapiens
gagaactgactttctc

SEQ ID NO: 3238311 - DNA, 15 bp, Homo sapiens
gagaagagaggagag

SEQ ID NO: 3238312 - DNA, 18 bp, Homo sapiens
gagaagagggcccagccc

SEQ ID NO: 3238313 - DNA, 21 bp, Homo sapiens
gagaagagggcccagcccaga

SEQ ID NO: 3238314 - DNA, 20 bp, Homo sapiens
gagaagcaaaccgccctgca

SEQ ID NO: 3238315 - DNA, 19 bp, Homo sapiens
gagaagcatatagaggcaa

SEQ ID NO: 3238316 - DNA, 15 bp, Homo sapiens
gagaagcatcctcca

SEQ ID NO: 3238317 - DNA, 19 bp, Homo sapiens
gagaagcatcctccacatc

SEQ ID NO: 3238318 - DNA, 14 bp, Homo sapiens
gagaagccacgctg

SEQ ID NO: 3238319 - DNA, 11 bp, Homo sapiens
gagaagccagc

SEQ ID NO: 3238320 - DNA, 14 bp, Homo sapiens
gagaagccttcagc

SEQ ID NO: 3238321 - DNA, 12 bp, Homo sapiens
gagaagctgctc

SEQ ID NO: 3238322 - DNA, 19 bp, Homo sapiens
gagaagctgctccaggcct

SEQ ID NO: 3238323 - DNA, 20 bp, Homo sapiens
gagaagctgctccaggcctg

SEQ ID NO: 3238324 - DNA, 21 bp, Homo sapiens
gagaagctttttttcttgcta

SEQ ID NO: 3238325 - DNA, 14 bp, Homo sapiens
gagaaggaagggca

SEQ ID NO: 3238326 - DNA, 17 bp, Homo sapiens
gagaaggaagggcagag

SEQ ID NO: 3238327 - DNA, 15 bp, Homo sapiens
gagaaggagagaaag

SEQ ID NO: 3238328 - DNA, 18 bp, Homo sapiens
gagaaggcatgagaaaga

SEQ ID NO: 3238329 - DNA, 19 bp, Homo sapiens
gagaagggaagaaggggcc

SEQ ID NO: 3238330 - DNA, 23 bp, Homo sapiens
gagaagggaagaaggggccatca

SEQ ID NO: 3238331 - DNA, 17 bp, Homo sapiens
gagaaggttggaggtgg

SEQ ID NO: 3238332 - DNA, 23 bp, Homo sapiens
gagaaggttggaggtggggaagg

SEQ ID NO: 3238333 - DNA, 14 bp, Homo sapiens
gagaagtacttggt

SEQ ID NO: 3238334 - DNA, 14 bp, Homo sapiens
gagaagtgccttct

SEQ ID NO: 3238335 - DNA, 14 bp, Homo sapiens
gagctggtgtctga

SEQ ID NO: 3238336 - DNA, 16 bp, Homo sapiens
gagctgtcaccaagga

SEQ ID NO: 3238337 - DNA, 18 bp, Homo sapiens
gagctgtcaccaaggaaa

SEQ ID NO: 3238338 - DNA, 20 bp, Homo sapiens
gagctgtctatgcagcctgc

SEQ ID NO: 3238339 - DNA, 21 bp, Homo sapiens
gagctgtctatgcagcctgct

SEQ ID NO: 3238340 - DNA, 11 bp, Homo sapiens
gagctgtgcca

SEQ ID NO: 3238341 - DNA, 15 bp, Homo sapiens
gagctgtgccagcag

SEQ ID NO: 3238342 - DNA, 19 bp, Homo sapiens
gagctgtttatggcctcag

SEQ ID NO: 3238343 - DNA, 16 bp, Homo sapiens
gagctgtttatgtttt

SEQ ID NO: 3238344 - DNA, 22 bp, Homo sapiens
gagcttaatgctacatgtgagt

SEQ ID NO: 3238345 - DNA, 14 bp, Homo sapiens
gagcttagccttgt

SEQ ID NO: 3238346 - DNA, 21 bp, Homo sapiens
gagcttagccttgtgccctgc

SEQ ID NO: 3238347 - DNA, 22 bp, Homo sapiens
gagcttagccttgtgccctgcc

SEQ ID NO: 3238348 - DNA, 18 bp, Homo sapiens
gagcttcggttctccaga

SEQ ID NO: 3238349 - DNA, 13 bp, Homo sapiens
gagcttgaggtgg

SEQ ID NO: 3238350 - DNA, 13 bp, Homo sapiens
gagcttgctttga

SEQ ID NO: 3238351 - DNA, 13 bp, Homo sapiens
gagcttgggaatg

SEQ ID NO: 3238352 - DNA, 18 bp, Homo sapiens
gagcttgtaataaatact

SEQ ID NO: 3238353 - DNA, 17 bp, Homo sapiens
gagcttgtcttttctgc

SEQ ID NO: 3238354 - DNA, 21 bp, Homo sapiens
gagctttctgtccttttggca

SEQ ID NO: 3238355 - DNA, 22 bp, Homo sapiens
gagctttgttttatatatttat

SEQ ID NO: 3238356 - DNA, 14 bp, Homo sapiens
gaggaaaaaggtca

SEQ ID NO: 3238357 - DNA, 23 bp, Homo sapiens
gaggaaaaccaagccgtggcttc

SEQ ID NO: 3238358 - DNA, 15 bp, Homo sapiens
gaggaaaagaaacct

SEQ ID NO: 3238359 - DNA, 21 bp, Homo sapiens
gaggaaaagtaaggtgcagtt

SEQ ID NO: 3238360 - DNA, 12 bp, Homo sapiens
gaggaaaattct

SEQ ID NO: 3238361 - DNA, 21 bp, Homo sapiens
gaggaaagagtcttcaacata

SEQ ID NO: 3238362 - DNA, 14 bp, Homo sapiens
gaggaaaggatttt

SEQ ID NO: 3238363 - DNA, 12 bp, Homo sapiens
gaggaacacctg

SEQ ID NO: 3238364 - DNA, 23 bp, Homo sapiens
gaggaactccttggcctagccca

SEQ ID NO: 3238365 - DNA, 14 bp, Homo sapiens
gaggaactgggcct

SEQ ID NO: 3238366 - DNA, 16 bp, Homo sapiens
gaggaactgtacagaa

SEQ ID NO: 3238367 - DNA, 19 bp, Homo sapiens
gaggaactgtccagagagc

SEQ ID NO: 3238368 - DNA, 17 bp, Homo sapiens
gaggaagagcaggcaca

SEQ ID NO: 3238369 - DNA, 13 bp, Homo sapiens
gaggaaggcaaga

SEQ ID NO: 3238370 - DNA, 21 bp, Homo sapiens
gaggaaggcaagagggggtgg

SEQ ID NO: 3238371 - DNA, 15 bp, Homo sapiens
gaggaaggtgctgag

SEQ ID NO: 3238372 - DNA, 18 bp, Homo sapiens
gaggaaggtgctgagctt

SEQ ID NO: 3238373 - DNA, 19 bp, Homo sapiens
gaggaatagttgagcccca

SEQ ID NO: 3238374 - DNA, 21 bp, Homo sapiens
gaggaatcatgtcaggcctgt

SEQ ID NO: 3238375 - DNA, 15 bp, Homo sapiens
gaggaatcctggcag

SEQ ID NO: 3238376 - DNA, 16 bp, Homo sapiens
gaggaatcctggcagc

SEQ ID NO: 3238377 - DNA, 19 bp, Homo sapiens
gaggaatttataacaaata

SEQ ID NO: 3238378 - DNA, 13 bp, Homo sapiens
gaggacaaaactt

SEQ ID NO: 3238379 - DNA, 17 bp, Homo sapiens
gaggacaaaacttcttg

SEQ ID NO: 3238380 - DNA, 13 bp, Homo sapiens
gaggacaggcagg

SEQ ID NO: 3238381 - DNA, 14 bp, Homo sapiens
gaggacaggcggga

SEQ ID NO: 3238382 - DNA, 15 bp, Homo sapiens
gaggacagtctggag

SEQ ID NO: 3238383 - DNA, 20 bp, Homo sapiens
gaggacagtctggagaaggt

SEQ ID NO: 3238384 - DNA, 13 bp, Homo sapiens
gaggaccatcggg

SEQ ID NO: 3238385 - DNA, 16 bp, Homo sapiens
gaggaccgctgataag

SEQ ID NO: 3238386 - DNA, 19 bp, Homo sapiens
gaggaccttatctgtgcgt

SEQ ID NO: 3238387 - DNA, 13 bp, Homo sapiens
gaggacgcacgct

SEQ ID NO: 3238388 - DNA, 19 bp, Homo sapiens
gaggacgcacgctcgctgc

SEQ ID NO: 3238389 - DNA, 22 bp, Homo sapiens
gaggacgtcatcggaggctggg

SEQ ID NO: 3238390 - DNA, 20 bp, Homo sapiens
gaggactgtagggagggcgg

SEQ ID NO: 3238391 - DNA, 21 bp, Homo sapiens
gaggactgtagggagggcggc

SEQ ID NO: 3238392 - DNA, 18 bp, Homo sapiens
gaggacttgtgtctctgt

SEQ ID NO: 3238393 - DNA, 16 bp, Homo sapiens
gaggacttttctttgt

SEQ ID NO: 3238394 - DNA, 12 bp, Homo sapiens
gaggagagagac

SEQ ID NO: 3238395 - DNA, 15 bp, Homo sapiens
gaggagagaggcaga

SEQ ID NO: 3238396 - DNA, 14 bp, Homo sapiens
gaggagaggagaga

SEQ ID NO: 3238397 - DNA, 16 bp, Homo sapiens
gaggagaggagagagg

SEQ ID NO: 3238398 - DNA, 16 bp, Homo sapiens
gaggagcacctgaacc

SEQ ID NO: 3238399 - DNA, 17 bp, Homo sapiens
gaggagcacctgaaccc

SEQ ID NO: 3238400 - DNA, 23 bp, Homo sapiens
gaggagcagcttccttctgggac

SEQ ID NO: 3238401 - DNA, 21 bp, Homo sapiens
gaggagcatgttttgtataca

SEQ ID NO: 3238402 - DNA, 16 bp, Homo sapiens
gaggagccaccagttc

SEQ ID NO: 3238403 - DNA, 16 bp, Homo sapiens
gaggagctgggcccct

SEQ ID NO: 3238404 - DNA, 18 bp, Homo sapiens
gaggaggaaaaggaaaaa

SEQ ID NO: 3238405 - DNA, 15 bp, Homo sapiens
gaggaggaagaccat

SEQ ID NO: 3238406 - DNA, 16 bp, Homo sapiens
gaggaggagatggcca

SEQ ID NO: 3238407 - DNA, 18 bp, Homo sapiens
gaggaggcgcggcctccc

SEQ ID NO: 3238408 - DNA, 11 bp, Homo sapiens
gaggagggaga

SEQ ID NO: 3238409 - DNA, 12 bp, Homo sapiens
gaggagggagaa

SEQ ID NO: 3238410 - DNA, 14 bp, Homo sapiens
gaggagggaggcca

SEQ ID NO: 3238411 - DNA, 22 bp, Homo sapiens
gaggagggaggccgggcggtca

SEQ ID NO: 3238412 - DNA, 19 bp, Homo sapiens
gaggagggatgctgctccg

SEQ ID NO: 3238413 - DNA, 17 bp, Homo sapiens
gaggagggcagtccaag

SEQ ID NO: 3238414 - DNA, 22 bp, Homo sapiens
gaggaggggcccggtggcggca

SEQ ID NO: 3238415 - DNA, 16 bp, Homo sapiens
gaggagggtggaggaa

SEQ ID NO: 3238416 - DNA, 20 bp, Homo sapiens
gaggagggtttgggcagagc

SEQ ID NO: 3238417 - DNA, 15 bp, Homo sapiens
gaggaggtggcagcc

SEQ ID NO: 3238418 - DNA, 14 bp, Homo sapiens
gaggagtaaaattc

SEQ ID NO: 3238419 - DNA, 12 bp, Homo sapiens
gaggagtaacaa

SEQ ID NO: 3238420 - DNA, 13 bp, Homo sapiens
gaggagtgaggaa

SEQ ID NO: 3238421 - DNA, 14 bp, Homo sapiens
gaggagtggaggtg

SEQ ID NO: 3238422 - DNA, 12 bp, Homo sapiens
gaggagtttcct

SEQ ID NO: 3238423 - DNA, 18 bp, Homo sapiens
gaggatatattttcactt

SEQ ID NO: 3238424 - DNA, 16 bp, Homo sapiens
gaggatcactggagcc

SEQ ID NO: 3238425 - DNA, 21 bp, Homo sapiens
gaggatgaatgtatgtgcact

SEQ ID NO: 3238426 - DNA, 15 bp, Homo sapiens
gaggatgagagccca

SEQ ID NO: 3238427 - DNA, 16 bp, Homo sapiens
gaggatgagagcccag

SEQ ID NO: 3238428 - DNA, 20 bp, Homo sapiens
gaggatgagagcccagaggt

SEQ ID NO: 3238429 - DNA, 16 bp, Homo sapiens
gaggatggccagtgtc

SEQ ID NO: 3238430 - DNA, 18 bp, Homo sapiens
gaggatgtccctgggcca

SEQ ID NO: 3238431 - DNA, 18 bp, Homo sapiens
gaggatgtctcaaacttc

SEQ ID NO: 3238432 - DNA, 17 bp, Homo sapiens
gaggattcaggggctgg

SEQ ID NO: 3238433 - DNA, 19 bp, Homo sapiens
gaggattcaggggctgggg

SEQ ID NO: 3238434 - DNA, 23 bp, Homo sapiens
gaggattgtggaaaaccaggaaa

SEQ ID NO: 3238435 - DNA, 22 bp, Homo sapiens
gaggatttaagggatggaaaag

SEQ ID NO: 3238436 - DNA, 15 bp, Homo sapiens
gaggatttcaagcct

SEQ ID NO: 3238437 - DNA, 16 bp, Homo sapiens
gaggcaaattaactgt

SEQ ID NO: 3238438 - DNA, 22 bp, Homo sapiens
gaggcacagttttagaataagg

SEQ ID NO: 3238439 - DNA, 13 bp, Homo sapiens
gaggcaccagctc

SEQ ID NO: 3238440 - DNA, 14 bp, Homo sapiens
gaggcaccagctct

SEQ ID NO: 3238441 - DNA, 15 bp, Homo sapiens
gaggcaccagctctg

SEQ ID NO: 3238442 - DNA, 16 bp, Homo sapiens
gaggcaccagctctgt

SEQ ID NO: 3238443 - DNA, 20 bp, Homo sapiens
gaggcaccagctctgtggcc

SEQ ID NO: 3238444 - DNA, 23 bp, Homo sapiens
gaggcaccagctctgtggcctgt

SEQ ID NO: 3238445 - DNA, 12 bp, Homo sapiens
gaggcagagagc

SEQ ID NO: 3238446 - DNA, 15 bp, Homo sapiens
gaggcagagagcggt

SEQ ID NO: 3238447 - DNA, 21 bp, Homo sapiens
gaggcagcatgcttgggctga

SEQ ID NO: 3238448 - DNA, 22 bp, Homo sapiens
gaggcagcatggagagaggcct

SEQ ID NO: 3238449 - DNA, 19 bp, Homo sapiens
gaggcagcttcaagtgcct

SEQ ID NO: 3238450 - DNA, 17 bp, Homo sapiens
gaggcagggaggggact

SEQ ID NO: 3238451 - DNA, 18 bp, Homo sapiens
gaggcagggtctcactct

SEQ ID NO: 3238452 - DNA, 14 bp, Homo sapiens
gaggcatcctgcct

SEQ ID NO: 3238453 - DNA, 16 bp, Homo sapiens
gaggcatcctgcctgg

SEQ ID NO: 3238454 - DNA, 17 bp, Homo sapiens
gaggcatcctgcctggg

SEQ ID NO: 3238455 - DNA, 20 bp, Homo sapiens
gaggcatcctgcctgggtgg

SEQ ID NO: 3238456 - DNA, 23 bp, Homo sapiens
gaggcatcctgcctgggtgggac

SEQ ID NO: 3238457 - DNA, 13 bp, Homo sapiens
gaggcatggccct

SEQ ID NO: 3238458 - DNA, 14 bp, Homo sapiens
gaggcatggccctg

SEQ ID NO: 3238459 - DNA, 22 bp, Homo sapiens
gaggcattacttgctttcaatt

SEQ ID NO: 3238460 - DNA, 23 bp, Homo sapiens
gaggcattgttagtttagtgtgt

SEQ ID NO: 3238461 - DNA, 15 bp, Homo sapiens
gagtgtaggtgactt

SEQ ID NO: 3238462 - DNA, 16 bp, Homo sapiens
gagtgtcctgcccatg

SEQ ID NO: 3238463 - DNA, 12 bp, Homo sapiens
gagtgtgacagg

SEQ ID NO: 3238464 - DNA, 14 bp, Homo sapiens
gagtgtgacagggc

SEQ ID NO: 3238465 - DNA, 15 bp, Homo sapiens
gagtgtgacagggcc

SEQ ID NO: 3238466 - DNA, 13 bp, Homo sapiens
gagtgtgcatgga

SEQ ID NO: 3238467 - DNA, 15 bp, Homo sapiens
gagtgtgcatggagg

SEQ ID NO: 3238468 - DNA, 20 bp, Homo sapiens
gagtgtgcatggaggccctc

SEQ ID NO: 3238469 - DNA, 15 bp, Homo sapiens
gagtgtgctgacttt

SEQ ID NO: 3238470 - DNA, 15 bp, Homo sapiens
gagtgtggactctgg

SEQ ID NO: 3238471 - DNA, 16 bp, Homo sapiens
gagtgtgtaaggtata

SEQ ID NO: 3238472 - DNA, 17 bp, Homo sapiens
gagtgtgtattgttccc

SEQ ID NO: 3238473 - DNA, 14 bp, Homo sapiens
gagtgtgtgtgtgt

SEQ ID NO: 3238474 - DNA, 19 bp, Homo sapiens
gagtgtgtgtttgtgctga

SEQ ID NO: 3238475 - DNA, 21 bp, Homo sapiens
gagtgttcattttagtgactg

SEQ ID NO: 3238476 - DNA, 22 bp, Homo sapiens
gagtgttcattttagtgactgt

SEQ ID NO: 3238477 - DNA, 22 bp, Homo sapiens
gagtgttgggcatgtgatcacg

SEQ ID NO: 3238478 - DNA, 18 bp, Homo sapiens
gagtgtttctaataaact

SEQ ID NO: 3238479 - DNA, 23 bp, Homo sapiens
gagtgtttgggggacgtttctca

SEQ ID NO: 3238480 - DNA, 13 bp, Homo sapiens
gagttaagaagct

SEQ ID NO: 3238481 - DNA, 19 bp, Homo sapiens
gagttaatgatggcagagg

SEQ ID NO: 3238482 - DNA, 16 bp, Homo sapiens
gagttacagttctgtg

SEQ ID NO: 3238483 - DNA, 19 bp, Homo sapiens
gagttacttgtctgaggcc

SEQ ID NO: 3238484 - DNA, 18 bp, Homo sapiens
gagttatcatgaatttta

SEQ ID NO: 3238485 - DNA, 20 bp, Homo sapiens
gagttatcatgaattttaaa

SEQ ID NO: 3238486 - DNA, 20 bp, Homo sapiens
gagttattcataaagagaaa

SEQ ID NO: 3238487 - DNA, 14 bp, Homo sapiens
gagttcacaggagg

SEQ ID NO: 3238488 - DNA, 19 bp, Homo sapiens
gagttcacaggaggccagt

SEQ ID NO: 3238489 - DNA, 20 bp, Homo sapiens
gagttcacaggaggccagtg

SEQ ID NO: 3238490 - DNA, 16 bp, Homo sapiens
gagttcaccatctctt

SEQ ID NO: 3238491 - DNA, 14 bp, Homo sapiens
gagttcatccaggc

SEQ ID NO: 3238492 - DNA, 19 bp, Homo sapiens
gagttccaagttgaaggga

SEQ ID NO: 3238493 - DNA, 23 bp, Homo sapiens
gagttcccccaaccatcttcact

SEQ ID NO: 3238494 - DNA, 22 bp, Homo sapiens
gagttcccttgaaactttggga

SEQ ID NO: 3238495 - DNA, 18 bp, Homo sapiens
gagttcgagaccagcctc

SEQ ID NO: 3238496 - DNA, 19 bp, Homo sapiens
gagttcgtaccgcttcctt

SEQ ID NO: 3238497 - DNA, 18 bp, Homo sapiens
gagttctcagggctcctg

SEQ ID NO: 3238498 - DNA, 14 bp, Homo sapiens
gagttctgtgaaga

SEQ ID NO: 3238499 - DNA, 21 bp, Homo sapiens
gagttctgtgtattttcagtc

SEQ ID NO: 3238500 - DNA, 15 bp, Homo sapiens
gagttcttgtgccat

SEQ ID NO: 3238501 - DNA, 16 bp, Homo sapiens
gagttgccaagacaaa

SEQ ID NO: 3238502 - DNA, 18 bp, Homo sapiens
gagttgctgcaaacctga

SEQ ID NO: 3238503 - DNA, 18 bp, Homo sapiens
gagttgctgccacaaaca

SEQ ID NO: 3238504 - DNA, 20 bp, Homo sapiens
gagttggcaaaatggggttt

SEQ ID NO: 3238505 - DNA, 15 bp, Homo sapiens
gagttgtgatgaatc

SEQ ID NO: 3238506 - DNA, 20 bp, Homo sapiens
gagttgtggaaagcctctgc

SEQ ID NO: 3238507 - DNA, 21 bp, Homo sapiens
gagtttaaaaatggtatcaaa

SEQ ID NO: 3238508 - DNA, 18 bp, Homo sapiens
gagtttcattctcctgcc

SEQ ID NO: 3238509 - DNA, 20 bp, Homo sapiens
gagtttcattctcctgcctg

SEQ ID NO: 3238510 - DNA, 18 bp, Homo sapiens
gagtttccactatcccaa

SEQ ID NO: 3238511 - DNA, 15 bp, Homo sapiens
gagtttcctaaaagt

SEQ ID NO: 3238512 - DNA, 13 bp, Homo sapiens
gagtttctaaggt

SEQ ID NO: 3238513 - DNA, 16 bp, Homo sapiens
gagtttctaaggtccg

SEQ ID NO: 3238514 - DNA, 17 bp, Homo sapiens
gagtttgagctgccttc

SEQ ID NO: 3238515 - DNA, 14 bp, Homo sapiens
gagtttgccttcct

SEQ ID NO: 3238516 - DNA, 23 bp, Homo sapiens
gagtttgtaggtaaaatgtattt

SEQ ID NO: 3238517 - DNA, 23 bp, Homo sapiens
gagttttcctctatacatctctc

SEQ ID NO: 3238518 - DNA, 20 bp, Homo sapiens
gagtttttatgcctttctct

SEQ ID NO: 3238519 - DNA, 13 bp, Homo sapiens
gataaaagatggc

SEQ ID NO: 3238520 - DNA, 16 bp, Homo sapiens
gataaaagatggccat

SEQ ID NO: 3238521 - DNA, 16 bp, Homo sapiens
gataaaaggtttcttt

SEQ ID NO: 3238522 - DNA, 16 bp, Homo sapiens
gataaaccaataaatc

SEQ ID NO: 3238523 - DNA, 12 bp, Homo sapiens
gataaagatgat

SEQ ID NO: 3238524 - DNA, 22 bp, Homo sapiens
gataaagatgcaaggaccagga

SEQ ID NO: 3238525 - DNA, 15 bp, Homo sapiens
gataaagcacagctg

SEQ ID NO: 3238526 - DNA, 13 bp, Homo sapiens
gataaatatatat

SEQ ID NO: 3238527 - DNA, 15 bp, Homo sapiens
gataaatatatatga

SEQ ID NO: 3238528 - DNA, 13 bp, Homo sapiens
gataaatatttga

SEQ ID NO: 3238529 - DNA, 18 bp, Homo sapiens
gataaatcataaagtcag

SEQ ID NO: 3238530 - DNA, 18 bp, Homo sapiens
gataaatcatttcagtat

SEQ ID NO: 3238531 - DNA, 12 bp, Homo sapiens
gataaattataa

SEQ ID NO: 3238532 - DNA, 13 bp, Homo sapiens
gataaattataag

SEQ ID NO: 3238533 - DNA, 15 bp, Homo sapiens
gataacaagatcttt

SEQ ID NO: 3238534 - DNA, 21 bp, Homo sapiens
gataacgcttaaaggaagtca

SEQ ID NO: 3238535 - DNA, 21 bp, Homo sapiens
gataactctgcaaaggcctgg

SEQ ID NO: 3238536 - DNA, 14 bp, Homo sapiens
gataactgatttct

SEQ ID NO: 3238537 - DNA, 23 bp, Homo sapiens
gataactgatttctatggctttc

SEQ ID NO: 3238538 - DNA, 19 bp, Homo sapiens
gataacttttttgagtcat

SEQ ID NO: 3238539 - DNA, 22 bp, Homo sapiens
gataagaatgctggttttccta

SEQ ID NO: 3238540 - DNA, 11 bp, Homo sapiens
gataagcctga

SEQ ID NO: 3238541 - DNA, 14 bp, Homo sapiens
gataagcctgagcc

SEQ ID NO: 3238542 - DNA, 12 bp, Homo sapiens
gataagtggaaa

SEQ ID NO: 3238543 - DNA, 13 bp, Homo sapiens
gataagtggaaaa

SEQ ID NO: 3238544 - DNA, 22 bp, Homo sapiens
gataagtttctattctgtcagt

SEQ ID NO: 3238545 - DNA, 17 bp, Homo sapiens
gataataatattgtttt

SEQ ID NO: 3238546 - DNA, 13 bp, Homo sapiens
gataatagattct

SEQ ID NO: 3238547 - DNA, 16 bp, Homo sapiens
gataatcccaccaccc

SEQ ID NO: 3238548 - DNA, 20 bp, Homo sapiens
gataatctcagtgctttcct

SEQ ID NO: 3238549 - DNA, 12 bp, Homo sapiens
gataatgttaaa

SEQ ID NO: 3238550 - DNA, 19 bp, Homo sapiens
gataattcatttgtattgc

SEQ ID NO: 3238551 - DNA, 20 bp, Homo sapiens
gataattcatttgtattgct

SEQ ID NO: 3238552 - DNA, 16 bp, Homo sapiens
gataattgctatttat

SEQ ID NO: 3238553 - DNA, 22 bp, Homo sapiens
gataattgctatttatttttac

SEQ ID NO: 3238554 - DNA, 14 bp, Homo sapiens
gataattgttgaaa

SEQ ID NO: 3238555 - DNA, 12 bp, Homo sapiens
gataatttgaaa

SEQ ID NO: 3238556 - DNA, 12 bp, Homo sapiens
gataatttgcat

SEQ ID NO: 3238557 - DNA, 13 bp, Homo sapiens
gataatttgcata

SEQ ID NO: 3238558 - DNA, 22 bp, Homo sapiens
gataatttgcatattctattgt

SEQ ID NO: 3238559 - DNA, 13 bp, Homo sapiens
gatacaaagtgtt

SEQ ID NO: 3238560 - DNA, 20 bp, Homo sapiens
gatacactgaagttaacaga

SEQ ID NO: 3238561 - DNA, 17 bp, Homo sapiens
gatacagaaatgcaaaa

SEQ ID NO: 3238562 - DNA, 20 bp, Homo sapiens
gatacaggaaaagctgctga

SEQ ID NO: 3238563 - DNA, 21 bp, Homo sapiens
gatacataactaaatttgata

SEQ ID NO: 3238564 - DNA, 14 bp, Homo sapiens
gatacatcactgct

SEQ ID NO: 3238565 - DNA, 16 bp, Homo sapiens
gatacatcactgcttg

SEQ ID NO: 3238566 - DNA, 19 bp, Homo sapiens
gataccaagatgccatctg

SEQ ID NO: 3238567 - DNA, 12 bp, Homo sapiens
gataccagcccc

SEQ ID NO: 3238568 - DNA, 20 bp, Homo sapiens
gataccaggttgaaagacct

SEQ ID NO: 3238569 - DNA, 19 bp, Homo sapiens
gataccatgctgtaaggat

SEQ ID NO: 3238570 - DNA, 18 bp, Homo sapiens
gatacccaggaccaagcc

SEQ ID NO: 3238571 - DNA, 19 bp, Homo sapiens
gatacgtagttgtgctttt

SEQ ID NO: 3238572 - DNA, 13 bp, Homo sapiens
gatactacatctt

SEQ ID NO: 3238573 - DNA, 15 bp, Homo sapiens
gatactactttctct

SEQ ID NO: 3238574 - DNA, 17 bp, Homo sapiens
gatactctgtcagatgg

SEQ ID NO: 3238575 - DNA, 17 bp, Homo sapiens
gatactgattatgaaat

SEQ ID NO: 3238576 - DNA, 18 bp, Homo sapiens
gatactgattatgaaatg

SEQ ID NO: 3238577 - DNA, 19 bp, Homo sapiens
gatactgattatgaaatgt

SEQ ID NO: 3238578 - DNA, 17 bp, Homo sapiens
gatactgcgactttctg

SEQ ID NO: 3238579 - DNA, 20 bp, Homo sapiens
gatactggaagttttgcatt

SEQ ID NO: 3238580 - DNA, 16 bp, Homo sapiens
gatactggcacagagg

SEQ ID NO: 3238581 - DNA, 23 bp, Homo sapiens
gatacttggatttagtttcagta

SEQ ID NO: 3238582 - DNA, 17 bp, Homo sapiens
gatacttgttccagatg

SEQ ID NO: 3238583 - DNA, 13 bp, Homo sapiens
gatactttacatg

SEQ ID NO: 3238584 - DNA, 15 bp, Homo sapiens
gatagagctgggtgg

SEQ ID NO: 3238585 - DNA, 21 bp, Homo sapiens
gatagatgcacttatgcagta

SEQ ID NO: 3238586 - DNA, 21 bp, Homo sapiens
gatagattgtatctcttaaag

SEQ ID NO: 3238587 - DNA, 14 bp, Homo sapiens
gatggtaagagaaa

SEQ ID NO: 3238588 - DNA, 15 bp, Homo sapiens
gatggtaagagaaaa

SEQ ID NO: 3238589 - DNA, 13 bp, Homo sapiens
gatggtcctgggg

SEQ ID NO: 3238590 - DNA, 21 bp, Homo sapiens
gatggtcctggggctctgtgc

SEQ ID NO: 3238591 - DNA, 13 bp, Homo sapiens
gatggtcgtgtgt

SEQ ID NO: 3238592 - DNA, 16 bp, Homo sapiens
gatggtgagctgggaa

SEQ ID NO: 3238593 - DNA, 18 bp, Homo sapiens
gatggtggactaagcaat

SEQ ID NO: 3238594 - DNA, 17 bp, Homo sapiens
gatggtggactacaaaa

SEQ ID NO: 3238595 - DNA, 17 bp, Homo sapiens
gatggttattttctttt

SEQ ID NO: 3238596 - DNA, 21 bp, Homo sapiens
gatggttcccctgttcactct

SEQ ID NO: 3238597 - DNA, 18 bp, Homo sapiens
gatggttcttcacctcct

SEQ ID NO: 3238598 - DNA, 23 bp, Homo sapiens
gatgtaaataaccccattctttg

SEQ ID NO: 3238599 - DNA, 11 bp, Homo sapiens
gatgtaattga

SEQ ID NO: 3238600 - DNA, 12 bp, Homo sapiens
gatgtaatttag

SEQ ID NO: 3238601 - DNA, 23 bp, Homo sapiens
gatgtaatttagggtactaaatt

SEQ ID NO: 3238602 - DNA, 19 bp, Homo sapiens
gatgtacagtctgtcatga

SEQ ID NO: 3238603 - DNA, 19 bp, Homo sapiens
gatgtaccatgaaacaaag

SEQ ID NO: 3238604 - DNA, 13 bp, Homo sapiens
gatgtagtatttt

SEQ ID NO: 3238605 - DNA, 20 bp, Homo sapiens
gatgtagttctgccaggcaa

SEQ ID NO: 3238606 - DNA, 15 bp, Homo sapiens
gatgtatatgtttat

SEQ ID NO: 3238607 - DNA, 19 bp, Homo sapiens
gatgtatctgagttgccaa

SEQ ID NO: 3238608 - DNA, 18 bp, Homo sapiens
gatgtcaatttctgtgtt

SEQ ID NO: 3238609 - DNA, 15 bp, Homo sapiens
gatgtcacagggcca

SEQ ID NO: 3238610 - DNA, 15 bp, Homo sapiens
gatgtcagcttccca

SEQ ID NO: 3238611 - DNA, 15 bp, Homo sapiens
gatgtcagtatttca

SEQ ID NO: 3238612 - DNA, 18 bp, Homo sapiens
gatgtcccaacttgtaaa

SEQ ID NO: 3238613 - DNA, 22 bp, Homo sapiens
gatgtcctctttactcccttcc

SEQ ID NO: 3238614 - DNA, 14 bp, Homo sapiens
gatgtctccagatt

SEQ ID NO: 3238615 - DNA, 12 bp, Homo sapiens
gatgtctctggg

SEQ ID NO: 3238616 - DNA, 21 bp, Homo sapiens
gatgtctctggggcagatccc

SEQ ID NO: 3238617 - DNA, 13 bp, Homo sapiens
gatgtctcttgta

SEQ ID NO: 3238618 - DNA, 20 bp, Homo sapiens
gatgtcttatttttagatgg

SEQ ID NO: 3238619 - DNA, 13 bp, Homo sapiens
gatgtcttctgcc

SEQ ID NO: 3238620 - DNA, 14 bp, Homo sapiens
gatgtcttctgcct

SEQ ID NO: 3238621 - DNA, 13 bp, Homo sapiens
gatgtcttggaac

SEQ ID NO: 3238622 - DNA, 21 bp, Homo sapiens
gatgtcttggaacattggaat

SEQ ID NO: 3238623 - DNA, 22 bp, Homo sapiens
gatgtcttggaacattggaatg

SEQ ID NO: 3238624 - DNA, 13 bp, Homo sapiens
gatgtgaaaatat

SEQ ID NO: 3238625 - DNA, 15 bp, Homo sapiens
gatgtgacattccat

SEQ ID NO: 3238626 - DNA, 15 bp, Homo sapiens
gatgtgacccaccag

SEQ ID NO: 3238627 - DNA, 14 bp, Homo sapiens
gatgtgactgtata

SEQ ID NO: 3238628 - DNA, 11 bp, Homo sapiens
gatgtgacttt

SEQ ID NO: 3238629 - DNA, 15 bp, Homo sapiens
gatgtgagccccagg

SEQ ID NO: 3238630 - DNA, 11 bp, Homo sapiens
gatgtgatata

SEQ ID NO: 3238631 - DNA, 18 bp, Homo sapiens
gatgtgatatataagtgt

SEQ ID NO: 3238632 - DNA, 15 bp, Homo sapiens
gatgtgattgtggaa

SEQ ID NO: 3238633 - DNA, 18 bp, Homo sapiens
gatgtgattgtggaatgg

SEQ ID NO: 3238634 - DNA, 14 bp, Homo sapiens
gatgtgcaattgat

SEQ ID NO: 3238635 - DNA, 22 bp, Homo sapiens
gatgtgcatttcacctgtgaca

SEQ ID NO: 3238636 - DNA, 17 bp, Homo sapiens
gatgtgcccaggggagc

SEQ ID NO: 3238637 - DNA, 19 bp, Homo sapiens
gatgtggcaaagtgctgta

SEQ ID NO: 3238638 - DNA, 22 bp, Homo sapiens
gatgtgggagggagcagacagg

SEQ ID NO: 3238639 - DNA, 23 bp, Homo sapiens
gatgtgggagggagcagacagga

SEQ ID NO: 3238640 - DNA, 15 bp, Homo sapiens
gatgtggtgcctgag

SEQ ID NO: 3238641 - DNA, 18 bp, Homo sapiens
gatgtgtcctcagggagc

SEQ ID NO: 3238642 - DNA, 13 bp, Homo sapiens
gatgtgtggggca

SEQ ID NO: 3238643 - DNA, 20 bp, Homo sapiens
gatgtgttcattcaagctat

SEQ ID NO: 3238644 - DNA, 22 bp, Homo sapiens
gatgtgttcattcaagctattt

SEQ ID NO: 3238645 - DNA, 16 bp, Homo sapiens
gatgtgttcctcctgc

SEQ ID NO: 3238646 - DNA, 17 bp, Homo sapiens
gatgtgttcctcctgct

SEQ ID NO: 3238647 - DNA, 18 bp, Homo sapiens
gatgtgttcctcctgctg

SEQ ID NO: 3238648 - DNA, 14 bp, Homo sapiens
gatgtgttcttatt

SEQ ID NO: 3238649 - DNA, 20 bp, Homo sapiens
gatgttaacaagaggggaaa

SEQ ID NO: 3238650 - DNA, 18 bp, Homo sapiens
gatgttcactgtggcatt

SEQ ID NO: 3238651 - DNA, 16 bp, Homo sapiens
gatgttctaaggctct

SEQ ID NO: 3238652 - DNA, 18 bp, Homo sapiens
gatgttctaaggctctga

SEQ ID NO: 3238653 - DNA, 18 bp, Homo sapiens
gatgttgaagaatacagt

SEQ ID NO: 3238654 - DNA, 23 bp, Homo sapiens
gatgttgaatgcccacaggcaaa

SEQ ID NO: 3238655 - DNA, 18 bp, Homo sapiens
gatgtttattcttctaga

SEQ ID NO: 3238656 - DNA, 22 bp, Homo sapiens
gatgtttgctcttgtttttatt

SEQ ID NO: 3238657 - DNA, 14 bp, Homo sapiens
gatgtttgtggcct

SEQ ID NO: 3238658 - DNA, 13 bp, Homo sapiens
gatgttttagcat

SEQ ID NO: 3238659 - DNA, 14 bp, Homo sapiens
gattaaaacaattt

SEQ ID NO: 3238660 - DNA, 13 bp, Homo sapiens
gattaaaggaagg

SEQ ID NO: 3238661 - DNA, 19 bp, Homo sapiens
gattaaatatagattagaa

SEQ ID NO: 3238662 - DNA, 20 bp, Homo sapiens
gattaaatatagattagaaa

SEQ ID NO: 3238663 - DNA, 20 bp, Homo sapiens
gattaaatgtgtcattggaa

SEQ ID NO: 3238664 - DNA, 19 bp, Homo sapiens
gattaaattacagctttta

SEQ ID NO: 3238665 - DNA, 13 bp, Homo sapiens
gattaacaaatat

SEQ ID NO: 3238666 - DNA, 16 bp, Homo sapiens
gattaacaaatatgct

SEQ ID NO: 3238667 - DNA, 14 bp, Homo sapiens
gattaatatgaaaa

SEQ ID NO: 3238668 - DNA, 17 bp, Homo sapiens
gattaatctttaataac

SEQ ID NO: 3238669 - DNA, 14 bp, Homo sapiens
gattaatggcactg

SEQ ID NO: 3238670 - DNA, 13 bp, Homo sapiens
gattaatgtttct

SEQ ID NO: 3238671 - DNA, 16 bp, Homo sapiens
gattaatgttttcatt

SEQ ID NO: 3238672 - DNA, 17 bp, Homo sapiens
gattacaaatcagaagt

SEQ ID NO: 3238673 - DNA, 23 bp, Homo sapiens
gattacaaatcagaagtcatctt

SEQ ID NO: 3238674 - DNA, 21 bp, Homo sapiens
gattacaagcgtgagccactg

SEQ ID NO: 3238675 - DNA, 16 bp, Homo sapiens
gattacagaaactgat

SEQ ID NO: 3238676 - DNA, 17 bp, Homo sapiens
gattacagaaactgatg

SEQ ID NO: 3238677 - DNA, 13 bp, Homo sapiens
gattacagaggaa

SEQ ID NO: 3238678 - DNA, 19 bp, Homo sapiens
gattacaggaatgaagaac

SEQ ID NO: 3238679 - DNA, 23 bp, Homo sapiens
gattactctccatatcccttcct

SEQ ID NO: 3238680 - DNA, 18 bp, Homo sapiens
gattactgtcaataaaca

SEQ ID NO: 3238681 - DNA, 17 bp, Homo sapiens
gattagagggaggtgtt

SEQ ID NO: 3238682 - DNA, 19 bp, Homo sapiens
gattagcaagttacagtga

SEQ ID NO: 3238683 - DNA, 20 bp, Homo sapiens
gattaggagaaacacattct

SEQ ID NO: 3238684 - DNA, 12 bp, Homo sapiens
gattaggattaa

SEQ ID NO: 3238685 - DNA, 16 bp, Homo sapiens
gattaggattaaaatg

SEQ ID NO: 3238686 - DNA, 15 bp, Homo sapiens
gattatagattctaa

SEQ ID NO: 3238687 - DNA, 18 bp, Homo sapiens
gattatagattctaaaga

SEQ ID NO: 3238688 - DNA, 20 bp, Homo sapiens
gattatatcaaagtatttgt

SEQ ID NO: 3238689 - DNA, 13 bp, Homo sapiens
gattatgaaatgt

SEQ ID NO: 3238690 - DNA, 19 bp, Homo sapiens
gattatgatgcatacagtt

SEQ ID NO: 3238691 - DNA, 22 bp, Homo sapiens
gattatgatgcatacagttttc

SEQ ID NO: 3238692 - DNA, 16 bp, Homo sapiens
gattatggttttgtga

SEQ ID NO: 3238693 - DNA, 17 bp, Homo sapiens
gattatggttttgtgat

SEQ ID NO: 3238694 - DNA, 23 bp, Homo sapiens
gattattaactaatatgggcatt

SEQ ID NO: 3238695 - DNA, 15 bp, Homo sapiens
gattattcatttaaa

SEQ ID NO: 3238696 - DNA, 22 bp, Homo sapiens
gattattcatttaaaatgatta

SEQ ID NO: 3238697 - DNA, 14 bp, Homo sapiens
gattatttaataac

SEQ ID NO: 3238698 - DNA, 12 bp, Homo sapiens
gattatttatcc

SEQ ID NO: 3238699 - DNA, 14 bp, Homo sapiens
gattatttcacttt

SEQ ID NO: 3238700 - DNA, 13 bp, Homo sapiens
gattcaaaggttc

SEQ ID NO: 3238701 - DNA, 18 bp, Homo sapiens
gattcaaattgctgcttg

SEQ ID NO: 3238702 - DNA, 18 bp, Homo sapiens
gattcaatctgtaaactg

SEQ ID NO: 3238703 - DNA, 19 bp, Homo sapiens
gattcaatctgtaaactgt

SEQ ID NO: 3238704 - DNA, 23 bp, Homo sapiens
gattcagaaaatgttctgtttgc

SEQ ID NO: 3238705 - DNA, 12 bp, Homo sapiens
gattcagaaatt

SEQ ID NO: 3238706 - DNA, 12 bp, Homo sapiens
gattcagcaaaa

SEQ ID NO: 3238707 - DNA, 13 bp, Homo sapiens
gattcaggaatgt

SEQ ID NO: 3238708 - DNA, 13 bp, Homo sapiens
gattcaggccagc

SEQ ID NO: 3238709 - DNA, 18 bp, Homo sapiens
gattcaggccagcccagc

SEQ ID NO: 3238710 - DNA, 13 bp, Homo sapiens
gattcaggctgct

SEQ ID NO: 3238711 - DNA, 17 bp, Homo sapiens
gattcaggtatgttgcc

SEQ ID NO: 3238712 - DNA, 19 bp, Homo sapiens
gattcatagtaacttctta

SEQ ID NO: 3238713 - DNA, 18 bp, Homo sapiens
gattcatatttacttctt

SEQ ID NO: 3238714 - DNA, 19 bp, Homo sapiens
gcacacagcagccccccag

SEQ ID NO: 3238715 - DNA, 21 bp, Homo sapiens
gcacacagcagccccccagca

SEQ ID NO: 3238716 - DNA, 18 bp, Homo sapiens
gcacacagctactctccc

SEQ ID NO: 3238717 - DNA, 18 bp, Homo sapiens
gcacacagctgagcactt

SEQ ID NO: 3238718 - DNA, 22 bp, Homo sapiens
gcacacagctgagcacttagca

SEQ ID NO: 3238719 - DNA, 14 bp, Homo sapiens
gcacacagggcccg

SEQ ID NO: 3238720 - DNA, 23 bp, Homo sapiens
gcacacagggcccggccacaccc

SEQ ID NO: 3238721 - DNA, 14 bp, Homo sapiens
gcacacagtcacct

SEQ ID NO: 3238722 - DNA, 14 bp, Homo sapiens
gcacaccaccctcc

SEQ ID NO: 3238723 - DNA, 13 bp, Homo sapiens
gcacaccactgcc

SEQ ID NO: 3238724 - DNA, 21 bp, Homo sapiens
gcacaccactgccctgcctgc

SEQ ID NO: 3238725 - DNA, 12 bp, Homo sapiens
gcacaccagccg

SEQ ID NO: 3238726 - DNA, 19 bp, Homo sapiens
gcacaccctcactctgcca

SEQ ID NO: 3238727 - DNA, 21 bp, Homo sapiens
gcacaccctcactctgccagg

SEQ ID NO: 3238728 - DNA, 22 bp, Homo sapiens
gcacacgggaaagccttaaaaa

SEQ ID NO: 3238729 - DNA, 20 bp, Homo sapiens
gcacactctgccagcaaaga

SEQ ID NO: 3238730 - DNA, 11 bp, Homo sapiens
gcacagaacag

SEQ ID NO: 3238731 - DNA, 12 bp, Homo sapiens
gcacagaacagg

SEQ ID NO: 3238732 - DNA, 23 bp, Homo sapiens
gcacagaacaggaggtgtgaatg

SEQ ID NO: 3238733 - DNA, 15 bp, Homo sapiens
gcacagaatttgtat

SEQ ID NO: 3238734 - DNA, 16 bp, Homo sapiens
gcacagacaagcagcc

SEQ ID NO: 3238735 - DNA, 17 bp, Homo sapiens
gcacagacacgctcgcg

SEQ ID NO: 3238736 - DNA, 22 bp, Homo sapiens
gcacagacacgctcgcgggcag

SEQ ID NO: 3238737 - DNA, 14 bp, Homo sapiens
gcacagacttctgg

SEQ ID NO: 3238738 - DNA, 15 bp, Homo sapiens
gcacagacttctgga

SEQ ID NO: 3238739 - DNA, 21 bp, Homo sapiens
gcacagacttctggaaggctg

SEQ ID NO: 3238740 - DNA, 18 bp, Homo sapiens
gcacagagctctccagct

SEQ ID NO: 3238741 - DNA, 21 bp, Homo sapiens
gcacagaggtcaggaagcagg

SEQ ID NO: 3238742 - DNA, 19 bp, Homo sapiens
gcacagatatactttgtgg

SEQ ID NO: 3238743 - DNA, 18 bp, Homo sapiens
gcacagatggatttgcct

SEQ ID NO: 3238744 - DNA, 22 bp, Homo sapiens
gcacagatggatttgcctgtgc

SEQ ID NO: 3238745 - DNA, 24 bp, Homo sapiens
gcacagatggatttgcctgtgcca

SEQ ID NO: 3238746 - DNA, 17 bp, Homo sapiens
gcacagattttaattgt

SEQ ID NO: 3238747 - DNA, 21 bp, Homo sapiens
gcacagattttaattgtcatg

SEQ ID NO: 3238748 - DNA, 12 bp, Homo sapiens
gcacagcagcct

SEQ ID NO: 3238749 - DNA, 13 bp, Homo sapiens
gcacagcagcctg

SEQ ID NO: 3238750 - DNA, 23 bp, Homo sapiens
gcacagccacccgtggggtgctg

SEQ ID NO: 3238751 - DNA, 14 bp, Homo sapiens
gcacagccctggga

SEQ ID NO: 3238752 - DNA, 11 bp, Homo sapiens
gcacagccctt

SEQ ID NO: 3238753 - DNA, 23 bp, Homo sapiens
gcacagcctagggtcttgggggt

SEQ ID NO: 3238754 - DNA, 12 bp, Homo sapiens
gcacagctcagg

SEQ ID NO: 3238755 - DNA, 23 bp, Homo sapiens
gcacagctccctgccaaactgaa

SEQ ID NO: 3238756 - DNA, 16 bp, Homo sapiens
gcacagctgtagtggg

SEQ ID NO: 3238757 - DNA, 17 bp, Homo sapiens
gcacagcttagatttca

SEQ ID NO: 3238758 - DNA, 23 bp, Homo sapiens
gcacagcttcatttcctgtgtct

SEQ ID NO: 3238759 - DNA, 21 bp, Homo sapiens
gcacagcttgacctgaggctg

SEQ ID NO: 3238760 - DNA, 15 bp, Homo sapiens
gcacaggaaaaggta

SEQ ID NO: 3238761 - DNA, 20 bp, Homo sapiens
gcacaggagtgtcctcttcc

SEQ ID NO: 3238762 - DNA, 15 bp, Homo sapiens
gcacaggatgctggc

SEQ ID NO: 3238763 - DNA, 12 bp, Homo sapiens
gcacaggcagct

SEQ ID NO: 3238764 - DNA, 14 bp, Homo sapiens
gcacaggcagctgg

SEQ ID NO: 3238765 - DNA, 14 bp, Homo sapiens
gcacaggccccctt

SEQ ID NO: 3238766 - DNA, 15 bp, Homo sapiens
gcacagggcaccaga

SEQ ID NO: 3238767 - DNA, 20 bp, Homo sapiens
gcacagggcaccagaggccg

SEQ ID NO: 3238768 - DNA, 12 bp, Homo sapiens
gcacaggggccc

SEQ ID NO: 3238769 - DNA, 16 bp, Homo sapiens
gcacaggggccccaga

SEQ ID NO: 3238770 - DNA, 17 bp, Homo sapiens
gcacagggtctgctctt

SEQ ID NO: 3238771 - DNA, 13 bp, Homo sapiens
gcacaggtcccac

SEQ ID NO: 3238772 - DNA, 21 bp, Homo sapiens
gcacaggtcccacctccagcc

SEQ ID NO: 3238773 - DNA, 23 bp, Homo sapiens
gcacaggtcccacctccagcccg

SEQ ID NO: 3238774 - DNA, 20 bp, Homo sapiens
gcacagtgcatctcagccca

SEQ ID NO: 3238775 - DNA, 20 bp, Homo sapiens
gcacagtggactcagcagtg

SEQ ID NO: 3238776 - DNA, 14 bp, Homo sapiens
gcacagtgggagct

SEQ ID NO: 3238777 - DNA, 16 bp, Homo sapiens
gcacagtgggagctga

SEQ ID NO: 3238778 - DNA, 20 bp, Homo sapiens
gcacagtgggagctgagctg

SEQ ID NO: 3238779 - DNA, 22 bp, Homo sapiens
gcacagtgtaatccaggggtgt

SEQ ID NO: 3238780 - DNA, 17 bp, Homo sapiens
gcacagtgttaaatgaa

SEQ ID NO: 3238781 - DNA, 19 bp, Homo sapiens
gcacagttgtctattctga

SEQ ID NO: 3238782 - DNA, 19 bp, Homo sapiens
gcacagttttagaataagg

SEQ ID NO: 3238783 - DNA, 23 bp, Homo sapiens
gcacagttttagaataaggagga

SEQ ID NO: 3238784 - DNA, 17 bp, Homo sapiens
gcacatacattaaaact

SEQ ID NO: 3238785 - DNA, 13 bp, Homo sapiens
gcacatatggact

SEQ ID NO: 3238786 - DNA, 19 bp, Homo sapiens
gcacatgacaactttgcca

SEQ ID NO: 3238787 - DNA, 14 bp, Homo sapiens
gcacatgctggcca

SEQ ID NO: 3238788 - DNA, 16 bp, Homo sapiens
gcacatgctggccagc

SEQ ID NO: 3238789 - DNA, 19 bp, Homo sapiens
gcacatgctggccagcctg

SEQ ID NO: 3238790 - DNA, 14 bp, Homo sapiens
gcacatgtaataaa

SEQ ID NO: 3238791 - DNA, 14 bp, Homo sapiens
gcacatttcaggga

SEQ ID NO: 3238792 - DNA, 15 bp, Homo sapiens
gcacatttcagggag

SEQ ID NO: 3238793 - DNA, 19 bp, Homo sapiens
gcacatttcagggagaaac

SEQ ID NO: 3238794 - DNA, 10 bp, Homo sapiens
gcaccaaaga

SEQ ID NO: 3238795 - DNA, 12 bp, Homo sapiens
gcaccaaagaca

SEQ ID NO: 3238796 - DNA, 22 bp, Homo sapiens
gcaccaaagacatcagtctcca

SEQ ID NO: 3238797 - DNA, 23 bp, Homo sapiens
gcaccaaagatgcagccgccttc

SEQ ID NO: 3238798 - DNA, 16 bp, Homo sapiens
gcaccaatgcccagca

SEQ ID NO: 3238799 - DNA, 16 bp, Homo sapiens
gcaccaattatcatct

SEQ ID NO: 3238800 - DNA, 15 bp, Homo sapiens
gcaccacaaaatata

SEQ ID NO: 3238801 - DNA, 17 bp, Homo sapiens
gcaccaccaagccaagg

SEQ ID NO: 3238802 - DNA, 23 bp, Homo sapiens
gcaccaccctagtcccttcccct

SEQ ID NO: 3238803 - DNA, 19 bp, Homo sapiens
gcaccactgcactccagcc

SEQ ID NO: 3238804 - DNA, 22 bp, Homo sapiens
gcaccactgcactccagcctgg

SEQ ID NO: 3238805 - DNA, 20 bp, Homo sapiens
gcaccagatgcaacctcact

SEQ ID NO: 3238806 - DNA, 14 bp, Homo sapiens
gcaccagccccctg

SEQ ID NO: 3238807 - DNA, 12 bp, Homo sapiens
gcaccagctctg

SEQ ID NO: 3238808 - DNA, 13 bp, Homo sapiens
gcaccagctctgt

SEQ ID NO: 3238809 - DNA, 18 bp, Homo sapiens
gcaccagctctgtggcct

SEQ ID NO: 3238810 - DNA, 13 bp, Homo sapiens
gcaccagctgctc

SEQ ID NO: 3238811 - DNA, 18 bp, Homo sapiens
gcaccagctgctctgccc

SEQ ID NO: 3238812 - DNA, 20 bp, Homo sapiens
gcaccagctgctctgcccct

SEQ ID NO: 3238813 - DNA, 21 bp, Homo sapiens
gcaccagctgctctgcccctt

SEQ ID NO: 3238814 - DNA, 12 bp, Homo sapiens
gcaccaggagac

SEQ ID NO: 3238815 - DNA, 20 bp, Homo sapiens
gcaccatctctgattttcaa

SEQ ID NO: 3238816 - DNA, 17 bp, Homo sapiens
gcaccattctgactcgg

SEQ ID NO: 3238817 - DNA, 22 bp, Homo sapiens
gcacccaccatcatgtctggct

SEQ ID NO: 3238818 - DNA, 19 bp, Homo sapiens
gcacccaccgtggaggagg

SEQ ID NO: 3238819 - DNA, 20 bp, Homo sapiens
gcacccaccgtggaggagga

SEQ ID NO: 3238820 - DNA, 14 bp, Homo sapiens
gcacccactcacca

SEQ ID NO: 3238821 - DNA, 16 bp, Homo sapiens
gcacccagctccaggg

SEQ ID NO: 3238822 - DNA, 17 bp, Homo sapiens
gcaccccaaagctttcc

SEQ ID NO: 3238823 - DNA, 20 bp, Homo sapiens
gcaccccaaagctttcctgc

SEQ ID NO: 3238824 - DNA, 16 bp, Homo sapiens
gcacccccaagcctgg

SEQ ID NO: 3238825 - DNA, 17 bp, Homo sapiens
gcacccccaagcctggg

SEQ ID NO: 3238826 - DNA, 23 bp, Homo sapiens
gcacccccacaagctgtccctgc

SEQ ID NO: 3238827 - DNA, 12 bp, Homo sapiens
gcacccccaccc

SEQ ID NO: 3238828 - DNA, 14 bp, Homo sapiens
gcacccccacccac

SEQ ID NO: 3238829 - DNA, 15 bp, Homo sapiens
gcacccccacccacc

SEQ ID NO: 3238830 - DNA, 18 bp, Homo sapiens
gcacccccacccacctcc

SEQ ID NO: 3238831 - DNA, 19 bp, Homo sapiens
gcacccccctgttctaagg

SEQ ID NO: 3238832 - DNA, 16 bp, Homo sapiens
gcaccccttccatgtg

SEQ ID NO: 3238833 - DNA, 12 bp, Homo sapiens
gcaccccttctc

SEQ ID NO: 3238834 - DNA, 22 bp, Homo sapiens
gcaccccttctctcctccccaa

SEQ ID NO: 3238835 - DNA, 13 bp, Homo sapiens
gcacccgcctctc

SEQ ID NO: 3238836 - DNA, 16 bp, Homo sapiens
gcacccgcctctcccg

SEQ ID NO: 3238837 - DNA, 13 bp, Homo sapiens
gcacccggctcgt

SEQ ID NO: 3238838 - DNA, 21 bp, Homo sapiens
gcacccggggccagagacata

SEQ ID NO: 3238839 - DNA, 13 bp, Homo sapiens
gcaccctccaccc

SEQ ID NO: 3238840 - DNA, 13 bp, Homo sapiens
gcagctctgagcc

SEQ ID NO: 3238841 - DNA, 14 bp, Homo sapiens
gcagctcttgccct

SEQ ID NO: 3238842 - DNA, 13 bp, Homo sapiens
gcagctcttgcta

SEQ ID NO: 3238843 - DNA, 22 bp, Homo sapiens
gcagctcttgctaatcagtgtc

SEQ ID NO: 3238844 - DNA, 20 bp, Homo sapiens
gcagctgagaaaatgagtga

SEQ ID NO: 3238845 - DNA, 14 bp, Homo sapiens
gcagctgagagccc

SEQ ID NO: 3238846 - DNA, 17 bp, Homo sapiens
gcagctgattttaacaa

SEQ ID NO: 3238847 - DNA, 10 bp, Homo sapiens
gcagctgcct

SEQ ID NO: 3238848 - DNA, 16 bp, Homo sapiens
gcagctgcctctgctc

SEQ ID NO: 3238849 - DNA, 17 bp, Homo sapiens
gcagctgcctctgctcc

SEQ ID NO: 3238850 - DNA, 14 bp, Homo sapiens
gcagctgcgggtct

SEQ ID NO: 3238851 - DNA, 22 bp, Homo sapiens
gcagctgctatttattttccta

SEQ ID NO: 3238852 - DNA, 16 bp, Homo sapiens
gcagctggactctgca

SEQ ID NO: 3238853 - DNA, 12 bp, Homo sapiens
gcagctgggccc

SEQ ID NO: 3238854 - DNA, 13 bp, Homo sapiens
gcagctgggcccc

SEQ ID NO: 3238855 - DNA, 17 bp, Homo sapiens
gcagctgggccccatgc

SEQ ID NO: 3238856 - DNA, 15 bp, Homo sapiens
gcagctgtgcattga

SEQ ID NO: 3238857 - DNA, 15 bp, Homo sapiens
gcagcttcaagtgcc

SEQ ID NO: 3238858 - DNA, 14 bp, Homo sapiens
gcagcttcaccaga

SEQ ID NO: 3238859 - DNA, 15 bp, Homo sapiens
gcagcttccttctgg

SEQ ID NO: 3238860 - DNA, 12 bp, Homo sapiens
gcagcttgcccc

SEQ ID NO: 3238861 - DNA, 20 bp, Homo sapiens
gcagctttaaactcagggac

SEQ ID NO: 3238862 - DNA, 23 bp, Homo sapiens
gcagctttactgccttcctcctt

SEQ ID NO: 3238863 - DNA, 14 bp, Homo sapiens
gcagctttctagaa

SEQ ID NO: 3238864 - DNA, 15 bp, Homo sapiens
gcagctttgggatcc

SEQ ID NO: 3238865 - DNA, 17 bp, Homo sapiens
gcagctttgggatccca

SEQ ID NO: 3238866 - DNA, 16 bp, Homo sapiens
gcaggaacaaacaggg

SEQ ID NO: 3238867 - DNA, 17 bp, Homo sapiens
gcaggaacaatgactac

SEQ ID NO: 3238868 - DNA, 16 bp, Homo sapiens
gcaggaacgagcactg

SEQ ID NO: 3238869 - DNA, 17 bp, Homo sapiens
gcaggaacgagcactgg

SEQ ID NO: 3238870 - DNA, 19 bp, Homo sapiens
gcaggaacgagcactggcc

SEQ ID NO: 3238871 - DNA, 16 bp, Homo sapiens
gcaggaactgggctgg

SEQ ID NO: 3238872 - DNA, 19 bp, Homo sapiens
gcaggaactgggctgggcc

SEQ ID NO: 3238873 - DNA, 20 bp, Homo sapiens
gcaggaactgggctgggcct

SEQ ID NO: 3238874 - DNA, 12 bp, Homo sapiens
gcaggaaggaaa

SEQ ID NO: 3238875 - DNA, 12 bp, Homo sapiens
gcaggaaggaga

SEQ ID NO: 3238876 - DNA, 18 bp, Homo sapiens
gcaggaaggagcggcgcc

SEQ ID NO: 3238877 - DNA, 21 bp, Homo sapiens
gcaggaaggagcggcgccctg

SEQ ID NO: 3238878 - DNA, 15 bp, Homo sapiens
gcaggaaggcctggg

SEQ ID NO: 3238879 - DNA, 23 bp, Homo sapiens
gcaggacaggaggcggcccggcc

SEQ ID NO: 3238880 - DNA, 22 bp, Homo sapiens
gcaggacctcccttccgaccct

SEQ ID NO: 3238881 - DNA, 13 bp, Homo sapiens
gcaggacctggca

SEQ ID NO: 3238882 - DNA, 20 bp, Homo sapiens
gcaggaccttcgggctgtgc

SEQ ID NO: 3238883 - DNA, 23 bp, Homo sapiens
gcaggactccaggcccaaggctc

SEQ ID NO: 3238884 - DNA, 19 bp, Homo sapiens
gcaggactgcacagcgtcc

SEQ ID NO: 3238885 - DNA, 22 bp, Homo sapiens
gcaggagaatcactgcagccca

SEQ ID NO: 3238886 - DNA, 23 bp, Homo sapiens
gcaggagaggctgggctgggtgg

SEQ ID NO: 3238887 - DNA, 19 bp, Homo sapiens
gcaggagccccgccacagc

SEQ ID NO: 3238888 - DNA, 15 bp, Homo sapiens
gcaggaggccaataa

SEQ ID NO: 3238889 - DNA, 17 bp, Homo sapiens
gcaggagtctctgccac

SEQ ID NO: 3238890 - DNA, 18 bp, Homo sapiens
gcaggagtctctgccacc

SEQ ID NO: 3238891 - DNA, 20 bp, Homo sapiens
gcaggagtctctgccaccca

SEQ ID NO: 3238892 - DNA, 15 bp, Homo sapiens
gcaggagtggtgcag

SEQ ID NO: 3238893 - DNA, 18 bp, Homo sapiens
gcaggatccgctgccacc

SEQ ID NO: 3238894 - DNA, 19 bp, Homo sapiens
gcaggatccgctgccacca

SEQ ID NO: 3238895 - DNA, 14 bp, Homo sapiens
gcaggatggaacta

SEQ ID NO: 3238896 - DNA, 18 bp, Homo sapiens
gcaggattcagccggagg

SEQ ID NO: 3238897 - DNA, 16 bp, Homo sapiens
gcaggcaagcccttcg

SEQ ID NO: 3238898 - DNA, 14 bp, Homo sapiens
gcaggcaccgccac

SEQ ID NO: 3238899 - DNA, 16 bp, Homo sapiens
gcaggcaccgccacgt

SEQ ID NO: 3238900 - DNA, 19 bp, Homo sapiens
gcaggcacttattgtaaat

SEQ ID NO: 3238901 - DNA, 18 bp, Homo sapiens
gcaggcagcgccaagcaa

SEQ ID NO: 3238902 - DNA, 13 bp, Homo sapiens
gcaggcccagtga

SEQ ID NO: 3238903 - DNA, 14 bp, Homo sapiens
gcaggcccagtgac

SEQ ID NO: 3238904 - DNA, 12 bp, Homo sapiens
gcaggccctgca

SEQ ID NO: 3238905 - DNA, 14 bp, Homo sapiens
gcaggccctgcagt

SEQ ID NO: 3238906 - DNA, 14 bp, Homo sapiens
gcaggccctggcct

SEQ ID NO: 3238907 - DNA, 23 bp, Homo sapiens
gcaggccggaaccacagggccag

SEQ ID NO: 3238908 - DNA, 15 bp, Homo sapiens
gcaggcctaagacat

SEQ ID NO: 3238909 - DNA, 20 bp, Homo sapiens
gcaggcctccaacgcccctg

SEQ ID NO: 3238910 - DNA, 22 bp, Homo sapiens
gcaggcctgggacccagctact

SEQ ID NO: 3238911 - DNA, 22 bp, Homo sapiens
gcaggcggcctttgttgctcag

SEQ ID NO: 3238912 - DNA, 21 bp, Homo sapiens
gcaggcgtgactcagcagcct

SEQ ID NO: 3238913 - DNA, 19 bp, Homo sapiens
gcaggctcactgccaggcc

SEQ ID NO: 3238914 - DNA, 21 bp, Homo sapiens
gcaggctcactgccaggccag

SEQ ID NO: 3238915 - DNA, 22 bp, Homo sapiens
gcaggctcactgccaggccagc

SEQ ID NO: 3238916 - DNA, 16 bp, Homo sapiens
gcaggctctgggctca

SEQ ID NO: 3238917 - DNA, 16 bp, Homo sapiens
gcaggctgagccactc

SEQ ID NO: 3238918 - DNA, 17 bp, Homo sapiens
gcaggctggcagctctc

SEQ ID NO: 3238919 - DNA, 22 bp, Homo sapiens
gcaggctggcagctctccagtc

SEQ ID NO: 3238920 - DNA, 15 bp, Homo sapiens
gcaggctggctggcc

SEQ ID NO: 3238921 - DNA, 23 bp, Homo sapiens
gcaggctgggccatgtccaaaga

SEQ ID NO: 3238922 - DNA, 13 bp, Homo sapiens
gcagggaaacagc

SEQ ID NO: 3238923 - DNA, 22 bp, Homo sapiens
gcagggaaacagctaatgggac

SEQ ID NO: 3238924 - DNA, 22 bp, Homo sapiens
gcagggaaaggctctgaaagcc

SEQ ID NO: 3238925 - DNA, 16 bp, Homo sapiens
gcagggaagagggcag

SEQ ID NO: 3238926 - DNA, 21 bp, Homo sapiens
gcagggaaggggaggcagccg

SEQ ID NO: 3238927 - DNA, 19 bp, Homo sapiens
gcagggaaggtgaagatga

SEQ ID NO: 3238928 - DNA, 15 bp, Homo sapiens
gcagggaatttctat

SEQ ID NO: 3238929 - DNA, 16 bp, Homo sapiens
gcagggacaagccctg

SEQ ID NO: 3238930 - DNA, 13 bp, Homo sapiens
gcagggaggggac

SEQ ID NO: 3238931 - DNA, 15 bp, Homo sapiens
gcagggaggtcaggc

SEQ ID NO: 3238932 - DNA, 16 bp, Homo sapiens
gcagggaggtcaggcc

SEQ ID NO: 3238933 - DNA, 18 bp, Homo sapiens
gcagggaggtcaggccct

SEQ ID NO: 3238934 - DNA, 19 bp, Homo sapiens
gcagggatgggggtggctg

SEQ ID NO: 3238935 - DNA, 22 bp, Homo sapiens
gcagggcaaatgacatgcactg

SEQ ID NO: 3238936 - DNA, 14 bp, Homo sapiens
gcagggcagaggga

SEQ ID NO: 3238937 - DNA, 13 bp, Homo sapiens
gcagggcagcccc

SEQ ID NO: 3238938 - DNA, 15 bp, Homo sapiens
gcagggcatctcctg

SEQ ID NO: 3238939 - DNA, 14 bp, Homo sapiens
gcagggccaggact

SEQ ID NO: 3238940 - DNA, 19 bp, Homo sapiens
gcagggccaggactgagcc

SEQ ID NO: 3238941 - DNA, 13 bp, Homo sapiens
gcagggccaggct

SEQ ID NO: 3238942 - DNA, 22 bp, Homo sapiens
gcagggccatctgactgccaag

SEQ ID NO: 3238943 - DNA, 22 bp, Homo sapiens
gcagggcctatatgccagcgcc

SEQ ID NO: 3238944 - DNA, 17 bp, Homo sapiens
gcagggcgcccctggga

SEQ ID NO: 3238945 - DNA, 19 bp, Homo sapiens
gcagggcgcccctgggaga

SEQ ID NO: 3238946 - DNA, 18 bp, Homo sapiens
gcagggcgggcagagggc

SEQ ID NO: 3238947 - DNA, 14 bp, Homo sapiens
gcagggctcagcgg

SEQ ID NO: 3238948 - DNA, 14 bp, Homo sapiens
gcagggctcaggat

SEQ ID NO: 3238949 - DNA, 21 bp, Homo sapiens
gcagggctcaggatttcgtgg

SEQ ID NO: 3238950 - DNA, 13 bp, Homo sapiens
gcagggctcccat

SEQ ID NO: 3238951 - DNA, 18 bp, Homo sapiens
gcagggctgaagtctggc

SEQ ID NO: 3238952 - DNA, 22 bp, Homo sapiens
gcaggggagacaggagcctagc

SEQ ID NO: 3238953 - DNA, 14 bp, Homo sapiens
gcaggggcctggag

SEQ ID NO: 3238954 - DNA, 19 bp, Homo sapiens
gcaggggctacaagaggga

SEQ ID NO: 3238955 - DNA, 13 bp, Homo sapiens
gcaggggctccag

SEQ ID NO: 3238956 - DNA, 12 bp, Homo sapiens
gcaggggctctg

SEQ ID NO: 3238957 - DNA, 17 bp, Homo sapiens
gcaggggctctggagag

SEQ ID NO: 3238958 - DNA, 18 bp, Homo sapiens
gcaggggctctggagaga

SEQ ID NO: 3238959 - DNA, 19 bp, Homo sapiens
gcaggggctctggagagaa

SEQ ID NO: 3238960 - DNA, 21 bp, Homo sapiens
gcaggggctctggagagaaac

SEQ ID NO: 3238961 - DNA, 22 bp, Homo sapiens
gcaggggctctggagagaaaca

SEQ ID NO: 3238962 - DNA, 15 bp, Homo sapiens
gcagggggccccgcc

SEQ ID NO: 3238963 - DNA, 18 bp, Homo sapiens
gcagggggccccgccagg

SEQ ID NO: 3238964 - DNA, 21 bp, Homo sapiens
gcagggggccccgccagggct

SEQ ID NO: 3238965 - DNA, 22 bp, Homo sapiens
gcagggggccccgccagggctg

SEQ ID NO: 3238966 - DNA, 14 bp, Homo sapiens
gccaagaatacttg

SEQ ID NO: 3238967 - DNA, 16 bp, Homo sapiens
gccaagacaaggaggt

SEQ ID NO: 3238968 - DNA, 18 bp, Homo sapiens
gccaagacttggcaacag

SEQ ID NO: 3238969 - DNA, 20 bp, Homo sapiens
gccaagagcagaggcagcga

SEQ ID NO: 3238970 - DNA, 23 bp, Homo sapiens
gccaagattttcctcttgtgatt

SEQ ID NO: 3238971 - DNA, 22 bp, Homo sapiens
gccaagcaaaccaatggtgatc

SEQ ID NO: 3238972 - DNA, 18 bp, Homo sapiens
gccaagcaacctgggtcc

SEQ ID NO: 3238973 - DNA, 20 bp, Homo sapiens
gccaagcaacctgggtccaa

SEQ ID NO: 3238974 - DNA, 13 bp, Homo sapiens
gccaagccccccg

SEQ ID NO: 3238975 - DNA, 22 bp, Homo sapiens
gccaagccctccccatcccatg

SEQ ID NO: 3238976 - DNA, 16 bp, Homo sapiens
gccaagctccctggag

SEQ ID NO: 3238977 - DNA, 17 bp, Homo sapiens
gccaagctccctggagc

SEQ ID NO: 3238978 - DNA, 22 bp, Homo sapiens
gccaagctccctggagccctgt

SEQ ID NO: 3238979 - DNA, 24 bp, Homo sapiens
gccaaggactgactgagacacgat

SEQ ID NO: 3238980 - DNA, 14 bp, Homo sapiens
gccaaggaggcctg

SEQ ID NO: 3238981 - DNA, 20 bp, Homo sapiens
gccaaggccagagtggcctg

SEQ ID NO: 3238982 - DNA, 21 bp, Homo sapiens
gccaaggccagagtggcctgg

SEQ ID NO: 3238983 - DNA, 18 bp, Homo sapiens
gccaagggaaaggggtgc

SEQ ID NO: 3238984 - DNA, 18 bp, Homo sapiens
gccaagggaacctgtgtc

SEQ ID NO: 3238985 - DNA, 16 bp, Homo sapiens
gccaaggtcctgctca

SEQ ID NO: 3238986 - DNA, 22 bp, Homo sapiens
gccaaggtgccaccaccctgcc

SEQ ID NO: 3238987 - DNA, 16 bp, Homo sapiens
gccaaggtgggctgag

SEQ ID NO: 3238988 - DNA, 22 bp, Homo sapiens
gccaaggtgggctgagccctgg

SEQ ID NO: 3238989 - DNA, 20 bp, Homo sapiens
gccaaggttttataaggctg

SEQ ID NO: 3238990 - DNA, 20 bp, Homo sapiens
gccaagtaaacagggtacct

SEQ ID NO: 3238991 - DNA, 16 bp, Homo sapiens
gccaagtataattttt

SEQ ID NO: 3238992 - DNA, 21 bp, Homo sapiens
gccaagtcatggagaatctgc

SEQ ID NO: 3238993 - DNA, 23 bp, Homo sapiens
gccaagtgcgtgccgtgtgagtg

SEQ ID NO: 3238994 - DNA, 19 bp, Homo sapiens
gccaagtggggtgctggga

SEQ ID NO: 3238995 - DNA, 15 bp, Homo sapiens
gccaagttgctgtca

SEQ ID NO: 3238996 - DNA, 18 bp, Homo sapiens
gccaagttgctgtcactg

SEQ ID NO: 3238997 - DNA, 10 bp, Homo sapiens
gccaataaaa

SEQ ID NO: 3238998 - DNA, 11 bp, Homo sapiens
gccaataaaaa

SEQ ID NO: 3238999 - DNA, 23 bp, Homo sapiens
gccaatatgtattgtaaacatgt

SEQ ID NO: 3239000 - DNA, 13 bp, Homo sapiens
gccaatcccctcc

SEQ ID NO: 3239001 - DNA, 22 bp, Homo sapiens
gccaatccctcaccttctgagt

SEQ ID NO: 3239002 - DNA, 16 bp, Homo sapiens
gccaatctattctcaa

SEQ ID NO: 3239003 - DNA, 23 bp, Homo sapiens
gccaatctattctcaaagttaaa

SEQ ID NO: 3239004 - DNA, 19 bp, Homo sapiens
gccaatggaaacctcacgc

SEQ ID NO: 3239005 - DNA, 21 bp, Homo sapiens
gccaatggaggggggtgctgg

SEQ ID NO: 3239006 - DNA, 19 bp, Homo sapiens
gccaattattgttacacat

SEQ ID NO: 3239007 - DNA, 20 bp, Homo sapiens
gccaatttcaagttccaagt

SEQ ID NO: 3239008 - DNA, 23 bp, Homo sapiens
gccacaaatcaaagcaagggctc

SEQ ID NO: 3239009 - DNA, 15 bp, Homo sapiens
gccacaaatgccttg

SEQ ID NO: 3239010 - DNA, 21 bp, Homo sapiens
gccacaaccctgttttatact

SEQ ID NO: 3239011 - DNA, 17 bp, Homo sapiens
gccacaaggctggccag

SEQ ID NO: 3239012 - DNA, 19 bp, Homo sapiens
gccacacaaacgtttactt

SEQ ID NO: 3239013 - DNA, 15 bp, Homo sapiens
gccacacccaggcac

SEQ ID NO: 3239014 - DNA, 13 bp, Homo sapiens
gccacaccctccc

SEQ ID NO: 3239015 - DNA, 14 bp, Homo sapiens
gccacacctggcct

SEQ ID NO: 3239016 - DNA, 18 bp, Homo sapiens
gccacactctccatcacc

SEQ ID NO: 3239017 - DNA, 13 bp, Homo sapiens
gccacagagaaag

SEQ ID NO: 3239018 - DNA, 21 bp, Homo sapiens
gccacagcccatccatagtaa

SEQ ID NO: 3239019 - DNA, 13 bp, Homo sapiens
gccacagcttttg

SEQ ID NO: 3239020 - DNA, 18 bp, Homo sapiens
gccacagcttttgcaact

SEQ ID NO: 3239021 - DNA, 14 bp, Homo sapiens
gccacaggcctccc

SEQ ID NO: 3239022 - DNA, 21 bp, Homo sapiens
gccacaggcctccctgtttga

SEQ ID NO: 3239023 - DNA, 12 bp, Homo sapiens
gccacaggctag

SEQ ID NO: 3239024 - DNA, 18 bp, Homo sapiens
gccacagtagtcttgatg

SEQ ID NO: 3239025 - DNA, 16 bp, Homo sapiens
gccacatacaggtgct

SEQ ID NO: 3239026 - DNA, 14 bp, Homo sapiens
gccacatacctctc

SEQ ID NO: 3239027 - DNA, 16 bp, Homo sapiens
gccacatacctctctg

SEQ ID NO: 3239028 - DNA, 21 bp, Homo sapiens
gccacatggagccccctctgc

SEQ ID NO: 3239029 - DNA, 21 bp, Homo sapiens
gccacatttctgatcagaggt

SEQ ID NO: 3239030 - DNA, 22 bp, Homo sapiens
gccacatttggaatactttttg

SEQ ID NO: 3239031 - DNA, 15 bp, Homo sapiens
gccaccaaagctgcc

SEQ ID NO: 3239032 - DNA, 20 bp, Homo sapiens
gccaccaaagctgcccactg

SEQ ID NO: 3239033 - DNA, 15 bp, Homo sapiens
gccaccacacacaca

SEQ ID NO: 3239034 - DNA, 14 bp, Homo sapiens
gccaccaccctgcc

SEQ ID NO: 3239035 - DNA, 12 bp, Homo sapiens
gccaccacctct

SEQ ID NO: 3239036 - DNA, 16 bp, Homo sapiens
gccaccacctctgtgg

SEQ ID NO: 3239037 - DNA, 18 bp, Homo sapiens
gccaccacctctgtggca

SEQ ID NO: 3239038 - DNA, 16 bp, Homo sapiens
gccaccacgtctgcca

SEQ ID NO: 3239039 - DNA, 19 bp, Homo sapiens
gccaccacgtctgccaggc

SEQ ID NO: 3239040 - DNA, 21 bp, Homo sapiens
gccaccacgtctgccaggccc

SEQ ID NO: 3239041 - DNA, 19 bp, Homo sapiens
gccaccagagaccgtcctc

SEQ ID NO: 3239042 - DNA, 21 bp, Homo sapiens
gccaccagagaccgtcctcac

SEQ ID NO: 3239043 - DNA, 16 bp, Homo sapiens
gccaccagatgctgaa

SEQ ID NO: 3239044 - DNA, 14 bp, Homo sapiens
gccaccagcatcca

SEQ ID NO: 3239045 - DNA, 22 bp, Homo sapiens
gccaccatattcagtgctgtgg

SEQ ID NO: 3239046 - DNA, 15 bp, Homo sapiens
gccaccatccccacc

SEQ ID NO: 3239047 - DNA, 18 bp, Homo sapiens
gccaccatcctattgcaa

SEQ ID NO: 3239048 - DNA, 22 bp, Homo sapiens
gccaccatgcctcactaatttt

SEQ ID NO: 3239049 - DNA, 14 bp, Homo sapiens
gccaccatggccag

SEQ ID NO: 3239050 - DNA, 16 bp, Homo sapiens
gccacccaagcctgct

SEQ ID NO: 3239051 - DNA, 14 bp, Homo sapiens
gccacccactcagg

SEQ ID NO: 3239052 - DNA, 20 bp, Homo sapiens
gccaccccactctacctcct

SEQ ID NO: 3239053 - DNA, 20 bp, Homo sapiens
gccacccgtggggtgctgcc

SEQ ID NO: 3239054 - DNA, 21 bp, Homo sapiens
gccacccgtggggtgctgccc

SEQ ID NO: 3239055 - DNA, 22 bp, Homo sapiens
gccaccctagccaatgtctcct

SEQ ID NO: 3239056 - DNA, 22 bp, Homo sapiens
gccaccgccgactttgtacccc

SEQ ID NO: 3239057 - DNA, 17 bp, Homo sapiens
gccaccgcgcctggccg

SEQ ID NO: 3239058 - DNA, 15 bp, Homo sapiens
gccaccgtttcttcc

SEQ ID NO: 3239059 - DNA, 12 bp, Homo sapiens
gccacctcctcc

SEQ ID NO: 3239060 - DNA, 22 bp, Homo sapiens
gccacctcctccccctgttctg

SEQ ID NO: 3239061 - DNA, 18 bp, Homo sapiens
gccacctctccaagggct

SEQ ID NO: 3239062 - DNA, 18 bp, Homo sapiens
gccacctgaggtgggccc

SEQ ID NO: 3239063 - DNA, 19 bp, Homo sapiens
gccacctgaggtgggccca

SEQ ID NO: 3239064 - DNA, 23 bp, Homo sapiens
gccacctgaggtgggcccaggac

SEQ ID NO: 3239065 - DNA, 17 bp, Homo sapiens
gccacctgtagccatct

SEQ ID NO: 3239066 - DNA, 16 bp, Homo sapiens
gccacctttcaccctc

SEQ ID NO: 3239067 - DNA, 16 bp, Homo sapiens
gccacgaccagcccct

SEQ ID NO: 3239068 - DNA, 17 bp, Homo sapiens
gccacgaccagcccctt

SEQ ID NO: 3239069 - DNA, 21 bp, Homo sapiens
gccacgctgtcctctcgagcc

SEQ ID NO: 3239070 - DNA, 19 bp, Homo sapiens
gccacgctttgctgctacc

SEQ ID NO: 3239071 - DNA, 16 bp, Homo sapiens
gccacggccaggccag

SEQ ID NO: 3239072 - DNA, 12 bp, Homo sapiens
gccacggcctgg

SEQ ID NO: 3239073 - DNA, 13 bp, Homo sapiens
gccacggcctggc

SEQ ID NO: 3239074 - DNA, 14 bp, Homo sapiens
gccacggcctggct

SEQ ID NO: 3239075 - DNA, 23 bp, Homo sapiens
gccacgtccatagttctgaggtc

SEQ ID NO: 3239076 - DNA, 21 bp, Homo sapiens
gccacgtcccagcatccctgg

SEQ ID NO: 3239077 - DNA, 18 bp, Homo sapiens
gccacgtggtcactgtgc

SEQ ID NO: 3239078 - DNA, 19 bp, Homo sapiens
gccactacactccagcctg

SEQ ID NO: 3239079 - DNA, 21 bp, Homo sapiens
gccactacactccagcctgag

SEQ ID NO: 3239080 - DNA, 23 bp, Homo sapiens
gccactcactaggcccccacttg

SEQ ID NO: 3239081 - DNA, 18 bp, Homo sapiens
gccactcagccatttccc

SEQ ID NO: 3239082 - DNA, 19 bp, Homo sapiens
gccactccctgagctttgg

SEQ ID NO: 3239083 - DNA, 14 bp, Homo sapiens
gccactcctgtccc

SEQ ID NO: 3239084 - DNA, 18 bp, Homo sapiens
gccactcctgtcccgcct

SEQ ID NO: 3239085 - DNA, 19 bp, Homo sapiens
gccactctcttccctttcc

SEQ ID NO: 3239086 - DNA, 14 bp, Homo sapiens
gccactgagcctgg

SEQ ID NO: 3239087 - DNA, 17 bp, Homo sapiens
gccactgcacagagctc

SEQ ID NO: 3239088 - DNA, 22 bp, Homo sapiens
gccactgcacagagctctccag

SEQ ID NO: 3239089 - DNA, 22 bp, Homo sapiens
gccactgcaccgggccacagag

SEQ ID NO: 3239090 - DNA, 20 bp, Homo sapiens
gccactgcactccagcctgg

SEQ ID NO: 3239091 - DNA, 18 bp, Homo sapiens
gcccagcattgctggttc

SEQ ID NO: 3239092 - DNA, 20 bp, Homo sapiens
gcccagccaaaccctgtctg

SEQ ID NO: 3239093 - DNA, 15 bp, Homo sapiens
gcccagccaggagca

SEQ ID NO: 3239094 - DNA, 23 bp, Homo sapiens
gcccagccagttggtggggccag

SEQ ID NO: 3239095 - DNA, 20 bp, Homo sapiens
gcccagccattaccatggag

SEQ ID NO: 3239096 - DNA, 21 bp, Homo sapiens
gcccagccattaccatggaga

SEQ ID NO: 3239097 - DNA, 23 bp, Homo sapiens
gcccagccattaccatggagaca

SEQ ID NO: 3239098 - DNA, 11 bp, Homo sapiens
gcccagcccag

SEQ ID NO: 3239099 - DNA, 16 bp, Homo sapiens
gcccagcccagagcca

SEQ ID NO: 3239100 - DNA, 11 bp, Homo sapiens
gcccagcccct

SEQ ID NO: 3239101 - DNA, 15 bp, Homo sapiens
gcccagcccctagaa

SEQ ID NO: 3239102 - DNA, 16 bp, Homo sapiens
gcccagcccctccacg

SEQ ID NO: 3239103 - DNA, 20 bp, Homo sapiens
gcccagccggcctctctggc

SEQ ID NO: 3239104 - DNA, 22 bp, Homo sapiens
gcccagccggcctctctggcct

SEQ ID NO: 3239105 - DNA, 23 bp, Homo sapiens
gcccagccggcctctctggcctc

SEQ ID NO: 3239106 - DNA, 19 bp, Homo sapiens
gcccagcctgggagcccag

SEQ ID NO: 3239107 - DNA, 20 bp, Homo sapiens
gcccagcctgggagcccaga

SEQ ID NO: 3239108 - DNA, 22 bp, Homo sapiens
gcccagcctgggagcccagagg

SEQ ID NO: 3239109 - DNA, 15 bp, Homo sapiens
gcccagcgccaagta

SEQ ID NO: 3239110 - DNA, 14 bp, Homo sapiens
gcccagcgcggcca

SEQ ID NO: 3239111 - DNA, 16 bp, Homo sapiens
gcccagcgcggccagc

SEQ ID NO: 3239112 - DNA, 18 bp, Homo sapiens
gcccagcgcggccagcgt

SEQ ID NO: 3239113 - DNA, 15 bp, Homo sapiens
gcccagcgctctgcc

SEQ ID NO: 3239114 - DNA, 18 bp, Homo sapiens
gcccagcgggcagatggg

SEQ ID NO: 3239115 - DNA, 15 bp, Homo sapiens
gcccagctgcacctg

SEQ ID NO: 3239116 - DNA, 18 bp, Homo sapiens
gcccagctgcacctgcca

SEQ ID NO: 3239117 - DNA, 23 bp, Homo sapiens
gcccagctgcacctgccagcctg

SEQ ID NO: 3239118 - DNA, 20 bp, Homo sapiens
gcccagctgtagccatggct

SEQ ID NO: 3239119 - DNA, 22 bp, Homo sapiens
gcccagctgtagccatggctca

SEQ ID NO: 3239120 - DNA, 13 bp, Homo sapiens
gcccagcttcctg

SEQ ID NO: 3239121 - DNA, 17 bp, Homo sapiens
gcccagcttcctggtgt

SEQ ID NO: 3239122 - DNA, 18 bp, Homo sapiens
gcccaggaagcccacact

SEQ ID NO: 3239123 - DNA, 13 bp, Homo sapiens
gcccaggaaggcc

SEQ ID NO: 3239124 - DNA, 23 bp, Homo sapiens
gcccaggaaggcctaggctagga

SEQ ID NO: 3239125 - DNA, 20 bp, Homo sapiens
gcccaggaatttgaagctgc

SEQ ID NO: 3239126 - DNA, 19 bp, Homo sapiens
gcccaggaccagctggggc

SEQ ID NO: 3239127 - DNA, 17 bp, Homo sapiens
gcccaggagagagaaag

SEQ ID NO: 3239128 - DNA, 20 bp, Homo sapiens
gcccaggagagagaaagcca

SEQ ID NO: 3239129 - DNA, 20 bp, Homo sapiens
gcccaggagggcatccatac

SEQ ID NO: 3239130 - DNA, 15 bp, Homo sapiens
gcccaggatactggc

SEQ ID NO: 3239131 - DNA, 17 bp, Homo sapiens
gcccaggatactggcac

SEQ ID NO: 3239132 - DNA, 20 bp, Homo sapiens
gcccaggatactggcacaga

SEQ ID NO: 3239133 - DNA, 22 bp, Homo sapiens
gcccaggatactggcacagagg

SEQ ID NO: 3239134 - DNA, 11 bp, Homo sapiens
gcccaggcagg

SEQ ID NO: 3239135 - DNA, 14 bp, Homo sapiens
gcccaggcaggcca

SEQ ID NO: 3239136 - DNA, 15 bp, Homo sapiens
gcccaggccacagcc

SEQ ID NO: 3239137 - DNA, 11 bp, Homo sapiens
gcccaggcccc

SEQ ID NO: 3239138 - DNA, 17 bp, Homo sapiens
gcccaggcccctgccac

SEQ ID NO: 3239139 - DNA, 21 bp, Homo sapiens
gcccaggcccctgccaccctg

SEQ ID NO: 3239140 - DNA, 13 bp, Homo sapiens
gcccaggccggcc

SEQ ID NO: 3239141 - DNA, 20 bp, Homo sapiens
gcccaggccggccagcctca

SEQ ID NO: 3239142 - DNA, 12 bp, Homo sapiens
gcccaggcggga

SEQ ID NO: 3239143 - DNA, 12 bp, Homo sapiens
gcccaggctggc

SEQ ID NO: 3239144 - DNA, 19 bp, Homo sapiens
gcccaggctggcgtgcagt

SEQ ID NO: 3239145 - DNA, 22 bp, Homo sapiens
gcccaggctgtgcagcgcagct

SEQ ID NO: 3239146 - DNA, 17 bp, Homo sapiens
gcccagggagggaagtg

SEQ ID NO: 3239147 - DNA, 22 bp, Homo sapiens
gcccagggagggaagtgtgagc

SEQ ID NO: 3239148 - DNA, 18 bp, Homo sapiens
gcccagggctcctgcact

SEQ ID NO: 3239149 - DNA, 14 bp, Homo sapiens
gcccaggggtgccc

SEQ ID NO: 3239150 - DNA, 22 bp, Homo sapiens
gcccaggggtgccccctcctct

SEQ ID NO: 3239151 - DNA, 23 bp, Homo sapiens
gcccagggtggacttagaaagca

SEQ ID NO: 3239152 - DNA, 14 bp, Homo sapiens
gcccagtcccccaa

SEQ ID NO: 3239153 - DNA, 15 bp, Homo sapiens
gcccagtgaagcctc

SEQ ID NO: 3239154 - DNA, 17 bp, Homo sapiens
gcccagtgaagcctctg

SEQ ID NO: 3239155 - DNA, 17 bp, Homo sapiens
gcccagtgttgtttgta

SEQ ID NO: 3239156 - DNA, 19 bp, Homo sapiens
gcccagttgggtggatgcc

SEQ ID NO: 3239157 - DNA, 22 bp, Homo sapiens
gcccagttgggtggatgcctgg

SEQ ID NO: 3239158 - DNA, 20 bp, Homo sapiens
gcccataatagttagccctc

SEQ ID NO: 3239159 - DNA, 23 bp, Homo sapiens
gcccataatagttagccctcagt

SEQ ID NO: 3239160 - DNA, 17 bp, Homo sapiens
gcccatactcagcctgc

SEQ ID NO: 3239161 - DNA, 23 bp, Homo sapiens
gcccatacttttggctcctctag

SEQ ID NO: 3239162 - DNA, 18 bp, Homo sapiens
gcccatagaaacatgaca

SEQ ID NO: 3239163 - DNA, 21 bp, Homo sapiens
gcccatagaaacatgacactg

SEQ ID NO: 3239164 - DNA, 22 bp, Homo sapiens
gcccatagaaacatgacactga

SEQ ID NO: 3239165 - DNA, 23 bp, Homo sapiens
gcccatagaaacatgacactgac

SEQ ID NO: 3239166 - DNA, 17 bp, Homo sapiens
gcccatcacagggttgg

SEQ ID NO: 3239167 - DNA, 22 bp, Homo sapiens
gcccatcacagggttgggccca

SEQ ID NO: 3239168 - DNA, 14 bp, Homo sapiens
gcccatccctgcct

SEQ ID NO: 3239169 - DNA, 16 bp, Homo sapiens
gcccatccctgcctgg

SEQ ID NO: 3239170 - DNA, 19 bp, Homo sapiens
gcccatccctgcctggtca

SEQ ID NO: 3239171 - DNA, 16 bp, Homo sapiens
gcccatctcagcctcc

SEQ ID NO: 3239172 - DNA, 20 bp, Homo sapiens
gcccatctcagcctcctgag

SEQ ID NO: 3239173 - DNA, 16 bp, Homo sapiens
gcccatctcaggtgcc

SEQ ID NO: 3239174 - DNA, 17 bp, Homo sapiens
gcccatctcaggtgcca

SEQ ID NO: 3239175 - DNA, 18 bp, Homo sapiens
gcccatctcaggtgccac

SEQ ID NO: 3239176 - DNA, 17 bp, Homo sapiens
gcccatgagtccttgaa

SEQ ID NO: 3239177 - DNA, 16 bp, Homo sapiens
gcccatggcccccaat

SEQ ID NO: 3239178 - DNA, 17 bp, Homo sapiens
gcccatggcccccaata

SEQ ID NO: 3239179 - DNA, 21 bp, Homo sapiens
gcccatggcccccaataaagg

SEQ ID NO: 3239180 - DNA, 23 bp, Homo sapiens
gcccatggcccccaataaaggca

SEQ ID NO: 3239181 - DNA, 20 bp, Homo sapiens
gcccatgggagctggttaga

SEQ ID NO: 3239182 - DNA, 20 bp, Homo sapiens
gcccatgtgtacattctgcc

SEQ ID NO: 3239183 - DNA, 17 bp, Homo sapiens
gcccatgtgtcccctca

SEQ ID NO: 3239184 - DNA, 15 bp, Homo sapiens
gcccatgttctgccc

SEQ ID NO: 3239185 - DNA, 16 bp, Homo sapiens
gcccatgttctgcccc

SEQ ID NO: 3239186 - DNA, 20 bp, Homo sapiens
gcccatttcaattctcaaaa

SEQ ID NO: 3239187 - DNA, 20 bp, Homo sapiens
gcccattttcaactgctttg

SEQ ID NO: 3239188 - DNA, 20 bp, Homo sapiens
gccccaaataacttcagtcc

SEQ ID NO: 3239189 - DNA, 12 bp, Homo sapiens
gccccaaatata

SEQ ID NO: 3239190 - DNA, 14 bp, Homo sapiens
gccccaagtcctca

SEQ ID NO: 3239191 - DNA, 15 bp, Homo sapiens
gccccaagtcctgaa

SEQ ID NO: 3239192 - DNA, 21 bp, Homo sapiens
gccccaagtcctgaagaggcg

SEQ ID NO: 3239193 - DNA, 19 bp, Homo sapiens
gccccaatccctttattac

SEQ ID NO: 3239194 - DNA, 14 bp, Homo sapiens
gccccacacggact

SEQ ID NO: 3239195 - DNA, 21 bp, Homo sapiens
gccccacacggactcccgggc

SEQ ID NO: 3239196 - DNA, 23 bp, Homo sapiens
gccccacacggactcccgggcca

SEQ ID NO: 3239197 - DNA, 20 bp, Homo sapiens
gccccacacggaggcatctg

SEQ ID NO: 3239198 - DNA, 10 bp, Homo sapiens
gccccacagc

SEQ ID NO: 3239199 - DNA, 14 bp, Homo sapiens
gccccacagctacc

SEQ ID NO: 3239200 - DNA, 21 bp, Homo sapiens
gccccacagctacctgagacg

SEQ ID NO: 3239201 - DNA, 13 bp, Homo sapiens
gccccacagttgt

SEQ ID NO: 3239202 - DNA, 14 bp, Homo sapiens
gccccacagttgtg

SEQ ID NO: 3239203 - DNA, 13 bp, Homo sapiens
gccccacccccag

SEQ ID NO: 3239204 - DNA, 17 bp, Homo sapiens
gccccacccccagccag

SEQ ID NO: 3239205 - DNA, 18 bp, Homo sapiens
gccccacccccagccagg

SEQ ID NO: 3239206 - DNA, 22 bp, Homo sapiens
gccccaccctccttgagactgg

SEQ ID NO: 3239207 - DNA, 12 bp, Homo sapiens
gccccaccctgg

SEQ ID NO: 3239208 - DNA, 22 bp, Homo sapiens
gccccaccctgggccctgggct

SEQ ID NO: 3239209 - DNA, 23 bp, Homo sapiens
gccccacctacttgtgactgaag

SEQ ID NO: 3239210 - DNA, 20 bp, Homo sapiens
gccccactcccttgctggcc

SEQ ID NO: 3239211 - DNA, 22 bp, Homo sapiens
gccccactcccttgctggcccc

SEQ ID NO: 3239212 - DNA, 12 bp, Homo sapiens
gccccactgcca

SEQ ID NO: 3239213 - DNA, 20 bp, Homo sapiens
gccccactgccagcagcagc

SEQ ID NO: 3239214 - DNA, 13 bp, Homo sapiens
gccccagaagaaa

SEQ ID NO: 3239215 - DNA, 13 bp, Homo sapiens
gccccagagagag

SEQ ID NO: 3239216 - DNA, 17 bp, Homo sapiens
gcctaccatttcacaga

SEQ ID NO: 3239217 - DNA, 14 bp, Homo sapiens
gcctaccccgcaga

SEQ ID NO: 3239218 - DNA, 15 bp, Homo sapiens
gcctacctcactctc

SEQ ID NO: 3239219 - DNA, 14 bp, Homo sapiens
gcctacctgtatgt

SEQ ID NO: 3239220 - DNA, 16 bp, Homo sapiens
gcctagaatctttatt

SEQ ID NO: 3239221 - DNA, 13 bp, Homo sapiens
gcctagactctgt

SEQ ID NO: 3239222 - DNA, 20 bp, Homo sapiens
gcctagatccacacacagag

SEQ ID NO: 3239223 - DNA, 18 bp, Homo sapiens
gcctagcaagctggcctc

SEQ ID NO: 3239224 - DNA, 22 bp, Homo sapiens
gcctagcccaccctgctgcctt

SEQ ID NO: 3239225 - DNA, 23 bp, Homo sapiens
gcctagcccaccctgctgccttc

SEQ ID NO: 3239226 - DNA, 20 bp, Homo sapiens
gcctagcgatctctcctggc

SEQ ID NO: 3239227 - DNA, 21 bp, Homo sapiens
gcctagcggagcccagcctgg

SEQ ID NO: 3239228 - DNA, 22 bp, Homo sapiens
gcctagcggagcccagcctggg

SEQ ID NO: 3239229 - DNA, 16 bp, Homo sapiens
gcctagctcctgccac

SEQ ID NO: 3239230 - DNA, 18 bp, Homo sapiens
gcctaggaccactcagcc

SEQ ID NO: 3239231 - DNA, 20 bp, Homo sapiens
gcctaggaccactcagcccc

SEQ ID NO: 3239232 - DNA, 14 bp, Homo sapiens
gcctaggaggcccc

SEQ ID NO: 3239233 - DNA, 13 bp, Homo sapiens
gcctaggattcta

SEQ ID NO: 3239234 - DNA, 15 bp, Homo sapiens
gcctaggattctaaa

SEQ ID NO: 3239235 - DNA, 13 bp, Homo sapiens
gcctaggtgacag

SEQ ID NO: 3239236 - DNA, 21 bp, Homo sapiens
gcctagttcatccaatcctca

SEQ ID NO: 3239237 - DNA, 18 bp, Homo sapiens
gcctataatcttatacaa

SEQ ID NO: 3239238 - DNA, 19 bp, Homo sapiens
gcctataatcttatacaac

SEQ ID NO: 3239239 - DNA, 18 bp, Homo sapiens
gcctatccgctgccagcc

SEQ ID NO: 3239240 - DNA, 14 bp, Homo sapiens
gcctatgcacatat

SEQ ID NO: 3239241 - DNA, 21 bp, Homo sapiens
gcctattatctgtcagctgca

SEQ ID NO: 3239242 - DNA, 22 bp, Homo sapiens
gcctattcccacacctccacag

SEQ ID NO: 3239243 - DNA, 20 bp, Homo sapiens
gcctatttacctgcaggctg

SEQ ID NO: 3239244 - DNA, 21 bp, Homo sapiens
gcctcaaaacgggtcagtatt

SEQ ID NO: 3239245 - DNA, 14 bp, Homo sapiens
gcctcaacctcctg

SEQ ID NO: 3239246 - DNA, 16 bp, Homo sapiens
gcctcaacctcctggg

SEQ ID NO: 3239247 - DNA, 17 bp, Homo sapiens
gcctcaacctcctgggc

SEQ ID NO: 3239248 - DNA, 19 bp, Homo sapiens
gcctcaacctcctgggcta

SEQ ID NO: 3239249 - DNA, 17 bp, Homo sapiens
gcctcaagagcacacag

SEQ ID NO: 3239250 - DNA, 21 bp, Homo sapiens
gcctcaaggttttaggttcta

SEQ ID NO: 3239251 - DNA, 19 bp, Homo sapiens
gcctcaagtgattctcctg

SEQ ID NO: 3239252 - DNA, 14 bp, Homo sapiens
gcctcaatgccagt

SEQ ID NO: 3239253 - DNA, 21 bp, Homo sapiens
gcctcaccatgtgagctcttc

SEQ ID NO: 3239254 - DNA, 18 bp, Homo sapiens
gcctcacgcccccaggaa

SEQ ID NO: 3239255 - DNA, 13 bp, Homo sapiens
gcctcactggctg

SEQ ID NO: 3239256 - DNA, 15 bp, Homo sapiens
gcctcactggctggg

SEQ ID NO: 3239257 - DNA, 18 bp, Homo sapiens
gcctcacttgaatgtgtc

SEQ ID NO: 3239258 - DNA, 16 bp, Homo sapiens
gcctcagcatcctggc

SEQ ID NO: 3239259 - DNA, 21 bp, Homo sapiens
gcctcagcatcctggcacccg

SEQ ID NO: 3239260 - DNA, 12 bp, Homo sapiens
gcctcagccctc

SEQ ID NO: 3239261 - DNA, 13 bp, Homo sapiens
gcctcagccctca

SEQ ID NO: 3239262 - DNA, 16 bp, Homo sapiens
gcctcagccctcagaa

SEQ ID NO: 3239263 - DNA, 23 bp, Homo sapiens
gcctcagcctcccaaagtgctgg

SEQ ID NO: 3239264 - DNA, 17 bp, Homo sapiens
gcctcagcctctcaagt

SEQ ID NO: 3239265 - DNA, 20 bp, Homo sapiens
gcctcagctacccactatcc

SEQ ID NO: 3239266 - DNA, 19 bp, Homo sapiens
gcctcagctgaatgcctcc

SEQ ID NO: 3239267 - DNA, 14 bp, Homo sapiens
gcctcagctgcctc

SEQ ID NO: 3239268 - DNA, 16 bp, Homo sapiens
gcctcagctgcctcac

SEQ ID NO: 3239269 - DNA, 19 bp, Homo sapiens
gcctcagctgcctcacttc

SEQ ID NO: 3239270 - DNA, 20 bp, Homo sapiens
gcctcagctgcctcacttcc

SEQ ID NO: 3239271 - DNA, 14 bp, Homo sapiens
gcctcaggctctgc

SEQ ID NO: 3239272 - DNA, 15 bp, Homo sapiens
gcctcaggctctgca

SEQ ID NO: 3239273 - DNA, 22 bp, Homo sapiens
gcctcagggccaggaaggacag

SEQ ID NO: 3239274 - DNA, 13 bp, Homo sapiens
gcctcagggcgct

SEQ ID NO: 3239275 - DNA, 15 bp, Homo sapiens
gcctcagggcgctca

SEQ ID NO: 3239276 - DNA, 19 bp, Homo sapiens
gcctcagggcgctcagacg

SEQ ID NO: 3239277 - DNA, 14 bp, Homo sapiens
gcctcaggttccta

SEQ ID NO: 3239278 - DNA, 15 bp, Homo sapiens
gcctcagtatattta

SEQ ID NO: 3239279 - DNA, 21 bp, Homo sapiens
gcctcagtatatttaaactca

SEQ ID NO: 3239280 - DNA, 16 bp, Homo sapiens
gcctcagtcctcccct

SEQ ID NO: 3239281 - DNA, 16 bp, Homo sapiens
gcctcagtgacccatg

SEQ ID NO: 3239282 - DNA, 12 bp, Homo sapiens
gcctcagtgcca

SEQ ID NO: 3239283 - DNA, 15 bp, Homo sapiens
gcctcagtggcagca

SEQ ID NO: 3239284 - DNA, 17 bp, Homo sapiens
gcctcagttcccagctc

SEQ ID NO: 3239285 - DNA, 18 bp, Homo sapiens
gcctcagttcccagctcc

SEQ ID NO: 3239286 - DNA, 20 bp, Homo sapiens
gcctcagtttctccatcagc

SEQ ID NO: 3239287 - DNA, 12 bp, Homo sapiens
gcctcatccctc

SEQ ID NO: 3239288 - DNA, 13 bp, Homo sapiens
gcctcatgcctgc

SEQ ID NO: 3239289 - DNA, 18 bp, Homo sapiens
gcctcatgtggctggaag

SEQ ID NO: 3239290 - DNA, 16 bp, Homo sapiens
gcctccaagcctgcct

SEQ ID NO: 3239291 - DNA, 17 bp, Homo sapiens
gcctccaagcctgcctc

SEQ ID NO: 3239292 - DNA, 12 bp, Homo sapiens
gcctccacagcg

SEQ ID NO: 3239293 - DNA, 14 bp, Homo sapiens
gcctccacagcgag

SEQ ID NO: 3239294 - DNA, 20 bp, Homo sapiens
gcctccacagcgagggcagc

SEQ ID NO: 3239295 - DNA, 13 bp, Homo sapiens
gcctccactcccc

SEQ ID NO: 3239296 - DNA, 15 bp, Homo sapiens
gcctccactccccca

SEQ ID NO: 3239297 - DNA, 21 bp, Homo sapiens
gcctccactcccccacctgac

SEQ ID NO: 3239298 - DNA, 23 bp, Homo sapiens
gcctccactcccccacctgacaa

SEQ ID NO: 3239299 - DNA, 12 bp, Homo sapiens
gcctccagaact

SEQ ID NO: 3239300 - DNA, 17 bp, Homo sapiens
gcctccagaactcactg

SEQ ID NO: 3239301 - DNA, 14 bp, Homo sapiens
gcctccagagccag

SEQ ID NO: 3239302 - DNA, 18 bp, Homo sapiens
gcctccagagccagcctg

SEQ ID NO: 3239303 - DNA, 21 bp, Homo sapiens
gcctccagagccagcctggga

SEQ ID NO: 3239304 - DNA, 19 bp, Homo sapiens
gcctccagcctctcccggc

SEQ ID NO: 3239305 - DNA, 20 bp, Homo sapiens
gcctccagcctctcccggct

SEQ ID NO: 3239306 - DNA, 22 bp, Homo sapiens
gcctccagcctctcccggctgc

SEQ ID NO: 3239307 - DNA, 23 bp, Homo sapiens
gcctccagcctctcccggctgcc

SEQ ID NO: 3239308 - DNA, 16 bp, Homo sapiens
gcctccagcctgccca

SEQ ID NO: 3239309 - DNA, 18 bp, Homo sapiens
gcctccagcctgcccaag

SEQ ID NO: 3239310 - DNA, 12 bp, Homo sapiens
gcctccagggcc

SEQ ID NO: 3239311 - DNA, 14 bp, Homo sapiens
gcctccaggtgtgc

SEQ ID NO: 3239312 - DNA, 15 bp, Homo sapiens
gcctccatccaaggc

SEQ ID NO: 3239313 - DNA, 15 bp, Homo sapiens
gcctccatcctgagg

SEQ ID NO: 3239314 - DNA, 16 bp, Homo sapiens
gcctccatcctgaggc

SEQ ID NO: 3239315 - DNA, 11 bp, Homo sapiens
gcctccatgct

SEQ ID NO: 3239316 - DNA, 18 bp, Homo sapiens
gcctcccaaagtgctggg

SEQ ID NO: 3239317 - DNA, 16 bp, Homo sapiens
gcctcccacacttgct

SEQ ID NO: 3239318 - DNA, 19 bp, Homo sapiens
gcctcccacacttgctggg

SEQ ID NO: 3239319 - DNA, 21 bp, Homo sapiens
gcctcccacacttgctggggc

SEQ ID NO: 3239320 - DNA, 12 bp, Homo sapiens
gcctcccacccc

SEQ ID NO: 3239321 - DNA, 21 bp, Homo sapiens
gcctcccacccgatgctgctt

SEQ ID NO: 3239322 - DNA, 12 bp, Homo sapiens
gcctcccaggtt

SEQ ID NO: 3239323 - DNA, 18 bp, Homo sapiens
gcctccccaccctcctct

SEQ ID NO: 3239324 - DNA, 19 bp, Homo sapiens
gcctccccaccctcctctt

SEQ ID NO: 3239325 - DNA, 21 bp, Homo sapiens
gcctccccacggccgctccag

SEQ ID NO: 3239326 - DNA, 19 bp, Homo sapiens
gcctccccatttcccatct

SEQ ID NO: 3239327 - DNA, 20 bp, Homo sapiens
gcctccccatttcccatctg

SEQ ID NO: 3239328 - DNA, 23 bp, Homo sapiens
gcctccccatttcccatctgcac

SEQ ID NO: 3239329 - DNA, 15 bp, Homo sapiens
gcctccccctcagat

SEQ ID NO: 3239330 - DNA, 20 bp, Homo sapiens
gcctcccctccatgggcgtc

SEQ ID NO: 3239331 - DNA, 18 bp, Homo sapiens
gcctcccctctccttcct

SEQ ID NO: 3239332 - DNA, 19 bp, Homo sapiens
gcctcccctctccttcctg

SEQ ID NO: 3239333 - DNA, 19 bp, Homo sapiens
gcctcccctgccaccaggc

SEQ ID NO: 3239334 - DNA, 18 bp, Homo sapiens
gcctcccgaatagctggg

SEQ ID NO: 3239335 - DNA, 17 bp, Homo sapiens
gcctcccgaggaggggc

SEQ ID NO: 3239336 - DNA, 19 bp, Homo sapiens
gcctcccgggtctcaggcc

SEQ ID NO: 3239337 - DNA, 23 bp, Homo sapiens
gcctccctctccatatctccttc

SEQ ID NO: 3239338 - DNA, 22 bp, Homo sapiens
gcctccctctctcttctgctcc

SEQ ID NO: 3239339 - DNA, 21 bp, Homo sapiens
gcctccctctgacctgcaggc

SEQ ID NO: 3239340 - DNA, 11 bp, Homo sapiens
gcctccctgct

SEQ ID NO: 3239341 - DNA, 13 bp, Homo sapiens
gcctccgctggct

SEQ ID NO: 3239342 - DNA, 21 bp, Homo sapiens
gcctgtcgtgccagtcctggg

SEQ ID NO: 3239343 - DNA, 18 bp, Homo sapiens
gcctgtctcatccccagg

SEQ ID NO: 3239344 - DNA, 13 bp, Homo sapiens
gcctgtctgaagc

SEQ ID NO: 3239345 - DNA, 14 bp, Homo sapiens
gcctgtgcagcagc

SEQ ID NO: 3239346 - DNA, 16 bp, Homo sapiens
gcctgtgcagcagccc

SEQ ID NO: 3239347 - DNA, 22 bp, Homo sapiens
gcctgtgcagcagcccagcttc

SEQ ID NO: 3239348 - DNA, 19 bp, Homo sapiens
gcctgtgccacccaccagg

SEQ ID NO: 3239349 - DNA, 18 bp, Homo sapiens
gcctgtgcctctgggact

SEQ ID NO: 3239350 - DNA, 16 bp, Homo sapiens
gcctgtgcctgccatg

SEQ ID NO: 3239351 - DNA, 21 bp, Homo sapiens
gcctgtgcctgccatgggcca

SEQ ID NO: 3239352 - DNA, 19 bp, Homo sapiens
gcctgtgcgtcccagctga

SEQ ID NO: 3239353 - DNA, 15 bp, Homo sapiens
gcctgtgctgtggca

SEQ ID NO: 3239354 - DNA, 16 bp, Homo sapiens
gcctgtggaatgagtg

SEQ ID NO: 3239355 - DNA, 17 bp, Homo sapiens
gcctgtggaatgagtgt

SEQ ID NO: 3239356 - DNA, 19 bp, Homo sapiens
gcctgtggaatgagtgtgc

SEQ ID NO: 3239357 - DNA, 22 bp, Homo sapiens
gcctgtggacggggaggctctc

SEQ ID NO: 3239358 - DNA, 19 bp, Homo sapiens
gcctgtggcagaaaagagg

SEQ ID NO: 3239359 - DNA, 19 bp, Homo sapiens
gcctgtggcgccgtctcca

SEQ ID NO: 3239360 - DNA, 12 bp, Homo sapiens
gcctgtgtccag

SEQ ID NO: 3239361 - DNA, 23 bp, Homo sapiens
gcctgtgtcccatgacccacccc

SEQ ID NO: 3239362 - DNA, 14 bp, Homo sapiens
gcctgttcccccgc

SEQ ID NO: 3239363 - DNA, 15 bp, Homo sapiens
gcctgttctgaggat

SEQ ID NO: 3239364 - DNA, 18 bp, Homo sapiens
gcctgttctgaggattca

SEQ ID NO: 3239365 - DNA, 19 bp, Homo sapiens
gcctgttctgaggattcag

SEQ ID NO: 3239366 - DNA, 16 bp, Homo sapiens
gcctgtttctgcagcc

SEQ ID NO: 3239367 - DNA, 14 bp, Homo sapiens
gcctgtttgatgta

SEQ ID NO: 3239368 - DNA, 17 bp, Homo sapiens
gccttaaaaggggccca

SEQ ID NO: 3239369 - DNA, 19 bp, Homo sapiens
gccttaaaaggggcccaag

SEQ ID NO: 3239370 - DNA, 20 bp, Homo sapiens
gccttaaaaggggcccaagc

SEQ ID NO: 3239371 - DNA, 13 bp, Homo sapiens
gccttaaatttgt

SEQ ID NO: 3239372 - DNA, 13 bp, Homo sapiens
gccttacactgaa

SEQ ID NO: 3239373 - DNA, 20 bp, Homo sapiens
gccttagaaatgtaaactgc

SEQ ID NO: 3239374 - DNA, 17 bp, Homo sapiens
gccttagaagtcacaca

SEQ ID NO: 3239375 - DNA, 18 bp, Homo sapiens
gccttagaagtcacacag

SEQ ID NO: 3239376 - DNA, 20 bp, Homo sapiens
gccttagaagtcacacagta

SEQ ID NO: 3239377 - DNA, 18 bp, Homo sapiens
gccttagcatgtttgctg

SEQ ID NO: 3239378 - DNA, 16 bp, Homo sapiens
gccttagctcccagct

SEQ ID NO: 3239379 - DNA, 23 bp, Homo sapiens
gccttagctcccagctagggggc

SEQ ID NO: 3239380 - DNA, 17 bp, Homo sapiens
gccttagggcactgggc

SEQ ID NO: 3239381 - DNA, 22 bp, Homo sapiens
gccttagtctcagtttgtgtgt

SEQ ID NO: 3239382 - DNA, 19 bp, Homo sapiens
gccttagtgggccagggct

SEQ ID NO: 3239383 - DNA, 13 bp, Homo sapiens
gccttatcaagtg

SEQ ID NO: 3239384 - DNA, 22 bp, Homo sapiens
gccttatcttgcaccccaaagc

SEQ ID NO: 3239385 - DNA, 17 bp, Homo sapiens
gccttatgttgaaaaaa

SEQ ID NO: 3239386 - DNA, 22 bp, Homo sapiens
gccttcaaaactatagcttgca

SEQ ID NO: 3239387 - DNA, 21 bp, Homo sapiens
gccttcaacaacgtgagagaa

SEQ ID NO: 3239388 - DNA, 14 bp, Homo sapiens
gccttcaagtgcca

SEQ ID NO: 3239389 - DNA, 19 bp, Homo sapiens
gccttcagaatgctcctga

SEQ ID NO: 3239390 - DNA, 23 bp, Homo sapiens
gccttcagacagagaggactgta

SEQ ID NO: 3239391 - DNA, 14 bp, Homo sapiens
gccttcagctccag

SEQ ID NO: 3239392 - DNA, 21 bp, Homo sapiens
gccttcaggcttctgtcaatt

SEQ ID NO: 3239393 - DNA, 20 bp, Homo sapiens
gccttcccaagttgtgcttg

SEQ ID NO: 3239394 - DNA, 23 bp, Homo sapiens
gccttccccctcccagggccagg

SEQ ID NO: 3239395 - DNA, 23 bp, Homo sapiens
gccttcccccttcctttggtgcc

SEQ ID NO: 3239396 - DNA, 18 bp, Homo sapiens
gccttcccctcagccaca

SEQ ID NO: 3239397 - DNA, 20 bp, Homo sapiens
gccttccccttttgcctggc

SEQ ID NO: 3239398 - DNA, 23 bp, Homo sapiens
gccttccccttttgcctggctgt

SEQ ID NO: 3239399 - DNA, 24 bp, Homo sapiens
gccttccctagctttagaccctgg

SEQ ID NO: 3239400 - DNA, 20 bp, Homo sapiens
gccttcctggttttgtacac

SEQ ID NO: 3239401 - DNA, 23 bp, Homo sapiens
gccttcctggttttgtacactgc

SEQ ID NO: 3239402 - DNA, 20 bp, Homo sapiens
gccttccttgaccttcctct

SEQ ID NO: 3239403 - DNA, 21 bp, Homo sapiens
gccttcctttctccaggacca

SEQ ID NO: 3239404 - DNA, 22 bp, Homo sapiens
gccttcgatacaccgggcctgg

SEQ ID NO: 3239405 - DNA, 23 bp, Homo sapiens
gccttcgatacaccgggcctgga

SEQ ID NO: 3239406 - DNA, 22 bp, Homo sapiens
gccttcgcttcttgcctctgtg

SEQ ID NO: 3239407 - DNA, 18 bp, Homo sapiens
gccttcggcctccatcct

SEQ ID NO: 3239408 - DNA, 21 bp, Homo sapiens
gccttcggcctccatcctgag

SEQ ID NO: 3239409 - DNA, 23 bp, Homo sapiens
gccttcggcctccatcctgaggc

SEQ ID NO: 3239410 - DNA, 19 bp, Homo sapiens
gccttcgtctttcccatgg

SEQ ID NO: 3239411 - DNA, 20 bp, Homo sapiens
gccttctcccacatgaggcc

SEQ ID NO: 3239412 - DNA, 17 bp, Homo sapiens
gccttctccttccccag

SEQ ID NO: 3239413 - DNA, 20 bp, Homo sapiens
gccttctccttccccaggat

SEQ ID NO: 3239414 - DNA, 17 bp, Homo sapiens
gccttctgacggccctg

SEQ ID NO: 3239415 - DNA, 14 bp, Homo sapiens
gccttctgatgtct

SEQ ID NO: 3239416 - DNA, 19 bp, Homo sapiens
gccttctgctgcccaggcc

SEQ ID NO: 3239417 - DNA, 22 bp, Homo sapiens
gccttctgctgcccaggccaca

SEQ ID NO: 3239418 - DNA, 24 bp, Homo sapiens
gccttctgctgcccaggccacagc

SEQ ID NO: 3239419 - DNA, 14 bp, Homo sapiens
gccttctggccttg

SEQ ID NO: 3239420 - DNA, 12 bp, Homo sapiens
gccttctgggct

SEQ ID NO: 3239421 - DNA, 22 bp, Homo sapiens
gccttcttccatcccaggacac

SEQ ID NO: 3239422 - DNA, 17 bp, Homo sapiens
gccttcttctttttgct

SEQ ID NO: 3239423 - DNA, 18 bp, Homo sapiens
gccttcttctttttgctg

SEQ ID NO: 3239424 - DNA, 14 bp, Homo sapiens
gccttgaagccact

SEQ ID NO: 3239425 - DNA, 15 bp, Homo sapiens
gccttgaagccactg

SEQ ID NO: 3239426 - DNA, 23 bp, Homo sapiens
gccttgagagaaaaagtgcccct

SEQ ID NO: 3239427 - DNA, 16 bp, Homo sapiens
gccttgagccctggct

SEQ ID NO: 3239428 - DNA, 19 bp, Homo sapiens
gccttgatttgttcttaca

SEQ ID NO: 3239429 - DNA, 17 bp, Homo sapiens
gccttgcagaactgcca

SEQ ID NO: 3239430 - DNA, 14 bp, Homo sapiens
gccttgcagccaca

SEQ ID NO: 3239431 - DNA, 22 bp, Homo sapiens
gccttgcccggattctgggagg

SEQ ID NO: 3239432 - DNA, 21 bp, Homo sapiens
gccttgctcctagcagacaga

SEQ ID NO: 3239433 - DNA, 14 bp, Homo sapiens
gccttgctgctgct

SEQ ID NO: 3239434 - DNA, 17 bp, Homo sapiens
gccttgctgtttgtcct

SEQ ID NO: 3239435 - DNA, 19 bp, Homo sapiens
gccttgctgtttgtcctga

SEQ ID NO: 3239436 - DNA, 13 bp, Homo sapiens
gccttggaaattc

SEQ ID NO: 3239437 - DNA, 14 bp, Homo sapiens
gccttggaaattcc

SEQ ID NO: 3239438 - DNA, 23 bp, Homo sapiens
gccttggatcgctaagctggctc

SEQ ID NO: 3239439 - DNA, 16 bp, Homo sapiens
gccttggctcagacat

SEQ ID NO: 3239440 - DNA, 22 bp, Homo sapiens
gccttgggctatttggactcag

SEQ ID NO: 3239441 - DNA, 14 bp, Homo sapiens
gccttgggctgctc

SEQ ID NO: 3239442 - DNA, 18 bp, Homo sapiens
gccttggggaatttcctc

SEQ ID NO: 3239443 - DNA, 20 bp, Homo sapiens
gccttggggaggacaaaact

SEQ ID NO: 3239444 - DNA, 20 bp, Homo sapiens
gccttgtaattctaaatgaa

SEQ ID NO: 3239445 - DNA, 21 bp, Homo sapiens
gccttgtataatattgaaaat

SEQ ID NO: 3239446 - DNA, 22 bp, Homo sapiens
gccttgtataatattgaaaatt

SEQ ID NO: 3239447 - DNA, 22 bp, Homo sapiens
gccttgtccctctcactcccca

SEQ ID NO: 3239448 - DNA, 14 bp, Homo sapiens
gccttgtgccctgc

SEQ ID NO: 3239449 - DNA, 15 bp, Homo sapiens
gccttgttggtggag

SEQ ID NO: 3239450 - DNA, 18 bp, Homo sapiens
gccttgttgtgacacatc

SEQ ID NO: 3239451 - DNA, 14 bp, Homo sapiens
gccttgttttattc

SEQ ID NO: 3239452 - DNA, 18 bp, Homo sapiens
gcctttaagaaccttaat

SEQ ID NO: 3239453 - DNA, 20 bp, Homo sapiens
gcctttaagaaccttaatga

SEQ ID NO: 3239454 - DNA, 13 bp, Homo sapiens
gcctttatttgct

SEQ ID NO: 3239455 - DNA, 14 bp, Homo sapiens
gcctttccagcctc

SEQ ID NO: 3239456 - DNA, 21 bp, Homo sapiens
gcctttccataaggaatgtag

SEQ ID NO: 3239457 - DNA, 22 bp, Homo sapiens
gcctttccataaggaatgtagc

SEQ ID NO: 3239458 - DNA, 21 bp, Homo sapiens
gcctttcccaccgccctccct

SEQ ID NO: 3239459 - DNA, 18 bp, Homo sapiens
gcctttccgcggagccct

SEQ ID NO: 3239460 - DNA, 23 bp, Homo sapiens
gcctttccgcggagcccttggcc

SEQ ID NO: 3239461 - DNA, 13 bp, Homo sapiens
gcctttcctctct

SEQ ID NO: 3239462 - DNA, 19 bp, Homo sapiens
gcctttctgggagcagaaa

SEQ ID NO: 3239463 - DNA, 14 bp, Homo sapiens
gcctttcttctgcc

SEQ ID NO: 3239464 - DNA, 14 bp, Homo sapiens
gcctttgagacagt

SEQ ID NO: 3239465 - DNA, 20 bp, Homo sapiens
gcctttgagacagtttctta

SEQ ID NO: 3239466 - DNA, 15 bp, Homo sapiens
gctattactgtctgg

SEQ ID NO: 3239467 - DNA, 21 bp, Homo sapiens
gctattagccaggatcatggt

SEQ ID NO: 3239468 - DNA, 18 bp, Homo sapiens
gctattctcatgcctcag

SEQ ID NO: 3239469 - DNA, 16 bp, Homo sapiens
gctattgttgtgggct

SEQ ID NO: 3239470 - DNA, 22 bp, Homo sapiens
gctattgtttctttaagaaagt

SEQ ID NO: 3239471 - DNA, 12 bp, Homo sapiens
gctatttgaaat

SEQ ID NO: 3239472 - DNA, 20 bp, Homo sapiens
gctatttgaaatactaaaag

SEQ ID NO: 3239473 - DNA, 22 bp, Homo sapiens
gctatttgaaatactaaaagca

SEQ ID NO: 3239474 - DNA, 23 bp, Homo sapiens
gctatttgaaatactaaaagcaa

SEQ ID NO: 3239475 - DNA, 19 bp, Homo sapiens
gctatttgtaaatctgcca

SEQ ID NO: 3239476 - DNA, 17 bp, Homo sapiens
gctatttgttcagagag

SEQ ID NO: 3239477 - DNA, 14 bp, Homo sapiens
gctcaaatctattc

SEQ ID NO: 3239478 - DNA, 20 bp, Homo sapiens
gctcaaatctattcagacaa

SEQ ID NO: 3239479 - DNA, 21 bp, Homo sapiens
gctcaagcagcgaccgccccc

SEQ ID NO: 3239480 - DNA, 23 bp, Homo sapiens
gctcaaggaaagggggtcccagt

SEQ ID NO: 3239481 - DNA, 13 bp, Homo sapiens
gctcaagtagaaa

SEQ ID NO: 3239482 - DNA, 22 bp, Homo sapiens
gctcaagtcctcttttctgaga

SEQ ID NO: 3239483 - DNA, 17 bp, Homo sapiens
gctcaagtcttccctga

SEQ ID NO: 3239484 - DNA, 20 bp, Homo sapiens
gctcaagtcttccctgatca

SEQ ID NO: 3239485 - DNA, 16 bp, Homo sapiens
gctcaagtttaaaagc

SEQ ID NO: 3239486 - DNA, 17 bp, Homo sapiens
gctcaatggactggaag

SEQ ID NO: 3239487 - DNA, 13 bp, Homo sapiens
gctcacacacctg

SEQ ID NO: 3239488 - DNA, 17 bp, Homo sapiens
gctcacacctgcaatcc

SEQ ID NO: 3239489 - DNA, 22 bp, Homo sapiens
gctcacagaacccttggagcca

SEQ ID NO: 3239490 - DNA, 11 bp, Homo sapiens
gctcacaggcc

SEQ ID NO: 3239491 - DNA, 15 bp, Homo sapiens
gctcacaggcctctc

SEQ ID NO: 3239492 - DNA, 17 bp, Homo sapiens
gctcacaggcctctctt

SEQ ID NO: 3239493 - DNA, 15 bp, Homo sapiens
gctcacagtacagca

SEQ ID NO: 3239494 - DNA, 13 bp, Homo sapiens
gctcaccagcccc

SEQ ID NO: 3239495 - DNA, 18 bp, Homo sapiens
gctcaccagccccagtgc

SEQ ID NO: 3239496 - DNA, 20 bp, Homo sapiens
gctcaccagccccagtgccc

SEQ ID NO: 3239497 - DNA, 23 bp, Homo sapiens
gctcaccagccccagtgcccaca

SEQ ID NO: 3239498 - DNA, 12 bp, Homo sapiens
gctcacccctgg

SEQ ID NO: 3239499 - DNA, 14 bp, Homo sapiens
gctcacccctgggc

SEQ ID NO: 3239500 - DNA, 14 bp, Homo sapiens
gctcaccctgcccg

SEQ ID NO: 3239501 - DNA, 21 bp, Homo sapiens
gctcaccctgcccgctcccaa

SEQ ID NO: 3239502 - DNA, 22 bp, Homo sapiens
gctcaccctgcccgctcccaac

SEQ ID NO: 3239503 - DNA, 15 bp, Homo sapiens
gctcaccgcccatca

SEQ ID NO: 3239504 - DNA, 14 bp, Homo sapiens
gctcacctagagcc

SEQ ID NO: 3239505 - DNA, 17 bp, Homo sapiens
gctcacctagagccaga

SEQ ID NO: 3239506 - DNA, 14 bp, Homo sapiens
gctcacctctgaag

SEQ ID NO: 3239507 - DNA, 12 bp, Homo sapiens
gctcacctctgc

SEQ ID NO: 3239508 - DNA, 18 bp, Homo sapiens
gctcactgaaacctctgc

SEQ ID NO: 3239509 - DNA, 19 bp, Homo sapiens
gctcactgcaacctccgcc

SEQ ID NO: 3239510 - DNA, 16 bp, Homo sapiens
gctcactgcagcctca

SEQ ID NO: 3239511 - DNA, 17 bp, Homo sapiens
gctcactgcagcctcaa

SEQ ID NO: 3239512 - DNA, 12 bp, Homo sapiens
gctcactgccag

SEQ ID NO: 3239513 - DNA, 13 bp, Homo sapiens
gctcactgccagg

SEQ ID NO: 3239514 - DNA, 20 bp, Homo sapiens
gctcactgccaggccagcct

SEQ ID NO: 3239515 - DNA, 22 bp, Homo sapiens
gctcactgccaggccagcctcc

SEQ ID NO: 3239516 - DNA, 14 bp, Homo sapiens
gctcacttgcctta

SEQ ID NO: 3239517 - DNA, 22 bp, Homo sapiens
gctcacttttcatccttcccca

SEQ ID NO: 3239518 - DNA, 16 bp, Homo sapiens
gctcagaacccagggc

SEQ ID NO: 3239519 - DNA, 22 bp, Homo sapiens
gctcagaacccagggctctgcc

SEQ ID NO: 3239520 - DNA, 23 bp, Homo sapiens
gctcagaacccagggctctgccc

SEQ ID NO: 3239521 - DNA, 20 bp, Homo sapiens
gctcagaataaggcaggcat

SEQ ID NO: 3239522 - DNA, 17 bp, Homo sapiens
gctcagaatagatctga

SEQ ID NO: 3239523 - DNA, 16 bp, Homo sapiens
gctcagacatgttttc

SEQ ID NO: 3239524 - DNA, 17 bp, Homo sapiens
gctcagacggcggccag

SEQ ID NO: 3239525 - DNA, 20 bp, Homo sapiens
gctcagacggcggccaggca

SEQ ID NO: 3239526 - DNA, 17 bp, Homo sapiens
gctcagacttgccaggc

SEQ ID NO: 3239527 - DNA, 18 bp, Homo sapiens
gctcagagcttgaagatt

SEQ ID NO: 3239528 - DNA, 22 bp, Homo sapiens
gctcagatcggccacagggcgg

SEQ ID NO: 3239529 - DNA, 20 bp, Homo sapiens
gctcagccccgagctgtccc

SEQ ID NO: 3239530 - DNA, 15 bp, Homo sapiens
gctcagccctccctg

SEQ ID NO: 3239531 - DNA, 17 bp, Homo sapiens
gctcagccctccctgcc

SEQ ID NO: 3239532 - DNA, 18 bp, Homo sapiens
gctcagccctccctgccc

SEQ ID NO: 3239533 - DNA, 22 bp, Homo sapiens
gctcagcggggacagctccttc

SEQ ID NO: 3239534 - DNA, 14 bp, Homo sapiens
gctcagcttcttcc

SEQ ID NO: 3239535 - DNA, 16 bp, Homo sapiens
gctcaggaagaagaga

SEQ ID NO: 3239536 - DNA, 14 bp, Homo sapiens
gctcaggacccagg

SEQ ID NO: 3239537 - DNA, 16 bp, Homo sapiens
gctcaggacccaggcc

SEQ ID NO: 3239538 - DNA, 18 bp, Homo sapiens
gctcaggacccaggccct

SEQ ID NO: 3239539 - DNA, 21 bp, Homo sapiens
gctcaggacccaggccctcca

SEQ ID NO: 3239540 - DNA, 13 bp, Homo sapiens
gctcaggcaagcc

SEQ ID NO: 3239541 - DNA, 14 bp, Homo sapiens
gctcaggcaagccc

SEQ ID NO: 3239542 - DNA, 16 bp, Homo sapiens
gctcaggcaagcccct

SEQ ID NO: 3239543 - DNA, 17 bp, Homo sapiens
gctcaggcaagcccctc

SEQ ID NO: 3239544 - DNA, 18 bp, Homo sapiens
gctcaggcaagcccctca

SEQ ID NO: 3239545 - DNA, 19 bp, Homo sapiens
gctcaggcaagcccctcag

SEQ ID NO: 3239546 - DNA, 21 bp, Homo sapiens
gctcaggcaagcccctcagcc

SEQ ID NO: 3239547 - DNA, 14 bp, Homo sapiens
gctcaggcctagga

SEQ ID NO: 3239548 - DNA, 17 bp, Homo sapiens
gctcaggcctaggaggc

SEQ ID NO: 3239549 - DNA, 18 bp, Homo sapiens
gctcaggcctaggaggcc

SEQ ID NO: 3239550 - DNA, 19 bp, Homo sapiens
gctcaggcgatccacctgt

SEQ ID NO: 3239551 - DNA, 22 bp, Homo sapiens
gctcaggcgatccacctgtctc

SEQ ID NO: 3239552 - DNA, 14 bp, Homo sapiens
gctcagggctggag

SEQ ID NO: 3239553 - DNA, 14 bp, Homo sapiens
gctcaggtgtccct

SEQ ID NO: 3239554 - DNA, 19 bp, Homo sapiens
gctcaggtgtccctgcact

SEQ ID NO: 3239555 - DNA, 22 bp, Homo sapiens
gctcagtaaacgggaacatgcc

SEQ ID NO: 3239556 - DNA, 21 bp, Homo sapiens
gctcagtctcaggagcatggg

SEQ ID NO: 3239557 - DNA, 14 bp, Homo sapiens
gctcagtctccctt

SEQ ID NO: 3239558 - DNA, 20 bp, Homo sapiens
gctcataatggaaaaaaaga

SEQ ID NO: 3239559 - DNA, 18 bp, Homo sapiens
gctcatattttgtatata

SEQ ID NO: 3239560 - DNA, 16 bp, Homo sapiens
gctcatccttaatgta

SEQ ID NO: 3239561 - DNA, 15 bp, Homo sapiens
gctcatctccaagga

SEQ ID NO: 3239562 - DNA, 23 bp, Homo sapiens
gctcatctgctggtccgtgggac

SEQ ID NO: 3239563 - DNA, 17 bp, Homo sapiens
gctcatgcatagtccca

SEQ ID NO: 3239564 - DNA, 21 bp, Homo sapiens
gctcatggcgtaatgggcctg

SEQ ID NO: 3239565 - DNA, 23 bp, Homo sapiens
gctcatggcgtaatgggcctgcc

SEQ ID NO: 3239566 - DNA, 21 bp, Homo sapiens
gctcattataatgtcattaaa

SEQ ID NO: 3239567 - DNA, 12 bp, Homo sapiens
gctcatttaagt

SEQ ID NO: 3239568 - DNA, 16 bp, Homo sapiens
gctccaagacctgttg

SEQ ID NO: 3239569 - DNA, 18 bp, Homo sapiens
gctccaagacctgttggt

SEQ ID NO: 3239570 - DNA, 12 bp, Homo sapiens
gctccaccacat

SEQ ID NO: 3239571 - DNA, 15 bp, Homo sapiens
gctccaccacatcct

SEQ ID NO: 3239572 - DNA, 17 bp, Homo sapiens
gctccaccctcccccag

SEQ ID NO: 3239573 - DNA, 15 bp, Homo sapiens
gctccacccttggcc

SEQ ID NO: 3239574 - DNA, 16 bp, Homo sapiens
gctccacccttggcct

SEQ ID NO: 3239575 - DNA, 17 bp, Homo sapiens
gctccacccttggcctg

SEQ ID NO: 3239576 - DNA, 19 bp, Homo sapiens
gctccacccttggcctgtc

SEQ ID NO: 3239577 - DNA, 22 bp, Homo sapiens
gctccacccttggcctgtctca

SEQ ID NO: 3239578 - DNA, 13 bp, Homo sapiens
gctccactctgct

SEQ ID NO: 3239579 - DNA, 17 bp, Homo sapiens
gctccactctgcttctc

SEQ ID NO: 3239580 - DNA, 21 bp, Homo sapiens
gctccactctgcttctctgac

SEQ ID NO: 3239581 - DNA, 23 bp, Homo sapiens
gctccactctgcttctctgactt

SEQ ID NO: 3239582 - DNA, 18 bp, Homo sapiens
gctccactgtcaccctcc

SEQ ID NO: 3239583 - DNA, 20 bp, Homo sapiens
gctccacttggtctgtgaga

SEQ ID NO: 3239584 - DNA, 22 bp, Homo sapiens
gctccagcaccttctttctgga

SEQ ID NO: 3239585 - DNA, 16 bp, Homo sapiens
gctccagcatccagcc

SEQ ID NO: 3239586 - DNA, 18 bp, Homo sapiens
gctccagcatccagcctg

SEQ ID NO: 3239587 - DNA, 13 bp, Homo sapiens
gctccagctcacc

SEQ ID NO: 3239588 - DNA, 18 bp, Homo sapiens
gctccagctcaccagccc

SEQ ID NO: 3239589 - DNA, 13 bp, Homo sapiens
gctccagctgccc

SEQ ID NO: 3239590 - DNA, 14 bp, Homo sapiens
gctccaggactcca

SEQ ID NO: 3239591 - DNA, 15 bp, Homo sapiens
gctccaggcacccag

SEQ ID NO: 3239592 - DNA, 12 bp, Homo sapiens
gctgccagccca

SEQ ID NO: 3239593 - DNA, 13 bp, Homo sapiens
gctgccagcccag

SEQ ID NO: 3239594 - DNA, 19 bp, Homo sapiens
gctgccagccttgagccct

SEQ ID NO: 3239595 - DNA, 10 bp, Homo sapiens
gctgccaggc

SEQ ID NO: 3239596 - DNA, 22 bp, Homo sapiens
gctgccaggcgttggtgccact

SEQ ID NO: 3239597 - DNA, 20 bp, Homo sapiens
gctgccagtgcagccactgg

SEQ ID NO: 3239598 - DNA, 16 bp, Homo sapiens
gctgccataattctaa

SEQ ID NO: 3239599 - DNA, 18 bp, Homo sapiens
gctgccatcaccgctggg

SEQ ID NO: 3239600 - DNA, 19 bp, Homo sapiens
gctgccatcaccgctgggt

SEQ ID NO: 3239601 - DNA, 21 bp, Homo sapiens
gctgccatcaccgctgggtgg

SEQ ID NO: 3239602 - DNA, 12 bp, Homo sapiens
gctgccatccag

SEQ ID NO: 3239603 - DNA, 14 bp, Homo sapiens
gctgccatgccact

SEQ ID NO: 3239604 - DNA, 21 bp, Homo sapiens
gctgccatgccactgccaggc

SEQ ID NO: 3239605 - DNA, 23 bp, Homo sapiens
gctgccatggcgtgtccctctcg

SEQ ID NO: 3239606 - DNA, 23 bp, Homo sapiens
gctgcccactgtttctcttgagc

SEQ ID NO: 3239607 - DNA, 13 bp, Homo sapiens
gctgcccaggcca

SEQ ID NO: 3239608 - DNA, 14 bp, Homo sapiens
gctgcccaggccac

SEQ ID NO: 3239609 - DNA, 17 bp, Homo sapiens
gctgcccatcatgtggc

SEQ ID NO: 3239610 - DNA, 19 bp, Homo sapiens
gctgcccatcatgtggccc

SEQ ID NO: 3239611 - DNA, 12 bp, Homo sapiens
gctgccccagcc

SEQ ID NO: 3239612 - DNA, 14 bp, Homo sapiens
gctgccccagccag

SEQ ID NO: 3239613 - DNA, 16 bp, Homo sapiens
gctgccccagccagat

SEQ ID NO: 3239614 - DNA, 14 bp, Homo sapiens
gctgccccagctga

SEQ ID NO: 3239615 - DNA, 21 bp, Homo sapiens
gctgccccagctgactgtggc

SEQ ID NO: 3239616 - DNA, 19 bp, Homo sapiens
gctgcccccaacactccag

SEQ ID NO: 3239617 - DNA, 20 bp, Homo sapiens
gctgcccccaacactccagg

SEQ ID NO: 3239618 - DNA, 20 bp, Homo sapiens
gctgcccccaccccggggac

SEQ ID NO: 3239619 - DNA, 16 bp, Homo sapiens
gctgcccctctcacca

SEQ ID NO: 3239620 - DNA, 21 bp, Homo sapiens
gctgcccctgcgtggcctgag

SEQ ID NO: 3239621 - DNA, 23 bp, Homo sapiens
gctgcccgcgggagacagcttct

SEQ ID NO: 3239622 - DNA, 23 bp, Homo sapiens
gctgccctcccctccggactggt

SEQ ID NO: 3239623 - DNA, 13 bp, Homo sapiens
gctgccctgagaa

SEQ ID NO: 3239624 - DNA, 18 bp, Homo sapiens
gctgccctgagaagctgc

SEQ ID NO: 3239625 - DNA, 15 bp, Homo sapiens
gctgccctggccctg

SEQ ID NO: 3239626 - DNA, 19 bp, Homo sapiens
gctgccctggccctgaggt

SEQ ID NO: 3239627 - DNA, 13 bp, Homo sapiens
gctgccctggtgc

SEQ ID NO: 3239628 - DNA, 18 bp, Homo sapiens
gctgccctggtgctgcca

SEQ ID NO: 3239629 - DNA, 23 bp, Homo sapiens
gctgccctggtgctgccacactt

SEQ ID NO: 3239630 - DNA, 18 bp, Homo sapiens
gctgccctgtaccccagc

SEQ ID NO: 3239631 - DNA, 14 bp, Homo sapiens
gctgccctgtgtac

SEQ ID NO: 3239632 - DNA, 16 bp, Homo sapiens
gctgccgaccagagcc

SEQ ID NO: 3239633 - DNA, 17 bp, Homo sapiens
gctgccgaccagagccc

SEQ ID NO: 3239634 - DNA, 15 bp, Homo sapiens
gctgccgaggaccct

SEQ ID NO: 3239635 - DNA, 13 bp, Homo sapiens
gctgccgcctccc

SEQ ID NO: 3239636 - DNA, 13 bp, Homo sapiens
gctgccgctgcac

SEQ ID NO: 3239637 - DNA, 16 bp, Homo sapiens
gctgccgctgcaccac

SEQ ID NO: 3239638 - DNA, 17 bp, Homo sapiens
gctgccgctgcaccacg

SEQ ID NO: 3239639 - DNA, 16 bp, Homo sapiens
gctgcctctcccatca

SEQ ID NO: 3239640 - DNA, 15 bp, Homo sapiens
gctgcctctgctccc

SEQ ID NO: 3239641 - DNA, 11 bp, Homo sapiens
gctgcctctgg

SEQ ID NO: 3239642 - DNA, 15 bp, Homo sapiens
gctgcctctgggcca

SEQ ID NO: 3239643 - DNA, 21 bp, Homo sapiens
gctgcctgacactgagcccca

SEQ ID NO: 3239644 - DNA, 23 bp, Homo sapiens
gctgcctgacactgagccccacc

SEQ ID NO: 3239645 - DNA, 20 bp, Homo sapiens
gctgcctgcccgcacagcag

SEQ ID NO: 3239646 - DNA, 22 bp, Homo sapiens
gctgcctgcccgcacagcagcc

SEQ ID NO: 3239647 - DNA, 13 bp, Homo sapiens
gctgcctgcttgg

SEQ ID NO: 3239648 - DNA, 15 bp, Homo sapiens
gctgcctggagaggg

SEQ ID NO: 3239649 - DNA, 19 bp, Homo sapiens
gctgcctggagagggtctc

SEQ ID NO: 3239650 - DNA, 16 bp, Homo sapiens
gctgcctggatgagaa

SEQ ID NO: 3239651 - DNA, 12 bp, Homo sapiens
gctgcctgggct

SEQ ID NO: 3239652 - DNA, 13 bp, Homo sapiens
gctgcctgggctg

SEQ ID NO: 3239653 - DNA, 12 bp, Homo sapiens
gctgcctgtagt

SEQ ID NO: 3239654 - DNA, 15 bp, Homo sapiens
gctgccttccctagc

SEQ ID NO: 3239655 - DNA, 22 bp, Homo sapiens
gctgccttctgacggccctgca

SEQ ID NO: 3239656 - DNA, 21 bp, Homo sapiens
gctgccttttgtttctagaat

SEQ ID NO: 3239657 - DNA, 15 bp, Homo sapiens
gctgcgatactggca

SEQ ID NO: 3239658 - DNA, 21 bp, Homo sapiens
gctgcgcaccaatgcccagca

SEQ ID NO: 3239659 - DNA, 15 bp, Homo sapiens
gctgcgcttgctttt

SEQ ID NO: 3239660 - DNA, 18 bp, Homo sapiens
gctgcgggaggccctggc

SEQ ID NO: 3239661 - DNA, 16 bp, Homo sapiens
gctgcgggtctgaagg

SEQ ID NO: 3239662 - DNA, 15 bp, Homo sapiens
gctgcggtccaccca

SEQ ID NO: 3239663 - DNA, 20 bp, Homo sapiens
gctgctaccgccctgggctg

SEQ ID NO: 3239664 - DNA, 21 bp, Homo sapiens
gctgctaccgccctgggctgg

SEQ ID NO: 3239665 - DNA, 23 bp, Homo sapiens
gctgctaccgccctgggctggac

SEQ ID NO: 3239666 - DNA, 18 bp, Homo sapiens
gctgctagaactttttta

SEQ ID NO: 3239667 - DNA, 19 bp, Homo sapiens
gctgctatgaaaatgagca

SEQ ID NO: 3239668 - DNA, 14 bp, Homo sapiens
gctgctccaggcct

SEQ ID NO: 3239669 - DNA, 23 bp, Homo sapiens
gctgctccaggcctgcagcagga

SEQ ID NO: 3239670 - DNA, 13 bp, Homo sapiens
gctgctcctcatg

SEQ ID NO: 3239671 - DNA, 14 bp, Homo sapiens
gctgctccttggct

SEQ ID NO: 3239672 - DNA, 16 bp, Homo sapiens
gctgctcgcccaggaa

SEQ ID NO: 3239673 - DNA, 19 bp, Homo sapiens
gctgctctcccctcccagt

SEQ ID NO: 3239674 - DNA, 22 bp, Homo sapiens
gctgctctgccccttgggcatc

SEQ ID NO: 3239675 - DNA, 18 bp, Homo sapiens
gctgctcttagtgcccgc

SEQ ID NO: 3239676 - DNA, 22 bp, Homo sapiens
gctgctgaaaaccatctggcct

SEQ ID NO: 3239677 - DNA, 12 bp, Homo sapiens
gctgctgacagt

SEQ ID NO: 3239678 - DNA, 18 bp, Homo sapiens
gctgctgcccatgtttca

SEQ ID NO: 3239679 - DNA, 16 bp, Homo sapiens
gctgctgctaccagcg

SEQ ID NO: 3239680 - DNA, 12 bp, Homo sapiens
gctgctgctctg

SEQ ID NO: 3239681 - DNA, 12 bp, Homo sapiens
gctgctggggca

SEQ ID NO: 3239682 - DNA, 17 bp, Homo sapiens
gctgctggggcatgtgt

SEQ ID NO: 3239683 - DNA, 18 bp, Homo sapiens
gctgctgtaactgctgag

SEQ ID NO: 3239684 - DNA, 15 bp, Homo sapiens
gctgctgtccctccc

SEQ ID NO: 3239685 - DNA, 15 bp, Homo sapiens
gctgctgtgtgtgag

SEQ ID NO: 3239686 - DNA, 24 bp, Homo sapiens
gctgctgtgtgtgagcagtggaca

SEQ ID NO: 3239687 - DNA, 15 bp, Homo sapiens
gctgcttcctcctgg

SEQ ID NO: 3239688 - DNA, 15 bp, Homo sapiens
gctgctttcccctgt

SEQ ID NO: 3239689 - DNA, 20 bp, Homo sapiens
gctgctttcccctgtgggga

SEQ ID NO: 3239690 - DNA, 21 bp, Homo sapiens
gctgctttcccctgtggggat

SEQ ID NO: 3239691 - DNA, 15 bp, Homo sapiens
gctgcttttgagcct

SEQ ID NO: 3239692 - DNA, 19 bp, Homo sapiens
gctgcttttgagcctcaga

SEQ ID NO: 3239693 - DNA, 18 bp, Homo sapiens
gctgctttttgaggtggc

SEQ ID NO: 3239694 - DNA, 17 bp, Homo sapiens
gctgctttttggcacag

SEQ ID NO: 3239695 - DNA, 18 bp, Homo sapiens
gctgctttttggcacagt

SEQ ID NO: 3239696 - DNA, 14 bp, Homo sapiens
gctggaagatcctg

SEQ ID NO: 3239697 - DNA, 15 bp, Homo sapiens
gctggaagatcctgc

SEQ ID NO: 3239698 - DNA, 20 bp, Homo sapiens
gctggaaggggccacgtgga

SEQ ID NO: 3239699 - DNA, 15 bp, Homo sapiens
gctggacagcctccg

SEQ ID NO: 3239700 - DNA, 20 bp, Homo sapiens
gctggaccagtggtgccttg

SEQ ID NO: 3239701 - DNA, 18 bp, Homo sapiens
gctggaccctgcttcacc

SEQ ID NO: 3239702 - DNA, 21 bp, Homo sapiens
gctggaccctgcttcaccctc

SEQ ID NO: 3239703 - DNA, 15 bp, Homo sapiens
gctggaccttgaact

SEQ ID NO: 3239704 - DNA, 21 bp, Homo sapiens
gctggacggggactggggatg

SEQ ID NO: 3239705 - DNA, 16 bp, Homo sapiens
gctggacgtctttctt

SEQ ID NO: 3239706 - DNA, 13 bp, Homo sapiens
gctggactctgca

SEQ ID NO: 3239707 - DNA, 16 bp, Homo sapiens
gctggactggaggtgg

SEQ ID NO: 3239708 - DNA, 22 bp, Homo sapiens
gctggactggaggtgggcatgc

SEQ ID NO: 3239709 - DNA, 17 bp, Homo sapiens
gctggactgttccaggc

SEQ ID NO: 3239710 - DNA, 23 bp, Homo sapiens
gctggactgttccaggccctcca

SEQ ID NO: 3239711 - DNA, 20 bp, Homo sapiens
gctggacttctacctgccct

SEQ ID NO: 3239712 - DNA, 23 bp, Homo sapiens
gctggacttctacctgccctcaa

SEQ ID NO: 3239713 - DNA, 12 bp, Homo sapiens
gctggagaaaga

SEQ ID NO: 3239714 - DNA, 16 bp, Homo sapiens
gctggagaaagagctg

SEQ ID NO: 3239715 - DNA, 20 bp, Homo sapiens
gctggagaaagagctgcctg

SEQ ID NO: 3239716 - DNA, 14 bp, Homo sapiens
gctggagaagagag

SEQ ID NO: 3239717 - DNA, 15 bp, Homo sapiens
gctggagaagagagg

SEQ ID NO: 3239718 - DNA, 21 bp, Homo sapiens
gcttcctcttccgggcagaaa

SEQ ID NO: 3239719 - DNA, 14 bp, Homo sapiens
gcttcctgaaataa

SEQ ID NO: 3239720 - DNA, 15 bp, Homo sapiens
gcttcctgaaataaa

SEQ ID NO: 3239721 - DNA, 22 bp, Homo sapiens
gcttcctggtgtatttttcagg

SEQ ID NO: 3239722 - DNA, 17 bp, Homo sapiens
gcttcctgtccactctc

SEQ ID NO: 3239723 - DNA, 23 bp, Homo sapiens
gcttcctgtgctaagtctttccc

SEQ ID NO: 3239724 - DNA, 22 bp, Homo sapiens
gcttccttctgggactggacag

SEQ ID NO: 3239725 - DNA, 23 bp, Homo sapiens
gcttcctttgaccactgtctttt

SEQ ID NO: 3239726 - DNA, 12 bp, Homo sapiens
gcttcggacagt

SEQ ID NO: 3239727 - DNA, 19 bp, Homo sapiens
gcttcggagggcccctgcg

SEQ ID NO: 3239728 - DNA, 14 bp, Homo sapiens
gcttcgtttatttt

SEQ ID NO: 3239729 - DNA, 16 bp, Homo sapiens
gcttctaataaattat

SEQ ID NO: 3239730 - DNA, 18 bp, Homo sapiens
gcttctaatgttccccgt

SEQ ID NO: 3239731 - DNA, 19 bp, Homo sapiens
gcttctaccatgaacagaa

SEQ ID NO: 3239732 - DNA, 18 bp, Homo sapiens
gcttctataattttgcct

SEQ ID NO: 3239733 - DNA, 16 bp, Homo sapiens
gcttctccgccagcct

SEQ ID NO: 3239734 - DNA, 17 bp, Homo sapiens
gcttctccgccagcctc

SEQ ID NO: 3239735 - DNA, 20 bp, Homo sapiens
gcttctcctcccagcgtgtg

SEQ ID NO: 3239736 - DNA, 23 bp, Homo sapiens
gcttctcctgcgccccgcccaca

SEQ ID NO: 3239737 - DNA, 11 bp, Homo sapiens
gcttctcctgt

SEQ ID NO: 3239738 - DNA, 22 bp, Homo sapiens
gcttctcctgttttatatatta

SEQ ID NO: 3239739 - DNA, 14 bp, Homo sapiens
gcttctctgacttc

SEQ ID NO: 3239740 - DNA, 16 bp, Homo sapiens
gcttctctgcagtaaa

SEQ ID NO: 3239741 - DNA, 17 bp, Homo sapiens
gcttctgaatgtgctga

SEQ ID NO: 3239742 - DNA, 21 bp, Homo sapiens
gcttctgagtttatattctga

SEQ ID NO: 3239743 - DNA, 12 bp, Homo sapiens
gcttctgcaccc

SEQ ID NO: 3239744 - DNA, 19 bp, Homo sapiens
gcttctgcaccctccaccc

SEQ ID NO: 3239745 - DNA, 16 bp, Homo sapiens
gcttctgccacataaa

SEQ ID NO: 3239746 - DNA, 23 bp, Homo sapiens
gcttctgcttttctgccctggct

SEQ ID NO: 3239747 - DNA, 13 bp, Homo sapiens
gcttctggagccc

SEQ ID NO: 3239748 - DNA, 18 bp, Homo sapiens
gcttctggagcccttggg

SEQ ID NO: 3239749 - DNA, 15 bp, Homo sapiens
gcttctggctcccat

SEQ ID NO: 3239750 - DNA, 19 bp, Homo sapiens
gcttctggtactctcctag

SEQ ID NO: 3239751 - DNA, 17 bp, Homo sapiens
gcttctgtgatgagctg

SEQ ID NO: 3239752 - DNA, 20 bp, Homo sapiens
gcttctgtgatgagctgatc

SEQ ID NO: 3239753 - DNA, 13 bp, Homo sapiens
gcttcttaattaa

SEQ ID NO: 3239754 - DNA, 20 bp, Homo sapiens
gcttcttactattaagcagt

SEQ ID NO: 3239755 - DNA, 19 bp, Homo sapiens
gcttcttcctaggtccaag

SEQ ID NO: 3239756 - DNA, 13 bp, Homo sapiens
gcttcttgcctct

SEQ ID NO: 3239757 - DNA, 14 bp, Homo sapiens
gcttcttgcctctg

SEQ ID NO: 3239758 - DNA, 15 bp, Homo sapiens
gcttcttgcctctgt

SEQ ID NO: 3239759 - DNA, 16 bp, Homo sapiens
gcttcttgcctctgtg

SEQ ID NO: 3239760 - DNA, 18 bp, Homo sapiens
gcttcttgcctctgtgct

SEQ ID NO: 3239761 - DNA, 19 bp, Homo sapiens
gcttcttgcctctgtgctg

SEQ ID NO: 3239762 - DNA, 20 bp, Homo sapiens
gcttcttgcctctgtgctgt

SEQ ID NO: 3239763 - DNA, 15 bp, Homo sapiens
gcttctttctagaaa

SEQ ID NO: 3239764 - DNA, 15 bp, Homo sapiens
gcttgaaattactgt

SEQ ID NO: 3239765 - DNA, 12 bp, Homo sapiens
gcttgaacacag

SEQ ID NO: 3239766 - DNA, 19 bp, Homo sapiens
gcttgacaaatattttcat

SEQ ID NO: 3239767 - DNA, 20 bp, Homo sapiens
gcttgaccaggcttggcctt

SEQ ID NO: 3239768 - DNA, 19 bp, Homo sapiens
gcttgaccgtactctcaca

SEQ ID NO: 3239769 - DNA, 22 bp, Homo sapiens
gcttgaccgtactctcacatgt

SEQ ID NO: 3239770 - DNA, 20 bp, Homo sapiens
gcttgagaaatatggacact

SEQ ID NO: 3239771 - DNA, 21 bp, Homo sapiens
gcttgagagccctgaggccta

SEQ ID NO: 3239772 - DNA, 13 bp, Homo sapiens
gcttgagcccagg

SEQ ID NO: 3239773 - DNA, 14 bp, Homo sapiens
gcttgagcccagga

SEQ ID NO: 3239774 - DNA, 18 bp, Homo sapiens
gcttgagccgggcccctg

SEQ ID NO: 3239775 - DNA, 18 bp, Homo sapiens
gcttgagggttgggctgg

SEQ ID NO: 3239776 - DNA, 19 bp, Homo sapiens
gcttgagttcaccatctct

SEQ ID NO: 3239777 - DNA, 20 bp, Homo sapiens
gcttgatgaagcaaggaaga

SEQ ID NO: 3239778 - DNA, 13 bp, Homo sapiens
gcttgattaaatc

SEQ ID NO: 3239779 - DNA, 11 bp, Homo sapiens
gcttgcagaac

SEQ ID NO: 3239780 - DNA, 23 bp, Homo sapiens
gcttgcataataagctaaagagg

SEQ ID NO: 3239781 - DNA, 14 bp, Homo sapiens
gcttgccaaagtac

SEQ ID NO: 3239782 - DNA, 12 bp, Homo sapiens
gcttgccccggc

SEQ ID NO: 3239783 - DNA, 16 bp, Homo sapiens
gcttgcgaactagaga

SEQ ID NO: 3239784 - DNA, 16 bp, Homo sapiens
gcttgctagctatgtg

SEQ ID NO: 3239785 - DNA, 22 bp, Homo sapiens
gcttgctagctatgtgaccttg

SEQ ID NO: 3239786 - DNA, 14 bp, Homo sapiens
gcttgctccagggt

SEQ ID NO: 3239787 - DNA, 12 bp, Homo sapiens
gcttgcttgccg

SEQ ID NO: 3239788 - DNA, 21 bp, Homo sapiens
gcttggaaagcatcacctcag

SEQ ID NO: 3239789 - DNA, 15 bp, Homo sapiens
gcttggaagaaggaa

SEQ ID NO: 3239790 - DNA, 12 bp, Homo sapiens
gcttggaagcca

SEQ ID NO: 3239791 - DNA, 16 bp, Homo sapiens
gcttggacttcctggg

SEQ ID NO: 3239792 - DNA, 23 bp, Homo sapiens
gcttggagacccacaaagagagt

SEQ ID NO: 3239793 - DNA, 18 bp, Homo sapiens
gcttggcagttgcagtgc

SEQ ID NO: 3239794 - DNA, 15 bp, Homo sapiens
gcttggcccagcgcc

SEQ ID NO: 3239795 - DNA, 16 bp, Homo sapiens
gcttggcccggccggc

SEQ ID NO: 3239796 - DNA, 15 bp, Homo sapiens
gcttggcctgctgtg

SEQ ID NO: 3239797 - DNA, 20 bp, Homo sapiens
gcttgggagagcccctgggg

SEQ ID NO: 3239798 - DNA, 14 bp, Homo sapiens
gcttgggctccacg

SEQ ID NO: 3239799 - DNA, 15 bp, Homo sapiens
gcttgggctccacgg

SEQ ID NO: 3239800 - DNA, 19 bp, Homo sapiens
gcttggggccaccaaagct

SEQ ID NO: 3239801 - DNA, 11 bp, Homo sapiens
gcttggggcta

SEQ ID NO: 3239802 - DNA, 16 bp, Homo sapiens
gcttggggctatttgt

SEQ ID NO: 3239803 - DNA, 16 bp, Homo sapiens
gcttggggctcacaca

SEQ ID NO: 3239804 - DNA, 20 bp, Homo sapiens
gcttggggctcacacacctg

SEQ ID NO: 3239805 - DNA, 13 bp, Homo sapiens
gcttggttggctg

SEQ ID NO: 3239806 - DNA, 20 bp, Homo sapiens
gcttgtaaatagctcaggtg

SEQ ID NO: 3239807 - DNA, 14 bp, Homo sapiens
gcttgtaacaagaa

SEQ ID NO: 3239808 - DNA, 16 bp, Homo sapiens
gcttgtaacaagaaaa

SEQ ID NO: 3239809 - DNA, 17 bp, Homo sapiens
gcttgtaacaagaaaac

SEQ ID NO: 3239810 - DNA, 18 bp, Homo sapiens
gcttgtaacaagaaaaca

SEQ ID NO: 3239811 - DNA, 15 bp, Homo sapiens
gcttgtactgggaca

SEQ ID NO: 3239812 - DNA, 16 bp, Homo sapiens
gcttgtactgggacat

SEQ ID NO: 3239813 - DNA, 13 bp, Homo sapiens
gcttgtaggagct

SEQ ID NO: 3239814 - DNA, 14 bp, Homo sapiens
gcttgtatagtgta

SEQ ID NO: 3239815 - DNA, 14 bp, Homo sapiens
gcttgtcttttctg

SEQ ID NO: 3239816 - DNA, 16 bp, Homo sapiens
gcttgtcttttctgct

SEQ ID NO: 3239817 - DNA, 23 bp, Homo sapiens
gcttgtcttttctgctgaggagg

SEQ ID NO: 3239818 - DNA, 11 bp, Homo sapiens
gcttgtgaact

SEQ ID NO: 3239819 - DNA, 21 bp, Homo sapiens
gcttgtggccccttttacttt

SEQ ID NO: 3239820 - DNA, 15 bp, Homo sapiens
gcttgtgggctggtg

SEQ ID NO: 3239821 - DNA, 14 bp, Homo sapiens
gcttgtgtgtttca

SEQ ID NO: 3239822 - DNA, 12 bp, Homo sapiens
gcttgtgttaag

SEQ ID NO: 3239823 - DNA, 16 bp, Homo sapiens
gcttgttagagagaaa

SEQ ID NO: 3239824 - DNA, 18 bp, Homo sapiens
gcttgttccctctccctg

SEQ ID NO: 3239825 - DNA, 14 bp, Homo sapiens
gcttgttctgggct

SEQ ID NO: 3239826 - DNA, 17 bp, Homo sapiens
gcttgttctgggctcag

SEQ ID NO: 3239827 - DNA, 20 bp, Homo sapiens
gcttgttgggattcctgacc

SEQ ID NO: 3239828 - DNA, 21 bp, Homo sapiens
gcttgttgggattcctgaccc

SEQ ID NO: 3239829 - DNA, 22 bp, Homo sapiens
gcttgttgggattcctgaccca

SEQ ID NO: 3239830 - DNA, 24 bp, Homo sapiens
gcttgttgggattcctgacccagg

SEQ ID NO: 3239831 - DNA, 20 bp, Homo sapiens
gcttgtttacagcactactc

SEQ ID NO: 3239832 - DNA, 20 bp, Homo sapiens
gcttgtttgatttcaacatg

SEQ ID NO: 3239833 - DNA, 15 bp, Homo sapiens
gcttgtttgcctgtc

SEQ ID NO: 3239834 - DNA, 16 bp, Homo sapiens
gctttaaagtgtaata

SEQ ID NO: 3239835 - DNA, 14 bp, Homo sapiens
gctttaagccttca

SEQ ID NO: 3239836 - DNA, 13 bp, Homo sapiens
gctttaatcagaa

SEQ ID NO: 3239837 - DNA, 22 bp, Homo sapiens
gctttaattaattaagtatctg

SEQ ID NO: 3239838 - DNA, 16 bp, Homo sapiens
gctttacacacacaga

SEQ ID NO: 3239839 - DNA, 12 bp, Homo sapiens
gctttacatgca

SEQ ID NO: 3239840 - DNA, 17 bp, Homo sapiens
gctttacatgctgtgct

SEQ ID NO: 3239841 - DNA, 13 bp, Homo sapiens
gctttaccttttt

SEQ ID NO: 3239842 - DNA, 19 bp, Homo sapiens
gctttactccgtaacagat

SEQ ID NO: 3239843 - DNA, 13 bp, Homo sapiens
gctttactgcctt

SEQ ID NO: 3239844 - DNA, 14 bp, Homo sapiens
gctttagaccctgg

SEQ ID NO: 3239845 - DNA, 19 bp, Homo sapiens
ggacagtgcttcagcctga

SEQ ID NO: 3239846 - DNA, 18 bp, Homo sapiens
ggacagttcacaccctgc

SEQ ID NO: 3239847 - DNA, 20 bp, Homo sapiens
ggacagttcacaccctgcaa

SEQ ID NO: 3239848 - DNA, 23 bp, Homo sapiens
ggacagttggcagagaaggcctc

SEQ ID NO: 3239849 - DNA, 23 bp, Homo sapiens
ggacagtttaccagttgcctttt

SEQ ID NO: 3239850 - DNA, 23 bp, Homo sapiens
ggacatagaggtatattggaaga

SEQ ID NO: 3239851 - DNA, 14 bp, Homo sapiens
ggacatcctcttct

SEQ ID NO: 3239852 - DNA, 16 bp, Homo sapiens
ggacatctcctggcta

SEQ ID NO: 3239853 - DNA, 21 bp, Homo sapiens
ggacatgtttttgttttcttt

SEQ ID NO: 3239854 - DNA, 18 bp, Homo sapiens
ggacattgctctctgggc

SEQ ID NO: 3239855 - DNA, 22 bp, Homo sapiens
ggacattgttctttccggccaa

SEQ ID NO: 3239856 - DNA, 20 bp, Homo sapiens
ggaccaaccctggggaagga

SEQ ID NO: 3239857 - DNA, 15 bp, Homo sapiens
ggaccaaggcaaggc

SEQ ID NO: 3239858 - DNA, 20 bp, Homo sapiens
ggaccaaggcaaggcaggtg

SEQ ID NO: 3239859 - DNA, 13 bp, Homo sapiens
ggaccaaggtgaa

SEQ ID NO: 3239860 - DNA, 23 bp, Homo sapiens
ggaccacacagtccccagactca

SEQ ID NO: 3239861 - DNA, 13 bp, Homo sapiens
ggaccacacctcc

SEQ ID NO: 3239862 - DNA, 21 bp, Homo sapiens
ggaccacagtgggtggcacct

SEQ ID NO: 3239863 - DNA, 13 bp, Homo sapiens
ggaccactcagcc

SEQ ID NO: 3239864 - DNA, 21 bp, Homo sapiens
ggaccactgcatgagctttta

SEQ ID NO: 3239865 - DNA, 11 bp, Homo sapiens
ggaccagagac

SEQ ID NO: 3239866 - DNA, 13 bp, Homo sapiens
ggaccagagccag

SEQ ID NO: 3239867 - DNA, 14 bp, Homo sapiens
ggaccagagccaga

SEQ ID NO: 3239868 - DNA, 16 bp, Homo sapiens
ggaccagagccagatg

SEQ ID NO: 3239869 - DNA, 18 bp, Homo sapiens
ggaccagagccagatgca

SEQ ID NO: 3239870 - DNA, 16 bp, Homo sapiens
ggaccagggatggggg

SEQ ID NO: 3239871 - DNA, 16 bp, Homo sapiens
ggaccatgtgtcactt

SEQ ID NO: 3239872 - DNA, 22 bp, Homo sapiens
ggacccaaggaaaactgcatgg

SEQ ID NO: 3239873 - DNA, 18 bp, Homo sapiens
ggacccaccaaactgcac

SEQ ID NO: 3239874 - DNA, 19 bp, Homo sapiens
ggacccacggagccctccc

SEQ ID NO: 3239875 - DNA, 18 bp, Homo sapiens
ggacccagcgggcaggtt

SEQ ID NO: 3239876 - DNA, 22 bp, Homo sapiens
ggacccagctactctgtccagg

SEQ ID NO: 3239877 - DNA, 14 bp, Homo sapiens
ggacccaggccctc

SEQ ID NO: 3239878 - DNA, 13 bp, Homo sapiens
ggacccaggctcc

SEQ ID NO: 3239879 - DNA, 20 bp, Homo sapiens
ggaccccaacctcagaggca

SEQ ID NO: 3239880 - DNA, 12 bp, Homo sapiens
ggaccccagaga

SEQ ID NO: 3239881 - DNA, 12 bp, Homo sapiens
ggaccccagctg

SEQ ID NO: 3239882 - DNA, 22 bp, Homo sapiens
ggacccctgctcccagcctgct

SEQ ID NO: 3239883 - DNA, 21 bp, Homo sapiens
ggaccctactattcatgtttt

SEQ ID NO: 3239884 - DNA, 13 bp, Homo sapiens
ggaccctgtccaa

SEQ ID NO: 3239885 - DNA, 23 bp, Homo sapiens
ggacccttgagagtatcaggtct

SEQ ID NO: 3239886 - DNA, 19 bp, Homo sapiens
ggaccgggtgggcctggcc

SEQ ID NO: 3239887 - DNA, 22 bp, Homo sapiens
ggaccgggtgggcctggcctga

SEQ ID NO: 3239888 - DNA, 15 bp, Homo sapiens
ggaccggtgctgcag

SEQ ID NO: 3239889 - DNA, 16 bp, Homo sapiens
ggaccggtgctgcagg

SEQ ID NO: 3239890 - DNA, 20 bp, Homo sapiens
ggaccggtgctgcaggagtg

SEQ ID NO: 3239891 - DNA, 17 bp, Homo sapiens
ggaccgtggacaggccc

SEQ ID NO: 3239892 - DNA, 18 bp, Homo sapiens
ggaccgtggacaggccca

SEQ ID NO: 3239893 - DNA, 21 bp, Homo sapiens
ggaccgtggacaggcccagcg

SEQ ID NO: 3239894 - DNA, 22 bp, Homo sapiens
ggacctaaatggcctcatgtgg

SEQ ID NO: 3239895 - DNA, 15 bp, Homo sapiens
ggacctcctcttccc

SEQ ID NO: 3239896 - DNA, 19 bp, Homo sapiens
ggacctgaaattccaaagt

SEQ ID NO: 3239897 - DNA, 14 bp, Homo sapiens
ggacctgccaggca

SEQ ID NO: 3239898 - DNA, 17 bp, Homo sapiens
ggacctgccaggcaggg

SEQ ID NO: 3239899 - DNA, 17 bp, Homo sapiens
ggacctggtaccctcct

SEQ ID NO: 3239900 - DNA, 15 bp, Homo sapiens
ggaccttgaactggg

SEQ ID NO: 3239901 - DNA, 18 bp, Homo sapiens
ggaccttgaactgggtac

SEQ ID NO: 3239902 - DNA, 19 bp, Homo sapiens
ggacgcacgctcgctgcca

SEQ ID NO: 3239903 - DNA, 24 bp, Homo sapiens
ggacgccgggccggccctagccca

SEQ ID NO: 3239904 - DNA, 15 bp, Homo sapiens
ggacgctttgtctgt

SEQ ID NO: 3239905 - DNA, 18 bp, Homo sapiens
ggacgtcctatctccccc

SEQ ID NO: 3239906 - DNA, 19 bp, Homo sapiens
ggactaaactatctgtatt

SEQ ID NO: 3239907 - DNA, 20 bp, Homo sapiens
ggactaaactatctgtattt

SEQ ID NO: 3239908 - DNA, 19 bp, Homo sapiens
ggactaacataaaatctgt

SEQ ID NO: 3239909 - DNA, 22 bp, Homo sapiens
ggactaaccccaacgcacagga

SEQ ID NO: 3239910 - DNA, 21 bp, Homo sapiens
ggactagatactactttctct

SEQ ID NO: 3239911 - DNA, 22 bp, Homo sapiens
ggactagcccctgtggagactg

SEQ ID NO: 3239912 - DNA, 22 bp, Homo sapiens
ggactatattaatcaccttctt

SEQ ID NO: 3239913 - DNA, 18 bp, Homo sapiens
ggactcagcccacctgca

SEQ ID NO: 3239914 - DNA, 15 bp, Homo sapiens
ggactcagccctgag

SEQ ID NO: 3239915 - DNA, 16 bp, Homo sapiens
ggactcagccctgagg

SEQ ID NO: 3239916 - DNA, 17 bp, Homo sapiens
ggactcagccctgaggt

SEQ ID NO: 3239917 - DNA, 11 bp, Homo sapiens
ggactcaggga

SEQ ID NO: 3239918 - DNA, 14 bp, Homo sapiens
ggactccaggccca

SEQ ID NO: 3239919 - DNA, 21 bp, Homo sapiens
ggactcccaaccctggcttgg

SEQ ID NO: 3239920 - DNA, 13 bp, Homo sapiens
ggactcccagtga

SEQ ID NO: 3239921 - DNA, 18 bp, Homo sapiens
ggactcccgggccacgcc

SEQ ID NO: 3239922 - DNA, 14 bp, Homo sapiens
ggactcctggtgcc

SEQ ID NO: 3239923 - DNA, 16 bp, Homo sapiens
ggactcgcttgtaaat

SEQ ID NO: 3239924 - DNA, 11 bp, Homo sapiens
ggactctcagg

SEQ ID NO: 3239925 - DNA, 15 bp, Homo sapiens
ggactctgagcggga

SEQ ID NO: 3239926 - DNA, 21 bp, Homo sapiens
ggactctgaggctctttctgg

SEQ ID NO: 3239927 - DNA, 22 bp, Homo sapiens
ggactctgcaagtgtctggagc

SEQ ID NO: 3239928 - DNA, 13 bp, Homo sapiens
ggactctgcacat

SEQ ID NO: 3239929 - DNA, 20 bp, Homo sapiens
ggactctgcacatgtcttgt

SEQ ID NO: 3239930 - DNA, 12 bp, Homo sapiens
ggactctgcccc

SEQ ID NO: 3239931 - DNA, 11 bp, Homo sapiens
ggactctgcct

SEQ ID NO: 3239932 - DNA, 16 bp, Homo sapiens
ggactcttctcggctc

SEQ ID NO: 3239933 - DNA, 21 bp, Homo sapiens
ggactcttgctctttctactc

SEQ ID NO: 3239934 - DNA, 16 bp, Homo sapiens
ggactgaagcctgcag

SEQ ID NO: 3239935 - DNA, 17 bp, Homo sapiens
ggactgaagcctgcagg

SEQ ID NO: 3239936 - DNA, 19 bp, Homo sapiens
ggactgaagcctgcaggag

SEQ ID NO: 3239937 - DNA, 13 bp, Homo sapiens
ggactgactgaga

SEQ ID NO: 3239938 - DNA, 17 bp, Homo sapiens
ggactgagcctggccca

SEQ ID NO: 3239939 - DNA, 13 bp, Homo sapiens
ggactgaggagtg

SEQ ID NO: 3239940 - DNA, 22 bp, Homo sapiens
ggactgcacagcgtcctgtcca

SEQ ID NO: 3239941 - DNA, 23 bp, Homo sapiens
ggactgcacagcgtcctgtccac

SEQ ID NO: 3239942 - DNA, 14 bp, Homo sapiens
ggactgcctctgcc

SEQ ID NO: 3239943 - DNA, 15 bp, Homo sapiens
ggactgcctctgcca

SEQ ID NO: 3239944 - DNA, 17 bp, Homo sapiens
ggactggaggtgggcat

SEQ ID NO: 3239945 - DNA, 19 bp, Homo sapiens
ggactggctagagtcctca

SEQ ID NO: 3239946 - DNA, 20 bp, Homo sapiens
ggactggctagagtcctcac

SEQ ID NO: 3239947 - DNA, 23 bp, Homo sapiens
ggactggggatgtgggagggagc

SEQ ID NO: 3239948 - DNA, 20 bp, Homo sapiens
ggactgggttgcgtcctgac

SEQ ID NO: 3239949 - DNA, 18 bp, Homo sapiens
ggactgggtttggacccc

SEQ ID NO: 3239950 - DNA, 21 bp, Homo sapiens
ggactggtgccctcctcactc

SEQ ID NO: 3239951 - DNA, 14 bp, Homo sapiens
ggactggtttgaga

SEQ ID NO: 3239952 - DNA, 18 bp, Homo sapiens
ggactgttccaaagccag

SEQ ID NO: 3239953 - DNA, 21 bp, Homo sapiens
ggactgttccaaagccagtga

SEQ ID NO: 3239954 - DNA, 15 bp, Homo sapiens
ggacttaacggctcc

SEQ ID NO: 3239955 - DNA, 23 bp, Homo sapiens
ggacttaagcatctggctctaat

SEQ ID NO: 3239956 - DNA, 16 bp, Homo sapiens
ggacttcctggggccc

SEQ ID NO: 3239957 - DNA, 15 bp, Homo sapiens
ggacttccttgctct

SEQ ID NO: 3239958 - DNA, 16 bp, Homo sapiens
ggacttcggaccgctt

SEQ ID NO: 3239959 - DNA, 23 bp, Homo sapiens
ggacttcggaccgcttgtgggga

SEQ ID NO: 3239960 - DNA, 14 bp, Homo sapiens
ggacttctgcagct

SEQ ID NO: 3239961 - DNA, 22 bp, Homo sapiens
ggacttctgtgggcccctcaac

SEQ ID NO: 3239962 - DNA, 21 bp, Homo sapiens
ggacttggtacagttgcagga

SEQ ID NO: 3239963 - DNA, 20 bp, Homo sapiens
ggacttgtatatttgtacaa

SEQ ID NO: 3239964 - DNA, 16 bp, Homo sapiens
ggactttatttatttc

SEQ ID NO: 3239965 - DNA, 22 bp, Homo sapiens
ggactttcaaaattaaatctgt

SEQ ID NO: 3239966 - DNA, 17 bp, Homo sapiens
ggactttgcagccggca

SEQ ID NO: 3239967 - DNA, 22 bp, Homo sapiens
ggactttgctgatttcccctct

SEQ ID NO: 3239968 - DNA, 18 bp, Homo sapiens
ggacttttcgttaacatt

SEQ ID NO: 3239969 - DNA, 20 bp, Homo sapiens
ggagaaaaaaaaccttgtaa

SEQ ID NO: 3239970 - DNA, 22 bp, Homo sapiens
ggatccccgcctggccaggagc

SEQ ID NO: 3239971 - DNA, 21 bp, Homo sapiens
ggatccgactgctttggacct

SEQ ID NO: 3239972 - DNA, 16 bp, Homo sapiens
ggatccgctgccacca

SEQ ID NO: 3239973 - DNA, 17 bp, Homo sapiens
ggatcctccctcatggc

SEQ ID NO: 3239974 - DNA, 12 bp, Homo sapiens
ggatcctgcagg

SEQ ID NO: 3239975 - DNA, 13 bp, Homo sapiens
ggatcctgcagga

SEQ ID NO: 3239976 - DNA, 12 bp, Homo sapiens
ggatcctgctgg

SEQ ID NO: 3239977 - DNA, 13 bp, Homo sapiens
ggatcctgctggg

SEQ ID NO: 3239978 - DNA, 17 bp, Homo sapiens
ggatcgctaagctggct

SEQ ID NO: 3239979 - DNA, 22 bp, Homo sapiens
ggatctcagctttgagaagcct

SEQ ID NO: 3239980 - DNA, 13 bp, Homo sapiens
ggatctcaggggc

SEQ ID NO: 3239981 - DNA, 16 bp, Homo sapiens
ggatctctcaggagca

SEQ ID NO: 3239982 - DNA, 22 bp, Homo sapiens
ggatcttgaatgtggtctcagg

SEQ ID NO: 3239983 - DNA, 13 bp, Homo sapiens
ggatcttgccaca

SEQ ID NO: 3239984 - DNA, 17 bp, Homo sapiens
ggatcttgccacatttc

SEQ ID NO: 3239985 - DNA, 18 bp, Homo sapiens
ggatcttgccacatttct

SEQ ID NO: 3239986 - DNA, 17 bp, Homo sapiens
ggatgaaattttctaga

SEQ ID NO: 3239987 - DNA, 21 bp, Homo sapiens
ggatgaattccaaattctgct

SEQ ID NO: 3239988 - DNA, 19 bp, Homo sapiens
ggatgactaacaagatttg

SEQ ID NO: 3239989 - DNA, 19 bp, Homo sapiens
ggatgagaaacagctcagc

SEQ ID NO: 3239990 - DNA, 22 bp, Homo sapiens
ggatgagaaaggttgaagcacc

SEQ ID NO: 3239991 - DNA, 16 bp, Homo sapiens
ggatgagagcccagag

SEQ ID NO: 3239992 - DNA, 19 bp, Homo sapiens
ggatgagagcccagaggta

SEQ ID NO: 3239993 - DNA, 15 bp, Homo sapiens
ggatgaggagacaga

SEQ ID NO: 3239994 - DNA, 19 bp, Homo sapiens
ggatgaggtcaccagggga

SEQ ID NO: 3239995 - DNA, 20 bp, Homo sapiens
ggatgaggtggtggagtgga

SEQ ID NO: 3239996 - DNA, 22 bp, Homo sapiens
ggatgaggttaggtcatgagga

SEQ ID NO: 3239997 - DNA, 18 bp, Homo sapiens
ggatgatttcatcttctg

SEQ ID NO: 3239998 - DNA, 15 bp, Homo sapiens
ggatgcaaggtagca

SEQ ID NO: 3239999 - DNA, 18 bp, Homo sapiens
ggatgcaaggtagcatgg

SEQ ID NO: 3240000 - DNA, 13 bp, Homo sapiens
ggatgcacatttc

SEQ ID NO: 3240001 - DNA, 15 bp, Homo sapiens
ggatgcacatttctg

SEQ ID NO: 3240002 - DNA, 17 bp, Homo sapiens
ggatgcacatttctgga

SEQ ID NO: 3240003 - DNA, 18 bp, Homo sapiens
ggatgcacatttctggat

SEQ ID NO: 3240004 - DNA, 17 bp, Homo sapiens
ggatgccaaggagcccc

SEQ ID NO: 3240005 - DNA, 19 bp, Homo sapiens
ggatgccactcctccctcc

SEQ ID NO: 3240006 - DNA, 14 bp, Homo sapiens
ggatgccagcccct

SEQ ID NO: 3240007 - DNA, 18 bp, Homo sapiens
ggatgccagcccctgcct

SEQ ID NO: 3240008 - DNA, 19 bp, Homo sapiens
ggatgccagcccctgcctg

SEQ ID NO: 3240009 - DNA, 13 bp, Homo sapiens
ggatgcctggtgg

SEQ ID NO: 3240010 - DNA, 20 bp, Homo sapiens
ggatgcctggtggcagctgc

SEQ ID NO: 3240011 - DNA, 17 bp, Homo sapiens
ggatgcgaggaccactt

SEQ ID NO: 3240012 - DNA, 20 bp, Homo sapiens
ggatgcggatcctgctgggg

SEQ ID NO: 3240013 - DNA, 17 bp, Homo sapiens
ggatgctagccccagag

SEQ ID NO: 3240014 - DNA, 12 bp, Homo sapiens
ggatgctgctcc

SEQ ID NO: 3240015 - DNA, 16 bp, Homo sapiens
ggatgctgctccgccc

SEQ ID NO: 3240016 - DNA, 13 bp, Homo sapiens
ggatgctgggctg

SEQ ID NO: 3240017 - DNA, 16 bp, Homo sapiens
ggatgctgggctgggc

SEQ ID NO: 3240018 - DNA, 22 bp, Homo sapiens
ggatggactcttctcggctcag

SEQ ID NO: 3240019 - DNA, 18 bp, Homo sapiens
ggatggagaaagaagtgg

SEQ ID NO: 3240020 - DNA, 16 bp, Homo sapiens
ggatggagaggcggcc

SEQ ID NO: 3240021 - DNA, 21 bp, Homo sapiens
ggatggaggggtggtcctgac

SEQ ID NO: 3240022 - DNA, 15 bp, Homo sapiens
ggatggccagtgtct

SEQ ID NO: 3240023 - DNA, 22 bp, Homo sapiens
ggatggccagtgtctgtcccgg

SEQ ID NO: 3240024 - DNA, 14 bp, Homo sapiens
ggatggccccagca

SEQ ID NO: 3240025 - DNA, 16 bp, Homo sapiens
ggatggccccagcaca

SEQ ID NO: 3240026 - DNA, 18 bp, Homo sapiens
ggatgggaacactggtgg

SEQ ID NO: 3240027 - DNA, 18 bp, Homo sapiens
ggatgggaatttgtcagc

SEQ ID NO: 3240028 - DNA, 16 bp, Homo sapiens
ggatgggagtgggcac

SEQ ID NO: 3240029 - DNA, 17 bp, Homo sapiens
ggatgggcattgggctg

SEQ ID NO: 3240030 - DNA, 17 bp, Homo sapiens
ggatgggccagggttta

SEQ ID NO: 3240031 - DNA, 19 bp, Homo sapiens
ggatggggagaatggtcaa

SEQ ID NO: 3240032 - DNA, 15 bp, Homo sapiens
ggatggggcacggac

SEQ ID NO: 3240033 - DNA, 14 bp, Homo sapiens
ggatggggctccca

SEQ ID NO: 3240034 - DNA, 21 bp, Homo sapiens
ggatgggggatgggccagggt

SEQ ID NO: 3240035 - DNA, 22 bp, Homo sapiens
ggatgggggctggcctctggct

SEQ ID NO: 3240036 - DNA, 14 bp, Homo sapiens
ggatggtccaggat

SEQ ID NO: 3240037 - DNA, 19 bp, Homo sapiens
ggatgtaattagctctggg

SEQ ID NO: 3240038 - DNA, 15 bp, Homo sapiens
ggatgtcacagggcc

SEQ ID NO: 3240039 - DNA, 14 bp, Homo sapiens
ggatgtccctgggc

SEQ ID NO: 3240040 - DNA, 19 bp, Homo sapiens
ggatgtccctgggccaggg

SEQ ID NO: 3240041 - DNA, 22 bp, Homo sapiens
ggatgtccctgggccagggtct

SEQ ID NO: 3240042 - DNA, 13 bp, Homo sapiens
ggatgtcttcctt

SEQ ID NO: 3240043 - DNA, 12 bp, Homo sapiens
ggatgtgagccc

SEQ ID NO: 3240044 - DNA, 15 bp, Homo sapiens
ggatgtgagccccag

SEQ ID NO: 3240045 - DNA, 18 bp, Homo sapiens
ggatgtgattgtggaatg

SEQ ID NO: 3240046 - DNA, 17 bp, Homo sapiens
ggatgtggaaagcactt

SEQ ID NO: 3240047 - DNA, 13 bp, Homo sapiens
ggatgtgtgcatg

SEQ ID NO: 3240048 - DNA, 15 bp, Homo sapiens
ggatgtgtgctttcc

SEQ ID NO: 3240049 - DNA, 20 bp, Homo sapiens
ggatgttcagcactgtccct

SEQ ID NO: 3240050 - DNA, 15 bp, Homo sapiens
ggatgttctgggaca

SEQ ID NO: 3240051 - DNA, 18 bp, Homo sapiens
ggattaaaacaatttttt

SEQ ID NO: 3240052 - DNA, 13 bp, Homo sapiens
ggattacagaaac

SEQ ID NO: 3240053 - DNA, 16 bp, Homo sapiens
ggattacagaaactga

SEQ ID NO: 3240054 - DNA, 17 bp, Homo sapiens
ggattacagaaactgat

SEQ ID NO: 3240055 - DNA, 19 bp, Homo sapiens
ggattattcatttaaaatg

SEQ ID NO: 3240056 - DNA, 17 bp, Homo sapiens
ggattatttaataacat

SEQ ID NO: 3240057 - DNA, 22 bp, Homo sapiens
ggattatttaataacattacct

SEQ ID NO: 3240058 - DNA, 19 bp, Homo sapiens
ggattcaggggctgggggt

SEQ ID NO: 3240059 - DNA, 21 bp, Homo sapiens
ggattcagtcataaagaggta

SEQ ID NO: 3240060 - DNA, 14 bp, Homo sapiens
ggattcctgaccca

SEQ ID NO: 3240061 - DNA, 15 bp, Homo sapiens
ggattctaaatacat

SEQ ID NO: 3240062 - DNA, 16 bp, Homo sapiens
ggattctctaaccttt

SEQ ID NO: 3240063 - DNA, 21 bp, Homo sapiens
ggattctgaggccctgcccaa

SEQ ID NO: 3240064 - DNA, 10 bp, Homo sapiens
ggattctggg

SEQ ID NO: 3240065 - DNA, 19 bp, Homo sapiens
ggattctgggaggaagcag

SEQ ID NO: 3240066 - DNA, 19 bp, Homo sapiens
ggattctggttccagggtc

SEQ ID NO: 3240067 - DNA, 14 bp, Homo sapiens
ggattgaagccctc

SEQ ID NO: 3240068 - DNA, 17 bp, Homo sapiens
ggattgaggggccctgg

SEQ ID NO: 3240069 - DNA, 14 bp, Homo sapiens
ggattgatcattct

SEQ ID NO: 3240070 - DNA, 20 bp, Homo sapiens
ggattgatcggagcctcctc

SEQ ID NO: 3240071 - DNA, 19 bp, Homo sapiens
ggattgcaatatctgaagc

SEQ ID NO: 3240072 - DNA, 22 bp, Homo sapiens
ggattgtaaaaaaaaatgcctt

SEQ ID NO: 3240073 - DNA, 12 bp, Homo sapiens
ggattgtggaaa

SEQ ID NO: 3240074 - DNA, 23 bp, Homo sapiens
ggattgtggttccatgcagcctt

SEQ ID NO: 3240075 - DNA, 20 bp, Homo sapiens
ggatttcatgatttcatttc

SEQ ID NO: 3240076 - DNA, 16 bp, Homo sapiens
ggatttgcatatttat

SEQ ID NO: 3240077 - DNA, 22 bp, Homo sapiens
ggatttgccccttcccatctct

SEQ ID NO: 3240078 - DNA, 21 bp, Homo sapiens
ggatttgtagcataactgtag

SEQ ID NO: 3240079 - DNA, 14 bp, Homo sapiens
ggattttaccaaag

SEQ ID NO: 3240080 - DNA, 17 bp, Homo sapiens
ggattttaccaaagcat

SEQ ID NO: 3240081 - DNA, 10 bp, Homo sapiens
ggattttcta

SEQ ID NO: 3240082 - DNA, 17 bp, Homo sapiens
ggcaaaaaagggacagc

SEQ ID NO: 3240083 - DNA, 10 bp, Homo sapiens
ggcaaacaat

SEQ ID NO: 3240084 - DNA, 22 bp, Homo sapiens
ggcaaagcacgaaatgttattt

SEQ ID NO: 3240085 - DNA, 22 bp, Homo sapiens
ggcaaagccacaaggctggcca

SEQ ID NO: 3240086 - DNA, 16 bp, Homo sapiens
ggcaaaggaaggtgga

SEQ ID NO: 3240087 - DNA, 13 bp, Homo sapiens
ggcaaatataaaa

SEQ ID NO: 3240088 - DNA, 19 bp, Homo sapiens
ggcaaatgacatgcactga

SEQ ID NO: 3240089 - DNA, 15 bp, Homo sapiens
ggcaaatggctgaga

SEQ ID NO: 3240090 - DNA, 13 bp, Homo sapiens
ggcaaattaaaca

SEQ ID NO: 3240091 - DNA, 15 bp, Homo sapiens
ggcaaattaactgta

SEQ ID NO: 3240092 - DNA, 16 bp, Homo sapiens
ggcaaattaactgtat

SEQ ID NO: 3240093 - DNA, 12 bp, Homo sapiens
ggcaacaggatt

SEQ ID NO: 3240094 - DNA, 18 bp, Homo sapiens
ggcaaccccagttctgct

SEQ ID NO: 3240095 - DNA, 20 bp, Homo sapiens
ggcaaccccagttctgctcc

SEQ ID NO: 3240096 - DNA, 22 bp, Homo sapiens
ggcaaccccagttctgctcctc

SEQ ID NO: 3240097 - DNA, 13 bp, Homo sapiens
ggccagcctagcc

SEQ ID NO: 3240098 - DNA, 17 bp, Homo sapiens
ggccagcctagcccttg

SEQ ID NO: 3240099 - DNA, 15 bp, Homo sapiens
ggccagcctcaccct

SEQ ID NO: 3240100 - DNA, 19 bp, Homo sapiens
ggccagcctggggcctggc

SEQ ID NO: 3240101 - DNA, 22 bp, Homo sapiens
ggccagcctggggcctggcagg

SEQ ID NO: 3240102 - DNA, 19 bp, Homo sapiens
ggccagcgggcacagggca

SEQ ID NO: 3240103 - DNA, 14 bp, Homo sapiens
ggccagcgtcccag

SEQ ID NO: 3240104 - DNA, 20 bp, Homo sapiens
ggccagctgccccagccaga

SEQ ID NO: 3240105 - DNA, 23 bp, Homo sapiens
ggccaggaccacacagtccccag

SEQ ID NO: 3240106 - DNA, 20 bp, Homo sapiens
ggccaggactgagccccgca

SEQ ID NO: 3240107 - DNA, 21 bp, Homo sapiens
ggccaggagcaggcacgggtg

SEQ ID NO: 3240108 - DNA, 15 bp, Homo sapiens
ggccaggagctcttc

SEQ ID NO: 3240109 - DNA, 16 bp, Homo sapiens
ggccaggcacagggcc

SEQ ID NO: 3240110 - DNA, 18 bp, Homo sapiens
ggccaggccaggaccaca

SEQ ID NO: 3240111 - DNA, 14 bp, Homo sapiens
ggccaggcccaggc

SEQ ID NO: 3240112 - DNA, 12 bp, Homo sapiens
ggccaggctggt

SEQ ID NO: 3240113 - DNA, 14 bp, Homo sapiens
ggccaggctggtct

SEQ ID NO: 3240114 - DNA, 19 bp, Homo sapiens
ggccaggctggtctaaaac

SEQ ID NO: 3240115 - DNA, 18 bp, Homo sapiens
ggccaggctggtctcaaa

SEQ ID NO: 3240116 - DNA, 18 bp, Homo sapiens
ggccagggaaagcccgtg

SEQ ID NO: 3240117 - DNA, 22 bp, Homo sapiens
ggccagggatctctctacaaga

SEQ ID NO: 3240118 - DNA, 11 bp, Homo sapiens
ggccagggcag

SEQ ID NO: 3240119 - DNA, 15 bp, Homo sapiens
ggccagggcagggcc

SEQ ID NO: 3240120 - DNA, 17 bp, Homo sapiens
ggccagggcagggccac

SEQ ID NO: 3240121 - DNA, 19 bp, Homo sapiens
ggccagggcatgtgtatgt

SEQ ID NO: 3240122 - DNA, 17 bp, Homo sapiens
ggccagggccctgcaga

SEQ ID NO: 3240123 - DNA, 18 bp, Homo sapiens
ggccagggccctgcagag

SEQ ID NO: 3240124 - DNA, 17 bp, Homo sapiens
ggccagggctgccctga

SEQ ID NO: 3240125 - DNA, 19 bp, Homo sapiens
ggccagggctgccctgaga

SEQ ID NO: 3240126 - DNA, 17 bp, Homo sapiens
ggccagggtctgtgtga

SEQ ID NO: 3240127 - DNA, 14 bp, Homo sapiens
ggccaggtgcagtg

SEQ ID NO: 3240128 - DNA, 19 bp, Homo sapiens
ggccaggtggccactccag

SEQ ID NO: 3240129 - DNA, 18 bp, Homo sapiens
ggccagtacctttccatt

SEQ ID NO: 3240130 - DNA, 15 bp, Homo sapiens
ggccagtccaggctg

SEQ ID NO: 3240131 - DNA, 16 bp, Homo sapiens
ggccagtcctgcctgg

SEQ ID NO: 3240132 - DNA, 19 bp, Homo sapiens
ggccagtcctgcctggcca

SEQ ID NO: 3240133 - DNA, 15 bp, Homo sapiens
ggccagtctgggctg

SEQ ID NO: 3240134 - DNA, 16 bp, Homo sapiens
ggccagtctgggctgc

SEQ ID NO: 3240135 - DNA, 17 bp, Homo sapiens
ggccagtgggcgggcca

SEQ ID NO: 3240136 - DNA, 18 bp, Homo sapiens
ggccagtggggcctgtgg

SEQ ID NO: 3240137 - DNA, 21 bp, Homo sapiens
ggccagtgtcattttattttt

SEQ ID NO: 3240138 - DNA, 23 bp, Homo sapiens
ggccagtgtctgtcccggggtcc

SEQ ID NO: 3240139 - DNA, 20 bp, Homo sapiens
ggccagtgtgacaaggattg

SEQ ID NO: 3240140 - DNA, 17 bp, Homo sapiens
ggccagttgcccagagc

SEQ ID NO: 3240141 - DNA, 18 bp, Homo sapiens
ggccagttgcccagagca

SEQ ID NO: 3240142 - DNA, 19 bp, Homo sapiens
ggccagttgcccagagcac

SEQ ID NO: 3240143 - DNA, 18 bp, Homo sapiens
ggccataaacggttcctg

SEQ ID NO: 3240144 - DNA, 16 bp, Homo sapiens
ggccataggagaggag

SEQ ID NO: 3240145 - DNA, 20 bp, Homo sapiens
ggccatcacaggatgccagc

SEQ ID NO: 3240146 - DNA, 21 bp, Homo sapiens
ggccatcacaggatgccagcc

SEQ ID NO: 3240147 - DNA, 20 bp, Homo sapiens
ggccatccctgggcccctcc

SEQ ID NO: 3240148 - DNA, 14 bp, Homo sapiens
ggccatccctgtga

SEQ ID NO: 3240149 - DNA, 15 bp, Homo sapiens
ggccatctcaggaga

SEQ ID NO: 3240150 - DNA, 17 bp, Homo sapiens
ggccatctcaggagatg

SEQ ID NO: 3240151 - DNA, 18 bp, Homo sapiens
ggccatctccctccccag

SEQ ID NO: 3240152 - DNA, 21 bp, Homo sapiens
ggccatctgactgccaagcca

SEQ ID NO: 3240153 - DNA, 14 bp, Homo sapiens
ggccatgctgaggc

SEQ ID NO: 3240154 - DNA, 19 bp, Homo sapiens
ggccatgctgaggcctggg

SEQ ID NO: 3240155 - DNA, 22 bp, Homo sapiens
ggccatgctgaggcctgggccg

SEQ ID NO: 3240156 - DNA, 21 bp, Homo sapiens
ggccatgtgagccaccgctgc

SEQ ID NO: 3240157 - DNA, 20 bp, Homo sapiens
ggccattctgccgccccctc

SEQ ID NO: 3240158 - DNA, 15 bp, Homo sapiens
ggcccaaatgatgga

SEQ ID NO: 3240159 - DNA, 19 bp, Homo sapiens
ggcccaagagatgaagagt

SEQ ID NO: 3240160 - DNA, 15 bp, Homo sapiens
ggcccaagccccatc

SEQ ID NO: 3240161 - DNA, 16 bp, Homo sapiens
ggcccaagccccatct

SEQ ID NO: 3240162 - DNA, 21 bp, Homo sapiens
ggcccaaggtcccctccacat

SEQ ID NO: 3240163 - DNA, 22 bp, Homo sapiens
ggcccaagtccctgttttctga

SEQ ID NO: 3240164 - DNA, 15 bp, Homo sapiens
ggcccaccagggtcc

SEQ ID NO: 3240165 - DNA, 18 bp, Homo sapiens
ggcccacctggccacctg

SEQ ID NO: 3240166 - DNA, 18 bp, Homo sapiens
ggcccacgtgtatagtat

SEQ ID NO: 3240167 - DNA, 22 bp, Homo sapiens
ggcccacgtgtatagtatctgt

SEQ ID NO: 3240168 - DNA, 16 bp, Homo sapiens
ggcccagagcaggaag

SEQ ID NO: 3240169 - DNA, 18 bp, Homo sapiens
ggcccagagcgaggaaag

SEQ ID NO: 3240170 - DNA, 17 bp, Homo sapiens
ggcccagcattgctggt

SEQ ID NO: 3240171 - DNA, 14 bp, Homo sapiens
ggcccagccaggag

SEQ ID NO: 3240172 - DNA, 13 bp, Homo sapiens
ggcccagccccta

SEQ ID NO: 3240173 - DNA, 19 bp, Homo sapiens
ggcccagccggcctctctg

SEQ ID NO: 3240174 - DNA, 20 bp, Homo sapiens
ggcccagccggcctctctgg

SEQ ID NO: 3240175 - DNA, 13 bp, Homo sapiens
ggcccagccttgt

SEQ ID NO: 3240176 - DNA, 16 bp, Homo sapiens
ggcccagcgcggccag

SEQ ID NO: 3240177 - DNA, 17 bp, Homo sapiens
ggcccagcgcggccagc

SEQ ID NO: 3240178 - DNA, 15 bp, Homo sapiens
ggcccagcgggcaga

SEQ ID NO: 3240179 - DNA, 16 bp, Homo sapiens
ggcccagcgggcagat

SEQ ID NO: 3240180 - DNA, 18 bp, Homo sapiens
ggcccagctgtagccatg

SEQ ID NO: 3240181 - DNA, 10 bp, Homo sapiens
ggcccaggaa

SEQ ID NO: 3240182 - DNA, 15 bp, Homo sapiens
ggcccaggaccagct

SEQ ID NO: 3240183 - DNA, 15 bp, Homo sapiens
ggcccaggcaggcca

SEQ ID NO: 3240184 - DNA, 18 bp, Homo sapiens
ggcccaggcctacctcac

SEQ ID NO: 3240185 - DNA, 16 bp, Homo sapiens
ggcccaggcctgggtt

SEQ ID NO: 3240186 - DNA, 19 bp, Homo sapiens
ggcccagtgccactgcccc

SEQ ID NO: 3240187 - DNA, 19 bp, Homo sapiens
ggcccatagaaacatgaca

SEQ ID NO: 3240188 - DNA, 23 bp, Homo sapiens
ggcccatagaaacatgacactga

SEQ ID NO: 3240189 - DNA, 14 bp, Homo sapiens
ggcccatctcagcc

SEQ ID NO: 3240190 - DNA, 20 bp, Homo sapiens
ggcccatctcaggtgccact

SEQ ID NO: 3240191 - DNA, 21 bp, Homo sapiens
ggcccatctcaggtgccactc

SEQ ID NO: 3240192 - DNA, 13 bp, Homo sapiens
ggccccacatggg

SEQ ID NO: 3240193 - DNA, 16 bp, Homo sapiens
ggccccacatgggaac

SEQ ID NO: 3240194 - DNA, 12 bp, Homo sapiens
ggccccagaggc

SEQ ID NO: 3240195 - DNA, 14 bp, Homo sapiens
ggccccagaggccc

SEQ ID NO: 3240196 - DNA, 13 bp, Homo sapiens
ggccccagatctg

SEQ ID NO: 3240197 - DNA, 15 bp, Homo sapiens
ggccccagatctgcc

SEQ ID NO: 3240198 - DNA, 18 bp, Homo sapiens
ggccccagatctgcctgg

SEQ ID NO: 3240199 - DNA, 20 bp, Homo sapiens
ggccccagatctgcctgggc

SEQ ID NO: 3240200 - DNA, 23 bp, Homo sapiens
ggccccagatctgcctgggcctg

SEQ ID NO: 3240201 - DNA, 15 bp, Homo sapiens
ggccccagcacagct

SEQ ID NO: 3240202 - DNA, 21 bp, Homo sapiens
ggccccagccctgctggggat

SEQ ID NO: 3240203 - DNA, 22 bp, Homo sapiens
ggccccagccctgctggggatc

SEQ ID NO: 3240204 - DNA, 18 bp, Homo sapiens
ggccccaggaaaggccca

SEQ ID NO: 3240205 - DNA, 13 bp, Homo sapiens
ggccccaggaggg

SEQ ID NO: 3240206 - DNA, 23 bp, Homo sapiens
ggccccaggaggggaactgagtc

SEQ ID NO: 3240207 - DNA, 16 bp, Homo sapiens
ggccccagggcaccct

SEQ ID NO: 3240208 - DNA, 17 bp, Homo sapiens
ggccccagggctaccct

SEQ ID NO: 3240209 - DNA, 12 bp, Homo sapiens
ggccccatccca

SEQ ID NO: 3240210 - DNA, 13 bp, Homo sapiens
ggccccatcccag

SEQ ID NO: 3240211 - DNA, 20 bp, Homo sapiens
ggccccatcctcatccctga

SEQ ID NO: 3240212 - DNA, 12 bp, Homo sapiens
ggccccatgctc

SEQ ID NO: 3240213 - DNA, 16 bp, Homo sapiens
ggccccatgctctgcc

SEQ ID NO: 3240214 - DNA, 16 bp, Homo sapiens
ggcccccaacctcagg

SEQ ID NO: 3240215 - DNA, 21 bp, Homo sapiens
ggcccccaacctcagggctcc

SEQ ID NO: 3240216 - DNA, 14 bp, Homo sapiens
ggcccccaataaag

SEQ ID NO: 3240217 - DNA, 16 bp, Homo sapiens
ggcccccaataaaggc

SEQ ID NO: 3240218 - DNA, 23 bp, Homo sapiens
ggcccccaataaaggcagctgcc

SEQ ID NO: 3240219 - DNA, 18 bp, Homo sapiens
ggcccccacttgcctctt

SEQ ID NO: 3240220 - DNA, 23 bp, Homo sapiens
ggcccccagcccagggctcctgc

SEQ ID NO: 3240221 - DNA, 17 bp, Homo sapiens
ggcccccaggggcagga

SEQ ID NO: 3240222 - DNA, 19 bp, Homo sapiens
ggccccccaaatcccaggg

SEQ ID NO: 3240223 - DNA, 15 bp, Homo sapiens
ggctccgaacaccct

SEQ ID NO: 3240224 - DNA, 22 bp, Homo sapiens
ggctccgcccttagtcccccaa

SEQ ID NO: 3240225 - DNA, 20 bp, Homo sapiens
ggctcctatctgtgttttga

SEQ ID NO: 3240226 - DNA, 14 bp, Homo sapiens
ggctcctcacatag

SEQ ID NO: 3240227 - DNA, 12 bp, Homo sapiens
ggctcctcccag

SEQ ID NO: 3240228 - DNA, 13 bp, Homo sapiens
ggctcctcccagc

SEQ ID NO: 3240229 - DNA, 9 bp, Homo sapiens
ggctcctgc

SEQ ID NO: 3240230 - DNA, 12 bp, Homo sapiens
ggctcctggctg

SEQ ID NO: 3240231 - DNA, 14 bp, Homo sapiens
ggctcctggctgcc

SEQ ID NO: 3240232 - DNA, 17 bp, Homo sapiens
ggctcctggctgccagg

SEQ ID NO: 3240233 - DNA, 19 bp, Homo sapiens
ggctcctggctgccaggcg

SEQ ID NO: 3240234 - DNA, 14 bp, Homo sapiens
ggctcctgttttgc

SEQ ID NO: 3240235 - DNA, 19 bp, Homo sapiens
ggctcgaatctctgtgcct

SEQ ID NO: 3240236 - DNA, 20 bp, Homo sapiens
ggctcgaatctctgtgcctt

SEQ ID NO: 3240237 - DNA, 22 bp, Homo sapiens
ggctcgctccctgtagctctgc

SEQ ID NO: 3240238 - DNA, 23 bp, Homo sapiens
ggctctatgagtctagatgttta

SEQ ID NO: 3240239 - DNA, 19 bp, Homo sapiens
ggctctcagctcagcgcca

SEQ ID NO: 3240240 - DNA, 22 bp, Homo sapiens
ggctctccaaaggggctgctgg

SEQ ID NO: 3240241 - DNA, 19 bp, Homo sapiens
ggctctccaagtgccagag

SEQ ID NO: 3240242 - DNA, 20 bp, Homo sapiens
ggctctcctcagaagaaaga

SEQ ID NO: 3240243 - DNA, 14 bp, Homo sapiens
ggctctcggaaatg

SEQ ID NO: 3240244 - DNA, 12 bp, Homo sapiens
ggctctctccag

SEQ ID NO: 3240245 - DNA, 14 bp, Homo sapiens
ggctctctccagga

SEQ ID NO: 3240246 - DNA, 10 bp, Homo sapiens
ggctctgaga

SEQ ID NO: 3240247 - DNA, 15 bp, Homo sapiens
ggctctgagagtcta

SEQ ID NO: 3240248 - DNA, 17 bp, Homo sapiens
ggctctgaggtgcctgt

SEQ ID NO: 3240249 - DNA, 19 bp, Homo sapiens
ggctctgaggtgcctgtcc

SEQ ID NO: 3240250 - DNA, 23 bp, Homo sapiens
ggctctgaggtgcctgtcccacc

SEQ ID NO: 3240251 - DNA, 12 bp, Homo sapiens
ggctctgcacag

SEQ ID NO: 3240252 - DNA, 12 bp, Homo sapiens
ggctctgccagt

SEQ ID NO: 3240253 - DNA, 15 bp, Homo sapiens
ggctctgccagtgga

SEQ ID NO: 3240254 - DNA, 22 bp, Homo sapiens
ggctctgccagtggatcccctg

SEQ ID NO: 3240255 - DNA, 13 bp, Homo sapiens
ggctctgccccag

SEQ ID NO: 3240256 - DNA, 21 bp, Homo sapiens
ggctctgccccagtcgttaga

SEQ ID NO: 3240257 - DNA, 15 bp, Homo sapiens
ggctctgctggtgga

SEQ ID NO: 3240258 - DNA, 14 bp, Homo sapiens
ggctctggagagaa

SEQ ID NO: 3240259 - DNA, 12 bp, Homo sapiens
ggctctggccct

SEQ ID NO: 3240260 - DNA, 16 bp, Homo sapiens
ggctctggcccttgcc

SEQ ID NO: 3240261 - DNA, 12 bp, Homo sapiens
ggctctgggctc

SEQ ID NO: 3240262 - DNA, 15 bp, Homo sapiens
ggctctgggctcagg

SEQ ID NO: 3240263 - DNA, 16 bp, Homo sapiens
ggctctgggctcaggg

SEQ ID NO: 3240264 - DNA, 15 bp, Homo sapiens
ggctctgtccccctg

SEQ ID NO: 3240265 - DNA, 20 bp, Homo sapiens
ggctctgtgaaaacatattt

SEQ ID NO: 3240266 - DNA, 17 bp, Homo sapiens
ggctctgtggaggggcc

SEQ ID NO: 3240267 - DNA, 18 bp, Homo sapiens
ggctctgtggcttgctag

SEQ ID NO: 3240268 - DNA, 22 bp, Homo sapiens
ggctcttaagcagcatggaaaa

SEQ ID NO: 3240269 - DNA, 11 bp, Homo sapiens
ggctcttccaa

SEQ ID NO: 3240270 - DNA, 12 bp, Homo sapiens
ggctcttctcct

SEQ ID NO: 3240271 - DNA, 13 bp, Homo sapiens
ggctcttctcctt

SEQ ID NO: 3240272 - DNA, 16 bp, Homo sapiens
ggctcttctcctttca

SEQ ID NO: 3240273 - DNA, 15 bp, Homo sapiens
ggctcttgactactt

SEQ ID NO: 3240274 - DNA, 21 bp, Homo sapiens
ggctcttgatacccccctctg

SEQ ID NO: 3240275 - DNA, 20 bp, Homo sapiens
ggctcttgtgctggatggag

SEQ ID NO: 3240276 - DNA, 15 bp, Homo sapiens
ggctctttcagagag

SEQ ID NO: 3240277 - DNA, 13 bp, Homo sapiens
ggctctttccttg

SEQ ID NO: 3240278 - DNA, 14 bp, Homo sapiens
ggctctttccttgc

SEQ ID NO: 3240279 - DNA, 17 bp, Homo sapiens
ggctctttccttgctca

SEQ ID NO: 3240280 - DNA, 16 bp, Homo sapiens
ggctctttctctctgc

SEQ ID NO: 3240281 - DNA, 18 bp, Homo sapiens
ggctctttctctctgctg

SEQ ID NO: 3240282 - DNA, 23 bp, Homo sapiens
ggctctttctctctgctgagctg

SEQ ID NO: 3240283 - DNA, 15 bp, Homo sapiens
ggctctttgggctgg

SEQ ID NO: 3240284 - DNA, 20 bp, Homo sapiens
ggctgaaaatgcaaagctga

SEQ ID NO: 3240285 - DNA, 24 bp, Homo sapiens
ggctgaaagaacatggacttgtat

SEQ ID NO: 3240286 - DNA, 21 bp, Homo sapiens
ggctgaaattctcctggaggt

SEQ ID NO: 3240287 - DNA, 13 bp, Homo sapiens
ggctgaagagagg

SEQ ID NO: 3240288 - DNA, 23 bp, Homo sapiens
ggctgacacctaccatgctgctt

SEQ ID NO: 3240289 - DNA, 15 bp, Homo sapiens
ggctgaccatgctca

SEQ ID NO: 3240290 - DNA, 23 bp, Homo sapiens
ggctgacctgcctctcacacaca

SEQ ID NO: 3240291 - DNA, 12 bp, Homo sapiens
ggctgactggcc

SEQ ID NO: 3240292 - DNA, 14 bp, Homo sapiens
ggctgactggggct

SEQ ID NO: 3240293 - DNA, 15 bp, Homo sapiens
ggctgagatatgaac

SEQ ID NO: 3240294 - DNA, 15 bp, Homo sapiens
ggctgagccctggca

SEQ ID NO: 3240295 - DNA, 20 bp, Homo sapiens
ggctgagctctctgtgggct

SEQ ID NO: 3240296 - DNA, 16 bp, Homo sapiens
ggctgaggggcttggg

SEQ ID NO: 3240297 - DNA, 20 bp, Homo sapiens
ggctgagtggaatgcaggga

SEQ ID NO: 3240298 - DNA, 21 bp, Homo sapiens
ggctgagttctggtcaaagaa

SEQ ID NO: 3240299 - DNA, 16 bp, Homo sapiens
ggctgatggaggaaaa

SEQ ID NO: 3240300 - DNA, 16 bp, Homo sapiens
ggctgatggctgcccc

SEQ ID NO: 3240301 - DNA, 20 bp, Homo sapiens
ggctgatttacatgtatggt

SEQ ID NO: 3240302 - DNA, 19 bp, Homo sapiens
ggctgcagaggccagaggc

SEQ ID NO: 3240303 - DNA, 22 bp, Homo sapiens
ggctgcagtgacgtgcacctgt

SEQ ID NO: 3240304 - DNA, 10 bp, Homo sapiens
ggctgccagg

SEQ ID NO: 3240305 - DNA, 18 bp, Homo sapiens
ggctgccatgtgaagagg

SEQ ID NO: 3240306 - DNA, 21 bp, Homo sapiens
ggctgcccagccccgctcagg

SEQ ID NO: 3240307 - DNA, 13 bp, Homo sapiens
ggctgcccaggag

SEQ ID NO: 3240308 - DNA, 14 bp, Homo sapiens
ggctgcccaggaga

SEQ ID NO: 3240309 - DNA, 23 bp, Homo sapiens
ggctgcccaggagacagaccact

SEQ ID NO: 3240310 - DNA, 21 bp, Homo sapiens
ggctgcccccaacactccagg

SEQ ID NO: 3240311 - DNA, 22 bp, Homo sapiens
ggctgcccccaacactccaggc

SEQ ID NO: 3240312 - DNA, 18 bp, Homo sapiens
ggctgccctgagaagctg

SEQ ID NO: 3240313 - DNA, 12 bp, Homo sapiens
ggctgccctgcc

SEQ ID NO: 3240314 - DNA, 15 bp, Homo sapiens
ggctgccctggccct

SEQ ID NO: 3240315 - DNA, 19 bp, Homo sapiens
ggctgccctggccctgagg

SEQ ID NO: 3240316 - DNA, 21 bp, Homo sapiens
ggctgccctggccctgaggtg

SEQ ID NO: 3240317 - DNA, 15 bp, Homo sapiens
ggctgccctggtgct

SEQ ID NO: 3240318 - DNA, 23 bp, Homo sapiens
ggctgccgtggggccgccgcctc

SEQ ID NO: 3240319 - DNA, 10 bp, Homo sapiens
ggctgcctgc

SEQ ID NO: 3240320 - DNA, 16 bp, Homo sapiens
ggctgcctgccgccca

SEQ ID NO: 3240321 - DNA, 21 bp, Homo sapiens
ggctgcgggaggccctggccc

SEQ ID NO: 3240322 - DNA, 11 bp, Homo sapiens
ggctgctcccc

SEQ ID NO: 3240323 - DNA, 16 bp, Homo sapiens
ggctgctcgcccagga

SEQ ID NO: 3240324 - DNA, 17 bp, Homo sapiens
ggctgctcgcccaggaa

SEQ ID NO: 3240325 - DNA, 20 bp, Homo sapiens
ggctgctcgcccaggaaggc

SEQ ID NO: 3240326 - DNA, 21 bp, Homo sapiens
ggctgctcgcccaggaaggcc

SEQ ID NO: 3240327 - DNA, 23 bp, Homo sapiens
ggctgctgaaaaccatctggcct

SEQ ID NO: 3240328 - DNA, 15 bp, Homo sapiens
ggctgctgcaggccg

SEQ ID NO: 3240329 - DNA, 18 bp, Homo sapiens
ggctgctgcccccacccc

SEQ ID NO: 3240330 - DNA, 24 bp, Homo sapiens
ggctgctggggcatgtgtgcctgt

SEQ ID NO: 3240331 - DNA, 21 bp, Homo sapiens
ggctgctggggcctcagacga

SEQ ID NO: 3240332 - DNA, 15 bp, Homo sapiens
ggctgcttcctcctg

SEQ ID NO: 3240333 - DNA, 22 bp, Homo sapiens
ggctggaagatcctgcgggtgg

SEQ ID NO: 3240334 - DNA, 16 bp, Homo sapiens
ggctggaaggggtcca

SEQ ID NO: 3240335 - DNA, 22 bp, Homo sapiens
ggctggacctatgtcctaagga

SEQ ID NO: 3240336 - DNA, 20 bp, Homo sapiens
ggctggacttctacctgccc

SEQ ID NO: 3240337 - DNA, 13 bp, Homo sapiens
ggctggagaaaga

SEQ ID NO: 3240338 - DNA, 23 bp, Homo sapiens
ggctggagaaagagctgcctgga

SEQ ID NO: 3240339 - DNA, 19 bp, Homo sapiens
ggctggagaccatgcagag

SEQ ID NO: 3240340 - DNA, 13 bp, Homo sapiens
ggctggaggccca

SEQ ID NO: 3240341 - DNA, 20 bp, Homo sapiens
ggctggagtgcagtggtgca

SEQ ID NO: 3240342 - DNA, 14 bp, Homo sapiens
ggctggagtgcgct

SEQ ID NO: 3240343 - DNA, 16 bp, Homo sapiens
ggctggagtgcgctct

SEQ ID NO: 3240344 - DNA, 14 bp, Homo sapiens
ggctggcaagcagg

SEQ ID NO: 3240345 - DNA, 14 bp, Homo sapiens
ggctggcagctctc

SEQ ID NO: 3240346 - DNA, 14 bp, Homo sapiens
ggctggcaggtatg

SEQ ID NO: 3240347 - DNA, 17 bp, Homo sapiens
ggctggccactgcacag

SEQ ID NO: 3240348 - DNA, 19 bp, Homo sapiens
ggctggccactgcacagag

SEQ ID NO: 3240349 - DNA, 15 bp, Homo sapiens
gggcctcagtgccac

SEQ ID NO: 3240350 - DNA, 16 bp, Homo sapiens
gggcctcatcacagca

SEQ ID NO: 3240351 - DNA, 16 bp, Homo sapiens
gggcctcccaccagag

SEQ ID NO: 3240352 - DNA, 16 bp, Homo sapiens
gggcctccctccttgg

SEQ ID NO: 3240353 - DNA, 13 bp, Homo sapiens
gggcctgcccctg

SEQ ID NO: 3240354 - DNA, 13 bp, Homo sapiens
gggcctgcctggc

SEQ ID NO: 3240355 - DNA, 22 bp, Homo sapiens
gggcctggcagccgtgccttca

SEQ ID NO: 3240356 - DNA, 20 bp, Homo sapiens
gggcctggcaggccagtgtc

SEQ ID NO: 3240357 - DNA, 13 bp, Homo sapiens
gggcctggcaggg

SEQ ID NO: 3240358 - DNA, 15 bp, Homo sapiens
gggcctggcctgagc

SEQ ID NO: 3240359 - DNA, 22 bp, Homo sapiens
gggcctggcctgagctggggcc

SEQ ID NO: 3240360 - DNA, 20 bp, Homo sapiens
gggcctggcgggatgggcca

SEQ ID NO: 3240361 - DNA, 19 bp, Homo sapiens
gggcctggcttgctccagg

SEQ ID NO: 3240362 - DNA, 20 bp, Homo sapiens
gggcctggcttgctccaggg

SEQ ID NO: 3240363 - DNA, 23 bp, Homo sapiens
gggcctggcttgctccagggtct

SEQ ID NO: 3240364 - DNA, 12 bp, Homo sapiens
gggcctgggagg

SEQ ID NO: 3240365 - DNA, 12 bp, Homo sapiens
gggcctgggcct

SEQ ID NO: 3240366 - DNA, 14 bp, Homo sapiens
gggcctgggcctct

SEQ ID NO: 3240367 - DNA, 18 bp, Homo sapiens
gggcctggggcctgagag

SEQ ID NO: 3240368 - DNA, 15 bp, Homo sapiens
gggcctggggtgcat

SEQ ID NO: 3240369 - DNA, 16 bp, Homo sapiens
gggcctgtcgtgccag

SEQ ID NO: 3240370 - DNA, 18 bp, Homo sapiens
gggccttagtgggccagg

SEQ ID NO: 3240371 - DNA, 22 bp, Homo sapiens
gggccttagtgggccagggctg

SEQ ID NO: 3240372 - DNA, 16 bp, Homo sapiens
gggccttttggatatg

SEQ ID NO: 3240373 - DNA, 20 bp, Homo sapiens
gggcgagactctgtctcaaa

SEQ ID NO: 3240374 - DNA, 13 bp, Homo sapiens
gggcgcccacctc

SEQ ID NO: 3240375 - DNA, 21 bp, Homo sapiens
gggcgcccacctccccacgcc

SEQ ID NO: 3240376 - DNA, 13 bp, Homo sapiens
gggcgccctctct

SEQ ID NO: 3240377 - DNA, 13 bp, Homo sapiens
gggcgcctagagc

SEQ ID NO: 3240378 - DNA, 18 bp, Homo sapiens
gggcgcctagagcgcggc

SEQ ID NO: 3240379 - DNA, 15 bp, Homo sapiens
gggcgcctggagagc

SEQ ID NO: 3240380 - DNA, 18 bp, Homo sapiens
gggcgcctggagagcgag

SEQ ID NO: 3240381 - DNA, 18 bp, Homo sapiens
gggcgcgatcccacacag

SEQ ID NO: 3240382 - DNA, 16 bp, Homo sapiens
gggcgcggtggctcac

SEQ ID NO: 3240383 - DNA, 18 bp, Homo sapiens
gggcgctcagacggcggc

SEQ ID NO: 3240384 - DNA, 23 bp, Homo sapiens
gggcgctcagacggcggccaggc

SEQ ID NO: 3240385 - DNA, 20 bp, Homo sapiens
gggcgctcaggacccaggcc

SEQ ID NO: 3240386 - DNA, 21 bp, Homo sapiens
gggcgctcaggacccaggccc

SEQ ID NO: 3240387 - DNA, 23 bp, Homo sapiens
gggcgctggacactctctgccct

SEQ ID NO: 3240388 - DNA, 15 bp, Homo sapiens
gggcgctggcccagc

SEQ ID NO: 3240389 - DNA, 21 bp, Homo sapiens
gggcggcaggggcctggagat

SEQ ID NO: 3240390 - DNA, 19 bp, Homo sapiens
gggcgggccatgagggaca

SEQ ID NO: 3240391 - DNA, 13 bp, Homo sapiens
gggcggggcccag

SEQ ID NO: 3240392 - DNA, 22 bp, Homo sapiens
gggcgggtacagcgcggaggag

SEQ ID NO: 3240393 - DNA, 14 bp, Homo sapiens
gggcgtgaggtccc

SEQ ID NO: 3240394 - DNA, 16 bp, Homo sapiens
gggcgttatttatgga

SEQ ID NO: 3240395 - DNA, 21 bp, Homo sapiens
gggcgttatttatggaccact

SEQ ID NO: 3240396 - DNA, 18 bp, Homo sapiens
gggctaacgggaggctgg

SEQ ID NO: 3240397 - DNA, 13 bp, Homo sapiens
gggctacaagagg

SEQ ID NO: 3240398 - DNA, 14 bp, Homo sapiens
gggctactggcagc

SEQ ID NO: 3240399 - DNA, 19 bp, Homo sapiens
gggctactggcagctcctc

SEQ ID NO: 3240400 - DNA, 16 bp, Homo sapiens
gggctatttctctccc

SEQ ID NO: 3240401 - DNA, 12 bp, Homo sapiens
gggctatttgtg

SEQ ID NO: 3240402 - DNA, 16 bp, Homo sapiens
gggctcacaggcctct

SEQ ID NO: 3240403 - DNA, 20 bp, Homo sapiens
gggctcacggggcctccaac

SEQ ID NO: 3240404 - DNA, 19 bp, Homo sapiens
gggctcagcggggacagct

SEQ ID NO: 3240405 - DNA, 17 bp, Homo sapiens
gggctcagggagggagg

SEQ ID NO: 3240406 - DNA, 22 bp, Homo sapiens
gggctcaggtcacataaaactt

SEQ ID NO: 3240407 - DNA, 23 bp, Homo sapiens
gggctccagcaccttctttctgg

SEQ ID NO: 3240408 - DNA, 13 bp, Homo sapiens
gggctccagcatc

SEQ ID NO: 3240409 - DNA, 17 bp, Homo sapiens
gggctccagcatccagc

SEQ ID NO: 3240410 - DNA, 19 bp, Homo sapiens
gggctccatgcctctggag

SEQ ID NO: 3240411 - DNA, 13 bp, Homo sapiens
gggctcccagggg

SEQ ID NO: 3240412 - DNA, 22 bp, Homo sapiens
gggctcccaggggtctccctgg

SEQ ID NO: 3240413 - DNA, 19 bp, Homo sapiens
gggctccctctctggtttc

SEQ ID NO: 3240414 - DNA, 16 bp, Homo sapiens
gggctccctggcagga

SEQ ID NO: 3240415 - DNA, 11 bp, Homo sapiens
gggctcctgca

SEQ ID NO: 3240416 - DNA, 18 bp, Homo sapiens
gggctcctggctgccagg

SEQ ID NO: 3240417 - DNA, 22 bp, Homo sapiens
gggctcctggtggccttctgct

SEQ ID NO: 3240418 - DNA, 18 bp, Homo sapiens
gggctcctttctccagcc

SEQ ID NO: 3240419 - DNA, 21 bp, Homo sapiens
gggctcctttctccagccagc

SEQ ID NO: 3240420 - DNA, 22 bp, Homo sapiens
gggctcctttctccagccagca

SEQ ID NO: 3240421 - DNA, 20 bp, Homo sapiens
gggctcgccatgccgggggt

SEQ ID NO: 3240422 - DNA, 22 bp, Homo sapiens
gggctctccaaaggggctgctg

SEQ ID NO: 3240423 - DNA, 19 bp, Homo sapiens
gggctctctgctgtacata

SEQ ID NO: 3240424 - DNA, 12 bp, Homo sapiens
gggctctgcccc

SEQ ID NO: 3240425 - DNA, 13 bp, Homo sapiens
gggctctgcccca

SEQ ID NO: 3240426 - DNA, 19 bp, Homo sapiens
gggctctgccccagctctg

SEQ ID NO: 3240427 - DNA, 16 bp, Homo sapiens
gggctctgccctccct

SEQ ID NO: 3240428 - DNA, 16 bp, Homo sapiens
gggctctgtgcagtca

SEQ ID NO: 3240429 - DNA, 16 bp, Homo sapiens
gggctgacccagcatc

SEQ ID NO: 3240430 - DNA, 16 bp, Homo sapiens
gggctgagccctggca

SEQ ID NO: 3240431 - DNA, 17 bp, Homo sapiens
gggctgagccctggcag

SEQ ID NO: 3240432 - DNA, 23 bp, Homo sapiens
gggctgagctggggacctggtac

SEQ ID NO: 3240433 - DNA, 23 bp, Homo sapiens
gggctgagtgagttcaactacat

SEQ ID NO: 3240434 - DNA, 16 bp, Homo sapiens
gggctgatttacatgt

SEQ ID NO: 3240435 - DNA, 11 bp, Homo sapiens
gggctgcagca

SEQ ID NO: 3240436 - DNA, 19 bp, Homo sapiens
gggctgcagcatgttgctg

SEQ ID NO: 3240437 - DNA, 13 bp, Homo sapiens
gggctgccctgag

SEQ ID NO: 3240438 - DNA, 16 bp, Homo sapiens
gggctgccctgagaag

SEQ ID NO: 3240439 - DNA, 13 bp, Homo sapiens
gggctgcctgggc

SEQ ID NO: 3240440 - DNA, 14 bp, Homo sapiens
gggctgctggggca

SEQ ID NO: 3240441 - DNA, 20 bp, Homo sapiens
gggctgcttcctcctggaaa

SEQ ID NO: 3240442 - DNA, 19 bp, Homo sapiens
gggctggactggaggtggg

SEQ ID NO: 3240443 - DNA, 21 bp, Homo sapiens
gggctggactggaggtgggca

SEQ ID NO: 3240444 - DNA, 19 bp, Homo sapiens
gggctggagaaagagctgc

SEQ ID NO: 3240445 - DNA, 23 bp, Homo sapiens
gggctggagaaagagctgcctgg

SEQ ID NO: 3240446 - DNA, 15 bp, Homo sapiens
gggctggaggcccag

SEQ ID NO: 3240447 - DNA, 16 bp, Homo sapiens
gggctggaggcccagg

SEQ ID NO: 3240448 - DNA, 23 bp, Homo sapiens
gggctggagtgcgctcttggtcc

SEQ ID NO: 3240449 - DNA, 18 bp, Homo sapiens
gggctggccccagggcac

SEQ ID NO: 3240450 - DNA, 22 bp, Homo sapiens
gggctggccccagggcaccctg

SEQ ID NO: 3240451 - DNA, 13 bp, Homo sapiens
gggctggcctagg

SEQ ID NO: 3240452 - DNA, 15 bp, Homo sapiens
gggctggcggggcga

SEQ ID NO: 3240453 - DNA, 10 bp, Homo sapiens
gggctggctc

SEQ ID NO: 3240454 - DNA, 13 bp, Homo sapiens
gggctggctctgc

SEQ ID NO: 3240455 - DNA, 18 bp, Homo sapiens
gggctgggctcacaggcc

SEQ ID NO: 3240456 - DNA, 20 bp, Homo sapiens
gggctgggctcacaggcctc

SEQ ID NO: 3240457 - DNA, 11 bp, Homo sapiens
gggctggggca

SEQ ID NO: 3240458 - DNA, 13 bp, Homo sapiens
gggctggggctgc

SEQ ID NO: 3240459 - DNA, 23 bp, Homo sapiens
gggctgggtggcacaccacccga

SEQ ID NO: 3240460 - DNA, 19 bp, Homo sapiens
gggctggtgccccacagct

SEQ ID NO: 3240461 - DNA, 15 bp, Homo sapiens
gggcttaagaaatct

SEQ ID NO: 3240462 - DNA, 20 bp, Homo sapiens
gggcttaatggagttcttgt

SEQ ID NO: 3240463 - DNA, 14 bp, Homo sapiens
gggcttcagtggca

SEQ ID NO: 3240464 - DNA, 15 bp, Homo sapiens
gggcttcagtggcag

SEQ ID NO: 3240465 - DNA, 18 bp, Homo sapiens
gggcttcagtggcagctg

SEQ ID NO: 3240466 - DNA, 18 bp, Homo sapiens
gggcttccatgcctgtag

SEQ ID NO: 3240467 - DNA, 17 bp, Homo sapiens
gggcttcctgggtcctg

SEQ ID NO: 3240468 - DNA, 13 bp, Homo sapiens
gggcttctcctga

SEQ ID NO: 3240469 - DNA, 16 bp, Homo sapiens
gggcttctcctgaccc

SEQ ID NO: 3240470 - DNA, 14 bp, Homo sapiens
gggcttctgcaccc

SEQ ID NO: 3240471 - DNA, 15 bp, Homo sapiens
gggcttctgcaccct

SEQ ID NO: 3240472 - DNA, 17 bp, Homo sapiens
gggcttgaagccaaaga

SEQ ID NO: 3240473 - DNA, 16 bp, Homo sapiens
gggcttggacttcctg

SEQ ID NO: 3240474 - DNA, 15 bp, Homo sapiens
gggcttggcccagcg

SEQ ID NO: 3240475 - DNA, 18 bp, Homo sapiens
ggtccaattagtttcctt

SEQ ID NO: 3240476 - DNA, 13 bp, Homo sapiens
ggtccacccagga

SEQ ID NO: 3240477 - DNA, 16 bp, Homo sapiens
ggtccacccaggagcc

SEQ ID NO: 3240478 - DNA, 19 bp, Homo sapiens
ggtccaccggcccctggca

SEQ ID NO: 3240479 - DNA, 20 bp, Homo sapiens
ggtccaccggcccctggcag

SEQ ID NO: 3240480 - DNA, 16 bp, Homo sapiens
ggtccagctctggagg

SEQ ID NO: 3240481 - DNA, 13 bp, Homo sapiens
ggtccagctggcc

SEQ ID NO: 3240482 - DNA, 15 bp, Homo sapiens
ggtccaggaaggcag

SEQ ID NO: 3240483 - DNA, 18 bp, Homo sapiens
ggtccaggaaggcagctg

SEQ ID NO: 3240484 - DNA, 19 bp, Homo sapiens
ggtccaggaaggcagctgc

SEQ ID NO: 3240485 - DNA, 20 bp, Homo sapiens
ggtccaggaaggcagctgct

SEQ ID NO: 3240486 - DNA, 21 bp, Homo sapiens
ggtccaggaaggcagctgctc

SEQ ID NO: 3240487 - DNA, 21 bp, Homo sapiens
ggtccagggaagctggccgag

SEQ ID NO: 3240488 - DNA, 18 bp, Homo sapiens
ggtcccatcagtgaaaga

SEQ ID NO: 3240489 - DNA, 14 bp, Homo sapiens
ggtcccatccaggc

SEQ ID NO: 3240490 - DNA, 16 bp, Homo sapiens
ggtccccatcatccca

SEQ ID NO: 3240491 - DNA, 13 bp, Homo sapiens
ggtccccatcccc

SEQ ID NO: 3240492 - DNA, 17 bp, Homo sapiens
ggtcccctgcctggaac

SEQ ID NO: 3240493 - DNA, 20 bp, Homo sapiens
ggtcccgcactctgccccca

SEQ ID NO: 3240494 - DNA, 24 bp, Homo sapiens
ggtcccggttcagacccctgcctg

SEQ ID NO: 3240495 - DNA, 16 bp, Homo sapiens
ggtccctcactccaca

SEQ ID NO: 3240496 - DNA, 17 bp, Homo sapiens
ggtccctccaccccaca

SEQ ID NO: 3240497 - DNA, 18 bp, Homo sapiens
ggtccctccgcggctgga

SEQ ID NO: 3240498 - DNA, 20 bp, Homo sapiens
ggtccctccgcggctggagc

SEQ ID NO: 3240499 - DNA, 11 bp, Homo sapiens
ggtccctcctc

SEQ ID NO: 3240500 - DNA, 14 bp, Homo sapiens
ggtccgcaccagct

SEQ ID NO: 3240501 - DNA, 18 bp, Homo sapiens
ggtccgcaccagctgctc

SEQ ID NO: 3240502 - DNA, 19 bp, Homo sapiens
ggtccgcaccagctgctct

SEQ ID NO: 3240503 - DNA, 16 bp, Homo sapiens
ggtccggtgttctaag

SEQ ID NO: 3240504 - DNA, 17 bp, Homo sapiens
ggtccgtggtagaggcc

SEQ ID NO: 3240505 - DNA, 22 bp, Homo sapiens
ggtccgtggtagaggcctgggg

SEQ ID NO: 3240506 - DNA, 22 bp, Homo sapiens
ggtcctcttctgggcctgacca

SEQ ID NO: 3240507 - DNA, 21 bp, Homo sapiens
ggtcctggagcagaccacccc

SEQ ID NO: 3240508 - DNA, 23 bp, Homo sapiens
ggtcctggggctctgtgcaggga

SEQ ID NO: 3240509 - DNA, 22 bp, Homo sapiens
ggtcctgtggcaggcagcgcca

SEQ ID NO: 3240510 - DNA, 22 bp, Homo sapiens
ggtccttaggagacgctgcact

SEQ ID NO: 3240511 - DNA, 10 bp, Homo sapiens
ggtccttcaa

SEQ ID NO: 3240512 - DNA, 14 bp, Homo sapiens
ggtccttctccaca

SEQ ID NO: 3240513 - DNA, 16 bp, Homo sapiens
ggtccttgcacccctc

SEQ ID NO: 3240514 - DNA, 19 bp, Homo sapiens
ggtccttgtctgcaccctc

SEQ ID NO: 3240515 - DNA, 16 bp, Homo sapiens
ggtcctttctggaagt

SEQ ID NO: 3240516 - DNA, 20 bp, Homo sapiens
ggtcgaccccaaagcccctt

SEQ ID NO: 3240517 - DNA, 22 bp, Homo sapiens
ggtcgaggagtaacaatacaaa

SEQ ID NO: 3240518 - DNA, 14 bp, Homo sapiens
ggtcgctcctgccc

SEQ ID NO: 3240519 - DNA, 15 bp, Homo sapiens
ggtcggaacccaagc

SEQ ID NO: 3240520 - DNA, 15 bp, Homo sapiens
ggtcggccctgccca

SEQ ID NO: 3240521 - DNA, 18 bp, Homo sapiens
ggtcgggcagccagcaga

SEQ ID NO: 3240522 - DNA, 15 bp, Homo sapiens
ggtctaaaaataaac

SEQ ID NO: 3240523 - DNA, 23 bp, Homo sapiens
ggtctcaaactcctgacctcagg

SEQ ID NO: 3240524 - DNA, 22 bp, Homo sapiens
ggtctcactctgtcgcccagtc

SEQ ID NO: 3240525 - DNA, 16 bp, Homo sapiens
ggtctcaggcctccag

SEQ ID NO: 3240526 - DNA, 15 bp, Homo sapiens
ggtctcatctcttca

SEQ ID NO: 3240527 - DNA, 16 bp, Homo sapiens
ggtctcatctcttcag

SEQ ID NO: 3240528 - DNA, 16 bp, Homo sapiens
ggtctccccatcccca

SEQ ID NO: 3240529 - DNA, 12 bp, Homo sapiens
ggtctccctggc

SEQ ID NO: 3240530 - DNA, 21 bp, Homo sapiens
ggtctcccttctctacactct

SEQ ID NO: 3240531 - DNA, 18 bp, Homo sapiens
ggtctcctcagggtgggg

SEQ ID NO: 3240532 - DNA, 19 bp, Homo sapiens
ggtctccttactctgagcc

SEQ ID NO: 3240533 - DNA, 20 bp, Homo sapiens
ggtctccttactctgagccc

SEQ ID NO: 3240534 - DNA, 22 bp, Homo sapiens
ggtctccttactctgagcccag

SEQ ID NO: 3240535 - DNA, 19 bp, Homo sapiens
ggtctcgaactcctggcct

SEQ ID NO: 3240536 - DNA, 19 bp, Homo sapiens
ggtctcgctgtcactggct

SEQ ID NO: 3240537 - DNA, 21 bp, Homo sapiens
ggtctcgctttgttgcccagg

SEQ ID NO: 3240538 - DNA, 20 bp, Homo sapiens
ggtctcggatgacaccctgg

SEQ ID NO: 3240539 - DNA, 16 bp, Homo sapiens
ggtctctccctcaggt

SEQ ID NO: 3240540 - DNA, 17 bp, Homo sapiens
ggtctctccctcaggtg

SEQ ID NO: 3240541 - DNA, 20 bp, Homo sapiens
ggtctcttactttcctttcc

SEQ ID NO: 3240542 - DNA, 15 bp, Homo sapiens
ggtctcttctcccag

SEQ ID NO: 3240543 - DNA, 13 bp, Homo sapiens
ggtctgaaatgga

SEQ ID NO: 3240544 - DNA, 21 bp, Homo sapiens
ggtctgaaggaatagccagag

SEQ ID NO: 3240545 - DNA, 21 bp, Homo sapiens
ggtctgaatgttctgacatta

SEQ ID NO: 3240546 - DNA, 22 bp, Homo sapiens
ggtctgaatgttctgacattaa

SEQ ID NO: 3240547 - DNA, 12 bp, Homo sapiens
ggtctgagccct

SEQ ID NO: 3240548 - DNA, 16 bp, Homo sapiens
ggtctgagccctggtg

SEQ ID NO: 3240549 - DNA, 19 bp, Homo sapiens
ggtctgaggaatccagacc

SEQ ID NO: 3240550 - DNA, 16 bp, Homo sapiens
ggtctgctctttctct

SEQ ID NO: 3240551 - DNA, 19 bp, Homo sapiens
ggtctgctctttctctgcc

SEQ ID NO: 3240552 - DNA, 22 bp, Homo sapiens
ggtctgctctttctctgccagt

SEQ ID NO: 3240553 - DNA, 16 bp, Homo sapiens
ggtctgggacttcctt

SEQ ID NO: 3240554 - DNA, 19 bp, Homo sapiens
ggtctgggagtcacacagt

SEQ ID NO: 3240555 - DNA, 20 bp, Homo sapiens
ggtctgggagtcacacagtg

SEQ ID NO: 3240556 - DNA, 18 bp, Homo sapiens
ggtctgtacgttacctct

SEQ ID NO: 3240557 - DNA, 14 bp, Homo sapiens
ggtctgtgagatgc

SEQ ID NO: 3240558 - DNA, 17 bp, Homo sapiens
ggtctgtgctgtgcctg

SEQ ID NO: 3240559 - DNA, 19 bp, Homo sapiens
ggtctgtgctgtgcctgct

SEQ ID NO: 3240560 - DNA, 12 bp, Homo sapiens
ggtctgtttgca

SEQ ID NO: 3240561 - DNA, 20 bp, Homo sapiens
ggtctgttttcctttctcac

SEQ ID NO: 3240562 - DNA, 17 bp, Homo sapiens
ggtcttaggatgtctgt

SEQ ID NO: 3240563 - DNA, 16 bp, Homo sapiens
ggtcttatgcttccat

SEQ ID NO: 3240564 - DNA, 18 bp, Homo sapiens
ggtcttccagacctgctt

SEQ ID NO: 3240565 - DNA, 20 bp, Homo sapiens
ggtctttcagtactttttta

SEQ ID NO: 3240566 - DNA, 14 bp, Homo sapiens
ggtctttgtaagag

SEQ ID NO: 3240567 - DNA, 16 bp, Homo sapiens
ggtcttttataggaaa

SEQ ID NO: 3240568 - DNA, 17 bp, Homo sapiens
ggtctttttatgcattt

SEQ ID NO: 3240569 - DNA, 21 bp, Homo sapiens
ggtcttttttcatttcttcct

SEQ ID NO: 3240570 - DNA, 14 bp, Homo sapiens
ggtgaaagggagct

SEQ ID NO: 3240571 - DNA, 17 bp, Homo sapiens
ggtgaaccacttcattc

SEQ ID NO: 3240572 - DNA, 21 bp, Homo sapiens
ggtgaactgagctgggcagga

SEQ ID NO: 3240573 - DNA, 15 bp, Homo sapiens
ggtgaagatgaagaa

SEQ ID NO: 3240574 - DNA, 12 bp, Homo sapiens
ggtgaatcttga

SEQ ID NO: 3240575 - DNA, 18 bp, Homo sapiens
ggtgaatggccttccttc

SEQ ID NO: 3240576 - DNA, 18 bp, Homo sapiens
ggtgacacattacaaagc

SEQ ID NO: 3240577 - DNA, 23 bp, Homo sapiens
ggtgacagtcatcatcagggcct

SEQ ID NO: 3240578 - DNA, 15 bp, Homo sapiens
ggtgacatgtgaaac

SEQ ID NO: 3240579 - DNA, 17 bp, Homo sapiens
ggtgacatttcccaagt

SEQ ID NO: 3240580 - DNA, 14 bp, Homo sapiens
ggtgacctctgcct

SEQ ID NO: 3240581 - DNA, 21 bp, Homo sapiens
ggtgacctctgcctgaagtca

SEQ ID NO: 3240582 - DNA, 16 bp, Homo sapiens
ggtgacggttgggagc

SEQ ID NO: 3240583 - DNA, 12 bp, Homo sapiens
ggtgactgtccc

SEQ ID NO: 3240584 - DNA, 16 bp, Homo sapiens
ggtgactgtcccaccg

SEQ ID NO: 3240585 - DNA, 23 bp, Homo sapiens
ggtgactgtcccaccgggagcct

SEQ ID NO: 3240586 - DNA, 16 bp, Homo sapiens
ggtgagatcacagcct

SEQ ID NO: 3240587 - DNA, 18 bp, Homo sapiens
ggtgagatcacagcctcc

SEQ ID NO: 3240588 - DNA, 14 bp, Homo sapiens
ggtgagatgctgga

SEQ ID NO: 3240589 - DNA, 23 bp, Homo sapiens
ggtgagatgctggagaagagagg

SEQ ID NO: 3240590 - DNA, 12 bp, Homo sapiens
ggtgagccagtg

SEQ ID NO: 3240591 - DNA, 13 bp, Homo sapiens
ggtgaggagcaca

SEQ ID NO: 3240592 - DNA, 15 bp, Homo sapiens
ggtgaggcaataaaa

SEQ ID NO: 3240593 - DNA, 20 bp, Homo sapiens
ggtgagtcttggcggcagca

SEQ ID NO: 3240594 - DNA, 20 bp, Homo sapiens
ggtgagtttgagctgccttc

SEQ ID NO: 3240595 - DNA, 14 bp, Homo sapiens
ggtgataagggaaa

SEQ ID NO: 3240596 - DNA, 15 bp, Homo sapiens
ggtgataagggaaaa

SEQ ID NO: 3240597 - DNA, 16 bp, Homo sapiens
ggtgataagtggaaaa

SEQ ID NO: 3240598 - DNA, 19 bp, Homo sapiens
ggtgatcaattaaatgtag

SEQ ID NO: 3240599 - DNA, 23 bp, Homo sapiens
ggtgatccacccacctcagcctc

SEQ ID NO: 3240600 - DNA, 13 bp, Homo sapiens
gtaagtcatctac

SEQ ID NO: 3240601 - DNA, 16 bp, Homo sapiens
gtaagtgagagagaca

SEQ ID NO: 3240602 - DNA, 18 bp, Homo sapiens
gtaagttaataatgtatt

SEQ ID NO: 3240603 - DNA, 16 bp, Homo sapiens
gtaagttgtacaaatg

SEQ ID NO: 3240604 - DNA, 16 bp, Homo sapiens
gtaagtttatccaaat

SEQ ID NO: 3240605 - DNA, 12 bp, Homo sapiens
gtaataaagtgt

SEQ ID NO: 3240606 - DNA, 18 bp, Homo sapiens
gtaataaagtgttttcag

SEQ ID NO: 3240607 - DNA, 19 bp, Homo sapiens
gtaataaagtgttttcaga

SEQ ID NO: 3240608 - DNA, 20 bp, Homo sapiens
gtaataaagtgttttcagag

SEQ ID NO: 3240609 - DNA, 12 bp, Homo sapiens
gtaataaatact

SEQ ID NO: 3240610 - DNA, 15 bp, Homo sapiens
gtaataactgtgaag

SEQ ID NO: 3240611 - DNA, 16 bp, Homo sapiens
gtaataactgtgaagt

SEQ ID NO: 3240612 - DNA, 22 bp, Homo sapiens
gtaataactgtgaagtttacat

SEQ ID NO: 3240613 - DNA, 15 bp, Homo sapiens
gtaatagaaaactga

SEQ ID NO: 3240614 - DNA, 15 bp, Homo sapiens
gtaatagagcaaaat

SEQ ID NO: 3240615 - DNA, 19 bp, Homo sapiens
gtaatataatggaagagaa

SEQ ID NO: 3240616 - DNA, 20 bp, Homo sapiens
gtaatataatggaagagaaa

SEQ ID NO: 3240617 - DNA, 22 bp, Homo sapiens
gtaatataatggaagagaaatc

SEQ ID NO: 3240618 - DNA, 12 bp, Homo sapiens
gtaatatattgt

SEQ ID NO: 3240619 - DNA, 16 bp, Homo sapiens
gtaatcaataaagaaa

SEQ ID NO: 3240620 - DNA, 21 bp, Homo sapiens
gtaatcaatgaatattgaagt

SEQ ID NO: 3240621 - DNA, 22 bp, Homo sapiens
gtaatcactcccatttttactt

SEQ ID NO: 3240622 - DNA, 19 bp, Homo sapiens
gtaatcagctctcctggct

SEQ ID NO: 3240623 - DNA, 16 bp, Homo sapiens
gtaatcatgtactttg

SEQ ID NO: 3240624 - DNA, 12 bp, Homo sapiens
gtaatcccagca

SEQ ID NO: 3240625 - DNA, 18 bp, Homo sapiens
gtaatcccagcactttgg

SEQ ID NO: 3240626 - DNA, 16 bp, Homo sapiens
gtaatcccagctactt

SEQ ID NO: 3240627 - DNA, 19 bp, Homo sapiens
gtaatcccccaggagaaca

SEQ ID NO: 3240628 - DNA, 17 bp, Homo sapiens
gtaatcccctaaaataa

SEQ ID NO: 3240629 - DNA, 14 bp, Homo sapiens
gtaatctaatagaa

SEQ ID NO: 3240630 - DNA, 23 bp, Homo sapiens
gtaatctgtacattttgttgtaa

SEQ ID NO: 3240631 - DNA, 16 bp, Homo sapiens
gtaatctttaaactgg

SEQ ID NO: 3240632 - DNA, 21 bp, Homo sapiens
gtaatgcactgtttttaatct

SEQ ID NO: 3240633 - DNA, 20 bp, Homo sapiens
gtaatgcttagagaatgttc

SEQ ID NO: 3240634 - DNA, 14 bp, Homo sapiens
gtaatggcagagca

SEQ ID NO: 3240635 - DNA, 14 bp, Homo sapiens
gtaatgggcctgcc

SEQ ID NO: 3240636 - DNA, 23 bp, Homo sapiens
gtaatggtactgactttgcttgc

SEQ ID NO: 3240637 - DNA, 15 bp, Homo sapiens
gtaatggtgtagaac

SEQ ID NO: 3240638 - DNA, 17 bp, Homo sapiens
gtaatggtgtagaacac

SEQ ID NO: 3240639 - DNA, 16 bp, Homo sapiens
gtaatgtgaataaatt

SEQ ID NO: 3240640 - DNA, 18 bp, Homo sapiens
gtaatgtgtggtggcctc

SEQ ID NO: 3240641 - DNA, 20 bp, Homo sapiens
gtaatgttaatgttatatca

SEQ ID NO: 3240642 - DNA, 16 bp, Homo sapiens
gtaatgttttgtatat

SEQ ID NO: 3240643 - DNA, 22 bp, Homo sapiens
gtaatgttttgtatatacagtt

SEQ ID NO: 3240644 - DNA, 14 bp, Homo sapiens
gtaattaagtacta

SEQ ID NO: 3240645 - DNA, 20 bp, Homo sapiens
gtaattagtgccacttaatg

SEQ ID NO: 3240646 - DNA, 17 bp, Homo sapiens
gtaattattttggtact

SEQ ID NO: 3240647 - DNA, 13 bp, Homo sapiens
gtaattcaagaaa

SEQ ID NO: 3240648 - DNA, 15 bp, Homo sapiens
gtaattgcttacatt

SEQ ID NO: 3240649 - DNA, 22 bp, Homo sapiens
gtaattgcttacatttttacaa

SEQ ID NO: 3240650 - DNA, 14 bp, Homo sapiens
gtaattgtttttta

SEQ ID NO: 3240651 - DNA, 20 bp, Homo sapiens
gtaattgttttttaaagcaa

SEQ ID NO: 3240652 - DNA, 16 bp, Homo sapiens
gtaatttaaacaggcc

SEQ ID NO: 3240653 - DNA, 20 bp, Homo sapiens
gtaatttaaacaggcccagc

SEQ ID NO: 3240654 - DNA, 21 bp, Homo sapiens
gtaatttaaatgaaagaaaat

SEQ ID NO: 3240655 - DNA, 19 bp, Homo sapiens
gtaatttagggtactaaat

SEQ ID NO: 3240656 - DNA, 17 bp, Homo sapiens
gtaatttagttattgat

SEQ ID NO: 3240657 - DNA, 23 bp, Homo sapiens
gtaatttgagagaaatatgaaga

SEQ ID NO: 3240658 - DNA, 16 bp, Homo sapiens
gtaatttgtgtaataa

SEQ ID NO: 3240659 - DNA, 19 bp, Homo sapiens
gtaattttattttaaaatt

SEQ ID NO: 3240660 - DNA, 17 bp, Homo sapiens
gtaattttggattttgc

SEQ ID NO: 3240661 - DNA, 22 bp, Homo sapiens
gtaatttttaccctaatgtctt

SEQ ID NO: 3240662 - DNA, 19 bp, Homo sapiens
gtacaaaaaaaaagtttta

SEQ ID NO: 3240663 - DNA, 22 bp, Homo sapiens
gtacaaaactgtaaataaaatg

SEQ ID NO: 3240664 - DNA, 22 bp, Homo sapiens
gtacaaattataaaaagccact

SEQ ID NO: 3240665 - DNA, 17 bp, Homo sapiens
gtacaagagtccctttg

SEQ ID NO: 3240666 - DNA, 15 bp, Homo sapiens
gtacaaggtaattgt

SEQ ID NO: 3240667 - DNA, 21 bp, Homo sapiens
gtacaagttgttattgttgaa

SEQ ID NO: 3240668 - DNA, 16 bp, Homo sapiens
gtacaagttttgtata

SEQ ID NO: 3240669 - DNA, 16 bp, Homo sapiens
gtacaatcaaaacaca

SEQ ID NO: 3240670 - DNA, 13 bp, Homo sapiens
gtacaatcatgaa

SEQ ID NO: 3240671 - DNA, 22 bp, Homo sapiens
gtacaatcatgaacagctctga

SEQ ID NO: 3240672 - DNA, 16 bp, Homo sapiens
gtacaattaagttaca

SEQ ID NO: 3240673 - DNA, 21 bp, Homo sapiens
gtacaattgtgggcataaact

SEQ ID NO: 3240674 - DNA, 24 bp, Homo sapiens
gtacacacccgcctgacaccgtgg

SEQ ID NO: 3240675 - DNA, 14 bp, Homo sapiens
gtacacactttatt

SEQ ID NO: 3240676 - DNA, 17 bp, Homo sapiens
gtacaccatagtttaca

SEQ ID NO: 3240677 - DNA, 14 bp, Homo sapiens
gtacacgtgtcctg

SEQ ID NO: 3240678 - DNA, 12 bp, Homo sapiens
gtacactaacat

SEQ ID NO: 3240679 - DNA, 16 bp, Homo sapiens
gtacactaacatttcc

SEQ ID NO: 3240680 - DNA, 15 bp, Homo sapiens
gtacactgaatattt

SEQ ID NO: 3240681 - DNA, 14 bp, Homo sapiens
gtacagaatatttc

SEQ ID NO: 3240682 - DNA, 17 bp, Homo sapiens
gtacagaatttgaatta

SEQ ID NO: 3240683 - DNA, 16 bp, Homo sapiens
gtacagactgttttac

SEQ ID NO: 3240684 - DNA, 21 bp, Homo sapiens
gtacagcgcggaggaggaggg

SEQ ID NO: 3240685 - DNA, 15 bp, Homo sapiens
gtacaggagaggcag

SEQ ID NO: 3240686 - DNA, 24 bp, Homo sapiens
gtacaggcaaaacacgcaagggca

SEQ ID NO: 3240687 - DNA, 14 bp, Homo sapiens
gtacagtctgtcat

SEQ ID NO: 3240688 - DNA, 18 bp, Homo sapiens
gtacagtgaattgtcttt

SEQ ID NO: 3240689 - DNA, 15 bp, Homo sapiens
gtacagtgaggaggg

SEQ ID NO: 3240690 - DNA, 16 bp, Homo sapiens
gtacagttgcaggagc

SEQ ID NO: 3240691 - DNA, 21 bp, Homo sapiens
gtacataaattgcataaagca

SEQ ID NO: 3240692 - DNA, 22 bp, Homo sapiens
gtacataaattgcataaagcat

SEQ ID NO: 3240693 - DNA, 22 bp, Homo sapiens
gtacatagcctatatttacagt

SEQ ID NO: 3240694 - DNA, 14 bp, Homo sapiens
gtacatatgtgctg

SEQ ID NO: 3240695 - DNA, 17 bp, Homo sapiens
gtacatatttgtggaat

SEQ ID NO: 3240696 - DNA, 18 bp, Homo sapiens
gtacatctattttggatt

SEQ ID NO: 3240697 - DNA, 14 bp, Homo sapiens
gtacatctggctta

SEQ ID NO: 3240698 - DNA, 18 bp, Homo sapiens
gtacatctggcttatttt

SEQ ID NO: 3240699 - DNA, 20 bp, Homo sapiens
gtacatctggcttattttaa

SEQ ID NO: 3240700 - DNA, 21 bp, Homo sapiens
gtacatctggcttattttaat

SEQ ID NO: 3240701 - DNA, 10 bp, Homo sapiens
gtacatgtat

SEQ ID NO: 3240702 - DNA, 20 bp, Homo sapiens
gtacatgtgtagcctgtgca

SEQ ID NO: 3240703 - DNA, 18 bp, Homo sapiens
gtacatgttcgggtgtgg

SEQ ID NO: 3240704 - DNA, 12 bp, Homo sapiens
gtacattctgcc

SEQ ID NO: 3240705 - DNA, 21 bp, Homo sapiens
gtacattctgcctagagtgta

SEQ ID NO: 3240706 - DNA, 15 bp, Homo sapiens
gtacatttaaaattg

SEQ ID NO: 3240707 - DNA, 12 bp, Homo sapiens
gtacatttataa

SEQ ID NO: 3240708 - DNA, 13 bp, Homo sapiens
gtacatttataat

SEQ ID NO: 3240709 - DNA, 16 bp, Homo sapiens
gtacatttatgattta

SEQ ID NO: 3240710 - DNA, 20 bp, Homo sapiens
gtacatttatgatttaataa

SEQ ID NO: 3240711 - DNA, 17 bp, Homo sapiens
gtacatttctctgagca

SEQ ID NO: 3240712 - DNA, 15 bp, Homo sapiens
gtacatttggagaca

SEQ ID NO: 3240713 - DNA, 21 bp, Homo sapiens
gtacattttgttgtaaaaaga

SEQ ID NO: 3240714 - DNA, 19 bp, Homo sapiens
gtaccaaaattttaaaaaa

SEQ ID NO: 3240715 - DNA, 20 bp, Homo sapiens
gtaccaaaattttaaaaaag

SEQ ID NO: 3240716 - DNA, 12 bp, Homo sapiens
gtaccacactga

SEQ ID NO: 3240717 - DNA, 16 bp, Homo sapiens
gtaccacactgagttc

SEQ ID NO: 3240718 - DNA, 21 bp, Homo sapiens
gtaccacagacacaatatgta

SEQ ID NO: 3240719 - DNA, 22 bp, Homo sapiens
gtaccacagacacaatatgtat

SEQ ID NO: 3240720 - DNA, 14 bp, Homo sapiens
gtaccactcaggcc

SEQ ID NO: 3240721 - DNA, 19 bp, Homo sapiens
gtaccagcatgttaacttt

SEQ ID NO: 3240722 - DNA, 22 bp, Homo sapiens
gtaccagttaatttttccaact

SEQ ID NO: 3240723 - DNA, 20 bp, Homo sapiens
gtaccatagtaccatttata

SEQ ID NO: 3240724 - DNA, 20 bp, Homo sapiens
gtaccatgaaacaaagctgc

SEQ ID NO: 3240725 - DNA, 14 bp, Homo sapiens
gtaccatttgcatg

SEQ ID NO: 3240726 - DNA, 18 bp, Homo sapiens
gtcagatgagaacaaagc

SEQ ID NO: 3240727 - DNA, 10 bp, Homo sapiens
gtcagatgca

SEQ ID NO: 3240728 - DNA, 22 bp, Homo sapiens
gtcagatgcgtgcccagctctt

SEQ ID NO: 3240729 - DNA, 18 bp, Homo sapiens
gtcagatgggaagacatg

SEQ ID NO: 3240730 - DNA, 14 bp, Homo sapiens
gtcagattaaatta

SEQ ID NO: 3240731 - DNA, 13 bp, Homo sapiens
gtcagattccttt

SEQ ID NO: 3240732 - DNA, 17 bp, Homo sapiens
gtcagattgctgggagg

SEQ ID NO: 3240733 - DNA, 22 bp, Homo sapiens
gtcagatttttaaagttttgta

SEQ ID NO: 3240734 - DNA, 19 bp, Homo sapiens
gtcagcatgcttcccagag

SEQ ID NO: 3240735 - DNA, 21 bp, Homo sapiens
gtcagccagccgccctgggct

SEQ ID NO: 3240736 - DNA, 20 bp, Homo sapiens
gtcagccatcgtcctgggac

SEQ ID NO: 3240737 - DNA, 12 bp, Homo sapiens
gtcagccatttt

SEQ ID NO: 3240738 - DNA, 19 bp, Homo sapiens
gtcagcgggcccaggccta

SEQ ID NO: 3240739 - DNA, 15 bp, Homo sapiens
gtcagcgttgcatgt

SEQ ID NO: 3240740 - DNA, 13 bp, Homo sapiens
gtcagctccagct

SEQ ID NO: 3240741 - DNA, 18 bp, Homo sapiens
gtcagctgttactttctt

SEQ ID NO: 3240742 - DNA, 17 bp, Homo sapiens
gtcagcttcccagccat

SEQ ID NO: 3240743 - DNA, 18 bp, Homo sapiens
gtcagcttttgttgttta

SEQ ID NO: 3240744 - DNA, 15 bp, Homo sapiens
gtcaggagagcagcg

SEQ ID NO: 3240745 - DNA, 13 bp, Homo sapiens
gtcaggagttcct

SEQ ID NO: 3240746 - DNA, 21 bp, Homo sapiens
gtcaggagttgtttctgaccc

SEQ ID NO: 3240747 - DNA, 20 bp, Homo sapiens
gtcaggatgcacatttctgg

SEQ ID NO: 3240748 - DNA, 15 bp, Homo sapiens
gtcaggccctggaac

SEQ ID NO: 3240749 - DNA, 21 bp, Homo sapiens
gtcaggcccttattttcaaga

SEQ ID NO: 3240750 - DNA, 12 bp, Homo sapiens
gtcaggctctgg

SEQ ID NO: 3240751 - DNA, 15 bp, Homo sapiens
gtcaggctctggccc

SEQ ID NO: 3240752 - DNA, 21 bp, Homo sapiens
gtcaggctgggcagccccaga

SEQ ID NO: 3240753 - DNA, 22 bp, Homo sapiens
gtcaggctgggcagccccagag

SEQ ID NO: 3240754 - DNA, 16 bp, Homo sapiens
gtcagggacttggaca

SEQ ID NO: 3240755 - DNA, 17 bp, Homo sapiens
gtcagggacttggacag

SEQ ID NO: 3240756 - DNA, 13 bp, Homo sapiens
gtcagggagtgct

SEQ ID NO: 3240757 - DNA, 22 bp, Homo sapiens
gtcagggagtgctggctcacag

SEQ ID NO: 3240758 - DNA, 20 bp, Homo sapiens
gtcagggccagactggaaga

SEQ ID NO: 3240759 - DNA, 20 bp, Homo sapiens
gtcagggcccaagtccctgt

SEQ ID NO: 3240760 - DNA, 21 bp, Homo sapiens
gtcagggcccaagtccctgtt

SEQ ID NO: 3240761 - DNA, 16 bp, Homo sapiens
gtcagggcccagaggc

SEQ ID NO: 3240762 - DNA, 15 bp, Homo sapiens
gtcagggtgggaaga

SEQ ID NO: 3240763 - DNA, 18 bp, Homo sapiens
gtcagggttggtgtgctg

SEQ ID NO: 3240764 - DNA, 18 bp, Homo sapiens
gtcaggtggggcagcttg

SEQ ID NO: 3240765 - DNA, 13 bp, Homo sapiens
gtcaggtttaaca

SEQ ID NO: 3240766 - DNA, 22 bp, Homo sapiens
gtcagtacccctggtaaaccaa

SEQ ID NO: 3240767 - DNA, 20 bp, Homo sapiens
gtcagtaggtccaagggcca

SEQ ID NO: 3240768 - DNA, 16 bp, Homo sapiens
gtcagtatccaggctt

SEQ ID NO: 3240769 - DNA, 21 bp, Homo sapiens
gtcagtctttttctgttgtaa

SEQ ID NO: 3240770 - DNA, 17 bp, Homo sapiens
gtcagttcccggagcac

SEQ ID NO: 3240771 - DNA, 14 bp, Homo sapiens
gtcagttcttggtg

SEQ ID NO: 3240772 - DNA, 14 bp, Homo sapiens
gtcagtttggaatg

SEQ ID NO: 3240773 - DNA, 13 bp, Homo sapiens
gtcatagaaatta

SEQ ID NO: 3240774 - DNA, 15 bp, Homo sapiens
gtcataggttaatat

SEQ ID NO: 3240775 - DNA, 22 bp, Homo sapiens
gtcatatactgccatgtactag

SEQ ID NO: 3240776 - DNA, 16 bp, Homo sapiens
gtcatattttgattat

SEQ ID NO: 3240777 - DNA, 20 bp, Homo sapiens
gtcatattttgattattgta

SEQ ID NO: 3240778 - DNA, 18 bp, Homo sapiens
gtcatcactccctggatg

SEQ ID NO: 3240779 - DNA, 15 bp, Homo sapiens
gtcatcacttttcag

SEQ ID NO: 3240780 - DNA, 16 bp, Homo sapiens
gtcatcacttttcagt

SEQ ID NO: 3240781 - DNA, 23 bp, Homo sapiens
gtcatcatcagggcctggggcct

SEQ ID NO: 3240782 - DNA, 19 bp, Homo sapiens
gtcatcctcaaagaaagtg

SEQ ID NO: 3240783 - DNA, 22 bp, Homo sapiens
gtcatctccggggtggccacag

SEQ ID NO: 3240784 - DNA, 16 bp, Homo sapiens
gtcatgattaatgtgt

SEQ ID NO: 3240785 - DNA, 13 bp, Homo sapiens
gtcatgcataaat

SEQ ID NO: 3240786 - DNA, 18 bp, Homo sapiens
gtcatgcataaatatgca

SEQ ID NO: 3240787 - DNA, 15 bp, Homo sapiens
gtcatgcccccctca

SEQ ID NO: 3240788 - DNA, 16 bp, Homo sapiens
gtcatgcccccctcaa

SEQ ID NO: 3240789 - DNA, 20 bp, Homo sapiens
gtcatggttacaaactacag

SEQ ID NO: 3240790 - DNA, 14 bp, Homo sapiens
gtcatgtttattct

SEQ ID NO: 3240791 - DNA, 15 bp, Homo sapiens
gtcatgtttgcaggg

SEQ ID NO: 3240792 - DNA, 11 bp, Homo sapiens
gtcattaaatg

SEQ ID NO: 3240793 - DNA, 17 bp, Homo sapiens
gtcattaacacattgtt

SEQ ID NO: 3240794 - DNA, 18 bp, Homo sapiens
gtcattatattctaatta

SEQ ID NO: 3240795 - DNA, 21 bp, Homo sapiens
gtcattatgagaggcaatgat

SEQ ID NO: 3240796 - DNA, 21 bp, Homo sapiens
gtcattcttacaattgcactg

SEQ ID NO: 3240797 - DNA, 22 bp, Homo sapiens
gtcattcttacaattgcactgc

SEQ ID NO: 3240798 - DNA, 17 bp, Homo sapiens
gtcattctttattcttt

SEQ ID NO: 3240799 - DNA, 18 bp, Homo sapiens
gtcattgacctctcaggg

SEQ ID NO: 3240800 - DNA, 15 bp, Homo sapiens
gtcattgacttcatt

SEQ ID NO: 3240801 - DNA, 15 bp, Homo sapiens
gtcattgtatgttat

SEQ ID NO: 3240802 - DNA, 12 bp, Homo sapiens
gtcattgtcata

SEQ ID NO: 3240803 - DNA, 14 bp, Homo sapiens
gtcatttataaaac

SEQ ID NO: 3240804 - DNA, 21 bp, Homo sapiens
gtcatttattttaaaaaatga

SEQ ID NO: 3240805 - DNA, 17 bp, Homo sapiens
gtcatttcgttccctga

SEQ ID NO: 3240806 - DNA, 17 bp, Homo sapiens
gtcatttgaacctggat

SEQ ID NO: 3240807 - DNA, 20 bp, Homo sapiens
gtcattttatgaatatcatt

SEQ ID NO: 3240808 - DNA, 19 bp, Homo sapiens
gtcattttattttttccct

SEQ ID NO: 3240809 - DNA, 19 bp, Homo sapiens
gtcattttttttatattgc

SEQ ID NO: 3240810 - DNA, 18 bp, Homo sapiens
gtccaaaaaaaggaaaaa

SEQ ID NO: 3240811 - DNA, 18 bp, Homo sapiens
gtccaaaagattgctgaa

SEQ ID NO: 3240812 - DNA, 20 bp, Homo sapiens
gtccaaataaaaactaaatt

SEQ ID NO: 3240813 - DNA, 20 bp, Homo sapiens
gtccaaataacaagtaccaa

SEQ ID NO: 3240814 - DNA, 22 bp, Homo sapiens
gtccaagaatccacatttctaa

SEQ ID NO: 3240815 - DNA, 14 bp, Homo sapiens
gtccaagagacatg

SEQ ID NO: 3240816 - DNA, 13 bp, Homo sapiens
gtccaagggccat

SEQ ID NO: 3240817 - DNA, 21 bp, Homo sapiens
gtccaagggccatacttttga

SEQ ID NO: 3240818 - DNA, 17 bp, Homo sapiens
gtccaattagtttcctt

SEQ ID NO: 3240819 - DNA, 16 bp, Homo sapiens
gtccacacaaagattt

SEQ ID NO: 3240820 - DNA, 13 bp, Homo sapiens
gtccacaggggca

SEQ ID NO: 3240821 - DNA, 17 bp, Homo sapiens
gtccacaggggcaggcc

SEQ ID NO: 3240822 - DNA, 19 bp, Homo sapiens
gtccacaggggcaggcctg

SEQ ID NO: 3240823 - DNA, 20 bp, Homo sapiens
gtccacaggggcaggcctgg

SEQ ID NO: 3240824 - DNA, 16 bp, Homo sapiens
gtccaccacttcaggg

SEQ ID NO: 3240825 - DNA, 23 bp, Homo sapiens
gtccacccaggagccccgaggcc

SEQ ID NO: 3240826 - DNA, 19 bp, Homo sapiens
gtccacccaggctgcactg

SEQ ID NO: 3240827 - DNA, 15 bp, Homo sapiens
gtccaccggcccctg

SEQ ID NO: 3240828 - DNA, 13 bp, Homo sapiens
gtccactccctgc

SEQ ID NO: 3240829 - DNA, 23 bp, Homo sapiens
gtccactcgggggtggagtgaga

SEQ ID NO: 3240830 - DNA, 17 bp, Homo sapiens
gtccactctcggggccc

SEQ ID NO: 3240831 - DNA, 22 bp, Homo sapiens
gtccagaagaatattcaggact

SEQ ID NO: 3240832 - DNA, 14 bp, Homo sapiens
gtccagaggctgca

SEQ ID NO: 3240833 - DNA, 20 bp, Homo sapiens
gtccagcagctgcgggtctg

SEQ ID NO: 3240834 - DNA, 13 bp, Homo sapiens
gtccagccacttg

SEQ ID NO: 3240835 - DNA, 19 bp, Homo sapiens
gtccagcccatctcggagc

SEQ ID NO: 3240836 - DNA, 20 bp, Homo sapiens
gtccagccgccattgccacc

SEQ ID NO: 3240837 - DNA, 11 bp, Homo sapiens
gtccagcctgg

SEQ ID NO: 3240838 - DNA, 18 bp, Homo sapiens
gtccagctctgacatccc

SEQ ID NO: 3240839 - DNA, 22 bp, Homo sapiens
gtccagctctgacatcccttcc

SEQ ID NO: 3240840 - DNA, 13 bp, Homo sapiens
gtccagctctgga

SEQ ID NO: 3240841 - DNA, 18 bp, Homo sapiens
gtccagctggcctggaca

SEQ ID NO: 3240842 - DNA, 16 bp, Homo sapiens
gtccaggaaggcagct

SEQ ID NO: 3240843 - DNA, 17 bp, Homo sapiens
gtccaggaaggcagctg

SEQ ID NO: 3240844 - DNA, 18 bp, Homo sapiens
gtccaggaaggcagctgc

SEQ ID NO: 3240845 - DNA, 23 bp, Homo sapiens
gtccaggagctcaggaagaagag

SEQ ID NO: 3240846 - DNA, 13 bp, Homo sapiens
gtccaggccactg

SEQ ID NO: 3240847 - DNA, 14 bp, Homo sapiens
gtccaggccactgt

SEQ ID NO: 3240848 - DNA, 17 bp, Homo sapiens
gtccaggccactgtggc

SEQ ID NO: 3240849 - DNA, 23 bp, Homo sapiens
gtccaggccactgtggccagagc

SEQ ID NO: 3240850 - DNA, 16 bp, Homo sapiens
gtccaggctgccgtgg

SEQ ID NO: 3240851 - DNA, 18 bp, Homo sapiens
gtccaggtgaggcccaag

SEQ ID NO: 3240852 - DNA, 22 bp, Homo sapiens
gtctgcattgttattgtggaag

SEQ ID NO: 3240853 - DNA, 13 bp, Homo sapiens
gtctgccaggccc

SEQ ID NO: 3240854 - DNA, 19 bp, Homo sapiens
gtctgcccacgcagaggac

SEQ ID NO: 3240855 - DNA, 20 bp, Homo sapiens
gtctgcccacgcagaggacg

SEQ ID NO: 3240856 - DNA, 21 bp, Homo sapiens
gtctgcccacgcagaggacgc

SEQ ID NO: 3240857 - DNA, 11 bp, Homo sapiens
gtctgcctgta

SEQ ID NO: 3240858 - DNA, 22 bp, Homo sapiens
gtctgctctcatccattcctct

SEQ ID NO: 3240859 - DNA, 20 bp, Homo sapiens
gtctgctctttctctgccag

SEQ ID NO: 3240860 - DNA, 22 bp, Homo sapiens
gtctgctctttctctgccagtg

SEQ ID NO: 3240861 - DNA, 13 bp, Homo sapiens
gtctgctgaggag

SEQ ID NO: 3240862 - DNA, 10 bp, Homo sapiens
gtctggaaag

SEQ ID NO: 3240863 - DNA, 20 bp, Homo sapiens
gtctggaaagtgatgtcaga

SEQ ID NO: 3240864 - DNA, 14 bp, Homo sapiens
gtctggaagtccaa

SEQ ID NO: 3240865 - DNA, 17 bp, Homo sapiens
gtctggaggggcccctg

SEQ ID NO: 3240866 - DNA, 12 bp, Homo sapiens
gtctggagtggg

SEQ ID NO: 3240867 - DNA, 16 bp, Homo sapiens
gtctggagtggtaaca

SEQ ID NO: 3240868 - DNA, 18 bp, Homo sapiens
gtctggagtggtaacagc

SEQ ID NO: 3240869 - DNA, 21 bp, Homo sapiens
gtctggagtggtaacagctct

SEQ ID NO: 3240870 - DNA, 19 bp, Homo sapiens
gtctggctttttcctctga

SEQ ID NO: 3240871 - DNA, 21 bp, Homo sapiens
gtctggctttttcctctgagc

SEQ ID NO: 3240872 - DNA, 14 bp, Homo sapiens
gtctgggacacaaa

SEQ ID NO: 3240873 - DNA, 15 bp, Homo sapiens
gtctgggcctctgac

SEQ ID NO: 3240874 - DNA, 13 bp, Homo sapiens
gtctggtggcccc

SEQ ID NO: 3240875 - DNA, 18 bp, Homo sapiens
gtctggttgggcagccag

SEQ ID NO: 3240876 - DNA, 18 bp, Homo sapiens
gtctgtaatgacaaataa

SEQ ID NO: 3240877 - DNA, 19 bp, Homo sapiens
gtctgtacacgtgtcctgt

SEQ ID NO: 3240878 - DNA, 21 bp, Homo sapiens
gtctgtacacgtgtcctgtag

SEQ ID NO: 3240879 - DNA, 13 bp, Homo sapiens
gtctgtacctcaa

SEQ ID NO: 3240880 - DNA, 20 bp, Homo sapiens
gtctgtaggtgaaagaacaa

SEQ ID NO: 3240881 - DNA, 21 bp, Homo sapiens
gtctgtatttcatgtggctgt

SEQ ID NO: 3240882 - DNA, 16 bp, Homo sapiens
gtctgtcccggggtcc

SEQ ID NO: 3240883 - DNA, 23 bp, Homo sapiens
gtctgtcccggggtcctgtggca

SEQ ID NO: 3240884 - DNA, 19 bp, Homo sapiens
gtctgtcctgatttctaca

SEQ ID NO: 3240885 - DNA, 16 bp, Homo sapiens
gtctgtcgtgatgggg

SEQ ID NO: 3240886 - DNA, 21 bp, Homo sapiens
gtctgtctacatttctgcaga

SEQ ID NO: 3240887 - DNA, 15 bp, Homo sapiens
gtctgtctactgtgg

SEQ ID NO: 3240888 - DNA, 18 bp, Homo sapiens
gtctgtgaacagagagac

SEQ ID NO: 3240889 - DNA, 11 bp, Homo sapiens
gtctgtgaatg

SEQ ID NO: 3240890 - DNA, 16 bp, Homo sapiens
gtctgtgaatgctaag

SEQ ID NO: 3240891 - DNA, 22 bp, Homo sapiens
gtctgtgagatgctagaactcc

SEQ ID NO: 3240892 - DNA, 20 bp, Homo sapiens
gtctgtgagtgcgtctgagg

SEQ ID NO: 3240893 - DNA, 13 bp, Homo sapiens
gtctgtgccatgg

SEQ ID NO: 3240894 - DNA, 15 bp, Homo sapiens
gtctgtgccatggat

SEQ ID NO: 3240895 - DNA, 16 bp, Homo sapiens
gtctgtgctgtgcctg

SEQ ID NO: 3240896 - DNA, 23 bp, Homo sapiens
gtctgtggggaggggttgttttg

SEQ ID NO: 3240897 - DNA, 14 bp, Homo sapiens
gtctgtgtgaatgt

SEQ ID NO: 3240898 - DNA, 21 bp, Homo sapiens
gtctgtgtggcaaattaaaca

SEQ ID NO: 3240899 - DNA, 17 bp, Homo sapiens
gtctgtgttgctgttta

SEQ ID NO: 3240900 - DNA, 19 bp, Homo sapiens
gtctgtgttgctgtttaga

SEQ ID NO: 3240901 - DNA, 16 bp, Homo sapiens
gtctgttggcaggctg

SEQ ID NO: 3240902 - DNA, 14 bp, Homo sapiens
gtctgtttttgtat

SEQ ID NO: 3240903 - DNA, 17 bp, Homo sapiens
gtcttaaactaaatgtg

SEQ ID NO: 3240904 - DNA, 24 bp, Homo sapiens
gtcttaatggtatcctactgagca

SEQ ID NO: 3240905 - DNA, 19 bp, Homo sapiens
gtcttaattattatttgtg

SEQ ID NO: 3240906 - DNA, 16 bp, Homo sapiens
gtcttaatttatttct

SEQ ID NO: 3240907 - DNA, 18 bp, Homo sapiens
gtcttacataaaccattt

SEQ ID NO: 3240908 - DNA, 13 bp, Homo sapiens
gtcttagagcctt

SEQ ID NO: 3240909 - DNA, 20 bp, Homo sapiens
gtcttagagccttttatctg

SEQ ID NO: 3240910 - DNA, 15 bp, Homo sapiens
gtcttaggatgtctg

SEQ ID NO: 3240911 - DNA, 20 bp, Homo sapiens
gtcttatcccccccagcctg

SEQ ID NO: 3240912 - DNA, 14 bp, Homo sapiens
gtcttatgcttcca

SEQ ID NO: 3240913 - DNA, 21 bp, Homo sapiens
gtcttatgcttccattaacaa

SEQ ID NO: 3240914 - DNA, 14 bp, Homo sapiens
gtcttattcttaag

SEQ ID NO: 3240915 - DNA, 14 bp, Homo sapiens
gtcttatttccaag

SEQ ID NO: 3240916 - DNA, 14 bp, Homo sapiens
gtcttatttcctca

SEQ ID NO: 3240917 - DNA, 22 bp, Homo sapiens
gtcttcaacataacccacttgt

SEQ ID NO: 3240918 - DNA, 18 bp, Homo sapiens
gtcttcaacatcctgcca

SEQ ID NO: 3240919 - DNA, 21 bp, Homo sapiens
gtcttcaacatcctgccagcc

SEQ ID NO: 3240920 - DNA, 15 bp, Homo sapiens
gtcttcacctgccac

SEQ ID NO: 3240921 - DNA, 16 bp, Homo sapiens
gtcttcacctgccacc

SEQ ID NO: 3240922 - DNA, 18 bp, Homo sapiens
gtcttcacctgccaccac

SEQ ID NO: 3240923 - DNA, 12 bp, Homo sapiens
gtcttcactctt

SEQ ID NO: 3240924 - DNA, 18 bp, Homo sapiens
gtcttcagcattccctcc

SEQ ID NO: 3240925 - DNA, 13 bp, Homo sapiens
gtcttccaaggag

SEQ ID NO: 3240926 - DNA, 21 bp, Homo sapiens
gtcttccctacctcaggcagg

SEQ ID NO: 3240927 - DNA, 18 bp, Homo sapiens
gtcttccttgtctctgct

SEQ ID NO: 3240928 - DNA, 15 bp, Homo sapiens
gtcttctaactttat

SEQ ID NO: 3240929 - DNA, 23 bp, Homo sapiens
gtcttctaatttcaaaaatataa

SEQ ID NO: 3240930 - DNA, 13 bp, Homo sapiens
gtcttctctgtct

SEQ ID NO: 3240931 - DNA, 16 bp, Homo sapiens
gtcttctctgtctcag

SEQ ID NO: 3240932 - DNA, 17 bp, Homo sapiens
gtcttctggtctgtgtg

SEQ ID NO: 3240933 - DNA, 12 bp, Homo sapiens
gtcttgaaagat

SEQ ID NO: 3240934 - DNA, 17 bp, Homo sapiens
gtcttgaactcctggcc

SEQ ID NO: 3240935 - DNA, 21 bp, Homo sapiens
gtcttgaactcctggcctcaa

SEQ ID NO: 3240936 - DNA, 17 bp, Homo sapiens
gtcttgaatgtcttttg

SEQ ID NO: 3240937 - DNA, 19 bp, Homo sapiens
gtcttgagccagtaatctt

SEQ ID NO: 3240938 - DNA, 16 bp, Homo sapiens
gtcttgcaatggcagc

SEQ ID NO: 3240939 - DNA, 19 bp, Homo sapiens
gtcttgcaatggcagcctt

SEQ ID NO: 3240940 - DNA, 23 bp, Homo sapiens
gtcttgcaatggcagccttggca

SEQ ID NO: 3240941 - DNA, 15 bp, Homo sapiens
gtcttggcggcagca

SEQ ID NO: 3240942 - DNA, 18 bp, Homo sapiens
gtcttggcggcagcagcc

SEQ ID NO: 3240943 - DNA, 23 bp, Homo sapiens
gtcttggcggcagcagccatcat

SEQ ID NO: 3240944 - DNA, 20 bp, Homo sapiens
gtcttgggcagagctggctc

SEQ ID NO: 3240945 - DNA, 20 bp, Homo sapiens
gtcttggggccactttcaga

SEQ ID NO: 3240946 - DNA, 17 bp, Homo sapiens
gtcttggtgccttttgt

SEQ ID NO: 3240947 - DNA, 15 bp, Homo sapiens
gtcttgtacatgtgt

SEQ ID NO: 3240948 - DNA, 15 bp, Homo sapiens
gtcttgtacttctgt

SEQ ID NO: 3240949 - DNA, 17 bp, Homo sapiens
gtcttgttagaaaacaa

SEQ ID NO: 3240950 - DNA, 18 bp, Homo sapiens
gtcttgttctgtcccttc

SEQ ID NO: 3240951 - DNA, 22 bp, Homo sapiens
gtcttgttttttttttccactt

SEQ ID NO: 3240952 - DNA, 18 bp, Homo sapiens
gtctttaaaggcccagcc

SEQ ID NO: 3240953 - DNA, 23 bp, Homo sapiens
gtctttaatttctgtcagaatgc

SEQ ID NO: 3240954 - DNA, 21 bp, Homo sapiens
gtctttatgagctaaaaatat

SEQ ID NO: 3240955 - DNA, 19 bp, Homo sapiens
gtctttcccatggggaggg

SEQ ID NO: 3240956 - DNA, 21 bp, Homo sapiens
gtctttcctcctaccttttgt

SEQ ID NO: 3240957 - DNA, 18 bp, Homo sapiens
gtctttctaatgtagcta

SEQ ID NO: 3240958 - DNA, 13 bp, Homo sapiens
gtctttctggaga

SEQ ID NO: 3240959 - DNA, 15 bp, Homo sapiens
gtctttctttggtgc

SEQ ID NO: 3240960 - DNA, 22 bp, Homo sapiens
gtctttctttggtgcctttcct

SEQ ID NO: 3240961 - DNA, 22 bp, Homo sapiens
gtctttgtaagagtgtagaagc

SEQ ID NO: 3240962 - DNA, 16 bp, Homo sapiens
gtcttttctgctgagg

SEQ ID NO: 3240963 - DNA, 14 bp, Homo sapiens
gtcttttgacatgt

SEQ ID NO: 3240964 - DNA, 16 bp, Homo sapiens
gtcttttgacatgtgg

SEQ ID NO: 3240965 - DNA, 19 bp, Homo sapiens
gtcttttgacatgtggaaa

SEQ ID NO: 3240966 - DNA, 13 bp, Homo sapiens
gtcttttgctttt

SEQ ID NO: 3240967 - DNA, 15 bp, Homo sapiens
gtcttttgttcgcat

SEQ ID NO: 3240968 - DNA, 17 bp, Homo sapiens
gtctttttctgttgtaa

SEQ ID NO: 3240969 - DNA, 19 bp, Homo sapiens
gtctttttctgttgtaact

SEQ ID NO: 3240970 - DNA, 15 bp, Homo sapiens
gtctttttgtttggg

SEQ ID NO: 3240971 - DNA, 15 bp, Homo sapiens
gtcttttttttcctg

SEQ ID NO: 3240972 - DNA, 19 bp, Homo sapiens
gtgaaaagtccttgattgt

SEQ ID NO: 3240973 - DNA, 16 bp, Homo sapiens
gtgaaaatatacttga

SEQ ID NO: 3240974 - DNA, 20 bp, Homo sapiens
gtgaaaatatacttgactct

SEQ ID NO: 3240975 - DNA, 14 bp, Homo sapiens
gtgaaaatgaagaa

SEQ ID NO: 3240976 - DNA, 20 bp, Homo sapiens
gtgaaaatttttacattcat

SEQ ID NO: 3240977 - DNA, 19 bp, Homo sapiens
gtgaaacaatgttgtccaa

SEQ ID NO: 3240978 - DNA, 14 bp, Homo sapiens
gtgctaaggttcta

SEQ ID NO: 3240979 - DNA, 16 bp, Homo sapiens
gtgctaaggttctaag

SEQ ID NO: 3240980 - DNA, 17 bp, Homo sapiens
gtgctaataacagtgca

SEQ ID NO: 3240981 - DNA, 19 bp, Homo sapiens
gtgctagaatactttttaa

SEQ ID NO: 3240982 - DNA, 16 bp, Homo sapiens
gtgctaggggatgagg

SEQ ID NO: 3240983 - DNA, 13 bp, Homo sapiens
gtgctatatatat

SEQ ID NO: 3240984 - DNA, 13 bp, Homo sapiens
gtgctatgaattt

SEQ ID NO: 3240985 - DNA, 15 bp, Homo sapiens
gtgctatttgaagaa

SEQ ID NO: 3240986 - DNA, 19 bp, Homo sapiens
gtgctatttgaagaaaaaa

SEQ ID NO: 3240987 - DNA, 21 bp, Homo sapiens
gtgctattttgtttgttttgt

SEQ ID NO: 3240988 - DNA, 21 bp, Homo sapiens
gtgctcacgctcccccgcagt

SEQ ID NO: 3240989 - DNA, 15 bp, Homo sapiens
gtgctcccgagagat

SEQ ID NO: 3240990 - DNA, 17 bp, Homo sapiens
gtgctccgtgcctccac

SEQ ID NO: 3240991 - DNA, 14 bp, Homo sapiens
gtgctcctgaaaga

SEQ ID NO: 3240992 - DNA, 13 bp, Homo sapiens
gtgctctggacag

SEQ ID NO: 3240993 - DNA, 18 bp, Homo sapiens
gtgctctggacaggcatg

SEQ ID NO: 3240994 - DNA, 13 bp, Homo sapiens
gtgctctggcggc

SEQ ID NO: 3240995 - DNA, 24 bp, Homo sapiens
gtgctctggcggcttcctgtccac

SEQ ID NO: 3240996 - DNA, 13 bp, Homo sapiens
gtgctctttgaag

SEQ ID NO: 3240997 - DNA, 14 bp, Homo sapiens
gtgctcttttctcc

SEQ ID NO: 3240998 - DNA, 22 bp, Homo sapiens
gtgctgaacaaaaaataaaaat

SEQ ID NO: 3240999 - DNA, 20 bp, Homo sapiens
gtgctgaatggttttcaaaa

SEQ ID NO: 3241000 - DNA, 11 bp, Homo sapiens
gtgctgagctt

SEQ ID NO: 3241001 - DNA, 18 bp, Homo sapiens
gtgctgagcttagccttg

SEQ ID NO: 3241002 - DNA, 20 bp, Homo sapiens
gtgctgatcgtgctaaattt

SEQ ID NO: 3241003 - DNA, 12 bp, Homo sapiens
gtgctgccacac

SEQ ID NO: 3241004 - DNA, 22 bp, Homo sapiens
gtgctgccatccaggttcagct

SEQ ID NO: 3241005 - DNA, 19 bp, Homo sapiens
gtgctgccatgccactgcc

SEQ ID NO: 3241006 - DNA, 11 bp, Homo sapiens
gtgctgccctg

SEQ ID NO: 3241007 - DNA, 14 bp, Homo sapiens
gtgctgccctgtgt

SEQ ID NO: 3241008 - DNA, 18 bp, Homo sapiens
gtgctggaattctaacaa

SEQ ID NO: 3241009 - DNA, 12 bp, Homo sapiens
gtgctggaggat

SEQ ID NO: 3241010 - DNA, 16 bp, Homo sapiens
gtgctggaggtgggag

SEQ ID NO: 3241011 - DNA, 19 bp, Homo sapiens
gtgctggatggagcccagg

SEQ ID NO: 3241012 - DNA, 15 bp, Homo sapiens
gtgctggcaaccact

SEQ ID NO: 3241013 - DNA, 13 bp, Homo sapiens
gtgctggccccca

SEQ ID NO: 3241014 - DNA, 14 bp, Homo sapiens
gtgctggctcacag

SEQ ID NO: 3241015 - DNA, 19 bp, Homo sapiens
gtgctggctcacagtacag

SEQ ID NO: 3241016 - DNA, 20 bp, Homo sapiens
gtgctggctcacagtacagc

SEQ ID NO: 3241017 - DNA, 21 bp, Homo sapiens
gtgctggctcacagtacagca

SEQ ID NO: 3241018 - DNA, 11 bp, Homo sapiens
gtgctgggacc

SEQ ID NO: 3241019 - DNA, 17 bp, Homo sapiens
gtgctgggaggagggag

SEQ ID NO: 3241020 - DNA, 23 bp, Homo sapiens
gtgctgggaggagggagagggag

SEQ ID NO: 3241021 - DNA, 21 bp, Homo sapiens
gtgctgggggaatgagcccag

SEQ ID NO: 3241022 - DNA, 23 bp, Homo sapiens
gtgctgggggaatgagcccagag

SEQ ID NO: 3241023 - DNA, 20 bp, Homo sapiens
gtgctgggtgcctcccacac

SEQ ID NO: 3241024 - DNA, 21 bp, Homo sapiens
gtgctggtctattttgatttt

SEQ ID NO: 3241025 - DNA, 16 bp, Homo sapiens
gtgctggtgtcctgac

SEQ ID NO: 3241026 - DNA, 18 bp, Homo sapiens
gtgctgtccatgcttctc

SEQ ID NO: 3241027 - DNA, 19 bp, Homo sapiens
gtgctgtcttctggtctgt

SEQ ID NO: 3241028 - DNA, 22 bp, Homo sapiens
gtgctgtcttctggtctgtgtg

SEQ ID NO: 3241029 - DNA, 22 bp, Homo sapiens
gtgctgtcttgatgactgctga

SEQ ID NO: 3241030 - DNA, 14 bp, Homo sapiens
gtgctgtgcctgct

SEQ ID NO: 3241031 - DNA, 16 bp, Homo sapiens
gtgctgtgcctgctag

SEQ ID NO: 3241032 - DNA, 16 bp, Homo sapiens
gtgctgtggcatagac

SEQ ID NO: 3241033 - DNA, 11 bp, Homo sapiens
gtgctgtggcc

SEQ ID NO: 3241034 - DNA, 12 bp, Homo sapiens
gtgctgtgggca

SEQ ID NO: 3241035 - DNA, 11 bp, Homo sapiens
gtgctgtgtgt

SEQ ID NO: 3241036 - DNA, 19 bp, Homo sapiens
gtgctgtttattaatctta

SEQ ID NO: 3241037 - DNA, 22 bp, Homo sapiens
gtgcttaagcagaagcattaac

SEQ ID NO: 3241038 - DNA, 13 bp, Homo sapiens
gtgcttaagttcc

SEQ ID NO: 3241039 - DNA, 21 bp, Homo sapiens
gtgcttatcccatagccagga

SEQ ID NO: 3241040 - DNA, 21 bp, Homo sapiens
gtgcttattctcaaagcagga

SEQ ID NO: 3241041 - DNA, 16 bp, Homo sapiens
gtgcttctccccagaa

SEQ ID NO: 3241042 - DNA, 21 bp, Homo sapiens
gtgcttctccccagaattcac

SEQ ID NO: 3241043 - DNA, 14 bp, Homo sapiens
gtgcttgagccagg

SEQ ID NO: 3241044 - DNA, 11 bp, Homo sapiens
gtgcttggatt

SEQ ID NO: 3241045 - DNA, 15 bp, Homo sapiens
gtgcttgggctccac

SEQ ID NO: 3241046 - DNA, 21 bp, Homo sapiens
gtgcttgggtggtgggtgctg

SEQ ID NO: 3241047 - DNA, 23 bp, Homo sapiens
gtgcttggtggggctcgtggcct

SEQ ID NO: 3241048 - DNA, 15 bp, Homo sapiens
gtggaaaaaagagaa

SEQ ID NO: 3241049 - DNA, 12 bp, Homo sapiens
gtggaaaaccag

SEQ ID NO: 3241050 - DNA, 14 bp, Homo sapiens
gtggaaagcctctg

SEQ ID NO: 3241051 - DNA, 15 bp, Homo sapiens
gtggaaagcctctgc

SEQ ID NO: 3241052 - DNA, 23 bp, Homo sapiens
gtggaaagcctctgctgccatgg

SEQ ID NO: 3241053 - DNA, 14 bp, Homo sapiens
gtggaacctctgtc

SEQ ID NO: 3241054 - DNA, 16 bp, Homo sapiens
gtggaactaataaata

SEQ ID NO: 3241055 - DNA, 20 bp, Homo sapiens
gtggaagaagggagaagaaa

SEQ ID NO: 3241056 - DNA, 16 bp, Homo sapiens
gtggaagagcagcctg

SEQ ID NO: 3241057 - DNA, 20 bp, Homo sapiens
gtggaaggcagacagcaggc

SEQ ID NO: 3241058 - DNA, 14 bp, Homo sapiens
gtggaatgagtgtg

SEQ ID NO: 3241059 - DNA, 18 bp, Homo sapiens
gtggaatgagtgtgcatg

SEQ ID NO: 3241060 - DNA, 18 bp, Homo sapiens
gtggaatgcagggaagag

SEQ ID NO: 3241061 - DNA, 17 bp, Homo sapiens
gtggacaaactggagtc

SEQ ID NO: 3241062 - DNA, 24 bp, Homo sapiens
gtggacacagctcttctccaggct

SEQ ID NO: 3241063 - DNA, 13 bp, Homo sapiens
gtggacagtcctg

SEQ ID NO: 3241064 - DNA, 15 bp, Homo sapiens
gtggacagtcctggg

SEQ ID NO: 3241065 - DNA, 21 bp, Homo sapiens
gtggaccttaggccttcctct

SEQ ID NO: 3241066 - DNA, 14 bp, Homo sapiens
gtggactgcgctgg

SEQ ID NO: 3241067 - DNA, 13 bp, Homo sapiens
gtggagactggca

SEQ ID NO: 3241068 - DNA, 19 bp, Homo sapiens
gtggagactggggggcttg

SEQ ID NO: 3241069 - DNA, 16 bp, Homo sapiens
gtggagagctggtgcc

SEQ ID NO: 3241070 - DNA, 17 bp, Homo sapiens
gtggagagctggtgccc

SEQ ID NO: 3241071 - DNA, 20 bp, Homo sapiens
gtggagaggggtgcacccac

SEQ ID NO: 3241072 - DNA, 14 bp, Homo sapiens
gtggagcaaaaggc

SEQ ID NO: 3241073 - DNA, 20 bp, Homo sapiens
gtggagcaaaaggcagctca

SEQ ID NO: 3241074 - DNA, 15 bp, Homo sapiens
gtggagccagggagc

SEQ ID NO: 3241075 - DNA, 16 bp, Homo sapiens
gtggaggaaggattgt

SEQ ID NO: 3241076 - DNA, 16 bp, Homo sapiens
gtggaggaaggtgctg

SEQ ID NO: 3241077 - DNA, 17 bp, Homo sapiens
gtggaggaggaaggcaa

SEQ ID NO: 3241078 - DNA, 14 bp, Homo sapiens
gtggaggcacttta

SEQ ID NO: 3241079 - DNA, 13 bp, Homo sapiens
gtggaggcctgat

SEQ ID NO: 3241080 - DNA, 19 bp, Homo sapiens
gtggaggcctgatgctgcc

SEQ ID NO: 3241081 - DNA, 13 bp, Homo sapiens
gtggaggcttcct

SEQ ID NO: 3241082 - DNA, 15 bp, Homo sapiens
gtggaggcttcctgc

SEQ ID NO: 3241083 - DNA, 13 bp, Homo sapiens
gtggagggcacag

SEQ ID NO: 3241084 - DNA, 16 bp, Homo sapiens
gtggagggcacagccc

SEQ ID NO: 3241085 - DNA, 15 bp, Homo sapiens
gtggaggggccctcc

SEQ ID NO: 3241086 - DNA, 23 bp, Homo sapiens
gtggaggggtgtggcagtggttt

SEQ ID NO: 3241087 - DNA, 18 bp, Homo sapiens
gtggaggtgggctgggcc

SEQ ID NO: 3241088 - DNA, 16 bp, Homo sapiens
gtggatataaaatgtg

SEQ ID NO: 3241089 - DNA, 24 bp, Homo sapiens
gtggatatggtgcagagaagctgg

SEQ ID NO: 3241090 - DNA, 22 bp, Homo sapiens
gtggatcacgaggtcaggagat

SEQ ID NO: 3241091 - DNA, 19 bp, Homo sapiens
gtggatccaaactgatcca

SEQ ID NO: 3241092 - DNA, 20 bp, Homo sapiens
gtggatcccctgcggtcagg

SEQ ID NO: 3241093 - DNA, 23 bp, Homo sapiens
gtggatcccctgcggtcaggctg

SEQ ID NO: 3241094 - DNA, 13 bp, Homo sapiens
gtggatcttcaga

SEQ ID NO: 3241095 - DNA, 20 bp, Homo sapiens
gtggatcttgccacatttct

SEQ ID NO: 3241096 - DNA, 21 bp, Homo sapiens
gtggatcttgccacatttctg

SEQ ID NO: 3241097 - DNA, 13 bp, Homo sapiens
gtggatgactgtt

SEQ ID NO: 3241098 - DNA, 21 bp, Homo sapiens
gtggatgcctggtggcagctg

SEQ ID NO: 3241099 - DNA, 19 bp, Homo sapiens
gtggatgcgcggaggagct

SEQ ID NO: 3241100 - DNA, 19 bp, Homo sapiens
gtggatggccccagcacag

SEQ ID NO: 3241101 - DNA, 12 bp, Homo sapiens
gtggatgggcaa

SEQ ID NO: 3241102 - DNA, 16 bp, Homo sapiens
gtggatgtcttccttg

SEQ ID NO: 3241103 - DNA, 22 bp, Homo sapiens
gtggattataaaaaatgtaaca

SEQ ID NO: 3241104 - DNA, 11 bp, Homo sapiens
gtgtgtgtgtg

SEQ ID NO: 3241105 - DNA, 13 bp, Homo sapiens
gtgtgtgtgtggc

SEQ ID NO: 3241106 - DNA, 15 bp, Homo sapiens
gtgtgttccaactgc

SEQ ID NO: 3241107 - DNA, 18 bp, Homo sapiens
gtgtgttccaactgcccc

SEQ ID NO: 3241108 - DNA, 13 bp, Homo sapiens
gtgtgttggacag

SEQ ID NO: 3241109 - DNA, 14 bp, Homo sapiens
gtgtgttgtctctt

SEQ ID NO: 3241110 - DNA, 13 bp, Homo sapiens
gtgtgttgtcttg

SEQ ID NO: 3241111 - DNA, 16 bp, Homo sapiens
gtgtgttgtcttgaaa

SEQ ID NO: 3241112 - DNA, 14 bp, Homo sapiens
gtgtgtttcacttt

SEQ ID NO: 3241113 - DNA, 20 bp, Homo sapiens
gtgttactaaaaaaaagatg

SEQ ID NO: 3241114 - DNA, 16 bp, Homo sapiens
gtgttattctttgcgt

SEQ ID NO: 3241115 - DNA, 21 bp, Homo sapiens
gtgttatttggaaccttgttt

SEQ ID NO: 3241116 - DNA, 12 bp, Homo sapiens
gtgttcatacat

SEQ ID NO: 3241117 - DNA, 17 bp, Homo sapiens
gtgttcatacatttgag

SEQ ID NO: 3241118 - DNA, 23 bp, Homo sapiens
gtgttcatgctgaatccacctcg

SEQ ID NO: 3241119 - DNA, 22 bp, Homo sapiens
gtgttcatttggtgttcctgga

SEQ ID NO: 3241120 - DNA, 17 bp, Homo sapiens
gtgttcccatttcagct

SEQ ID NO: 3241121 - DNA, 14 bp, Homo sapiens
gtgttcctcctgct

SEQ ID NO: 3241122 - DNA, 11 bp, Homo sapiens
gtgttcctgga

SEQ ID NO: 3241123 - DNA, 20 bp, Homo sapiens
gtgttcctttttaaatgtga

SEQ ID NO: 3241124 - DNA, 14 bp, Homo sapiens
gtgttcgcttggct

SEQ ID NO: 3241125 - DNA, 13 bp, Homo sapiens
gtgttctaagatg

SEQ ID NO: 3241126 - DNA, 16 bp, Homo sapiens
gtgttctccttttcct

SEQ ID NO: 3241127 - DNA, 14 bp, Homo sapiens
gtgttctctcttat

SEQ ID NO: 3241128 - DNA, 22 bp, Homo sapiens
gtgttcttcaagccagctctag

SEQ ID NO: 3241129 - DNA, 16 bp, Homo sapiens
gtgttgaaaatgttca

SEQ ID NO: 3241130 - DNA, 17 bp, Homo sapiens
gtgttgaaaatgttcag

SEQ ID NO: 3241131 - DNA, 18 bp, Homo sapiens
gtgttgactttataaatt

SEQ ID NO: 3241132 - DNA, 14 bp, Homo sapiens
gtgttgaggttttt

SEQ ID NO: 3241133 - DNA, 19 bp, Homo sapiens
gtgttgattttctgttgta

SEQ ID NO: 3241134 - DNA, 17 bp, Homo sapiens
gtgttgccaaatatgtc

SEQ ID NO: 3241135 - DNA, 14 bp, Homo sapiens
gtgttgccaagctc

SEQ ID NO: 3241136 - DNA, 19 bp, Homo sapiens
gtgttgccacagtagaact

SEQ ID NO: 3241137 - DNA, 18 bp, Homo sapiens
gtgttgcgtgtcgtgggt

SEQ ID NO: 3241138 - DNA, 12 bp, Homo sapiens
gtgttggaaaaa

SEQ ID NO: 3241139 - DNA, 14 bp, Homo sapiens
gtgttggacagaga

SEQ ID NO: 3241140 - DNA, 21 bp, Homo sapiens
gtgttggctaatgaagggaaa

SEQ ID NO: 3241141 - DNA, 14 bp, Homo sapiens
gtgttggtctttct

SEQ ID NO: 3241142 - DNA, 12 bp, Homo sapiens
gtgttgtacaat

SEQ ID NO: 3241143 - DNA, 18 bp, Homo sapiens
gtgttgtattaacaaaag

SEQ ID NO: 3241144 - DNA, 15 bp, Homo sapiens
gtgttgtcagcctgt

SEQ ID NO: 3241145 - DNA, 18 bp, Homo sapiens
gtgttgtccttttgtctt

SEQ ID NO: 3241146 - DNA, 12 bp, Homo sapiens
gtgttgtctcta

SEQ ID NO: 3241147 - DNA, 16 bp, Homo sapiens
gtgttgtcttgaaaga

SEQ ID NO: 3241148 - DNA, 17 bp, Homo sapiens
gtgttgttgctctagga

SEQ ID NO: 3241149 - DNA, 19 bp, Homo sapiens
gtgttgttttttgttcaat

SEQ ID NO: 3241150 - DNA, 22 bp, Homo sapiens
gtgtttaaaaagtaagttaata

SEQ ID NO: 3241151 - DNA, 18 bp, Homo sapiens
gtgtttaaagagaggtta

SEQ ID NO: 3241152 - DNA, 18 bp, Homo sapiens
gtgtttacagacagaaga

SEQ ID NO: 3241153 - DNA, 15 bp, Homo sapiens
gtgtttagttgcaga

SEQ ID NO: 3241154 - DNA, 10 bp, Homo sapiens
gtgtttattt

SEQ ID NO: 3241155 - DNA, 16 bp, Homo sapiens
gtgtttatttttcata

SEQ ID NO: 3241156 - DNA, 18 bp, Homo sapiens
gtgtttccatattttata

SEQ ID NO: 3241157 - DNA, 14 bp, Homo sapiens
gtgtttccatctca

SEQ ID NO: 3241158 - DNA, 12 bp, Homo sapiens
gtgtttcccata

SEQ ID NO: 3241159 - DNA, 15 bp, Homo sapiens
gtgtttcccataatt

SEQ ID NO: 3241160 - DNA, 17 bp, Homo sapiens
gtgtttctattgacttc

SEQ ID NO: 3241161 - DNA, 23 bp, Homo sapiens
gtgtttgatggtgccagagaggg

SEQ ID NO: 3241162 - DNA, 17 bp, Homo sapiens
gtgtttgcttgaatgct

SEQ ID NO: 3241163 - DNA, 22 bp, Homo sapiens
gtgtttgggaagcaacaaagag

SEQ ID NO: 3241164 - DNA, 13 bp, Homo sapiens
gtgttttaaattc

SEQ ID NO: 3241165 - DNA, 15 bp, Homo sapiens
gtgttttaattccaa

SEQ ID NO: 3241166 - DNA, 14 bp, Homo sapiens
gtgttttactgtca

SEQ ID NO: 3241167 - DNA, 21 bp, Homo sapiens
gtgttttataggagagattgg

SEQ ID NO: 3241168 - DNA, 12 bp, Homo sapiens
gtgttttcagag

SEQ ID NO: 3241169 - DNA, 13 bp, Homo sapiens
gtgttttcataat

SEQ ID NO: 3241170 - DNA, 16 bp, Homo sapiens
gtgttttcataataaa

SEQ ID NO: 3241171 - DNA, 20 bp, Homo sapiens
gtgttttgaaagaatagaac

SEQ ID NO: 3241172 - DNA, 14 bp, Homo sapiens
gtgtttttctccag

SEQ ID NO: 3241173 - DNA, 15 bp, Homo sapiens
gtgtttttgaaatat

SEQ ID NO: 3241174 - DNA, 12 bp, Homo sapiens
gttaaaaaggcc

SEQ ID NO: 3241175 - DNA, 11 bp, Homo sapiens
gttaaaaataa

SEQ ID NO: 3241176 - DNA, 21 bp, Homo sapiens
gttaaaaatggctcaagtaga

SEQ ID NO: 3241177 - DNA, 19 bp, Homo sapiens
gttaaaactgtacatttaa

SEQ ID NO: 3241178 - DNA, 23 bp, Homo sapiens
gttaaaactgtacatttaaaatt

SEQ ID NO: 3241179 - DNA, 19 bp, Homo sapiens
gttaaaatgtgaggaagaa

SEQ ID NO: 3241180 - DNA, 23 bp, Homo sapiens
gttaaacagtagttgtattcttc

SEQ ID NO: 3241181 - DNA, 21 bp, Homo sapiens
gttaaactaaaaaaaaaaagg

SEQ ID NO: 3241182 - DNA, 22 bp, Homo sapiens
gttaaactaaaaaaaaaaaggc

SEQ ID NO: 3241183 - DNA, 12 bp, Homo sapiens
gttaaactgtta

SEQ ID NO: 3241184 - DNA, 11 bp, Homo sapiens
gttaaagcaga

SEQ ID NO: 3241185 - DNA, 15 bp, Homo sapiens
gttaaatactgtgca

SEQ ID NO: 3241186 - DNA, 22 bp, Homo sapiens
gttaaatactgtgcagaataat

SEQ ID NO: 3241187 - DNA, 18 bp, Homo sapiens
gttaaatttgtaagtttc

SEQ ID NO: 3241188 - DNA, 19 bp, Homo sapiens
gttaaatttgtaagtttca

SEQ ID NO: 3241189 - DNA, 22 bp, Homo sapiens
gttaacaaggaatgcctgtgcc

SEQ ID NO: 3241190 - DNA, 23 bp, Homo sapiens
gttaacaaggaatgcctgtgcca

SEQ ID NO: 3241191 - DNA, 18 bp, Homo sapiens
gttaacaataaagtgaca

SEQ ID NO: 3241192 - DNA, 19 bp, Homo sapiens
gttaacaataaagtgacaa

SEQ ID NO: 3241193 - DNA, 23 bp, Homo sapiens
gttaacagagacagataactctc

SEQ ID NO: 3241194 - DNA, 15 bp, Homo sapiens
gttaacattgaccaa

SEQ ID NO: 3241195 - DNA, 23 bp, Homo sapiens
gttaacattgaccaagaactgca

SEQ ID NO: 3241196 - DNA, 18 bp, Homo sapiens
gttaaccttgaagtgact

SEQ ID NO: 3241197 - DNA, 19 bp, Homo sapiens
gttaacctttttgtaaata

SEQ ID NO: 3241198 - DNA, 22 bp, Homo sapiens
gttaactatgacagatatattt

SEQ ID NO: 3241199 - DNA, 15 bp, Homo sapiens
gttaacttggtcaga

SEQ ID NO: 3241200 - DNA, 22 bp, Homo sapiens
gttaagagtgggggagagcagg

SEQ ID NO: 3241201 - DNA, 15 bp, Homo sapiens
gttaagataacttac

SEQ ID NO: 3241202 - DNA, 16 bp, Homo sapiens
gttaagatacagtgta

SEQ ID NO: 3241203 - DNA, 16 bp, Homo sapiens
gttaaggaaactctta

SEQ ID NO: 3241204 - DNA, 19 bp, Homo sapiens
gttaaggaaactcttatct

SEQ ID NO: 3241205 - DNA, 21 bp, Homo sapiens
gttaaggaaactcttatctca

SEQ ID NO: 3241206 - DNA, 22 bp, Homo sapiens
gttaaggaccgtggccctgccc

SEQ ID NO: 3241207 - DNA, 12 bp, Homo sapiens
gttaaggacttc

SEQ ID NO: 3241208 - DNA, 14 bp, Homo sapiens
gttaaggttgaact

SEQ ID NO: 3241209 - DNA, 19 bp, Homo sapiens
gttaatacacagtacttta

SEQ ID NO: 3241210 - DNA, 13 bp, Homo sapiens
gttaatattttgt

SEQ ID NO: 3241211 - DNA, 19 bp, Homo sapiens
gttaatgactctttctgaa

SEQ ID NO: 3241212 - DNA, 13 bp, Homo sapiens
gttaatgagccat

SEQ ID NO: 3241213 - DNA, 22 bp, Homo sapiens
gttaatgatggttgatgggttc

SEQ ID NO: 3241214 - DNA, 22 bp, Homo sapiens
gttaatgctctatgtttgtatt

SEQ ID NO: 3241215 - DNA, 22 bp, Homo sapiens
gttaatgtatttgttcatgttt

SEQ ID NO: 3241216 - DNA, 15 bp, Homo sapiens
gttaattatgtgcat

SEQ ID NO: 3241217 - DNA, 19 bp, Homo sapiens
gttaattccaattatatga

SEQ ID NO: 3241218 - DNA, 15 bp, Homo sapiens
gttaattcctatgaa

SEQ ID NO: 3241219 - DNA, 12 bp, Homo sapiens
gttaattttacc

SEQ ID NO: 3241220 - DNA, 17 bp, Homo sapiens
gttaattttgaagtgct

SEQ ID NO: 3241221 - DNA, 22 bp, Homo sapiens
gttaattttgaagtgctgttta

SEQ ID NO: 3241222 - DNA, 14 bp, Homo sapiens
gttaatttttccaa

SEQ ID NO: 3241223 - DNA, 19 bp, Homo sapiens
gttacaaactgcaatagag

SEQ ID NO: 3241224 - DNA, 17 bp, Homo sapiens
gttacaacttgtatttc

SEQ ID NO: 3241225 - DNA, 13 bp, Homo sapiens
gttacaagtatac

SEQ ID NO: 3241226 - DNA, 22 bp, Homo sapiens
gttacaagtatacttatatttc

SEQ ID NO: 3241227 - DNA, 15 bp, Homo sapiens
gttacactaaaaggt

SEQ ID NO: 3241228 - DNA, 13 bp, Homo sapiens
gttacagagacct

SEQ ID NO: 3241229 - DNA, 17 bp, Homo sapiens
gttacagagacctatgt

SEQ ID NO: 3241230 - DNA, 21 bp, Homo sapiens
gttacagcctgttagtaacat

SEQ ID NO: 3241231 - DNA, 23 bp, Homo sapiens
gttgatttttttttttttttcct

SEQ ID NO: 3241232 - DNA, 19 bp, Homo sapiens
gttgcagatgtattgactg

SEQ ID NO: 3241233 - DNA, 17 bp, Homo sapiens
gttgcagtgagccgaga

SEQ ID NO: 3241234 - DNA, 19 bp, Homo sapiens
gttgccaaagttttgctgt

SEQ ID NO: 3241235 - DNA, 19 bp, Homo sapiens
gttgccaaatatgtcctgg

SEQ ID NO: 3241236 - DNA, 21 bp, Homo sapiens
gttgccaaatatgtcctgggg

SEQ ID NO: 3241237 - DNA, 14 bp, Homo sapiens
gttgccaagacaaa

SEQ ID NO: 3241238 - DNA, 15 bp, Homo sapiens
gttgccaagacaaat

SEQ ID NO: 3241239 - DNA, 20 bp, Homo sapiens
gttgccaagacaaatcaaca

SEQ ID NO: 3241240 - DNA, 21 bp, Homo sapiens
gttgccacatttagtcctgta

SEQ ID NO: 3241241 - DNA, 21 bp, Homo sapiens
gttgccaccacctctgtggca

SEQ ID NO: 3241242 - DNA, 23 bp, Homo sapiens
gttgccatcctaccgtcttttcc

SEQ ID NO: 3241243 - DNA, 15 bp, Homo sapiens
gttgcccaggcaggt

SEQ ID NO: 3241244 - DNA, 17 bp, Homo sapiens
gttgcccaggcaggtct

SEQ ID NO: 3241245 - DNA, 19 bp, Homo sapiens
gttgcccaggcaggtcttg

SEQ ID NO: 3241246 - DNA, 23 bp, Homo sapiens
gttgcccaggcaggtcttgaact

SEQ ID NO: 3241247 - DNA, 14 bp, Homo sapiens
gttgcccaggctgg

SEQ ID NO: 3241248 - DNA, 15 bp, Homo sapiens
gttgcccaggctggc

SEQ ID NO: 3241249 - DNA, 17 bp, Homo sapiens
gttgcccaggctggcgt

SEQ ID NO: 3241250 - DNA, 20 bp, Homo sapiens
gttgccctagcccagactct

SEQ ID NO: 3241251 - DNA, 18 bp, Homo sapiens
gttgcctaagcattgcct

SEQ ID NO: 3241252 - DNA, 21 bp, Homo sapiens
gttgcctaagcattgcctggc

SEQ ID NO: 3241253 - DNA, 14 bp, Homo sapiens
gttgcctaattgga

SEQ ID NO: 3241254 - DNA, 15 bp, Homo sapiens
gttgcctaattggaa

SEQ ID NO: 3241255 - DNA, 15 bp, Homo sapiens
gttgcctgaaaaatg

SEQ ID NO: 3241256 - DNA, 18 bp, Homo sapiens
gttgccttaaagaaagtc

SEQ ID NO: 3241257 - DNA, 15 bp, Homo sapiens
gttgcctttatttgc

SEQ ID NO: 3241258 - DNA, 16 bp, Homo sapiens
gttgcgacggagagaa

SEQ ID NO: 3241259 - DNA, 17 bp, Homo sapiens
gttgcgacggagagaaa

SEQ ID NO: 3241260 - DNA, 22 bp, Homo sapiens
gttgctcagtctccctttccct

SEQ ID NO: 3241261 - DNA, 21 bp, Homo sapiens
gttgctgatgggtagtacctg

SEQ ID NO: 3241262 - DNA, 15 bp, Homo sapiens
gttgctggttgctgt

SEQ ID NO: 3241263 - DNA, 18 bp, Homo sapiens
gttgctggttgctgtgtg

SEQ ID NO: 3241264 - DNA, 14 bp, Homo sapiens
gttgctggttggat

SEQ ID NO: 3241265 - DNA, 14 bp, Homo sapiens
gttgctgtcactgt

SEQ ID NO: 3241266 - DNA, 19 bp, Homo sapiens
gttgctgtcataagaatga

SEQ ID NO: 3241267 - DNA, 19 bp, Homo sapiens
gttgctgtgtttaatttga

SEQ ID NO: 3241268 - DNA, 22 bp, Homo sapiens
gttgcttagatgagggtgactg

SEQ ID NO: 3241269 - DNA, 13 bp, Homo sapiens
gttgcttgtcttc

SEQ ID NO: 3241270 - DNA, 15 bp, Homo sapiens
gttggaagaggaaca

SEQ ID NO: 3241271 - DNA, 18 bp, Homo sapiens
gttggaaggggccttgct

SEQ ID NO: 3241272 - DNA, 14 bp, Homo sapiens
gttggaccccagag

SEQ ID NO: 3241273 - DNA, 17 bp, Homo sapiens
gttggaccccagagatt

SEQ ID NO: 3241274 - DNA, 13 bp, Homo sapiens
gttggactaaatg

SEQ ID NO: 3241275 - DNA, 21 bp, Homo sapiens
gttggacttttcgttaacatt

SEQ ID NO: 3241276 - DNA, 18 bp, Homo sapiens
gttggagctcattctgtc

SEQ ID NO: 3241277 - DNA, 18 bp, Homo sapiens
gttggagtactatattta

SEQ ID NO: 3241278 - DNA, 20 bp, Homo sapiens
gttggatttgctcattgctg

SEQ ID NO: 3241279 - DNA, 11 bp, Homo sapiens
gttggcacaga

SEQ ID NO: 3241280 - DNA, 19 bp, Homo sapiens
gttggcactcacagacctg

SEQ ID NO: 3241281 - DNA, 13 bp, Homo sapiens
gttggcagagaag

SEQ ID NO: 3241282 - DNA, 14 bp, Homo sapiens
gttggcagagaagg

SEQ ID NO: 3241283 - DNA, 20 bp, Homo sapiens
gttggcagagaaggcctctt

SEQ ID NO: 3241284 - DNA, 14 bp, Homo sapiens
gttggcaggctggc

SEQ ID NO: 3241285 - DNA, 22 bp, Homo sapiens
gttggcagtgagtgagcctggc

SEQ ID NO: 3241286 - DNA, 19 bp, Homo sapiens
gttggcatagctctggggt

SEQ ID NO: 3241287 - DNA, 15 bp, Homo sapiens
gttggccaggctggt

SEQ ID NO: 3241288 - DNA, 18 bp, Homo sapiens
gttggccaggctggtcta

SEQ ID NO: 3241289 - DNA, 19 bp, Homo sapiens
gttggccaggctggtctca

SEQ ID NO: 3241290 - DNA, 13 bp, Homo sapiens
gttggcccctgcc

SEQ ID NO: 3241291 - DNA, 14 bp, Homo sapiens
gttggcccctgccc

SEQ ID NO: 3241292 - DNA, 23 bp, Homo sapiens
gttggcctcagggccaggaagga

SEQ ID NO: 3241293 - DNA, 14 bp, Homo sapiens
gttggctatttgaa

SEQ ID NO: 3241294 - DNA, 14 bp, Homo sapiens
gttggctggatgaa

SEQ ID NO: 3241295 - DNA, 15 bp, Homo sapiens
gttgggagcctagct

SEQ ID NO: 3241296 - DNA, 16 bp, Homo sapiens
gttgggagcctagctc

SEQ ID NO: 3241297 - DNA, 21 bp, Homo sapiens
gttgggatactgcagggccag

SEQ ID NO: 3241298 - DNA, 16 bp, Homo sapiens
gttgggattcctgacc

SEQ ID NO: 3241299 - DNA, 21 bp, Homo sapiens
gttgggattcctgacccaggc

SEQ ID NO: 3241300 - DNA, 14 bp, Homo sapiens
gttgggcagccaga

SEQ ID NO: 3241301 - DNA, 22 bp, Homo sapiens
gttgggcagggtgaccctgaag

SEQ ID NO: 3241302 - DNA, 13 bp, Homo sapiens
gttgggcccagat

SEQ ID NO: 3241303 - DNA, 13 bp, Homo sapiens
gttggggtgacag

SEQ ID NO: 3241304 - DNA, 15 bp, Homo sapiens
gttggggtgacagtc

SEQ ID NO: 3241305 - DNA, 19 bp, Homo sapiens
gttggggtgacagtcatca

SEQ ID NO: 3241306 - DNA, 21 bp, Homo sapiens
gttggtctttctaatgtagct

SEQ ID NO: 3241307 - DNA, 12 bp, Homo sapiens
gttggtgactga

SEQ ID NO: 3241308 - DNA, 15 bp, Homo sapiens
gttggtgctgatgga

SEQ ID NO: 3241309 - DNA, 19 bp, Homo sapiens
gttggtggcagtgacttct

SEQ ID NO: 3241310 - DNA, 18 bp, Homo sapiens
gttggtggggccaggcca

SEQ ID NO: 3241311 - DNA, 18 bp, Homo sapiens
gttggtgttccacgtgtt

SEQ ID NO: 3241312 - DNA, 12 bp, Homo sapiens
gttggtgttcct

SEQ ID NO: 3241313 - DNA, 19 bp, Homo sapiens
gttggttccaagccctgga

SEQ ID NO: 3241314 - DNA, 14 bp, Homo sapiens
gttggtttgtatga

SEQ ID NO: 3241315 - DNA, 13 bp, Homo sapiens
gttgtaaaaagaa

SEQ ID NO: 3241316 - DNA, 14 bp, Homo sapiens
gttgtaaatattta

SEQ ID NO: 3241317 - DNA, 12 bp, Homo sapiens
gttgtaacttat

SEQ ID NO: 3241318 - DNA, 19 bp, Homo sapiens
gttgtaacttatgtagata

SEQ ID NO: 3241319 - DNA, 21 bp, Homo sapiens
gttgtacaaatgtattttgaa

SEQ ID NO: 3241320 - DNA, 16 bp, Homo sapiens
gttgtacatttatgat

SEQ ID NO: 3241321 - DNA, 14 bp, Homo sapiens
gttgtataatttcg

SEQ ID NO: 3241322 - DNA, 23 bp, Homo sapiens
gttgtatggctgagcaagagaga

SEQ ID NO: 3241323 - DNA, 23 bp, Homo sapiens
gttgtatgggattggtgggctga

SEQ ID NO: 3241324 - DNA, 21 bp, Homo sapiens
gttgtatttctatatttattt

SEQ ID NO: 3241325 - DNA, 16 bp, Homo sapiens
gttgtcagcctgtgct

SEQ ID NO: 3241326 - DNA, 20 bp, Homo sapiens
gttgtctattctgagccttg

SEQ ID NO: 3241327 - DNA, 21 bp, Homo sapiens
gttgtgatagctaacatttta

SEQ ID NO: 3241328 - DNA, 12 bp, Homo sapiens
gttgtgggcttt

SEQ ID NO: 3241329 - DNA, 16 bp, Homo sapiens
gttgtgggtgggagag

SEQ ID NO: 3241330 - DNA, 14 bp, Homo sapiens
gttgtggttaatct

SEQ ID NO: 3241331 - DNA, 14 bp, Homo sapiens
gttgtgtatagatg

SEQ ID NO: 3241332 - DNA, 18 bp, Homo sapiens
gttgttaatgaaaatgtc

SEQ ID NO: 3241333 - DNA, 22 bp, Homo sapiens
gttgttaccaaatacacatttc

SEQ ID NO: 3241334 - DNA, 13 bp, Homo sapiens
gttgttcaactat

SEQ ID NO: 3241335 - DNA, 16 bp, Homo sapiens
gttgttccaaatgtgt

SEQ ID NO: 3241336 - DNA, 18 bp, Homo sapiens
gttgttccattttatgca

SEQ ID NO: 3241337 - DNA, 19 bp, Homo sapiens
gttgttgcaccatctgctt

SEQ ID NO: 3241338 - DNA, 24 bp, Homo sapiens
gttgttgttaatgaaaatgtcaga

SEQ ID NO: 3241339 - DNA, 14 bp, Homo sapiens
gttgtttctgttcc

SEQ ID NO: 3241340 - DNA, 14 bp, Homo sapiens
gttgtttctttcta

SEQ ID NO: 3241341 - DNA, 21 bp, Homo sapiens
gttgttttgggtgaatcttga

SEQ ID NO: 3241342 - DNA, 19 bp, Homo sapiens
gttgttttttgaaaacatg

SEQ ID NO: 3241343 - DNA, 16 bp, Homo sapiens
gttgttttttgttcaa

SEQ ID NO: 3241344 - DNA, 21 bp, Homo sapiens
gtttaaaataaaatgaaaatt

SEQ ID NO: 3241345 - DNA, 13 bp, Homo sapiens
gtttaaaatgtaa

SEQ ID NO: 3241346 - DNA, 21 bp, Homo sapiens
gtttaaaatgtaatttaaatg

SEQ ID NO: 3241347 - DNA, 22 bp, Homo sapiens
gtttaaacacttatcttctgga

SEQ ID NO: 3241348 - DNA, 12 bp, Homo sapiens
gtttaaactgat

SEQ ID NO: 3241349 - DNA, 13 bp, Homo sapiens
gtttaaagaaagt

SEQ ID NO: 3241350 - DNA, 17 bp, Homo sapiens
gtttaaagaaagtgtat

SEQ ID NO: 3241351 - DNA, 18 bp, Homo sapiens
gtttaaagagtctagatt

SEQ ID NO: 3241352 - DNA, 13 bp, Homo sapiens
gtttaaagttctg

SEQ ID NO: 3241353 - DNA, 17 bp, Homo sapiens
gtttaaagttctgtgta

SEQ ID NO: 3241354 - DNA, 21 bp, Homo sapiens
gtttaaagttctgtgtattta

SEQ ID NO: 3241355 - DNA, 22 bp, Homo sapiens
gtttaacatttgccttgcagaa

SEQ ID NO: 3241356 - DNA, 20 bp, Homo sapiens
gtttaactgcagttgacttt

SEQ ID NO: 3241357 - DNA, 19 bp, Homo sapiens
taaaaccttgttctatttt

SEQ ID NO: 3241358 - DNA, 22 bp, Homo sapiens
taaaaccttgttctatttttca

SEQ ID NO: 3241359 - DNA, 20 bp, Homo sapiens
taaaacgctgtcaaaagttg

SEQ ID NO: 3241360 - DNA, 17 bp, Homo sapiens
taaaactaaatttcact

SEQ ID NO: 3241361 - DNA, 23 bp, Homo sapiens
taaaactaggtaatgttttgtat

SEQ ID NO: 3241362 - DNA, 14 bp, Homo sapiens
taaaactcaacatt

SEQ ID NO: 3241363 - DNA, 19 bp, Homo sapiens
taaaactgcacagtgctgt

SEQ ID NO: 3241364 - DNA, 12 bp, Homo sapiens
taaaactgcttt

SEQ ID NO: 3241365 - DNA, 16 bp, Homo sapiens
taaaactggcatctga

SEQ ID NO: 3241366 - DNA, 16 bp, Homo sapiens
taaaactggcctgact

SEQ ID NO: 3241367 - DNA, 16 bp, Homo sapiens
taaaactttatgtact

SEQ ID NO: 3241368 - DNA, 13 bp, Homo sapiens
taaaagaaaattt

SEQ ID NO: 3241369 - DNA, 14 bp, Homo sapiens
taaaagaaaatttt

SEQ ID NO: 3241370 - DNA, 17 bp, Homo sapiens
taaaagaacagtaaaca

SEQ ID NO: 3241371 - DNA, 18 bp, Homo sapiens
taaaagaacttactgatt

SEQ ID NO: 3241372 - DNA, 12 bp, Homo sapiens
taaaagaattgc

SEQ ID NO: 3241373 - DNA, 23 bp, Homo sapiens
taaaagataacaagatctttcag

SEQ ID NO: 3241374 - DNA, 20 bp, Homo sapiens
taaaagcacaagtacttttg

SEQ ID NO: 3241375 - DNA, 14 bp, Homo sapiens
taaaagcacaatca

SEQ ID NO: 3241376 - DNA, 21 bp, Homo sapiens
taaaagcagcatctgctaata

SEQ ID NO: 3241377 - DNA, 14 bp, Homo sapiens
taaaagcattgtct

SEQ ID NO: 3241378 - DNA, 22 bp, Homo sapiens
taaaagccaaccttcaaagaaa

SEQ ID NO: 3241379 - DNA, 14 bp, Homo sapiens
taaaagcctgctca

SEQ ID NO: 3241380 - DNA, 20 bp, Homo sapiens
taaaagcgttggatgtagca

SEQ ID NO: 3241381 - DNA, 14 bp, Homo sapiens
taaaagctataaag

SEQ ID NO: 3241382 - DNA, 12 bp, Homo sapiens
taaaaggagcca

SEQ ID NO: 3241383 - DNA, 18 bp, Homo sapiens
taaaaggatagtattttt

SEQ ID NO: 3241384 - DNA, 13 bp, Homo sapiens
taaaaggattaat

SEQ ID NO: 3241385 - DNA, 19 bp, Homo sapiens
taaaaggcaaatgtgtaca

SEQ ID NO: 3241386 - DNA, 15 bp, Homo sapiens
taaaagggatacaca

SEQ ID NO: 3241387 - DNA, 15 bp, Homo sapiens
taaaaggtaatgtgt

SEQ ID NO: 3241388 - DNA, 18 bp, Homo sapiens
taaaaggtagagtcttac

SEQ ID NO: 3241389 - DNA, 21 bp, Homo sapiens
taaaaggttcagggaaccgtt

SEQ ID NO: 3241390 - DNA, 16 bp, Homo sapiens
taaaagtaaaatgtct

SEQ ID NO: 3241391 - DNA, 17 bp, Homo sapiens
taaaagtaaaattgttt

SEQ ID NO: 3241392 - DNA, 21 bp, Homo sapiens
taaaagtactttaaaaaggaa

SEQ ID NO: 3241393 - DNA, 14 bp, Homo sapiens
taaaagtagtaaat

SEQ ID NO: 3241394 - DNA, 12 bp, Homo sapiens
taaaagtattca

SEQ ID NO: 3241395 - DNA, 14 bp, Homo sapiens
taaaagtattcata

SEQ ID NO: 3241396 - DNA, 23 bp, Homo sapiens
taaaagtgaatgaaagattaaac

SEQ ID NO: 3241397 - DNA, 19 bp, Homo sapiens
taaaagtgggcttgattct

SEQ ID NO: 3241398 - DNA, 23 bp, Homo sapiens
taaaagtgggcttgattctgcag

SEQ ID NO: 3241399 - DNA, 14 bp, Homo sapiens
taaaagttgtgatt

SEQ ID NO: 3241400 - DNA, 18 bp, Homo sapiens
taaaagtttcaatgtgat

SEQ ID NO: 3241401 - DNA, 20 bp, Homo sapiens
taaaagtttgaaaagcaata

SEQ ID NO: 3241402 - DNA, 20 bp, Homo sapiens
taaaataaaatgaaaattgt

SEQ ID NO: 3241403 - DNA, 21 bp, Homo sapiens
taaaataaaatgaaaattgta

SEQ ID NO: 3241404 - DNA, 23 bp, Homo sapiens
taaaataaaccaaatatgttaaa

SEQ ID NO: 3241405 - DNA, 13 bp, Homo sapiens
taaaataaagtat

SEQ ID NO: 3241406 - DNA, 12 bp, Homo sapiens
taaaataaatgg

SEQ ID NO: 3241407 - DNA, 21 bp, Homo sapiens
taaaataagcaggtggatcta

SEQ ID NO: 3241408 - DNA, 15 bp, Homo sapiens
taaaataatgggatt

SEQ ID NO: 3241409 - DNA, 17 bp, Homo sapiens
taaaataattctaaagg

SEQ ID NO: 3241410 - DNA, 18 bp, Homo sapiens
taaaataatttctctaca

SEQ ID NO: 3241411 - DNA, 16 bp, Homo sapiens
taaaatacacaacaca

SEQ ID NO: 3241412 - DNA, 16 bp, Homo sapiens
taaaatacatttaaaa

SEQ ID NO: 3241413 - DNA, 23 bp, Homo sapiens
taaaatactctagcctgggccag

SEQ ID NO: 3241414 - DNA, 21 bp, Homo sapiens
taaaatacttttactctgcct

SEQ ID NO: 3241415 - DNA, 14 bp, Homo sapiens
taaaatagcttgta

SEQ ID NO: 3241416 - DNA, 19 bp, Homo sapiens
taaaataggggatatttaa

SEQ ID NO: 3241417 - DNA, 14 bp, Homo sapiens
taaaatatctatat

SEQ ID NO: 3241418 - DNA, 12 bp, Homo sapiens
taaaatatttat

SEQ ID NO: 3241419 - DNA, 15 bp, Homo sapiens
taaaatatttatctg

SEQ ID NO: 3241420 - DNA, 19 bp, Homo sapiens
taaaatatttgaatgaaaa

SEQ ID NO: 3241421 - DNA, 19 bp, Homo sapiens
taaaatcaatttttaggaa

SEQ ID NO: 3241422 - DNA, 17 bp, Homo sapiens
taaaatcactaacatta

SEQ ID NO: 3241423 - DNA, 18 bp, Homo sapiens
taaaatcactaacattat

SEQ ID NO: 3241424 - DNA, 18 bp, Homo sapiens
taaaatcactctcagtgc

SEQ ID NO: 3241425 - DNA, 20 bp, Homo sapiens
taaaatccaaaatgaatgca

SEQ ID NO: 3241426 - DNA, 17 bp, Homo sapiens
taaaatcctaagacaca

SEQ ID NO: 3241427 - DNA, 22 bp, Homo sapiens
taaaatcctaagacacaaatgc

SEQ ID NO: 3241428 - DNA, 13 bp, Homo sapiens
taaaatcttatag

SEQ ID NO: 3241429 - DNA, 18 bp, Homo sapiens
taaaatcttatagttcta

SEQ ID NO: 3241430 - DNA, 13 bp, Homo sapiens
taaaatcttggaa

SEQ ID NO: 3241431 - DNA, 24 bp, Homo sapiens
taaaatcttggaagtacatgaata

SEQ ID NO: 3241432 - DNA, 20 bp, Homo sapiens
taaaatcttggcacagaaac

SEQ ID NO: 3241433 - DNA, 18 bp, Homo sapiens
taaaatgattgtaaaata

SEQ ID NO: 3241434 - DNA, 14 bp, Homo sapiens
taaaatgattttat

SEQ ID NO: 3241435 - DNA, 15 bp, Homo sapiens
taaaatgcaatgtaa

SEQ ID NO: 3241436 - DNA, 19 bp, Homo sapiens
taaaatgcatgattttgta

SEQ ID NO: 3241437 - DNA, 16 bp, Homo sapiens
taaaatgcattgaaag

SEQ ID NO: 3241438 - DNA, 20 bp, Homo sapiens
taaaatgccatagtttgtga

SEQ ID NO: 3241439 - DNA, 15 bp, Homo sapiens
taaaatggaagcaat

SEQ ID NO: 3241440 - DNA, 17 bp, Homo sapiens
taaaatggacacaaatt

SEQ ID NO: 3241441 - DNA, 15 bp, Homo sapiens
taaaatggatttaat

SEQ ID NO: 3241442 - DNA, 20 bp, Homo sapiens
taaaatgtaatttaaatgaa

SEQ ID NO: 3241443 - DNA, 22 bp, Homo sapiens
taaaatgtatctaagaataata

SEQ ID NO: 3241444 - DNA, 14 bp, Homo sapiens
taaaatgtattcaa

SEQ ID NO: 3241445 - DNA, 15 bp, Homo sapiens
taaaatgtattcaag

SEQ ID NO: 3241446 - DNA, 17 bp, Homo sapiens
taaaatgtatttttcta

SEQ ID NO: 3241447 - DNA, 15 bp, Homo sapiens
taaaatgtctttcca

SEQ ID NO: 3241448 - DNA, 20 bp, Homo sapiens
taaaatgtctttccaaatta

SEQ ID NO: 3241449 - DNA, 11 bp, Homo sapiens
taaaatgtgaa

SEQ ID NO: 3241450 - DNA, 17 bp, Homo sapiens
taaaatgtgatgttcta

SEQ ID NO: 3241451 - DNA, 21 bp, Homo sapiens
taaaatgtgatgttctaaggc

SEQ ID NO: 3241452 - DNA, 22 bp, Homo sapiens
taaaatgtgatgttctaaggct

SEQ ID NO: 3241453 - DNA, 17 bp, Homo sapiens
taaaatgtgtacagtga

SEQ ID NO: 3241454 - DNA, 18 bp, Homo sapiens
taaaatgtgtacagtgaa

SEQ ID NO: 3241455 - DNA, 19 bp, Homo sapiens
taaaatgtgtacagtgaat

SEQ ID NO: 3241456 - DNA, 18 bp, Homo sapiens
taaaatgtgttgaaactg

SEQ ID NO: 3241457 - DNA, 19 bp, Homo sapiens
taaaatgtgttgaaactgc

SEQ ID NO: 3241458 - DNA, 13 bp, Homo sapiens
taaaattaaatgc

SEQ ID NO: 3241459 - DNA, 15 bp, Homo sapiens
taaaattaagtagaa

SEQ ID NO: 3241460 - DNA, 19 bp, Homo sapiens
taaaattacagatgtgaaa

SEQ ID NO: 3241461 - DNA, 16 bp, Homo sapiens
taaaattataaacttt

SEQ ID NO: 3241462 - DNA, 20 bp, Homo sapiens
taaaattatgaatctgattt

SEQ ID NO: 3241463 - DNA, 22 bp, Homo sapiens
taaaattcagtttttgtatctt

SEQ ID NO: 3241464 - DNA, 23 bp, Homo sapiens
taaaattcagtttttgtatcttg

SEQ ID NO: 3241465 - DNA, 22 bp, Homo sapiens
taaaattgatttttctcttcat

SEQ ID NO: 3241466 - DNA, 18 bp, Homo sapiens
taaaattgctatgttact

SEQ ID NO: 3241467 - DNA, 23 bp, Homo sapiens
taaaattgctatgttactatttt

SEQ ID NO: 3241468 - DNA, 17 bp, Homo sapiens
taaaattggcaccatgt

SEQ ID NO: 3241469 - DNA, 14 bp, Homo sapiens
taaaattgtcacct

SEQ ID NO: 3241470 - DNA, 21 bp, Homo sapiens
taaaattgtcacctctgttaa

SEQ ID NO: 3241471 - DNA, 18 bp, Homo sapiens
taaaattgtgcataatgc

SEQ ID NO: 3241472 - DNA, 22 bp, Homo sapiens
taaaattgtgcataatgctttg

SEQ ID NO: 3241473 - DNA, 23 bp, Homo sapiens
taaacaaaatagaagctgtagta

SEQ ID NO: 3241474 - DNA, 22 bp, Homo sapiens
taaacaaacattgtgttgacat

SEQ ID NO: 3241475 - DNA, 17 bp, Homo sapiens
taaacaaactcttgaag

SEQ ID NO: 3241476 - DNA, 17 bp, Homo sapiens
taaacaaattcatattc

SEQ ID NO: 3241477 - DNA, 21 bp, Homo sapiens
taaacaaattcatattctgtc

SEQ ID NO: 3241478 - DNA, 21 bp, Homo sapiens
taaacaacgtgtatagtgcct

SEQ ID NO: 3241479 - DNA, 16 bp, Homo sapiens
taaacaagaaccattt

SEQ ID NO: 3241480 - DNA, 20 bp, Homo sapiens
taaacaagaatcagtctatc

SEQ ID NO: 3241481 - DNA, 18 bp, Homo sapiens
taaacaagtaagaaaaat

SEQ ID NO: 3241482 - DNA, 16 bp, Homo sapiens
taaatcatttcagtat

SEQ ID NO: 3241483 - DNA, 14 bp, Homo sapiens
taaatccagttcta

SEQ ID NO: 3241484 - DNA, 19 bp, Homo sapiens
taaatcctttttctttata

SEQ ID NO: 3241485 - DNA, 18 bp, Homo sapiens
taaatctatttattaata

SEQ ID NO: 3241486 - DNA, 17 bp, Homo sapiens
taaatctcaaatttatt

SEQ ID NO: 3241487 - DNA, 14 bp, Homo sapiens
taaatctctaatat

SEQ ID NO: 3241488 - DNA, 18 bp, Homo sapiens
taaatctctaatatggca

SEQ ID NO: 3241489 - DNA, 18 bp, Homo sapiens
taaatctgtaagctcttt

SEQ ID NO: 3241490 - DNA, 13 bp, Homo sapiens
taaatctgtgatg

SEQ ID NO: 3241491 - DNA, 20 bp, Homo sapiens
taaatctgttgccaagctgg

SEQ ID NO: 3241492 - DNA, 16 bp, Homo sapiens
taaatcttaaacaatg

SEQ ID NO: 3241493 - DNA, 17 bp, Homo sapiens
taaatcttaaacaatgt

SEQ ID NO: 3241494 - DNA, 18 bp, Homo sapiens
taaatcttaaacaatgta

SEQ ID NO: 3241495 - DNA, 20 bp, Homo sapiens
taaatcttaaacaatgtata

SEQ ID NO: 3241496 - DNA, 22 bp, Homo sapiens
taaatcttaaacaatgtataaa

SEQ ID NO: 3241497 - DNA, 14 bp, Homo sapiens
taaatctttcttca

SEQ ID NO: 3241498 - DNA, 14 bp, Homo sapiens
taaatgaaagaaaa

SEQ ID NO: 3241499 - DNA, 22 bp, Homo sapiens
taaatgaaagaaaattgagttg

SEQ ID NO: 3241500 - DNA, 22 bp, Homo sapiens
taaatgaagcagctttaaacaa

SEQ ID NO: 3241501 - DNA, 16 bp, Homo sapiens
taaatgaataaatcca

SEQ ID NO: 3241502 - DNA, 16 bp, Homo sapiens
taaatgaatctggtgt

SEQ ID NO: 3241503 - DNA, 12 bp, Homo sapiens
taaatgaatgtt

SEQ ID NO: 3241504 - DNA, 13 bp, Homo sapiens
taaatgaatgttt

SEQ ID NO: 3241505 - DNA, 16 bp, Homo sapiens
taaatgcaaagttctg

SEQ ID NO: 3241506 - DNA, 21 bp, Homo sapiens
taaatgcaaagttctgtgttt

SEQ ID NO: 3241507 - DNA, 16 bp, Homo sapiens
taaatgcataaatgca

SEQ ID NO: 3241508 - DNA, 21 bp, Homo sapiens
taaatgcatatcctgagccat

SEQ ID NO: 3241509 - DNA, 20 bp, Homo sapiens
taaatgcctagtttttagta

SEQ ID NO: 3241510 - DNA, 15 bp, Homo sapiens
taaatgcctcttaaa

SEQ ID NO: 3241511 - DNA, 16 bp, Homo sapiens
taaatgcctcttaaat

SEQ ID NO: 3241512 - DNA, 15 bp, Homo sapiens
taaatgccttgtata

SEQ ID NO: 3241513 - DNA, 22 bp, Homo sapiens
taaatgctctctcatcttgttc

SEQ ID NO: 3241514 - DNA, 11 bp, Homo sapiens
taaatggaaat

SEQ ID NO: 3241515 - DNA, 17 bp, Homo sapiens
taaatggaattattttg

SEQ ID NO: 3241516 - DNA, 23 bp, Homo sapiens
taaatggaattattttgaatgtc

SEQ ID NO: 3241517 - DNA, 22 bp, Homo sapiens
taaatgggactggagtccctgt

SEQ ID NO: 3241518 - DNA, 19 bp, Homo sapiens
taaatggtaataagcactg

SEQ ID NO: 3241519 - DNA, 15 bp, Homo sapiens
taaatgtataaatat

SEQ ID NO: 3241520 - DNA, 19 bp, Homo sapiens
taaatgtataaatatacag

SEQ ID NO: 3241521 - DNA, 12 bp, Homo sapiens
taaatgtatata

SEQ ID NO: 3241522 - DNA, 14 bp, Homo sapiens
taaatgtatataca

SEQ ID NO: 3241523 - DNA, 18 bp, Homo sapiens
taaatgtatatacacata

SEQ ID NO: 3241524 - DNA, 10 bp, Homo sapiens
taaatgtgaa

SEQ ID NO: 3241525 - DNA, 11 bp, Homo sapiens
taaatgtgaat

SEQ ID NO: 3241526 - DNA, 14 bp, Homo sapiens
taaatgtgaatttt

SEQ ID NO: 3241527 - DNA, 21 bp, Homo sapiens
taaatgtgaatttttatttct

SEQ ID NO: 3241528 - DNA, 19 bp, Homo sapiens
taaatgtgcaatagaaggt

SEQ ID NO: 3241529 - DNA, 22 bp, Homo sapiens
taaatgttctatggttatgaaa

SEQ ID NO: 3241530 - DNA, 17 bp, Homo sapiens
taaatgttggaatgtta

SEQ ID NO: 3241531 - DNA, 17 bp, Homo sapiens
taaatgtttatactgta

SEQ ID NO: 3241532 - DNA, 12 bp, Homo sapiens
taaatgtttctt

SEQ ID NO: 3241533 - DNA, 16 bp, Homo sapiens
taaatgttttataagt

SEQ ID NO: 3241534 - DNA, 14 bp, Homo sapiens
taaattaatatctt

SEQ ID NO: 3241535 - DNA, 19 bp, Homo sapiens
taaattacaattgtcattt

SEQ ID NO: 3241536 - DNA, 17 bp, Homo sapiens
taaattacaattttatc

SEQ ID NO: 3241537 - DNA, 14 bp, Homo sapiens
taaattacagcttt

SEQ ID NO: 3241538 - DNA, 23 bp, Homo sapiens
taaattacagcttttatggatga

SEQ ID NO: 3241539 - DNA, 15 bp, Homo sapiens
taaattacataagtt

SEQ ID NO: 3241540 - DNA, 23 bp, Homo sapiens
taaattacgtatgcaagtctgtg

SEQ ID NO: 3241541 - DNA, 20 bp, Homo sapiens
taaattagaaaatattctct

SEQ ID NO: 3241542 - DNA, 23 bp, Homo sapiens
taaattagatttggcatctcctg

SEQ ID NO: 3241543 - DNA, 14 bp, Homo sapiens
taaattaggaataa

SEQ ID NO: 3241544 - DNA, 17 bp, Homo sapiens
taaattaggaataaata

SEQ ID NO: 3241545 - DNA, 21 bp, Homo sapiens
taaattaggaataaataaaaa

SEQ ID NO: 3241546 - DNA, 17 bp, Homo sapiens
taaattagtaatgtact

SEQ ID NO: 3241547 - DNA, 14 bp, Homo sapiens
taaattatatattt

SEQ ID NO: 3241548 - DNA, 13 bp, Homo sapiens
taaattatttatg

SEQ ID NO: 3241549 - DNA, 15 bp, Homo sapiens
taaattcaactttgt

SEQ ID NO: 3241550 - DNA, 16 bp, Homo sapiens
taaattcaactttgta

SEQ ID NO: 3241551 - DNA, 19 bp, Homo sapiens
taaattcaactttgtaaaa

SEQ ID NO: 3241552 - DNA, 15 bp, Homo sapiens
taaattcagatcaaa

SEQ ID NO: 3241553 - DNA, 13 bp, Homo sapiens
taaattccactgg

SEQ ID NO: 3241554 - DNA, 14 bp, Homo sapiens
taaattccactgga

SEQ ID NO: 3241555 - DNA, 18 bp, Homo sapiens
taaattcccgttttgtca

SEQ ID NO: 3241556 - DNA, 20 bp, Homo sapiens
taaattcctcaacagtgttt

SEQ ID NO: 3241557 - DNA, 14 bp, Homo sapiens
taaattctactaag

SEQ ID NO: 3241558 - DNA, 16 bp, Homo sapiens
taaattctactaagtt

SEQ ID NO: 3241559 - DNA, 14 bp, Homo sapiens
taaattctatgtta

SEQ ID NO: 3241560 - DNA, 18 bp, Homo sapiens
taaattctatgttaaata

SEQ ID NO: 3241561 - DNA, 20 bp, Homo sapiens
taaattctatgttaaatact

SEQ ID NO: 3241562 - DNA, 23 bp, Homo sapiens
taaattgcttttgttgtgacttt

SEQ ID NO: 3241563 - DNA, 16 bp, Homo sapiens
taaattggaattttct

SEQ ID NO: 3241564 - DNA, 17 bp, Homo sapiens
taaattggtgataagtg

SEQ ID NO: 3241565 - DNA, 23 bp, Homo sapiens
taaattggtgataagtggaaaaa

SEQ ID NO: 3241566 - DNA, 23 bp, Homo sapiens
taaattgtccgtgttcatacatt

SEQ ID NO: 3241567 - DNA, 18 bp, Homo sapiens
taaattgtctttaaaaac

SEQ ID NO: 3241568 - DNA, 22 bp, Homo sapiens
taaattgtctttaaaaactgtt

SEQ ID NO: 3241569 - DNA, 15 bp, Homo sapiens
taaatttaaagatat

SEQ ID NO: 3241570 - DNA, 20 bp, Homo sapiens
taaatttaaagatattgttc

SEQ ID NO: 3241571 - DNA, 14 bp, Homo sapiens
taaatttaatacca

SEQ ID NO: 3241572 - DNA, 16 bp, Homo sapiens
taaatttatatacttt

SEQ ID NO: 3241573 - DNA, 15 bp, Homo sapiens
taaatttatttcaaa

SEQ ID NO: 3241574 - DNA, 17 bp, Homo sapiens
taaatttatttcaaaaa

SEQ ID NO: 3241575 - DNA, 14 bp, Homo sapiens
taaatttctgggat

SEQ ID NO: 3241576 - DNA, 21 bp, Homo sapiens
taaatttctgggatatttaac

SEQ ID NO: 3241577 - DNA, 15 bp, Homo sapiens
taaatttcttctggt

SEQ ID NO: 3241578 - DNA, 13 bp, Homo sapiens
taaatttgatact

SEQ ID NO: 3241579 - DNA, 21 bp, Homo sapiens
taaatttggtttgttaattct

SEQ ID NO: 3241580 - DNA, 23 bp, Homo sapiens
taaatttgtaagtttcaggtgac

SEQ ID NO: 3241581 - DNA, 12 bp, Homo sapiens
taaattttaaag

SEQ ID NO: 3241582 - DNA, 16 bp, Homo sapiens
taaattttacccttta

SEQ ID NO: 3241583 - DNA, 11 bp, Homo sapiens
taaattttcac

SEQ ID NO: 3241584 - DNA, 15 bp, Homo sapiens
taaattttcttcagt

SEQ ID NO: 3241585 - DNA, 16 bp, Homo sapiens
taaattttgagttcta

SEQ ID NO: 3241586 - DNA, 14 bp, Homo sapiens
taaattttgtgatg

SEQ ID NO: 3241587 - DNA, 15 bp, Homo sapiens
taaattttttgaaac

SEQ ID NO: 3241588 - DNA, 14 bp, Homo sapiens
taaatttttttcct

SEQ ID NO: 3241589 - DNA, 20 bp, Homo sapiens
taacaaaaaaatatatttaa

SEQ ID NO: 3241590 - DNA, 18 bp, Homo sapiens
taacaaaaactacacata

SEQ ID NO: 3241591 - DNA, 14 bp, Homo sapiens
taacaaaagatgaa

SEQ ID NO: 3241592 - DNA, 21 bp, Homo sapiens
taacaaaagttccctgaaaca

SEQ ID NO: 3241593 - DNA, 12 bp, Homo sapiens
taacaaatctaa

SEQ ID NO: 3241594 - DNA, 18 bp, Homo sapiens
taacaaatctaatctctt

SEQ ID NO: 3241595 - DNA, 22 bp, Homo sapiens
taacaacccacaccgtcttcct

SEQ ID NO: 3241596 - DNA, 19 bp, Homo sapiens
taacaagaactttaaattg

SEQ ID NO: 3241597 - DNA, 12 bp, Homo sapiens
taacaagaatgt

SEQ ID NO: 3241598 - DNA, 16 bp, Homo sapiens
taacaagatctttcag

SEQ ID NO: 3241599 - DNA, 17 bp, Homo sapiens
taacaagatctttcagg

SEQ ID NO: 3241600 - DNA, 18 bp, Homo sapiens
taacaagatctttcagga

SEQ ID NO: 3241601 - DNA, 15 bp, Homo sapiens
taacaagatttgtaa

SEQ ID NO: 3241602 - DNA, 19 bp, Homo sapiens
taacaaggaatgcctgtgc

SEQ ID NO: 3241603 - DNA, 21 bp, Homo sapiens
taacaaggaatgcctgtgcca

SEQ ID NO: 3241604 - DNA, 22 bp, Homo sapiens
taacaaggaatgcctgtgccaa

SEQ ID NO: 3241605 - DNA, 23 bp, Homo sapiens
taacaaggagctcaccctgcccg

SEQ ID NO: 3241606 - DNA, 21 bp, Homo sapiens
taacaagtaccaaagttttat

SEQ ID NO: 3241607 - DNA, 19 bp, Homo sapiens
taacaataactactgtgtt

SEQ ID NO: 3241608 - DNA, 14 bp, Homo sapiens
taatatctggcact

SEQ ID NO: 3241609 - DNA, 17 bp, Homo sapiens
taatatctggcactgtt

SEQ ID NO: 3241610 - DNA, 19 bp, Homo sapiens
taatatctttctgcacaca

SEQ ID NO: 3241611 - DNA, 22 bp, Homo sapiens
taatatctttctgcacacaaat

SEQ ID NO: 3241612 - DNA, 15 bp, Homo sapiens
taatatgattataca

SEQ ID NO: 3241613 - DNA, 16 bp, Homo sapiens
taatatgattatacaa

SEQ ID NO: 3241614 - DNA, 16 bp, Homo sapiens
taatatgctgccaaat

SEQ ID NO: 3241615 - DNA, 22 bp, Homo sapiens
taatatggaaccttccctccaa

SEQ ID NO: 3241616 - DNA, 18 bp, Homo sapiens
taatatggcaaaaatggc

SEQ ID NO: 3241617 - DNA, 22 bp, Homo sapiens
taatatggccacagtagtcttg

SEQ ID NO: 3241618 - DNA, 20 bp, Homo sapiens
taatatggctatgcttaaaa

SEQ ID NO: 3241619 - DNA, 20 bp, Homo sapiens
taatatgttaacctcagtgt

SEQ ID NO: 3241620 - DNA, 21 bp, Homo sapiens
taatatgttaacctcagtgtc

SEQ ID NO: 3241621 - DNA, 22 bp, Homo sapiens
taatattaaaaatatggaactt

SEQ ID NO: 3241622 - DNA, 17 bp, Homo sapiens
taatattagtgattctg

SEQ ID NO: 3241623 - DNA, 18 bp, Homo sapiens
taatattcacatgttcta

SEQ ID NO: 3241624 - DNA, 18 bp, Homo sapiens
taatattcattggttaac

SEQ ID NO: 3241625 - DNA, 17 bp, Homo sapiens
taatattgaaaattgaa

SEQ ID NO: 3241626 - DNA, 20 bp, Homo sapiens
taatattgaaaattgaaaag

SEQ ID NO: 3241627 - DNA, 22 bp, Homo sapiens
taatattgaaaattgaaaagta

SEQ ID NO: 3241628 - DNA, 18 bp, Homo sapiens
taatattgacttgtatat

SEQ ID NO: 3241629 - DNA, 19 bp, Homo sapiens
taatattgagaaagaaact

SEQ ID NO: 3241630 - DNA, 20 bp, Homo sapiens
taatattgatgtcagtattt

SEQ ID NO: 3241631 - DNA, 18 bp, Homo sapiens
taatattgttgtataatt

SEQ ID NO: 3241632 - DNA, 21 bp, Homo sapiens
taatattgtttggtaaatgtt

SEQ ID NO: 3241633 - DNA, 15 bp, Homo sapiens
taatattgtttttct

SEQ ID NO: 3241634 - DNA, 20 bp, Homo sapiens
taatattgtttttctttcta

SEQ ID NO: 3241635 - DNA, 21 bp, Homo sapiens
taatatttaacattatttata

SEQ ID NO: 3241636 - DNA, 23 bp, Homo sapiens
taatatttatgtctatttaagcc

SEQ ID NO: 3241637 - DNA, 21 bp, Homo sapiens
taatcaaaagggaaaagaaga

SEQ ID NO: 3241638 - DNA, 14 bp, Homo sapiens
taatcaaaattgtc

SEQ ID NO: 3241639 - DNA, 15 bp, Homo sapiens
taatcaaaattgtct

SEQ ID NO: 3241640 - DNA, 14 bp, Homo sapiens
taatcaaatgattt

SEQ ID NO: 3241641 - DNA, 22 bp, Homo sapiens
taatcaaatgatttcatattga

SEQ ID NO: 3241642 - DNA, 11 bp, Homo sapiens
taatcaagatt

SEQ ID NO: 3241643 - DNA, 14 bp, Homo sapiens
taatcaataaagaa

SEQ ID NO: 3241644 - DNA, 17 bp, Homo sapiens
taatcaatcatctgtgt

SEQ ID NO: 3241645 - DNA, 20 bp, Homo sapiens
taatcaatgaatattgaagt

SEQ ID NO: 3241646 - DNA, 18 bp, Homo sapiens
taatcaatgtttcttcta

SEQ ID NO: 3241647 - DNA, 18 bp, Homo sapiens
taatcacagtcatcttta

SEQ ID NO: 3241648 - DNA, 23 bp, Homo sapiens
taatcaccctaccaactttactg

SEQ ID NO: 3241649 - DNA, 17 bp, Homo sapiens
taatcacgctttcctga

SEQ ID NO: 3241650 - DNA, 14 bp, Homo sapiens
taatcactcccatt

SEQ ID NO: 3241651 - DNA, 20 bp, Homo sapiens
taatcactcccatttttact

SEQ ID NO: 3241652 - DNA, 22 bp, Homo sapiens
taatcactcccatttttactta

SEQ ID NO: 3241653 - DNA, 20 bp, Homo sapiens
taatcagaaaagtaattttg

SEQ ID NO: 3241654 - DNA, 23 bp, Homo sapiens
taatcagaaaagtaattttgtca

SEQ ID NO: 3241655 - DNA, 20 bp, Homo sapiens
taatcagcaagaatttgatc

SEQ ID NO: 3241656 - DNA, 18 bp, Homo sapiens
taatcagcattattcttc

SEQ ID NO: 3241657 - DNA, 23 bp, Homo sapiens
taatcagctctcctggctccctc

SEQ ID NO: 3241658 - DNA, 19 bp, Homo sapiens
taatcaggtcctcagagaa

SEQ ID NO: 3241659 - DNA, 14 bp, Homo sapiens
taatcagtgactga

SEQ ID NO: 3241660 - DNA, 15 bp, Homo sapiens
taatcagtgtctcac

SEQ ID NO: 3241661 - DNA, 15 bp, Homo sapiens
taatcatataataaa

SEQ ID NO: 3241662 - DNA, 20 bp, Homo sapiens
taatcatataataaatgtac

SEQ ID NO: 3241663 - DNA, 14 bp, Homo sapiens
taatcatatttgaa

SEQ ID NO: 3241664 - DNA, 15 bp, Homo sapiens
taatcatatttgaaa

SEQ ID NO: 3241665 - DNA, 13 bp, Homo sapiens
taatcatgaatat

SEQ ID NO: 3241666 - DNA, 16 bp, Homo sapiens
taatcatttccccata

SEQ ID NO: 3241667 - DNA, 14 bp, Homo sapiens
taatcattttcatt

SEQ ID NO: 3241668 - DNA, 17 bp, Homo sapiens
taatcattttcattcct

SEQ ID NO: 3241669 - DNA, 12 bp, Homo sapiens
taatcccaccac

SEQ ID NO: 3241670 - DNA, 20 bp, Homo sapiens
taatcccagctacttgggaa

SEQ ID NO: 3241671 - DNA, 14 bp, Homo sapiens
taatcccccaggag

SEQ ID NO: 3241672 - DNA, 20 bp, Homo sapiens
taatccctatgtttgtctca

SEQ ID NO: 3241673 - DNA, 23 bp, Homo sapiens
taatcctatctggggagctcctg

SEQ ID NO: 3241674 - DNA, 14 bp, Homo sapiens
taatcctgtaccaa

SEQ ID NO: 3241675 - DNA, 21 bp, Homo sapiens
taatcctgtaccaaatctgac

SEQ ID NO: 3241676 - DNA, 20 bp, Homo sapiens
taatcctttctgccgacccc

SEQ ID NO: 3241677 - DNA, 23 bp, Homo sapiens
taatcgactcaaaaataagtcat

SEQ ID NO: 3241678 - DNA, 15 bp, Homo sapiens
taatctagtttacag

SEQ ID NO: 3241679 - DNA, 18 bp, Homo sapiens
taatctagtttacagaaa

SEQ ID NO: 3241680 - DNA, 20 bp, Homo sapiens
taatctagtttacagaaaaa

SEQ ID NO: 3241681 - DNA, 16 bp, Homo sapiens
taatctattgggttca

SEQ ID NO: 3241682 - DNA, 19 bp, Homo sapiens
taatctattgggttcatta

SEQ ID NO: 3241683 - DNA, 22 bp, Homo sapiens
taatctattgggttcattattg

SEQ ID NO: 3241684 - DNA, 16 bp, Homo sapiens
taatctcaaaggagaa

SEQ ID NO: 3241685 - DNA, 16 bp, Homo sapiens
taatctcagtgctttc

SEQ ID NO: 3241686 - DNA, 17 bp, Homo sapiens
taatctcatacctctga

SEQ ID NO: 3241687 - DNA, 20 bp, Homo sapiens
taatctcatacctctgacca

SEQ ID NO: 3241688 - DNA, 21 bp, Homo sapiens
taatctctaaatcaagtattt

SEQ ID NO: 3241689 - DNA, 18 bp, Homo sapiens
taatctctgttatgtact

SEQ ID NO: 3241690 - DNA, 21 bp, Homo sapiens
taatctgaaaggatgtggaag

SEQ ID NO: 3241691 - DNA, 16 bp, Homo sapiens
taatctgaaattctaa

SEQ ID NO: 3241692 - DNA, 20 bp, Homo sapiens
taatctgaataaagtgtaac

SEQ ID NO: 3241693 - DNA, 18 bp, Homo sapiens
taatctggactcctctgt

SEQ ID NO: 3241694 - DNA, 19 bp, Homo sapiens
taatctggcactactcagt

SEQ ID NO: 3241695 - DNA, 22 bp, Homo sapiens
taatctgtacattttgttgtaa

SEQ ID NO: 3241696 - DNA, 23 bp, Homo sapiens
taatctgtacattttgttgtaaa

SEQ ID NO: 3241697 - DNA, 11 bp, Homo sapiens
taatctgtcaa

SEQ ID NO: 3241698 - DNA, 15 bp, Homo sapiens
taatctgtcaaaaca

SEQ ID NO: 3241699 - DNA, 17 bp, Homo sapiens
taatctgtcaaaacact

SEQ ID NO: 3241700 - DNA, 19 bp, Homo sapiens
taatctgtcaaaacactgt

SEQ ID NO: 3241701 - DNA, 21 bp, Homo sapiens
taatctgtcaaaacactgtgg

SEQ ID NO: 3241702 - DNA, 23 bp, Homo sapiens
taatctgtcaaaacactgtggaa

SEQ ID NO: 3241703 - DNA, 20 bp, Homo sapiens
taatcttaggggagagcttt

SEQ ID NO: 3241704 - DNA, 13 bp, Homo sapiens
taatcttagtgta

SEQ ID NO: 3241705 - DNA, 15 bp, Homo sapiens
taatcttatacaaca

SEQ ID NO: 3241706 - DNA, 21 bp, Homo sapiens
taatcttattagggagaaaat

SEQ ID NO: 3241707 - DNA, 17 bp, Homo sapiens
taatcttcaaagccttc

SEQ ID NO: 3241708 - DNA, 13 bp, Homo sapiens
taatcttcagttt

SEQ ID NO: 3241709 - DNA, 14 bp, Homo sapiens
taatcttctgcctt

SEQ ID NO: 3241710 - DNA, 14 bp, Homo sapiens
taatcttggctcag

SEQ ID NO: 3241711 - DNA, 18 bp, Homo sapiens
taatcttgtagacactta

SEQ ID NO: 3241712 - DNA, 13 bp, Homo sapiens
taatcttgtccct

SEQ ID NO: 3241713 - DNA, 15 bp, Homo sapiens
taatctttaaactgg

SEQ ID NO: 3241714 - DNA, 20 bp, Homo sapiens
taatctttcacttgaaagat

SEQ ID NO: 3241715 - DNA, 21 bp, Homo sapiens
taatctttctttacctgagac

SEQ ID NO: 3241716 - DNA, 16 bp, Homo sapiens
taatctttgtgacagg

SEQ ID NO: 3241717 - DNA, 16 bp, Homo sapiens
taatgaaaaggaagtt

SEQ ID NO: 3241718 - DNA, 14 bp, Homo sapiens
taatgaaaatgtca

SEQ ID NO: 3241719 - DNA, 17 bp, Homo sapiens
taatgaaagactgtaca

SEQ ID NO: 3241720 - DNA, 14 bp, Homo sapiens
taatgaaataatca

SEQ ID NO: 3241721 - DNA, 15 bp, Homo sapiens
taatgaaataatcag

SEQ ID NO: 3241722 - DNA, 19 bp, Homo sapiens
taatgaaataatcagtgac

SEQ ID NO: 3241723 - DNA, 18 bp, Homo sapiens
taatgaactaccatctga

SEQ ID NO: 3241724 - DNA, 14 bp, Homo sapiens
taatgaagctttat

SEQ ID NO: 3241725 - DNA, 16 bp, Homo sapiens
taatgaagtaaagcca

SEQ ID NO: 3241726 - DNA, 16 bp, Homo sapiens
taatgaataaactgaa

SEQ ID NO: 3241727 - DNA, 23 bp, Homo sapiens
taatgaataaactgaatattttg

SEQ ID NO: 3241728 - DNA, 14 bp, Homo sapiens
taatgaattataac

SEQ ID NO: 3241729 - DNA, 15 bp, Homo sapiens
taatgaattataaca

SEQ ID NO: 3241730 - DNA, 22 bp, Homo sapiens
taatgaattataacagttatat

SEQ ID NO: 3241731 - DNA, 22 bp, Homo sapiens
taatgagccatcactagaagaa

SEQ ID NO: 3241732 - DNA, 16 bp, Homo sapiens
taatgataatcccacc

SEQ ID NO: 3241733 - DNA, 17 bp, Homo sapiens
tacatgcatacaaagag

SEQ ID NO: 3241734 - DNA, 13 bp, Homo sapiens
tacatgctacttt

SEQ ID NO: 3241735 - DNA, 17 bp, Homo sapiens
tacatgctgtgctcttt

SEQ ID NO: 3241736 - DNA, 16 bp, Homo sapiens
tacatggaaaggattt

SEQ ID NO: 3241737 - DNA, 15 bp, Homo sapiens
tacatggtgtttgtg

SEQ ID NO: 3241738 - DNA, 19 bp, Homo sapiens
tacatgtaaaacattatct

SEQ ID NO: 3241739 - DNA, 20 bp, Homo sapiens
tacatgtattgcacattgta

SEQ ID NO: 3241740 - DNA, 23 bp, Homo sapiens
tacatgtcatttgactgtctcac

SEQ ID NO: 3241741 - DNA, 15 bp, Homo sapiens
tacatgtgatacatt

SEQ ID NO: 3241742 - DNA, 19 bp, Homo sapiens
tacatgtgatacatttttt

SEQ ID NO: 3241743 - DNA, 14 bp, Homo sapiens
tacatgtgtaaagg

SEQ ID NO: 3241744 - DNA, 13 bp, Homo sapiens
tacatgtgtgtat

SEQ ID NO: 3241745 - DNA, 19 bp, Homo sapiens
tacatgtgtgtatatatgt

SEQ ID NO: 3241746 - DNA, 15 bp, Homo sapiens
tacatgtttataaat

SEQ ID NO: 3241747 - DNA, 13 bp, Homo sapiens
tacattaaaacta

SEQ ID NO: 3241748 - DNA, 20 bp, Homo sapiens
tacattaaaataaaccaaat

SEQ ID NO: 3241749 - DNA, 21 bp, Homo sapiens
tacattaaaataaaccaaata

SEQ ID NO: 3241750 - DNA, 15 bp, Homo sapiens
tacattaacttgaaa

SEQ ID NO: 3241751 - DNA, 22 bp, Homo sapiens
tacattccctctcctgcccaga

SEQ ID NO: 3241752 - DNA, 17 bp, Homo sapiens
tacattcctaactagaa

SEQ ID NO: 3241753 - DNA, 21 bp, Homo sapiens
tacattcctaactagaattag

SEQ ID NO: 3241754 - DNA, 19 bp, Homo sapiens
tacattggctggtaacagt

SEQ ID NO: 3241755 - DNA, 17 bp, Homo sapiens
tacattgtaaatagtat

SEQ ID NO: 3241756 - DNA, 23 bp, Homo sapiens
tacattgttgagctattgctgtt

SEQ ID NO: 3241757 - DNA, 13 bp, Homo sapiens
tacatttaaacaa

SEQ ID NO: 3241758 - DNA, 23 bp, Homo sapiens
tacatttaaaccttttattataa

SEQ ID NO: 3241759 - DNA, 15 bp, Homo sapiens
tacatttaatacagc

SEQ ID NO: 3241760 - DNA, 19 bp, Homo sapiens
tacatttataatgtttgct

SEQ ID NO: 3241761 - DNA, 14 bp, Homo sapiens
tacatttataattg

SEQ ID NO: 3241762 - DNA, 16 bp, Homo sapiens
tacatttataattgca

SEQ ID NO: 3241763 - DNA, 12 bp, Homo sapiens
tacatttatgat

SEQ ID NO: 3241764 - DNA, 22 bp, Homo sapiens
tacatttatgatttaataaaat

SEQ ID NO: 3241765 - DNA, 13 bp, Homo sapiens
tacatttattcat

SEQ ID NO: 3241766 - DNA, 18 bp, Homo sapiens
tacatttcatacaacaga

SEQ ID NO: 3241767 - DNA, 15 bp, Homo sapiens
tacatttctgcagat

SEQ ID NO: 3241768 - DNA, 22 bp, Homo sapiens
tacatttgagggcccagccagg

SEQ ID NO: 3241769 - DNA, 23 bp, Homo sapiens
tacatttggattagaaatttaac

SEQ ID NO: 3241770 - DNA, 16 bp, Homo sapiens
tacatttgtgagattc

SEQ ID NO: 3241771 - DNA, 11 bp, Homo sapiens
tacattttata

SEQ ID NO: 3241772 - DNA, 19 bp, Homo sapiens
tacattttatatttttgta

SEQ ID NO: 3241773 - DNA, 20 bp, Homo sapiens
tacattttatatttttgtac

SEQ ID NO: 3241774 - DNA, 22 bp, Homo sapiens
tacattttatatttttgtacat

SEQ ID NO: 3241775 - DNA, 14 bp, Homo sapiens
tacattttctggtg

SEQ ID NO: 3241776 - DNA, 13 bp, Homo sapiens
tacattttgttgt

SEQ ID NO: 3241777 - DNA, 17 bp, Homo sapiens
tacattttgttgtaaaa

SEQ ID NO: 3241778 - DNA, 22 bp, Homo sapiens
tacattttgttgtaaaaagaaa

SEQ ID NO: 3241779 - DNA, 15 bp, Homo sapiens
tacattttttaagct

SEQ ID NO: 3241780 - DNA, 17 bp, Homo sapiens
taccaaatacacatttc

SEQ ID NO: 3241781 - DNA, 14 bp, Homo sapiens
taccaaatctgaca

SEQ ID NO: 3241782 - DNA, 18 bp, Homo sapiens
taccaaatctgacatatt

SEQ ID NO: 3241783 - DNA, 13 bp, Homo sapiens
taccaaattaaaa

SEQ ID NO: 3241784 - DNA, 13 bp, Homo sapiens
taccaactttctg

SEQ ID NO: 3241785 - DNA, 17 bp, Homo sapiens
taccaactttctgtaaa

SEQ ID NO: 3241786 - DNA, 15 bp, Homo sapiens
taccaagagtaactt

SEQ ID NO: 3241787 - DNA, 19 bp, Homo sapiens
taccaatcattttaattat

SEQ ID NO: 3241788 - DNA, 14 bp, Homo sapiens
taccaatgctgttg

SEQ ID NO: 3241789 - DNA, 18 bp, Homo sapiens
taccaatgctgttgtaaa

SEQ ID NO: 3241790 - DNA, 12 bp, Homo sapiens
taccacaagcct

SEQ ID NO: 3241791 - DNA, 17 bp, Homo sapiens
taccacacatctatgat

SEQ ID NO: 3241792 - DNA, 15 bp, Homo sapiens
taccacactgagttc

SEQ ID NO: 3241793 - DNA, 14 bp, Homo sapiens
taccacagtgtctg

SEQ ID NO: 3241794 - DNA, 15 bp, Homo sapiens
taccacccttcagac

SEQ ID NO: 3241795 - DNA, 15 bp, Homo sapiens
taccacctttactgt

SEQ ID NO: 3241796 - DNA, 16 bp, Homo sapiens
taccactatttaagtt

SEQ ID NO: 3241797 - DNA, 14 bp, Homo sapiens
taccactcaggcca

SEQ ID NO: 3241798 - DNA, 15 bp, Homo sapiens
taccagacctcttct

SEQ ID NO: 3241799 - DNA, 14 bp, Homo sapiens
taccagactgcagg

SEQ ID NO: 3241800 - DNA, 21 bp, Homo sapiens
taccagactgcaggttggacc

SEQ ID NO: 3241801 - DNA, 18 bp, Homo sapiens
taccagagccttcaagtg

SEQ ID NO: 3241802 - DNA, 12 bp, Homo sapiens
taccagatgcta

SEQ ID NO: 3241803 - DNA, 20 bp, Homo sapiens
taccagcagaaggatttttt

SEQ ID NO: 3241804 - DNA, 17 bp, Homo sapiens
taccagcatgttaactt

SEQ ID NO: 3241805 - DNA, 20 bp, Homo sapiens
taccagccctggggctgggc

SEQ ID NO: 3241806 - DNA, 21 bp, Homo sapiens
taccagctgcgcttgcttttc

SEQ ID NO: 3241807 - DNA, 16 bp, Homo sapiens
taccagggatgtagat

SEQ ID NO: 3241808 - DNA, 21 bp, Homo sapiens
taccaggtccattttgcctga

SEQ ID NO: 3241809 - DNA, 14 bp, Homo sapiens
taccaggtgttcta

SEQ ID NO: 3241810 - DNA, 14 bp, Homo sapiens
taccaggttgaaag

SEQ ID NO: 3241811 - DNA, 19 bp, Homo sapiens
taccagtatttagaagcca

SEQ ID NO: 3241812 - DNA, 23 bp, Homo sapiens
taccagtctttaaaggcccagcc

SEQ ID NO: 3241813 - DNA, 16 bp, Homo sapiens
taccagttgcctttta

SEQ ID NO: 3241814 - DNA, 17 bp, Homo sapiens
taccagttgtatttaat

SEQ ID NO: 3241815 - DNA, 14 bp, Homo sapiens
taccagtttgctga

SEQ ID NO: 3241816 - DNA, 20 bp, Homo sapiens
taccataagggactgtgcca

SEQ ID NO: 3241817 - DNA, 13 bp, Homo sapiens
taccataatctta

SEQ ID NO: 3241818 - DNA, 15 bp, Homo sapiens
taccataatcttaga

SEQ ID NO: 3241819 - DNA, 16 bp, Homo sapiens
taccatactcatttct

SEQ ID NO: 3241820 - DNA, 22 bp, Homo sapiens
taccatactcatttctaaaaga

SEQ ID NO: 3241821 - DNA, 20 bp, Homo sapiens
taccatagctacatcagttt

SEQ ID NO: 3241822 - DNA, 20 bp, Homo sapiens
taccatagtaccatttatac

SEQ ID NO: 3241823 - DNA, 15 bp, Homo sapiens
taccatatttatcca

SEQ ID NO: 3241824 - DNA, 22 bp, Homo sapiens
taccatatttatccatttgtaa

SEQ ID NO: 3241825 - DNA, 17 bp, Homo sapiens
taccatctgatgtttca

SEQ ID NO: 3241826 - DNA, 20 bp, Homo sapiens
taccatgagaagagggcctg

SEQ ID NO: 3241827 - DNA, 16 bp, Homo sapiens
taccattaaaactgct

SEQ ID NO: 3241828 - DNA, 17 bp, Homo sapiens
taccattaaaactgctt

SEQ ID NO: 3241829 - DNA, 18 bp, Homo sapiens
taccattaaaactgcttt

SEQ ID NO: 3241830 - DNA, 12 bp, Homo sapiens
taccattagcat

SEQ ID NO: 3241831 - DNA, 15 bp, Homo sapiens
taccattcagatcac

SEQ ID NO: 3241832 - DNA, 22 bp, Homo sapiens
taccattcagatcactgaattt

SEQ ID NO: 3241833 - DNA, 14 bp, Homo sapiens
taccatttatacaa

SEQ ID NO: 3241834 - DNA, 21 bp, Homo sapiens
taccatttatacaaattagaa

SEQ ID NO: 3241835 - DNA, 14 bp, Homo sapiens
taccatttatgaag

SEQ ID NO: 3241836 - DNA, 12 bp, Homo sapiens
taccatttcaga

SEQ ID NO: 3241837 - DNA, 23 bp, Homo sapiens
taccatttcctcagcttatctct

SEQ ID NO: 3241838 - DNA, 19 bp, Homo sapiens
taccattttaacgctgcct

SEQ ID NO: 3241839 - DNA, 15 bp, Homo sapiens
tacccaaactgcttt

SEQ ID NO: 3241840 - DNA, 13 bp, Homo sapiens
tacccaaccactc

SEQ ID NO: 3241841 - DNA, 23 bp, Homo sapiens
tacccaacggccctgcagccagc

SEQ ID NO: 3241842 - DNA, 17 bp, Homo sapiens
tacccaccgatggagcc

SEQ ID NO: 3241843 - DNA, 18 bp, Homo sapiens
tacccaccgatggagccc

SEQ ID NO: 3241844 - DNA, 12 bp, Homo sapiens
tacccacctaga

SEQ ID NO: 3241845 - DNA, 16 bp, Homo sapiens
tacccagagagtcctg

SEQ ID NO: 3241846 - DNA, 18 bp, Homo sapiens
tacccagccatctgccca

SEQ ID NO: 3241847 - DNA, 21 bp, Homo sapiens
tacccaggaccaagccacagc

SEQ ID NO: 3241848 - DNA, 20 bp, Homo sapiens
tacccatctagtacttgaaa

SEQ ID NO: 3241849 - DNA, 21 bp, Homo sapiens
tacccatctagtacttgaaaa

SEQ ID NO: 3241850 - DNA, 13 bp, Homo sapiens
tacccatgagcct

SEQ ID NO: 3241851 - DNA, 14 bp, Homo sapiens
tacccatgagcctg

SEQ ID NO: 3241852 - DNA, 21 bp, Homo sapiens
tacccattcgtggtgatcaat

SEQ ID NO: 3241853 - DNA, 20 bp, Homo sapiens
taccccagcctacccttcct

SEQ ID NO: 3241854 - DNA, 18 bp, Homo sapiens
taccccatgaagatattt

SEQ ID NO: 3241855 - DNA, 12 bp, Homo sapiens
tacccccaacct

SEQ ID NO: 3241856 - DNA, 17 bp, Homo sapiens
taccccccaacccctga

SEQ ID NO: 3241857 - DNA, 16 bp, Homo sapiens
taccccctaagagcca

SEQ ID NO: 3241858 - DNA, 18 bp, Homo sapiens
taccccctccttcagaca

SEQ ID NO: 3241859 - DNA, 19 bp, Homo sapiens
tactttggtttctgtctgt

SEQ ID NO: 3241860 - DNA, 12 bp, Homo sapiens
tactttgtactt

SEQ ID NO: 3241861 - DNA, 16 bp, Homo sapiens
tactttgtctgaaaaa

SEQ ID NO: 3241862 - DNA, 21 bp, Homo sapiens
tactttgtggaccaattattg

SEQ ID NO: 3241863 - DNA, 19 bp, Homo sapiens
tactttgttaggattttca

SEQ ID NO: 3241864 - DNA, 22 bp, Homo sapiens
tactttgtttattgtaaaacag

SEQ ID NO: 3241865 - DNA, 19 bp, Homo sapiens
tacttttaaaaatgtagaa

SEQ ID NO: 3241866 - DNA, 14 bp, Homo sapiens
tacttttaaactgt

SEQ ID NO: 3241867 - DNA, 18 bp, Homo sapiens
tacttttaccactattta

SEQ ID NO: 3241868 - DNA, 19 bp, Homo sapiens
tacttttagttgactcaca

SEQ ID NO: 3241869 - DNA, 19 bp, Homo sapiens
tacttttatttgcaacatt

SEQ ID NO: 3241870 - DNA, 21 bp, Homo sapiens
tacttttatttgcaacattta

SEQ ID NO: 3241871 - DNA, 22 bp, Homo sapiens
tacttttcccctgttaaacagt

SEQ ID NO: 3241872 - DNA, 18 bp, Homo sapiens
tacttttgttgtatggga

SEQ ID NO: 3241873 - DNA, 14 bp, Homo sapiens
tactttttaaatgt

SEQ ID NO: 3241874 - DNA, 20 bp, Homo sapiens
tacttttttaaatattttct

SEQ ID NO: 3241875 - DNA, 20 bp, Homo sapiens
tacttttttacactgataaa

SEQ ID NO: 3241876 - DNA, 19 bp, Homo sapiens
tacttttttctagtttcag

SEQ ID NO: 3241877 - DNA, 14 bp, Homo sapiens
tacttttttcttat

SEQ ID NO: 3241878 - DNA, 18 bp, Homo sapiens
tacttttttcttatttaa

SEQ ID NO: 3241879 - DNA, 23 bp, Homo sapiens
tactttttttggaagttatttat

SEQ ID NO: 3241880 - DNA, 18 bp, Homo sapiens
tagaaaaaagtttacaac

SEQ ID NO: 3241881 - DNA, 17 bp, Homo sapiens
tagaaaaatctcattcc

SEQ ID NO: 3241882 - DNA, 16 bp, Homo sapiens
tagaaaacataatctt

SEQ ID NO: 3241883 - DNA, 20 bp, Homo sapiens
tagaaaactgaaaatctaat

SEQ ID NO: 3241884 - DNA, 20 bp, Homo sapiens
tagaaaagctgatcataagt

SEQ ID NO: 3241885 - DNA, 20 bp, Homo sapiens
tagaaaagttgcagatgtat

SEQ ID NO: 3241886 - DNA, 22 bp, Homo sapiens
tagaaaagttgcagatgtattg

SEQ ID NO: 3241887 - DNA, 18 bp, Homo sapiens
tagaaaatattctctatt

SEQ ID NO: 3241888 - DNA, 16 bp, Homo sapiens
tagaaaattagactgt

SEQ ID NO: 3241889 - DNA, 21 bp, Homo sapiens
tagaaacccaagctcctcctc

SEQ ID NO: 3241890 - DNA, 19 bp, Homo sapiens
tagaaacctcattggccag

SEQ ID NO: 3241891 - DNA, 22 bp, Homo sapiens
tagaaagaaaagaccctgagac

SEQ ID NO: 3241892 - DNA, 23 bp, Homo sapiens
tagaaagaagctcgccccacctc

SEQ ID NO: 3241893 - DNA, 18 bp, Homo sapiens
tagaaagagatacagagg

SEQ ID NO: 3241894 - DNA, 15 bp, Homo sapiens
tagaaagcttgaaaa

SEQ ID NO: 3241895 - DNA, 19 bp, Homo sapiens
tagaaagcttgaaaagatt

SEQ ID NO: 3241896 - DNA, 21 bp, Homo sapiens
tagaaagcttgaaaagattct

SEQ ID NO: 3241897 - DNA, 13 bp, Homo sapiens
tagaaaggaacac

SEQ ID NO: 3241898 - DNA, 18 bp, Homo sapiens
tagaaagtaagaaaacaa

SEQ ID NO: 3241899 - DNA, 22 bp, Homo sapiens
tagaaagtaagaaaacaatatg

SEQ ID NO: 3241900 - DNA, 19 bp, Homo sapiens
tagaaataaaggatgtgat

SEQ ID NO: 3241901 - DNA, 19 bp, Homo sapiens
tagaaataaatagctatat

SEQ ID NO: 3241902 - DNA, 15 bp, Homo sapiens
tagaaataatatgca

SEQ ID NO: 3241903 - DNA, 16 bp, Homo sapiens
tagaaataatatgcat

SEQ ID NO: 3241904 - DNA, 15 bp, Homo sapiens
tagaaatacactttt

SEQ ID NO: 3241905 - DNA, 23 bp, Homo sapiens
tagaaatacacttttttccaaag

SEQ ID NO: 3241906 - DNA, 20 bp, Homo sapiens
tagaaatatctgaaaatgta

SEQ ID NO: 3241907 - DNA, 21 bp, Homo sapiens
tagaaatatctgaaaatgtat

SEQ ID NO: 3241908 - DNA, 14 bp, Homo sapiens
tagaaatcattgta

SEQ ID NO: 3241909 - DNA, 20 bp, Homo sapiens
tagaaatctaaaagaatttt

SEQ ID NO: 3241910 - DNA, 19 bp, Homo sapiens
tagaaatgtaaactgccat

SEQ ID NO: 3241911 - DNA, 19 bp, Homo sapiens
tagaaatgtaacttttgta

SEQ ID NO: 3241912 - DNA, 18 bp, Homo sapiens
tagaaattacctgtggat

SEQ ID NO: 3241913 - DNA, 22 bp, Homo sapiens
tagaaattagaaaaaaattact

SEQ ID NO: 3241914 - DNA, 12 bp, Homo sapiens
tagaacaaaaaa

SEQ ID NO: 3241915 - DNA, 16 bp, Homo sapiens
tagaacaaaggacaga

SEQ ID NO: 3241916 - DNA, 23 bp, Homo sapiens
tagaacaccaaagataaggacta

SEQ ID NO: 3241917 - DNA, 16 bp, Homo sapiens
tagaacactaactcac

SEQ ID NO: 3241918 - DNA, 18 bp, Homo sapiens
tagaacactaattcataa

SEQ ID NO: 3241919 - DNA, 20 bp, Homo sapiens
tagaacactaattcataatc

SEQ ID NO: 3241920 - DNA, 13 bp, Homo sapiens
tagaacactattt

SEQ ID NO: 3241921 - DNA, 16 bp, Homo sapiens
tagaacactattttca

SEQ ID NO: 3241922 - DNA, 22 bp, Homo sapiens
tagaacactattttcagaatct

SEQ ID NO: 3241923 - DNA, 23 bp, Homo sapiens
tagaacactattttcagaatctg

SEQ ID NO: 3241924 - DNA, 23 bp, Homo sapiens
tagaacaggttcttaaaaaggaa

SEQ ID NO: 3241925 - DNA, 18 bp, Homo sapiens
tagaacagtggaaactat

SEQ ID NO: 3241926 - DNA, 11 bp, Homo sapiens
tagaacattta

SEQ ID NO: 3241927 - DNA, 15 bp, Homo sapiens
tagaaccactatgaa

SEQ ID NO: 3241928 - DNA, 16 bp, Homo sapiens
tagaaccactatgaag

SEQ ID NO: 3241929 - DNA, 21 bp, Homo sapiens
tagaaccagccgtattttaca

SEQ ID NO: 3241930 - DNA, 14 bp, Homo sapiens
tagaacctgggctg

SEQ ID NO: 3241931 - DNA, 17 bp, Homo sapiens
tagaacctgggctgtgc

SEQ ID NO: 3241932 - DNA, 22 bp, Homo sapiens
tagaacgtgtttaattaaattt

SEQ ID NO: 3241933 - DNA, 15 bp, Homo sapiens
tagaactcactctgg

SEQ ID NO: 3241934 - DNA, 19 bp, Homo sapiens
tagaactcactctgggctg

SEQ ID NO: 3241935 - DNA, 15 bp, Homo sapiens
tagaactccctttca

SEQ ID NO: 3241936 - DNA, 20 bp, Homo sapiens
tagaactgggtaaatgcaaa

SEQ ID NO: 3241937 - DNA, 15 bp, Homo sapiens
tagaactgtctgtga

SEQ ID NO: 3241938 - DNA, 16 bp, Homo sapiens
tagaactgtctgtgaa

SEQ ID NO: 3241939 - DNA, 15 bp, Homo sapiens
tagaacttactattc

SEQ ID NO: 3241940 - DNA, 23 bp, Homo sapiens
tagaacttcaagaagtaagagct

SEQ ID NO: 3241941 - DNA, 19 bp, Homo sapiens
tagaacttttttaaataaa

SEQ ID NO: 3241942 - DNA, 23 bp, Homo sapiens
tagaacttttttaaataaacttt

SEQ ID NO: 3241943 - DNA, 18 bp, Homo sapiens
tagaagaagctatgtcaa

SEQ ID NO: 3241944 - DNA, 14 bp, Homo sapiens
tagaagataacatt

SEQ ID NO: 3241945 - DNA, 17 bp, Homo sapiens
tagaagataacattttc

SEQ ID NO: 3241946 - DNA, 19 bp, Homo sapiens
tagaagataacattttcaa

SEQ ID NO: 3241947 - DNA, 21 bp, Homo sapiens
tagaagcattccttctttgat

SEQ ID NO: 3241948 - DNA, 16 bp, Homo sapiens
tagaagctgtagtagc

SEQ ID NO: 3241949 - DNA, 16 bp, Homo sapiens
tagaaggaatttgtac

SEQ ID NO: 3241950 - DNA, 20 bp, Homo sapiens
tagaaggaggttctaatatt

SEQ ID NO: 3241951 - DNA, 17 bp, Homo sapiens
tagaaggcttaagaact

SEQ ID NO: 3241952 - DNA, 19 bp, Homo sapiens
tagaaggttgacacagttg

SEQ ID NO: 3241953 - DNA, 16 bp, Homo sapiens
tagaagtcacacagta

SEQ ID NO: 3241954 - DNA, 16 bp, Homo sapiens
tagaagtcttagatgt

SEQ ID NO: 3241955 - DNA, 23 bp, Homo sapiens
tagaagtgcatttctgaatagaa

SEQ ID NO: 3241956 - DNA, 21 bp, Homo sapiens
tagaagtttgtccatttgtaa

SEQ ID NO: 3241957 - DNA, 22 bp, Homo sapiens
tagaagtttttgtactgtaaag

SEQ ID NO: 3241958 - DNA, 13 bp, Homo sapiens
tagaataaaagct

SEQ ID NO: 3241959 - DNA, 23 bp, Homo sapiens
tagaataaaagctataaagtata

SEQ ID NO: 3241960 - DNA, 21 bp, Homo sapiens
tagaataaaggcagttttcta

SEQ ID NO: 3241961 - DNA, 16 bp, Homo sapiens
tagaataaggaggagg

SEQ ID NO: 3241962 - DNA, 18 bp, Homo sapiens
tagaatataattatcgga

SEQ ID NO: 3241963 - DNA, 15 bp, Homo sapiens
tagaatatttattac

SEQ ID NO: 3241964 - DNA, 16 bp, Homo sapiens
tagaatcaatttaagt

SEQ ID NO: 3241965 - DNA, 12 bp, Homo sapiens
tagaatgatcta

SEQ ID NO: 3241966 - DNA, 15 bp, Homo sapiens
tagaatgattaatca

SEQ ID NO: 3241967 - DNA, 16 bp, Homo sapiens
tagaatgatttcatgc

SEQ ID NO: 3241968 - DNA, 13 bp, Homo sapiens
tagaattaccatt

SEQ ID NO: 3241969 - DNA, 16 bp, Homo sapiens
tagaattagtatgtct

SEQ ID NO: 3241970 - DNA, 22 bp, Homo sapiens
tagaattataactgtaaagatg

SEQ ID NO: 3241971 - DNA, 19 bp, Homo sapiens
tagaattatctaatttata

SEQ ID NO: 3241972 - DNA, 21 bp, Homo sapiens
tagaattatctaatttataaa

SEQ ID NO: 3241973 - DNA, 13 bp, Homo sapiens
tagaattgcattg

SEQ ID NO: 3241974 - DNA, 14 bp, Homo sapiens
tagaattgcattga

SEQ ID NO: 3241975 - DNA, 15 bp, Homo sapiens
tagaattgtatatag

SEQ ID NO: 3241976 - DNA, 12 bp, Homo sapiens
tagaattgttat

SEQ ID NO: 3241977 - DNA, 13 bp, Homo sapiens
tagaattgttata

SEQ ID NO: 3241978 - DNA, 23 bp, Homo sapiens
tagaatttattcaattcctctgg

SEQ ID NO: 3241979 - DNA, 17 bp, Homo sapiens
tagacaaatagaaaatg

SEQ ID NO: 3241980 - DNA, 19 bp, Homo sapiens
tagacaaatatttggaggg

SEQ ID NO: 3241981 - DNA, 19 bp, Homo sapiens
tagacaacgatgaatttct

SEQ ID NO: 3241982 - DNA, 14 bp, Homo sapiens
tagacaactagatt

SEQ ID NO: 3241983 - DNA, 14 bp, Homo sapiens
tagacaatatacaa

SEQ ID NO: 3241984 - DNA, 19 bp, Homo sapiens
taggcatcccaggggacca

SEQ ID NO: 3241985 - DNA, 20 bp, Homo sapiens
taggcatgaagagcaaaaat

SEQ ID NO: 3241986 - DNA, 16 bp, Homo sapiens
taggcatgtcccaccc

SEQ ID NO: 3241987 - DNA, 16 bp, Homo sapiens
taggcattaacacaaa

SEQ ID NO: 3241988 - DNA, 20 bp, Homo sapiens
taggccagggcatgtgtatg

SEQ ID NO: 3241989 - DNA, 12 bp, Homo sapiens
taggcccaggat

SEQ ID NO: 3241990 - DNA, 14 bp, Homo sapiens
taggcccccacttg

SEQ ID NO: 3241991 - DNA, 19 bp, Homo sapiens
taggcccccacttgcctct

SEQ ID NO: 3241992 - DNA, 20 bp, Homo sapiens
taggcccctcctagacccag

SEQ ID NO: 3241993 - DNA, 15 bp, Homo sapiens
taggcccttgtcctg

SEQ ID NO: 3241994 - DNA, 23 bp, Homo sapiens
taggcccttgtcctgccagctgc

SEQ ID NO: 3241995 - DNA, 14 bp, Homo sapiens
taggcctggccaga

SEQ ID NO: 3241996 - DNA, 18 bp, Homo sapiens
taggccttttaacatttt

SEQ ID NO: 3241997 - DNA, 15 bp, Homo sapiens
taggcggcgattttt

SEQ ID NO: 3241998 - DNA, 16 bp, Homo sapiens
taggcgtgagaagcat

SEQ ID NO: 3241999 - DNA, 23 bp, Homo sapiens
taggctaggacgttggcctcagg

SEQ ID NO: 3242000 - DNA, 22 bp, Homo sapiens
taggctcctgccagtgtggaac

SEQ ID NO: 3242001 - DNA, 20 bp, Homo sapiens
taggctcttaagcagcatgg

SEQ ID NO: 3242002 - DNA, 13 bp, Homo sapiens
taggctgttcctt

SEQ ID NO: 3242003 - DNA, 14 bp, Homo sapiens
tagggaaaggtttt

SEQ ID NO: 3242004 - DNA, 18 bp, Homo sapiens
tagggaaaggttttgtat

SEQ ID NO: 3242005 - DNA, 13 bp, Homo sapiens
tagggaactctgg

SEQ ID NO: 3242006 - DNA, 15 bp, Homo sapiens
tagggaactggggaa

SEQ ID NO: 3242007 - DNA, 16 bp, Homo sapiens
tagggaatctggatta

SEQ ID NO: 3242008 - DNA, 14 bp, Homo sapiens
tagggacttaaaaa

SEQ ID NO: 3242009 - DNA, 16 bp, Homo sapiens
tagggaggcagcctcc

SEQ ID NO: 3242010 - DNA, 15 bp, Homo sapiens
tagggatgcctcctt

SEQ ID NO: 3242011 - DNA, 16 bp, Homo sapiens
tagggatgcctccttt

SEQ ID NO: 3242012 - DNA, 20 bp, Homo sapiens
tagggatgcggatcctgctg

SEQ ID NO: 3242013 - DNA, 20 bp, Homo sapiens
tagggcaccaggggtttctc

SEQ ID NO: 3242014 - DNA, 16 bp, Homo sapiens
tagggcttttattttt

SEQ ID NO: 3242015 - DNA, 20 bp, Homo sapiens
tagggcttttattttttctt

SEQ ID NO: 3242016 - DNA, 16 bp, Homo sapiens
taggggaacagaccag

SEQ ID NO: 3242017 - DNA, 19 bp, Homo sapiens
taggggaacagaccagtga

SEQ ID NO: 3242018 - DNA, 23 bp, Homo sapiens
taggggaggggttgccacaggcc

SEQ ID NO: 3242019 - DNA, 18 bp, Homo sapiens
taggggccacctcctccc

SEQ ID NO: 3242020 - DNA, 20 bp, Homo sapiens
taggggccacctcctccccc

SEQ ID NO: 3242021 - DNA, 22 bp, Homo sapiens
taggggccacctcctccccctg

SEQ ID NO: 3242022 - DNA, 14 bp, Homo sapiens
tagggtaaaaaaag

SEQ ID NO: 3242023 - DNA, 14 bp, Homo sapiens
tagggtaaaaattg

SEQ ID NO: 3242024 - DNA, 20 bp, Homo sapiens
tagggtactaaatttaaatt

SEQ ID NO: 3242025 - DNA, 18 bp, Homo sapiens
tagggtagaatgattaat

SEQ ID NO: 3242026 - DNA, 14 bp, Homo sapiens
tagggtcagccatt

SEQ ID NO: 3242027 - DNA, 15 bp, Homo sapiens
tagggtcggaaccca

SEQ ID NO: 3242028 - DNA, 16 bp, Homo sapiens
tagggtggctttaatt

SEQ ID NO: 3242029 - DNA, 17 bp, Homo sapiens
tagggttataataatgt

SEQ ID NO: 3242030 - DNA, 18 bp, Homo sapiens
tagggttgctggagcctg

SEQ ID NO: 3242031 - DNA, 21 bp, Homo sapiens
taggtaaaatgtatttttcta

SEQ ID NO: 3242032 - DNA, 16 bp, Homo sapiens
taggtaatgttttgta

SEQ ID NO: 3242033 - DNA, 22 bp, Homo sapiens
taggtaatgttttgtatataca

SEQ ID NO: 3242034 - DNA, 16 bp, Homo sapiens
taggtagtttggatat

SEQ ID NO: 3242035 - DNA, 14 bp, Homo sapiens
taggtatgtttgca

SEQ ID NO: 3242036 - DNA, 11 bp, Homo sapiens
taggtattttg

SEQ ID NO: 3242037 - DNA, 16 bp, Homo sapiens
taggtcaaactcccta

SEQ ID NO: 3242038 - DNA, 15 bp, Homo sapiens
taggtcactcctggg

SEQ ID NO: 3242039 - DNA, 20 bp, Homo sapiens
taggtcactggctctccaag

SEQ ID NO: 3242040 - DNA, 21 bp, Homo sapiens
taggtcactggctctccaagt

SEQ ID NO: 3242041 - DNA, 12 bp, Homo sapiens
taggtctccagt

SEQ ID NO: 3242042 - DNA, 16 bp, Homo sapiens
taggtctcctcagggt

SEQ ID NO: 3242043 - DNA, 20 bp, Homo sapiens
taggtctcttctcccagaat

SEQ ID NO: 3242044 - DNA, 12 bp, Homo sapiens
taggtctggttg

SEQ ID NO: 3242045 - DNA, 19 bp, Homo sapiens
taggtctttctctcagtga

SEQ ID NO: 3242046 - DNA, 11 bp, Homo sapiens
taggtgacaga

SEQ ID NO: 3242047 - DNA, 22 bp, Homo sapiens
taggtgcaatttcaaggttcta

SEQ ID NO: 3242048 - DNA, 14 bp, Homo sapiens
taggtgcagctcct

SEQ ID NO: 3242049 - DNA, 17 bp, Homo sapiens
taggtgcagctcctcag

SEQ ID NO: 3242050 - DNA, 16 bp, Homo sapiens
taggtgtcatttccat

SEQ ID NO: 3242051 - DNA, 15 bp, Homo sapiens
taggttatacaataa

SEQ ID NO: 3242052 - DNA, 19 bp, Homo sapiens
taggttatctttttaaaaa

SEQ ID NO: 3242053 - DNA, 17 bp, Homo sapiens
taggttattttgctttg

SEQ ID NO: 3242054 - DNA, 14 bp, Homo sapiens
taggttcaattccc

SEQ ID NO: 3242055 - DNA, 17 bp, Homo sapiens
taggttctaaagttcta

SEQ ID NO: 3242056 - DNA, 21 bp, Homo sapiens
taggttctaaagttctaagat

SEQ ID NO: 3242057 - DNA, 14 bp, Homo sapiens
taggtttcaaagat

SEQ ID NO: 3242058 - DNA, 21 bp, Homo sapiens
taggtttttccttatttgctt

SEQ ID NO: 3242059 - DNA, 20 bp, Homo sapiens
taggtttttctcatgtatct

SEQ ID NO: 3242060 - DNA, 18 bp, Homo sapiens
tagtaaaaccttgttcta

SEQ ID NO: 3242061 - DNA, 18 bp, Homo sapiens
tagtaaaatttatttcat

SEQ ID NO: 3242062 - DNA, 13 bp, Homo sapiens
tagtaactgacat

SEQ ID NO: 3242063 - DNA, 15 bp, Homo sapiens
tagtaactgacatga

SEQ ID NO: 3242064 - DNA, 17 bp, Homo sapiens
tagtaactttttatgta

SEQ ID NO: 3242065 - DNA, 22 bp, Homo sapiens
tagtaagaataccacatcaaat

SEQ ID NO: 3242066 - DNA, 21 bp, Homo sapiens
tagtaagtaattatgcactaa

SEQ ID NO: 3242067 - DNA, 15 bp, Homo sapiens
tagtaagttaatgta

SEQ ID NO: 3242068 - DNA, 14 bp, Homo sapiens
tagtaatcacagtt

SEQ ID NO: 3242069 - DNA, 12 bp, Homo sapiens
tagtaatctgta

SEQ ID NO: 3242070 - DNA, 18 bp, Homo sapiens
tagtaatggcagagcagt

SEQ ID NO: 3242071 - DNA, 14 bp, Homo sapiens
tagtaatttctttt

SEQ ID NO: 3242072 - DNA, 20 bp, Homo sapiens
tagtaatttctttttttcct

SEQ ID NO: 3242073 - DNA, 21 bp, Homo sapiens
tagtaatttctttttttcctt

SEQ ID NO: 3242074 - DNA, 15 bp, Homo sapiens
tagtacaaattataa

SEQ ID NO: 3242075 - DNA, 16 bp, Homo sapiens
tagtaccatttataca

SEQ ID NO: 3242076 - DNA, 17 bp, Homo sapiens
tagtactcctgcaaaat

SEQ ID NO: 3242077 - DNA, 20 bp, Homo sapiens
tagtactcctgcaaaatttt

SEQ ID NO: 3242078 - DNA, 21 bp, Homo sapiens
tagtactcctgcaaaatttta

SEQ ID NO: 3242079 - DNA, 16 bp, Homo sapiens
tagtactgtattggct

SEQ ID NO: 3242080 - DNA, 12 bp, Homo sapiens
tagtagaaaaat

SEQ ID NO: 3242081 - DNA, 13 bp, Homo sapiens
tagtagagacagg

SEQ ID NO: 3242082 - DNA, 22 bp, Homo sapiens
tagtagcccttcagtcttaata

SEQ ID NO: 3242083 - DNA, 19 bp, Homo sapiens
tagtatatctggacaagcc

SEQ ID NO: 3242084 - DNA, 16 bp, Homo sapiens
tagtatcagtgtttta

SEQ ID NO: 3242085 - DNA, 19 bp, Homo sapiens
tagtatcagtgttttaaat

SEQ ID NO: 3242086 - DNA, 14 bp, Homo sapiens
tagtatctaacatg

SEQ ID NO: 3242087 - DNA, 20 bp, Homo sapiens
tagtatgacgctgatacata

SEQ ID NO: 3242088 - DNA, 16 bp, Homo sapiens
tagtatttatttaatg

SEQ ID NO: 3242089 - DNA, 20 bp, Homo sapiens
tagtatttctcctttgcaat

SEQ ID NO: 3242090 - DNA, 21 bp, Homo sapiens
tagtatttctcctttgcaata

SEQ ID NO: 3242091 - DNA, 13 bp, Homo sapiens
tagtatttttatc

SEQ ID NO: 3242092 - DNA, 18 bp, Homo sapiens
tagtattttttgtataat

SEQ ID NO: 3242093 - DNA, 22 bp, Homo sapiens
tagtcaaaactatttttgtaaa

SEQ ID NO: 3242094 - DNA, 21 bp, Homo sapiens
tagtcacatggcctatgcaca

SEQ ID NO: 3242095 - DNA, 13 bp, Homo sapiens
tagtcatgtgacc

SEQ ID NO: 3242096 - DNA, 13 bp, Homo sapiens
tagtcattgtcat

SEQ ID NO: 3242097 - DNA, 13 bp, Homo sapiens
tagtcatttacta

SEQ ID NO: 3242098 - DNA, 14 bp, Homo sapiens
tagtcatttactaa

SEQ ID NO: 3242099 - DNA, 13 bp, Homo sapiens
tagtcatttattt

SEQ ID NO: 3242100 - DNA, 19 bp, Homo sapiens
tagtcatttattttaaaaa

SEQ ID NO: 3242101 - DNA, 20 bp, Homo sapiens
tagtcccttcccctccctgg

SEQ ID NO: 3242102 - DNA, 22 bp, Homo sapiens
tagtcctattctattgcagtta

SEQ ID NO: 3242103 - DNA, 19 bp, Homo sapiens
tagtctcactgcttgaact

SEQ ID NO: 3242104 - DNA, 19 bp, Homo sapiens
tagtctcagtttgtgtgtc

SEQ ID NO: 3242105 - DNA, 22 bp, Homo sapiens
tagtctcagtttgtgtgtctta

SEQ ID NO: 3242106 - DNA, 21 bp, Homo sapiens
tagtctcattacttttgaagt

SEQ ID NO: 3242107 - DNA, 13 bp, Homo sapiens
tagtctcctgggt

SEQ ID NO: 3242108 - DNA, 19 bp, Homo sapiens
tagtctcctttgcactgag

SEQ ID NO: 3242109 - DNA, 16 bp, Homo sapiens
tagtctctgttcttca

SEQ ID NO: 3242110 - DNA, 17 bp, Homo sapiens
tatacgtgtagctatat

SEQ ID NO: 3242111 - DNA, 19 bp, Homo sapiens
tatacgtgtagctatatct

SEQ ID NO: 3242112 - DNA, 19 bp, Homo sapiens
tatactaaaccaactctaa

SEQ ID NO: 3242113 - DNA, 15 bp, Homo sapiens
tatactaagaaaaga

SEQ ID NO: 3242114 - DNA, 20 bp, Homo sapiens
tatactagggagccatttga

SEQ ID NO: 3242115 - DNA, 22 bp, Homo sapiens
tatactagggagccatttgaga

SEQ ID NO: 3242116 - DNA, 16 bp, Homo sapiens
tatactatatttatgg

SEQ ID NO: 3242117 - DNA, 13 bp, Homo sapiens
tatactatgaaat

SEQ ID NO: 3242118 - DNA, 15 bp, Homo sapiens
tatactcaagtttca

SEQ ID NO: 3242119 - DNA, 18 bp, Homo sapiens
tatactccagtgtacata

SEQ ID NO: 3242120 - DNA, 19 bp, Homo sapiens
tatactctttctgtatata

SEQ ID NO: 3242121 - DNA, 22 bp, Homo sapiens
tatactgaaggaaaaacacaag

SEQ ID NO: 3242122 - DNA, 17 bp, Homo sapiens
tatactgattatgtctt

SEQ ID NO: 3242123 - DNA, 20 bp, Homo sapiens
tatactgattatgtctttta

SEQ ID NO: 3242124 - DNA, 17 bp, Homo sapiens
tatactgcatacttttt

SEQ ID NO: 3242125 - DNA, 18 bp, Homo sapiens
tatactgggttcttgttt

SEQ ID NO: 3242126 - DNA, 14 bp, Homo sapiens
tatactgggtttca

SEQ ID NO: 3242127 - DNA, 15 bp, Homo sapiens
tatactgtaatttag

SEQ ID NO: 3242128 - DNA, 16 bp, Homo sapiens
tatactgtacttaata

SEQ ID NO: 3242129 - DNA, 21 bp, Homo sapiens
tatactgtatttctaagaagt

SEQ ID NO: 3242130 - DNA, 22 bp, Homo sapiens
tatactgtgtgggatacttagt

SEQ ID NO: 3242131 - DNA, 12 bp, Homo sapiens
tatacttcaaaa

SEQ ID NO: 3242132 - DNA, 21 bp, Homo sapiens
tatacttccttacttttaagg

SEQ ID NO: 3242133 - DNA, 16 bp, Homo sapiens
tatacttgactctaat

SEQ ID NO: 3242134 - DNA, 19 bp, Homo sapiens
tatacttgtggttttcaaa

SEQ ID NO: 3242135 - DNA, 20 bp, Homo sapiens
tatactttatatctgtaatg

SEQ ID NO: 3242136 - DNA, 20 bp, Homo sapiens
tatactttgtggaccaatta

SEQ ID NO: 3242137 - DNA, 22 bp, Homo sapiens
tatacttttcccctgttaaaca

SEQ ID NO: 3242138 - DNA, 19 bp, Homo sapiens
tatacttttttcttattta

SEQ ID NO: 3242139 - DNA, 18 bp, Homo sapiens
tatagaaggaatttgtac

SEQ ID NO: 3242140 - DNA, 20 bp, Homo sapiens
tatagaatacttttttctag

SEQ ID NO: 3242141 - DNA, 13 bp, Homo sapiens
tatagaattgtag

SEQ ID NO: 3242142 - DNA, 22 bp, Homo sapiens
tatagacaacgatgaatttctt

SEQ ID NO: 3242143 - DNA, 21 bp, Homo sapiens
tatagatataatgaacaaaat

SEQ ID NO: 3242144 - DNA, 21 bp, Homo sapiens
tatagattagaaaaattccta

SEQ ID NO: 3242145 - DNA, 12 bp, Homo sapiens
tatagattctaa

SEQ ID NO: 3242146 - DNA, 13 bp, Homo sapiens
tatagattctaaa

SEQ ID NO: 3242147 - DNA, 14 bp, Homo sapiens
tatagattctaaag

SEQ ID NO: 3242148 - DNA, 16 bp, Homo sapiens
tatagcaacaacaatt

SEQ ID NO: 3242149 - DNA, 13 bp, Homo sapiens
tatagcaagatat

SEQ ID NO: 3242150 - DNA, 18 bp, Homo sapiens
tatagcacctttcaacca

SEQ ID NO: 3242151 - DNA, 13 bp, Homo sapiens
tatagcactttga

SEQ ID NO: 3242152 - DNA, 23 bp, Homo sapiens
tatagcactttgaaatacctcat

SEQ ID NO: 3242153 - DNA, 18 bp, Homo sapiens
tatagcagcaaaaatata

SEQ ID NO: 3242154 - DNA, 20 bp, Homo sapiens
tatagcagcaaaaatataaa

SEQ ID NO: 3242155 - DNA, 20 bp, Homo sapiens
tatagcctaggtgacagagt

SEQ ID NO: 3242156 - DNA, 12 bp, Homo sapiens
tatagcctgcct

SEQ ID NO: 3242157 - DNA, 15 bp, Homo sapiens
tatagcctgcctcag

SEQ ID NO: 3242158 - DNA, 16 bp, Homo sapiens
tatagcctgcctcagt

SEQ ID NO: 3242159 - DNA, 11 bp, Homo sapiens
tatagctatta

SEQ ID NO: 3242160 - DNA, 21 bp, Homo sapiens
tatagctgcaagtgtatctcc

SEQ ID NO: 3242161 - DNA, 22 bp, Homo sapiens
tataggaaaaaaactgggataa

SEQ ID NO: 3242162 - DNA, 19 bp, Homo sapiens
tataggaatagaggaagaa

SEQ ID NO: 3242163 - DNA, 18 bp, Homo sapiens
tataggagccttaatttt

SEQ ID NO: 3242164 - DNA, 23 bp, Homo sapiens
tataggtagatccagatccagac

SEQ ID NO: 3242165 - DNA, 14 bp, Homo sapiens
tataggtcactcct

SEQ ID NO: 3242166 - DNA, 23 bp, Homo sapiens
tatagtatgtgacttttctgatt

SEQ ID NO: 3242167 - DNA, 20 bp, Homo sapiens
tatagtctaagactatatat

SEQ ID NO: 3242168 - DNA, 19 bp, Homo sapiens
tatagtgcctaaaattgta

SEQ ID NO: 3242169 - DNA, 22 bp, Homo sapiens
tatagtgcctaaaattgtatga

SEQ ID NO: 3242170 - DNA, 18 bp, Homo sapiens
tatagtgtaaaataagaa

SEQ ID NO: 3242171 - DNA, 21 bp, Homo sapiens
tatagtgtaaaataagaatga

SEQ ID NO: 3242172 - DNA, 13 bp, Homo sapiens
tatagttactgtg

SEQ ID NO: 3242173 - DNA, 18 bp, Homo sapiens
tatagttactgtgtaatt

SEQ ID NO: 3242174 - DNA, 12 bp, Homo sapiens
tatagttctaga

SEQ ID NO: 3242175 - DNA, 13 bp, Homo sapiens
tatagttctagac

SEQ ID NO: 3242176 - DNA, 18 bp, Homo sapiens
tatagtttaaaacacatt

SEQ ID NO: 3242177 - DNA, 18 bp, Homo sapiens
tatagtttgtacatgcat

SEQ ID NO: 3242178 - DNA, 15 bp, Homo sapiens
tatagttttactttt

SEQ ID NO: 3242179 - DNA, 22 bp, Homo sapiens
tatagttttgaatcctttgcct

SEQ ID NO: 3242180 - DNA, 23 bp, Homo sapiens
tatagttttgaatcctttgcctg

SEQ ID NO: 3242181 - DNA, 12 bp, Homo sapiens
tatataaaaaga

SEQ ID NO: 3242182 - DNA, 19 bp, Homo sapiens
tatataaaaagaaaagata

SEQ ID NO: 3242183 - DNA, 23 bp, Homo sapiens
tatataaaaagaaaagataaaga

SEQ ID NO: 3242184 - DNA, 14 bp, Homo sapiens
tatataaaataact

SEQ ID NO: 3242185 - DNA, 14 bp, Homo sapiens
tatataaaatgtat

SEQ ID NO: 3242186 - DNA, 15 bp, Homo sapiens
tatataaagaatata

SEQ ID NO: 3242187 - DNA, 16 bp, Homo sapiens
tatataaagatatata

SEQ ID NO: 3242188 - DNA, 14 bp, Homo sapiens
tatataaagtatag

SEQ ID NO: 3242189 - DNA, 16 bp, Homo sapiens
tatataaagtattctt

SEQ ID NO: 3242190 - DNA, 12 bp, Homo sapiens
tatataaatgta

SEQ ID NO: 3242191 - DNA, 13 bp, Homo sapiens
tatataaatgtat

SEQ ID NO: 3242192 - DNA, 13 bp, Homo sapiens
tatataacagata

SEQ ID NO: 3242193 - DNA, 17 bp, Homo sapiens
tatataacagatacatt

SEQ ID NO: 3242194 - DNA, 19 bp, Homo sapiens
tatataagtgtacatatgt

SEQ ID NO: 3242195 - DNA, 23 bp, Homo sapiens
tatataagtgtacatatgtgctg

SEQ ID NO: 3242196 - DNA, 13 bp, Homo sapiens
tatataattcact

SEQ ID NO: 3242197 - DNA, 17 bp, Homo sapiens
tatataattctgtacat

SEQ ID NO: 3242198 - DNA, 14 bp, Homo sapiens
tatatacacatata

SEQ ID NO: 3242199 - DNA, 18 bp, Homo sapiens
tatatacacatataccta

SEQ ID NO: 3242200 - DNA, 14 bp, Homo sapiens
tatatacagtaact

SEQ ID NO: 3242201 - DNA, 12 bp, Homo sapiens
tatatacagtta

SEQ ID NO: 3242202 - DNA, 18 bp, Homo sapiens
tatatacatgtgtgtata

SEQ ID NO: 3242203 - DNA, 19 bp, Homo sapiens
tatatacctggcttttact

SEQ ID NO: 3242204 - DNA, 21 bp, Homo sapiens
tatatacttgtggttttcaaa

SEQ ID NO: 3242205 - DNA, 14 bp, Homo sapiens
tatatacttttaaa

SEQ ID NO: 3242206 - DNA, 12 bp, Homo sapiens
tatatacttttt

SEQ ID NO: 3242207 - DNA, 21 bp, Homo sapiens
tatatagaatgatctattgct

SEQ ID NO: 3242208 - DNA, 13 bp, Homo sapiens
tatatagagatgt

SEQ ID NO: 3242209 - DNA, 14 bp, Homo sapiens
tatatagagatgtt

SEQ ID NO: 3242210 - DNA, 10 bp, Homo sapiens
tatatataaa

SEQ ID NO: 3242211 - DNA, 15 bp, Homo sapiens
tatatataaaatatc

SEQ ID NO: 3242212 - DNA, 14 bp, Homo sapiens
tatatataaagaat

SEQ ID NO: 3242213 - DNA, 18 bp, Homo sapiens
tatatataattctgtaca

SEQ ID NO: 3242214 - DNA, 20 bp, Homo sapiens
tatatataattctgtacata

SEQ ID NO: 3242215 - DNA, 11 bp, Homo sapiens
tatatatacat

SEQ ID NO: 3242216 - DNA, 13 bp, Homo sapiens
tatatatacatat

SEQ ID NO: 3242217 - DNA, 12 bp, Homo sapiens
tatatatagaat

SEQ ID NO: 3242218 - DNA, 14 bp, Homo sapiens
tatatatataaagt

SEQ ID NO: 3242219 - DNA, 14 bp, Homo sapiens
tatatatataaata

SEQ ID NO: 3242220 - DNA, 14 bp, Homo sapiens
tatatatatataaa

SEQ ID NO: 3242221 - DNA, 15 bp, Homo sapiens
tatatatatatataa

SEQ ID NO: 3242222 - DNA, 16 bp, Homo sapiens
tatatatgatcattga

SEQ ID NO: 3242223 - DNA, 14 bp, Homo sapiens
tatatatgtgtatg

SEQ ID NO: 3242224 - DNA, 15 bp, Homo sapiens
tatatattatgtgaa

SEQ ID NO: 3242225 - DNA, 19 bp, Homo sapiens
tatatattatgtgaagaat

SEQ ID NO: 3242226 - DNA, 17 bp, Homo sapiens
tatatattcttataaaa

SEQ ID NO: 3242227 - DNA, 14 bp, Homo sapiens
tatatatttataac

SEQ ID NO: 3242228 - DNA, 13 bp, Homo sapiens
tatatattttatg

SEQ ID NO: 3242229 - DNA, 15 bp, Homo sapiens
tatatattttatgat

SEQ ID NO: 3242230 - DNA, 22 bp, Homo sapiens
tatatcaacagatagttgtgtt

SEQ ID NO: 3242231 - DNA, 14 bp, Homo sapiens
tatatcatatgtat

SEQ ID NO: 3242232 - DNA, 16 bp, Homo sapiens
tatatcattctacaga

SEQ ID NO: 3242233 - DNA, 20 bp, Homo sapiens
tatatcattctacagaataa

SEQ ID NO: 3242234 - DNA, 21 bp, Homo sapiens
tatatcattctacagaataat

SEQ ID NO: 3242235 - DNA, 15 bp, Homo sapiens
tatatccatgtactg

SEQ ID NO: 3242236 - DNA, 17 bp, Homo sapiens
tatatccccactactca

SEQ ID NO: 3242237 - DNA, 16 bp, Homo sapiens
tattctactgtacttt

SEQ ID NO: 3242238 - DNA, 19 bp, Homo sapiens
tattctagctaatgtaata

SEQ ID NO: 3242239 - DNA, 17 bp, Homo sapiens
tattctagggtttctta

SEQ ID NO: 3242240 - DNA, 18 bp, Homo sapiens
tattctagggtttcttaa

SEQ ID NO: 3242241 - DNA, 19 bp, Homo sapiens
tattctataaaactctgca

SEQ ID NO: 3242242 - DNA, 14 bp, Homo sapiens
tattctcaaagcag

SEQ ID NO: 3242243 - DNA, 17 bp, Homo sapiens
tattctcatgcctcagc

SEQ ID NO: 3242244 - DNA, 15 bp, Homo sapiens
tattctgaaaggaaa

SEQ ID NO: 3242245 - DNA, 22 bp, Homo sapiens
tattctgggcaccacaaaatat

SEQ ID NO: 3242246 - DNA, 19 bp, Homo sapiens
tattctgtagattctgtgg

SEQ ID NO: 3242247 - DNA, 22 bp, Homo sapiens
tattctgtagattctgtggaac

SEQ ID NO: 3242248 - DNA, 18 bp, Homo sapiens
tattctgtcagtgttaaa

SEQ ID NO: 3242249 - DNA, 22 bp, Homo sapiens
tattctgtgttgcattattcat

SEQ ID NO: 3242250 - DNA, 16 bp, Homo sapiens
tattctgttggccagt

SEQ ID NO: 3242251 - DNA, 20 bp, Homo sapiens
tattcttattggaaatgtac

SEQ ID NO: 3242252 - DNA, 14 bp, Homo sapiens
tattcttcataaca

SEQ ID NO: 3242253 - DNA, 13 bp, Homo sapiens
tattcttggtttt

SEQ ID NO: 3242254 - DNA, 14 bp, Homo sapiens
tattcttggttttc

SEQ ID NO: 3242255 - DNA, 13 bp, Homo sapiens
tattcttgtgctt

SEQ ID NO: 3242256 - DNA, 18 bp, Homo sapiens
tattctttggttgtgaat

SEQ ID NO: 3242257 - DNA, 13 bp, Homo sapiens
tattgaaaacttc

SEQ ID NO: 3242258 - DNA, 14 bp, Homo sapiens
tattgaaaacttca

SEQ ID NO: 3242259 - DNA, 18 bp, Homo sapiens
tattgaaaacttcaaagc

SEQ ID NO: 3242260 - DNA, 13 bp, Homo sapiens
tattgaaattcta

SEQ ID NO: 3242261 - DNA, 16 bp, Homo sapiens
tattgaagaaaagcac

SEQ ID NO: 3242262 - DNA, 20 bp, Homo sapiens
tattgaagaaaagcactttt

SEQ ID NO: 3242263 - DNA, 20 bp, Homo sapiens
tattgaaggaagccaaattt

SEQ ID NO: 3242264 - DNA, 21 bp, Homo sapiens
tattgaaggaagccaaattta

SEQ ID NO: 3242265 - DNA, 22 bp, Homo sapiens
tattgaaggaagccaaatttat

SEQ ID NO: 3242266 - DNA, 14 bp, Homo sapiens
tattgaatgttaaa

SEQ ID NO: 3242267 - DNA, 13 bp, Homo sapiens
tattgacacagaa

SEQ ID NO: 3242268 - DNA, 18 bp, Homo sapiens
tattgacacagaaaatgt

SEQ ID NO: 3242269 - DNA, 20 bp, Homo sapiens
tattgacacagaaaatgttg

SEQ ID NO: 3242270 - DNA, 14 bp, Homo sapiens
tattgaccattttt

SEQ ID NO: 3242271 - DNA, 22 bp, Homo sapiens
tattgagaatcccttaaaatta

SEQ ID NO: 3242272 - DNA, 14 bp, Homo sapiens
tattgagatttctt

SEQ ID NO: 3242273 - DNA, 14 bp, Homo sapiens
tattgagtttgtag

SEQ ID NO: 3242274 - DNA, 20 bp, Homo sapiens
tattgatctttttatcatga

SEQ ID NO: 3242275 - DNA, 21 bp, Homo sapiens
tattgatctttttatcatgat

SEQ ID NO: 3242276 - DNA, 18 bp, Homo sapiens
tattgatgaaaagattta

SEQ ID NO: 3242277 - DNA, 14 bp, Homo sapiens
tattgatgtcagta

SEQ ID NO: 3242278 - DNA, 16 bp, Homo sapiens
tattgatgttaacaag

SEQ ID NO: 3242279 - DNA, 23 bp, Homo sapiens
tattgatgttaacaagaggggaa

SEQ ID NO: 3242280 - DNA, 14 bp, Homo sapiens
tattgattgggaaa

SEQ ID NO: 3242281 - DNA, 18 bp, Homo sapiens
tattgattgggaaaacat

SEQ ID NO: 3242282 - DNA, 20 bp, Homo sapiens
tattgattgggaaaacattt

SEQ ID NO: 3242283 - DNA, 21 bp, Homo sapiens
tattgcaaaggttccaactgt

SEQ ID NO: 3242284 - DNA, 18 bp, Homo sapiens
tattgcaaggcagtctct

SEQ ID NO: 3242285 - DNA, 18 bp, Homo sapiens
tattgcaataaagtataa

SEQ ID NO: 3242286 - DNA, 20 bp, Homo sapiens
tattgcaggagacattttca

SEQ ID NO: 3242287 - DNA, 15 bp, Homo sapiens
tattgcagttataga

SEQ ID NO: 3242288 - DNA, 15 bp, Homo sapiens
tattgcattaatttt

SEQ ID NO: 3242289 - DNA, 16 bp, Homo sapiens
tattgccaactcttct

SEQ ID NO: 3242290 - DNA, 17 bp, Homo sapiens
tattgccaactcttcta

SEQ ID NO: 3242291 - DNA, 13 bp, Homo sapiens
tattgcccacgct

SEQ ID NO: 3242292 - DNA, 16 bp, Homo sapiens
tattgcccatgggata

SEQ ID NO: 3242293 - DNA, 13 bp, Homo sapiens
tattgctactata

SEQ ID NO: 3242294 - DNA, 15 bp, Homo sapiens
tattgctgagagaaa

SEQ ID NO: 3242295 - DNA, 16 bp, Homo sapiens
tattgctgattttaaa

SEQ ID NO: 3242296 - DNA, 13 bp, Homo sapiens
tattgcttcttgt

SEQ ID NO: 3242297 - DNA, 18 bp, Homo sapiens
tattggaaatggatgcaa

SEQ ID NO: 3242298 - DNA, 19 bp, Homo sapiens
tattggaaatgtacttttg

SEQ ID NO: 3242299 - DNA, 16 bp, Homo sapiens
tattggaattaacctg

SEQ ID NO: 3242300 - DNA, 21 bp, Homo sapiens
tattggaattaacctggtgct

SEQ ID NO: 3242301 - DNA, 23 bp, Homo sapiens
tattggaattaacctggtgctgg

SEQ ID NO: 3242302 - DNA, 21 bp, Homo sapiens
tattggagggtaaatgatgtg

SEQ ID NO: 3242303 - DNA, 20 bp, Homo sapiens
tattggaggtgagatcacag

SEQ ID NO: 3242304 - DNA, 18 bp, Homo sapiens
tattgggttcattattgg

SEQ ID NO: 3242305 - DNA, 17 bp, Homo sapiens
tattgggtttttattgt

SEQ ID NO: 3242306 - DNA, 19 bp, Homo sapiens
tattggtgcgtttttacag

SEQ ID NO: 3242307 - DNA, 18 bp, Homo sapiens
tattggtggctttccttg

SEQ ID NO: 3242308 - DNA, 16 bp, Homo sapiens
tattgtaaacatgtgt

SEQ ID NO: 3242309 - DNA, 18 bp, Homo sapiens
tattgtaaacatgtgttt

SEQ ID NO: 3242310 - DNA, 17 bp, Homo sapiens
tattgtaagttgtacaa

SEQ ID NO: 3242311 - DNA, 18 bp, Homo sapiens
tattgtaagttgtacaaa

SEQ ID NO: 3242312 - DNA, 20 bp, Homo sapiens
tattgtacaaatgtaagcaa

SEQ ID NO: 3242313 - DNA, 14 bp, Homo sapiens
tattgtacataaaa

SEQ ID NO: 3242314 - DNA, 15 bp, Homo sapiens
tattgtacataaaat

SEQ ID NO: 3242315 - DNA, 17 bp, Homo sapiens
tattgtaccattttcta

SEQ ID NO: 3242316 - DNA, 15 bp, Homo sapiens
tattgtagcatttct

SEQ ID NO: 3242317 - DNA, 16 bp, Homo sapiens
tattgtagcatttctt

SEQ ID NO: 3242318 - DNA, 15 bp, Homo sapiens
tattgtataaaaagt

SEQ ID NO: 3242319 - DNA, 16 bp, Homo sapiens
tattgtataaactatc

SEQ ID NO: 3242320 - DNA, 15 bp, Homo sapiens
tattgtattatttgg

SEQ ID NO: 3242321 - DNA, 18 bp, Homo sapiens
tattgtatttattccata

SEQ ID NO: 3242322 - DNA, 21 bp, Homo sapiens
tattgtcatggggatcaattt

SEQ ID NO: 3242323 - DNA, 19 bp, Homo sapiens
tattgtcctcaccttcaaa

SEQ ID NO: 3242324 - DNA, 18 bp, Homo sapiens
tattgtccttcagagctc

SEQ ID NO: 3242325 - DNA, 16 bp, Homo sapiens
tattgtggatgtgttc

SEQ ID NO: 3242326 - DNA, 20 bp, Homo sapiens
tattgtgggacttattacaa

SEQ ID NO: 3242327 - DNA, 22 bp, Homo sapiens
tattgtggtaggccttttaaca

SEQ ID NO: 3242328 - DNA, 14 bp, Homo sapiens
tattgtgttccttt

SEQ ID NO: 3242329 - DNA, 22 bp, Homo sapiens
tattgtgttgactttataaatt

SEQ ID NO: 3242330 - DNA, 16 bp, Homo sapiens
tattgtgtttgtgtat

SEQ ID NO: 3242331 - DNA, 19 bp, Homo sapiens
tattgttagggtcagccat

SEQ ID NO: 3242332 - DNA, 21 bp, Homo sapiens
tattgttagggtcagccattt

SEQ ID NO: 3242333 - DNA, 18 bp, Homo sapiens
tattgttccaagacattg

SEQ ID NO: 3242334 - DNA, 17 bp, Homo sapiens
tattgttcccagtgaca

SEQ ID NO: 3242335 - DNA, 21 bp, Homo sapiens
tattgttgaacatacttcaaa

SEQ ID NO: 3242336 - DNA, 19 bp, Homo sapiens
tattgttgacaactgtgac

SEQ ID NO: 3242337 - DNA, 20 bp, Homo sapiens
tattgttgacaactgtgact

SEQ ID NO: 3242338 - DNA, 23 bp, Homo sapiens
tattgttgacaactgtgactgta

SEQ ID NO: 3242339 - DNA, 17 bp, Homo sapiens
tattgttgcattgcttt

SEQ ID NO: 3242340 - DNA, 20 bp, Homo sapiens
tattgttggcacagaacagg

SEQ ID NO: 3242341 - DNA, 17 bp, Homo sapiens
tattgtttaaaatgtaa

SEQ ID NO: 3242342 - DNA, 15 bp, Homo sapiens
tattgtttaaaattc

SEQ ID NO: 3242343 - DNA, 20 bp, Homo sapiens
tattgtttaaaattcagttt

SEQ ID NO: 3242344 - DNA, 13 bp, Homo sapiens
tattgtttctgca

SEQ ID NO: 3242345 - DNA, 15 bp, Homo sapiens
tattgtttggtaaat

SEQ ID NO: 3242346 - DNA, 17 bp, Homo sapiens
tattgtttggtaaatgt

SEQ ID NO: 3242347 - DNA, 12 bp, Homo sapiens
tattgttttcag

SEQ ID NO: 3242348 - DNA, 14 bp, Homo sapiens
tatttaaaaaatta

SEQ ID NO: 3242349 - DNA, 19 bp, Homo sapiens
tatttaaaaaattatggaa

SEQ ID NO: 3242350 - DNA, 20 bp, Homo sapiens
tatttaaaaaattatggaat

SEQ ID NO: 3242351 - DNA, 19 bp, Homo sapiens
tatttaaaaatatttcaga

SEQ ID NO: 3242352 - DNA, 18 bp, Homo sapiens
tatttaaaaatatttttg

SEQ ID NO: 3242353 - DNA, 21 bp, Homo sapiens
tatttaaaaattgtttcttga

SEQ ID NO: 3242354 - DNA, 23 bp, Homo sapiens
tatttaaaaattgtttcttgaca

SEQ ID NO: 3242355 - DNA, 15 bp, Homo sapiens
tatttaaaccttttt

SEQ ID NO: 3242356 - DNA, 17 bp, Homo sapiens
tatttaaactcaagaca

SEQ ID NO: 3242357 - DNA, 20 bp, Homo sapiens
tatttaaacttataaatcat

SEQ ID NO: 3242358 - DNA, 21 bp, Homo sapiens
tatttaaacttataaatcata

SEQ ID NO: 3242359 - DNA, 15 bp, Homo sapiens
tatttaaataaaatc

SEQ ID NO: 3242360 - DNA, 23 bp, Homo sapiens
tatttaaatattaccctccaagt

SEQ ID NO: 3242361 - DNA, 23 bp, Homo sapiens
tatttaacagctgaattatctat

SEQ ID NO: 3242362 - DNA, 17 bp, Homo sapiens
tcaaattaataatctta

SEQ ID NO: 3242363 - DNA, 20 bp, Homo sapiens
tcaaattcaatgattcttcc

SEQ ID NO: 3242364 - DNA, 21 bp, Homo sapiens
tcaaattcttctgaactcaaa

SEQ ID NO: 3242365 - DNA, 14 bp, Homo sapiens
tcaaattgctgctt

SEQ ID NO: 3242366 - DNA, 17 bp, Homo sapiens
tcaaattgctgcttgga

SEQ ID NO: 3242367 - DNA, 20 bp, Homo sapiens
tcaaattggactttcaaaat

SEQ ID NO: 3242368 - DNA, 12 bp, Homo sapiens
tcaaattgtatc

SEQ ID NO: 3242369 - DNA, 13 bp, Homo sapiens
tcaaattgtatct

SEQ ID NO: 3242370 - DNA, 20 bp, Homo sapiens
tcaaatttattttaatgtaa

SEQ ID NO: 3242371 - DNA, 21 bp, Homo sapiens
tcaaatttattttaatgtaaa

SEQ ID NO: 3242372 - DNA, 20 bp, Homo sapiens
tcaaattttgagcaaagaaa

SEQ ID NO: 3242373 - DNA, 20 bp, Homo sapiens
tcaacaaagaaacaaagatg

SEQ ID NO: 3242374 - DNA, 18 bp, Homo sapiens
tcaacaaagcacagtgtt

SEQ ID NO: 3242375 - DNA, 23 bp, Homo sapiens
tcaacaaagcacagtgttaaatg

SEQ ID NO: 3242376 - DNA, 18 bp, Homo sapiens
tcaacaaatattcactgg

SEQ ID NO: 3242377 - DNA, 21 bp, Homo sapiens
tcaacaacgtgagagaaagag

SEQ ID NO: 3242378 - DNA, 17 bp, Homo sapiens
tcaacaagggagagacc

SEQ ID NO: 3242379 - DNA, 17 bp, Homo sapiens
tcaacactatatatttt

SEQ ID NO: 3242380 - DNA, 14 bp, Homo sapiens
tcaacagaagcatt

SEQ ID NO: 3242381 - DNA, 22 bp, Homo sapiens
tcaacagaagcatttgtatttt

SEQ ID NO: 3242382 - DNA, 17 bp, Homo sapiens
tcaacagccaagtgtga

SEQ ID NO: 3242383 - DNA, 17 bp, Homo sapiens
tcaacaggcccagggag

SEQ ID NO: 3242384 - DNA, 21 bp, Homo sapiens
tcaacaggcccagggagggaa

SEQ ID NO: 3242385 - DNA, 15 bp, Homo sapiens
tcaacatcaatgttc

SEQ ID NO: 3242386 - DNA, 18 bp, Homo sapiens
tcaacatcaatgttcatt

SEQ ID NO: 3242387 - DNA, 20 bp, Homo sapiens
tcaacatcctgccagcccca

SEQ ID NO: 3242388 - DNA, 15 bp, Homo sapiens
tcaacatgttactga

SEQ ID NO: 3242389 - DNA, 19 bp, Homo sapiens
tcaacatgttactgaccag

SEQ ID NO: 3242390 - DNA, 23 bp, Homo sapiens
tcaacatgttattcaatgtgaca

SEQ ID NO: 3242391 - DNA, 16 bp, Homo sapiens
tcaacattaaggcagt

SEQ ID NO: 3242392 - DNA, 14 bp, Homo sapiens
tcaaccaccatgga

SEQ ID NO: 3242393 - DNA, 16 bp, Homo sapiens
tcaaccactaaagtat

SEQ ID NO: 3242394 - DNA, 23 bp, Homo sapiens
tcaaccactgtaaaatgaaatta

SEQ ID NO: 3242395 - DNA, 14 bp, Homo sapiens
tcaaccagcagatg

SEQ ID NO: 3242396 - DNA, 22 bp, Homo sapiens
tcaaccaggtccagatgtgcta

SEQ ID NO: 3242397 - DNA, 15 bp, Homo sapiens
tcaaccattccccat

SEQ ID NO: 3242398 - DNA, 18 bp, Homo sapiens
tcaacccccatttctatt

SEQ ID NO: 3242399 - DNA, 19 bp, Homo sapiens
tcaaccctcaggggaaaac

SEQ ID NO: 3242400 - DNA, 23 bp, Homo sapiens
tcaaccggaaggaggccaaccag

SEQ ID NO: 3242401 - DNA, 15 bp, Homo sapiens
tcaaccgtacaatgg

SEQ ID NO: 3242402 - DNA, 16 bp, Homo sapiens
tcaacctcctgggcta

SEQ ID NO: 3242403 - DNA, 17 bp, Homo sapiens
tcaacctcttctggctc

SEQ ID NO: 3242404 - DNA, 15 bp, Homo sapiens
tcaacgcagccctgc

SEQ ID NO: 3242405 - DNA, 18 bp, Homo sapiens
tcaacgcagccctgcttt

SEQ ID NO: 3242406 - DNA, 19 bp, Homo sapiens
tcaacgcctcactgaaaca

SEQ ID NO: 3242407 - DNA, 23 bp, Homo sapiens
tcaacgcctcactgaaacatggc

SEQ ID NO: 3242408 - DNA, 12 bp, Homo sapiens
tcaactatttta

SEQ ID NO: 3242409 - DNA, 19 bp, Homo sapiens
tcaactcacctaatgttta

SEQ ID NO: 3242410 - DNA, 14 bp, Homo sapiens
tcaactctacccct

SEQ ID NO: 3242411 - DNA, 16 bp, Homo sapiens
tcaactctacccctgc

SEQ ID NO: 3242412 - DNA, 18 bp, Homo sapiens
tcaactctacccctgctc

SEQ ID NO: 3242413 - DNA, 14 bp, Homo sapiens
tcaactctgagccc

SEQ ID NO: 3242414 - DNA, 16 bp, Homo sapiens
tcaactcttcgaagcc

SEQ ID NO: 3242415 - DNA, 16 bp, Homo sapiens
tcaactctttgttatt

SEQ ID NO: 3242416 - DNA, 22 bp, Homo sapiens
tcaactctttgttatttgaaaa

SEQ ID NO: 3242417 - DNA, 22 bp, Homo sapiens
tcaactgctgtaaaattataaa

SEQ ID NO: 3242418 - DNA, 12 bp, Homo sapiens
tcaactgtataa

SEQ ID NO: 3242419 - DNA, 13 bp, Homo sapiens
tcaacttaacatg

SEQ ID NO: 3242420 - DNA, 19 bp, Homo sapiens
tcaacttcagtactcaaat

SEQ ID NO: 3242421 - DNA, 16 bp, Homo sapiens
tcaacttctggctcct

SEQ ID NO: 3242422 - DNA, 19 bp, Homo sapiens
tcaacttctggctcctcaa

SEQ ID NO: 3242423 - DNA, 13 bp, Homo sapiens
tcaactttactgt

SEQ ID NO: 3242424 - DNA, 18 bp, Homo sapiens
tcaactttactgtaatat

SEQ ID NO: 3242425 - DNA, 16 bp, Homo sapiens
tcaagaaaaaataaat

SEQ ID NO: 3242426 - DNA, 14 bp, Homo sapiens
tcaagaaaatcttt

SEQ ID NO: 3242427 - DNA, 13 bp, Homo sapiens
tcaagaaacagcc

SEQ ID NO: 3242428 - DNA, 18 bp, Homo sapiens
tcaagaaacagccagcaa

SEQ ID NO: 3242429 - DNA, 21 bp, Homo sapiens
tcaagaaagcttcaaactgca

SEQ ID NO: 3242430 - DNA, 18 bp, Homo sapiens
tcaagaagaaaaaggttt

SEQ ID NO: 3242431 - DNA, 15 bp, Homo sapiens
tcaagaagaatgaac

SEQ ID NO: 3242432 - DNA, 12 bp, Homo sapiens
tcaagaagacat

SEQ ID NO: 3242433 - DNA, 19 bp, Homo sapiens
tcaagaagacatggagact

SEQ ID NO: 3242434 - DNA, 17 bp, Homo sapiens
tcaagaagtaagagcta

SEQ ID NO: 3242435 - DNA, 22 bp, Homo sapiens
tcaagaagtgaagaatgcacaa

SEQ ID NO: 3242436 - DNA, 14 bp, Homo sapiens
tcaagagcacacag

SEQ ID NO: 3242437 - DNA, 16 bp, Homo sapiens
tcaagaggcagagttc

SEQ ID NO: 3242438 - DNA, 12 bp, Homo sapiens
tcaagaggctga

SEQ ID NO: 3242439 - DNA, 19 bp, Homo sapiens
tcaagatactgctactgta

SEQ ID NO: 3242440 - DNA, 20 bp, Homo sapiens
tcaagatgcctcctgtcaga

SEQ ID NO: 3242441 - DNA, 18 bp, Homo sapiens
tcaagatgtcagactggc

SEQ ID NO: 3242442 - DNA, 15 bp, Homo sapiens
tcaagattttagggc

SEQ ID NO: 3242443 - DNA, 14 bp, Homo sapiens
tcaagcaaacatca

SEQ ID NO: 3242444 - DNA, 21 bp, Homo sapiens
tcaagcaaacatcaaataaat

SEQ ID NO: 3242445 - DNA, 22 bp, Homo sapiens
tcaagcaaacatcaaataaatt

SEQ ID NO: 3242446 - DNA, 18 bp, Homo sapiens
tcaagcaataattgtttc

SEQ ID NO: 3242447 - DNA, 20 bp, Homo sapiens
tcaagcaataattgtttcca

SEQ ID NO: 3242448 - DNA, 19 bp, Homo sapiens
tcaagcaatcgagatttgg

SEQ ID NO: 3242449 - DNA, 14 bp, Homo sapiens
tcaagcacatgtaa

SEQ ID NO: 3242450 - DNA, 18 bp, Homo sapiens
tcaagcagcgaccgcccc

SEQ ID NO: 3242451 - DNA, 21 bp, Homo sapiens
tcaagcagcgaccgccccctc

SEQ ID NO: 3242452 - DNA, 17 bp, Homo sapiens
tcaagcaggaattatgt

SEQ ID NO: 3242453 - DNA, 16 bp, Homo sapiens
tcaagcagtcgtgcct

SEQ ID NO: 3242454 - DNA, 18 bp, Homo sapiens
tcaagcagtcgtgcctgt

SEQ ID NO: 3242455 - DNA, 18 bp, Homo sapiens
tcaagccaatcccctcct

SEQ ID NO: 3242456 - DNA, 20 bp, Homo sapiens
tcaagccaatcccctccttg

SEQ ID NO: 3242457 - DNA, 19 bp, Homo sapiens
tcaagccagcaacacagag

SEQ ID NO: 3242458 - DNA, 24 bp, Homo sapiens
tcaagccccagcagccctcaacag

SEQ ID NO: 3242459 - DNA, 18 bp, Homo sapiens
tcaagctattctcatgcc

SEQ ID NO: 3242460 - DNA, 18 bp, Homo sapiens
tcaagctgtcccctctgt

SEQ ID NO: 3242461 - DNA, 19 bp, Homo sapiens
tcaagctgtcccctctgtc

SEQ ID NO: 3242462 - DNA, 21 bp, Homo sapiens
tcaagctgtcccctctgtcat

SEQ ID NO: 3242463 - DNA, 15 bp, Homo sapiens
tcaagcttttctgta

SEQ ID NO: 3242464 - DNA, 21 bp, Homo sapiens
tcaaggaaagggggtcccagt

SEQ ID NO: 3242465 - DNA, 19 bp, Homo sapiens
tcaaggaatttcttaactt

SEQ ID NO: 3242466 - DNA, 19 bp, Homo sapiens
tcaaggacttgaaagcatc

SEQ ID NO: 3242467 - DNA, 19 bp, Homo sapiens
tcaaggataccttcttatt

SEQ ID NO: 3242468 - DNA, 15 bp, Homo sapiens
tcaaggcaaaaatat

SEQ ID NO: 3242469 - DNA, 16 bp, Homo sapiens
tcaaggcactctagat

SEQ ID NO: 3242470 - DNA, 21 bp, Homo sapiens
tcaaggcactctagattccat

SEQ ID NO: 3242471 - DNA, 18 bp, Homo sapiens
tcaaggctgcttagaatc

SEQ ID NO: 3242472 - DNA, 15 bp, Homo sapiens
tcaagggctgtcatt

SEQ ID NO: 3242473 - DNA, 18 bp, Homo sapiens
tcaagggcttactatttc

SEQ ID NO: 3242474 - DNA, 11 bp, Homo sapiens
tcaaggttcta

SEQ ID NO: 3242475 - DNA, 18 bp, Homo sapiens
tcaaggttttaggttcta

SEQ ID NO: 3242476 - DNA, 20 bp, Homo sapiens
tcaaggttttaggttctaaa

SEQ ID NO: 3242477 - DNA, 22 bp, Homo sapiens
tcaaggttttaggttctaaagt

SEQ ID NO: 3242478 - DNA, 15 bp, Homo sapiens
tcaagtaaaagaaaa

SEQ ID NO: 3242479 - DNA, 17 bp, Homo sapiens
tcaagtaaaagaaaagc

SEQ ID NO: 3242480 - DNA, 21 bp, Homo sapiens
tcaagtaaaagaaaagccgaa

SEQ ID NO: 3242481 - DNA, 16 bp, Homo sapiens
tcaagtaagaagacat

SEQ ID NO: 3242482 - DNA, 23 bp, Homo sapiens
tcaagtaagaagacatgaaccaa

SEQ ID NO: 3242483 - DNA, 22 bp, Homo sapiens
tcaagtaccaccaagggatctg

SEQ ID NO: 3242484 - DNA, 12 bp, Homo sapiens
tcaagtatttgg

SEQ ID NO: 3242485 - DNA, 18 bp, Homo sapiens
tcaagtcaatcatttctc

SEQ ID NO: 3242486 - DNA, 22 bp, Homo sapiens
tcaagtcctcttttctgagagg

SEQ ID NO: 3242487 - DNA, 14 bp, Homo sapiens
tcacagcacttgtt

SEQ ID NO: 3242488 - DNA, 15 bp, Homo sapiens
tcacagcacttgttt

SEQ ID NO: 3242489 - DNA, 14 bp, Homo sapiens
tcacagcagcctcc

SEQ ID NO: 3242490 - DNA, 16 bp, Homo sapiens
tcacagcatggaggag

SEQ ID NO: 3242491 - DNA, 17 bp, Homo sapiens
tcacagcctccagggcc

SEQ ID NO: 3242492 - DNA, 18 bp, Homo sapiens
tcacagcctccagggccc

SEQ ID NO: 3242493 - DNA, 11 bp, Homo sapiens
tcacagcctct

SEQ ID NO: 3242494 - DNA, 18 bp, Homo sapiens
tcacagcctctgacccct

SEQ ID NO: 3242495 - DNA, 19 bp, Homo sapiens
tcacagcctctgacccctc

SEQ ID NO: 3242496 - DNA, 15 bp, Homo sapiens
tcacagctgcagctg

SEQ ID NO: 3242497 - DNA, 17 bp, Homo sapiens
tcacagctgcagctggg

SEQ ID NO: 3242498 - DNA, 23 bp, Homo sapiens
tcacagctggaccctgcttcacc

SEQ ID NO: 3242499 - DNA, 18 bp, Homo sapiens
tcacaggactctgcctcc

SEQ ID NO: 3242500 - DNA, 14 bp, Homo sapiens
tcacaggaggccag

SEQ ID NO: 3242501 - DNA, 15 bp, Homo sapiens
tcacaggaggccagt

SEQ ID NO: 3242502 - DNA, 18 bp, Homo sapiens
tcacaggaggccagtggg

SEQ ID NO: 3242503 - DNA, 16 bp, Homo sapiens
tcacaggatgccagcc

SEQ ID NO: 3242504 - DNA, 12 bp, Homo sapiens
tcacaggcaggt

SEQ ID NO: 3242505 - DNA, 16 bp, Homo sapiens
tcacaggcaggtccag

SEQ ID NO: 3242506 - DNA, 18 bp, Homo sapiens
tcacaggcaggtccaggg

SEQ ID NO: 3242507 - DNA, 13 bp, Homo sapiens
tcacaggcagtgc

SEQ ID NO: 3242508 - DNA, 19 bp, Homo sapiens
tcacaggctgtaaattgaa

SEQ ID NO: 3242509 - DNA, 22 bp, Homo sapiens
tcacaggctgtaaattgaactt

SEQ ID NO: 3242510 - DNA, 18 bp, Homo sapiens
tcacagggcagagccggg

SEQ ID NO: 3242511 - DNA, 19 bp, Homo sapiens
tcacagggcagagccggga

SEQ ID NO: 3242512 - DNA, 20 bp, Homo sapiens
tcacagggcatgccccggcc

SEQ ID NO: 3242513 - DNA, 16 bp, Homo sapiens
tcacagggccccagaa

SEQ ID NO: 3242514 - DNA, 19 bp, Homo sapiens
tcacagggttgggcccaga

SEQ ID NO: 3242515 - DNA, 18 bp, Homo sapiens
tcacaggtgtggtgtaat

SEQ ID NO: 3242516 - DNA, 18 bp, Homo sapiens
tcacagtaaaaataaaat

SEQ ID NO: 3242517 - DNA, 18 bp, Homo sapiens
tcacagtacagcatgtgc

SEQ ID NO: 3242518 - DNA, 15 bp, Homo sapiens
tcacagtagagccag

SEQ ID NO: 3242519 - DNA, 19 bp, Homo sapiens
tcacagtagagccagcttg

SEQ ID NO: 3242520 - DNA, 20 bp, Homo sapiens
tcacagtagagccagcttgg

SEQ ID NO: 3242521 - DNA, 14 bp, Homo sapiens
tcacagtcctgagt

SEQ ID NO: 3242522 - DNA, 20 bp, Homo sapiens
tcacagtgctcttttctcct

SEQ ID NO: 3242523 - DNA, 14 bp, Homo sapiens
tcacagtgctgtgt

SEQ ID NO: 3242524 - DNA, 22 bp, Homo sapiens
tcacagttccctttatttcaca

SEQ ID NO: 3242525 - DNA, 17 bp, Homo sapiens
tcacagttggccttcag

SEQ ID NO: 3242526 - DNA, 14 bp, Homo sapiens
tcacataccctccc

SEQ ID NO: 3242527 - DNA, 15 bp, Homo sapiens
tcacataccctcccc

SEQ ID NO: 3242528 - DNA, 13 bp, Homo sapiens
tcacatcagataa

SEQ ID NO: 3242529 - DNA, 18 bp, Homo sapiens
tcacatgctaaagccagg

SEQ ID NO: 3242530 - DNA, 13 bp, Homo sapiens
tcacatgtggcaa

SEQ ID NO: 3242531 - DNA, 21 bp, Homo sapiens
tcacattaaaaaatgaaatat

SEQ ID NO: 3242532 - DNA, 18 bp, Homo sapiens
tcacattatttattaaaa

SEQ ID NO: 3242533 - DNA, 19 bp, Homo sapiens
tcacattgtttgctgctat

SEQ ID NO: 3242534 - DNA, 11 bp, Homo sapiens
tcacattttcc

SEQ ID NO: 3242535 - DNA, 16 bp, Homo sapiens
tcacattttccttttc

SEQ ID NO: 3242536 - DNA, 17 bp, Homo sapiens
tcacattttccttttca

SEQ ID NO: 3242537 - DNA, 19 bp, Homo sapiens
tcacattttctcagtgtgc

SEQ ID NO: 3242538 - DNA, 16 bp, Homo sapiens
tcaccaaaatttctac

SEQ ID NO: 3242539 - DNA, 17 bp, Homo sapiens
tcaccaaagtatttttt

SEQ ID NO: 3242540 - DNA, 19 bp, Homo sapiens
tcaccaaatcagctgctac

SEQ ID NO: 3242541 - DNA, 19 bp, Homo sapiens
tcaccaaatgatgccactt

SEQ ID NO: 3242542 - DNA, 13 bp, Homo sapiens
tcaccaaggaaac

SEQ ID NO: 3242543 - DNA, 24 bp, Homo sapiens
tcaccaccaataaatcagaccatg

SEQ ID NO: 3242544 - DNA, 13 bp, Homo sapiens
tcaccaccacact

SEQ ID NO: 3242545 - DNA, 21 bp, Homo sapiens
tcaccaccacccgaaatgcca

SEQ ID NO: 3242546 - DNA, 16 bp, Homo sapiens
tcaccaccgcctctgg

SEQ ID NO: 3242547 - DNA, 15 bp, Homo sapiens
tcaccactccattcc

SEQ ID NO: 3242548 - DNA, 15 bp, Homo sapiens
tcaccagatttgcta

SEQ ID NO: 3242549 - DNA, 19 bp, Homo sapiens
tcaccagccccactgccag

SEQ ID NO: 3242550 - DNA, 21 bp, Homo sapiens
tcaccagccccactgccagca

SEQ ID NO: 3242551 - DNA, 23 bp, Homo sapiens
tcaccagccccactgccagcagc

SEQ ID NO: 3242552 - DNA, 24 bp, Homo sapiens
tcaccagccccactgccagcagca

SEQ ID NO: 3242553 - DNA, 19 bp, Homo sapiens
tcaccagctatctgtcatc

SEQ ID NO: 3242554 - DNA, 16 bp, Homo sapiens
tcaccaggggaggagc

SEQ ID NO: 3242555 - DNA, 23 bp, Homo sapiens
tcaccaggggtgctcacctctgc

SEQ ID NO: 3242556 - DNA, 19 bp, Homo sapiens
tcaccagtctgtctactgt

SEQ ID NO: 3242557 - DNA, 13 bp, Homo sapiens
tcaccagtgtccc

SEQ ID NO: 3242558 - DNA, 20 bp, Homo sapiens
tcaccagtgtcccctccact

SEQ ID NO: 3242559 - DNA, 21 bp, Homo sapiens
tcaccagttaaaagcatttta

SEQ ID NO: 3242560 - DNA, 22 bp, Homo sapiens
tcaccatctcttcattcaaact

SEQ ID NO: 3242561 - DNA, 22 bp, Homo sapiens
tcaccattgtgaagcacctact

SEQ ID NO: 3242562 - DNA, 19 bp, Homo sapiens
tcaccccatcccacaccct

SEQ ID NO: 3242563 - DNA, 13 bp, Homo sapiens
tcacccccagctt

SEQ ID NO: 3242564 - DNA, 14 bp, Homo sapiens
tcaccccccactca

SEQ ID NO: 3242565 - DNA, 16 bp, Homo sapiens
tcaccccctcctggca

SEQ ID NO: 3242566 - DNA, 15 bp, Homo sapiens
tcaccccctttgctg

SEQ ID NO: 3242567 - DNA, 20 bp, Homo sapiens
tcaccccggcaggccctgca

SEQ ID NO: 3242568 - DNA, 17 bp, Homo sapiens
tcaccccgttacagctc

SEQ ID NO: 3242569 - DNA, 13 bp, Homo sapiens
tcacccctccagg

SEQ ID NO: 3242570 - DNA, 14 bp, Homo sapiens
tcacccctccagga

SEQ ID NO: 3242571 - DNA, 13 bp, Homo sapiens
tcacccctcgcca

SEQ ID NO: 3242572 - DNA, 16 bp, Homo sapiens
tcacccctgggcaggc

SEQ ID NO: 3242573 - DNA, 13 bp, Homo sapiens
tcacccctgtcct

SEQ ID NO: 3242574 - DNA, 20 bp, Homo sapiens
tcacccgtacaggcaattcc

SEQ ID NO: 3242575 - DNA, 19 bp, Homo sapiens
tcaccctaccaactttact

SEQ ID NO: 3242576 - DNA, 17 bp, Homo sapiens
tcaccctacctgtgcct

SEQ ID NO: 3242577 - DNA, 14 bp, Homo sapiens
tcaccctccacctc

SEQ ID NO: 3242578 - DNA, 15 bp, Homo sapiens
tcaccctccacctct

SEQ ID NO: 3242579 - DNA, 12 bp, Homo sapiens
tcaccctgcccg

SEQ ID NO: 3242580 - DNA, 13 bp, Homo sapiens
tcaccctgcctta

SEQ ID NO: 3242581 - DNA, 15 bp, Homo sapiens
tcaccctgccttatc

SEQ ID NO: 3242582 - DNA, 17 bp, Homo sapiens
tcaccctgggagccagt

SEQ ID NO: 3242583 - DNA, 17 bp, Homo sapiens
tcacccttaacccaagg

SEQ ID NO: 3242584 - DNA, 19 bp, Homo sapiens
tcacccttaacccaaggag

SEQ ID NO: 3242585 - DNA, 23 bp, Homo sapiens
tcacccttaacccaaggagcaca

SEQ ID NO: 3242586 - DNA, 22 bp, Homo sapiens
tcacccttatagtctaagacta

SEQ ID NO: 3242587 - DNA, 17 bp, Homo sapiens
tcacccttggacaagac

SEQ ID NO: 3242588 - DNA, 13 bp, Homo sapiens
tcaccctttgctg

SEQ ID NO: 3242589 - DNA, 17 bp, Homo sapiens
tcaccgacgcgtctcct

SEQ ID NO: 3242590 - DNA, 23 bp, Homo sapiens
tcaccgcagtcgtcgcacagtct

SEQ ID NO: 3242591 - DNA, 15 bp, Homo sapiens
tcaccgctgggtggt

SEQ ID NO: 3242592 - DNA, 17 bp, Homo sapiens
tcaccgctgggtggttt

SEQ ID NO: 3242593 - DNA, 19 bp, Homo sapiens
tcaccgcttccctcctgcc

SEQ ID NO: 3242594 - DNA, 17 bp, Homo sapiens
tcaccggtcagtgcctt

SEQ ID NO: 3242595 - DNA, 19 bp, Homo sapiens
tcaccgtatctcaggaagt

SEQ ID NO: 3242596 - DNA, 21 bp, Homo sapiens
tcacctaatgtttatgagcca

SEQ ID NO: 3242597 - DNA, 22 bp, Homo sapiens
tcacctaatgtttatgagccag

SEQ ID NO: 3242598 - DNA, 13 bp, Homo sapiens
tcacctagagcca

SEQ ID NO: 3242599 - DNA, 16 bp, Homo sapiens
tcacctagcagcctca

SEQ ID NO: 3242600 - DNA, 16 bp, Homo sapiens
tcacctccctgctcag

SEQ ID NO: 3242601 - DNA, 17 bp, Homo sapiens
tcacctccctgctcagt

SEQ ID NO: 3242602 - DNA, 23 bp, Homo sapiens
tcacctccctgctcagtgcttgg

SEQ ID NO: 3242603 - DNA, 19 bp, Homo sapiens
tcacctcctctgtgatttc

SEQ ID NO: 3242604 - DNA, 23 bp, Homo sapiens
tcacctctacccaaaccctaggt

SEQ ID NO: 3242605 - DNA, 14 bp, Homo sapiens
tcacctctctcaga

SEQ ID NO: 3242606 - DNA, 20 bp, Homo sapiens
tcacctctctcagagcatct

SEQ ID NO: 3242607 - DNA, 21 bp, Homo sapiens
tcacctgagcccggatgcttc

SEQ ID NO: 3242608 - DNA, 23 bp, Homo sapiens
tcacctgagcccggatgcttctc

SEQ ID NO: 3242609 - DNA, 19 bp, Homo sapiens
tcacctgagtcaccctacc

SEQ ID NO: 3242610 - DNA, 13 bp, Homo sapiens
tcacctgcaagcc

SEQ ID NO: 3242611 - DNA, 16 bp, Homo sapiens
tcacctgcaagcccca

SEQ ID NO: 3242612 - DNA, 19 bp, Homo sapiens
tcacctgcaagccccaggg

SEQ ID NO: 3242613 - DNA, 23 bp, Homo sapiens
tcaggaagcaggtgtcctttccc

SEQ ID NO: 3242614 - DNA, 16 bp, Homo sapiens
tcaggaatataaatat

SEQ ID NO: 3242615 - DNA, 20 bp, Homo sapiens
tcaggaattccaattaaatt

SEQ ID NO: 3242616 - DNA, 16 bp, Homo sapiens
tcaggaattcttggag

SEQ ID NO: 3242617 - DNA, 16 bp, Homo sapiens
tcaggacttgaaagaa

SEQ ID NO: 3242618 - DNA, 15 bp, Homo sapiens
tcaggacttggtctg

SEQ ID NO: 3242619 - DNA, 23 bp, Homo sapiens
tcaggagagggatacaagagagg

SEQ ID NO: 3242620 - DNA, 22 bp, Homo sapiens
tcaggagatcgagaccatcctg

SEQ ID NO: 3242621 - DNA, 23 bp, Homo sapiens
tcaggagatggagggcttggccc

SEQ ID NO: 3242622 - DNA, 17 bp, Homo sapiens
tcaggaggcaggacctt

SEQ ID NO: 3242623 - DNA, 18 bp, Homo sapiens
tcaggaggctgaggggag

SEQ ID NO: 3242624 - DNA, 19 bp, Homo sapiens
tcaggagttcgagaccagc

SEQ ID NO: 3242625 - DNA, 16 bp, Homo sapiens
tcaggagttggaatgt

SEQ ID NO: 3242626 - DNA, 22 bp, Homo sapiens
tcaggatatccttatcagagct

SEQ ID NO: 3242627 - DNA, 16 bp, Homo sapiens
tcaggatcaagaaagt

SEQ ID NO: 3242628 - DNA, 20 bp, Homo sapiens
tcaggatccaagctaagcac

SEQ ID NO: 3242629 - DNA, 15 bp, Homo sapiens
tcaggatgaacccag

SEQ ID NO: 3242630 - DNA, 16 bp, Homo sapiens
tcaggatgaacccagg

SEQ ID NO: 3242631 - DNA, 18 bp, Homo sapiens
tcaggatgcacatttctg

SEQ ID NO: 3242632 - DNA, 21 bp, Homo sapiens
tcaggatgcacatttctggat

SEQ ID NO: 3242633 - DNA, 21 bp, Homo sapiens
tcaggatgtaggggttaactt

SEQ ID NO: 3242634 - DNA, 15 bp, Homo sapiens
tcaggcaagcccctc

SEQ ID NO: 3242635 - DNA, 22 bp, Homo sapiens
tcaggcaagcccctcagccctt

SEQ ID NO: 3242636 - DNA, 17 bp, Homo sapiens
tcaggcaccagcatcca

SEQ ID NO: 3242637 - DNA, 15 bp, Homo sapiens
tcaggcactagcctt

SEQ ID NO: 3242638 - DNA, 13 bp, Homo sapiens
tcaggcaggaagg

SEQ ID NO: 3242639 - DNA, 15 bp, Homo sapiens
tcaggcagtgtttaa

SEQ ID NO: 3242640 - DNA, 16 bp, Homo sapiens
tcaggcagtgtttaaa

SEQ ID NO: 3242641 - DNA, 16 bp, Homo sapiens
tcaggcataggcctgg

SEQ ID NO: 3242642 - DNA, 17 bp, Homo sapiens
tcaggcataggcctggg

SEQ ID NO: 3242643 - DNA, 18 bp, Homo sapiens
tcaggcataggcctgggt

SEQ ID NO: 3242644 - DNA, 12 bp, Homo sapiens
tcaggcatggct

SEQ ID NO: 3242645 - DNA, 17 bp, Homo sapiens
tcaggcatggctcagag

SEQ ID NO: 3242646 - DNA, 19 bp, Homo sapiens
tcaggcatggctcagagct

SEQ ID NO: 3242647 - DNA, 20 bp, Homo sapiens
tcaggcatggctcagagctt

SEQ ID NO: 3242648 - DNA, 12 bp, Homo sapiens
tcaggccagccc

SEQ ID NO: 3242649 - DNA, 13 bp, Homo sapiens
tcaggccagccca

SEQ ID NO: 3242650 - DNA, 15 bp, Homo sapiens
tcaggccatggctcc

SEQ ID NO: 3242651 - DNA, 13 bp, Homo sapiens
tcaggccctggaa

SEQ ID NO: 3242652 - DNA, 19 bp, Homo sapiens
tcaggcccttattttcaag

SEQ ID NO: 3242653 - DNA, 11 bp, Homo sapiens
tcaggcctcca

SEQ ID NO: 3242654 - DNA, 18 bp, Homo sapiens
tcaggcctccctctctct

SEQ ID NO: 3242655 - DNA, 13 bp, Homo sapiens
tcaggcctgtgtg

SEQ ID NO: 3242656 - DNA, 14 bp, Homo sapiens
tcaggcgcctggca

SEQ ID NO: 3242657 - DNA, 23 bp, Homo sapiens
tcaggcgcctggcacatttcagg

SEQ ID NO: 3242658 - DNA, 11 bp, Homo sapiens
tcaggctccat

SEQ ID NO: 3242659 - DNA, 20 bp, Homo sapiens
tcaggctccattaggatttg

SEQ ID NO: 3242660 - DNA, 11 bp, Homo sapiens
tcaggctctgc

SEQ ID NO: 3242661 - DNA, 15 bp, Homo sapiens
tcaggctctgctggt

SEQ ID NO: 3242662 - DNA, 12 bp, Homo sapiens
tcaggctctggc

SEQ ID NO: 3242663 - DNA, 20 bp, Homo sapiens
tcaggctctggcccttgcct

SEQ ID NO: 3242664 - DNA, 15 bp, Homo sapiens
tcaggctcttctcct

SEQ ID NO: 3242665 - DNA, 20 bp, Homo sapiens
tcaggctgggcagccccaga

SEQ ID NO: 3242666 - DNA, 22 bp, Homo sapiens
tcaggctgggcagccccagaga

SEQ ID NO: 3242667 - DNA, 15 bp, Homo sapiens
tcaggcttccttggc

SEQ ID NO: 3242668 - DNA, 23 bp, Homo sapiens
tcaggcttccttggcatcacagg

SEQ ID NO: 3242669 - DNA, 21 bp, Homo sapiens
tcagggaaactaagattcttt

SEQ ID NO: 3242670 - DNA, 15 bp, Homo sapiens
tcagggacaggatga

SEQ ID NO: 3242671 - DNA, 19 bp, Homo sapiens
tcagggaccagctttactg

SEQ ID NO: 3242672 - DNA, 22 bp, Homo sapiens
tcagggaccggtgctgcaggag

SEQ ID NO: 3242673 - DNA, 23 bp, Homo sapiens
tcagggagcagggaaggcctgac

SEQ ID NO: 3242674 - DNA, 20 bp, Homo sapiens
tcagggaggtagtttcaaag

SEQ ID NO: 3242675 - DNA, 22 bp, Homo sapiens
tcagggagtgctggctcacagt

SEQ ID NO: 3242676 - DNA, 19 bp, Homo sapiens
tcagggccagactggaaga

SEQ ID NO: 3242677 - DNA, 12 bp, Homo sapiens
tcagggccagga

SEQ ID NO: 3242678 - DNA, 14 bp, Homo sapiens
tcagggccagtcct

SEQ ID NO: 3242679 - DNA, 13 bp, Homo sapiens
tcagggccatgct

SEQ ID NO: 3242680 - DNA, 19 bp, Homo sapiens
tcagggccatgctgaggcc

SEQ ID NO: 3242681 - DNA, 19 bp, Homo sapiens
tcagggcccaagtccctgt

SEQ ID NO: 3242682 - DNA, 12 bp, Homo sapiens
tcagggcccaga

SEQ ID NO: 3242683 - DNA, 13 bp, Homo sapiens
tcagggcccagag

SEQ ID NO: 3242684 - DNA, 19 bp, Homo sapiens
tcagggcccagaggctgag

SEQ ID NO: 3242685 - DNA, 22 bp, Homo sapiens
tcagggcctggcaggccagtgt

SEQ ID NO: 3242686 - DNA, 18 bp, Homo sapiens
tcagggcctggggcctga

SEQ ID NO: 3242687 - DNA, 20 bp, Homo sapiens
tcagggcctggggcctgaga

SEQ ID NO: 3242688 - DNA, 15 bp, Homo sapiens
tcagggcgctcagac

SEQ ID NO: 3242689 - DNA, 16 bp, Homo sapiens
tcagggcgctcagacg

SEQ ID NO: 3242690 - DNA, 23 bp, Homo sapiens
tcagggcgctcagacggcggcca

SEQ ID NO: 3242691 - DNA, 13 bp, Homo sapiens
tcagggctcctcc

SEQ ID NO: 3242692 - DNA, 15 bp, Homo sapiens
tcagggctcctccca

SEQ ID NO: 3242693 - DNA, 16 bp, Homo sapiens
tcagggctcctcccag

SEQ ID NO: 3242694 - DNA, 15 bp, Homo sapiens
tcagggctcctgcct

SEQ ID NO: 3242695 - DNA, 21 bp, Homo sapiens
tcaggggatcaaaaggacgga

SEQ ID NO: 3242696 - DNA, 18 bp, Homo sapiens
tcaggggttcgagaccag

SEQ ID NO: 3242697 - DNA, 17 bp, Homo sapiens
tcagggtttaatagact

SEQ ID NO: 3242698 - DNA, 21 bp, Homo sapiens
tcaggtaacaggcagatacag

SEQ ID NO: 3242699 - DNA, 16 bp, Homo sapiens
tcaggtacctggagtt

SEQ ID NO: 3242700 - DNA, 14 bp, Homo sapiens
tcaggtacggagaa

SEQ ID NO: 3242701 - DNA, 15 bp, Homo sapiens
tcaggtacggagaag

SEQ ID NO: 3242702 - DNA, 15 bp, Homo sapiens
tcaggtaggcccttg

SEQ ID NO: 3242703 - DNA, 21 bp, Homo sapiens
tcaggtaggcccttgtcctgc

SEQ ID NO: 3242704 - DNA, 23 bp, Homo sapiens
tcaggtaggcccttgtcctgcca

SEQ ID NO: 3242705 - DNA, 19 bp, Homo sapiens
tcaggtagttgcaattgaa

SEQ ID NO: 3242706 - DNA, 23 bp, Homo sapiens
tcaggtcccacgtctggccaggc

SEQ ID NO: 3242707 - DNA, 16 bp, Homo sapiens
tcaggtcctcagagaa

SEQ ID NO: 3242708 - DNA, 21 bp, Homo sapiens
tcaggtctcccacgtgggaga

SEQ ID NO: 3242709 - DNA, 13 bp, Homo sapiens
tcaggtgaaaatg

SEQ ID NO: 3242710 - DNA, 18 bp, Homo sapiens
tcaggtgaaaatgttcat

SEQ ID NO: 3242711 - DNA, 21 bp, Homo sapiens
tcaggtgaacacttagtgatc

SEQ ID NO: 3242712 - DNA, 11 bp, Homo sapiens
tcaggtgccac

SEQ ID NO: 3242713 - DNA, 13 bp, Homo sapiens
tcaggtgccactc

SEQ ID NO: 3242714 - DNA, 16 bp, Homo sapiens
tcaggtgccactccct

SEQ ID NO: 3242715 - DNA, 19 bp, Homo sapiens
tcaggtgccactccctgag

SEQ ID NO: 3242716 - DNA, 20 bp, Homo sapiens
tcaggtgccactccctgagc

SEQ ID NO: 3242717 - DNA, 13 bp, Homo sapiens
tcaggtgctgcca

SEQ ID NO: 3242718 - DNA, 17 bp, Homo sapiens
tcaggtgggcgtggtca

SEQ ID NO: 3242719 - DNA, 14 bp, Homo sapiens
tcaggtggggcagc

SEQ ID NO: 3242720 - DNA, 17 bp, Homo sapiens
tcaggtggggcagcttg

SEQ ID NO: 3242721 - DNA, 20 bp, Homo sapiens
tcaggtggggcagcttgagg

SEQ ID NO: 3242722 - DNA, 21 bp, Homo sapiens
tcaggtggggcagcttgaggg

SEQ ID NO: 3242723 - DNA, 14 bp, Homo sapiens
tcaggtgttgccaa

SEQ ID NO: 3242724 - DNA, 15 bp, Homo sapiens
tcaggttatactcct

SEQ ID NO: 3242725 - DNA, 23 bp, Homo sapiens
tcaggttatcgaaataacaatgt

SEQ ID NO: 3242726 - DNA, 15 bp, Homo sapiens
tcaggttctattttc

SEQ ID NO: 3242727 - DNA, 19 bp, Homo sapiens
tcaggttctattttcttaa

SEQ ID NO: 3242728 - DNA, 18 bp, Homo sapiens
tcaggttcttagtgtcac

SEQ ID NO: 3242729 - DNA, 14 bp, Homo sapiens
tcaggttttcaggt

SEQ ID NO: 3242730 - DNA, 21 bp, Homo sapiens
tcagtaacatttctgttctca

SEQ ID NO: 3242731 - DNA, 17 bp, Homo sapiens
tcagtaagaaaaagaag

SEQ ID NO: 3242732 - DNA, 12 bp, Homo sapiens
tcagtaataaaa

SEQ ID NO: 3242733 - DNA, 13 bp, Homo sapiens
tcagtaataaaac

SEQ ID NO: 3242734 - DNA, 21 bp, Homo sapiens
tcagtacccctggtaaaccaa

SEQ ID NO: 3242735 - DNA, 16 bp, Homo sapiens
tcagtaccctctcagc

SEQ ID NO: 3242736 - DNA, 23 bp, Homo sapiens
tcagtacttgtgaaacacagctg

SEQ ID NO: 3242737 - DNA, 14 bp, Homo sapiens
tcagtactttttta

SEQ ID NO: 3242738 - DNA, 15 bp, Homo sapiens
tcagtagaattacca

SEQ ID NO: 3242739 - DNA, 20 bp, Homo sapiens
tcatttgttgtgatgtcttt

SEQ ID NO: 3242740 - DNA, 15 bp, Homo sapiens
tcatttgtttacatt

SEQ ID NO: 3242741 - DNA, 14 bp, Homo sapiens
tcatttgttttgct

SEQ ID NO: 3242742 - DNA, 16 bp, Homo sapiens
tcatttgttttgcttt

SEQ ID NO: 3242743 - DNA, 21 bp, Homo sapiens
tcattttaacatgatttcaaa

SEQ ID NO: 3242744 - DNA, 14 bp, Homo sapiens
tcattttaattatt

SEQ ID NO: 3242745 - DNA, 14 bp, Homo sapiens
tcattttacagtga

SEQ ID NO: 3242746 - DNA, 17 bp, Homo sapiens
tcattttatatttaaaa

SEQ ID NO: 3242747 - DNA, 15 bp, Homo sapiens
tcattttatgttaag

SEQ ID NO: 3242748 - DNA, 15 bp, Homo sapiens
tcattttcatcactg

SEQ ID NO: 3242749 - DNA, 19 bp, Homo sapiens
tcattttccccccactctc

SEQ ID NO: 3242750 - DNA, 16 bp, Homo sapiens
tcattttctataacag

SEQ ID NO: 3242751 - DNA, 18 bp, Homo sapiens
tcattttctgacatgcat

SEQ ID NO: 3242752 - DNA, 19 bp, Homo sapiens
tcattttctgacatgcatt

SEQ ID NO: 3242753 - DNA, 21 bp, Homo sapiens
tcattttctgacatgcattgt

SEQ ID NO: 3242754 - DNA, 21 bp, Homo sapiens
tcattttgttgcttttgtgaa

SEQ ID NO: 3242755 - DNA, 16 bp, Homo sapiens
tcatttttaacagcat

SEQ ID NO: 3242756 - DNA, 13 bp, Homo sapiens
tcatttttatagc

SEQ ID NO: 3242757 - DNA, 16 bp, Homo sapiens
tcatttttatagcaac

SEQ ID NO: 3242758 - DNA, 17 bp, Homo sapiens
tcatttttcactgtaca

SEQ ID NO: 3242759 - DNA, 12 bp, Homo sapiens
tcatttttgctg

SEQ ID NO: 3242760 - DNA, 16 bp, Homo sapiens
tcatttttgtacagtt

SEQ ID NO: 3242761 - DNA, 21 bp, Homo sapiens
tcatttttgtacagtttgctg

SEQ ID NO: 3242762 - DNA, 23 bp, Homo sapiens
tcatttttgtacagtttgctgta

SEQ ID NO: 3242763 - DNA, 13 bp, Homo sapiens
tcattttttctta

SEQ ID NO: 3242764 - DNA, 16 bp, Homo sapiens
tcatttttttaacaca

SEQ ID NO: 3242765 - DNA, 18 bp, Homo sapiens
tcatttttttaacacata

SEQ ID NO: 3242766 - DNA, 22 bp, Homo sapiens
tccaaaaaaaaaaaaaatacaa

SEQ ID NO: 3242767 - DNA, 23 bp, Homo sapiens
tccaaaaaaaggaaaaataatca

SEQ ID NO: 3242768 - DNA, 19 bp, Homo sapiens
tccaaaaagattttcagaa

SEQ ID NO: 3242769 - DNA, 17 bp, Homo sapiens
tccaaaaatgtgtaaga

SEQ ID NO: 3242770 - DNA, 21 bp, Homo sapiens
tccaaaaatgtgtaagaacaa

SEQ ID NO: 3242771 - DNA, 14 bp, Homo sapiens
tccaaaacatttct

SEQ ID NO: 3242772 - DNA, 20 bp, Homo sapiens
tccaaaacatttctggacag

SEQ ID NO: 3242773 - DNA, 22 bp, Homo sapiens
tccaaaacatttctggacagta

SEQ ID NO: 3242774 - DNA, 15 bp, Homo sapiens
tccaaaacttagacc

SEQ ID NO: 3242775 - DNA, 22 bp, Homo sapiens
tccaaaacttagacccatgctg

SEQ ID NO: 3242776 - DNA, 19 bp, Homo sapiens
tccaaaagattgctgaaat

SEQ ID NO: 3242777 - DNA, 20 bp, Homo sapiens
tccaaaagattgctgaaatt

SEQ ID NO: 3242778 - DNA, 22 bp, Homo sapiens
tccaaaagattgctgaaatttt

SEQ ID NO: 3242779 - DNA, 22 bp, Homo sapiens
tccaaaatgttggtcattttat

SEQ ID NO: 3242780 - DNA, 14 bp, Homo sapiens
tccaaaccaaattt

SEQ ID NO: 3242781 - DNA, 19 bp, Homo sapiens
tccaaactgaagcagcctc

SEQ ID NO: 3242782 - DNA, 18 bp, Homo sapiens
tccaaacttggatttttg

SEQ ID NO: 3242783 - DNA, 13 bp, Homo sapiens
tccaaagaaagtt

SEQ ID NO: 3242784 - DNA, 17 bp, Homo sapiens
tccaaagactgtactgg

SEQ ID NO: 3242785 - DNA, 21 bp, Homo sapiens
tccaaagactgtactggccag

SEQ ID NO: 3242786 - DNA, 15 bp, Homo sapiens
tccaaagaggctgcc

SEQ ID NO: 3242787 - DNA, 18 bp, Homo sapiens
tccaaagaggctgcccct

SEQ ID NO: 3242788 - DNA, 23 bp, Homo sapiens
tccaaagagtagaattgcattga

SEQ ID NO: 3242789 - DNA, 19 bp, Homo sapiens
tccaaagcacattgaaaga

SEQ ID NO: 3242790 - DNA, 14 bp, Homo sapiens
tccaaagccagtga

SEQ ID NO: 3242791 - DNA, 18 bp, Homo sapiens
tccaaaggggctgctggg

SEQ ID NO: 3242792 - DNA, 11 bp, Homo sapiens
tccaaagtcca

SEQ ID NO: 3242793 - DNA, 17 bp, Homo sapiens
tccaaataaaaactaaa

SEQ ID NO: 3242794 - DNA, 14 bp, Homo sapiens
tccaaataataaag

SEQ ID NO: 3242795 - DNA, 16 bp, Homo sapiens
tccaaataataaagtc

SEQ ID NO: 3242796 - DNA, 21 bp, Homo sapiens
tccaaatctcttgcttgtcat

SEQ ID NO: 3242797 - DNA, 20 bp, Homo sapiens
tccaaatggcgtctggaagt

SEQ ID NO: 3242798 - DNA, 17 bp, Homo sapiens
tccaaatgtcctccaga

SEQ ID NO: 3242799 - DNA, 20 bp, Homo sapiens
tccaaatgtcctccagaagc

SEQ ID NO: 3242800 - DNA, 22 bp, Homo sapiens
tccaaatgtcctccagaagcct

SEQ ID NO: 3242801 - DNA, 14 bp, Homo sapiens
tccaaattcagttt

SEQ ID NO: 3242802 - DNA, 16 bp, Homo sapiens
tccaaattcagtttca

SEQ ID NO: 3242803 - DNA, 18 bp, Homo sapiens
tccaaattcagtttcata

SEQ ID NO: 3242804 - DNA, 19 bp, Homo sapiens
tccaaattcagtttcataa

SEQ ID NO: 3242805 - DNA, 22 bp, Homo sapiens
tccaaattgtgcttctccccag

SEQ ID NO: 3242806 - DNA, 15 bp, Homo sapiens
tccaacacaaggctc

SEQ ID NO: 3242807 - DNA, 17 bp, Homo sapiens
tccaacagaactaaatg

SEQ ID NO: 3242808 - DNA, 17 bp, Homo sapiens
tccaaccccccacctgc

SEQ ID NO: 3242809 - DNA, 15 bp, Homo sapiens
tccaacccggggacc

SEQ ID NO: 3242810 - DNA, 19 bp, Homo sapiens
tccaacgcccctgtggcca

SEQ ID NO: 3242811 - DNA, 23 bp, Homo sapiens
tccaactactaatagaataaagg

SEQ ID NO: 3242812 - DNA, 18 bp, Homo sapiens
tccaactcccttaaaata

SEQ ID NO: 3242813 - DNA, 21 bp, Homo sapiens
tccaactggattataaataaa

SEQ ID NO: 3242814 - DNA, 18 bp, Homo sapiens
tccaacttatgtttttaa

SEQ ID NO: 3242815 - DNA, 16 bp, Homo sapiens
tccaagaaagatgaat

SEQ ID NO: 3242816 - DNA, 23 bp, Homo sapiens
tccaagaatccacatttctaaaa

SEQ ID NO: 3242817 - DNA, 17 bp, Homo sapiens
tccaagacatgtctgtt

SEQ ID NO: 3242818 - DNA, 11 bp, Homo sapiens
tccaagacatt

SEQ ID NO: 3242819 - DNA, 15 bp, Homo sapiens
tccaagacattgtca

SEQ ID NO: 3242820 - DNA, 20 bp, Homo sapiens
tccaagagacatggaagaga

SEQ ID NO: 3242821 - DNA, 18 bp, Homo sapiens
tccaagagtctaaagatg

SEQ ID NO: 3242822 - DNA, 17 bp, Homo sapiens
tccaagataagcctgag

SEQ ID NO: 3242823 - DNA, 20 bp, Homo sapiens
tccaagataagcctgagcct

SEQ ID NO: 3242824 - DNA, 13 bp, Homo sapiens
tccaagattccgg

SEQ ID NO: 3242825 - DNA, 17 bp, Homo sapiens
tccaagattctagatga

SEQ ID NO: 3242826 - DNA, 11 bp, Homo sapiens
tccaagcaaag

SEQ ID NO: 3242827 - DNA, 19 bp, Homo sapiens
tccaagcctgcctcccaag

SEQ ID NO: 3242828 - DNA, 22 bp, Homo sapiens
tccaagctaagcactgccactg

SEQ ID NO: 3242829 - DNA, 18 bp, Homo sapiens
tccaagctccatctccac

SEQ ID NO: 3242830 - DNA, 20 bp, Homo sapiens
tccaagctggtcccactcag

SEQ ID NO: 3242831 - DNA, 16 bp, Homo sapiens
tccaaggagaaacaga

SEQ ID NO: 3242832 - DNA, 18 bp, Homo sapiens
tccaaggagaccaagtcc

SEQ ID NO: 3242833 - DNA, 20 bp, Homo sapiens
tccaaggaggggctgtaaaa

SEQ ID NO: 3242834 - DNA, 12 bp, Homo sapiens
tccaaggatcct

SEQ ID NO: 3242835 - DNA, 23 bp, Homo sapiens
tccaaggccctgctttttttctt

SEQ ID NO: 3242836 - DNA, 22 bp, Homo sapiens
tccaagggcttctgcaccctcc

SEQ ID NO: 3242837 - DNA, 23 bp, Homo sapiens
tccaagggtttcgactggtccag

SEQ ID NO: 3242838 - DNA, 15 bp, Homo sapiens
tccaaggtttaaaga

SEQ ID NO: 3242839 - DNA, 19 bp, Homo sapiens
tccaaggtttaaagagtct

SEQ ID NO: 3242840 - DNA, 19 bp, Homo sapiens
tccaagtaccaatgctgtt

SEQ ID NO: 3242841 - DNA, 16 bp, Homo sapiens
tccaagtctctctgtg

SEQ ID NO: 3242842 - DNA, 17 bp, Homo sapiens
tccaagtctctctgtga

SEQ ID NO: 3242843 - DNA, 18 bp, Homo sapiens
tccaagtctctctgtgaa

SEQ ID NO: 3242844 - DNA, 20 bp, Homo sapiens
tccaagtctctctgtgaata

SEQ ID NO: 3242845 - DNA, 18 bp, Homo sapiens
tccaagtctgtacctcaa

SEQ ID NO: 3242846 - DNA, 17 bp, Homo sapiens
tccaagtgccagaggtg

SEQ ID NO: 3242847 - DNA, 20 bp, Homo sapiens
tccaagttccccatccctgt

SEQ ID NO: 3242848 - DNA, 21 bp, Homo sapiens
tccaagttcttcacctctatc

SEQ ID NO: 3242849 - DNA, 15 bp, Homo sapiens
tccaagtttccaaac

SEQ ID NO: 3242850 - DNA, 23 bp, Homo sapiens
tccaataaaaacattttgaagtg

SEQ ID NO: 3242851 - DNA, 18 bp, Homo sapiens
tccaataaagtgccttct

SEQ ID NO: 3242852 - DNA, 23 bp, Homo sapiens
tccaataaagtgccttctgggct

SEQ ID NO: 3242853 - DNA, 15 bp, Homo sapiens
tccaatatttctgct

SEQ ID NO: 3242854 - DNA, 16 bp, Homo sapiens
tccaatcctcactggg

SEQ ID NO: 3242855 - DNA, 18 bp, Homo sapiens
tccaatcctcactgggtg

SEQ ID NO: 3242856 - DNA, 22 bp, Homo sapiens
tccaatcctggctctgtggctt

SEQ ID NO: 3242857 - DNA, 17 bp, Homo sapiens
tccaatctcaaggaatc

SEQ ID NO: 3242858 - DNA, 19 bp, Homo sapiens
tccaatctcaaggaatctt

SEQ ID NO: 3242859 - DNA, 11 bp, Homo sapiens
tccaatgaaat

SEQ ID NO: 3242860 - DNA, 19 bp, Homo sapiens
tccaatgtctgctgaggag

SEQ ID NO: 3242861 - DNA, 15 bp, Homo sapiens
tccaattagtttcct

SEQ ID NO: 3242862 - DNA, 19 bp, Homo sapiens
tccaattgatgtatatgtt

SEQ ID NO: 3242863 - DNA, 22 bp, Homo sapiens
tccaattgttgacagttctgaa

SEQ ID NO: 3242864 - DNA, 13 bp, Homo sapiens
tcccaatcagcac

SEQ ID NO: 3242865 - DNA, 19 bp, Homo sapiens
tcccaatcagcactgaaaa

SEQ ID NO: 3242866 - DNA, 20 bp, Homo sapiens
tcccaatccttatcccaagc

SEQ ID NO: 3242867 - DNA, 19 bp, Homo sapiens
tcccaatctttctatataa

SEQ ID NO: 3242868 - DNA, 15 bp, Homo sapiens
tcccaattaggaagt

SEQ ID NO: 3242869 - DNA, 11 bp, Homo sapiens
tcccacacagg

SEQ ID NO: 3242870 - DNA, 15 bp, Homo sapiens
tcccacacctccaca

SEQ ID NO: 3242871 - DNA, 17 bp, Homo sapiens
tcccacacctccacagt

SEQ ID NO: 3242872 - DNA, 20 bp, Homo sapiens
tcccacacgattagctttat

SEQ ID NO: 3242873 - DNA, 19 bp, Homo sapiens
tcccacacttgctggggct

SEQ ID NO: 3242874 - DNA, 15 bp, Homo sapiens
tcccacagagtgctg

SEQ ID NO: 3242875 - DNA, 20 bp, Homo sapiens
tcccacagagtgctggactg

SEQ ID NO: 3242876 - DNA, 15 bp, Homo sapiens
tcccacaggcccttc

SEQ ID NO: 3242877 - DNA, 20 bp, Homo sapiens
tcccacatccaactccagca

SEQ ID NO: 3242878 - DNA, 22 bp, Homo sapiens
tcccacatccaactccagcaac

SEQ ID NO: 3242879 - DNA, 23 bp, Homo sapiens
tcccacatgaggccatctcagga

SEQ ID NO: 3242880 - DNA, 16 bp, Homo sapiens
tcccacattccaaaag

SEQ ID NO: 3242881 - DNA, 19 bp, Homo sapiens
tcccaccaaccctcagagc

SEQ ID NO: 3242882 - DNA, 11 bp, Homo sapiens
tcccaccaccc

SEQ ID NO: 3242883 - DNA, 23 bp, Homo sapiens
tcccaccaccctttgctgactct

SEQ ID NO: 3242884 - DNA, 18 bp, Homo sapiens
tcccacccacatgtgaca

SEQ ID NO: 3242885 - DNA, 22 bp, Homo sapiens
tcccacccacccgccgcctccc

SEQ ID NO: 3242886 - DNA, 20 bp, Homo sapiens
tcccacccccatctctccct

SEQ ID NO: 3242887 - DNA, 16 bp, Homo sapiens
tcccacccgatgctgc

SEQ ID NO: 3242888 - DNA, 20 bp, Homo sapiens
tcccacccgatgctgctttc

SEQ ID NO: 3242889 - DNA, 11 bp, Homo sapiens
tcccaccctgt

SEQ ID NO: 3242890 - DNA, 14 bp, Homo sapiens
tcccaccgccccca

SEQ ID NO: 3242891 - DNA, 17 bp, Homo sapiens
tcccaccgcccccaccc

SEQ ID NO: 3242892 - DNA, 21 bp, Homo sapiens
tcccaccgggagcctccccct

SEQ ID NO: 3242893 - DNA, 15 bp, Homo sapiens
tcccacctagcccag

SEQ ID NO: 3242894 - DNA, 14 bp, Homo sapiens
tcccacctcagcct

SEQ ID NO: 3242895 - DNA, 18 bp, Homo sapiens
tcccacctcagcctcccg

SEQ ID NO: 3242896 - DNA, 15 bp, Homo sapiens
tcccacctccagccc

SEQ ID NO: 3242897 - DNA, 17 bp, Homo sapiens
tcccacctccagcccgg

SEQ ID NO: 3242898 - DNA, 13 bp, Homo sapiens
tcccacctccagt

SEQ ID NO: 3242899 - DNA, 14 bp, Homo sapiens
tcccacctccctgc

SEQ ID NO: 3242900 - DNA, 23 bp, Homo sapiens
tcccacctctccttttgaggctt

SEQ ID NO: 3242901 - DNA, 22 bp, Homo sapiens
tcccacctctgtgacctcaggc

SEQ ID NO: 3242902 - DNA, 19 bp, Homo sapiens
tcccacctgacacaccagg

SEQ ID NO: 3242903 - DNA, 19 bp, Homo sapiens
tcccacctgcatctggggc

SEQ ID NO: 3242904 - DNA, 20 bp, Homo sapiens
tcccacctgcatctggggcc

SEQ ID NO: 3242905 - DNA, 13 bp, Homo sapiens
tcccaccttggct

SEQ ID NO: 3242906 - DNA, 17 bp, Homo sapiens
tcccaccttggctgcag

SEQ ID NO: 3242907 - DNA, 21 bp, Homo sapiens
tcccaccttggctgcagggag

SEQ ID NO: 3242908 - DNA, 15 bp, Homo sapiens
tcccacgaatttgct

SEQ ID NO: 3242909 - DNA, 18 bp, Homo sapiens
tcccacgaatttgctggg

SEQ ID NO: 3242910 - DNA, 23 bp, Homo sapiens
tcccacggaggagttttggcagc

SEQ ID NO: 3242911 - DNA, 15 bp, Homo sapiens
tcccacgtctggcca

SEQ ID NO: 3242912 - DNA, 19 bp, Homo sapiens
tcccacgtctggccaggca

SEQ ID NO: 3242913 - DNA, 14 bp, Homo sapiens
tcccacgtgggaga

SEQ ID NO: 3242914 - DNA, 16 bp, Homo sapiens
tcccactgcctcaggt

SEQ ID NO: 3242915 - DNA, 20 bp, Homo sapiens
tcccactgcctcaggttcct

SEQ ID NO: 3242916 - DNA, 12 bp, Homo sapiens
tcccactggaag

SEQ ID NO: 3242917 - DNA, 18 bp, Homo sapiens
tcccactgtatgatttat

SEQ ID NO: 3242918 - DNA, 21 bp, Homo sapiens
tcccagaccagccaagggtcc

SEQ ID NO: 3242919 - DNA, 16 bp, Homo sapiens
tcccagagcaaaataa

SEQ ID NO: 3242920 - DNA, 11 bp, Homo sapiens
tcccagagccc

SEQ ID NO: 3242921 - DNA, 14 bp, Homo sapiens
tcccagaggcaggc

SEQ ID NO: 3242922 - DNA, 14 bp, Homo sapiens
tcccagagggagca

SEQ ID NO: 3242923 - DNA, 16 bp, Homo sapiens
tcccagagggagcagg

SEQ ID NO: 3242924 - DNA, 16 bp, Homo sapiens
tcccagaggtccagcc

SEQ ID NO: 3242925 - DNA, 22 bp, Homo sapiens
tcccagaggtccagcccatctc

SEQ ID NO: 3242926 - DNA, 22 bp, Homo sapiens
tcccagaggttatctgcctggc

SEQ ID NO: 3242927 - DNA, 22 bp, Homo sapiens
tcccagcaagacctcatctgtg

SEQ ID NO: 3242928 - DNA, 23 bp, Homo sapiens
tcccagcaagacctcatctgtgg

SEQ ID NO: 3242929 - DNA, 18 bp, Homo sapiens
tcccagcactccccttgc

SEQ ID NO: 3242930 - DNA, 21 bp, Homo sapiens
tcccagcactccccttgcctt

SEQ ID NO: 3242931 - DNA, 16 bp, Homo sapiens
tcccagcactttggga

SEQ ID NO: 3242932 - DNA, 18 bp, Homo sapiens
tcccagcactttgggagg

SEQ ID NO: 3242933 - DNA, 21 bp, Homo sapiens
tcccagcactttgggaggcct

SEQ ID NO: 3242934 - DNA, 18 bp, Homo sapiens
tcccagcatccctggagc

SEQ ID NO: 3242935 - DNA, 20 bp, Homo sapiens
tcccagccaccccgggctct

SEQ ID NO: 3242936 - DNA, 15 bp, Homo sapiens
tcccagccatgccca

SEQ ID NO: 3242937 - DNA, 15 bp, Homo sapiens
tcccagcccaaagct

SEQ ID NO: 3242938 - DNA, 16 bp, Homo sapiens
tcccagccctatggat

SEQ ID NO: 3242939 - DNA, 19 bp, Homo sapiens
tcccagccggccaatggaa

SEQ ID NO: 3242940 - DNA, 21 bp, Homo sapiens
tcccagccggccaatggaaac

SEQ ID NO: 3242941 - DNA, 10 bp, Homo sapiens
tcccagcctg

SEQ ID NO: 3242942 - DNA, 11 bp, Homo sapiens
tcccagcctgc

SEQ ID NO: 3242943 - DNA, 19 bp, Homo sapiens
tcccagcctgccctccagc

SEQ ID NO: 3242944 - DNA, 13 bp, Homo sapiens
tcccagcctgctg

SEQ ID NO: 3242945 - DNA, 23 bp, Homo sapiens
tcccagcctgctgagagccccca

SEQ ID NO: 3242946 - DNA, 14 bp, Homo sapiens
tcccagcctggggc

SEQ ID NO: 3242947 - DNA, 23 bp, Homo sapiens
tcccagcctggggctccctctct

SEQ ID NO: 3242948 - DNA, 14 bp, Homo sapiens
tcccagcctgtggt

SEQ ID NO: 3242949 - DNA, 15 bp, Homo sapiens
tcccagcctgtggtt

SEQ ID NO: 3242950 - DNA, 15 bp, Homo sapiens
tcccagcgtgtgtat

SEQ ID NO: 3242951 - DNA, 17 bp, Homo sapiens
tcccagctacttgggaa

SEQ ID NO: 3242952 - DNA, 16 bp, Homo sapiens
tcccagctccccccgc

SEQ ID NO: 3242953 - DNA, 21 bp, Homo sapiens
tcccagctccccccgcccacc

SEQ ID NO: 3242954 - DNA, 20 bp, Homo sapiens
tcccagctcctttctcctgt

SEQ ID NO: 3242955 - DNA, 15 bp, Homo sapiens
tcccagctgaaggca

SEQ ID NO: 3242956 - DNA, 14 bp, Homo sapiens
tcccagctgtgctg

SEQ ID NO: 3242957 - DNA, 19 bp, Homo sapiens
tcccaggacaccacaccca

SEQ ID NO: 3242958 - DNA, 22 bp, Homo sapiens
tcccaggagacagttcaagaaa

SEQ ID NO: 3242959 - DNA, 17 bp, Homo sapiens
tcccaggccccctgcat

SEQ ID NO: 3242960 - DNA, 16 bp, Homo sapiens
tcccaggcgccccttc

SEQ ID NO: 3242961 - DNA, 12 bp, Homo sapiens
tcccaggctgcc

SEQ ID NO: 3242962 - DNA, 14 bp, Homo sapiens
tcccaggctgcccc

SEQ ID NO: 3242963 - DNA, 18 bp, Homo sapiens
tcccaggcttcaccctga

SEQ ID NO: 3242964 - DNA, 22 bp, Homo sapiens
tcccaggcttcaccctgaatgg

SEQ ID NO: 3242965 - DNA, 20 bp, Homo sapiens
tcccagggccagggccctgc

SEQ ID NO: 3242966 - DNA, 21 bp, Homo sapiens
tcccagggccagggccctgca

SEQ ID NO: 3242967 - DNA, 14 bp, Homo sapiens
tcccagggccctgg

SEQ ID NO: 3242968 - DNA, 17 bp, Homo sapiens
tcccagggccctggatg

SEQ ID NO: 3242969 - DNA, 13 bp, Homo sapiens
tcccagggctggc

SEQ ID NO: 3242970 - DNA, 21 bp, Homo sapiens
tcccagggctggctctgcact

SEQ ID NO: 3242971 - DNA, 23 bp, Homo sapiens
tcccagggctggctctgcactaa

SEQ ID NO: 3242972 - DNA, 17 bp, Homo sapiens
tcccaggggaccacacc

SEQ ID NO: 3242973 - DNA, 19 bp, Homo sapiens
tcccaggggtctccctggc

SEQ ID NO: 3242974 - DNA, 20 bp, Homo sapiens
tcccaggggtctccctggct

SEQ ID NO: 3242975 - DNA, 17 bp, Homo sapiens
tcccaggtaccagctgc

SEQ ID NO: 3242976 - DNA, 21 bp, Homo sapiens
tcccaggtaccagctgcgctt

SEQ ID NO: 3242977 - DNA, 20 bp, Homo sapiens
tcccaggttcccccagcaag

SEQ ID NO: 3242978 - DNA, 19 bp, Homo sapiens
tcccagtattctcagagca

SEQ ID NO: 3242979 - DNA, 20 bp, Homo sapiens
tcccagtccaaatgtcctcc

SEQ ID NO: 3242980 - DNA, 12 bp, Homo sapiens
tcccagtgacaa

SEQ ID NO: 3242981 - DNA, 14 bp, Homo sapiens
tcccagtgacaaca

SEQ ID NO: 3242982 - DNA, 14 bp, Homo sapiens
tcccagtgggaggg

SEQ ID NO: 3242983 - DNA, 17 bp, Homo sapiens
tcccagtgggaggggca

SEQ ID NO: 3242984 - DNA, 23 bp, Homo sapiens
tcccagtgggaggggcaggctga

SEQ ID NO: 3242985 - DNA, 17 bp, Homo sapiens
tcccatagcccttacct

SEQ ID NO: 3242986 - DNA, 17 bp, Homo sapiens
tcccatatcttgccttc

SEQ ID NO: 3242987 - DNA, 15 bp, Homo sapiens
tcccatcatcctttg

SEQ ID NO: 3242988 - DNA, 15 bp, Homo sapiens
tcccatcccctggac

SEQ ID NO: 3242989 - DNA, 17 bp, Homo sapiens
tcccatcctggggcagc

SEQ ID NO: 3242990 - DNA, 22 bp, Homo sapiens
tccccgccttccgccccttccc

SEQ ID NO: 3242991 - DNA, 15 bp, Homo sapiens
tccccggacatactc

SEQ ID NO: 3242992 - DNA, 14 bp, Homo sapiens
tccccggcaccctc

SEQ ID NO: 3242993 - DNA, 20 bp, Homo sapiens
tccccggcaccctctggccg

SEQ ID NO: 3242994 - DNA, 19 bp, Homo sapiens
tccccgtgtcctctccctg

SEQ ID NO: 3242995 - DNA, 17 bp, Homo sapiens
tccccgttcctgacatc

SEQ ID NO: 3242996 - DNA, 14 bp, Homo sapiens
tcccctaacctcat

SEQ ID NO: 3242997 - DNA, 15 bp, Homo sapiens
tcccctactccctct

SEQ ID NO: 3242998 - DNA, 17 bp, Homo sapiens
tcccctactccctcttc

SEQ ID NO: 3242999 - DNA, 14 bp, Homo sapiens
tcccctcaaagtct

SEQ ID NO: 3243000 - DNA, 18 bp, Homo sapiens
tcccctcaaagtctgcaa

SEQ ID NO: 3243001 - DNA, 21 bp, Homo sapiens
tcccctcaaagtctgcaactt

SEQ ID NO: 3243002 - DNA, 13 bp, Homo sapiens
tcccctcacagcc

SEQ ID NO: 3243003 - DNA, 14 bp, Homo sapiens
tcccctcacagcct

SEQ ID NO: 3243004 - DNA, 17 bp, Homo sapiens
tcccctcacctcctcta

SEQ ID NO: 3243005 - DNA, 15 bp, Homo sapiens
tcccctcagctccag

SEQ ID NO: 3243006 - DNA, 18 bp, Homo sapiens
tcccctccatccctggcc

SEQ ID NO: 3243007 - DNA, 19 bp, Homo sapiens
tcccctcccacctctcctt

SEQ ID NO: 3243008 - DNA, 15 bp, Homo sapiens
tcccctcccatctgg

SEQ ID NO: 3243009 - DNA, 18 bp, Homo sapiens
tcccctccccgcctggcc

SEQ ID NO: 3243010 - DNA, 15 bp, Homo sapiens
tcccctcccctgctg

SEQ ID NO: 3243011 - DNA, 13 bp, Homo sapiens
tcccctccctggc

SEQ ID NO: 3243012 - DNA, 17 bp, Homo sapiens
tcccctccggactggtg

SEQ ID NO: 3243013 - DNA, 12 bp, Homo sapiens
tcccctccttgg

SEQ ID NO: 3243014 - DNA, 18 bp, Homo sapiens
tcccctccttgggcactt

SEQ ID NO: 3243015 - DNA, 13 bp, Homo sapiens
tcccctccttgtc

SEQ ID NO: 3243016 - DNA, 20 bp, Homo sapiens
tcccctcgtgtcagctcagg

SEQ ID NO: 3243017 - DNA, 14 bp, Homo sapiens
tcccctctcctgcc

SEQ ID NO: 3243018 - DNA, 16 bp, Homo sapiens
tcccctctccttcctg

SEQ ID NO: 3243019 - DNA, 13 bp, Homo sapiens
tcccctctctgcc

SEQ ID NO: 3243020 - DNA, 14 bp, Homo sapiens
tcccctctctgccc

SEQ ID NO: 3243021 - DNA, 15 bp, Homo sapiens
tcccctctctgcccc

SEQ ID NO: 3243022 - DNA, 18 bp, Homo sapiens
tcccctctctgcccctga

SEQ ID NO: 3243023 - DNA, 18 bp, Homo sapiens
tcccctcttcccttcaac

SEQ ID NO: 3243024 - DNA, 18 bp, Homo sapiens
tcccctcttcttctttcc

SEQ ID NO: 3243025 - DNA, 19 bp, Homo sapiens
tcccctcttcttctttcct

SEQ ID NO: 3243026 - DNA, 23 bp, Homo sapiens
tcccctcttttgttaaataatat

SEQ ID NO: 3243027 - DNA, 19 bp, Homo sapiens
tcccctgccccttccttta

SEQ ID NO: 3243028 - DNA, 13 bp, Homo sapiens
tcccctgcccggt

SEQ ID NO: 3243029 - DNA, 18 bp, Homo sapiens
tcccctgcggtcaggctg

SEQ ID NO: 3243030 - DNA, 14 bp, Homo sapiens
tcccctgctaccct

SEQ ID NO: 3243031 - DNA, 20 bp, Homo sapiens
tcccctgctactcctgtgct

SEQ ID NO: 3243032 - DNA, 12 bp, Homo sapiens
tcccctggcctc

SEQ ID NO: 3243033 - DNA, 22 bp, Homo sapiens
tcccctgggcatcttctggctt

SEQ ID NO: 3243034 - DNA, 18 bp, Homo sapiens
tcccctgtcctgtgaatg

SEQ ID NO: 3243035 - DNA, 20 bp, Homo sapiens
tcccctgtcctgtgaatgga

SEQ ID NO: 3243036 - DNA, 21 bp, Homo sapiens
tcccctgtcttcacctgccac

SEQ ID NO: 3243037 - DNA, 22 bp, Homo sapiens
tcccctgtcttcacctgccacc

SEQ ID NO: 3243038 - DNA, 20 bp, Homo sapiens
tcccctgtggggatctcagg

SEQ ID NO: 3243039 - DNA, 14 bp, Homo sapiens
tccccttcccctcc

SEQ ID NO: 3243040 - DNA, 15 bp, Homo sapiens
tccccttcccctccc

SEQ ID NO: 3243041 - DNA, 13 bp, Homo sapiens
tccccttctctgt

SEQ ID NO: 3243042 - DNA, 14 bp, Homo sapiens
tccccttgcccttg

SEQ ID NO: 3243043 - DNA, 22 bp, Homo sapiens
tccccttgccttcccctgtctt

SEQ ID NO: 3243044 - DNA, 22 bp, Homo sapiens
tccccttggcttcctccgtcca

SEQ ID NO: 3243045 - DNA, 21 bp, Homo sapiens
tccccttgtttgtcccttcta

SEQ ID NO: 3243046 - DNA, 20 bp, Homo sapiens
tccccttttcttttctaccc

SEQ ID NO: 3243047 - DNA, 21 bp, Homo sapiens
tccccttttcttttctaccct

SEQ ID NO: 3243048 - DNA, 19 bp, Homo sapiens
tccccttttgcctggctgt

SEQ ID NO: 3243049 - DNA, 20 bp, Homo sapiens
tcccgaagaatggagaggaa

SEQ ID NO: 3243050 - DNA, 14 bp, Homo sapiens
tcccgaggaggggc

SEQ ID NO: 3243051 - DNA, 15 bp, Homo sapiens
tcccgagtacagtct

SEQ ID NO: 3243052 - DNA, 16 bp, Homo sapiens
tcccgagtagctggga

SEQ ID NO: 3243053 - DNA, 16 bp, Homo sapiens
tcccgcactctgcccc

SEQ ID NO: 3243054 - DNA, 18 bp, Homo sapiens
tcccgcactctgccccca

SEQ ID NO: 3243055 - DNA, 17 bp, Homo sapiens
tcccgcctccctctcag

SEQ ID NO: 3243056 - DNA, 18 bp, Homo sapiens
tcccgcctccctctcaga

SEQ ID NO: 3243057 - DNA, 15 bp, Homo sapiens
tcccggagcacagcc

SEQ ID NO: 3243058 - DNA, 22 bp, Homo sapiens
tcccggagcacagccctgggag

SEQ ID NO: 3243059 - DNA, 14 bp, Homo sapiens
tcccggaggaaatc

SEQ ID NO: 3243060 - DNA, 18 bp, Homo sapiens
tcccggaggttgggtggg

SEQ ID NO: 3243061 - DNA, 14 bp, Homo sapiens
tcccggctgcctgc

SEQ ID NO: 3243062 - DNA, 18 bp, Homo sapiens
tcccggctgcctgccgcc

SEQ ID NO: 3243063 - DNA, 14 bp, Homo sapiens
tcccgggccacgcc

SEQ ID NO: 3243064 - DNA, 16 bp, Homo sapiens
tcccgggccacgcccc

SEQ ID NO: 3243065 - DNA, 19 bp, Homo sapiens
tcccgggccacgccccagc

SEQ ID NO: 3243066 - DNA, 14 bp, Homo sapiens
tcccggggctccac

SEQ ID NO: 3243067 - DNA, 14 bp, Homo sapiens
tcccggtcccgagt

SEQ ID NO: 3243068 - DNA, 19 bp, Homo sapiens
tcccggttcagacccctgc

SEQ ID NO: 3243069 - DNA, 23 bp, Homo sapiens
tcccgtcagggcccaagtccctg

SEQ ID NO: 3243070 - DNA, 15 bp, Homo sapiens
tcccgtgttctcctt

SEQ ID NO: 3243071 - DNA, 16 bp, Homo sapiens
tccctaaaatacattt

SEQ ID NO: 3243072 - DNA, 13 bp, Homo sapiens
tccctaaactgta

SEQ ID NO: 3243073 - DNA, 18 bp, Homo sapiens
tccctaaccctacaaaga

SEQ ID NO: 3243074 - DNA, 22 bp, Homo sapiens
tccctaagtaagtttcttcctg

SEQ ID NO: 3243075 - DNA, 20 bp, Homo sapiens
tccctaatttaacccagctc

SEQ ID NO: 3243076 - DNA, 17 bp, Homo sapiens
tccctaatttatgtgct

SEQ ID NO: 3243077 - DNA, 20 bp, Homo sapiens
tccctaatttatgtgctata

SEQ ID NO: 3243078 - DNA, 13 bp, Homo sapiens
tccctacactgat

SEQ ID NO: 3243079 - DNA, 16 bp, Homo sapiens
tccctacactgatgca

SEQ ID NO: 3243080 - DNA, 17 bp, Homo sapiens
tccctacactgatgcaa

SEQ ID NO: 3243081 - DNA, 21 bp, Homo sapiens
tccctaccgagtctcttctcc

SEQ ID NO: 3243082 - DNA, 15 bp, Homo sapiens
tccctacctcaggca

SEQ ID NO: 3243083 - DNA, 18 bp, Homo sapiens
tccctactcccctgggca

SEQ ID NO: 3243084 - DNA, 22 bp, Homo sapiens
tccctagaaaacaatgcaaaac

SEQ ID NO: 3243085 - DNA, 16 bp, Homo sapiens
tccctagatctttcta

SEQ ID NO: 3243086 - DNA, 20 bp, Homo sapiens
tccctagccagcacttgtat

SEQ ID NO: 3243087 - DNA, 22 bp, Homo sapiens
tccctagctttagaccctgggt

SEQ ID NO: 3243088 - DNA, 15 bp, Homo sapiens
tccctatgaaagatt

SEQ ID NO: 3243089 - DNA, 13 bp, Homo sapiens
tccctatgtattt

SEQ ID NO: 3243090 - DNA, 17 bp, Homo sapiens
tccctcaaagaggcctt

SEQ ID NO: 3243091 - DNA, 21 bp, Homo sapiens
tccctcaaatgcgcgtgtgca

SEQ ID NO: 3243092 - DNA, 20 bp, Homo sapiens
tccctcacaagcgctcccag

SEQ ID NO: 3243093 - DNA, 15 bp, Homo sapiens
tccctcacccccatg

SEQ ID NO: 3243094 - DNA, 17 bp, Homo sapiens
tccctcagctctctggg

SEQ ID NO: 3243095 - DNA, 18 bp, Homo sapiens
tccctcaggttctatttt

SEQ ID NO: 3243096 - DNA, 22 bp, Homo sapiens
tccctcaggttctattttctta

SEQ ID NO: 3243097 - DNA, 16 bp, Homo sapiens
tccctcagtgccctca

SEQ ID NO: 3243098 - DNA, 15 bp, Homo sapiens
tccctcatggctctg

SEQ ID NO: 3243099 - DNA, 14 bp, Homo sapiens
tccctccacctacc

SEQ ID NO: 3243100 - DNA, 17 bp, Homo sapiens
tccctccactccatccc

SEQ ID NO: 3243101 - DNA, 22 bp, Homo sapiens
tccctcccagaggagccaccag

SEQ ID NO: 3243102 - DNA, 23 bp, Homo sapiens
tccctcccagaggagccaccagt

SEQ ID NO: 3243103 - DNA, 18 bp, Homo sapiens
tccctcccatcatgcccg

SEQ ID NO: 3243104 - DNA, 14 bp, Homo sapiens
tccctcccccttgt

SEQ ID NO: 3243105 - DNA, 15 bp, Homo sapiens
tccctcccctgccct

SEQ ID NO: 3243106 - DNA, 14 bp, Homo sapiens
tccctccccttctc

SEQ ID NO: 3243107 - DNA, 22 bp, Homo sapiens
tccctcccggcatgggaaagcc

SEQ ID NO: 3243108 - DNA, 21 bp, Homo sapiens
tccctcccgtagtctcctggg

SEQ ID NO: 3243109 - DNA, 18 bp, Homo sapiens
tccctccgcggctggagc

SEQ ID NO: 3243110 - DNA, 19 bp, Homo sapiens
tccctccgcggctggagcg

SEQ ID NO: 3243111 - DNA, 19 bp, Homo sapiens
tccctccggcttgacctgt

SEQ ID NO: 3243112 - DNA, 12 bp, Homo sapiens
tccctcctcacc

SEQ ID NO: 3243113 - DNA, 16 bp, Homo sapiens
tccctcctcacctctg

SEQ ID NO: 3243114 - DNA, 17 bp, Homo sapiens
tccctcctcacctctgg

SEQ ID NO: 3243115 - DNA, 21 bp, Homo sapiens
tccctcctccaggcctgcctc

SEQ ID NO: 3243116 - DNA, 19 bp, Homo sapiens
tcctccttggtgcctggcc

SEQ ID NO: 3243117 - DNA, 13 bp, Homo sapiens
tcctcctttctcc

SEQ ID NO: 3243118 - DNA, 14 bp, Homo sapiens
tcctcctttttcca

SEQ ID NO: 3243119 - DNA, 13 bp, Homo sapiens
tcctcgcctgaca

SEQ ID NO: 3243120 - DNA, 15 bp, Homo sapiens
tcctcgcctgacaac

SEQ ID NO: 3243121 - DNA, 24 bp, Homo sapiens
tcctcgcctgacaaccactggtct

SEQ ID NO: 3243122 - DNA, 18 bp, Homo sapiens
tcctcggagagcagcagc

SEQ ID NO: 3243123 - DNA, 13 bp, Homo sapiens
tcctcgggaaaca

SEQ ID NO: 3243124 - DNA, 15 bp, Homo sapiens
tcctcgggccgaggc

SEQ ID NO: 3243125 - DNA, 18 bp, Homo sapiens
tcctcggggctccaggct

SEQ ID NO: 3243126 - DNA, 17 bp, Homo sapiens
tcctcgttcctttctcc

SEQ ID NO: 3243127 - DNA, 19 bp, Homo sapiens
tcctctacttaatgagata

SEQ ID NO: 3243128 - DNA, 14 bp, Homo sapiens
tcctctagaagcca

SEQ ID NO: 3243129 - DNA, 16 bp, Homo sapiens
tcctctagaagccaag

SEQ ID NO: 3243130 - DNA, 19 bp, Homo sapiens
tcctctagaagccaaggga

SEQ ID NO: 3243131 - DNA, 23 bp, Homo sapiens
tcctctaggcaagcaggacctgg

SEQ ID NO: 3243132 - DNA, 18 bp, Homo sapiens
tcctctattttgtgatga

SEQ ID NO: 3243133 - DNA, 18 bp, Homo sapiens
tcctctcacctctccctc

SEQ ID NO: 3243134 - DNA, 16 bp, Homo sapiens
tcctctcactcctgcc

SEQ ID NO: 3243135 - DNA, 12 bp, Homo sapiens
tcctctccactg

SEQ ID NO: 3243136 - DNA, 13 bp, Homo sapiens
tcctctccactgc

SEQ ID NO: 3243137 - DNA, 17 bp, Homo sapiens
tcctctccactgccttc

SEQ ID NO: 3243138 - DNA, 16 bp, Homo sapiens
tcctctcccatccccc

SEQ ID NO: 3243139 - DNA, 20 bp, Homo sapiens
tcctctcccatccccctgcc

SEQ ID NO: 3243140 - DNA, 17 bp, Homo sapiens
tcctctcccctccagcc

SEQ ID NO: 3243141 - DNA, 15 bp, Homo sapiens
tcctctccctctctc

SEQ ID NO: 3243142 - DNA, 13 bp, Homo sapiens
tcctctccctgcc

SEQ ID NO: 3243143 - DNA, 21 bp, Homo sapiens
tcctctccttgggctcctggc

SEQ ID NO: 3243144 - DNA, 23 bp, Homo sapiens
tcctctccttgggctcctggctg

SEQ ID NO: 3243145 - DNA, 17 bp, Homo sapiens
tcctctcctttgaaacc

SEQ ID NO: 3243146 - DNA, 17 bp, Homo sapiens
tcctctcgagcccagat

SEQ ID NO: 3243147 - DNA, 18 bp, Homo sapiens
tcctctcgagcccagatg

SEQ ID NO: 3243148 - DNA, 13 bp, Homo sapiens
tcctctctgggcc

SEQ ID NO: 3243149 - DNA, 14 bp, Homo sapiens
tcctctctgggcct

SEQ ID NO: 3243150 - DNA, 15 bp, Homo sapiens
tcctctctttgttct

SEQ ID NO: 3243151 - DNA, 21 bp, Homo sapiens
tcctctctttgttctcagctc

SEQ ID NO: 3243152 - DNA, 14 bp, Homo sapiens
tcctctgagcccag

SEQ ID NO: 3243153 - DNA, 15 bp, Homo sapiens
tcctctgagcccagc

SEQ ID NO: 3243154 - DNA, 19 bp, Homo sapiens
tcctctgagcccagctgcc

SEQ ID NO: 3243155 - DNA, 20 bp, Homo sapiens
tcctctgagcccagctgcct

SEQ ID NO: 3243156 - DNA, 21 bp, Homo sapiens
tcctctgagcccagctgcctg

SEQ ID NO: 3243157 - DNA, 22 bp, Homo sapiens
tcctctgagcccagctgcctgg

SEQ ID NO: 3243158 - DNA, 15 bp, Homo sapiens
tcctctgcagtgcct

SEQ ID NO: 3243159 - DNA, 13 bp, Homo sapiens
tcctctgcctgcc

SEQ ID NO: 3243160 - DNA, 14 bp, Homo sapiens
tcctctgcctgccc

SEQ ID NO: 3243161 - DNA, 22 bp, Homo sapiens
tcctctgcctgccccgccccca

SEQ ID NO: 3243162 - DNA, 12 bp, Homo sapiens
tcctctgctggt

SEQ ID NO: 3243163 - DNA, 14 bp, Homo sapiens
tcctctgctggttc

SEQ ID NO: 3243164 - DNA, 21 bp, Homo sapiens
tcctctgctggttcctgactg

SEQ ID NO: 3243165 - DNA, 18 bp, Homo sapiens
tcctctggacggcaggct

SEQ ID NO: 3243166 - DNA, 16 bp, Homo sapiens
tcctctgggcctgggg

SEQ ID NO: 3243167 - DNA, 13 bp, Homo sapiens
tcctctggggctc

SEQ ID NO: 3243168 - DNA, 22 bp, Homo sapiens
tcctctgtccaggcactgctgc

SEQ ID NO: 3243169 - DNA, 12 bp, Homo sapiens
tcctctgttcac

SEQ ID NO: 3243170 - DNA, 21 bp, Homo sapiens
tcctctgtttagaacaccaaa

SEQ ID NO: 3243171 - DNA, 22 bp, Homo sapiens
tcctctgtttctccttctgaaa

SEQ ID NO: 3243172 - DNA, 13 bp, Homo sapiens
tcctcttcagaac

SEQ ID NO: 3243173 - DNA, 18 bp, Homo sapiens
tcctcttccccttgccct

SEQ ID NO: 3243174 - DNA, 14 bp, Homo sapiens
tcctcttccctctc

SEQ ID NO: 3243175 - DNA, 13 bp, Homo sapiens
tcctcttctgggc

SEQ ID NO: 3243176 - DNA, 13 bp, Homo sapiens
tcctcttgctcaa

SEQ ID NO: 3243177 - DNA, 19 bp, Homo sapiens
tcctcttgtcctacaatga

SEQ ID NO: 3243178 - DNA, 20 bp, Homo sapiens
tcctcttgtgatttctttaa

SEQ ID NO: 3243179 - DNA, 18 bp, Homo sapiens
tcctctttagtttttggt

SEQ ID NO: 3243180 - DNA, 22 bp, Homo sapiens
tcctctttgtaatttaatgaaa

SEQ ID NO: 3243181 - DNA, 13 bp, Homo sapiens
tcctctttttcca

SEQ ID NO: 3243182 - DNA, 21 bp, Homo sapiens
tcctctttttccatcataatt

SEQ ID NO: 3243183 - DNA, 17 bp, Homo sapiens
tcctgaaacccaaagcc

SEQ ID NO: 3243184 - DNA, 19 bp, Homo sapiens
tcctgaaataaacactggt

SEQ ID NO: 3243185 - DNA, 14 bp, Homo sapiens
tcctgaaccatgtg

SEQ ID NO: 3243186 - DNA, 22 bp, Homo sapiens
tcctgaaccatgtggataactt

SEQ ID NO: 3243187 - DNA, 18 bp, Homo sapiens
tcctgaaccgcacagctc

SEQ ID NO: 3243188 - DNA, 19 bp, Homo sapiens
tcctgaaccgcacagctca

SEQ ID NO: 3243189 - DNA, 21 bp, Homo sapiens
tcctgaaccgcacagctcagg

SEQ ID NO: 3243190 - DNA, 17 bp, Homo sapiens
tcctgaactttctccct

SEQ ID NO: 3243191 - DNA, 18 bp, Homo sapiens
tcctgaactttctccctc

SEQ ID NO: 3243192 - DNA, 21 bp, Homo sapiens
tcctgaactttctccctcatc

SEQ ID NO: 3243193 - DNA, 14 bp, Homo sapiens
tcctgaagaattaa

SEQ ID NO: 3243194 - DNA, 19 bp, Homo sapiens
tcctgaagaggcgggccag

SEQ ID NO: 3243195 - DNA, 20 bp, Homo sapiens
tcctgaagaggcgggccagc

SEQ ID NO: 3243196 - DNA, 16 bp, Homo sapiens
tcctgaatctgtgcaa

SEQ ID NO: 3243197 - DNA, 22 bp, Homo sapiens
tcctgacaaatattttagaagc

SEQ ID NO: 3243198 - DNA, 14 bp, Homo sapiens
tcctgacagaaggt

SEQ ID NO: 3243199 - DNA, 21 bp, Homo sapiens
tcctgacatcacagcagcctc

SEQ ID NO: 3243200 - DNA, 14 bp, Homo sapiens
tcctgacattgtct

SEQ ID NO: 3243201 - DNA, 15 bp, Homo sapiens
tcctgacattgtctc

SEQ ID NO: 3243202 - DNA, 14 bp, Homo sapiens
tcctgaccaccctc

SEQ ID NO: 3243203 - DNA, 15 bp, Homo sapiens
tcctgaccaccctcc

SEQ ID NO: 3243204 - DNA, 14 bp, Homo sapiens
tcctgacccaggcc

SEQ ID NO: 3243205 - DNA, 19 bp, Homo sapiens
tcctgacccaggccgcagc

SEQ ID NO: 3243206 - DNA, 16 bp, Homo sapiens
tcctgacccagtcccc

SEQ ID NO: 3243207 - DNA, 16 bp, Homo sapiens
tcctgacctcaggtga

SEQ ID NO: 3243208 - DNA, 21 bp, Homo sapiens
tcctgacgaaactggccccgg

SEQ ID NO: 3243209 - DNA, 22 bp, Homo sapiens
tcctgacgaaactggccccgga

SEQ ID NO: 3243210 - DNA, 18 bp, Homo sapiens
tcctgacgtctgaagctt

SEQ ID NO: 3243211 - DNA, 23 bp, Homo sapiens
tcctgagaaggcgaggagagtgg

SEQ ID NO: 3243212 - DNA, 14 bp, Homo sapiens
tcctgagccccgcc

SEQ ID NO: 3243213 - DNA, 18 bp, Homo sapiens
tcctgagccccgccctct

SEQ ID NO: 3243214 - DNA, 13 bp, Homo sapiens
tcctgagcctgtg

SEQ ID NO: 3243215 - DNA, 18 bp, Homo sapiens
tcctgaggctttggattt

SEQ ID NO: 3243216 - DNA, 20 bp, Homo sapiens
tcctgaggggcatctgcccc

SEQ ID NO: 3243217 - DNA, 17 bp, Homo sapiens
tcctgagggtccccacc

SEQ ID NO: 3243218 - DNA, 19 bp, Homo sapiens
tcctgagggtccccacctg

SEQ ID NO: 3243219 - DNA, 16 bp, Homo sapiens
tcctgagtggccaggg

SEQ ID NO: 3243220 - DNA, 21 bp, Homo sapiens
tcctgataaaacaacagctcg

SEQ ID NO: 3243221 - DNA, 21 bp, Homo sapiens
tcctgataaagcacagctgta

SEQ ID NO: 3243222 - DNA, 19 bp, Homo sapiens
tcctgatgaccaatgggat

SEQ ID NO: 3243223 - DNA, 18 bp, Homo sapiens
tcctgatggtacaggaaa

SEQ ID NO: 3243224 - DNA, 19 bp, Homo sapiens
tcctgatggtcagctccct

SEQ ID NO: 3243225 - DNA, 13 bp, Homo sapiens
tcctgattttgta

SEQ ID NO: 3243226 - DNA, 17 bp, Homo sapiens
tcctgcaaaattttata

SEQ ID NO: 3243227 - DNA, 19 bp, Homo sapiens
tcctgcaaaattttatagc

SEQ ID NO: 3243228 - DNA, 15 bp, Homo sapiens
tcctgcactgtttaa

SEQ ID NO: 3243229 - DNA, 19 bp, Homo sapiens
tcctgcagacacctggact

SEQ ID NO: 3243230 - DNA, 20 bp, Homo sapiens
tcctgcagacacctggactg

SEQ ID NO: 3243231 - DNA, 19 bp, Homo sapiens
tcctgcagccccagaagaa

SEQ ID NO: 3243232 - DNA, 12 bp, Homo sapiens
tcctgcagcctc

SEQ ID NO: 3243233 - DNA, 16 bp, Homo sapiens
tcctgcagcctcctcc

SEQ ID NO: 3243234 - DNA, 22 bp, Homo sapiens
tcctgcagcctcctcctgacca

SEQ ID NO: 3243235 - DNA, 17 bp, Homo sapiens
tcctgcaggaacgagca

SEQ ID NO: 3243236 - DNA, 24 bp, Homo sapiens
tcctgcaggaacgagcactggcca

SEQ ID NO: 3243237 - DNA, 12 bp, Homo sapiens
tcctgcatttct

SEQ ID NO: 3243238 - DNA, 11 bp, Homo sapiens
tcctgccaaaa

SEQ ID NO: 3243239 - DNA, 20 bp, Homo sapiens
tcctgccacaacagaataaa

SEQ ID NO: 3243240 - DNA, 23 bp, Homo sapiens
tcctgccacaacagaataaagca

SEQ ID NO: 3243241 - DNA, 16 bp, Homo sapiens
tcctgccaccctgtag

SEQ ID NO: 3243242 - DNA, 19 bp, Homo sapiens
tcggaggccccactgatgc

SEQ ID NO: 3243243 - DNA, 14 bp, Homo sapiens
tcggaggctgggcc

SEQ ID NO: 3243244 - DNA, 21 bp, Homo sapiens
tcggaggctgggcccctggga

SEQ ID NO: 3243245 - DNA, 20 bp, Homo sapiens
tcggatttgagtgatcatta

SEQ ID NO: 3243246 - DNA, 16 bp, Homo sapiens
tcggcaggaaggagcg

SEQ ID NO: 3243247 - DNA, 13 bp, Homo sapiens
tcggccacagggc

SEQ ID NO: 3243248 - DNA, 16 bp, Homo sapiens
tcggccccacatggga

SEQ ID NO: 3243249 - DNA, 19 bp, Homo sapiens
tcggccccacatgggaacc

SEQ ID NO: 3243250 - DNA, 17 bp, Homo sapiens
tcggcctccatcctgag

SEQ ID NO: 3243251 - DNA, 23 bp, Homo sapiens
tcggcgcccaccaccccctcaag

SEQ ID NO: 3243252 - DNA, 19 bp, Homo sapiens
tcggctcaggctctgctgg

SEQ ID NO: 3243253 - DNA, 14 bp, Homo sapiens
tcggctctgggtgg

SEQ ID NO: 3243254 - DNA, 18 bp, Homo sapiens
tcggctggggactgctac

SEQ ID NO: 3243255 - DNA, 22 bp, Homo sapiens
tcggcttgagttcaccatctct

SEQ ID NO: 3243256 - DNA, 21 bp, Homo sapiens
tcgggaaaaggtagaggagtc

SEQ ID NO: 3243257 - DNA, 18 bp, Homo sapiens
tcgggaaacacacaagca

SEQ ID NO: 3243258 - DNA, 14 bp, Homo sapiens
tcgggaagcagcca

SEQ ID NO: 3243259 - DNA, 15 bp, Homo sapiens
tcgggaagcagccag

SEQ ID NO: 3243260 - DNA, 17 bp, Homo sapiens
tcgggagcacccagagc

SEQ ID NO: 3243261 - DNA, 14 bp, Homo sapiens
tcgggagcagtgtc

SEQ ID NO: 3243262 - DNA, 19 bp, Homo sapiens
tcgggagcagtgtcttcca

SEQ ID NO: 3243263 - DNA, 22 bp, Homo sapiens
tcgggagcagtgtcttccataa

SEQ ID NO: 3243264 - DNA, 17 bp, Homo sapiens
tcgggcaccagccagcg

SEQ ID NO: 3243265 - DNA, 13 bp, Homo sapiens
tcgggcagccagc

SEQ ID NO: 3243266 - DNA, 16 bp, Homo sapiens
tcgggcagccagcaga

SEQ ID NO: 3243267 - DNA, 17 bp, Homo sapiens
tcgggcagccagcagag

SEQ ID NO: 3243268 - DNA, 18 bp, Homo sapiens
tcgggcccacctggccac

SEQ ID NO: 3243269 - DNA, 22 bp, Homo sapiens
tcgggccccatcctcatccctg

SEQ ID NO: 3243270 - DNA, 23 bp, Homo sapiens
tcgggccccatcctcatccctga

SEQ ID NO: 3243271 - DNA, 22 bp, Homo sapiens
tcggggaagctgcacatgtgcc

SEQ ID NO: 3243272 - DNA, 15 bp, Homo sapiens
tcggggccctgtgta

SEQ ID NO: 3243273 - DNA, 13 bp, Homo sapiens
tcggggctccagg

SEQ ID NO: 3243274 - DNA, 14 bp, Homo sapiens
tcggggctccaggc

SEQ ID NO: 3243275 - DNA, 16 bp, Homo sapiens
tcggggggtcacaggc

SEQ ID NO: 3243276 - DNA, 18 bp, Homo sapiens
tcggggggtcacaggccc

SEQ ID NO: 3243277 - DNA, 20 bp, Homo sapiens
tcggggggtcacaggcccag

SEQ ID NO: 3243278 - DNA, 21 bp, Homo sapiens
tcggggggtcacaggcccaga

SEQ ID NO: 3243279 - DNA, 23 bp, Homo sapiens
tcggggggtcacaggcccagaag

SEQ ID NO: 3243280 - DNA, 20 bp, Homo sapiens
tcggtatccccccatcttgc

SEQ ID NO: 3243281 - DNA, 13 bp, Homo sapiens
tcggtcttttgta

SEQ ID NO: 3243282 - DNA, 24 bp, Homo sapiens
tcggtgttcttcttctcttctctg

SEQ ID NO: 3243283 - DNA, 15 bp, Homo sapiens
tcggttccacgtccc

SEQ ID NO: 3243284 - DNA, 12 bp, Homo sapiens
tcgtagctttcc

SEQ ID NO: 3243285 - DNA, 22 bp, Homo sapiens
tcgtagctttcccaaataaact

SEQ ID NO: 3243286 - DNA, 20 bp, Homo sapiens
tcgtatcccgagtctgggac

SEQ ID NO: 3243287 - DNA, 15 bp, Homo sapiens
tcgtatgaaaatgag

SEQ ID NO: 3243288 - DNA, 17 bp, Homo sapiens
tcgtatgatcagtactg

SEQ ID NO: 3243289 - DNA, 21 bp, Homo sapiens
tcgtccacaggggcaggcctg

SEQ ID NO: 3243290 - DNA, 23 bp, Homo sapiens
tcgtccacaggggcaggcctggg

SEQ ID NO: 3243291 - DNA, 16 bp, Homo sapiens
tcgtccttttggttta

SEQ ID NO: 3243292 - DNA, 14 bp, Homo sapiens
tcgtcgcacagtct

SEQ ID NO: 3243293 - DNA, 16 bp, Homo sapiens
tcgtcgcacagtctct

SEQ ID NO: 3243294 - DNA, 16 bp, Homo sapiens
tcgtctccctcgacag

SEQ ID NO: 3243295 - DNA, 14 bp, Homo sapiens
tcgtcttcactctt

SEQ ID NO: 3243296 - DNA, 19 bp, Homo sapiens
tcgtcttgagcccaggagt

SEQ ID NO: 3243297 - DNA, 18 bp, Homo sapiens
tcgtgacccttcagggcc

SEQ ID NO: 3243298 - DNA, 13 bp, Homo sapiens
tcgtgagctgggg

SEQ ID NO: 3243299 - DNA, 18 bp, Homo sapiens
tcgtgagctggggactca

SEQ ID NO: 3243300 - DNA, 20 bp, Homo sapiens
tcgtgagctggggactcagg

SEQ ID NO: 3243301 - DNA, 20 bp, Homo sapiens
tcgtgattttcaagcagcat

SEQ ID NO: 3243302 - DNA, 17 bp, Homo sapiens
tcgtgccatgatctgta

SEQ ID NO: 3243303 - DNA, 23 bp, Homo sapiens
tcgtgcctccttccacctccctc

SEQ ID NO: 3243304 - DNA, 13 bp, Homo sapiens
tcgtgcctgtgtc

SEQ ID NO: 3243305 - DNA, 13 bp, Homo sapiens
tcgtggccagccc

SEQ ID NO: 3243306 - DNA, 18 bp, Homo sapiens
tcgtggccagcccggctg

SEQ ID NO: 3243307 - DNA, 20 bp, Homo sapiens
tcgtggctttggcagtgttt

SEQ ID NO: 3243308 - DNA, 15 bp, Homo sapiens
tcgtgggtgtgtgta

SEQ ID NO: 3243309 - DNA, 22 bp, Homo sapiens
tcgtgtagtggaagagcagcct

SEQ ID NO: 3243310 - DNA, 14 bp, Homo sapiens
tcgtgtatttatta

SEQ ID NO: 3243311 - DNA, 12 bp, Homo sapiens
tcgttaacattg

SEQ ID NO: 3243312 - DNA, 15 bp, Homo sapiens
tcgttagaccgctct

SEQ ID NO: 3243313 - DNA, 14 bp, Homo sapiens
tcgttcaaaacatt

SEQ ID NO: 3243314 - DNA, 15 bp, Homo sapiens
tcgttcaaaacattc

SEQ ID NO: 3243315 - DNA, 12 bp, Homo sapiens
tcgttcctttct

SEQ ID NO: 3243316 - DNA, 15 bp, Homo sapiens
tcgttggagactgaa

SEQ ID NO: 3243317 - DNA, 12 bp, Homo sapiens
tcgtttctgtat

SEQ ID NO: 3243318 - DNA, 16 bp, Homo sapiens
tctaaaacaaaatctg

SEQ ID NO: 3243319 - DNA, 19 bp, Homo sapiens
tctaaaacaaaatctgaac

SEQ ID NO: 3243320 - DNA, 16 bp, Homo sapiens
tctaaaagcagaaaat

SEQ ID NO: 3243321 - DNA, 17 bp, Homo sapiens
tctaaaaggtaatgtgt

SEQ ID NO: 3243322 - DNA, 16 bp, Homo sapiens
tctaaaaggttcaggg

SEQ ID NO: 3243323 - DNA, 18 bp, Homo sapiens
tctaaaatcttatagttc

SEQ ID NO: 3243324 - DNA, 19 bp, Homo sapiens
tctaaaatcttatagttct

SEQ ID NO: 3243325 - DNA, 12 bp, Homo sapiens
tctaaaatgtca

SEQ ID NO: 3243326 - DNA, 20 bp, Homo sapiens
tctaaacaagaaccatttgc

SEQ ID NO: 3243327 - DNA, 21 bp, Homo sapiens
tctaaaccatatgaacatata

SEQ ID NO: 3243328 - DNA, 20 bp, Homo sapiens
tctaaacgtggtcaccttcg

SEQ ID NO: 3243329 - DNA, 18 bp, Homo sapiens
tctaaactggtacaattt

SEQ ID NO: 3243330 - DNA, 17 bp, Homo sapiens
tctaaacttccccatct

SEQ ID NO: 3243331 - DNA, 18 bp, Homo sapiens
tctaaagatggagtttct

SEQ ID NO: 3243332 - DNA, 20 bp, Homo sapiens
tctaaagatggagtttctaa

SEQ ID NO: 3243333 - DNA, 22 bp, Homo sapiens
tctaaagattctatagttctag

SEQ ID NO: 3243334 - DNA, 20 bp, Homo sapiens
tctaaagcagtttattataa

SEQ ID NO: 3243335 - DNA, 14 bp, Homo sapiens
tctaaagctctgac

SEQ ID NO: 3243336 - DNA, 15 bp, Homo sapiens
tctaaaggtccacag

SEQ ID NO: 3243337 - DNA, 17 bp, Homo sapiens
tctaaaggtccacaggt

SEQ ID NO: 3243338 - DNA, 22 bp, Homo sapiens
tctaaaggtccacaggtctaga

SEQ ID NO: 3243339 - DNA, 18 bp, Homo sapiens
tctaaaggtggtgaggca

SEQ ID NO: 3243340 - DNA, 21 bp, Homo sapiens
tctaaagtgttggtctttcta

SEQ ID NO: 3243341 - DNA, 14 bp, Homo sapiens
tctaaagttctaag

SEQ ID NO: 3243342 - DNA, 19 bp, Homo sapiens
tctaaagttctaagattct

SEQ ID NO: 3243343 - DNA, 21 bp, Homo sapiens
tctaaagttctaagattctga

SEQ ID NO: 3243344 - DNA, 15 bp, Homo sapiens
tctaaagttgctcca

SEQ ID NO: 3243345 - DNA, 23 bp, Homo sapiens
tctaaatatttccttaaactgtg

SEQ ID NO: 3243346 - DNA, 21 bp, Homo sapiens
tctaaatctatttattaatat

SEQ ID NO: 3243347 - DNA, 20 bp, Homo sapiens
tctaaattctttatttctgt

SEQ ID NO: 3243348 - DNA, 19 bp, Homo sapiens
tctaacaaaaaaatatatt

SEQ ID NO: 3243349 - DNA, 22 bp, Homo sapiens
tctaacagccctcctctgcact

SEQ ID NO: 3243350 - DNA, 23 bp, Homo sapiens
tctaacagccctcctctgcactc

SEQ ID NO: 3243351 - DNA, 14 bp, Homo sapiens
tctaactcagaatt

SEQ ID NO: 3243352 - DNA, 18 bp, Homo sapiens
tctaactcagaattattt

SEQ ID NO: 3243353 - DNA, 17 bp, Homo sapiens
tctaactttattctttg

SEQ ID NO: 3243354 - DNA, 18 bp, Homo sapiens
tctaactttattctttgt

SEQ ID NO: 3243355 - DNA, 17 bp, Homo sapiens
tctaagaataataaaat

SEQ ID NO: 3243356 - DNA, 21 bp, Homo sapiens
tctaagactatatatataaat

SEQ ID NO: 3243357 - DNA, 21 bp, Homo sapiens
tctaagactcaaatgttctaa

SEQ ID NO: 3243358 - DNA, 23 bp, Homo sapiens
tctaagacttactctaagatctt

SEQ ID NO: 3243359 - DNA, 16 bp, Homo sapiens
tctaagattctaaagg

SEQ ID NO: 3243360 - DNA, 17 bp, Homo sapiens
tctaagattctaatgat

SEQ ID NO: 3243361 - DNA, 14 bp, Homo sapiens
tctaagctgtgtgc

SEQ ID NO: 3243362 - DNA, 19 bp, Homo sapiens
tctaaggataatgaaataa

SEQ ID NO: 3243363 - DNA, 22 bp, Homo sapiens
tctaaggctctgagagtctaga

SEQ ID NO: 3243364 - DNA, 15 bp, Homo sapiens
tctaaggtctatcaa

SEQ ID NO: 3243365 - DNA, 18 bp, Homo sapiens
tctaaggttctcatagga

SEQ ID NO: 3243366 - DNA, 17 bp, Homo sapiens
tctaagtatttaaatgt

SEQ ID NO: 3243367 - DNA, 16 bp, Homo sapiens
tctccagtatgaaatt

SEQ ID NO: 3243368 - DNA, 23 bp, Homo sapiens
tctccagttgggactcaggatat

SEQ ID NO: 3243369 - DNA, 15 bp, Homo sapiens
tctccagttttcagt

SEQ ID NO: 3243370 - DNA, 15 bp, Homo sapiens
tctccatatctcctt

SEQ ID NO: 3243371 - DNA, 14 bp, Homo sapiens
tctccatatgttac

SEQ ID NO: 3243372 - DNA, 20 bp, Homo sapiens
tctccatcaccctcttcctg

SEQ ID NO: 3243373 - DNA, 13 bp, Homo sapiens
tctccatcagctg

SEQ ID NO: 3243374 - DNA, 17 bp, Homo sapiens
tctccatcagctgtaag

SEQ ID NO: 3243375 - DNA, 17 bp, Homo sapiens
tctccatggcatcttcg

SEQ ID NO: 3243376 - DNA, 16 bp, Homo sapiens
tctcccacagagtgct

SEQ ID NO: 3243377 - DNA, 14 bp, Homo sapiens
tctcccacatgagg

SEQ ID NO: 3243378 - DNA, 17 bp, Homo sapiens
tctcccacatgaggcca

SEQ ID NO: 3243379 - DNA, 21 bp, Homo sapiens
tctcccacatgaggccatctc

SEQ ID NO: 3243380 - DNA, 21 bp, Homo sapiens
tctcccaccccggcctccact

SEQ ID NO: 3243381 - DNA, 16 bp, Homo sapiens
tctcccacgtgggaga

SEQ ID NO: 3243382 - DNA, 12 bp, Homo sapiens
tctcccaggccc

SEQ ID NO: 3243383 - DNA, 17 bp, Homo sapiens
tctcccaggtaccagct

SEQ ID NO: 3243384 - DNA, 18 bp, Homo sapiens
tctcccaggtaccagctg

SEQ ID NO: 3243385 - DNA, 15 bp, Homo sapiens
tctcccatccccctg

SEQ ID NO: 3243386 - DNA, 18 bp, Homo sapiens
tctcccatccccctgccc

SEQ ID NO: 3243387 - DNA, 20 bp, Homo sapiens
tctcccatccccctgccctc

SEQ ID NO: 3243388 - DNA, 16 bp, Homo sapiens
tctcccatttcaggaa

SEQ ID NO: 3243389 - DNA, 23 bp, Homo sapiens
tctcccattttggaatttgcctg

SEQ ID NO: 3243390 - DNA, 15 bp, Homo sapiens
tctccccacagcctc

SEQ ID NO: 3243391 - DNA, 12 bp, Homo sapiens
tctccccactga

SEQ ID NO: 3243392 - DNA, 23 bp, Homo sapiens
tctccccagcaagtgagagctgg

SEQ ID NO: 3243393 - DNA, 14 bp, Homo sapiens
tctccccatcccca

SEQ ID NO: 3243394 - DNA, 19 bp, Homo sapiens
tctccccatccccttccta

SEQ ID NO: 3243395 - DNA, 22 bp, Homo sapiens
tctccccatccccttcctaaat

SEQ ID NO: 3243396 - DNA, 22 bp, Homo sapiens
tctccccatgtgcctgcaccag

SEQ ID NO: 3243397 - DNA, 14 bp, Homo sapiens
tctcccccaaccca

SEQ ID NO: 3243398 - DNA, 22 bp, Homo sapiens
tctcccccaacccacctctggc

SEQ ID NO: 3243399 - DNA, 23 bp, Homo sapiens
tctcccccaacccacctctggcc

SEQ ID NO: 3243400 - DNA, 18 bp, Homo sapiens
tctcccccgacactgctg

SEQ ID NO: 3243401 - DNA, 12 bp, Homo sapiens
tctccccctggg

SEQ ID NO: 3243402 - DNA, 13 bp, Homo sapiens
tctccccctgggc

SEQ ID NO: 3243403 - DNA, 22 bp, Homo sapiens
tctccccgctaaggaagatatc

SEQ ID NO: 3243404 - DNA, 11 bp, Homo sapiens
tctcccctcaa

SEQ ID NO: 3243405 - DNA, 16 bp, Homo sapiens
tctcccctccagcctt

SEQ ID NO: 3243406 - DNA, 15 bp, Homo sapiens
tctcccctgccctgc

SEQ ID NO: 3243407 - DNA, 20 bp, Homo sapiens
tctcccgtcagggcccaagt

SEQ ID NO: 3243408 - DNA, 13 bp, Homo sapiens
tctccctctctct

SEQ ID NO: 3243409 - DNA, 21 bp, Homo sapiens
tctccctcttctcaagtgcct

SEQ ID NO: 3243410 - DNA, 22 bp, Homo sapiens
tctccctcttctcaagtgcctt

SEQ ID NO: 3243411 - DNA, 20 bp, Homo sapiens
tctccctgccaagtctcaga

SEQ ID NO: 3243412 - DNA, 17 bp, Homo sapiens
tctccctgcctggcccc

SEQ ID NO: 3243413 - DNA, 15 bp, Homo sapiens
tctccctggctccct

SEQ ID NO: 3243414 - DNA, 19 bp, Homo sapiens
tctcccttcctctctcctt

SEQ ID NO: 3243415 - DNA, 15 bp, Homo sapiens
tctccctttcccttc

SEQ ID NO: 3243416 - DNA, 23 bp, Homo sapiens
tctccgaccagacaccttgacag

SEQ ID NO: 3243417 - DNA, 15 bp, Homo sapiens
tctccgccagcctcc

SEQ ID NO: 3243418 - DNA, 18 bp, Homo sapiens
tctccgccagcctcctct

SEQ ID NO: 3243419 - DNA, 15 bp, Homo sapiens
tctccggggtctgtg

SEQ ID NO: 3243420 - DNA, 21 bp, Homo sapiens
tctccgggtgtggcctcagcc

SEQ ID NO: 3243421 - DNA, 22 bp, Homo sapiens
tctcctaatttgtttcttctgt

SEQ ID NO: 3243422 - DNA, 19 bp, Homo sapiens
tctcctataatctgtcaaa

SEQ ID NO: 3243423 - DNA, 15 bp, Homo sapiens
tctcctatatatttc

SEQ ID NO: 3243424 - DNA, 19 bp, Homo sapiens
tctcctatatatttctatt

SEQ ID NO: 3243425 - DNA, 23 bp, Homo sapiens
tctcctatatatttctattatta

SEQ ID NO: 3243426 - DNA, 13 bp, Homo sapiens
tctcctatttttt

SEQ ID NO: 3243427 - DNA, 20 bp, Homo sapiens
tctcctatttttttaaaatc

SEQ ID NO: 3243428 - DNA, 15 bp, Homo sapiens
tctcctcactctgtc

SEQ ID NO: 3243429 - DNA, 16 bp, Homo sapiens
tctcctcactctgtcc

SEQ ID NO: 3243430 - DNA, 17 bp, Homo sapiens
tctcctcactctgtccc

SEQ ID NO: 3243431 - DNA, 19 bp, Homo sapiens
tctcctcactctgtccctg

SEQ ID NO: 3243432 - DNA, 12 bp, Homo sapiens
tctcctcagggt

SEQ ID NO: 3243433 - DNA, 16 bp, Homo sapiens
tctcctcagggtgggg

SEQ ID NO: 3243434 - DNA, 17 bp, Homo sapiens
tctcctccatactcagg

SEQ ID NO: 3243435 - DNA, 12 bp, Homo sapiens
tctcctcccagc

SEQ ID NO: 3243436 - DNA, 15 bp, Homo sapiens
tctcctcccagcgtg

SEQ ID NO: 3243437 - DNA, 20 bp, Homo sapiens
tctcctcccagcgtgtgtat

SEQ ID NO: 3243438 - DNA, 22 bp, Homo sapiens
tctcctcccagcgtgtgtatcc

SEQ ID NO: 3243439 - DNA, 12 bp, Homo sapiens
tctcctcccagg

SEQ ID NO: 3243440 - DNA, 13 bp, Homo sapiens
tctcctccctcag

SEQ ID NO: 3243441 - DNA, 13 bp, Homo sapiens
tctcctcccttcc

SEQ ID NO: 3243442 - DNA, 11 bp, Homo sapiens
tctcctctctg

SEQ ID NO: 3243443 - DNA, 13 bp, Homo sapiens
tctcctcttgcca

SEQ ID NO: 3243444 - DNA, 22 bp, Homo sapiens
tctcctcttgccactgcctctt

SEQ ID NO: 3243445 - DNA, 14 bp, Homo sapiens
tctcctgcccagat

SEQ ID NO: 3243446 - DNA, 17 bp, Homo sapiens
tctcctgcctcagcctc

SEQ ID NO: 3243447 - DNA, 19 bp, Homo sapiens
tctcctgcgccccgcccac

SEQ ID NO: 3243448 - DNA, 22 bp, Homo sapiens
tctcctgcgccccgcccacacc

SEQ ID NO: 3243449 - DNA, 11 bp, Homo sapiens
tctcctggagg

SEQ ID NO: 3243450 - DNA, 23 bp, Homo sapiens
tctcctggcctatccgctgccag

SEQ ID NO: 3243451 - DNA, 20 bp, Homo sapiens
tctcctggctaagcctctgc

SEQ ID NO: 3243452 - DNA, 19 bp, Homo sapiens
tctcctgggggtggcaggc

SEQ ID NO: 3243453 - DNA, 20 bp, Homo sapiens
tctcctgggggtggcaggca

SEQ ID NO: 3243454 - DNA, 17 bp, Homo sapiens
tctcctgtgcatgggtg

SEQ ID NO: 3243455 - DNA, 17 bp, Homo sapiens
tctcctgtgcccacatc

SEQ ID NO: 3243456 - DNA, 18 bp, Homo sapiens
tctcctgtttcccttccc

SEQ ID NO: 3243457 - DNA, 12 bp, Homo sapiens
tctccttaagct

SEQ ID NO: 3243458 - DNA, 22 bp, Homo sapiens
tctccttaagctgcagagattt

SEQ ID NO: 3243459 - DNA, 19 bp, Homo sapiens
tctccttactctgagccca

SEQ ID NO: 3243460 - DNA, 20 bp, Homo sapiens
tctccttactctgagcccag

SEQ ID NO: 3243461 - DNA, 14 bp, Homo sapiens
tctccttagtcttc

SEQ ID NO: 3243462 - DNA, 18 bp, Homo sapiens
tctccttagtcttctcat

SEQ ID NO: 3243463 - DNA, 13 bp, Homo sapiens
tctccttcagcac

SEQ ID NO: 3243464 - DNA, 14 bp, Homo sapiens
tctccttcagcacg

SEQ ID NO: 3243465 - DNA, 17 bp, Homo sapiens
tctccttccccaggatg

SEQ ID NO: 3243466 - DNA, 14 bp, Homo sapiens
tctccttcccctac

SEQ ID NO: 3243467 - DNA, 19 bp, Homo sapiens
tctccttcgtatcccgagt

SEQ ID NO: 3243468 - DNA, 23 bp, Homo sapiens
tctccttcgtatcccgagtctgg

SEQ ID NO: 3243469 - DNA, 14 bp, Homo sapiens
tctccttcttagct

SEQ ID NO: 3243470 - DNA, 14 bp, Homo sapiens
tctccttgggctcc

SEQ ID NO: 3243471 - DNA, 19 bp, Homo sapiens
tctccttgggctcctggct

SEQ ID NO: 3243472 - DNA, 14 bp, Homo sapiens
tctcctttcaggga

SEQ ID NO: 3243473 - DNA, 12 bp, Homo sapiens
tctcctttgaaa

SEQ ID NO: 3243474 - DNA, 17 bp, Homo sapiens
tctcctttgcactgagg

SEQ ID NO: 3243475 - DNA, 22 bp, Homo sapiens
tctcctttgcactgagggccac

SEQ ID NO: 3243476 - DNA, 13 bp, Homo sapiens
tctcctttgctct

SEQ ID NO: 3243477 - DNA, 16 bp, Homo sapiens
tctcctttgctcttgc

SEQ ID NO: 3243478 - DNA, 17 bp, Homo sapiens
tctccttttccttacca

SEQ ID NO: 3243479 - DNA, 12 bp, Homo sapiens
tctccttttctt

SEQ ID NO: 3243480 - DNA, 14 bp, Homo sapiens
tctccttttctttt

SEQ ID NO: 3243481 - DNA, 18 bp, Homo sapiens
tctccttttcttttgtta

SEQ ID NO: 3243482 - DNA, 19 bp, Homo sapiens
tctccttttcttttgttac

SEQ ID NO: 3243483 - DNA, 15 bp, Homo sapiens
tctccttttgaggct

SEQ ID NO: 3243484 - DNA, 13 bp, Homo sapiens
tctcgaccttctg

SEQ ID NO: 3243485 - DNA, 18 bp, Homo sapiens
tctcgagcccagatggaa

SEQ ID NO: 3243486 - DNA, 13 bp, Homo sapiens
tctcgatctcctg

SEQ ID NO: 3243487 - DNA, 14 bp, Homo sapiens
tctcgatctcctga

SEQ ID NO: 3243488 - DNA, 21 bp, Homo sapiens
tctcgctgtcactggctggct

SEQ ID NO: 3243489 - DNA, 18 bp, Homo sapiens
tctcggatgacaccctgg

SEQ ID NO: 3243490 - DNA, 18 bp, Homo sapiens
tctcggatgaccaaacca

SEQ ID NO: 3243491 - DNA, 15 bp, Homo sapiens
tctcggctcaggctc

SEQ ID NO: 3243492 - DNA, 21 bp, Homo sapiens
tctcggctccccatgtgtcct

SEQ ID NO: 3243493 - DNA, 17 bp, Homo sapiens
tctcggttccacgtccc

SEQ ID NO: 3243494 - DNA, 16 bp, Homo sapiens
tctgcctgcccaggcc

SEQ ID NO: 3243495 - DNA, 12 bp, Homo sapiens
tctgcctgcccc

SEQ ID NO: 3243496 - DNA, 15 bp, Homo sapiens
tctgcctgcggccca

SEQ ID NO: 3243497 - DNA, 12 bp, Homo sapiens
tctgcctggagt

SEQ ID NO: 3243498 - DNA, 21 bp, Homo sapiens
tctgcctggagtgtatgactg

SEQ ID NO: 3243499 - DNA, 17 bp, Homo sapiens
tctgcctggcctggctc

SEQ ID NO: 3243500 - DNA, 19 bp, Homo sapiens
tctgcctggcctggctccc

SEQ ID NO: 3243501 - DNA, 21 bp, Homo sapiens
tctgcctggtggtcagatgca

SEQ ID NO: 3243502 - DNA, 13 bp, Homo sapiens
tctgcctgtattt

SEQ ID NO: 3243503 - DNA, 15 bp, Homo sapiens
tctgcctgttataac

SEQ ID NO: 3243504 - DNA, 21 bp, Homo sapiens
tctgcctgttataactctgca

SEQ ID NO: 3243505 - DNA, 16 bp, Homo sapiens
tctgccttaaaaccaa

SEQ ID NO: 3243506 - DNA, 13 bp, Homo sapiens
tctgccttagagg

SEQ ID NO: 3243507 - DNA, 12 bp, Homo sapiens
tctgccttggcc

SEQ ID NO: 3243508 - DNA, 10 bp, Homo sapiens
tctgcctttg

SEQ ID NO: 3243509 - DNA, 20 bp, Homo sapiens
tctgcctttgacatttaatt

SEQ ID NO: 3243510 - DNA, 22 bp, Homo sapiens
tctgcctttggggacttttctt

SEQ ID NO: 3243511 - DNA, 15 bp, Homo sapiens
tctgcgcaccaagga

SEQ ID NO: 3243512 - DNA, 15 bp, Homo sapiens
tctgcgccacttcct

SEQ ID NO: 3243513 - DNA, 16 bp, Homo sapiens
tctgcggaccccagct

SEQ ID NO: 3243514 - DNA, 17 bp, Homo sapiens
tctgcggaccccagctg

SEQ ID NO: 3243515 - DNA, 14 bp, Homo sapiens
tctgctaatgtaaa

SEQ ID NO: 3243516 - DNA, 21 bp, Homo sapiens
tctgctagatttctacattaa

SEQ ID NO: 3243517 - DNA, 14 bp, Homo sapiens
tctgctaggcgctg

SEQ ID NO: 3243518 - DNA, 19 bp, Homo sapiens
tctgctcacatatctgtca

SEQ ID NO: 3243519 - DNA, 20 bp, Homo sapiens
tctgctcaccgcccatcagg

SEQ ID NO: 3243520 - DNA, 21 bp, Homo sapiens
tctgctcaccgcccatcaggg

SEQ ID NO: 3243521 - DNA, 13 bp, Homo sapiens
tctgctcacttta

SEQ ID NO: 3243522 - DNA, 22 bp, Homo sapiens
tctgctcagacagaacccctac

SEQ ID NO: 3243523 - DNA, 12 bp, Homo sapiens
tctgctcagcca

SEQ ID NO: 3243524 - DNA, 22 bp, Homo sapiens
tctgctcagtaatttgaggaca

SEQ ID NO: 3243525 - DNA, 20 bp, Homo sapiens
tctgctccaccacatcctcc

SEQ ID NO: 3243526 - DNA, 17 bp, Homo sapiens
tctgctccacccttggc

SEQ ID NO: 3243527 - DNA, 19 bp, Homo sapiens
tctgctccacccttggcct

SEQ ID NO: 3243528 - DNA, 20 bp, Homo sapiens
tctgctccacccttggcctg

SEQ ID NO: 3243529 - DNA, 15 bp, Homo sapiens
tctgctcctctccag

SEQ ID NO: 3243530 - DNA, 17 bp, Homo sapiens
tctgctcctctccaggc

SEQ ID NO: 3243531 - DNA, 20 bp, Homo sapiens
tctgctcctctccaggcacc

SEQ ID NO: 3243532 - DNA, 21 bp, Homo sapiens
tctgctcctctccccagcaag

SEQ ID NO: 3243533 - DNA, 19 bp, Homo sapiens
tctgctccttcactgttcc

SEQ ID NO: 3243534 - DNA, 21 bp, Homo sapiens
tctgctcgccctcctttctgt

SEQ ID NO: 3243535 - DNA, 13 bp, Homo sapiens
tctgctctggaat

SEQ ID NO: 3243536 - DNA, 18 bp, Homo sapiens
tctgctctggttgtttct

SEQ ID NO: 3243537 - DNA, 17 bp, Homo sapiens
tctgctctttctctgcc

SEQ ID NO: 3243538 - DNA, 20 bp, Homo sapiens
tctgctctttctctgccagt

SEQ ID NO: 3243539 - DNA, 21 bp, Homo sapiens
tctgctgacagacacaggccc

SEQ ID NO: 3243540 - DNA, 15 bp, Homo sapiens
tctgctgatataata

SEQ ID NO: 3243541 - DNA, 22 bp, Homo sapiens
tctgctgcctgcccgcacagca

SEQ ID NO: 3243542 - DNA, 13 bp, Homo sapiens
tctgctggagttt

SEQ ID NO: 3243543 - DNA, 22 bp, Homo sapiens
tctgctggataaaatgaggttc

SEQ ID NO: 3243544 - DNA, 23 bp, Homo sapiens
tctgctggcatcaagaggtggga

SEQ ID NO: 3243545 - DNA, 16 bp, Homo sapiens
tctgctggcctggatc

SEQ ID NO: 3243546 - DNA, 17 bp, Homo sapiens
tctgctgtccccttggc

SEQ ID NO: 3243547 - DNA, 22 bp, Homo sapiens
tctgctgtccccttggcaggtc

SEQ ID NO: 3243548 - DNA, 13 bp, Homo sapiens
tctgctgttgcca

SEQ ID NO: 3243549 - DNA, 18 bp, Homo sapiens
tctgctgttgccatagcc

SEQ ID NO: 3243550 - DNA, 17 bp, Homo sapiens
tctgcttaggagagacc

SEQ ID NO: 3243551 - DNA, 12 bp, Homo sapiens
tctgcttcaata

SEQ ID NO: 3243552 - DNA, 19 bp, Homo sapiens
tctgcttcaataaatcttt

SEQ ID NO: 3243553 - DNA, 14 bp, Homo sapiens
tctgcttcagcctc

SEQ ID NO: 3243554 - DNA, 15 bp, Homo sapiens
tctgcttcagcctcc

SEQ ID NO: 3243555 - DNA, 16 bp, Homo sapiens
tctgcttctctgactt

SEQ ID NO: 3243556 - DNA, 19 bp, Homo sapiens
tctgcttctctgacttctg

SEQ ID NO: 3243557 - DNA, 18 bp, Homo sapiens
tctgctttaaagggcctg

SEQ ID NO: 3243558 - DNA, 17 bp, Homo sapiens
tctgctttatcttttca

SEQ ID NO: 3243559 - DNA, 20 bp, Homo sapiens
tctgctttatcttttcataa

SEQ ID NO: 3243560 - DNA, 13 bp, Homo sapiens
tctgcttttatta

SEQ ID NO: 3243561 - DNA, 19 bp, Homo sapiens
tctgcttttctgccctggc

SEQ ID NO: 3243562 - DNA, 22 bp, Homo sapiens
tctgcttttctgccctggctgc

SEQ ID NO: 3243563 - DNA, 14 bp, Homo sapiens
tctggaagaaaaaa

SEQ ID NO: 3243564 - DNA, 18 bp, Homo sapiens
tctggaagcccctgggcc

SEQ ID NO: 3243565 - DNA, 18 bp, Homo sapiens
tctggaaggctggctgag

SEQ ID NO: 3243566 - DNA, 18 bp, Homo sapiens
tctggaagtttctggtgc

SEQ ID NO: 3243567 - DNA, 18 bp, Homo sapiens
tctggaataaagttgcag

SEQ ID NO: 3243568 - DNA, 14 bp, Homo sapiens
tctggaatacatga

SEQ ID NO: 3243569 - DNA, 22 bp, Homo sapiens
tctggaatacatgaaatataga

SEQ ID NO: 3243570 - DNA, 13 bp, Homo sapiens
tctggaatattgt

SEQ ID NO: 3243571 - DNA, 19 bp, Homo sapiens
tctggaatctggagaccag

SEQ ID NO: 3243572 - DNA, 15 bp, Homo sapiens
tctggaatgtaatca

SEQ ID NO: 3243573 - DNA, 15 bp, Homo sapiens
tctggacggcaggct

SEQ ID NO: 3243574 - DNA, 21 bp, Homo sapiens
tctggacggcaggctcactgc

SEQ ID NO: 3243575 - DNA, 23 bp, Homo sapiens
tctggacggcaggctcactgcca

SEQ ID NO: 3243576 - DNA, 22 bp, Homo sapiens
tctggactcctctgtccaggca

SEQ ID NO: 3243577 - DNA, 21 bp, Homo sapiens
tctggactgaagcctgcagga

SEQ ID NO: 3243578 - DNA, 12 bp, Homo sapiens
tctggagacagc

SEQ ID NO: 3243579 - DNA, 20 bp, Homo sapiens
tctggagacagccccagagc

SEQ ID NO: 3243580 - DNA, 20 bp, Homo sapiens
tctggagaccagggagcctt

SEQ ID NO: 3243581 - DNA, 15 bp, Homo sapiens
tctggagagaaacaa

SEQ ID NO: 3243582 - DNA, 20 bp, Homo sapiens
tctggagaggttataggtca

SEQ ID NO: 3243583 - DNA, 22 bp, Homo sapiens
tctggagaggttataggtcact

SEQ ID NO: 3243584 - DNA, 23 bp, Homo sapiens
tctggagccctaaccccttccag

SEQ ID NO: 3243585 - DNA, 14 bp, Homo sapiens
tctggagcggctgc

SEQ ID NO: 3243586 - DNA, 14 bp, Homo sapiens
tctggaggaaaggg

SEQ ID NO: 3243587 - DNA, 20 bp, Homo sapiens
tctggaggcctctggccctc

SEQ ID NO: 3243588 - DNA, 14 bp, Homo sapiens
tctggaggggaggg

SEQ ID NO: 3243589 - DNA, 21 bp, Homo sapiens
tctggagtctcacttgtctca

SEQ ID NO: 3243590 - DNA, 19 bp, Homo sapiens
tctggatatttgcacttat

SEQ ID NO: 3243591 - DNA, 22 bp, Homo sapiens
tctggattctgggaggcaagaa

SEQ ID NO: 3243592 - DNA, 21 bp, Homo sapiens
tctggcaaagcttttagaaat

SEQ ID NO: 3243593 - DNA, 11 bp, Homo sapiens
tctggccaggc

SEQ ID NO: 3243594 - DNA, 14 bp, Homo sapiens
tctggccaggcact

SEQ ID NO: 3243595 - DNA, 17 bp, Homo sapiens
tctggccaggcactgcc

SEQ ID NO: 3243596 - DNA, 14 bp, Homo sapiens
tctggcccaccagg

SEQ ID NO: 3243597 - DNA, 14 bp, Homo sapiens
tctggccctggccc

SEQ ID NO: 3243598 - DNA, 11 bp, Homo sapiens
tctggccctgt

SEQ ID NO: 3243599 - DNA, 13 bp, Homo sapiens
tctggccctgtgt

SEQ ID NO: 3243600 - DNA, 15 bp, Homo sapiens
tctggccgccacccc

SEQ ID NO: 3243601 - DNA, 17 bp, Homo sapiens
tctggcctaaaatcttg

SEQ ID NO: 3243602 - DNA, 14 bp, Homo sapiens
tctggcctcccacc

SEQ ID NO: 3243603 - DNA, 14 bp, Homo sapiens
tctggcctggcctg

SEQ ID NO: 3243604 - DNA, 16 bp, Homo sapiens
tctggcctggcctggc

SEQ ID NO: 3243605 - DNA, 17 bp, Homo sapiens
tctggcctggcctggcc

SEQ ID NO: 3243606 - DNA, 22 bp, Homo sapiens
tctggcctggcctggccctgcc

SEQ ID NO: 3243607 - DNA, 19 bp, Homo sapiens
tctggcctgggttttgtgg

SEQ ID NO: 3243608 - DNA, 23 bp, Homo sapiens
tctggccttcggcctccatcctg

SEQ ID NO: 3243609 - DNA, 21 bp, Homo sapiens
tctggcctttcctctctcctg

SEQ ID NO: 3243610 - DNA, 15 bp, Homo sapiens
tctggcggcttcctg

SEQ ID NO: 3243611 - DNA, 19 bp, Homo sapiens
tctggcggcttcctgtcca

SEQ ID NO: 3243612 - DNA, 17 bp, Homo sapiens
tctggctcctttacaaa

SEQ ID NO: 3243613 - DNA, 14 bp, Homo sapiens
tctggctgaaaaag

SEQ ID NO: 3243614 - DNA, 14 bp, Homo sapiens
tctggctgaaccct

SEQ ID NO: 3243615 - DNA, 21 bp, Homo sapiens
tctggctgaaccctgtgctgg

SEQ ID NO: 3243616 - DNA, 21 bp, Homo sapiens
tctggctgtaaggctctagat

SEQ ID NO: 3243617 - DNA, 22 bp, Homo sapiens
tctggctgtaaggctctagatc

SEQ ID NO: 3243618 - DNA, 14 bp, Homo sapiens
tctggctgtttagc

SEQ ID NO: 3243619 - DNA, 20 bp, Homo sapiens
tctggcttattttaatgtga

SEQ ID NO: 3243620 - DNA, 23 bp, Homo sapiens
tctggcttccagaaaaccccagc

SEQ ID NO: 3243621 - DNA, 14 bp, Homo sapiens
tctggctttaagcc

SEQ ID NO: 3243622 - DNA, 17 bp, Homo sapiens
tctggctttaagccttc

SEQ ID NO: 3243623 - DNA, 21 bp, Homo sapiens
tctggctttacctttttgtat

SEQ ID NO: 3243624 - DNA, 22 bp, Homo sapiens
tctggctttttcctctgagccc

SEQ ID NO: 3243625 - DNA, 18 bp, Homo sapiens
tctgggaaataagagaga

SEQ ID NO: 3243626 - DNA, 16 bp, Homo sapiens
tctgggaacctcccag

SEQ ID NO: 3243627 - DNA, 18 bp, Homo sapiens
tctgggaacctcccagag

SEQ ID NO: 3243628 - DNA, 19 bp, Homo sapiens
tctgggaacctcccagagg

SEQ ID NO: 3243629 - DNA, 22 bp, Homo sapiens
tctgggaacctcccagaggtcc

SEQ ID NO: 3243630 - DNA, 22 bp, Homo sapiens
tctgggaatcatgtccatccct

SEQ ID NO: 3243631 - DNA, 17 bp, Homo sapiens
tctgggaattgtgtgtc

SEQ ID NO: 3243632 - DNA, 20 bp, Homo sapiens
tctgggacctgccaggcagg

SEQ ID NO: 3243633 - DNA, 22 bp, Homo sapiens
tctgggacctgccaggcagggg

SEQ ID NO: 3243634 - DNA, 14 bp, Homo sapiens
tctgggagcagaaa

SEQ ID NO: 3243635 - DNA, 21 bp, Homo sapiens
tctgggagcagaaacagccat

SEQ ID NO: 3243636 - DNA, 20 bp, Homo sapiens
tctgggaggcagaacaggct

SEQ ID NO: 3243637 - DNA, 16 bp, Homo sapiens
tctgggagtcacacag

SEQ ID NO: 3243638 - DNA, 17 bp, Homo sapiens
tctgggagtcacacagt

SEQ ID NO: 3243639 - DNA, 21 bp, Homo sapiens
tctgggatatggctgcccagg

SEQ ID NO: 3243640 - DNA, 20 bp, Homo sapiens
tctgggcacactctgccagc

SEQ ID NO: 3243641 - DNA, 21 bp, Homo sapiens
tctgggcaccacaaaatatac

SEQ ID NO: 3243642 - DNA, 18 bp, Homo sapiens
tctgggcatctgttctgg

SEQ ID NO: 3243643 - DNA, 19 bp, Homo sapiens
tctgggcatctgttctggt

SEQ ID NO: 3243644 - DNA, 14 bp, Homo sapiens
tctgggcctctgac

SEQ ID NO: 3243645 - DNA, 15 bp, Homo sapiens
tctgggcctctgact

SEQ ID NO: 3243646 - DNA, 17 bp, Homo sapiens
tctgggcctgggctagg

SEQ ID NO: 3243647 - DNA, 13 bp, Homo sapiens
tctgggcctgggg

SEQ ID NO: 3243648 - DNA, 15 bp, Homo sapiens
tctgggctcagggct

SEQ ID NO: 3243649 - DNA, 16 bp, Homo sapiens
tctgggctcagggctg

SEQ ID NO: 3243650 - DNA, 19 bp, Homo sapiens
tctgggcttggggcttcct

SEQ ID NO: 3243651 - DNA, 21 bp, Homo sapiens
tctgggcttggggcttcctaa

SEQ ID NO: 3243652 - DNA, 21 bp, Homo sapiens
tctggggaccccaacctcaga

SEQ ID NO: 3243653 - DNA, 22 bp, Homo sapiens
tctggggaccccaacctcagag

SEQ ID NO: 3243654 - DNA, 13 bp, Homo sapiens
tctggggagctcc

SEQ ID NO: 3243655 - DNA, 15 bp, Homo sapiens
tctggggcagatccc

SEQ ID NO: 3243656 - DNA, 15 bp, Homo sapiens
tctggggcccaggaa

SEQ ID NO: 3243657 - DNA, 22 bp, Homo sapiens
tctggggcccaggaagcccaca

SEQ ID NO: 3243658 - DNA, 16 bp, Homo sapiens
tctgggggacagagaa

SEQ ID NO: 3243659 - DNA, 13 bp, Homo sapiens
tctggggggcagt

SEQ ID NO: 3243660 - DNA, 13 bp, Homo sapiens
tctgggtggcctc

SEQ ID NO: 3243661 - DNA, 19 bp, Homo sapiens
tctgggtgtgactgattcc

SEQ ID NO: 3243662 - DNA, 14 bp, Homo sapiens
tctgggtttttctt

SEQ ID NO: 3243663 - DNA, 19 bp, Homo sapiens
tctggtaaagttacacttt

SEQ ID NO: 3243664 - DNA, 16 bp, Homo sapiens
tctggtagatagaaat

SEQ ID NO: 3243665 - DNA, 20 bp, Homo sapiens
tctggtagatttttaacgaa

SEQ ID NO: 3243666 - DNA, 23 bp, Homo sapiens
tctggtcaaagaaagaaagttta

SEQ ID NO: 3243667 - DNA, 14 bp, Homo sapiens
tctggtcccttgca

SEQ ID NO: 3243668 - DNA, 15 bp, Homo sapiens
tctggtcgctcctgc

SEQ ID NO: 3243669 - DNA, 17 bp, Homo sapiens
tctggtgagtcaccact

SEQ ID NO: 3243670 - DNA, 14 bp, Homo sapiens
tctggtgcctcctc

SEQ ID NO: 3243671 - DNA, 16 bp, Homo sapiens
tctggtgcctcctcaa

SEQ ID NO: 3243672 - DNA, 16 bp, Homo sapiens
tctggtgctactccat

SEQ ID NO: 3243673 - DNA, 19 bp, Homo sapiens
tctggtgctactccatgca

SEQ ID NO: 3243674 - DNA, 23 bp, Homo sapiens
tctggtggggtgtgttccaactg

SEQ ID NO: 3243675 - DNA, 12 bp, Homo sapiens
tctggttccagg

SEQ ID NO: 3243676 - DNA, 15 bp, Homo sapiens
tctggttgtatttct

SEQ ID NO: 3243677 - DNA, 18 bp, Homo sapiens
tctggttgtttctgttcc

SEQ ID NO: 3243678 - DNA, 22 bp, Homo sapiens
tctggttgtttctgttccaaat

SEQ ID NO: 3243679 - DNA, 14 bp, Homo sapiens
tctggtttctcatt

SEQ ID NO: 3243680 - DNA, 15 bp, Homo sapiens
tctggttttaacaat

SEQ ID NO: 3243681 - DNA, 14 bp, Homo sapiens
tctggttttgctat

SEQ ID NO: 3243682 - DNA, 15 bp, Homo sapiens
tctggttttgctatt

SEQ ID NO: 3243683 - DNA, 19 bp, Homo sapiens
tctgtaaaaacactgaaaa

SEQ ID NO: 3243684 - DNA, 22 bp, Homo sapiens
tctgtaaactgtgtattccaag

SEQ ID NO: 3243685 - DNA, 18 bp, Homo sapiens
tctgtacatagcctatat

SEQ ID NO: 3243686 - DNA, 18 bp, Homo sapiens
tctgtacatattactgtt

SEQ ID NO: 3243687 - DNA, 22 bp, Homo sapiens
tctgtacattttgttgtaaaaa

SEQ ID NO: 3243688 - DNA, 17 bp, Homo sapiens
tctgtacctcaaatgaa

SEQ ID NO: 3243689 - DNA, 17 bp, Homo sapiens
tctgtacgtctgacagg

SEQ ID NO: 3243690 - DNA, 16 bp, Homo sapiens
tctgtagattctgtgg

SEQ ID NO: 3243691 - DNA, 20 bp, Homo sapiens
tctgtaggagcaacttctct

SEQ ID NO: 3243692 - DNA, 15 bp, Homo sapiens
tctgtagggctggac

SEQ ID NO: 3243693 - DNA, 16 bp, Homo sapiens
tctgtagggctggacc

SEQ ID NO: 3243694 - DNA, 17 bp, Homo sapiens
tctgtagggctggacct

SEQ ID NO: 3243695 - DNA, 22 bp, Homo sapiens
tctgtagtaatttattgtctgt

SEQ ID NO: 3243696 - DNA, 19 bp, Homo sapiens
tctgtagttcctaatggat

SEQ ID NO: 3243697 - DNA, 21 bp, Homo sapiens
tctgtataaacattaaatgtc

SEQ ID NO: 3243698 - DNA, 23 bp, Homo sapiens
tctgtataaacattaaatgtctt

SEQ ID NO: 3243699 - DNA, 15 bp, Homo sapiens
tctgtatacaaccct

SEQ ID NO: 3243700 - DNA, 14 bp, Homo sapiens
tctgtatagaaatc

SEQ ID NO: 3243701 - DNA, 19 bp, Homo sapiens
tctgtatataagttgctgt

SEQ ID NO: 3243702 - DNA, 13 bp, Homo sapiens
tctgtattgccat

SEQ ID NO: 3243703 - DNA, 18 bp, Homo sapiens
tctgtatttaatggtttt

SEQ ID NO: 3243704 - DNA, 13 bp, Homo sapiens
tctgtatttcatg

SEQ ID NO: 3243705 - DNA, 14 bp, Homo sapiens
tctgtatttctagg

SEQ ID NO: 3243706 - DNA, 23 bp, Homo sapiens
tctgtattttatttagacaagag

SEQ ID NO: 3243707 - DNA, 15 bp, Homo sapiens
tctgtcaaaacactg

SEQ ID NO: 3243708 - DNA, 16 bp, Homo sapiens
tctgtcaaaacactgt

SEQ ID NO: 3243709 - DNA, 18 bp, Homo sapiens
tctgtcaaaacactgtgg

SEQ ID NO: 3243710 - DNA, 20 bp, Homo sapiens
tctgtcaaaacactgtggaa

SEQ ID NO: 3243711 - DNA, 18 bp, Homo sapiens
tctgtcacagtaaaaata

SEQ ID NO: 3243712 - DNA, 20 bp, Homo sapiens
tctgtcacagtaaaaataaa

SEQ ID NO: 3243713 - DNA, 19 bp, Homo sapiens
tctgtcaccaattggttaa

SEQ ID NO: 3243714 - DNA, 19 bp, Homo sapiens
tctgtcagatgagaacaaa

SEQ ID NO: 3243715 - DNA, 20 bp, Homo sapiens
tctgtcagatgagaacaaag

SEQ ID NO: 3243716 - DNA, 22 bp, Homo sapiens
tctgtcagccagccgccctggg

SEQ ID NO: 3243717 - DNA, 14 bp, Homo sapiens
tctgtcattatatt

SEQ ID NO: 3243718 - DNA, 13 bp, Homo sapiens
tctgtcatttgtt

SEQ ID NO: 3243719 - DNA, 16 bp, Homo sapiens
tctgtccaaaggaggc

SEQ ID NO: 3243720 - DNA, 24 bp, Homo sapiens
tctgtccaggcactgctgcccagc

SEQ ID NO: 3243721 - DNA, 14 bp, Homo sapiens
tctgtccaggccac

SEQ ID NO: 3243722 - DNA, 16 bp, Homo sapiens
tctgtccaggccactg

SEQ ID NO: 3243723 - DNA, 18 bp, Homo sapiens
tctgtccaggccactgtg

SEQ ID NO: 3243724 - DNA, 21 bp, Homo sapiens
tctgtccaggccactgtggcc

SEQ ID NO: 3243725 - DNA, 15 bp, Homo sapiens
tctgtccatggcctt

SEQ ID NO: 3243726 - DNA, 19 bp, Homo sapiens
tctgtcccggggtcctgtg

SEQ ID NO: 3243727 - DNA, 17 bp, Homo sapiens
tctgtcccttgctgtat

SEQ ID NO: 3243728 - DNA, 14 bp, Homo sapiens
tctgtcctactctg

SEQ ID NO: 3243729 - DNA, 16 bp, Homo sapiens
tctgtcctgagaagca

SEQ ID NO: 3243730 - DNA, 16 bp, Homo sapiens
tctgtcctgcttctga

SEQ ID NO: 3243731 - DNA, 14 bp, Homo sapiens
tctgtcgcccagtc

SEQ ID NO: 3243732 - DNA, 16 bp, Homo sapiens
tctgtctaaaaaccag

SEQ ID NO: 3243733 - DNA, 22 bp, Homo sapiens
tctgtctacaaatataagattt

SEQ ID NO: 3243734 - DNA, 16 bp, Homo sapiens
tctgtctactgtggtg

SEQ ID NO: 3243735 - DNA, 21 bp, Homo sapiens
tctgtctcaaaaaataaaaat

SEQ ID NO: 3243736 - DNA, 17 bp, Homo sapiens
tctgtctcatcctcctg

SEQ ID NO: 3243737 - DNA, 12 bp, Homo sapiens
tctgtctccaag

SEQ ID NO: 3243738 - DNA, 22 bp, Homo sapiens
tctgtctcccagttatgaatca

SEQ ID NO: 3243739 - DNA, 18 bp, Homo sapiens
tctgtctggagtgacaga

SEQ ID NO: 3243740 - DNA, 13 bp, Homo sapiens
tctgtctggtggc

SEQ ID NO: 3243741 - DNA, 17 bp, Homo sapiens
tctgtctggtggccccg

SEQ ID NO: 3243742 - DNA, 14 bp, Homo sapiens
tctgtcttaaatga

SEQ ID NO: 3243743 - DNA, 13 bp, Homo sapiens
tctgtgaaacctg

SEQ ID NO: 3243744 - DNA, 17 bp, Homo sapiens
tctgtgaaatgctggca

SEQ ID NO: 3243745 - DNA, 17 bp, Homo sapiens
tctgtgaacgatttaga

SEQ ID NO: 3243746 - DNA, 19 bp, Homo sapiens
tctttgtataaataaatat

SEQ ID NO: 3243747 - DNA, 20 bp, Homo sapiens
tctttgtcttatctggccct

SEQ ID NO: 3243748 - DNA, 16 bp, Homo sapiens
tctttgtgacaggaaa

SEQ ID NO: 3243749 - DNA, 23 bp, Homo sapiens
tctttgtgataatttaagagcta

SEQ ID NO: 3243750 - DNA, 16 bp, Homo sapiens
tctttgtggggaagag

SEQ ID NO: 3243751 - DNA, 13 bp, Homo sapiens
tctttgtggggct

SEQ ID NO: 3243752 - DNA, 22 bp, Homo sapiens
tctttgtggggcttggcgtgga

SEQ ID NO: 3243753 - DNA, 18 bp, Homo sapiens
tctttgtgtagctttgct

SEQ ID NO: 3243754 - DNA, 15 bp, Homo sapiens
tctttgttacaggca

SEQ ID NO: 3243755 - DNA, 15 bp, Homo sapiens
tctttgttataccat

SEQ ID NO: 3243756 - DNA, 21 bp, Homo sapiens
tctttgttatcaaacttcagc

SEQ ID NO: 3243757 - DNA, 17 bp, Homo sapiens
tctttgttctcagctcc

SEQ ID NO: 3243758 - DNA, 19 bp, Homo sapiens
tctttgttctcagctcccc

SEQ ID NO: 3243759 - DNA, 20 bp, Homo sapiens
tctttgtttctttttacagc

SEQ ID NO: 3243760 - DNA, 21 bp, Homo sapiens
tcttttaatgaggaccaatgt

SEQ ID NO: 3243761 - DNA, 13 bp, Homo sapiens
tcttttacagact

SEQ ID NO: 3243762 - DNA, 17 bp, Homo sapiens
tcttttagacaactaga

SEQ ID NO: 3243763 - DNA, 18 bp, Homo sapiens
tcttttagacaactagat

SEQ ID NO: 3243764 - DNA, 12 bp, Homo sapiens
tcttttataata

SEQ ID NO: 3243765 - DNA, 13 bp, Homo sapiens
tcttttatatttg

SEQ ID NO: 3243766 - DNA, 12 bp, Homo sapiens
tcttttcacatt

SEQ ID NO: 3243767 - DNA, 16 bp, Homo sapiens
tcttttcattctcatt

SEQ ID NO: 3243768 - DNA, 17 bp, Homo sapiens
tcttttccaagctcctt

SEQ ID NO: 3243769 - DNA, 14 bp, Homo sapiens
tcttttccccgcct

SEQ ID NO: 3243770 - DNA, 20 bp, Homo sapiens
tcttttccttcattcatagg

SEQ ID NO: 3243771 - DNA, 17 bp, Homo sapiens
tcttttctaccctagcc

SEQ ID NO: 3243772 - DNA, 19 bp, Homo sapiens
tcttttctaccctagccat

SEQ ID NO: 3243773 - DNA, 12 bp, Homo sapiens
tcttttctattt

SEQ ID NO: 3243774 - DNA, 23 bp, Homo sapiens
tcttttctgcatcatctgtagat

SEQ ID NO: 3243775 - DNA, 18 bp, Homo sapiens
tcttttctgtacttcctg

SEQ ID NO: 3243776 - DNA, 22 bp, Homo sapiens
tcttttcttggcaaaagccttg

SEQ ID NO: 3243777 - DNA, 12 bp, Homo sapiens
tcttttctttac

SEQ ID NO: 3243778 - DNA, 14 bp, Homo sapiens
tcttttgacatgtg

SEQ ID NO: 3243779 - DNA, 15 bp, Homo sapiens
tcttttgacatgtgg

SEQ ID NO: 3243780 - DNA, 15 bp, Homo sapiens
tcttttgagtggtaa

SEQ ID NO: 3243781 - DNA, 20 bp, Homo sapiens
tcttttgcatgtcgcacaat

SEQ ID NO: 3243782 - DNA, 20 bp, Homo sapiens
tcttttgcttgccaaagtac

SEQ ID NO: 3243783 - DNA, 18 bp, Homo sapiens
tcttttggttattctaag

SEQ ID NO: 3243784 - DNA, 12 bp, Homo sapiens
tcttttgtaatt

SEQ ID NO: 3243785 - DNA, 21 bp, Homo sapiens
tcttttgtaattgtgtaaaaa

SEQ ID NO: 3243786 - DNA, 11 bp, Homo sapiens
tcttttgttac

SEQ ID NO: 3243787 - DNA, 14 bp, Homo sapiens
tcttttgttactgt

SEQ ID NO: 3243788 - DNA, 18 bp, Homo sapiens
tcttttgttactgttctt

SEQ ID NO: 3243789 - DNA, 21 bp, Homo sapiens
tcttttgttactgttcttgct

SEQ ID NO: 3243790 - DNA, 21 bp, Homo sapiens
tctttttaattattttaaaat

SEQ ID NO: 3243791 - DNA, 15 bp, Homo sapiens
tctttttacagcatt

SEQ ID NO: 3243792 - DNA, 19 bp, Homo sapiens
tctttttacctttcataca

SEQ ID NO: 3243793 - DNA, 15 bp, Homo sapiens
tctttttatcatgat

SEQ ID NO: 3243794 - DNA, 20 bp, Homo sapiens
tctttttcgtataatcttgt

SEQ ID NO: 3243795 - DNA, 11 bp, Homo sapiens
tctttttctga

SEQ ID NO: 3243796 - DNA, 14 bp, Homo sapiens
tctttttctgttgt

SEQ ID NO: 3243797 - DNA, 17 bp, Homo sapiens
tctttttctgttgtaac

SEQ ID NO: 3243798 - DNA, 17 bp, Homo sapiens
tctttttcttcttccct

SEQ ID NO: 3243799 - DNA, 22 bp, Homo sapiens
tctttttggactcagcccacct

SEQ ID NO: 3243800 - DNA, 14 bp, Homo sapiens
tctttttgtacact

SEQ ID NO: 3243801 - DNA, 16 bp, Homo sapiens
tctttttgtacactta

SEQ ID NO: 3243802 - DNA, 21 bp, Homo sapiens
tcttttttaaccggtaagagt

SEQ ID NO: 3243803 - DNA, 23 bp, Homo sapiens
tcttttttaaccggtaagagttt

SEQ ID NO: 3243804 - DNA, 15 bp, Homo sapiens
tcttttttactcatt

SEQ ID NO: 3243805 - DNA, 19 bp, Homo sapiens
tcttttttactcattgaaa

SEQ ID NO: 3243806 - DNA, 20 bp, Homo sapiens
tcttttttactcattgaaat

SEQ ID NO: 3243807 - DNA, 21 bp, Homo sapiens
tcttttttcatttcttcctca

SEQ ID NO: 3243808 - DNA, 23 bp, Homo sapiens
tcttttttcatttcttcctcagc

SEQ ID NO: 3243809 - DNA, 14 bp, Homo sapiens
tctttttttaaaag

SEQ ID NO: 3243810 - DNA, 15 bp, Homo sapiens
tctttttttcttggc

SEQ ID NO: 3243811 - DNA, 22 bp, Homo sapiens
tctttttttggtgattcaaatg

SEQ ID NO: 3243812 - DNA, 16 bp, Homo sapiens
tctttttttgtgatgt

SEQ ID NO: 3243813 - DNA, 22 bp, Homo sapiens
tctttttttttttttttgaaag

SEQ ID NO: 3243814 - DNA, 20 bp, Homo sapiens
tgaaaaaaaaaaagaagaag

SEQ ID NO: 3243815 - DNA, 18 bp, Homo sapiens
tgaaaaaaaaaatgttga

SEQ ID NO: 3243816 - DNA, 16 bp, Homo sapiens
tgaaaaaaagtttaca

SEQ ID NO: 3243817 - DNA, 17 bp, Homo sapiens
tgaaaaaaagtttacaa

SEQ ID NO: 3243818 - DNA, 16 bp, Homo sapiens
tgaaaaaaattattca

SEQ ID NO: 3243819 - DNA, 21 bp, Homo sapiens
tgaaaaaaccgttcaaattct

SEQ ID NO: 3243820 - DNA, 14 bp, Homo sapiens
tgaaaaaagaaaat

SEQ ID NO: 3243821 - DNA, 18 bp, Homo sapiens
tgaaaaacattccaggaa

SEQ ID NO: 3243822 - DNA, 16 bp, Homo sapiens
tgaaaaactgctgtaa

SEQ ID NO: 3243823 - DNA, 22 bp, Homo sapiens
tgaaaaagacctttggagcaaa

SEQ ID NO: 3243824 - DNA, 15 bp, Homo sapiens
tgaaaaagatgccaa

SEQ ID NO: 3243825 - DNA, 15 bp, Homo sapiens
tgaaaaaggtgatta

SEQ ID NO: 3243826 - DNA, 16 bp, Homo sapiens
tgaaaaagtaaagtgt

SEQ ID NO: 3243827 - DNA, 20 bp, Homo sapiens
tgaaaaagttccatagaaaa

SEQ ID NO: 3243828 - DNA, 20 bp, Homo sapiens
tgaaaaatataaaattatga

SEQ ID NO: 3243829 - DNA, 22 bp, Homo sapiens
tgaaaaatataaaattatgaga

SEQ ID NO: 3243830 - DNA, 16 bp, Homo sapiens
tgaaaaatatgttgag

SEQ ID NO: 3243831 - DNA, 19 bp, Homo sapiens
tgaaaaattcctttgtgtt

SEQ ID NO: 3243832 - DNA, 20 bp, Homo sapiens
tgaaaaatttaagcattgtt

SEQ ID NO: 3243833 - DNA, 18 bp, Homo sapiens
tgaaaacaagttccaaat

SEQ ID NO: 3243834 - DNA, 16 bp, Homo sapiens
tgaaaacacactcaaa

SEQ ID NO: 3243835 - DNA, 22 bp, Homo sapiens
tgaaaacacactcaaaagacaa

SEQ ID NO: 3243836 - DNA, 23 bp, Homo sapiens
tgaaaacatggtagaattggaga

SEQ ID NO: 3243837 - DNA, 16 bp, Homo sapiens
tgaaaacttcaaagct

SEQ ID NO: 3243838 - DNA, 20 bp, Homo sapiens
tgaaaacttcaaagctgaat

SEQ ID NO: 3243839 - DNA, 22 bp, Homo sapiens
tgaaaacttcaaagctgaatat

SEQ ID NO: 3243840 - DNA, 23 bp, Homo sapiens
tgaaaacttcaaagctgaatatt

SEQ ID NO: 3243841 - DNA, 18 bp, Homo sapiens
tgaaaagagtatgtagtg

SEQ ID NO: 3243842 - DNA, 19 bp, Homo sapiens
tgaaaagcaatattgtata

SEQ ID NO: 3243843 - DNA, 20 bp, Homo sapiens
tgaaaagctattagccagga

SEQ ID NO: 3243844 - DNA, 23 bp, Homo sapiens
tgaaaagctattagccaggatca

SEQ ID NO: 3243845 - DNA, 15 bp, Homo sapiens
tgaaaagcttcttaa

SEQ ID NO: 3243846 - DNA, 17 bp, Homo sapiens
tgaaaagcttcttaatt

SEQ ID NO: 3243847 - DNA, 19 bp, Homo sapiens
tgaaaagcttcttaattaa

SEQ ID NO: 3243848 - DNA, 23 bp, Homo sapiens
tgaaaagcttcttaattaatttg

SEQ ID NO: 3243849 - DNA, 19 bp, Homo sapiens
tgaaaagggggtgggatgg

SEQ ID NO: 3243850 - DNA, 18 bp, Homo sapiens
tgaaaagtgtgtatatat

SEQ ID NO: 3243851 - DNA, 20 bp, Homo sapiens
tgaaaagttactacctgtca

SEQ ID NO: 3243852 - DNA, 15 bp, Homo sapiens
tgaaaataactgaac

SEQ ID NO: 3243853 - DNA, 16 bp, Homo sapiens
tgaaaataactgaatt

SEQ ID NO: 3243854 - DNA, 13 bp, Homo sapiens
tgaaaataccatt

SEQ ID NO: 3243855 - DNA, 19 bp, Homo sapiens
tgaaaatatacttgactct

SEQ ID NO: 3243856 - DNA, 16 bp, Homo sapiens
tgaaaatcgtgacaac

SEQ ID NO: 3243857 - DNA, 14 bp, Homo sapiens
tgaaaatgaagaag

SEQ ID NO: 3243858 - DNA, 20 bp, Homo sapiens
tgaaaatgaagaaggaagct

SEQ ID NO: 3243859 - DNA, 19 bp, Homo sapiens
tgaaaatgaatatctatta

SEQ ID NO: 3243860 - DNA, 21 bp, Homo sapiens
tgaaaatgaatatctattaat

SEQ ID NO: 3243861 - DNA, 23 bp, Homo sapiens
tgaaaatgaatatctattaatat

SEQ ID NO: 3243862 - DNA, 18 bp, Homo sapiens
tgaaaatgagttgtgaaa

SEQ ID NO: 3243863 - DNA, 18 bp, Homo sapiens
tgaaaatggtttcaagtt

SEQ ID NO: 3243864 - DNA, 20 bp, Homo sapiens
tgaaaatggtttcaagttat

SEQ ID NO: 3243865 - DNA, 12 bp, Homo sapiens
tgaaaatgtaaa

SEQ ID NO: 3243866 - DNA, 18 bp, Homo sapiens
tgaaaatgtaagctgttt

SEQ ID NO: 3243867 - DNA, 13 bp, Homo sapiens
tgaaaatgtactg

SEQ ID NO: 3243868 - DNA, 14 bp, Homo sapiens
tgaaaatgtcaaag

SEQ ID NO: 3243869 - DNA, 15 bp, Homo sapiens
tgaaaatgtcagaaa

SEQ ID NO: 3243870 - DNA, 18 bp, Homo sapiens
tgaaaatgtcagaaacca

SEQ ID NO: 3243871 - DNA, 22 bp, Homo sapiens
tgaatggttccatgcctgaggg

SEQ ID NO: 3243872 - DNA, 15 bp, Homo sapiens
tgaatgtaatttgtg

SEQ ID NO: 3243873 - DNA, 20 bp, Homo sapiens
tgaatgtaatttgtgtaata

SEQ ID NO: 3243874 - DNA, 15 bp, Homo sapiens
tgaatgtatattttg

SEQ ID NO: 3243875 - DNA, 20 bp, Homo sapiens
tgaatgtatgtaatgtgtgg

SEQ ID NO: 3243876 - DNA, 18 bp, Homo sapiens
tgaatgtatgtgcactgt

SEQ ID NO: 3243877 - DNA, 23 bp, Homo sapiens
tgaatgtatgtgcactgtcactt

SEQ ID NO: 3243878 - DNA, 11 bp, Homo sapiens
tgaatgtattt

SEQ ID NO: 3243879 - DNA, 23 bp, Homo sapiens
tgaatgtatttatttgggagacc

SEQ ID NO: 3243880 - DNA, 11 bp, Homo sapiens
tgaatgtcaca

SEQ ID NO: 3243881 - DNA, 14 bp, Homo sapiens
tgaatgtcacaaat

SEQ ID NO: 3243882 - DNA, 18 bp, Homo sapiens
tgaatgtctaaaattgtt

SEQ ID NO: 3243883 - DNA, 15 bp, Homo sapiens
tgaatgtcttttgaa

SEQ ID NO: 3243884 - DNA, 20 bp, Homo sapiens
tgaatgtgctgatcatttga

SEQ ID NO: 3243885 - DNA, 15 bp, Homo sapiens
tgaatgtgggcactg

SEQ ID NO: 3243886 - DNA, 14 bp, Homo sapiens
tgaatgtgtcacta

SEQ ID NO: 3243887 - DNA, 17 bp, Homo sapiens
tgaatgttaagaattga

SEQ ID NO: 3243888 - DNA, 17 bp, Homo sapiens
tgaatgttacaacgaat

SEQ ID NO: 3243889 - DNA, 15 bp, Homo sapiens
tgaatgttatttgtt

SEQ ID NO: 3243890 - DNA, 23 bp, Homo sapiens
tgaatgttatttgttattttcag

SEQ ID NO: 3243891 - DNA, 15 bp, Homo sapiens
tgaatgttctgacat

SEQ ID NO: 3243892 - DNA, 16 bp, Homo sapiens
tgaatgttctgacatt

SEQ ID NO: 3243893 - DNA, 18 bp, Homo sapiens
tgaatgttctgacattaa

SEQ ID NO: 3243894 - DNA, 20 bp, Homo sapiens
tgaatgttctgacattaaca

SEQ ID NO: 3243895 - DNA, 22 bp, Homo sapiens
tgaatgtttccaacctggagta

SEQ ID NO: 3243896 - DNA, 13 bp, Homo sapiens
tgaattaaacatg

SEQ ID NO: 3243897 - DNA, 11 bp, Homo sapiens
tgaattaaatt

SEQ ID NO: 3243898 - DNA, 19 bp, Homo sapiens
tgaattaattaatttggag

SEQ ID NO: 3243899 - DNA, 17 bp, Homo sapiens
tgaattacctggatgtt

SEQ ID NO: 3243900 - DNA, 16 bp, Homo sapiens
tgaattataacagtta

SEQ ID NO: 3243901 - DNA, 17 bp, Homo sapiens
tgaattatcagcaaaga

SEQ ID NO: 3243902 - DNA, 15 bp, Homo sapiens
tgaattatctataca

SEQ ID NO: 3243903 - DNA, 21 bp, Homo sapiens
tgaattatcttggttgaaaat

SEQ ID NO: 3243904 - DNA, 14 bp, Homo sapiens
tgaattatgtgcac

SEQ ID NO: 3243905 - DNA, 14 bp, Homo sapiens
tgaattcaaagctt

SEQ ID NO: 3243906 - DNA, 17 bp, Homo sapiens
tgaattcagattttaaa

SEQ ID NO: 3243907 - DNA, 21 bp, Homo sapiens
tgaattcctgtcttccaaatt

SEQ ID NO: 3243908 - DNA, 23 bp, Homo sapiens
tgaattcggaactgtcctttcct

SEQ ID NO: 3243909 - DNA, 20 bp, Homo sapiens
tgaattgaggggattaatat

SEQ ID NO: 3243910 - DNA, 12 bp, Homo sapiens
tgaatttaaata

SEQ ID NO: 3243911 - DNA, 15 bp, Homo sapiens
tgaatttaaatataa

SEQ ID NO: 3243912 - DNA, 20 bp, Homo sapiens
tgaatttaaatataattctg

SEQ ID NO: 3243913 - DNA, 19 bp, Homo sapiens
tgaatttagtgagatttac

SEQ ID NO: 3243914 - DNA, 19 bp, Homo sapiens
tgaatttccccatctgcca

SEQ ID NO: 3243915 - DNA, 11 bp, Homo sapiens
tgaatttctgc

SEQ ID NO: 3243916 - DNA, 15 bp, Homo sapiens
tgaatttgaatgaaa

SEQ ID NO: 3243917 - DNA, 18 bp, Homo sapiens
tgaatttgaatgaaaaat

SEQ ID NO: 3243918 - DNA, 14 bp, Homo sapiens
tgaatttggagact

SEQ ID NO: 3243919 - DNA, 18 bp, Homo sapiens
tgaatttgtcgcaaagac

SEQ ID NO: 3243920 - DNA, 23 bp, Homo sapiens
tgaattttaaatctaaatctatt

SEQ ID NO: 3243921 - DNA, 21 bp, Homo sapiens
tgaattttaaattaaagcaaa

SEQ ID NO: 3243922 - DNA, 21 bp, Homo sapiens
tgaattttgtttttattttca

SEQ ID NO: 3243923 - DNA, 15 bp, Homo sapiens
tgaatttttctcttc

SEQ ID NO: 3243924 - DNA, 20 bp, Homo sapiens
tgaatttttttttcctagcc

SEQ ID NO: 3243925 - DNA, 15 bp, Homo sapiens
tgacaaaagctcatg

SEQ ID NO: 3243926 - DNA, 18 bp, Homo sapiens
tgacaaaatttgttgaaa

SEQ ID NO: 3243927 - DNA, 22 bp, Homo sapiens
tgacaaactgtgtacatagcgg

SEQ ID NO: 3243928 - DNA, 15 bp, Homo sapiens
tgacaaagactcctc

SEQ ID NO: 3243929 - DNA, 17 bp, Homo sapiens
tgacaaagactcctctg

SEQ ID NO: 3243930 - DNA, 18 bp, Homo sapiens
tgacaaagactcctctgg

SEQ ID NO: 3243931 - DNA, 19 bp, Homo sapiens
tgacaaagactcctctggg

SEQ ID NO: 3243932 - DNA, 18 bp, Homo sapiens
tgacaaaggatgaagaac

SEQ ID NO: 3243933 - DNA, 16 bp, Homo sapiens
tgacaaatctgtgtat

SEQ ID NO: 3243934 - DNA, 13 bp, Homo sapiens
tgacaaatgtgta

SEQ ID NO: 3243935 - DNA, 12 bp, Homo sapiens
tgacaacactta

SEQ ID NO: 3243936 - DNA, 19 bp, Homo sapiens
tgacaacagaaaaacaatc

SEQ ID NO: 3243937 - DNA, 17 bp, Homo sapiens
tgacaaccactggtctg

SEQ ID NO: 3243938 - DNA, 19 bp, Homo sapiens
tgacaaccatgagaccact

SEQ ID NO: 3243939 - DNA, 17 bp, Homo sapiens
tgacaaccattaaagtc

SEQ ID NO: 3243940 - DNA, 19 bp, Homo sapiens
tgacaaccattaaagtcag

SEQ ID NO: 3243941 - DNA, 12 bp, Homo sapiens
tgacaactgtga

SEQ ID NO: 3243942 - DNA, 13 bp, Homo sapiens
tgacaactgtgac

SEQ ID NO: 3243943 - DNA, 18 bp, Homo sapiens
tgacaacttttaaagaaa

SEQ ID NO: 3243944 - DNA, 11 bp, Homo sapiens
tgacaagagcc

SEQ ID NO: 3243945 - DNA, 23 bp, Homo sapiens
tgacaagagcctgatctcttcct

SEQ ID NO: 3243946 - DNA, 18 bp, Homo sapiens
tgacaagccaatgtgaat

SEQ ID NO: 3243947 - DNA, 22 bp, Homo sapiens
tgacaagctgacttggcactta

SEQ ID NO: 3243948 - DNA, 21 bp, Homo sapiens
tgacaagggctgacctgcctc

SEQ ID NO: 3243949 - DNA, 14 bp, Homo sapiens
tgacaagtcatttt

SEQ ID NO: 3243950 - DNA, 20 bp, Homo sapiens
tgacaagtcattttaacttt

SEQ ID NO: 3243951 - DNA, 19 bp, Homo sapiens
tgacaataatattgttgta

SEQ ID NO: 3243952 - DNA, 20 bp, Homo sapiens
tgacaataatattgttgtat

SEQ ID NO: 3243953 - DNA, 23 bp, Homo sapiens
tgacaatggacctctcagcagaa

SEQ ID NO: 3243954 - DNA, 15 bp, Homo sapiens
tgacaatggcagcta

SEQ ID NO: 3243955 - DNA, 16 bp, Homo sapiens
tgacaattctgttttt

SEQ ID NO: 3243956 - DNA, 17 bp, Homo sapiens
tgacaattctgttttta

SEQ ID NO: 3243957 - DNA, 16 bp, Homo sapiens
tgacaattttgtacaa

SEQ ID NO: 3243958 - DNA, 18 bp, Homo sapiens
tgacaattttgtacaaat

SEQ ID NO: 3243959 - DNA, 17 bp, Homo sapiens
tgacacaaaaaaagttg

SEQ ID NO: 3243960 - DNA, 14 bp, Homo sapiens
tgacacaaaggaag

SEQ ID NO: 3243961 - DNA, 15 bp, Homo sapiens
tgacacaaaggaagt

SEQ ID NO: 3243962 - DNA, 18 bp, Homo sapiens
tgacacaaaggtggaata

SEQ ID NO: 3243963 - DNA, 16 bp, Homo sapiens
tgacacaactgtgtga

SEQ ID NO: 3243964 - DNA, 22 bp, Homo sapiens
tgacacaactgtgtgattaaaa

SEQ ID NO: 3243965 - DNA, 18 bp, Homo sapiens
tgacacaatctcggctca

SEQ ID NO: 3243966 - DNA, 17 bp, Homo sapiens
tgacacaattggaattg

SEQ ID NO: 3243967 - DNA, 18 bp, Homo sapiens
tgacacacagctctgtcc

SEQ ID NO: 3243968 - DNA, 19 bp, Homo sapiens
tgacacacgtatttatatt

SEQ ID NO: 3243969 - DNA, 12 bp, Homo sapiens
tgacacactaac

SEQ ID NO: 3243970 - DNA, 23 bp, Homo sapiens
tgacacagaaaatgttgagaatc

SEQ ID NO: 3243971 - DNA, 16 bp, Homo sapiens
tgacacaggaaaccaa

SEQ ID NO: 3243972 - DNA, 21 bp, Homo sapiens
tgacacatatgcaccttgtgt

SEQ ID NO: 3243973 - DNA, 18 bp, Homo sapiens
tgacacattacaaagcca

SEQ ID NO: 3243974 - DNA, 14 bp, Homo sapiens
tgacaccaaagcca

SEQ ID NO: 3243975 - DNA, 16 bp, Homo sapiens
tgacaccaaagccacc

SEQ ID NO: 3243976 - DNA, 18 bp, Homo sapiens
tgacaccaaccagacagc

SEQ ID NO: 3243977 - DNA, 17 bp, Homo sapiens
tgacaccatcttttatt

SEQ ID NO: 3243978 - DNA, 16 bp, Homo sapiens
tgacaccattctcctg

SEQ ID NO: 3243979 - DNA, 24 bp, Homo sapiens
tgacacccacaatcccacctagcc

SEQ ID NO: 3243980 - DNA, 22 bp, Homo sapiens
tgacacccgtgagcgcctgtgc

SEQ ID NO: 3243981 - DNA, 16 bp, Homo sapiens
tgacacctccatttct

SEQ ID NO: 3243982 - DNA, 22 bp, Homo sapiens
tgacacctccatttctctccag

SEQ ID NO: 3243983 - DNA, 23 bp, Homo sapiens
tgacacgcgctctccaccaccca

SEQ ID NO: 3243984 - DNA, 15 bp, Homo sapiens
tgacactagaaaact

SEQ ID NO: 3243985 - DNA, 22 bp, Homo sapiens
tgacactagcccaatgaaatga

SEQ ID NO: 3243986 - DNA, 20 bp, Homo sapiens
tgacactatagtttaaaaca

SEQ ID NO: 3243987 - DNA, 13 bp, Homo sapiens
tgacactgagccc

SEQ ID NO: 3243988 - DNA, 18 bp, Homo sapiens
tgacactgagccccacct

SEQ ID NO: 3243989 - DNA, 13 bp, Homo sapiens
tgacactgctcta

SEQ ID NO: 3243990 - DNA, 22 bp, Homo sapiens
tgacactgctctaacagccctc

SEQ ID NO: 3243991 - DNA, 19 bp, Homo sapiens
tgacacttcagagagctgg

SEQ ID NO: 3243992 - DNA, 23 bp, Homo sapiens
tgacacttcagagagctggtagt

SEQ ID NO: 3243993 - DNA, 16 bp, Homo sapiens
tgacagaaggaccagc

SEQ ID NO: 3243994 - DNA, 16 bp, Homo sapiens
tgacagacacaggccc

SEQ ID NO: 3243995 - DNA, 17 bp, Homo sapiens
tgacagacacaggcccg

SEQ ID NO: 3243996 - DNA, 15 bp, Homo sapiens
tgacagacaggctct

SEQ ID NO: 3243997 - DNA, 13 bp, Homo sapiens
tgagcacacttta

SEQ ID NO: 3243998 - DNA, 20 bp, Homo sapiens
tgagcacactttagtggccg

SEQ ID NO: 3243999 - DNA, 17 bp, Homo sapiens
tgagcacagcctagggc

SEQ ID NO: 3244000 - DNA, 19 bp, Homo sapiens
tgagcaccgtcatggctta

SEQ ID NO: 3244001 - DNA, 21 bp, Homo sapiens
tgagcactaaggtgtgctctg

SEQ ID NO: 3244002 - DNA, 23 bp, Homo sapiens
tgagcactaaggtgtgctctgat

SEQ ID NO: 3244003 - DNA, 14 bp, Homo sapiens
tgagcagaaggaaa

SEQ ID NO: 3244004 - DNA, 18 bp, Homo sapiens
tgagcagaaggaaacaaa

SEQ ID NO: 3244005 - DNA, 15 bp, Homo sapiens
tgagcagccgccagc

SEQ ID NO: 3244006 - DNA, 19 bp, Homo sapiens
tgagcaggaaggcctgggt

SEQ ID NO: 3244007 - DNA, 13 bp, Homo sapiens
tgagcagggctca

SEQ ID NO: 3244008 - DNA, 14 bp, Homo sapiens
tgagcagggctcag

SEQ ID NO: 3244009 - DNA, 16 bp, Homo sapiens
tgagcagggctcagcg

SEQ ID NO: 3244010 - DNA, 17 bp, Homo sapiens
tgagcagggctcagcgg

SEQ ID NO: 3244011 - DNA, 20 bp, Homo sapiens
tgagcagggctcagcgggga

SEQ ID NO: 3244012 - DNA, 13 bp, Homo sapiens
tgagcagtggctg

SEQ ID NO: 3244013 - DNA, 15 bp, Homo sapiens
tgagcagtggctggt

SEQ ID NO: 3244014 - DNA, 18 bp, Homo sapiens
tgagcagtggctggtcca

SEQ ID NO: 3244015 - DNA, 14 bp, Homo sapiens
tgagcatcctgagc

SEQ ID NO: 3244016 - DNA, 15 bp, Homo sapiens
tgagcatcctgagcc

SEQ ID NO: 3244017 - DNA, 16 bp, Homo sapiens
tgagcatcctgagccc

SEQ ID NO: 3244018 - DNA, 18 bp, Homo sapiens
tgagcatcctgagccccg

SEQ ID NO: 3244019 - DNA, 19 bp, Homo sapiens
tgagcatcctgagccccgc

SEQ ID NO: 3244020 - DNA, 16 bp, Homo sapiens
tgagcatgcattttct

SEQ ID NO: 3244021 - DNA, 17 bp, Homo sapiens
tgagcatgcattttctt

SEQ ID NO: 3244022 - DNA, 14 bp, Homo sapiens
tgagccaaggaggc

SEQ ID NO: 3244023 - DNA, 18 bp, Homo sapiens
tgagccaaggaggcctgg

SEQ ID NO: 3244024 - DNA, 19 bp, Homo sapiens
tgagccaaggaggcctggg

SEQ ID NO: 3244025 - DNA, 17 bp, Homo sapiens
tgagccaccgctgccag

SEQ ID NO: 3244026 - DNA, 22 bp, Homo sapiens
tgagccactcgcagtcgcagga

SEQ ID NO: 3244027 - DNA, 15 bp, Homo sapiens
tgagccactgagcct

SEQ ID NO: 3244028 - DNA, 12 bp, Homo sapiens
tgagccactgca

SEQ ID NO: 3244029 - DNA, 23 bp, Homo sapiens
tgagccactgcaccgggccacag

SEQ ID NO: 3244030 - DNA, 13 bp, Homo sapiens
tgagccagattac

SEQ ID NO: 3244031 - DNA, 14 bp, Homo sapiens
tgagccagtaatct

SEQ ID NO: 3244032 - DNA, 18 bp, Homo sapiens
tgagccagtaatctttat

SEQ ID NO: 3244033 - DNA, 21 bp, Homo sapiens
tgagccagtgctttaatggca

SEQ ID NO: 3244034 - DNA, 22 bp, Homo sapiens
tgagccatcactagaagaaaag

SEQ ID NO: 3244035 - DNA, 17 bp, Homo sapiens
tgagcccaagctaagcc

SEQ ID NO: 3244036 - DNA, 19 bp, Homo sapiens
tgagcccactgcccacccc

SEQ ID NO: 3244037 - DNA, 22 bp, Homo sapiens
tgagcccactgcccaccccctc

SEQ ID NO: 3244038 - DNA, 13 bp, Homo sapiens
tgagcccagagaa

SEQ ID NO: 3244039 - DNA, 18 bp, Homo sapiens
tgagcccagccctgttct

SEQ ID NO: 3244040 - DNA, 13 bp, Homo sapiens
tgagcccagctgc

SEQ ID NO: 3244041 - DNA, 15 bp, Homo sapiens
tgagcccagctgcct

SEQ ID NO: 3244042 - DNA, 21 bp, Homo sapiens
tgagcccagctgcctggagag

SEQ ID NO: 3244043 - DNA, 13 bp, Homo sapiens
tgagcccaggagt

SEQ ID NO: 3244044 - DNA, 22 bp, Homo sapiens
tgagcccaggagtttgagacaa

SEQ ID NO: 3244045 - DNA, 13 bp, Homo sapiens
tgagcccaggccg

SEQ ID NO: 3244046 - DNA, 22 bp, Homo sapiens
tgagccccaagtcctgaagagg

SEQ ID NO: 3244047 - DNA, 19 bp, Homo sapiens
tgagccccacctctccaag

SEQ ID NO: 3244048 - DNA, 12 bp, Homo sapiens
tgagccccaggg

SEQ ID NO: 3244049 - DNA, 16 bp, Homo sapiens
tgagccccaggggggc

SEQ ID NO: 3244050 - DNA, 22 bp, Homo sapiens
tgagccccaggggggcctcctc

SEQ ID NO: 3244051 - DNA, 21 bp, Homo sapiens
tgagccccagggtgcccagaa

SEQ ID NO: 3244052 - DNA, 16 bp, Homo sapiens
tgagccccgcagacct

SEQ ID NO: 3244053 - DNA, 21 bp, Homo sapiens
tgagccccgccctcttcctga

SEQ ID NO: 3244054 - DNA, 14 bp, Homo sapiens
tgagcccgggctgc

SEQ ID NO: 3244055 - DNA, 17 bp, Homo sapiens
tgagcccgggctgcctg

SEQ ID NO: 3244056 - DNA, 19 bp, Homo sapiens
tgagcccgggctgcctggg

SEQ ID NO: 3244057 - DNA, 20 bp, Homo sapiens
tgagcccgggctgcctgggc

SEQ ID NO: 3244058 - DNA, 19 bp, Homo sapiens
tgagccctactccctgcag

SEQ ID NO: 3244059 - DNA, 12 bp, Homo sapiens
tgagccctgggg

SEQ ID NO: 3244060 - DNA, 19 bp, Homo sapiens
tgagccgagatcacgccac

SEQ ID NO: 3244061 - DNA, 21 bp, Homo sapiens
tgagccgagatcacgccactg

SEQ ID NO: 3244062 - DNA, 22 bp, Homo sapiens
tgagccgagatcacgccactgc

SEQ ID NO: 3244063 - DNA, 18 bp, Homo sapiens
tgagccgagattgcacca

SEQ ID NO: 3244064 - DNA, 20 bp, Homo sapiens
tgagccgagattgcgccact

SEQ ID NO: 3244065 - DNA, 23 bp, Homo sapiens
tgagccgagattgcgccactgca

SEQ ID NO: 3244066 - DNA, 20 bp, Homo sapiens
tgagccgggcccctgggctt

SEQ ID NO: 3244067 - DNA, 15 bp, Homo sapiens
tgagcctcagcatcc

SEQ ID NO: 3244068 - DNA, 22 bp, Homo sapiens
tgagcctcagcatcctggcacc

SEQ ID NO: 3244069 - DNA, 17 bp, Homo sapiens
tgagcctcccccaaagc

SEQ ID NO: 3244070 - DNA, 17 bp, Homo sapiens
tgagcctcgtgtcatct

SEQ ID NO: 3244071 - DNA, 14 bp, Homo sapiens
tgagcctctgctcc

SEQ ID NO: 3244072 - DNA, 16 bp, Homo sapiens
tgagcctctgctcccc

SEQ ID NO: 3244073 - DNA, 18 bp, Homo sapiens
tgagcctctgctccccag

SEQ ID NO: 3244074 - DNA, 20 bp, Homo sapiens
tgagcctgcccgctgcaatg

SEQ ID NO: 3244075 - DNA, 15 bp, Homo sapiens
tgagccttagctccc

SEQ ID NO: 3244076 - DNA, 18 bp, Homo sapiens
tgagcgcctccatccaag

SEQ ID NO: 3244077 - DNA, 12 bp, Homo sapiens
tgagcgggaggc

SEQ ID NO: 3244078 - DNA, 16 bp, Homo sapiens
tgagcgggaggcagag

SEQ ID NO: 3244079 - DNA, 18 bp, Homo sapiens
tgagctactggattctta

SEQ ID NO: 3244080 - DNA, 18 bp, Homo sapiens
tgagctagcgatttcaga

SEQ ID NO: 3244081 - DNA, 16 bp, Homo sapiens
tgagctattgctgttc

SEQ ID NO: 3244082 - DNA, 19 bp, Homo sapiens
tgagctatttccattccag

SEQ ID NO: 3244083 - DNA, 21 bp, Homo sapiens
tgagctatttccattccagaa

SEQ ID NO: 3244084 - DNA, 12 bp, Homo sapiens
tgagctcaggca

SEQ ID NO: 3244085 - DNA, 20 bp, Homo sapiens
tgagctccccagatctccca

SEQ ID NO: 3244086 - DNA, 15 bp, Homo sapiens
tgagctctgaaatct

SEQ ID NO: 3244087 - DNA, 21 bp, Homo sapiens
tgagctcttcctatccctctc

SEQ ID NO: 3244088 - DNA, 17 bp, Homo sapiens
tgagctgagtggccagc

SEQ ID NO: 3244089 - DNA, 15 bp, Homo sapiens
tgagctgatataaat

SEQ ID NO: 3244090 - DNA, 16 bp, Homo sapiens
tgagctgatataaatt

SEQ ID NO: 3244091 - DNA, 21 bp, Homo sapiens
tgagctgatataaattctgtg

SEQ ID NO: 3244092 - DNA, 16 bp, Homo sapiens
tgagctgatctgcgga

SEQ ID NO: 3244093 - DNA, 12 bp, Homo sapiens
tgagctgcaggt

SEQ ID NO: 3244094 - DNA, 11 bp, Homo sapiens
tgagctgcctt

SEQ ID NO: 3244095 - DNA, 16 bp, Homo sapiens
tgagctgccttcccta

SEQ ID NO: 3244096 - DNA, 14 bp, Homo sapiens
tgagctgggcatgg

SEQ ID NO: 3244097 - DNA, 13 bp, Homo sapiens
tgagctgggccca

SEQ ID NO: 3244098 - DNA, 20 bp, Homo sapiens
tgagctggggactcagggac

SEQ ID NO: 3244099 - DNA, 12 bp, Homo sapiens
tgagctggggcc

SEQ ID NO: 3244100 - DNA, 11 bp, Homo sapiens
tgagctgtttt

SEQ ID NO: 3244101 - DNA, 20 bp, Homo sapiens
tgagcttagccttgtgccct

SEQ ID NO: 3244102 - DNA, 23 bp, Homo sapiens
tgagcttcggttctccagaatgt

SEQ ID NO: 3244103 - DNA, 15 bp, Homo sapiens
tgagcttctctgtga

SEQ ID NO: 3244104 - DNA, 19 bp, Homo sapiens
tgagcttggcagctgaact

SEQ ID NO: 3244105 - DNA, 18 bp, Homo sapiens
tgagcttgtcttttctgc

SEQ ID NO: 3244106 - DNA, 14 bp, Homo sapiens
tgagctttctttgc

SEQ ID NO: 3244107 - DNA, 16 bp, Homo sapiens
tgagctttctttgcac

SEQ ID NO: 3244108 - DNA, 17 bp, Homo sapiens
tgagcttttcatggaag

SEQ ID NO: 3244109 - DNA, 14 bp, Homo sapiens
tgaggaaagcacac

SEQ ID NO: 3244110 - DNA, 17 bp, Homo sapiens
tgaggaaagcacacagt

SEQ ID NO: 3244111 - DNA, 23 bp, Homo sapiens
tgaggaaatccattgtttaaaga

SEQ ID NO: 3244112 - DNA, 15 bp, Homo sapiens
tgaggaactgtacag

SEQ ID NO: 3244113 - DNA, 19 bp, Homo sapiens
tgaggaataattatttatt

SEQ ID NO: 3244114 - DNA, 18 bp, Homo sapiens
tgaggaatgctctgtgcc

SEQ ID NO: 3244115 - DNA, 19 bp, Homo sapiens
tgaggacaaccattccaga

SEQ ID NO: 3244116 - DNA, 21 bp, Homo sapiens
tgaggacatgtttttgttttc

SEQ ID NO: 3244117 - DNA, 18 bp, Homo sapiens
tgaggaccgctgataagc

SEQ ID NO: 3244118 - DNA, 17 bp, Homo sapiens
tgaggactgatttcaga

SEQ ID NO: 3244119 - DNA, 12 bp, Homo sapiens
tgaggagacatc

SEQ ID NO: 3244120 - DNA, 14 bp, Homo sapiens
tgaggagacatcta

SEQ ID NO: 3244121 - DNA, 21 bp, Homo sapiens
tgaggagatgaccagggatgc

SEQ ID NO: 3244122 - DNA, 22 bp, Homo sapiens
tgaggagatgaccagggatgct

SEQ ID NO: 3244123 - DNA, 18 bp, Homo sapiens
tgagtggcagccatgcct

SEQ ID NO: 3244124 - DNA, 21 bp, Homo sapiens
tgagtggcaggggacaggagt

SEQ ID NO: 3244125 - DNA, 14 bp, Homo sapiens
tgagtggccagcca

SEQ ID NO: 3244126 - DNA, 17 bp, Homo sapiens
tgagtggccagccagtg

SEQ ID NO: 3244127 - DNA, 15 bp, Homo sapiens
tgagtggccagggaa

SEQ ID NO: 3244128 - DNA, 18 bp, Homo sapiens
tgagtggtggttcctttg

SEQ ID NO: 3244129 - DNA, 16 bp, Homo sapiens
tgagtgtaaataattt

SEQ ID NO: 3244130 - DNA, 22 bp, Homo sapiens
tgagtgtattttttaaaattga

SEQ ID NO: 3244131 - DNA, 20 bp, Homo sapiens
tgagtgtcttctaactttat

SEQ ID NO: 3244132 - DNA, 13 bp, Homo sapiens
tgagtgtgacagg

SEQ ID NO: 3244133 - DNA, 17 bp, Homo sapiens
tgagtgttcctttttaa

SEQ ID NO: 3244134 - DNA, 21 bp, Homo sapiens
tgagtgttcctttttaaatgt

SEQ ID NO: 3244135 - DNA, 15 bp, Homo sapiens
tgagttaactgtgaa

SEQ ID NO: 3244136 - DNA, 16 bp, Homo sapiens
tgagttacagcctgtt

SEQ ID NO: 3244137 - DNA, 21 bp, Homo sapiens
tgagttattcataaagagaaa

SEQ ID NO: 3244138 - DNA, 17 bp, Homo sapiens
tgagttcataccctgtt

SEQ ID NO: 3244139 - DNA, 18 bp, Homo sapiens
tgagttcataccctgtta

SEQ ID NO: 3244140 - DNA, 17 bp, Homo sapiens
tgagttccagttgaagt

SEQ ID NO: 3244141 - DNA, 19 bp, Homo sapiens
tgagttccagttgaagtta

SEQ ID NO: 3244142 - DNA, 22 bp, Homo sapiens
tgagttctacataagtaattca

SEQ ID NO: 3244143 - DNA, 15 bp, Homo sapiens
tgagttctgtgtatt

SEQ ID NO: 3244144 - DNA, 17 bp, Homo sapiens
tgagttgccaagacaaa

SEQ ID NO: 3244145 - DNA, 18 bp, Homo sapiens
tgagttgggcaaaaccca

SEQ ID NO: 3244146 - DNA, 14 bp, Homo sapiens
tgagttgtgatgaa

SEQ ID NO: 3244147 - DNA, 14 bp, Homo sapiens
tgagttgttctaac

SEQ ID NO: 3244148 - DNA, 14 bp, Homo sapiens
tgagtttaaagcaa

SEQ ID NO: 3244149 - DNA, 15 bp, Homo sapiens
tgagtttaccatttg

SEQ ID NO: 3244150 - DNA, 17 bp, Homo sapiens
tgagtttgagctgcctt

SEQ ID NO: 3244151 - DNA, 18 bp, Homo sapiens
tgagtttgagctgccttc

SEQ ID NO: 3244152 - DNA, 14 bp, Homo sapiens
tgagtttgccctgg

SEQ ID NO: 3244153 - DNA, 22 bp, Homo sapiens
tgagtttgccctggtttcactg

SEQ ID NO: 3244154 - DNA, 13 bp, Homo sapiens
tgagtttgcttat

SEQ ID NO: 3244155 - DNA, 20 bp, Homo sapiens
tgagtttgtcgctcatgtgt

SEQ ID NO: 3244156 - DNA, 18 bp, Homo sapiens
tgagttttattgagaatt

SEQ ID NO: 3244157 - DNA, 19 bp, Homo sapiens
tgagtttttgatagcttta

SEQ ID NO: 3244158 - DNA, 20 bp, Homo sapiens
tgataaaagggcaaatctgc

SEQ ID NO: 3244159 - DNA, 15 bp, Homo sapiens
tgataaagagacagt

SEQ ID NO: 3244160 - DNA, 19 bp, Homo sapiens
tgataactgcaattttaat

SEQ ID NO: 3244161 - DNA, 20 bp, Homo sapiens
tgataagggaaaagataaag

SEQ ID NO: 3244162 - DNA, 16 bp, Homo sapiens
tgataagtaaatgcta

SEQ ID NO: 3244163 - DNA, 15 bp, Homo sapiens
tgataagtggaaaaa

SEQ ID NO: 3244164 - DNA, 15 bp, Homo sapiens
tgataataaattgaa

SEQ ID NO: 3244165 - DNA, 23 bp, Homo sapiens
tgataataaattgaaattgtgaa

SEQ ID NO: 3244166 - DNA, 18 bp, Homo sapiens
tgataataatattgtttt

SEQ ID NO: 3244167 - DNA, 11 bp, Homo sapiens
tgataatcttc

SEQ ID NO: 3244168 - DNA, 13 bp, Homo sapiens
tgataatcttcag

SEQ ID NO: 3244169 - DNA, 23 bp, Homo sapiens
tgataatcttcaggtgaacactt

SEQ ID NO: 3244170 - DNA, 23 bp, Homo sapiens
tgataatgatttgctctttgaca

SEQ ID NO: 3244171 - DNA, 18 bp, Homo sapiens
tgataatgttaaatttgt

SEQ ID NO: 3244172 - DNA, 22 bp, Homo sapiens
tgataatgttaaatttgtaagt

SEQ ID NO: 3244173 - DNA, 13 bp, Homo sapiens
tgataattttgct

SEQ ID NO: 3244174 - DNA, 15 bp, Homo sapiens
tgatacataactaaa

SEQ ID NO: 3244175 - DNA, 19 bp, Homo sapiens
tgatacataactaaatttg

SEQ ID NO: 3244176 - DNA, 22 bp, Homo sapiens
tgatacataactaaatttgata

SEQ ID NO: 3244177 - DNA, 13 bp, Homo sapiens
tgataccacctgc

SEQ ID NO: 3244178 - DNA, 19 bp, Homo sapiens
tgataccacctttactgtg

SEQ ID NO: 3244179 - DNA, 22 bp, Homo sapiens
tgataccacctttactgtgctt

SEQ ID NO: 3244180 - DNA, 18 bp, Homo sapiens
tgatacccccctctgtct

SEQ ID NO: 3244181 - DNA, 16 bp, Homo sapiens
tgatacccctggggaa

SEQ ID NO: 3244182 - DNA, 19 bp, Homo sapiens
tgatacgatagttacataa

SEQ ID NO: 3244183 - DNA, 15 bp, Homo sapiens
tgatacgatgcttca

SEQ ID NO: 3244184 - DNA, 16 bp, Homo sapiens
tgatacgatgcttcaa

SEQ ID NO: 3244185 - DNA, 21 bp, Homo sapiens
tgatactatcatactactgaa

SEQ ID NO: 3244186 - DNA, 17 bp, Homo sapiens
tgatactgaatgcataa

SEQ ID NO: 3244187 - DNA, 17 bp, Homo sapiens
tgatactgattatgaaa

SEQ ID NO: 3244188 - DNA, 15 bp, Homo sapiens
tgatacttatatttt

SEQ ID NO: 3244189 - DNA, 15 bp, Homo sapiens
tgatacttttaagag

SEQ ID NO: 3244190 - DNA, 14 bp, Homo sapiens
tgatagcactttct

SEQ ID NO: 3244191 - DNA, 16 bp, Homo sapiens
tgatagcccagaacaa

SEQ ID NO: 3244192 - DNA, 23 bp, Homo sapiens
tgatagctttattttttaagtat

SEQ ID NO: 3244193 - DNA, 16 bp, Homo sapiens
tgatagtcttttgctt

SEQ ID NO: 3244194 - DNA, 22 bp, Homo sapiens
tgatagtgactagcactagaca

SEQ ID NO: 3244195 - DNA, 14 bp, Homo sapiens
tgatagttgaatgt

SEQ ID NO: 3244196 - DNA, 19 bp, Homo sapiens
tgatataaatcagattctt

SEQ ID NO: 3244197 - DNA, 13 bp, Homo sapiens
tgatataaattct

SEQ ID NO: 3244198 - DNA, 15 bp, Homo sapiens
tgatataaattctgt

SEQ ID NO: 3244199 - DNA, 20 bp, Homo sapiens
tgatataccaaattaaaaaa

SEQ ID NO: 3244200 - DNA, 22 bp, Homo sapiens
tgatatataagtgtacatatgt

SEQ ID NO: 3244201 - DNA, 16 bp, Homo sapiens
tgatatatattataaa

SEQ ID NO: 3244202 - DNA, 18 bp, Homo sapiens
tgatatccctgatcctaa

SEQ ID NO: 3244203 - DNA, 16 bp, Homo sapiens
tgatatgagtatacaa

SEQ ID NO: 3244204 - DNA, 18 bp, Homo sapiens
tgatatgagtatacaata

SEQ ID NO: 3244205 - DNA, 14 bp, Homo sapiens
tgatatgatccaga

SEQ ID NO: 3244206 - DNA, 15 bp, Homo sapiens
tgatatggcagaaga

SEQ ID NO: 3244207 - DNA, 17 bp, Homo sapiens
tgatatggcagaagaca

SEQ ID NO: 3244208 - DNA, 20 bp, Homo sapiens
tgatatggcagaagacacca

SEQ ID NO: 3244209 - DNA, 21 bp, Homo sapiens
tgatattccccccacttaaga

SEQ ID NO: 3244210 - DNA, 12 bp, Homo sapiens
tgatattctaag

SEQ ID NO: 3244211 - DNA, 16 bp, Homo sapiens
tgatattgaaggaatt

SEQ ID NO: 3244212 - DNA, 16 bp, Homo sapiens
tgatatttcttgcttt

SEQ ID NO: 3244213 - DNA, 17 bp, Homo sapiens
tgatatttcttgctttc

SEQ ID NO: 3244214 - DNA, 16 bp, Homo sapiens
tgatatttgcattgag

SEQ ID NO: 3244215 - DNA, 22 bp, Homo sapiens
tgatattttcaacgcagccctg

SEQ ID NO: 3244216 - DNA, 20 bp, Homo sapiens
tgatattttctgtgcctgaa

SEQ ID NO: 3244217 - DNA, 15 bp, Homo sapiens
tgatcaaaacctgtg

SEQ ID NO: 3244218 - DNA, 19 bp, Homo sapiens
tgatcaaaattacttttct

SEQ ID NO: 3244219 - DNA, 16 bp, Homo sapiens
tgatcaataaaatgtg

SEQ ID NO: 3244220 - DNA, 18 bp, Homo sapiens
tgatcaataaaatgtgat

SEQ ID NO: 3244221 - DNA, 22 bp, Homo sapiens
tgatcaattatagtttctgagg

SEQ ID NO: 3244222 - DNA, 18 bp, Homo sapiens
tgatcaattgaccttgtg

SEQ ID NO: 3244223 - DNA, 19 bp, Homo sapiens
tgatcacccaatgcatcac

SEQ ID NO: 3244224 - DNA, 14 bp, Homo sapiens
tgatcacgcctggc

SEQ ID NO: 3244225 - DNA, 15 bp, Homo sapiens
tgatcacgcctggct

SEQ ID NO: 3244226 - DNA, 18 bp, Homo sapiens
tgatcacggctcactgca

SEQ ID NO: 3244227 - DNA, 19 bp, Homo sapiens
tgatcacggctcactgcag

SEQ ID NO: 3244228 - DNA, 22 bp, Homo sapiens
tgatcacggctcactgcagcct

SEQ ID NO: 3244229 - DNA, 22 bp, Homo sapiens
tgatcactccaggtagtttggg

SEQ ID NO: 3244230 - DNA, 23 bp, Homo sapiens
tgatcactcccagcactcccctt

SEQ ID NO: 3244231 - DNA, 11 bp, Homo sapiens
tgatcagaggt

SEQ ID NO: 3244232 - DNA, 16 bp, Homo sapiens
tgatcagctgtttgtc

SEQ ID NO: 3244233 - DNA, 17 bp, Homo sapiens
tgatcagctgtttgtca

SEQ ID NO: 3244234 - DNA, 21 bp, Homo sapiens
tgatcataagtctaaataaat

SEQ ID NO: 3244235 - DNA, 17 bp, Homo sapiens
tgatcataagtgaattt

SEQ ID NO: 3244236 - DNA, 18 bp, Homo sapiens
tgatcataagtgaattta

SEQ ID NO: 3244237 - DNA, 15 bp, Homo sapiens
tgatcatcatgtaga

SEQ ID NO: 3244238 - DNA, 18 bp, Homo sapiens
tgatcatcgccagaggtg

SEQ ID NO: 3244239 - DNA, 14 bp, Homo sapiens
tgatcatgtacttt

SEQ ID NO: 3244240 - DNA, 22 bp, Homo sapiens
tgatcatgtgtggaagttatta

SEQ ID NO: 3244241 - DNA, 16 bp, Homo sapiens
tgatcattgaaatact

SEQ ID NO: 3244242 - DNA, 22 bp, Homo sapiens
tgatcatttaaaaagctcactg

SEQ ID NO: 3244243 - DNA, 20 bp, Homo sapiens
tgatcatttattttaagcac

SEQ ID NO: 3244244 - DNA, 16 bp, Homo sapiens
tgatcattttcccccc

SEQ ID NO: 3244245 - DNA, 20 bp, Homo sapiens
tgatcattttccccccactc

SEQ ID NO: 3244246 - DNA, 22 bp, Homo sapiens
tgatcattttccccccactctc

SEQ ID NO: 3244247 - DNA, 14 bp, Homo sapiens
tgatccaactaatg

SEQ ID NO: 3244248 - DNA, 22 bp, Homo sapiens
tgcagcaggagtggtgcagaca

SEQ ID NO: 3244249 - DNA, 22 bp, Homo sapiens
tgcagcagtgagtctcttcaga

SEQ ID NO: 3244250 - DNA, 19 bp, Homo sapiens
tgcagcatggtccctgcct

SEQ ID NO: 3244251 - DNA, 20 bp, Homo sapiens
tgcagcatgttgctgaggag

SEQ ID NO: 3244252 - DNA, 12 bp, Homo sapiens
tgcagcccatgc

SEQ ID NO: 3244253 - DNA, 12 bp, Homo sapiens
tgcagcccttgg

SEQ ID NO: 3244254 - DNA, 16 bp, Homo sapiens
tgcagccgccttcctt

SEQ ID NO: 3244255 - DNA, 17 bp, Homo sapiens
tgcagccggcacagggt

SEQ ID NO: 3244256 - DNA, 18 bp, Homo sapiens
tgcagccggcacagggtc

SEQ ID NO: 3244257 - DNA, 15 bp, Homo sapiens
tgcagcctcctcctg

SEQ ID NO: 3244258 - DNA, 17 bp, Homo sapiens
tgcagcctcctcctgac

SEQ ID NO: 3244259 - DNA, 14 bp, Homo sapiens
tgcagcctgcgcca

SEQ ID NO: 3244260 - DNA, 11 bp, Homo sapiens
tgcagcctgct

SEQ ID NO: 3244261 - DNA, 19 bp, Homo sapiens
tgcagcgcagctggactct

SEQ ID NO: 3244262 - DNA, 22 bp, Homo sapiens
tgcagcgcagctggactctgca

SEQ ID NO: 3244263 - DNA, 17 bp, Homo sapiens
tgcagcgcccctctgca

SEQ ID NO: 3244264 - DNA, 12 bp, Homo sapiens
tgcagctgggcc

SEQ ID NO: 3244265 - DNA, 13 bp, Homo sapiens
tgcagctgggccc

SEQ ID NO: 3244266 - DNA, 22 bp, Homo sapiens
tgcagctgtggcagagttacag

SEQ ID NO: 3244267 - DNA, 14 bp, Homo sapiens
tgcagcttgagttt

SEQ ID NO: 3244268 - DNA, 16 bp, Homo sapiens
tgcagcttgggagagc

SEQ ID NO: 3244269 - DNA, 18 bp, Homo sapiens
tgcagcttgggagagccc

SEQ ID NO: 3244270 - DNA, 14 bp, Homo sapiens
tgcagctttgcaaa

SEQ ID NO: 3244271 - DNA, 16 bp, Homo sapiens
tgcaggaacgagcact

SEQ ID NO: 3244272 - DNA, 17 bp, Homo sapiens
tgcaggaacgagcactg

SEQ ID NO: 3244273 - DNA, 20 bp, Homo sapiens
tgcaggaacgagcactggcc

SEQ ID NO: 3244274 - DNA, 21 bp, Homo sapiens
tgcaggaacgagcactggcca

SEQ ID NO: 3244275 - DNA, 17 bp, Homo sapiens
tgcaggaaggaaaacta

SEQ ID NO: 3244276 - DNA, 16 bp, Homo sapiens
tgcaggaataaggcct

SEQ ID NO: 3244277 - DNA, 20 bp, Homo sapiens
tgcaggacaggaggcggccc

SEQ ID NO: 3244278 - DNA, 18 bp, Homo sapiens
tgcaggacttgagaagac

SEQ ID NO: 3244279 - DNA, 17 bp, Homo sapiens
tgcaggagacattttca

SEQ ID NO: 3244280 - DNA, 22 bp, Homo sapiens
tgcaggagcgtgaaggacttag

SEQ ID NO: 3244281 - DNA, 13 bp, Homo sapiens
tgcaggagcttct

SEQ ID NO: 3244282 - DNA, 14 bp, Homo sapiens
tgcaggatggtgtc

SEQ ID NO: 3244283 - DNA, 22 bp, Homo sapiens
tgcaggcatgcttctcaccgtg

SEQ ID NO: 3244284 - DNA, 20 bp, Homo sapiens
tgcaggccctggcctcccct

SEQ ID NO: 3244285 - DNA, 17 bp, Homo sapiens
tgcaggcctaggtgcag

SEQ ID NO: 3244286 - DNA, 17 bp, Homo sapiens
tgcaggctctgggctca

SEQ ID NO: 3244287 - DNA, 18 bp, Homo sapiens
tgcaggctctgggctcag

SEQ ID NO: 3244288 - DNA, 19 bp, Homo sapiens
tgcaggctctgggctcagg

SEQ ID NO: 3244289 - DNA, 20 bp, Homo sapiens
tgcaggctctgggctcaggg

SEQ ID NO: 3244290 - DNA, 19 bp, Homo sapiens
tgcaggctgagccactctc

SEQ ID NO: 3244291 - DNA, 17 bp, Homo sapiens
tgcagggaagagggcag

SEQ ID NO: 3244292 - DNA, 24 bp, Homo sapiens
tgcagggaggaggtggcagccctg

SEQ ID NO: 3244293 - DNA, 18 bp, Homo sapiens
tgcagggaggggaggcag

SEQ ID NO: 3244294 - DNA, 13 bp, Homo sapiens
tgcagggagtccg

SEQ ID NO: 3244295 - DNA, 12 bp, Homo sapiens
tgcagggcagcc

SEQ ID NO: 3244296 - DNA, 14 bp, Homo sapiens
tgcagggcagcccc

SEQ ID NO: 3244297 - DNA, 23 bp, Homo sapiens
tgcagggccaggactgagccccg

SEQ ID NO: 3244298 - DNA, 19 bp, Homo sapiens
tgcagggctaaggccccca

SEQ ID NO: 3244299 - DNA, 20 bp, Homo sapiens
tgcaggggattgaagccctc

SEQ ID NO: 3244300 - DNA, 21 bp, Homo sapiens
tgcaggggattgaagccctcc

SEQ ID NO: 3244301 - DNA, 21 bp, Homo sapiens
tgcaggggctctggagagaaa

SEQ ID NO: 3244302 - DNA, 19 bp, Homo sapiens
tgcagggggtgtgtctgct

SEQ ID NO: 3244303 - DNA, 23 bp, Homo sapiens
tgcaggggtcagtgcagcagagg

SEQ ID NO: 3244304 - DNA, 15 bp, Homo sapiens
tgcaggggtccctgc

SEQ ID NO: 3244305 - DNA, 17 bp, Homo sapiens
tgcaggggtccctgcta

SEQ ID NO: 3244306 - DNA, 22 bp, Homo sapiens
tgcagggtcctcttctgggcct

SEQ ID NO: 3244307 - DNA, 23 bp, Homo sapiens
tgcagggttctccctcccacctt

SEQ ID NO: 3244308 - DNA, 19 bp, Homo sapiens
tgcaggtacttcctcctga

SEQ ID NO: 3244309 - DNA, 17 bp, Homo sapiens
tgcaggtggcagagtga

SEQ ID NO: 3244310 - DNA, 15 bp, Homo sapiens
tgcaggtgggcactg

SEQ ID NO: 3244311 - DNA, 23 bp, Homo sapiens
tgcaggtgggggttgctgtataa

SEQ ID NO: 3244312 - DNA, 23 bp, Homo sapiens
tgcaggttggaaggggccttgct

SEQ ID NO: 3244313 - DNA, 13 bp, Homo sapiens
tgcagtaaatctt

SEQ ID NO: 3244314 - DNA, 18 bp, Homo sapiens
tgcagtaactgtttttta

SEQ ID NO: 3244315 - DNA, 22 bp, Homo sapiens
tgcagtacttttgttgtatggg

SEQ ID NO: 3244316 - DNA, 19 bp, Homo sapiens
tgcagtagagtcatctcca

SEQ ID NO: 3244317 - DNA, 18 bp, Homo sapiens
tgcagtaggggaggagca

SEQ ID NO: 3244318 - DNA, 15 bp, Homo sapiens
tgcagtcgtgtaatt

SEQ ID NO: 3244319 - DNA, 13 bp, Homo sapiens
tgcagtcttctgg

SEQ ID NO: 3244320 - DNA, 23 bp, Homo sapiens
tgcagtgccttggggaatttcct

SEQ ID NO: 3244321 - DNA, 21 bp, Homo sapiens
tgcagtggcgcattctaggct

SEQ ID NO: 3244322 - DNA, 18 bp, Homo sapiens
tgcagtggcgtgatcttg

SEQ ID NO: 3244323 - DNA, 16 bp, Homo sapiens
tgcagtggcttttcat

SEQ ID NO: 3244324 - DNA, 22 bp, Homo sapiens
tgcagtggtatgatcacggctc

SEQ ID NO: 3244325 - DNA, 20 bp, Homo sapiens
tgcagtggtgcgatctgggt

SEQ ID NO: 3244326 - DNA, 23 bp, Homo sapiens
tgcagttaacaggatattagaca

SEQ ID NO: 3244327 - DNA, 19 bp, Homo sapiens
tgcagttcagcaccaccct

SEQ ID NO: 3244328 - DNA, 15 bp, Homo sapiens
tgcagttcattattt

SEQ ID NO: 3244329 - DNA, 20 bp, Homo sapiens
tgcagttcccccaacctcag

SEQ ID NO: 3244330 - DNA, 12 bp, Homo sapiens
tgcagttcctgg

SEQ ID NO: 3244331 - DNA, 18 bp, Homo sapiens
tgcagttctttttgtaca

SEQ ID NO: 3244332 - DNA, 18 bp, Homo sapiens
tgcagttggactctcagg

SEQ ID NO: 3244333 - DNA, 15 bp, Homo sapiens
tgcagtttttcattt

SEQ ID NO: 3244334 - DNA, 13 bp, Homo sapiens
tgcataaataaat

SEQ ID NO: 3244335 - DNA, 15 bp, Homo sapiens
tgcataaatatgcag

SEQ ID NO: 3244336 - DNA, 18 bp, Homo sapiens
tgcataagattaaaggaa

SEQ ID NO: 3244337 - DNA, 21 bp, Homo sapiens
tgcataagattaaaggaagga

SEQ ID NO: 3244338 - DNA, 22 bp, Homo sapiens
tgcataagattaaaggaaggaa

SEQ ID NO: 3244339 - DNA, 17 bp, Homo sapiens
tgcataatagctacagt

SEQ ID NO: 3244340 - DNA, 18 bp, Homo sapiens
tgcataatgctttggaaa

SEQ ID NO: 3244341 - DNA, 17 bp, Homo sapiens
tgcataatgtttctgga

SEQ ID NO: 3244342 - DNA, 14 bp, Homo sapiens
tgcatactttattg

SEQ ID NO: 3244343 - DNA, 13 bp, Homo sapiens
tgcatactttgta

SEQ ID NO: 3244344 - DNA, 15 bp, Homo sapiens
tgcatagagccctgg

SEQ ID NO: 3244345 - DNA, 18 bp, Homo sapiens
tgcatagagccctggcca

SEQ ID NO: 3244346 - DNA, 22 bp, Homo sapiens
tgcatagcagatggtttccaca

SEQ ID NO: 3244347 - DNA, 22 bp, Homo sapiens
tgcatagtaccaatcattttaa

SEQ ID NO: 3244348 - DNA, 15 bp, Homo sapiens
tgcatagtcccagct

SEQ ID NO: 3244349 - DNA, 21 bp, Homo sapiens
tgcatagttgtagacaaagta

SEQ ID NO: 3244350 - DNA, 16 bp, Homo sapiens
tgcatatatgttcttc

SEQ ID NO: 3244351 - DNA, 16 bp, Homo sapiens
tgcatatcctgagcca

SEQ ID NO: 3244352 - DNA, 18 bp, Homo sapiens
tgcatattctattgtatt

SEQ ID NO: 3244353 - DNA, 22 bp, Homo sapiens
tgcatatttatccaaaatgtgt

SEQ ID NO: 3244354 - DNA, 13 bp, Homo sapiens
tgcatcactgggt

SEQ ID NO: 3244355 - DNA, 19 bp, Homo sapiens
tgcatcactgggtgttgat

SEQ ID NO: 3244356 - DNA, 12 bp, Homo sapiens
tgcatcccagca

SEQ ID NO: 3244357 - DNA, 19 bp, Homo sapiens
tgcatcccagcacctgcct

SEQ ID NO: 3244358 - DNA, 20 bp, Homo sapiens
tgcatcccagcacctgcctc

SEQ ID NO: 3244359 - DNA, 14 bp, Homo sapiens
tgcatccctgagac

SEQ ID NO: 3244360 - DNA, 17 bp, Homo sapiens
tgcatcctcctcagccc

SEQ ID NO: 3244361 - DNA, 21 bp, Homo sapiens
tgcatcctcctcagcccccag

SEQ ID NO: 3244362 - DNA, 14 bp, Homo sapiens
tgcatccttcctat

SEQ ID NO: 3244363 - DNA, 23 bp, Homo sapiens
tgcatcggactaaactatctgta

SEQ ID NO: 3244364 - DNA, 20 bp, Homo sapiens
tgcatcgggaaagaagaaac

SEQ ID NO: 3244365 - DNA, 18 bp, Homo sapiens
tgcatctagcctcaagct

SEQ ID NO: 3244366 - DNA, 19 bp, Homo sapiens
tgcatctcaaaattattct

SEQ ID NO: 3244367 - DNA, 21 bp, Homo sapiens
tgcatcttatagcactttgaa

SEQ ID NO: 3244368 - DNA, 20 bp, Homo sapiens
tgcatgaagagaagcaattt

SEQ ID NO: 3244369 - DNA, 21 bp, Homo sapiens
tgcatgaagagaagcaatttt

SEQ ID NO: 3244370 - DNA, 15 bp, Homo sapiens
tgcatgacttgtagc

SEQ ID NO: 3244371 - DNA, 15 bp, Homo sapiens
tgcatgcaaacaaga

SEQ ID NO: 3244372 - DNA, 15 bp, Homo sapiens
tgcatgcaaatgagc

SEQ ID NO: 3244373 - DNA, 15 bp, Homo sapiens
tgccgctcctctcta

SEQ ID NO: 3244374 - DNA, 18 bp, Homo sapiens
tgccggatacaaactggt

SEQ ID NO: 3244375 - DNA, 20 bp, Homo sapiens
tgccggctctttccttgctc

SEQ ID NO: 3244376 - DNA, 19 bp, Homo sapiens
tgccgggttctagtctcct

SEQ ID NO: 3244377 - DNA, 13 bp, Homo sapiens
tgccggtgggacc

SEQ ID NO: 3244378 - DNA, 16 bp, Homo sapiens
tgccgtgtgagtgtga

SEQ ID NO: 3244379 - DNA, 19 bp, Homo sapiens
tgccgtgtgagtgtgacag

SEQ ID NO: 3244380 - DNA, 20 bp, Homo sapiens
tgccgtgtgagtgtgacagg

SEQ ID NO: 3244381 - DNA, 16 bp, Homo sapiens
tgcctaaaattgtatg

SEQ ID NO: 3244382 - DNA, 18 bp, Homo sapiens
tgcctaaaattgtatgaa

SEQ ID NO: 3244383 - DNA, 21 bp, Homo sapiens
tgcctaaatttaatgctgcct

SEQ ID NO: 3244384 - DNA, 14 bp, Homo sapiens
tgcctaaccaggcc

SEQ ID NO: 3244385 - DNA, 19 bp, Homo sapiens
tgcctaagcattgcctggc

SEQ ID NO: 3244386 - DNA, 15 bp, Homo sapiens
tgcctaattggaaag

SEQ ID NO: 3244387 - DNA, 19 bp, Homo sapiens
tgcctacaaccatccctgc

SEQ ID NO: 3244388 - DNA, 20 bp, Homo sapiens
tgcctacaaccatccctgcc

SEQ ID NO: 3244389 - DNA, 23 bp, Homo sapiens
tgcctacagaacttcagaaagac

SEQ ID NO: 3244390 - DNA, 14 bp, Homo sapiens
tgcctaccatttca

SEQ ID NO: 3244391 - DNA, 15 bp, Homo sapiens
tgcctagactgttac

SEQ ID NO: 3244392 - DNA, 16 bp, Homo sapiens
tgcctagactgttact

SEQ ID NO: 3244393 - DNA, 19 bp, Homo sapiens
tgcctagcaagctggcctc

SEQ ID NO: 3244394 - DNA, 21 bp, Homo sapiens
tgcctaggcgattttgtctac

SEQ ID NO: 3244395 - DNA, 16 bp, Homo sapiens
tgcctagtttttagta

SEQ ID NO: 3244396 - DNA, 14 bp, Homo sapiens
tgcctatagtccca

SEQ ID NO: 3244397 - DNA, 20 bp, Homo sapiens
tgcctatcacctcttatgca

SEQ ID NO: 3244398 - DNA, 21 bp, Homo sapiens
tgcctattatctgtcagctgc

SEQ ID NO: 3244399 - DNA, 15 bp, Homo sapiens
tgcctcaatgccagt

SEQ ID NO: 3244400 - DNA, 16 bp, Homo sapiens
tgcctcaccctcccaa

SEQ ID NO: 3244401 - DNA, 15 bp, Homo sapiens
tgcctcaccgcttcc

SEQ ID NO: 3244402 - DNA, 14 bp, Homo sapiens
tgcctcagcctccg

SEQ ID NO: 3244403 - DNA, 16 bp, Homo sapiens
tgcctcaggttcctat

SEQ ID NO: 3244404 - DNA, 21 bp, Homo sapiens
tgcctcagtatatttaaactc

SEQ ID NO: 3244405 - DNA, 12 bp, Homo sapiens
tgcctcagtggc

SEQ ID NO: 3244406 - DNA, 16 bp, Homo sapiens
tgcctcagtggcagca

SEQ ID NO: 3244407 - DNA, 17 bp, Homo sapiens
tgcctcagtggcagcat

SEQ ID NO: 3244408 - DNA, 23 bp, Homo sapiens
tgcctcagtggcagcatcctcca

SEQ ID NO: 3244409 - DNA, 17 bp, Homo sapiens
tgcctcatgccacacct

SEQ ID NO: 3244410 - DNA, 17 bp, Homo sapiens
tgcctccaagccattca

SEQ ID NO: 3244411 - DNA, 15 bp, Homo sapiens
tgcctccaccaccac

SEQ ID NO: 3244412 - DNA, 11 bp, Homo sapiens
tgcctccaggt

SEQ ID NO: 3244413 - DNA, 20 bp, Homo sapiens
tgcctcccaaagtgctggga

SEQ ID NO: 3244414 - DNA, 23 bp, Homo sapiens
tgcctcccacacttgctggggct

SEQ ID NO: 3244415 - DNA, 16 bp, Homo sapiens
tgcctcccacttcact

SEQ ID NO: 3244416 - DNA, 17 bp, Homo sapiens
tgcctcccatgcctggt

SEQ ID NO: 3244417 - DNA, 17 bp, Homo sapiens
tgcctccccatttccca

SEQ ID NO: 3244418 - DNA, 18 bp, Homo sapiens
tgcctccccggctcgagc

SEQ ID NO: 3244419 - DNA, 19 bp, Homo sapiens
tgcctcctcaaacccagtc

SEQ ID NO: 3244420 - DNA, 19 bp, Homo sapiens
tgcctcctcacccccagct

SEQ ID NO: 3244421 - DNA, 12 bp, Homo sapiens
tgcctcctggga

SEQ ID NO: 3244422 - DNA, 13 bp, Homo sapiens
tgcctcctgtggg

SEQ ID NO: 3244423 - DNA, 17 bp, Homo sapiens
tgcctcctgtgtactgt

SEQ ID NO: 3244424 - DNA, 19 bp, Homo sapiens
tgcctcctgttctgcccac

SEQ ID NO: 3244425 - DNA, 19 bp, Homo sapiens
tgcctccttccacctccct

SEQ ID NO: 3244426 - DNA, 21 bp, Homo sapiens
tgcctcgaaacacagaaacct

SEQ ID NO: 3244427 - DNA, 15 bp, Homo sapiens
tgcctcgaggcaccg

SEQ ID NO: 3244428 - DNA, 21 bp, Homo sapiens
tgcctcgaggcaccggcgctg

SEQ ID NO: 3244429 - DNA, 23 bp, Homo sapiens
tgcctcgaggcaccggcgctgca

SEQ ID NO: 3244430 - DNA, 14 bp, Homo sapiens
tgcctcgctccctt

SEQ ID NO: 3244431 - DNA, 22 bp, Homo sapiens
tgcctctcaactgccctaagtc

SEQ ID NO: 3244432 - DNA, 14 bp, Homo sapiens
tgcctctgacacac

SEQ ID NO: 3244433 - DNA, 22 bp, Homo sapiens
tgcctctgacacacagctctgt

SEQ ID NO: 3244434 - DNA, 19 bp, Homo sapiens
tgcctctgatatgggactg

SEQ ID NO: 3244435 - DNA, 21 bp, Homo sapiens
tgcctctgccaaaggatgtga

SEQ ID NO: 3244436 - DNA, 16 bp, Homo sapiens
tgcctctgcctcccaa

SEQ ID NO: 3244437 - DNA, 15 bp, Homo sapiens
tgcctctgcctctga

SEQ ID NO: 3244438 - DNA, 12 bp, Homo sapiens
tgcctctgcctg

SEQ ID NO: 3244439 - DNA, 22 bp, Homo sapiens
tgcctctgccttagaggagccc

SEQ ID NO: 3244440 - DNA, 20 bp, Homo sapiens
tgcctctgcggggcagggcc

SEQ ID NO: 3244441 - DNA, 11 bp, Homo sapiens
tgcctctgctc

SEQ ID NO: 3244442 - DNA, 12 bp, Homo sapiens
tgcctctgctcc

SEQ ID NO: 3244443 - DNA, 14 bp, Homo sapiens
tgcctctgctccct

SEQ ID NO: 3244444 - DNA, 15 bp, Homo sapiens
tgcctctgctccctc

SEQ ID NO: 3244445 - DNA, 21 bp, Homo sapiens
tgcctctggaggcctctggcc

SEQ ID NO: 3244446 - DNA, 11 bp, Homo sapiens
tgcctctgtgc

SEQ ID NO: 3244447 - DNA, 12 bp, Homo sapiens
tgcctctgtgct

SEQ ID NO: 3244448 - DNA, 13 bp, Homo sapiens
tgcctctgtgctg

SEQ ID NO: 3244449 - DNA, 17 bp, Homo sapiens
tgcctctgtgctgtgtg

SEQ ID NO: 3244450 - DNA, 21 bp, Homo sapiens
tgcctctgtgctgtgtgtgac

SEQ ID NO: 3244451 - DNA, 17 bp, Homo sapiens
tgcctcttccttgaaga

SEQ ID NO: 3244452 - DNA, 13 bp, Homo sapiens
tgcctctttgaag

SEQ ID NO: 3244453 - DNA, 18 bp, Homo sapiens
tgcctgaagtcacacagt

SEQ ID NO: 3244454 - DNA, 16 bp, Homo sapiens
tgcctgacacactaac

SEQ ID NO: 3244455 - DNA, 15 bp, Homo sapiens
tgcctgacactgagc

SEQ ID NO: 3244456 - DNA, 21 bp, Homo sapiens
tgcctgaccccttgctccctt

SEQ ID NO: 3244457 - DNA, 13 bp, Homo sapiens
tgcctgagaggca

SEQ ID NO: 3244458 - DNA, 19 bp, Homo sapiens
tgcctgagaggcaggcata

SEQ ID NO: 3244459 - DNA, 14 bp, Homo sapiens
tgcctgagggtgga

SEQ ID NO: 3244460 - DNA, 16 bp, Homo sapiens
tgcctgaggtctgtac

SEQ ID NO: 3244461 - DNA, 14 bp, Homo sapiens
tgcctgcaccagga

SEQ ID NO: 3244462 - DNA, 17 bp, Homo sapiens
tgcctgcaccaggagac

SEQ ID NO: 3244463 - DNA, 18 bp, Homo sapiens
tgcctgcaccaggagaca

SEQ ID NO: 3244464 - DNA, 11 bp, Homo sapiens
tgcctgcagcc

SEQ ID NO: 3244465 - DNA, 14 bp, Homo sapiens
tgcctgccaccgcg

SEQ ID NO: 3244466 - DNA, 19 bp, Homo sapiens
tgcctgccatgggccagcc

SEQ ID NO: 3244467 - DNA, 20 bp, Homo sapiens
tgcctgccatgggccagcct

SEQ ID NO: 3244468 - DNA, 15 bp, Homo sapiens
tgcctgcccaggccc

SEQ ID NO: 3244469 - DNA, 16 bp, Homo sapiens
tgcctgcccaggcccc

SEQ ID NO: 3244470 - DNA, 17 bp, Homo sapiens
tgcctgcccaggcccct

SEQ ID NO: 3244471 - DNA, 22 bp, Homo sapiens
tgcctgcccaggcccctgccac

SEQ ID NO: 3244472 - DNA, 17 bp, Homo sapiens
tgcctgccccgccccca

SEQ ID NO: 3244473 - DNA, 19 bp, Homo sapiens
tgcctgcttggcccggccg

SEQ ID NO: 3244474 - DNA, 21 bp, Homo sapiens
tgcctgctttttggaaagtca

SEQ ID NO: 3244475 - DNA, 18 bp, Homo sapiens
tgcctggagacgtggaac

SEQ ID NO: 3244476 - DNA, 20 bp, Homo sapiens
tgcctggagacttagggcac

SEQ ID NO: 3244477 - DNA, 20 bp, Homo sapiens
tgcctggatgaggcacttct

SEQ ID NO: 3244478 - DNA, 22 bp, Homo sapiens
tgcctggatgaggcacttctgt

SEQ ID NO: 3244479 - DNA, 20 bp, Homo sapiens
tgcctggccaggcagatctg

SEQ ID NO: 3244480 - DNA, 11 bp, Homo sapiens
tgcctggcccc

SEQ ID NO: 3244481 - DNA, 12 bp, Homo sapiens
tgcctggcctgg

SEQ ID NO: 3244482 - DNA, 13 bp, Homo sapiens
tgcctggcctggc

SEQ ID NO: 3244483 - DNA, 15 bp, Homo sapiens
tgcctggcctggctc

SEQ ID NO: 3244484 - DNA, 16 bp, Homo sapiens
tgcctggcctggctcc

SEQ ID NO: 3244485 - DNA, 15 bp, Homo sapiens
tgcctggctgtggag

SEQ ID NO: 3244486 - DNA, 17 bp, Homo sapiens
tgcctggctgtggaggc

SEQ ID NO: 3244487 - DNA, 14 bp, Homo sapiens
tgcctgggaatgta

SEQ ID NO: 3244488 - DNA, 15 bp, Homo sapiens
tgcctgggaatgtat

SEQ ID NO: 3244489 - DNA, 12 bp, Homo sapiens
tgcctgggcctg

SEQ ID NO: 3244490 - DNA, 22 bp, Homo sapiens
tgcctgggcctgtgcagcagcc

SEQ ID NO: 3244491 - DNA, 12 bp, Homo sapiens
tgcctgggctgt

SEQ ID NO: 3244492 - DNA, 17 bp, Homo sapiens
tgcctgggctgttggca

SEQ ID NO: 3244493 - DNA, 19 bp, Homo sapiens
tgcctgggggagagaggca

SEQ ID NO: 3244494 - DNA, 13 bp, Homo sapiens
tgcctgggtggga

SEQ ID NO: 3244495 - DNA, 16 bp, Homo sapiens
tgcctgggtgggacag

SEQ ID NO: 3244496 - DNA, 17 bp, Homo sapiens
tgcctggtcacagggca

SEQ ID NO: 3244497 - DNA, 18 bp, Homo sapiens
tgcctggtgaatggcctt

SEQ ID NO: 3244498 - DNA, 19 bp, Homo sapiens
tgcctggtggtcagatgca

SEQ ID NO: 3244499 - DNA, 13 bp, Homo sapiens
tgcctgtaaacat

SEQ ID NO: 3244500 - DNA, 17 bp, Homo sapiens
tgcttaaaataagcagg

SEQ ID NO: 3244501 - DNA, 19 bp, Homo sapiens
tgcttaaaataagcaggtg

SEQ ID NO: 3244502 - DNA, 12 bp, Homo sapiens
tgcttaaacaaa

SEQ ID NO: 3244503 - DNA, 18 bp, Homo sapiens
tgcttaaactaaataatg

SEQ ID NO: 3244504 - DNA, 16 bp, Homo sapiens
tgcttaagttccagca

SEQ ID NO: 3244505 - DNA, 14 bp, Homo sapiens
tgcttaatcttcaa

SEQ ID NO: 3244506 - DNA, 15 bp, Homo sapiens
tgcttaatcttcaaa

SEQ ID NO: 3244507 - DNA, 21 bp, Homo sapiens
tgcttaatcttcaaagccttc

SEQ ID NO: 3244508 - DNA, 20 bp, Homo sapiens
tgcttaatttctaaagataa

SEQ ID NO: 3244509 - DNA, 16 bp, Homo sapiens
tgcttacacatctcag

SEQ ID NO: 3244510 - DNA, 14 bp, Homo sapiens
tgcttacattttta

SEQ ID NO: 3244511 - DNA, 15 bp, Homo sapiens
tgcttacatttttac

SEQ ID NO: 3244512 - DNA, 17 bp, Homo sapiens
tgcttagacataacaaa

SEQ ID NO: 3244513 - DNA, 14 bp, Homo sapiens
tgcttagcttatct

SEQ ID NO: 3244514 - DNA, 23 bp, Homo sapiens
tgcttagcttatctttctttcca

SEQ ID NO: 3244515 - DNA, 14 bp, Homo sapiens
tgcttaggatgtgt

SEQ ID NO: 3244516 - DNA, 16 bp, Homo sapiens
tgcttaggatgtgtgc

SEQ ID NO: 3244517 - DNA, 21 bp, Homo sapiens
tgcttatgacatcacttgtac

SEQ ID NO: 3244518 - DNA, 14 bp, Homo sapiens
tgcttattgcttag

SEQ ID NO: 3244519 - DNA, 23 bp, Homo sapiens
tgcttattgttccaagacattgt

SEQ ID NO: 3244520 - DNA, 19 bp, Homo sapiens
tgcttattgttttattgta

SEQ ID NO: 3244521 - DNA, 16 bp, Homo sapiens
tgcttattttgtttca

SEQ ID NO: 3244522 - DNA, 17 bp, Homo sapiens
tgcttattttgtttcaa

SEQ ID NO: 3244523 - DNA, 16 bp, Homo sapiens
tgcttcaagagaaaat

SEQ ID NO: 3244524 - DNA, 16 bp, Homo sapiens
tgcttcaaggcttcca

SEQ ID NO: 3244525 - DNA, 19 bp, Homo sapiens
tgcttcaagtgttgctctt

SEQ ID NO: 3244526 - DNA, 15 bp, Homo sapiens
tgcttcaatcccagc

SEQ ID NO: 3244527 - DNA, 20 bp, Homo sapiens
tgcttcacagtagagccagc

SEQ ID NO: 3244528 - DNA, 21 bp, Homo sapiens
tgcttcaccatggccttatga

SEQ ID NO: 3244529 - DNA, 19 bp, Homo sapiens
tgcttcagagtttgtgtgt

SEQ ID NO: 3244530 - DNA, 20 bp, Homo sapiens
tgcttcagagtttgtgtgta

SEQ ID NO: 3244531 - DNA, 20 bp, Homo sapiens
tgcttcagatattattgctt

SEQ ID NO: 3244532 - DNA, 12 bp, Homo sapiens
tgcttcagcctg

SEQ ID NO: 3244533 - DNA, 15 bp, Homo sapiens
tgcttcagcctgagg

SEQ ID NO: 3244534 - DNA, 16 bp, Homo sapiens
tgcttcagtggagaat

SEQ ID NO: 3244535 - DNA, 18 bp, Homo sapiens
tgcttcataaatgaagca

SEQ ID NO: 3244536 - DNA, 20 bp, Homo sapiens
tgcttcatttgtatgtcaaa

SEQ ID NO: 3244537 - DNA, 19 bp, Homo sapiens
tgcttccaggaaactccac

SEQ ID NO: 3244538 - DNA, 19 bp, Homo sapiens
tgcttccattaacaaatgc

SEQ ID NO: 3244539 - DNA, 12 bp, Homo sapiens
tgcttcccagag

SEQ ID NO: 3244540 - DNA, 14 bp, Homo sapiens
tgcttcccagaggg

SEQ ID NO: 3244541 - DNA, 17 bp, Homo sapiens
tgcttcccagagggagc

SEQ ID NO: 3244542 - DNA, 18 bp, Homo sapiens
tgcttcccagagggagca

SEQ ID NO: 3244543 - DNA, 20 bp, Homo sapiens
tgcttcccattgtggctcct

SEQ ID NO: 3244544 - DNA, 19 bp, Homo sapiens
tgcttccccttcctaagtc

SEQ ID NO: 3244545 - DNA, 15 bp, Homo sapiens
tgcttccgccactca

SEQ ID NO: 3244546 - DNA, 15 bp, Homo sapiens
tgcttcctcctggaa

SEQ ID NO: 3244547 - DNA, 20 bp, Homo sapiens
tgcttcctgaaataaacact

SEQ ID NO: 3244548 - DNA, 16 bp, Homo sapiens
tgcttcgagccaactc

SEQ ID NO: 3244549 - DNA, 13 bp, Homo sapiens
tgcttctccccag

SEQ ID NO: 3244550 - DNA, 15 bp, Homo sapiens
tgcttctccccagaa

SEQ ID NO: 3244551 - DNA, 14 bp, Homo sapiens
tgcttctctacaga

SEQ ID NO: 3244552 - DNA, 14 bp, Homo sapiens
tgcttctctgactt

SEQ ID NO: 3244553 - DNA, 17 bp, Homo sapiens
tgcttctctgacttctg

SEQ ID NO: 3244554 - DNA, 20 bp, Homo sapiens
tgcttctctgacttctgcct

SEQ ID NO: 3244555 - DNA, 22 bp, Homo sapiens
tgcttctctgacttctgcctgg

SEQ ID NO: 3244556 - DNA, 21 bp, Homo sapiens
tgcttctgcccacaccgcagg

SEQ ID NO: 3244557 - DNA, 13 bp, Homo sapiens
tgcttctgggaga

SEQ ID NO: 3244558 - DNA, 16 bp, Homo sapiens
tgcttcttgtgtttta

SEQ ID NO: 3244559 - DNA, 13 bp, Homo sapiens
tgcttgaacacag

SEQ ID NO: 3244560 - DNA, 16 bp, Homo sapiens
tgcttgaacacagtat

SEQ ID NO: 3244561 - DNA, 20 bp, Homo sapiens
tgcttgacaaatattttcat

SEQ ID NO: 3244562 - DNA, 18 bp, Homo sapiens
tgcttgccaaagtacaga

SEQ ID NO: 3244563 - DNA, 14 bp, Homo sapiens
tgcttgccgagcct

SEQ ID NO: 3244564 - DNA, 19 bp, Homo sapiens
tgcttgctttcttttttaa

SEQ ID NO: 3244565 - DNA, 15 bp, Homo sapiens
tgcttggaagccagg

SEQ ID NO: 3244566 - DNA, 18 bp, Homo sapiens
tgcttggcccggccggcc

SEQ ID NO: 3244567 - DNA, 23 bp, Homo sapiens
tgcttggcccggccggcctggca

SEQ ID NO: 3244568 - DNA, 23 bp, Homo sapiens
tgcttgggaatgaaattaacaca

SEQ ID NO: 3244569 - DNA, 15 bp, Homo sapiens
tgcttggggctattt

SEQ ID NO: 3244570 - DNA, 20 bp, Homo sapiens
tgcttggtggggctcgtggc

SEQ ID NO: 3244571 - DNA, 19 bp, Homo sapiens
tgcttgtaacaagaaaaca

SEQ ID NO: 3244572 - DNA, 17 bp, Homo sapiens
tgcttgtcattgactct

SEQ ID NO: 3244573 - DNA, 22 bp, Homo sapiens
tgcttgtcattgactcttgcgt

SEQ ID NO: 3244574 - DNA, 12 bp, Homo sapiens
tgcttgtgttaa

SEQ ID NO: 3244575 - DNA, 17 bp, Homo sapiens
tgcttgttagagagaaa

SEQ ID NO: 3244576 - DNA, 15 bp, Homo sapiens
tgcttgttgggattc

SEQ ID NO: 3244577 - DNA, 18 bp, Homo sapiens
tgcttgtttatgatattt

SEQ ID NO: 3244578 - DNA, 20 bp, Homo sapiens
tgcttgtttatgatatttct

SEQ ID NO: 3244579 - DNA, 19 bp, Homo sapiens
tgctttaaagggcctgcct

SEQ ID NO: 3244580 - DNA, 15 bp, Homo sapiens
tgctttaattaatta

SEQ ID NO: 3244581 - DNA, 16 bp, Homo sapiens
tgctttatcttttcat

SEQ ID NO: 3244582 - DNA, 15 bp, Homo sapiens
tgctttattaatgtt

SEQ ID NO: 3244583 - DNA, 17 bp, Homo sapiens
tgctttattccagaatg

SEQ ID NO: 3244584 - DNA, 20 bp, Homo sapiens
tgctttccccgggggaggaa

SEQ ID NO: 3244585 - DNA, 14 bp, Homo sapiens
tgctttctgttcca

SEQ ID NO: 3244586 - DNA, 15 bp, Homo sapiens
tgctttctgttccaa

SEQ ID NO: 3244587 - DNA, 22 bp, Homo sapiens
tgctttgaagcagttgtgtcag

SEQ ID NO: 3244588 - DNA, 17 bp, Homo sapiens
tgctttgatttacagca

SEQ ID NO: 3244589 - DNA, 22 bp, Homo sapiens
tgctttgatttacagcaagtag

SEQ ID NO: 3244590 - DNA, 17 bp, Homo sapiens
tgctttgccaagttgct

SEQ ID NO: 3244591 - DNA, 13 bp, Homo sapiens
tgctttgctcttg

SEQ ID NO: 3244592 - DNA, 13 bp, Homo sapiens
tgctttgctgcta

SEQ ID NO: 3244593 - DNA, 16 bp, Homo sapiens
tgctttgctgctatga

SEQ ID NO: 3244594 - DNA, 13 bp, Homo sapiens
tgctttgcttttt

SEQ ID NO: 3244595 - DNA, 14 bp, Homo sapiens
tgctttgcttttta

SEQ ID NO: 3244596 - DNA, 22 bp, Homo sapiens
tgctttggaaaaatgggtcttt

SEQ ID NO: 3244597 - DNA, 21 bp, Homo sapiens
tgctttggacctaaatggcct

SEQ ID NO: 3244598 - DNA, 23 bp, Homo sapiens
tgctttggacctaaatggcctca

SEQ ID NO: 3244599 - DNA, 16 bp, Homo sapiens
tgctttgggctgccct

SEQ ID NO: 3244600 - DNA, 18 bp, Homo sapiens
tgctttgggctgccctgg

SEQ ID NO: 3244601 - DNA, 21 bp, Homo sapiens
tgctttgggctgccctggtgc

SEQ ID NO: 3244602 - DNA, 12 bp, Homo sapiens
tgctttgggctt

SEQ ID NO: 3244603 - DNA, 18 bp, Homo sapiens
tgctttgggctttgcagg

SEQ ID NO: 3244604 - DNA, 22 bp, Homo sapiens
tgctttgtaagatccaccccct

SEQ ID NO: 3244605 - DNA, 17 bp, Homo sapiens
tgctttgtgtgattgaa

SEQ ID NO: 3244606 - DNA, 15 bp, Homo sapiens
tgctttgttttctaa

SEQ ID NO: 3244607 - DNA, 22 bp, Homo sapiens
tgcttttatatggcccagcctt

SEQ ID NO: 3244608 - DNA, 15 bp, Homo sapiens
tgcttttattttgaa

SEQ ID NO: 3244609 - DNA, 23 bp, Homo sapiens
tgcttttcaccaaaatttctaca

SEQ ID NO: 3244610 - DNA, 22 bp, Homo sapiens
tgcttttccaggatcctgcagg

SEQ ID NO: 3244611 - DNA, 16 bp, Homo sapiens
tgcttttctgccctgg

SEQ ID NO: 3244612 - DNA, 21 bp, Homo sapiens
tgcttttggcaaaactctact

SEQ ID NO: 3244613 - DNA, 14 bp, Homo sapiens
tgcttttggtctgt

SEQ ID NO: 3244614 - DNA, 17 bp, Homo sapiens
tgcttttggtctgtgtg

SEQ ID NO: 3244615 - DNA, 19 bp, Homo sapiens
tgcttttgttgtgactttt

SEQ ID NO: 3244616 - DNA, 13 bp, Homo sapiens
tgctttttgaaat

SEQ ID NO: 3244617 - DNA, 20 bp, Homo sapiens
tgctttttgaaatgaaattt

SEQ ID NO: 3244618 - DNA, 17 bp, Homo sapiens
tgctttttgaggtggca

SEQ ID NO: 3244619 - DNA, 19 bp, Homo sapiens
tgcttttttttttccagca

SEQ ID NO: 3244620 - DNA, 15 bp, Homo sapiens
tggaaaaaaacataa

SEQ ID NO: 3244621 - DNA, 20 bp, Homo sapiens
tggaaaaaaacataaaaagc

SEQ ID NO: 3244622 - DNA, 15 bp, Homo sapiens
tggaaaaaagagaaa

SEQ ID NO: 3244623 - DNA, 16 bp, Homo sapiens
tggaaaaacagcatgt

SEQ ID NO: 3244624 - DNA, 12 bp, Homo sapiens
tggaaaaataaa

SEQ ID NO: 3244625 - DNA, 14 bp, Homo sapiens
tggaaaaatagctc

SEQ ID NO: 3244626 - DNA, 17 bp, Homo sapiens
tggccgactctgcactc

SEQ ID NO: 3244627 - DNA, 18 bp, Homo sapiens
tggccgagggtcctggct

SEQ ID NO: 3244628 - DNA, 20 bp, Homo sapiens
tggccgagggtcctggctcc

SEQ ID NO: 3244629 - DNA, 12 bp, Homo sapiens
tggccgccacct

SEQ ID NO: 3244630 - DNA, 13 bp, Homo sapiens
tggccgccacctg

SEQ ID NO: 3244631 - DNA, 19 bp, Homo sapiens
tggccgcgtttagaccaag

SEQ ID NO: 3244632 - DNA, 17 bp, Homo sapiens
tggccgctgagtggcag

SEQ ID NO: 3244633 - DNA, 19 bp, Homo sapiens
tggccggcaaccccagttc

SEQ ID NO: 3244634 - DNA, 17 bp, Homo sapiens
tggccggctgtgctcag

SEQ ID NO: 3244635 - DNA, 14 bp, Homo sapiens
tggccgggcaggcg

SEQ ID NO: 3244636 - DNA, 15 bp, Homo sapiens
tggccgtctcctccc

SEQ ID NO: 3244637 - DNA, 15 bp, Homo sapiens
tggcctaaaatcttg

SEQ ID NO: 3244638 - DNA, 17 bp, Homo sapiens
tggcctagcccaccctg

SEQ ID NO: 3244639 - DNA, 20 bp, Homo sapiens
tggcctagcccaccctgctg

SEQ ID NO: 3244640 - DNA, 19 bp, Homo sapiens
tggcctatccgctgccagc

SEQ ID NO: 3244641 - DNA, 15 bp, Homo sapiens
tggcctatgcacata

SEQ ID NO: 3244642 - DNA, 20 bp, Homo sapiens
tggcctatgcacatatggac

SEQ ID NO: 3244643 - DNA, 19 bp, Homo sapiens
tggcctcaaaacagaagca

SEQ ID NO: 3244644 - DNA, 18 bp, Homo sapiens
tggcctcaagtgattctc

SEQ ID NO: 3244645 - DNA, 15 bp, Homo sapiens
tggcctcacccaccc

SEQ ID NO: 3244646 - DNA, 15 bp, Homo sapiens
tggcctcactggctg

SEQ ID NO: 3244647 - DNA, 19 bp, Homo sapiens
tggcctcactggctggggc

SEQ ID NO: 3244648 - DNA, 20 bp, Homo sapiens
tggcctcactggctggggca

SEQ ID NO: 3244649 - DNA, 15 bp, Homo sapiens
tggcctcagccctca

SEQ ID NO: 3244650 - DNA, 14 bp, Homo sapiens
tggcctcagctgcc

SEQ ID NO: 3244651 - DNA, 16 bp, Homo sapiens
tggcctcagttcccag

SEQ ID NO: 3244652 - DNA, 18 bp, Homo sapiens
tggcctcatgtggctgga

SEQ ID NO: 3244653 - DNA, 19 bp, Homo sapiens
tggcctcatgtggctggaa

SEQ ID NO: 3244654 - DNA, 13 bp, Homo sapiens
tggcctcatttca

SEQ ID NO: 3244655 - DNA, 11 bp, Homo sapiens
tggcctcccac

SEQ ID NO: 3244656 - DNA, 22 bp, Homo sapiens
tggcctcccacccgatgctgct

SEQ ID NO: 3244657 - DNA, 14 bp, Homo sapiens
tggcctcccctgcc

SEQ ID NO: 3244658 - DNA, 21 bp, Homo sapiens
tggcctcccctgccaccaggc

SEQ ID NO: 3244659 - DNA, 23 bp, Homo sapiens
tggcctcccctgccaccaggcca

SEQ ID NO: 3244660 - DNA, 15 bp, Homo sapiens
tggcctccctgctgt

SEQ ID NO: 3244661 - DNA, 19 bp, Homo sapiens
tggcctcgtgaggggcaag

SEQ ID NO: 3244662 - DNA, 16 bp, Homo sapiens
tggcctctggccaggc

SEQ ID NO: 3244663 - DNA, 17 bp, Homo sapiens
tggcctcttgagcagtg

SEQ ID NO: 3244664 - DNA, 16 bp, Homo sapiens
tggcctgaactgagga

SEQ ID NO: 3244665 - DNA, 17 bp, Homo sapiens
tggcctgacttggggga

SEQ ID NO: 3244666 - DNA, 11 bp, Homo sapiens
tggcctgagct

SEQ ID NO: 3244667 - DNA, 22 bp, Homo sapiens
tggcctgctaaggctcctcctt

SEQ ID NO: 3244668 - DNA, 22 bp, Homo sapiens
tggcctgctgggaaccccgcag

SEQ ID NO: 3244669 - DNA, 15 bp, Homo sapiens
tggcctggacagtat

SEQ ID NO: 3244670 - DNA, 16 bp, Homo sapiens
tggcctggcaaaataa

SEQ ID NO: 3244671 - DNA, 13 bp, Homo sapiens
tggcctggccagg

SEQ ID NO: 3244672 - DNA, 17 bp, Homo sapiens
tggcctggccaggagct

SEQ ID NO: 3244673 - DNA, 15 bp, Homo sapiens
tggcctggcctggcc

SEQ ID NO: 3244674 - DNA, 18 bp, Homo sapiens
tggcctggcctggccctg

SEQ ID NO: 3244675 - DNA, 16 bp, Homo sapiens
tggcctgggcgacaga

SEQ ID NO: 3244676 - DNA, 15 bp, Homo sapiens
tggcctgtagagttg

SEQ ID NO: 3244677 - DNA, 18 bp, Homo sapiens
tggcctgtagagttgctg

SEQ ID NO: 3244678 - DNA, 12 bp, Homo sapiens
tggcctgtctca

SEQ ID NO: 3244679 - DNA, 18 bp, Homo sapiens
tggcctgtctcatcccca

SEQ ID NO: 3244680 - DNA, 13 bp, Homo sapiens
tggcctgtgtcca

SEQ ID NO: 3244681 - DNA, 17 bp, Homo sapiens
tggcctgtgtccagcag

SEQ ID NO: 3244682 - DNA, 20 bp, Homo sapiens
tggcctgtgtccagcagctg

SEQ ID NO: 3244683 - DNA, 16 bp, Homo sapiens
tggcctgtgtcccatg

SEQ ID NO: 3244684 - DNA, 20 bp, Homo sapiens
tggcctgtgtcccatgaccc

SEQ ID NO: 3244685 - DNA, 21 bp, Homo sapiens
tggcctgtgtcccatgaccca

SEQ ID NO: 3244686 - DNA, 20 bp, Homo sapiens
tggcctgtttctgcagccct

SEQ ID NO: 3244687 - DNA, 18 bp, Homo sapiens
tggccttccatttatatg

SEQ ID NO: 3244688 - DNA, 14 bp, Homo sapiens
tggccttcctgccc

SEQ ID NO: 3244689 - DNA, 23 bp, Homo sapiens
tggccttcggcctccatcctgag

SEQ ID NO: 3244690 - DNA, 18 bp, Homo sapiens
tggccttctgctgcccag

SEQ ID NO: 3244691 - DNA, 22 bp, Homo sapiens
tggccttctgctgcccaggcca

SEQ ID NO: 3244692 - DNA, 15 bp, Homo sapiens
tggccttgaaacagt

SEQ ID NO: 3244693 - DNA, 21 bp, Homo sapiens
tggccttggcttttctagcct

SEQ ID NO: 3244694 - DNA, 13 bp, Homo sapiens
tggcctttgcatt

SEQ ID NO: 3244695 - DNA, 15 bp, Homo sapiens
tggcctttgcattta

SEQ ID NO: 3244696 - DNA, 18 bp, Homo sapiens
tggcctttgcttatgaat

SEQ ID NO: 3244697 - DNA, 21 bp, Homo sapiens
tggcgcaacaggagtcagtct

SEQ ID NO: 3244698 - DNA, 16 bp, Homo sapiens
tggcgcaggtgggctg

SEQ ID NO: 3244699 - DNA, 14 bp, Homo sapiens
tggcgcccaggggc

SEQ ID NO: 3244700 - DNA, 13 bp, Homo sapiens
tggcgcgggaggc

SEQ ID NO: 3244701 - DNA, 16 bp, Homo sapiens
tggcgcgggaggcacc

SEQ ID NO: 3244702 - DNA, 23 bp, Homo sapiens
tggcgcgggaggcaccagctctg

SEQ ID NO: 3244703 - DNA, 20 bp, Homo sapiens
tggcgcttagagaggacaat

SEQ ID NO: 3244704 - DNA, 17 bp, Homo sapiens
tggcggcagggccaggc

SEQ ID NO: 3244705 - DNA, 19 bp, Homo sapiens
tggcgggatgggccaccgc

SEQ ID NO: 3244706 - DNA, 16 bp, Homo sapiens
tggcggtggctgcccc

SEQ ID NO: 3244707 - DNA, 18 bp, Homo sapiens
tggcgtaatgggcctgcc

SEQ ID NO: 3244708 - DNA, 19 bp, Homo sapiens
tggcgtctgcatacgagag

SEQ ID NO: 3244709 - DNA, 18 bp, Homo sapiens
tggcgtgggagccagcct

SEQ ID NO: 3244710 - DNA, 18 bp, Homo sapiens
tggcgtgtccctctcgga

SEQ ID NO: 3244711 - DNA, 14 bp, Homo sapiens
tggctaataaactg

SEQ ID NO: 3244712 - DNA, 18 bp, Homo sapiens
tggctaataaactgtatt

SEQ ID NO: 3244713 - DNA, 16 bp, Homo sapiens
tggctaatttaacacc

SEQ ID NO: 3244714 - DNA, 20 bp, Homo sapiens
tggctacatcccagcctgtg

SEQ ID NO: 3244715 - DNA, 22 bp, Homo sapiens
tggctactttggtttctgtctg

SEQ ID NO: 3244716 - DNA, 18 bp, Homo sapiens
tggctagagtcctcactc

SEQ ID NO: 3244717 - DNA, 12 bp, Homo sapiens
tggctagagttt

SEQ ID NO: 3244718 - DNA, 17 bp, Homo sapiens
tggctagagtttccact

SEQ ID NO: 3244719 - DNA, 15 bp, Homo sapiens
tggctagtccttgtt

SEQ ID NO: 3244720 - DNA, 22 bp, Homo sapiens
tggctataacatgtctttcagc

SEQ ID NO: 3244721 - DNA, 21 bp, Homo sapiens
tggctatatggcaagaaagct

SEQ ID NO: 3244722 - DNA, 23 bp, Homo sapiens
tggctatcaaaagaaatagaaaa

SEQ ID NO: 3244723 - DNA, 12 bp, Homo sapiens
tggctatttgaa

SEQ ID NO: 3244724 - DNA, 17 bp, Homo sapiens
tggctcaagtagaaaag

SEQ ID NO: 3244725 - DNA, 24 bp, Homo sapiens
tggctcacagtacagcatgtgcct

SEQ ID NO: 3244726 - DNA, 13 bp, Homo sapiens
tggctcacgcctg

SEQ ID NO: 3244727 - DNA, 22 bp, Homo sapiens
tggctcatggcgtaatgggcct

SEQ ID NO: 3244728 - DNA, 23 bp, Homo sapiens
tggctcatggcgtaatgggcctg

SEQ ID NO: 3244729 - DNA, 18 bp, Homo sapiens
tggctccacacctccacc

SEQ ID NO: 3244730 - DNA, 20 bp, Homo sapiens
tggctccagaaatgtctaaa

SEQ ID NO: 3244731 - DNA, 19 bp, Homo sapiens
tggctccatgattctctga

SEQ ID NO: 3244732 - DNA, 15 bp, Homo sapiens
tggctccatgctcct

SEQ ID NO: 3244733 - DNA, 17 bp, Homo sapiens
tggctcccacaggccct

SEQ ID NO: 3244734 - DNA, 20 bp, Homo sapiens
tggctcccatgaccatactg

SEQ ID NO: 3244735 - DNA, 23 bp, Homo sapiens
tggctcccatgaccatactgagg

SEQ ID NO: 3244736 - DNA, 19 bp, Homo sapiens
tggctcccgcggtgccatg

SEQ ID NO: 3244737 - DNA, 20 bp, Homo sapiens
tggctccctcctccaggcct

SEQ ID NO: 3244738 - DNA, 19 bp, Homo sapiens
tggctccgaacaccctcga

SEQ ID NO: 3244739 - DNA, 19 bp, Homo sapiens
tggctcctcccggtgccca

SEQ ID NO: 3244740 - DNA, 13 bp, Homo sapiens
tggctcctgagaa

SEQ ID NO: 3244741 - DNA, 17 bp, Homo sapiens
tggctccttcccatcgc

SEQ ID NO: 3244742 - DNA, 15 bp, Homo sapiens
tggctcctttacaaa

SEQ ID NO: 3244743 - DNA, 16 bp, Homo sapiens
tggctcctttacaaaa

SEQ ID NO: 3244744 - DNA, 18 bp, Homo sapiens
tggctcgaatctctgtgc

SEQ ID NO: 3244745 - DNA, 19 bp, Homo sapiens
tggctcgaatctctgtgcc

SEQ ID NO: 3244746 - DNA, 15 bp, Homo sapiens
tggctcgctccctgt

SEQ ID NO: 3244747 - DNA, 21 bp, Homo sapiens
tggctctcagttaaaatgtga

SEQ ID NO: 3244748 - DNA, 19 bp, Homo sapiens
tggctctccaagtgccaga

SEQ ID NO: 3244749 - DNA, 21 bp, Homo sapiens
tggctctgaggtgcctgtccc

SEQ ID NO: 3244750 - DNA, 13 bp, Homo sapiens
tggctctgccagt

SEQ ID NO: 3244751 - DNA, 11 bp, Homo sapiens
tggctctggga

SEQ ID NO: 3244752 - DNA, 16 bp, Homo sapiens
tgggtggcacctcctg

SEQ ID NO: 3244753 - DNA, 15 bp, Homo sapiens
tgggtggcctcggga

SEQ ID NO: 3244754 - DNA, 13 bp, Homo sapiens
tgggtgggggctc

SEQ ID NO: 3244755 - DNA, 22 bp, Homo sapiens
tgggtggtaccctctggagggg

SEQ ID NO: 3244756 - DNA, 22 bp, Homo sapiens
tgggtgtcctgcagaagaagct

SEQ ID NO: 3244757 - DNA, 17 bp, Homo sapiens
tgggtgtctccttaagc

SEQ ID NO: 3244758 - DNA, 15 bp, Homo sapiens
tgggtgtgggtggaa

SEQ ID NO: 3244759 - DNA, 15 bp, Homo sapiens
tgggtgtttcagttt

SEQ ID NO: 3244760 - DNA, 16 bp, Homo sapiens
tgggttaatggctagt

SEQ ID NO: 3244761 - DNA, 11 bp, Homo sapiens
tgggttcatta

SEQ ID NO: 3244762 - DNA, 16 bp, Homo sapiens
tgggttccatcttgct

SEQ ID NO: 3244763 - DNA, 16 bp, Homo sapiens
tgggttcttgttttat

SEQ ID NO: 3244764 - DNA, 21 bp, Homo sapiens
tgggttctttttcttgtcatt

SEQ ID NO: 3244765 - DNA, 18 bp, Homo sapiens
tgggttgaatatagcctg

SEQ ID NO: 3244766 - DNA, 20 bp, Homo sapiens
tgggttgaatatagcctgcc

SEQ ID NO: 3244767 - DNA, 23 bp, Homo sapiens
tgggttgaatatagcctgcctca

SEQ ID NO: 3244768 - DNA, 18 bp, Homo sapiens
tgggttgggggcactcag

SEQ ID NO: 3244769 - DNA, 23 bp, Homo sapiens
tgggtttcccttgccctttccat

SEQ ID NO: 3244770 - DNA, 14 bp, Homo sapiens
tgggtttcctgcag

SEQ ID NO: 3244771 - DNA, 20 bp, Homo sapiens
tgggtttggaccccagctgg

SEQ ID NO: 3244772 - DNA, 18 bp, Homo sapiens
tgggttttccgcccacag

SEQ ID NO: 3244773 - DNA, 21 bp, Homo sapiens
tgggtttttttttttaaaaaa

SEQ ID NO: 3244774 - DNA, 17 bp, Homo sapiens
tggtaaaaatgctgctc

SEQ ID NO: 3244775 - DNA, 19 bp, Homo sapiens
tggtaaaccaagcctccca

SEQ ID NO: 3244776 - DNA, 13 bp, Homo sapiens
tggtaaatgtttc

SEQ ID NO: 3244777 - DNA, 21 bp, Homo sapiens
tggtaaattagtatttattta

SEQ ID NO: 3244778 - DNA, 15 bp, Homo sapiens
tggtaacagctctct

SEQ ID NO: 3244779 - DNA, 21 bp, Homo sapiens
tggtaacagttcatgtttgct

SEQ ID NO: 3244780 - DNA, 22 bp, Homo sapiens
tggtaactgctttctgttccaa

SEQ ID NO: 3244781 - DNA, 20 bp, Homo sapiens
tggtaagagacagaatgtat

SEQ ID NO: 3244782 - DNA, 20 bp, Homo sapiens
tggtaagcaacatggctttg

SEQ ID NO: 3244783 - DNA, 16 bp, Homo sapiens
tggtaataagcactgt

SEQ ID NO: 3244784 - DNA, 22 bp, Homo sapiens
tggtaatttaagattccagaga

SEQ ID NO: 3244785 - DNA, 13 bp, Homo sapiens
tggtacatgtctt

SEQ ID NO: 3244786 - DNA, 14 bp, Homo sapiens
tggtaccagccctg

SEQ ID NO: 3244787 - DNA, 13 bp, Homo sapiens
tggtacccagcca

SEQ ID NO: 3244788 - DNA, 17 bp, Homo sapiens
tggtacccccttctggg

SEQ ID NO: 3244789 - DNA, 14 bp, Homo sapiens
tggtaccctctgga

SEQ ID NO: 3244790 - DNA, 13 bp, Homo sapiens
tggtacctgccct

SEQ ID NO: 3244791 - DNA, 17 bp, Homo sapiens
tggtactagtgtggtgt

SEQ ID NO: 3244792 - DNA, 19 bp, Homo sapiens
tggtactagtgtggtgtgt

SEQ ID NO: 3244793 - DNA, 13 bp, Homo sapiens
tggtactctccta

SEQ ID NO: 3244794 - DNA, 17 bp, Homo sapiens
tggtactgactttgctt

SEQ ID NO: 3244795 - DNA, 19 bp, Homo sapiens
tggtactgctgtcttccaa

SEQ ID NO: 3244796 - DNA, 20 bp, Homo sapiens
tggtagaattggagagtaaa

SEQ ID NO: 3244797 - DNA, 13 bp, Homo sapiens
tggtagagattca

SEQ ID NO: 3244798 - DNA, 13 bp, Homo sapiens
tggtagaggcctg

SEQ ID NO: 3244799 - DNA, 17 bp, Homo sapiens
tggtagaggcctggggc

SEQ ID NO: 3244800 - DNA, 17 bp, Homo sapiens
tggtagattaaatatag

SEQ ID NO: 3244801 - DNA, 19 bp, Homo sapiens
tggtagattaaatatagat

SEQ ID NO: 3244802 - DNA, 22 bp, Homo sapiens
tggtagcataaataaaactgaa

SEQ ID NO: 3244803 - DNA, 23 bp, Homo sapiens
tggtagcataaataaaactgaat

SEQ ID NO: 3244804 - DNA, 16 bp, Homo sapiens
tggtaggaccaagcat

SEQ ID NO: 3244805 - DNA, 16 bp, Homo sapiens
tggtaggcatttccta

SEQ ID NO: 3244806 - DNA, 21 bp, Homo sapiens
tggtaggccttttaacatttt

SEQ ID NO: 3244807 - DNA, 18 bp, Homo sapiens
tggtaggttgggacacca

SEQ ID NO: 3244808 - DNA, 17 bp, Homo sapiens
tggtagttagtagcatg

SEQ ID NO: 3244809 - DNA, 18 bp, Homo sapiens
tggtagttagtagcatgt

SEQ ID NO: 3244810 - DNA, 15 bp, Homo sapiens
tggtataatgtttaa

SEQ ID NO: 3244811 - DNA, 19 bp, Homo sapiens
tggtataatgtttaaatca

SEQ ID NO: 3244812 - DNA, 22 bp, Homo sapiens
tggtataatgtttaaatcatgt

SEQ ID NO: 3244813 - DNA, 19 bp, Homo sapiens
tggtatatccaaaagcttt

SEQ ID NO: 3244814 - DNA, 16 bp, Homo sapiens
tggtatcaaaattaca

SEQ ID NO: 3244815 - DNA, 14 bp, Homo sapiens
tggtatcctactga

SEQ ID NO: 3244816 - DNA, 22 bp, Homo sapiens
tggtatcctgtgacatgtaaca

SEQ ID NO: 3244817 - DNA, 18 bp, Homo sapiens
tggtatgaataattgcat

SEQ ID NO: 3244818 - DNA, 18 bp, Homo sapiens
tggtatgatcacggctca

SEQ ID NO: 3244819 - DNA, 15 bp, Homo sapiens
tggtatgctggccag

SEQ ID NO: 3244820 - DNA, 21 bp, Homo sapiens
tggtatgctggccagcaccct

SEQ ID NO: 3244821 - DNA, 22 bp, Homo sapiens
tggtatgctggccagcaccctc

SEQ ID NO: 3244822 - DNA, 20 bp, Homo sapiens
tggtatgtaatttatgcaag

SEQ ID NO: 3244823 - DNA, 13 bp, Homo sapiens
tggtatgtctctt

SEQ ID NO: 3244824 - DNA, 19 bp, Homo sapiens
tggtatgtgacaccaaagc

SEQ ID NO: 3244825 - DNA, 15 bp, Homo sapiens
tggtattacacagtc

SEQ ID NO: 3244826 - DNA, 21 bp, Homo sapiens
tggtattctgttctggaggaa

SEQ ID NO: 3244827 - DNA, 15 bp, Homo sapiens
tggtatttgctgtca

SEQ ID NO: 3244828 - DNA, 17 bp, Homo sapiens
tggtcaaaagctggatt

SEQ ID NO: 3244829 - DNA, 23 bp, Homo sapiens
tggtcaagggctgtcattgcaca

SEQ ID NO: 3244830 - DNA, 22 bp, Homo sapiens
tggtcaatccgaagtatgaggg

SEQ ID NO: 3244831 - DNA, 15 bp, Homo sapiens
tggtcacagcggagg

SEQ ID NO: 3244832 - DNA, 13 bp, Homo sapiens
tggtcacagggca

SEQ ID NO: 3244833 - DNA, 17 bp, Homo sapiens
tggtcacagggcatgcc

SEQ ID NO: 3244834 - DNA, 20 bp, Homo sapiens
tggtcaccaaatcagctgct

SEQ ID NO: 3244835 - DNA, 21 bp, Homo sapiens
tggtcaccaaatcagctgcta

SEQ ID NO: 3244836 - DNA, 23 bp, Homo sapiens
tggtcaccaaatcagctgctact

SEQ ID NO: 3244837 - DNA, 15 bp, Homo sapiens
tggtcactatagctc

SEQ ID NO: 3244838 - DNA, 13 bp, Homo sapiens
tggtcactgctgt

SEQ ID NO: 3244839 - DNA, 18 bp, Homo sapiens
tggtcactgtgcactgcc

SEQ ID NO: 3244840 - DNA, 19 bp, Homo sapiens
tggtcagaactgcagggcc

SEQ ID NO: 3244841 - DNA, 10 bp, Homo sapiens
tggtcagagg

SEQ ID NO: 3244842 - DNA, 12 bp, Homo sapiens
tggtcagaggag

SEQ ID NO: 3244843 - DNA, 17 bp, Homo sapiens
tggtcagcgttgcatgt

SEQ ID NO: 3244844 - DNA, 22 bp, Homo sapiens
tggtcagtttggttgtgtaaga

SEQ ID NO: 3244845 - DNA, 16 bp, Homo sapiens
tggtccaaaaaaagga

SEQ ID NO: 3244846 - DNA, 19 bp, Homo sapiens
tggtccaaaaaaaggaaaa

SEQ ID NO: 3244847 - DNA, 15 bp, Homo sapiens
tggtccaattagttt

SEQ ID NO: 3244848 - DNA, 12 bp, Homo sapiens
tggtccagagcg

SEQ ID NO: 3244849 - DNA, 14 bp, Homo sapiens
tggtccagctctga

SEQ ID NO: 3244850 - DNA, 16 bp, Homo sapiens
tggtccagctctgaca

SEQ ID NO: 3244851 - DNA, 17 bp, Homo sapiens
tggtccagggaagctgg

SEQ ID NO: 3244852 - DNA, 15 bp, Homo sapiens
tggtcccatccaggc

SEQ ID NO: 3244853 - DNA, 16 bp, Homo sapiens
tggtcccctcctcagt

SEQ ID NO: 3244854 - DNA, 23 bp, Homo sapiens
tggtccctcgtccacaggggcag

SEQ ID NO: 3244855 - DNA, 14 bp, Homo sapiens
tggtccctgggagg

SEQ ID NO: 3244856 - DNA, 20 bp, Homo sapiens
tggtccgtgggacggtgccc

SEQ ID NO: 3244857 - DNA, 22 bp, Homo sapiens
tggtcctgactcaacatgttac

SEQ ID NO: 3244858 - DNA, 12 bp, Homo sapiens
tggtcctgactt

SEQ ID NO: 3244859 - DNA, 23 bp, Homo sapiens
tggtccttccaggcccccaccac

SEQ ID NO: 3244860 - DNA, 17 bp, Homo sapiens
tggtcctttctggaagt

SEQ ID NO: 3244861 - DNA, 22 bp, Homo sapiens
tggtcggggagctggggtacag

SEQ ID NO: 3244862 - DNA, 17 bp, Homo sapiens
tggtctaacactggcat

SEQ ID NO: 3244863 - DNA, 24 bp, Homo sapiens
tggtctagaaatgcggtctggtct

SEQ ID NO: 3244864 - DNA, 12 bp, Homo sapiens
tggtctattttc

SEQ ID NO: 3244865 - DNA, 16 bp, Homo sapiens
tggtctcaaactcctg

SEQ ID NO: 3244866 - DNA, 23 bp, Homo sapiens
tggtctcaaactcttgacctcag

SEQ ID NO: 3244867 - DNA, 23 bp, Homo sapiens
tggtctcaggatatccttatcag

SEQ ID NO: 3244868 - DNA, 15 bp, Homo sapiens
tggtctcccttctct

SEQ ID NO: 3244869 - DNA, 21 bp, Homo sapiens
tggtctccttgcactttctca

SEQ ID NO: 3244870 - DNA, 20 bp, Homo sapiens
tggtctcgatctcctgacct

SEQ ID NO: 3244871 - DNA, 18 bp, Homo sapiens
tggtctgaatgttctgac

SEQ ID NO: 3244872 - DNA, 22 bp, Homo sapiens
tggtctgaatgttctgacatta

SEQ ID NO: 3244873 - DNA, 16 bp, Homo sapiens
tggtctgacccactgc

SEQ ID NO: 3244874 - DNA, 18 bp, Homo sapiens
tggtctgacccactgctt

SEQ ID NO: 3244875 - DNA, 16 bp, Homo sapiens
tggtctgatttcagga

SEQ ID NO: 3244876 - DNA, 17 bp, Homo sapiens
tggtctggttgggcagc

SEQ ID NO: 3244877 - DNA, 14 bp, Homo sapiens
tgtaccagttaatt

SEQ ID NO: 3244878 - DNA, 14 bp, Homo sapiens
tgtaccatttgcct

SEQ ID NO: 3244879 - DNA, 15 bp, Homo sapiens
tgtacccagatgcct

SEQ ID NO: 3244880 - DNA, 16 bp, Homo sapiens
tgtaccccccaacccc

SEQ ID NO: 3244881 - DNA, 22 bp, Homo sapiens
tgtacccttccacctcctagag

SEQ ID NO: 3244882 - DNA, 15 bp, Homo sapiens
tgtacctcctctcag

SEQ ID NO: 3244883 - DNA, 20 bp, Homo sapiens
tgtacctcctctcagtgttt

SEQ ID NO: 3244884 - DNA, 19 bp, Homo sapiens
tgtacctgtgtacataact

SEQ ID NO: 3244885 - DNA, 18 bp, Homo sapiens
tgtaccttctttcactct

SEQ ID NO: 3244886 - DNA, 17 bp, Homo sapiens
tgtacgtctgacaggca

SEQ ID NO: 3244887 - DNA, 16 bp, Homo sapiens
tgtacgtttgtatgtg

SEQ ID NO: 3244888 - DNA, 14 bp, Homo sapiens
tgtactaaacagta

SEQ ID NO: 3244889 - DNA, 20 bp, Homo sapiens
tgtactaaacagtaagatat

SEQ ID NO: 3244890 - DNA, 19 bp, Homo sapiens
tgtactagtctgtgtggga

SEQ ID NO: 3244891 - DNA, 13 bp, Homo sapiens
tgtactagtttta

SEQ ID NO: 3244892 - DNA, 19 bp, Homo sapiens
tgtactataagtagttggt

SEQ ID NO: 3244893 - DNA, 15 bp, Homo sapiens
tgtactcagagcaga

SEQ ID NO: 3244894 - DNA, 13 bp, Homo sapiens
tgtactcctccca

SEQ ID NO: 3244895 - DNA, 15 bp, Homo sapiens
tgtactcttaggata

SEQ ID NO: 3244896 - DNA, 16 bp, Homo sapiens
tgtactcttaggatat

SEQ ID NO: 3244897 - DNA, 19 bp, Homo sapiens
tgtactcttaggatatttg

SEQ ID NO: 3244898 - DNA, 13 bp, Homo sapiens
tgtactcttgctg

SEQ ID NO: 3244899 - DNA, 22 bp, Homo sapiens
tgtactgagccttgtaattcta

SEQ ID NO: 3244900 - DNA, 18 bp, Homo sapiens
tgtactgcatgttaccat

SEQ ID NO: 3244901 - DNA, 19 bp, Homo sapiens
tgtactgggttaatggcta

SEQ ID NO: 3244902 - DNA, 19 bp, Homo sapiens
tgtactgtgtcataaacag

SEQ ID NO: 3244903 - DNA, 19 bp, Homo sapiens
tgtactgttctgtgtcttt

SEQ ID NO: 3244904 - DNA, 15 bp, Homo sapiens
tgtacttaaatggta

SEQ ID NO: 3244905 - DNA, 16 bp, Homo sapiens
tgtacttaataaattc

SEQ ID NO: 3244906 - DNA, 20 bp, Homo sapiens
tgtacttaataaattcagat

SEQ ID NO: 3244907 - DNA, 16 bp, Homo sapiens
tgtacttctgtgttca

SEQ ID NO: 3244908 - DNA, 20 bp, Homo sapiens
tgtacttctgtgttcatttt

SEQ ID NO: 3244909 - DNA, 18 bp, Homo sapiens
tgtacttcttattgcaag

SEQ ID NO: 3244910 - DNA, 18 bp, Homo sapiens
tgtacttgatactgaatg

SEQ ID NO: 3244911 - DNA, 22 bp, Homo sapiens
tgtacttggagtattggggtct

SEQ ID NO: 3244912 - DNA, 22 bp, Homo sapiens
tgtacttgtgtttgcttaaaca

SEQ ID NO: 3244913 - DNA, 14 bp, Homo sapiens
tgtacttgtttgca

SEQ ID NO: 3244914 - DNA, 20 bp, Homo sapiens
tgtactttatcatgaatgct

SEQ ID NO: 3244915 - DNA, 21 bp, Homo sapiens
tgtactttgccatttttctat

SEQ ID NO: 3244916 - DNA, 23 bp, Homo sapiens
tgtactttgccatttttctataa

SEQ ID NO: 3244917 - DNA, 18 bp, Homo sapiens
tgtactttgcttgctcat

SEQ ID NO: 3244918 - DNA, 16 bp, Homo sapiens
tgtacttttaaggcag

SEQ ID NO: 3244919 - DNA, 17 bp, Homo sapiens
tgtacttttcattctct

SEQ ID NO: 3244920 - DNA, 22 bp, Homo sapiens
tgtacttttcattctcttttaa

SEQ ID NO: 3244921 - DNA, 20 bp, Homo sapiens
tgtactttttagtaatttct

SEQ ID NO: 3244922 - DNA, 21 bp, Homo sapiens
tgtactttttagtaatttctt

SEQ ID NO: 3244923 - DNA, 18 bp, Homo sapiens
tgtactttttagttgttc

SEQ ID NO: 3244924 - DNA, 15 bp, Homo sapiens
tgtagaacactaatt

SEQ ID NO: 3244925 - DNA, 17 bp, Homo sapiens
tgtagaacactaattca

SEQ ID NO: 3244926 - DNA, 17 bp, Homo sapiens
tgtagaactcactctgg

SEQ ID NO: 3244927 - DNA, 17 bp, Homo sapiens
tgtagaactcagcagtt

SEQ ID NO: 3244928 - DNA, 19 bp, Homo sapiens
tgtagaactcagcagttga

SEQ ID NO: 3244929 - DNA, 13 bp, Homo sapiens
tgtagaagcattc

SEQ ID NO: 3244930 - DNA, 22 bp, Homo sapiens
tgtagaagcattccttctttga

SEQ ID NO: 3244931 - DNA, 16 bp, Homo sapiens
tgtagaatgatttcat

SEQ ID NO: 3244932 - DNA, 16 bp, Homo sapiens
tgtagaattgttatag

SEQ ID NO: 3244933 - DNA, 21 bp, Homo sapiens
tgtagacctagggaggacctt

SEQ ID NO: 3244934 - DNA, 11 bp, Homo sapiens
tgtagactagt

SEQ ID NO: 3244935 - DNA, 15 bp, Homo sapiens
tgtagactatataca

SEQ ID NO: 3244936 - DNA, 16 bp, Homo sapiens
tgtagactatatacat

SEQ ID NO: 3244937 - DNA, 19 bp, Homo sapiens
tgtagactatatacatgtg

SEQ ID NO: 3244938 - DNA, 21 bp, Homo sapiens
tgtagactatatacatgtgtg

SEQ ID NO: 3244939 - DNA, 22 bp, Homo sapiens
tgtagactgatgttttagcatt

SEQ ID NO: 3244940 - DNA, 18 bp, Homo sapiens
tgtagagccagggtctca

SEQ ID NO: 3244941 - DNA, 14 bp, Homo sapiens
tgtagagcttctgg

SEQ ID NO: 3244942 - DNA, 13 bp, Homo sapiens
tgtagagttgctg

SEQ ID NO: 3244943 - DNA, 20 bp, Homo sapiens
tgtagagttgctgagagggc

SEQ ID NO: 3244944 - DNA, 22 bp, Homo sapiens
tgtagatattgtgaagtacata

SEQ ID NO: 3244945 - DNA, 19 bp, Homo sapiens
tgtagatatttggcttaaa

SEQ ID NO: 3244946 - DNA, 22 bp, Homo sapiens
tgtagatcccaagatgactggg

SEQ ID NO: 3244947 - DNA, 19 bp, Homo sapiens
tgtagatgctaacgtgtca

SEQ ID NO: 3244948 - DNA, 20 bp, Homo sapiens
tgtagatgggggaactgtga

SEQ ID NO: 3244949 - DNA, 19 bp, Homo sapiens
tgtagattaggattaaaat

SEQ ID NO: 3244950 - DNA, 22 bp, Homo sapiens
tgtagcaaaattcttaagtatg

SEQ ID NO: 3244951 - DNA, 14 bp, Homo sapiens
tgtagcactgaggg

SEQ ID NO: 3244952 - DNA, 19 bp, Homo sapiens
tgtagcacttactggtagg

SEQ ID NO: 3244953 - DNA, 17 bp, Homo sapiens
tgtagcaggttctaggc

SEQ ID NO: 3244954 - DNA, 12 bp, Homo sapiens
tgtagcataact

SEQ ID NO: 3244955 - DNA, 10 bp, Homo sapiens
tgtagccaag

SEQ ID NO: 3244956 - DNA, 17 bp, Homo sapiens
tgtagccaggtatggct

SEQ ID NO: 3244957 - DNA, 16 bp, Homo sapiens
tgtagccatctgcaca

SEQ ID NO: 3244958 - DNA, 17 bp, Homo sapiens
tgtagccatggctcagg

SEQ ID NO: 3244959 - DNA, 21 bp, Homo sapiens
tgtagccatggctcaggcaag

SEQ ID NO: 3244960 - DNA, 15 bp, Homo sapiens
tgtagcctaaagggc

SEQ ID NO: 3244961 - DNA, 22 bp, Homo sapiens
tgtagcctaaagggcagggccc

SEQ ID NO: 3244962 - DNA, 14 bp, Homo sapiens
tgtagcctgtgcat

SEQ ID NO: 3244963 - DNA, 16 bp, Homo sapiens
tgtagcctgtgcatgt

SEQ ID NO: 3244964 - DNA, 21 bp, Homo sapiens
tgtagcgtgtttacatgtgta

SEQ ID NO: 3244965 - DNA, 14 bp, Homo sapiens
tgtagctcaagttt

SEQ ID NO: 3244966 - DNA, 13 bp, Homo sapiens
tgtagctgtaaaa

SEQ ID NO: 3244967 - DNA, 16 bp, Homo sapiens
tgtagctgtaagggca

SEQ ID NO: 3244968 - DNA, 17 bp, Homo sapiens
tgtagctttcctggtcc

SEQ ID NO: 3244969 - DNA, 15 bp, Homo sapiens
tgtagctttgctctt

SEQ ID NO: 3244970 - DNA, 18 bp, Homo sapiens
tgtaggagaaactcccat

SEQ ID NO: 3244971 - DNA, 15 bp, Homo sapiens
tgtaggagctgcctt

SEQ ID NO: 3244972 - DNA, 22 bp, Homo sapiens
tgtaggagctgccttggctcag

SEQ ID NO: 3244973 - DNA, 22 bp, Homo sapiens
tgtaggctggggcggggcccag

SEQ ID NO: 3244974 - DNA, 13 bp, Homo sapiens
tgtagggagggcg

SEQ ID NO: 3244975 - DNA, 14 bp, Homo sapiens
tgtaggggccacct

SEQ ID NO: 3244976 - DNA, 16 bp, Homo sapiens
tgtaggggccacctcc

SEQ ID NO: 3244977 - DNA, 18 bp, Homo sapiens
tgtaggggccacctcctc

SEQ ID NO: 3244978 - DNA, 22 bp, Homo sapiens
tgtaggggttaacttggtcaga

SEQ ID NO: 3244979 - DNA, 14 bp, Homo sapiens
tgtaggtaagactg

SEQ ID NO: 3244980 - DNA, 15 bp, Homo sapiens
tgtaggtaagactgt

SEQ ID NO: 3244981 - DNA, 16 bp, Homo sapiens
tgtaggtggtatgtga

SEQ ID NO: 3244982 - DNA, 18 bp, Homo sapiens
tgtaggttatctttttaa

SEQ ID NO: 3244983 - DNA, 19 bp, Homo sapiens
tgtagtaaactatttatct

SEQ ID NO: 3244984 - DNA, 16 bp, Homo sapiens
tgtagtaattgacatg

SEQ ID NO: 3244985 - DNA, 19 bp, Homo sapiens
tgtagtaattgacatgtgc

SEQ ID NO: 3244986 - DNA, 20 bp, Homo sapiens
tgtagtcatttactaaacat

SEQ ID NO: 3244987 - DNA, 12 bp, Homo sapiens
tgtagtctctga

SEQ ID NO: 3244988 - DNA, 13 bp, Homo sapiens
tgtagtggaagag

SEQ ID NO: 3244989 - DNA, 15 bp, Homo sapiens
tgtagtggaagagca

SEQ ID NO: 3244990 - DNA, 18 bp, Homo sapiens
tgtagtggaagagcagcc

SEQ ID NO: 3244991 - DNA, 21 bp, Homo sapiens
tgtagtggaagagcagcctga

SEQ ID NO: 3244992 - DNA, 23 bp, Homo sapiens
tgtagtggctcatgcctgtaatc

SEQ ID NO: 3244993 - DNA, 23 bp, Homo sapiens
tgtagtggcttcttttgaactgt

SEQ ID NO: 3244994 - DNA, 23 bp, Homo sapiens
tgtagtgtgtgcttacagtaact

SEQ ID NO: 3244995 - DNA, 18 bp, Homo sapiens
tgtagttaatttatctaa

SEQ ID NO: 3244996 - DNA, 18 bp, Homo sapiens
tgtagttctgccaggcaa

SEQ ID NO: 3244997 - DNA, 16 bp, Homo sapiens
tgtagttctgtgtact

SEQ ID NO: 3244998 - DNA, 17 bp, Homo sapiens
tgtagttctgtgtactt

SEQ ID NO: 3244999 - DNA, 15 bp, Homo sapiens
tgtagttgcgtggac

SEQ ID NO: 3245000 - DNA, 21 bp, Homo sapiens
tgtagttgcgtggactctgca

SEQ ID NO: 3245001 - DNA, 19 bp, Homo sapiens
tgtagtttttcttcaacat

SEQ ID NO: 3245002 - DNA, 16 bp, Homo sapiens
tgtcctctcgagccca

SEQ ID NO: 3245003 - DNA, 15 bp, Homo sapiens
tgtcctcttgctcaa

SEQ ID NO: 3245004 - DNA, 12 bp, Homo sapiens
tgtcctgaccac

SEQ ID NO: 3245005 - DNA, 20 bp, Homo sapiens
tgtcctgaccaccctcccct

SEQ ID NO: 3245006 - DNA, 18 bp, Homo sapiens
tgtcctgatggtcagctc

SEQ ID NO: 3245007 - DNA, 12 bp, Homo sapiens
tgtcctgatttc

SEQ ID NO: 3245008 - DNA, 15 bp, Homo sapiens
tgtcctgccagctgc

SEQ ID NO: 3245009 - DNA, 18 bp, Homo sapiens
tgtcctgctggcttccag

SEQ ID NO: 3245010 - DNA, 15 bp, Homo sapiens
tgtcctgcttctgaa

SEQ ID NO: 3245011 - DNA, 17 bp, Homo sapiens
tgtcctgggcctgcccc

SEQ ID NO: 3245012 - DNA, 17 bp, Homo sapiens
tgtcctggttagcagag

SEQ ID NO: 3245013 - DNA, 22 bp, Homo sapiens
tgtcctgtaaaggttacaagcc

SEQ ID NO: 3245014 - DNA, 13 bp, Homo sapiens
tgtcctgtgaatg

SEQ ID NO: 3245015 - DNA, 12 bp, Homo sapiens
tgtccttagaac

SEQ ID NO: 3245016 - DNA, 20 bp, Homo sapiens
tgtccttagtgtataaaaac

SEQ ID NO: 3245017 - DNA, 15 bp, Homo sapiens
tgtccttcagagctc

SEQ ID NO: 3245018 - DNA, 18 bp, Homo sapiens
tgtccttcagagctcttc

SEQ ID NO: 3245019 - DNA, 16 bp, Homo sapiens
tgtccttccctgttct

SEQ ID NO: 3245020 - DNA, 18 bp, Homo sapiens
tgtcctttaaaaaagaaa

SEQ ID NO: 3245021 - DNA, 12 bp, Homo sapiens
tgtcctttcccc

SEQ ID NO: 3245022 - DNA, 20 bp, Homo sapiens
tgtcctttcccctctctgcc

SEQ ID NO: 3245023 - DNA, 23 bp, Homo sapiens
tgtcctttcccctctctgcccct

SEQ ID NO: 3245024 - DNA, 13 bp, Homo sapiens
tgtcctttccctt

SEQ ID NO: 3245025 - DNA, 14 bp, Homo sapiens
tgtcctttcccttc

SEQ ID NO: 3245026 - DNA, 12 bp, Homo sapiens
tgtcctttcctt

SEQ ID NO: 3245027 - DNA, 21 bp, Homo sapiens
tgtccttttcccctacagaat

SEQ ID NO: 3245028 - DNA, 22 bp, Homo sapiens
tgtcgaaacctacaagatttcc

SEQ ID NO: 3245029 - DNA, 12 bp, Homo sapiens
tgtcgcacaatg

SEQ ID NO: 3245030 - DNA, 14 bp, Homo sapiens
tgtcgcccagtctg

SEQ ID NO: 3245031 - DNA, 15 bp, Homo sapiens
tgtcgccccaggccc

SEQ ID NO: 3245032 - DNA, 16 bp, Homo sapiens
tgtcgccccaggccct

SEQ ID NO: 3245033 - DNA, 19 bp, Homo sapiens
tgtcgccccaggccctccc

SEQ ID NO: 3245034 - DNA, 13 bp, Homo sapiens
tgtcgccgcctgc

SEQ ID NO: 3245035 - DNA, 22 bp, Homo sapiens
tgtcgctcatgtgtgcaacagg

SEQ ID NO: 3245036 - DNA, 22 bp, Homo sapiens
tgtcgggggctgtggatgggtg

SEQ ID NO: 3245037 - DNA, 23 bp, Homo sapiens
tgtcgtagccaaggtgggctgag

SEQ ID NO: 3245038 - DNA, 15 bp, Homo sapiens
tgtcgtgccagtcct

SEQ ID NO: 3245039 - DNA, 15 bp, Homo sapiens
tgtcgtggttcttaa

SEQ ID NO: 3245040 - DNA, 19 bp, Homo sapiens
tgtcgtggttcttaaatgt

SEQ ID NO: 3245041 - DNA, 21 bp, Homo sapiens
tgtcgtggttcttaaatgttt

SEQ ID NO: 3245042 - DNA, 21 bp, Homo sapiens
tgtcgttaaaaagttgtttgt

SEQ ID NO: 3245043 - DNA, 18 bp, Homo sapiens
tgtctaaatttgaatgtt

SEQ ID NO: 3245044 - DNA, 18 bp, Homo sapiens
tgtctaactcagaattat

SEQ ID NO: 3245045 - DNA, 13 bp, Homo sapiens
tgtctaagattct

SEQ ID NO: 3245046 - DNA, 14 bp, Homo sapiens
tgtctaagattcta

SEQ ID NO: 3245047 - DNA, 18 bp, Homo sapiens
tgtctaattgcatctcaa

SEQ ID NO: 3245048 - DNA, 13 bp, Homo sapiens
tgtctacatttct

SEQ ID NO: 3245049 - DNA, 16 bp, Homo sapiens
tgtctacctctgactt

SEQ ID NO: 3245050 - DNA, 19 bp, Homo sapiens
tgtctagaaagtaagaaaa

SEQ ID NO: 3245051 - DNA, 21 bp, Homo sapiens
tgtctagaaagtaagaaaaca

SEQ ID NO: 3245052 - DNA, 14 bp, Homo sapiens
tgtctagagtagct

SEQ ID NO: 3245053 - DNA, 17 bp, Homo sapiens
tgtctagtcattgtcat

SEQ ID NO: 3245054 - DNA, 14 bp, Homo sapiens
tgtctagtttccca

SEQ ID NO: 3245055 - DNA, 18 bp, Homo sapiens
tgtctagtttcccacatt

SEQ ID NO: 3245056 - DNA, 12 bp, Homo sapiens
tgtctatgaagt

SEQ ID NO: 3245057 - DNA, 20 bp, Homo sapiens
tgtctatgaagttgctgttt

SEQ ID NO: 3245058 - DNA, 21 bp, Homo sapiens
tgtctatgaagttgctgttta

SEQ ID NO: 3245059 - DNA, 20 bp, Homo sapiens
tgtctatgattgtactttga

SEQ ID NO: 3245060 - DNA, 14 bp, Homo sapiens
tgtctatgggactc

SEQ ID NO: 3245061 - DNA, 16 bp, Homo sapiens
tgtctattctgagcct

SEQ ID NO: 3245062 - DNA, 21 bp, Homo sapiens
tgtctcaaacttcagatggga

SEQ ID NO: 3245063 - DNA, 20 bp, Homo sapiens
tgtctcaaccagatttattt

SEQ ID NO: 3245064 - DNA, 18 bp, Homo sapiens
tgtctcaagagggcactg

SEQ ID NO: 3245065 - DNA, 16 bp, Homo sapiens
tgtctcacctggactt

SEQ ID NO: 3245066 - DNA, 13 bp, Homo sapiens
tgtctcactgttc

SEQ ID NO: 3245067 - DNA, 14 bp, Homo sapiens
tgtctcactgttct

SEQ ID NO: 3245068 - DNA, 18 bp, Homo sapiens
tgtctcactgttctgcaa

SEQ ID NO: 3245069 - DNA, 16 bp, Homo sapiens
tgtctcacttttcatc

SEQ ID NO: 3245070 - DNA, 17 bp, Homo sapiens
tgtctcacttttcatct

SEQ ID NO: 3245071 - DNA, 15 bp, Homo sapiens
tgtctcagacttttg

SEQ ID NO: 3245072 - DNA, 15 bp, Homo sapiens
tgtctcatcctcctg

SEQ ID NO: 3245073 - DNA, 19 bp, Homo sapiens
tgtctcatcctcctggaac

SEQ ID NO: 3245074 - DNA, 18 bp, Homo sapiens
tgtctcctatatatttct

SEQ ID NO: 3245075 - DNA, 14 bp, Homo sapiens
tgtctcctttgctc

SEQ ID NO: 3245076 - DNA, 15 bp, Homo sapiens
tgtctcctttgctct

SEQ ID NO: 3245077 - DNA, 17 bp, Homo sapiens
tgtctcgtgtacagctc

SEQ ID NO: 3245078 - DNA, 13 bp, Homo sapiens
tgtctctcctttt

SEQ ID NO: 3245079 - DNA, 15 bp, Homo sapiens
tgtctctgcatctga

SEQ ID NO: 3245080 - DNA, 20 bp, Homo sapiens
tgtctctgttcagatgtgca

SEQ ID NO: 3245081 - DNA, 17 bp, Homo sapiens
tgtctcttctttagaac

SEQ ID NO: 3245082 - DNA, 15 bp, Homo sapiens
tgtctcttgaaaaat

SEQ ID NO: 3245083 - DNA, 14 bp, Homo sapiens
tgtctcttgagttt

SEQ ID NO: 3245084 - DNA, 20 bp, Homo sapiens
tgtctctttaagttttgatt

SEQ ID NO: 3245085 - DNA, 16 bp, Homo sapiens
tgtctgaacttgcatt

SEQ ID NO: 3245086 - DNA, 18 bp, Homo sapiens
tgtctgaacttgcattgt

SEQ ID NO: 3245087 - DNA, 17 bp, Homo sapiens
tgtctgaagtcactgca

SEQ ID NO: 3245088 - DNA, 22 bp, Homo sapiens
tgtctgaatcgagtgagacaaa

SEQ ID NO: 3245089 - DNA, 16 bp, Homo sapiens
tgtctgaatgtattta

SEQ ID NO: 3245090 - DNA, 16 bp, Homo sapiens
tgtctgagatgctggt

SEQ ID NO: 3245091 - DNA, 14 bp, Homo sapiens
tgtctgaggcctca

SEQ ID NO: 3245092 - DNA, 20 bp, Homo sapiens
tgtctgagtgaacctgtata

SEQ ID NO: 3245093 - DNA, 14 bp, Homo sapiens
tgtctgataatgat

SEQ ID NO: 3245094 - DNA, 15 bp, Homo sapiens
tgtctgattggcttg

SEQ ID NO: 3245095 - DNA, 13 bp, Homo sapiens
tgtctgatttctt

SEQ ID NO: 3245096 - DNA, 14 bp, Homo sapiens
tgtctgatttttaa

SEQ ID NO: 3245097 - DNA, 19 bp, Homo sapiens
tgtctgcccaatgaataat

SEQ ID NO: 3245098 - DNA, 16 bp, Homo sapiens
tgtctgccctctgggt

SEQ ID NO: 3245099 - DNA, 13 bp, Homo sapiens
tgtctgccttccc

SEQ ID NO: 3245100 - DNA, 14 bp, Homo sapiens
tgtctgctaatgta

SEQ ID NO: 3245101 - DNA, 23 bp, Homo sapiens
tgtctgctaggcgctggggagac

SEQ ID NO: 3245102 - DNA, 22 bp, Homo sapiens
tgtctggagtggtaacagctct

SEQ ID NO: 3245103 - DNA, 15 bp, Homo sapiens
tgtctgggaattgtg

SEQ ID NO: 3245104 - DNA, 12 bp, Homo sapiens
tgtctggtacta

SEQ ID NO: 3245105 - DNA, 13 bp, Homo sapiens
tgtctgtacacgt

SEQ ID NO: 3245106 - DNA, 14 bp, Homo sapiens
tgtctgtatttcat

SEQ ID NO: 3245107 - DNA, 22 bp, Homo sapiens
tgtctgtatttcatgtggctgt

SEQ ID NO: 3245108 - DNA, 14 bp, Homo sapiens
tgtctgtctacatt

SEQ ID NO: 3245109 - DNA, 13 bp, Homo sapiens
tgtctgtgccatg

SEQ ID NO: 3245110 - DNA, 20 bp, Homo sapiens
tgtctgtgccctccaaagag

SEQ ID NO: 3245111 - DNA, 21 bp, Homo sapiens
tgtctgtggatggtcattgca

SEQ ID NO: 3245112 - DNA, 13 bp, Homo sapiens
tgtctgtggggag

SEQ ID NO: 3245113 - DNA, 15 bp, Homo sapiens
tgtctgtgttgctgt

SEQ ID NO: 3245114 - DNA, 16 bp, Homo sapiens
tgtctgtgttgctgtt

SEQ ID NO: 3245115 - DNA, 18 bp, Homo sapiens
tgtctgtgttgctgttta

SEQ ID NO: 3245116 - DNA, 19 bp, Homo sapiens
tgtctgttaccatgtcact

SEQ ID NO: 3245117 - DNA, 22 bp, Homo sapiens
tgtctgttaccatgtcactgtg

SEQ ID NO: 3245118 - DNA, 15 bp, Homo sapiens
tgtctgttctacata

SEQ ID NO: 3245119 - DNA, 18 bp, Homo sapiens
tgtctgtttttgtatctt

SEQ ID NO: 3245120 - DNA, 19 bp, Homo sapiens
tgtctgtttttgtatcttt

SEQ ID NO: 3245121 - DNA, 18 bp, Homo sapiens
tgtcttaaactaaatgtg

SEQ ID NO: 3245122 - DNA, 19 bp, Homo sapiens
tgtcttcaatgatcaaatt

SEQ ID NO: 3245123 - DNA, 14 bp, Homo sapiens
tgtcttcacctgcc

SEQ ID NO: 3245124 - DNA, 15 bp, Homo sapiens
tgtcttcataaagta

SEQ ID NO: 3245125 - DNA, 15 bp, Homo sapiens
tgtcttccccaccgc

SEQ ID NO: 3245126 - DNA, 14 bp, Homo sapiens
tgtcttccttggag

SEQ ID NO: 3245127 - DNA, 14 bp, Homo sapiens
tgtcttcgctggct

SEQ ID NO: 3245128 - DNA, 14 bp, Homo sapiens
tgtcttctctgtct

SEQ ID NO: 3245129 - DNA, 19 bp, Homo sapiens
tgtgtgttcttcaagccag

SEQ ID NO: 3245130 - DNA, 13 bp, Homo sapiens
tgtgtgtttcact

SEQ ID NO: 3245131 - DNA, 16 bp, Homo sapiens
tgtgtgtttgtgctga

SEQ ID NO: 3245132 - DNA, 19 bp, Homo sapiens
tgtgttaccctcctgtaaa

SEQ ID NO: 3245133 - DNA, 15 bp, Homo sapiens
tgtgttacttcaagt

SEQ ID NO: 3245134 - DNA, 18 bp, Homo sapiens
tgtgttcattcaagctat

SEQ ID NO: 3245135 - DNA, 20 bp, Homo sapiens
tgtgttcatttggtgttcct

SEQ ID NO: 3245136 - DNA, 16 bp, Homo sapiens
tgtgttccaagtttcc

SEQ ID NO: 3245137 - DNA, 18 bp, Homo sapiens
tgtgttccaagtttccaa

SEQ ID NO: 3245138 - DNA, 16 bp, Homo sapiens
tgtgttcccagaggca

SEQ ID NO: 3245139 - DNA, 12 bp, Homo sapiens
tgtgttcctcct

SEQ ID NO: 3245140 - DNA, 10 bp, Homo sapiens
tgtgttcctg

SEQ ID NO: 3245141 - DNA, 18 bp, Homo sapiens
tgtgttcctggcccactc

SEQ ID NO: 3245142 - DNA, 13 bp, Homo sapiens
tgtgttctatcca

SEQ ID NO: 3245143 - DNA, 20 bp, Homo sapiens
tgtgttctatccaaacatgt

SEQ ID NO: 3245144 - DNA, 14 bp, Homo sapiens
tgtgttgcattatt

SEQ ID NO: 3245145 - DNA, 13 bp, Homo sapiens
tgtgttgccaagc

SEQ ID NO: 3245146 - DNA, 18 bp, Homo sapiens
tgtgttgctaaaaaaagt

SEQ ID NO: 3245147 - DNA, 13 bp, Homo sapiens
tgtgttgctgttt

SEQ ID NO: 3245148 - DNA, 12 bp, Homo sapiens
tgtgttgtatta

SEQ ID NO: 3245149 - DNA, 16 bp, Homo sapiens
tgtgttgtcagcctgt

SEQ ID NO: 3245150 - DNA, 19 bp, Homo sapiens
tgtgttgttttttgttcaa

SEQ ID NO: 3245151 - DNA, 15 bp, Homo sapiens
tgtgtttatatggaa

SEQ ID NO: 3245152 - DNA, 15 bp, Homo sapiens
tgtgtttatttcact

SEQ ID NO: 3245153 - DNA, 12 bp, Homo sapiens
tgtgtttccaca

SEQ ID NO: 3245154 - DNA, 21 bp, Homo sapiens
tgtgtttccagatcgatcctg

SEQ ID NO: 3245155 - DNA, 20 bp, Homo sapiens
tgtgtttctatgtgacaatt

SEQ ID NO: 3245156 - DNA, 15 bp, Homo sapiens
tgtgtttgctgcctt

SEQ ID NO: 3245157 - DNA, 21 bp, Homo sapiens
tgtgtttgcttaaacaaagtg

SEQ ID NO: 3245158 - DNA, 14 bp, Homo sapiens
tgtgtttgtgagca

SEQ ID NO: 3245159 - DNA, 14 bp, Homo sapiens
tgtgtttgttccta

SEQ ID NO: 3245160 - DNA, 17 bp, Homo sapiens
tgtgttttcataataaa

SEQ ID NO: 3245161 - DNA, 17 bp, Homo sapiens
tgtgttttctctggaat

SEQ ID NO: 3245162 - DNA, 16 bp, Homo sapiens
tgtgttttcttgtaaa

SEQ ID NO: 3245163 - DNA, 16 bp, Homo sapiens
tgtgttttgaaagaat

SEQ ID NO: 3245164 - DNA, 13 bp, Homo sapiens
tgtgtttttctca

SEQ ID NO: 3245165 - DNA, 16 bp, Homo sapiens
tgtgtttttctttttc

SEQ ID NO: 3245166 - DNA, 13 bp, Homo sapiens
tgttaaaaataaa

SEQ ID NO: 3245167 - DNA, 15 bp, Homo sapiens
tgttaaaagattttt

SEQ ID NO: 3245168 - DNA, 15 bp, Homo sapiens
tgttaaaagttttat

SEQ ID NO: 3245169 - DNA, 18 bp, Homo sapiens
tgttaaaatagacaactc

SEQ ID NO: 3245170 - DNA, 12 bp, Homo sapiens
tgttaaacagta

SEQ ID NO: 3245171 - DNA, 11 bp, Homo sapiens
tgttaaactgt

SEQ ID NO: 3245172 - DNA, 21 bp, Homo sapiens
tgttaaactgttagcactgtt

SEQ ID NO: 3245173 - DNA, 22 bp, Homo sapiens
tgttaaagctggaacatttgat

SEQ ID NO: 3245174 - DNA, 18 bp, Homo sapiens
tgttaaatgaaattgtaa

SEQ ID NO: 3245175 - DNA, 19 bp, Homo sapiens
tgttaaatgaaattgtaaa

SEQ ID NO: 3245176 - DNA, 15 bp, Homo sapiens
tgttaaatttgtaag

SEQ ID NO: 3245177 - DNA, 16 bp, Homo sapiens
tgttaaatttttctga

SEQ ID NO: 3245178 - DNA, 21 bp, Homo sapiens
tgttaacaagaggggaaaaca

SEQ ID NO: 3245179 - DNA, 21 bp, Homo sapiens
tgttaacattccaagactcta

SEQ ID NO: 3245180 - DNA, 14 bp, Homo sapiens
tgttaactacatat

SEQ ID NO: 3245181 - DNA, 18 bp, Homo sapiens
tgttaactgttaactatg

SEQ ID NO: 3245182 - DNA, 22 bp, Homo sapiens
tgttaacttaatagtatttatg

SEQ ID NO: 3245183 - DNA, 13 bp, Homo sapiens
tgttaactttatt

SEQ ID NO: 3245184 - DNA, 14 bp, Homo sapiens
tgttaagaatagaa

SEQ ID NO: 3245185 - DNA, 15 bp, Homo sapiens
tgttaagaattgacc

SEQ ID NO: 3245186 - DNA, 23 bp, Homo sapiens
tgttaagaattgaccatctgctt

SEQ ID NO: 3245187 - DNA, 15 bp, Homo sapiens
tgttaagataactta

SEQ ID NO: 3245188 - DNA, 19 bp, Homo sapiens
tgttaagataacttactgt

SEQ ID NO: 3245189 - DNA, 17 bp, Homo sapiens
tgttaaggaaactctta

SEQ ID NO: 3245190 - DNA, 17 bp, Homo sapiens
tgttaaggttgaacttt

SEQ ID NO: 3245191 - DNA, 19 bp, Homo sapiens
tgttaatacacagtacttt

SEQ ID NO: 3245192 - DNA, 20 bp, Homo sapiens
tgttaatacacagtacttta

SEQ ID NO: 3245193 - DNA, 16 bp, Homo sapiens
tgttaatatcttcaca

SEQ ID NO: 3245194 - DNA, 21 bp, Homo sapiens
tgttaatctctgttatgtact

SEQ ID NO: 3245195 - DNA, 14 bp, Homo sapiens
tgttaatgaaaatg

SEQ ID NO: 3245196 - DNA, 13 bp, Homo sapiens
tgttaatgactct

SEQ ID NO: 3245197 - DNA, 18 bp, Homo sapiens
tgttaatgactctttctg

SEQ ID NO: 3245198 - DNA, 19 bp, Homo sapiens
tgttaatgatagctactgt

SEQ ID NO: 3245199 - DNA, 21 bp, Homo sapiens
tgttaatgctctatgtttgta

SEQ ID NO: 3245200 - DNA, 12 bp, Homo sapiens
tgttaatgtatt

SEQ ID NO: 3245201 - DNA, 12 bp, Homo sapiens
tgttaatgtgat

SEQ ID NO: 3245202 - DNA, 17 bp, Homo sapiens
tgttaatgtgatggatg

SEQ ID NO: 3245203 - DNA, 18 bp, Homo sapiens
tgttaattataggagcct

SEQ ID NO: 3245204 - DNA, 20 bp, Homo sapiens
tgttaatttgtgtgttttta

SEQ ID NO: 3245205 - DNA, 19 bp, Homo sapiens
tgttaattttcctcatttt

SEQ ID NO: 3245206 - DNA, 20 bp, Homo sapiens
tgttacaacttgtatttcca

SEQ ID NO: 3245207 - DNA, 23 bp, Homo sapiens
tgttacaggcaccgagaatgttg

SEQ ID NO: 3245208 - DNA, 17 bp, Homo sapiens
tgttacataacaagaaa

SEQ ID NO: 3245209 - DNA, 14 bp, Homo sapiens
tgttaccaaataca

SEQ ID NO: 3245210 - DNA, 19 bp, Homo sapiens
tgttaccaaatacacattt

SEQ ID NO: 3245211 - DNA, 17 bp, Homo sapiens
tgttaccgcctgtctct

SEQ ID NO: 3245212 - DNA, 16 bp, Homo sapiens
tgttacctactttgac

SEQ ID NO: 3245213 - DNA, 19 bp, Homo sapiens
tgttacctccaacagaact

SEQ ID NO: 3245214 - DNA, 20 bp, Homo sapiens
tgttactaaaaaaaagatga

SEQ ID NO: 3245215 - DNA, 14 bp, Homo sapiens
tgttactattttct

SEQ ID NO: 3245216 - DNA, 20 bp, Homo sapiens
tgttactattttctacaatt

SEQ ID NO: 3245217 - DNA, 20 bp, Homo sapiens
tgttactcagtgttagagaa

SEQ ID NO: 3245218 - DNA, 13 bp, Homo sapiens
tgttactgatcat

SEQ ID NO: 3245219 - DNA, 14 bp, Homo sapiens
tgttactgatcatg

SEQ ID NO: 3245220 - DNA, 19 bp, Homo sapiens
tgttactgcctataatctt

SEQ ID NO: 3245221 - DNA, 12 bp, Homo sapiens
tgttactgtaat

SEQ ID NO: 3245222 - DNA, 18 bp, Homo sapiens
tgttactgttaaccattt

SEQ ID NO: 3245223 - DNA, 16 bp, Homo sapiens
tgttactgttcttgct

SEQ ID NO: 3245224 - DNA, 17 bp, Homo sapiens
tgttactgttcttgctg

SEQ ID NO: 3245225 - DNA, 19 bp, Homo sapiens
tgttactgttcttgctgct

SEQ ID NO: 3245226 - DNA, 20 bp, Homo sapiens
tgttactgttcttgctgcta

SEQ ID NO: 3245227 - DNA, 21 bp, Homo sapiens
tgttactgttcttgctgctag

SEQ ID NO: 3245228 - DNA, 12 bp, Homo sapiens
tgttactttctt

SEQ ID NO: 3245229 - DNA, 21 bp, Homo sapiens
tgttactttctttcagatgtt

SEQ ID NO: 3245230 - DNA, 13 bp, Homo sapiens
tgttactttggaa

SEQ ID NO: 3245231 - DNA, 23 bp, Homo sapiens
tgttactttggcaatttcctggc

SEQ ID NO: 3245232 - DNA, 17 bp, Homo sapiens
tgttagaaaacaaaatt

SEQ ID NO: 3245233 - DNA, 17 bp, Homo sapiens
tgttagaaaatgactta

SEQ ID NO: 3245234 - DNA, 22 bp, Homo sapiens
tgttagaaaatgacttatttct

SEQ ID NO: 3245235 - DNA, 23 bp, Homo sapiens
tgttagaaaatgacttatttctg

SEQ ID NO: 3245236 - DNA, 14 bp, Homo sapiens
tgttagaacactat

SEQ ID NO: 3245237 - DNA, 19 bp, Homo sapiens
tgttagaacactattttca

SEQ ID NO: 3245238 - DNA, 22 bp, Homo sapiens
tgttagaacactattttcagaa

SEQ ID NO: 3245239 - DNA, 22 bp, Homo sapiens
tgttagaaccaccaaaattata

SEQ ID NO: 3245240 - DNA, 17 bp, Homo sapiens
tgttagagagaaagaga

SEQ ID NO: 3245241 - DNA, 14 bp, Homo sapiens
tgttagagagcttt

SEQ ID NO: 3245242 - DNA, 22 bp, Homo sapiens
tgttagaggttttaaagtgatt

SEQ ID NO: 3245243 - DNA, 14 bp, Homo sapiens
tgttagatattgct

SEQ ID NO: 3245244 - DNA, 22 bp, Homo sapiens
tgttagatgctgaatatctgtt

SEQ ID NO: 3245245 - DNA, 15 bp, Homo sapiens
tgttagcaaagatta

SEQ ID NO: 3245246 - DNA, 13 bp, Homo sapiens
tgttagcactgtt

SEQ ID NO: 3245247 - DNA, 14 bp, Homo sapiens
tgttagcactgttg

SEQ ID NO: 3245248 - DNA, 18 bp, Homo sapiens
tgttaggcatgtcccacc

SEQ ID NO: 3245249 - DNA, 15 bp, Homo sapiens
tgttagggtcagcca

SEQ ID NO: 3245250 - DNA, 13 bp, Homo sapiens
tgttagtaacatg

SEQ ID NO: 3245251 - DNA, 17 bp, Homo sapiens
tgttagttatagatgtc

SEQ ID NO: 3245252 - DNA, 14 bp, Homo sapiens
tgttagttcctgta

SEQ ID NO: 3245253 - DNA, 20 bp, Homo sapiens
tgttagttcctgtatgaaag

SEQ ID NO: 3245254 - DNA, 22 bp, Homo sapiens
tgttagttcctgtatgaaagat

SEQ ID NO: 3245255 - DNA, 21 bp, Homo sapiens
tgttagtttagtgtgtgtgca

SEQ ID NO: 3245256 - DNA, 15 bp, Homo sapiens
tgttttggttaataa

SEQ ID NO: 3245257 - DNA, 13 bp, Homo sapiens
tgttttgtacaat

SEQ ID NO: 3245258 - DNA, 21 bp, Homo sapiens
tgttttgtacaattactaaat

SEQ ID NO: 3245259 - DNA, 22 bp, Homo sapiens
tgttttgtatacaaatatattg

SEQ ID NO: 3245260 - DNA, 15 bp, Homo sapiens
tgttttgtatataca

SEQ ID NO: 3245261 - DNA, 17 bp, Homo sapiens
tgttttgtatatacagt

SEQ ID NO: 3245262 - DNA, 19 bp, Homo sapiens
tgttttgtggtttggaata

SEQ ID NO: 3245263 - DNA, 12 bp, Homo sapiens
tgttttgttaat

SEQ ID NO: 3245264 - DNA, 13 bp, Homo sapiens
tgttttgtttctg

SEQ ID NO: 3245265 - DNA, 19 bp, Homo sapiens
tgtttttaagtaacttaag

SEQ ID NO: 3245266 - DNA, 19 bp, Homo sapiens
tgtttttaatgctatttga

SEQ ID NO: 3245267 - DNA, 17 bp, Homo sapiens
tgtttttagacaccttc

SEQ ID NO: 3245268 - DNA, 21 bp, Homo sapiens
tgtttttaggctgttccttgt

SEQ ID NO: 3245269 - DNA, 15 bp, Homo sapiens
tgtttttataaaaat

SEQ ID NO: 3245270 - DNA, 14 bp, Homo sapiens
tgtttttcattcat

SEQ ID NO: 3245271 - DNA, 11 bp, Homo sapiens
tgtttttctca

SEQ ID NO: 3245272 - DNA, 13 bp, Homo sapiens
tgtttttgcatga

SEQ ID NO: 3245273 - DNA, 16 bp, Homo sapiens
tgtttttgcatgaaat

SEQ ID NO: 3245274 - DNA, 18 bp, Homo sapiens
tgtttttgcatgaaattg

SEQ ID NO: 3245275 - DNA, 13 bp, Homo sapiens
tgtttttgtatct

SEQ ID NO: 3245276 - DNA, 11 bp, Homo sapiens
tgttttttaag

SEQ ID NO: 3245277 - DNA, 15 bp, Homo sapiens
tgttttttatgaagt

SEQ ID NO: 3245278 - DNA, 23 bp, Homo sapiens
tgttttttcggacatgcttttct

SEQ ID NO: 3245279 - DNA, 14 bp, Homo sapiens
tgttttttgaaaac

SEQ ID NO: 3245280 - DNA, 15 bp, Homo sapiens
tgttttttgccacag

SEQ ID NO: 3245281 - DNA, 18 bp, Homo sapiens
tgttttttgccacagctt

SEQ ID NO: 3245282 - DNA, 12 bp, Homo sapiens
tgtttttttcct

SEQ ID NO: 3245283 - DNA, 20 bp, Homo sapiens
tgtttttttcctcatgtaac

SEQ ID NO: 3245284 - DNA, 23 bp, Homo sapiens
ttaaaaaaaaaaaaaaaagacta

SEQ ID NO: 3245285 - DNA, 16 bp, Homo sapiens
ttaaaaaaaaattgta

SEQ ID NO: 3245286 - DNA, 19 bp, Homo sapiens
ttaaaaaaaaattgtatct

SEQ ID NO: 3245287 - DNA, 14 bp, Homo sapiens
ttaaaaaaatgaca

SEQ ID NO: 3245288 - DNA, 13 bp, Homo sapiens
ttaaaaaatactt

SEQ ID NO: 3245289 - DNA, 19 bp, Homo sapiens
ttaaaaaatatttattaaa

SEQ ID NO: 3245290 - DNA, 16 bp, Homo sapiens
ttaaaaaatgaaaata

SEQ ID NO: 3245291 - DNA, 13 bp, Homo sapiens
ttaaaaaatgtcc

SEQ ID NO: 3245292 - DNA, 19 bp, Homo sapiens
ttaaaaaattatggaatat

SEQ ID NO: 3245293 - DNA, 15 bp, Homo sapiens
ttaaaaactcctttt

SEQ ID NO: 3245294 - DNA, 22 bp, Homo sapiens
ttaaaaaggaaatttgtttgta

SEQ ID NO: 3245295 - DNA, 18 bp, Homo sapiens
ttaaaaaggactatatta

SEQ ID NO: 3245296 - DNA, 19 bp, Homo sapiens
ttaaaaaggccaaagataa

SEQ ID NO: 3245297 - DNA, 16 bp, Homo sapiens
ttaaaaagttgttcaa

SEQ ID NO: 3245298 - DNA, 11 bp, Homo sapiens
ttaaaaataaa

SEQ ID NO: 3245299 - DNA, 20 bp, Homo sapiens
ttaaaaataatagagcccca

SEQ ID NO: 3245300 - DNA, 23 bp, Homo sapiens
ttaaaaatatggaacttctaata

SEQ ID NO: 3245301 - DNA, 14 bp, Homo sapiens
ttaaaaatatttca

SEQ ID NO: 3245302 - DNA, 17 bp, Homo sapiens
ttaaaaatatttcagat

SEQ ID NO: 3245303 - DNA, 20 bp, Homo sapiens
ttaaaaatggtatcaaaatt

SEQ ID NO: 3245304 - DNA, 22 bp, Homo sapiens
ttaaaaatggtatcaaaattac

SEQ ID NO: 3245305 - DNA, 17 bp, Homo sapiens
ttaaaaatgtaaatatt

SEQ ID NO: 3245306 - DNA, 16 bp, Homo sapiens
ttaaaaattgtttctt

SEQ ID NO: 3245307 - DNA, 15 bp, Homo sapiens
ttaaaacactaaaag

SEQ ID NO: 3245308 - DNA, 14 bp, Homo sapiens
ttaaaacagacact

SEQ ID NO: 3245309 - DNA, 21 bp, Homo sapiens
ttaaaacagctgcattagaaa

SEQ ID NO: 3245310 - DNA, 13 bp, Homo sapiens
ttaaaacatattt

SEQ ID NO: 3245311 - DNA, 19 bp, Homo sapiens
ttaaaacatatttcatttt

SEQ ID NO: 3245312 - DNA, 14 bp, Homo sapiens
ttaaaaccaaagag

SEQ ID NO: 3245313 - DNA, 23 bp, Homo sapiens
ttaaaacctgggtatgttcctaa

SEQ ID NO: 3245314 - DNA, 16 bp, Homo sapiens
ttaaaacgaaaataaa

SEQ ID NO: 3245315 - DNA, 16 bp, Homo sapiens
ttaaaactaagcacaa

SEQ ID NO: 3245316 - DNA, 13 bp, Homo sapiens
ttaaaactaggta

SEQ ID NO: 3245317 - DNA, 19 bp, Homo sapiens
ttaaaactaggtaatgttt

SEQ ID NO: 3245318 - DNA, 15 bp, Homo sapiens
ttaaaagaatgacta

SEQ ID NO: 3245319 - DNA, 14 bp, Homo sapiens
ttaaaagataagtt

SEQ ID NO: 3245320 - DNA, 20 bp, Homo sapiens
ttaaaagcacaagcgtgttt

SEQ ID NO: 3245321 - DNA, 15 bp, Homo sapiens
ttaaaaggatagtat

SEQ ID NO: 3245322 - DNA, 14 bp, Homo sapiens
ttaaaaggggccca

SEQ ID NO: 3245323 - DNA, 16 bp, Homo sapiens
ttaaaaggtataatta

SEQ ID NO: 3245324 - DNA, 19 bp, Homo sapiens
ttaaaaggtataattaaac

SEQ ID NO: 3245325 - DNA, 15 bp, Homo sapiens
ttaaaagtaaaatgt

SEQ ID NO: 3245326 - DNA, 20 bp, Homo sapiens
ttaaaataaacagttgtgaa

SEQ ID NO: 3245327 - DNA, 20 bp, Homo sapiens
ttaaaataagcactgtgcta

SEQ ID NO: 3245328 - DNA, 16 bp, Homo sapiens
ttaaaataattaaata

SEQ ID NO: 3245329 - DNA, 15 bp, Homo sapiens
ttaaaatacttgttt

SEQ ID NO: 3245330 - DNA, 23 bp, Homo sapiens
ttaaaatacttgtttcagcttct

SEQ ID NO: 3245331 - DNA, 15 bp, Homo sapiens
ttaaaatagaaataa

SEQ ID NO: 3245332 - DNA, 12 bp, Homo sapiens
ttaaaatatatt

SEQ ID NO: 3245333 - DNA, 14 bp, Homo sapiens
ttaaaatattttat

SEQ ID NO: 3245334 - DNA, 14 bp, Homo sapiens
ttaaaatattttgg

SEQ ID NO: 3245335 - DNA, 18 bp, Homo sapiens
ttaaaatgattgtaaaat

SEQ ID NO: 3245336 - DNA, 21 bp, Homo sapiens
ttaaaatgcattgaaagaatt

SEQ ID NO: 3245337 - DNA, 23 bp, Homo sapiens
ttaaaatggatttaatccatttt

SEQ ID NO: 3245338 - DNA, 13 bp, Homo sapiens
ttaaaattacaga

SEQ ID NO: 3245339 - DNA, 23 bp, Homo sapiens
ttaaaattatcaatatctaatat

SEQ ID NO: 3245340 - DNA, 16 bp, Homo sapiens
ttaaaattatgaatct

SEQ ID NO: 3245341 - DNA, 20 bp, Homo sapiens
ttaaaattatgaatctgatt

SEQ ID NO: 3245342 - DNA, 21 bp, Homo sapiens
ttaaaattcagtttttgtatc

SEQ ID NO: 3245343 - DNA, 22 bp, Homo sapiens
ttaaaattgatttttctcttca

SEQ ID NO: 3245344 - DNA, 15 bp, Homo sapiens
ttaaaattgccattt

SEQ ID NO: 3245345 - DNA, 13 bp, Homo sapiens
ttaaaattgtcac

SEQ ID NO: 3245346 - DNA, 21 bp, Homo sapiens
ttaaaattgtcacctctgtta

SEQ ID NO: 3245347 - DNA, 16 bp, Homo sapiens
ttaaaattgtgcataa

SEQ ID NO: 3245348 - DNA, 13 bp, Homo sapiens
ttaaaatttcata

SEQ ID NO: 3245349 - DNA, 20 bp, Homo sapiens
ttaaacaaacattgtgttga

SEQ ID NO: 3245350 - DNA, 14 bp, Homo sapiens
ttaaacaaaggttg

SEQ ID NO: 3245351 - DNA, 13 bp, Homo sapiens
ttaaacaaagtga

SEQ ID NO: 3245352 - DNA, 17 bp, Homo sapiens
ttaaacaaagtttcaga

SEQ ID NO: 3245353 - DNA, 12 bp, Homo sapiens
ttaaacacacag

SEQ ID NO: 3245354 - DNA, 22 bp, Homo sapiens
ttaaacacacagatacacacac

SEQ ID NO: 3245355 - DNA, 15 bp, Homo sapiens
ttaaacaggcccagc

SEQ ID NO: 3245356 - DNA, 21 bp, Homo sapiens
ttaaacagtagttgtattctt

SEQ ID NO: 3245357 - DNA, 23 bp, Homo sapiens
ttaaacagtagttgtattcttct

SEQ ID NO: 3245358 - DNA, 19 bp, Homo sapiens
ttaaacagtatttcattgc

SEQ ID NO: 3245359 - DNA, 23 bp, Homo sapiens
ttaaacagtgagcctgaattttg

SEQ ID NO: 3245360 - DNA, 10 bp, Homo sapiens
ttaaacatta

SEQ ID NO: 3245361 - DNA, 18 bp, Homo sapiens
ttaaacattaaaaatgga

SEQ ID NO: 3245362 - DNA, 21 bp, Homo sapiens
ttaaacattaaaaatggaact

SEQ ID NO: 3245363 - DNA, 13 bp, Homo sapiens
ttaaacattttca

SEQ ID NO: 3245364 - DNA, 14 bp, Homo sapiens
ttaaaccacttaaa

SEQ ID NO: 3245365 - DNA, 21 bp, Homo sapiens
ttaaaccagtttagatttcaa

SEQ ID NO: 3245366 - DNA, 19 bp, Homo sapiens
ttaaacccaatcagatgcc

SEQ ID NO: 3245367 - DNA, 18 bp, Homo sapiens
ttaaacctctcttctacc

SEQ ID NO: 3245368 - DNA, 21 bp, Homo sapiens
ttaaacctgtttttttttcat

SEQ ID NO: 3245369 - DNA, 17 bp, Homo sapiens
ttaaacctttttcttga

SEQ ID NO: 3245370 - DNA, 17 bp, Homo sapiens
ttaaacgcttcttatgt

SEQ ID NO: 3245371 - DNA, 15 bp, Homo sapiens
ttaaactaaataatg

SEQ ID NO: 3245372 - DNA, 16 bp, Homo sapiens
ttaaactatcttgtgt

SEQ ID NO: 3245373 - DNA, 14 bp, Homo sapiens
ttaaactcaagaca

SEQ ID NO: 3245374 - DNA, 20 bp, Homo sapiens
ttaaactgtgtggactgtga

SEQ ID NO: 3245375 - DNA, 21 bp, Homo sapiens
ttaaactgtgtggactgtgat

SEQ ID NO: 3245376 - DNA, 20 bp, Homo sapiens
ttaaactgttagcactgttg

SEQ ID NO: 3245377 - DNA, 22 bp, Homo sapiens
ttaaactgttagcactgttgat

SEQ ID NO: 3245378 - DNA, 23 bp, Homo sapiens
ttaaacttataaatcatattgat

SEQ ID NO: 3245379 - DNA, 17 bp, Homo sapiens
ttaaagaaagtgtattt

SEQ ID NO: 3245380 - DNA, 16 bp, Homo sapiens
ttaaagaagagtgact

SEQ ID NO: 3245381 - DNA, 9 bp, Homo sapiens
ttaaagaca

SEQ ID NO: 3245382 - DNA, 14 bp, Homo sapiens
ttccacttcttcct

SEQ ID NO: 3245383 - DNA, 21 bp, Homo sapiens
ttccacttcttcctttctctt

SEQ ID NO: 3245384 - DNA, 17 bp, Homo sapiens
ttccacttgagtgtcaa

SEQ ID NO: 3245385 - DNA, 15 bp, Homo sapiens
ttccactttgttctt

SEQ ID NO: 3245386 - DNA, 13 bp, Homo sapiens
ttccagacctgct

SEQ ID NO: 3245387 - DNA, 20 bp, Homo sapiens
ttccagacctgcttcctgaa

SEQ ID NO: 3245388 - DNA, 15 bp, Homo sapiens
ttccagacttcaaaa

SEQ ID NO: 3245389 - DNA, 19 bp, Homo sapiens
ttccagagagtggctcctc

SEQ ID NO: 3245390 - DNA, 20 bp, Homo sapiens
ttccagagagtggctcctcc

SEQ ID NO: 3245391 - DNA, 21 bp, Homo sapiens
ttccagagagtggctcctccc

SEQ ID NO: 3245392 - DNA, 17 bp, Homo sapiens
ttccagagtttgtcatt

SEQ ID NO: 3245393 - DNA, 16 bp, Homo sapiens
ttccagatctttcaga

SEQ ID NO: 3245394 - DNA, 15 bp, Homo sapiens
ttccagcaagcaaag

SEQ ID NO: 3245395 - DNA, 20 bp, Homo sapiens
ttccagcccctctggtcgct

SEQ ID NO: 3245396 - DNA, 17 bp, Homo sapiens
ttccagcttcaggcacc

SEQ ID NO: 3245397 - DNA, 21 bp, Homo sapiens
ttccagcttcaggcaccagca

SEQ ID NO: 3245398 - DNA, 21 bp, Homo sapiens
ttccaggaaactccacatctg

SEQ ID NO: 3245399 - DNA, 22 bp, Homo sapiens
ttccaggaaactccacatctgc

SEQ ID NO: 3245400 - DNA, 12 bp, Homo sapiens
ttccaggcccct

SEQ ID NO: 3245401 - DNA, 17 bp, Homo sapiens
ttccaggcccctgagga

SEQ ID NO: 3245402 - DNA, 16 bp, Homo sapiens
ttccaggccctccagt

SEQ ID NO: 3245403 - DNA, 17 bp, Homo sapiens
ttccaggccctccagtg

SEQ ID NO: 3245404 - DNA, 21 bp, Homo sapiens
ttccaggctaaacatccaata

SEQ ID NO: 3245405 - DNA, 14 bp, Homo sapiens
ttccaggggaacct

SEQ ID NO: 3245406 - DNA, 13 bp, Homo sapiens
ttccagtaacttt

SEQ ID NO: 3245407 - DNA, 16 bp, Homo sapiens
ttccagtaactttttt

SEQ ID NO: 3245408 - DNA, 18 bp, Homo sapiens
ttccagtacctttgtcac

SEQ ID NO: 3245409 - DNA, 14 bp, Homo sapiens
ttccagtattgaaa

SEQ ID NO: 3245410 - DNA, 18 bp, Homo sapiens
ttccagtattgaaaactt

SEQ ID NO: 3245411 - DNA, 17 bp, Homo sapiens
ttccagtcttcctgaca

SEQ ID NO: 3245412 - DNA, 20 bp, Homo sapiens
ttccagtcttcctgacactt

SEQ ID NO: 3245413 - DNA, 22 bp, Homo sapiens
ttccagtgatgtgtgagctatg

SEQ ID NO: 3245414 - DNA, 18 bp, Homo sapiens
ttccagtgtccttagaac

SEQ ID NO: 3245415 - DNA, 14 bp, Homo sapiens
ttccataattatga

SEQ ID NO: 3245416 - DNA, 15 bp, Homo sapiens
ttccatacagctcta

SEQ ID NO: 3245417 - DNA, 15 bp, Homo sapiens
ttccatagcaacagg

SEQ ID NO: 3245418 - DNA, 17 bp, Homo sapiens
ttccatagcaacaggaa

SEQ ID NO: 3245419 - DNA, 22 bp, Homo sapiens
ttccataggacatactgcatgt

SEQ ID NO: 3245420 - DNA, 23 bp, Homo sapiens
ttccataggacatactgcatgta

SEQ ID NO: 3245421 - DNA, 15 bp, Homo sapiens
ttccatatcttgcga

SEQ ID NO: 3245422 - DNA, 16 bp, Homo sapiens
ttccatatgctccagg

SEQ ID NO: 3245423 - DNA, 17 bp, Homo sapiens
ttccatatgctccagga

SEQ ID NO: 3245424 - DNA, 22 bp, Homo sapiens
ttccatcacccgtacaggcaat

SEQ ID NO: 3245425 - DNA, 15 bp, Homo sapiens
ttccatcatttctgt

SEQ ID NO: 3245426 - DNA, 18 bp, Homo sapiens
ttccatcctttacgtgtt

SEQ ID NO: 3245427 - DNA, 23 bp, Homo sapiens
ttccatctcctataatctgtcaa

SEQ ID NO: 3245428 - DNA, 12 bp, Homo sapiens
ttccatctctgg

SEQ ID NO: 3245429 - DNA, 14 bp, Homo sapiens
ttccatctctggta

SEQ ID NO: 3245430 - DNA, 14 bp, Homo sapiens
ttccatcttgctaa

SEQ ID NO: 3245431 - DNA, 20 bp, Homo sapiens
ttccatgaagtttgaacttc

SEQ ID NO: 3245432 - DNA, 15 bp, Homo sapiens
ttccatgaatgtatc

SEQ ID NO: 3245433 - DNA, 20 bp, Homo sapiens
ttccatgaatgtatcaggaa

SEQ ID NO: 3245434 - DNA, 21 bp, Homo sapiens
ttccatgagttatcatgaatt

SEQ ID NO: 3245435 - DNA, 13 bp, Homo sapiens
ttccatgcctgag

SEQ ID NO: 3245436 - DNA, 14 bp, Homo sapiens
ttccatgcctgagg

SEQ ID NO: 3245437 - DNA, 15 bp, Homo sapiens
ttccatgcctgaggg

SEQ ID NO: 3245438 - DNA, 18 bp, Homo sapiens
ttccatgcctgagggtgg

SEQ ID NO: 3245439 - DNA, 21 bp, Homo sapiens
ttccatgcgtgtttctgactc

SEQ ID NO: 3245440 - DNA, 17 bp, Homo sapiens
ttccatggcaattttgt

SEQ ID NO: 3245441 - DNA, 12 bp, Homo sapiens
ttccatgggaat

SEQ ID NO: 3245442 - DNA, 19 bp, Homo sapiens
ttccatgtcgcctctgcat

SEQ ID NO: 3245443 - DNA, 12 bp, Homo sapiens
ttccatgttaaa

SEQ ID NO: 3245444 - DNA, 24 bp, Homo sapiens
ttccattgcctcttttcacatttt

SEQ ID NO: 3245445 - DNA, 16 bp, Homo sapiens
ttccattggtccaaga

SEQ ID NO: 3245446 - DNA, 17 bp, Homo sapiens
ttccattggtccaagat

SEQ ID NO: 3245447 - DNA, 19 bp, Homo sapiens
ttccattggtccaagattc

SEQ ID NO: 3245448 - DNA, 20 bp, Homo sapiens
ttccatttacagtctctttc

SEQ ID NO: 3245449 - DNA, 17 bp, Homo sapiens
ttccatttatttatgaa

SEQ ID NO: 3245450 - DNA, 12 bp, Homo sapiens
ttccatttctga

SEQ ID NO: 3245451 - DNA, 14 bp, Homo sapiens
ttcccaacagcctt

SEQ ID NO: 3245452 - DNA, 17 bp, Homo sapiens
ttcccaacagccttagc

SEQ ID NO: 3245453 - DNA, 23 bp, Homo sapiens
ttcccaacttcatactggcagga

SEQ ID NO: 3245454 - DNA, 16 bp, Homo sapiens
ttcccaatcagcactg

SEQ ID NO: 3245455 - DNA, 18 bp, Homo sapiens
ttcccaatcagcactgaa

SEQ ID NO: 3245456 - DNA, 23 bp, Homo sapiens
ttcccaatctctacccctttctt

SEQ ID NO: 3245457 - DNA, 22 bp, Homo sapiens
ttcccaccgccctccctcccca

SEQ ID NO: 3245458 - DNA, 14 bp, Homo sapiens
ttcccactccttca

SEQ ID NO: 3245459 - DNA, 18 bp, Homo sapiens
ttcccactttcccacccc

SEQ ID NO: 3245460 - DNA, 20 bp, Homo sapiens
ttcccactttcccaccccac

SEQ ID NO: 3245461 - DNA, 18 bp, Homo sapiens
ttcccagagcaaaataat

SEQ ID NO: 3245462 - DNA, 19 bp, Homo sapiens
ttcccagagtcatctgatt

SEQ ID NO: 3245463 - DNA, 15 bp, Homo sapiens
ttcccagctcccccc

SEQ ID NO: 3245464 - DNA, 22 bp, Homo sapiens
ttcccagctccccccgcccacc

SEQ ID NO: 3245465 - DNA, 18 bp, Homo sapiens
ttcccaggttctgtttat

SEQ ID NO: 3245466 - DNA, 16 bp, Homo sapiens
ttcccataattttctt

SEQ ID NO: 3245467 - DNA, 13 bp, Homo sapiens
ttcccatcctacc

SEQ ID NO: 3245468 - DNA, 16 bp, Homo sapiens
ttcccatgactgcacc

SEQ ID NO: 3245469 - DNA, 14 bp, Homo sapiens
ttcccatggggagg

SEQ ID NO: 3245470 - DNA, 14 bp, Homo sapiens
ttcccattcttgca

SEQ ID NO: 3245471 - DNA, 20 bp, Homo sapiens
ttcccattgcatcacctctg

SEQ ID NO: 3245472 - DNA, 15 bp, Homo sapiens
ttcccatttcagctg

SEQ ID NO: 3245473 - DNA, 14 bp, Homo sapiens
ttcccattttgcaa

SEQ ID NO: 3245474 - DNA, 13 bp, Homo sapiens
ttcccattttgga

SEQ ID NO: 3245475 - DNA, 17 bp, Homo sapiens
ttccccaagggccctgg

SEQ ID NO: 3245476 - DNA, 22 bp, Homo sapiens
ttccccaccccagctcatgccc

SEQ ID NO: 3245477 - DNA, 18 bp, Homo sapiens
ttccccactaataaagtg

SEQ ID NO: 3245478 - DNA, 18 bp, Homo sapiens
ttccccagcatcactccc

SEQ ID NO: 3245479 - DNA, 20 bp, Homo sapiens
ttccccagcatcactcccca

SEQ ID NO: 3245480 - DNA, 22 bp, Homo sapiens
ttcccccaccggtccagctggc

SEQ ID NO: 3245481 - DNA, 14 bp, Homo sapiens
ttcccccactaccg

SEQ ID NO: 3245482 - DNA, 17 bp, Homo sapiens
ttcccccatagccaccc

SEQ ID NO: 3245483 - DNA, 18 bp, Homo sapiens
ttcccccatagccacccc

SEQ ID NO: 3245484 - DNA, 18 bp, Homo sapiens
ttcccccccctttcctaa

SEQ ID NO: 3245485 - DNA, 21 bp, Homo sapiens
ttcccccttccaaataataaa

SEQ ID NO: 3245486 - DNA, 16 bp, Homo sapiens
ttcccccttcctagtg

SEQ ID NO: 3245487 - DNA, 22 bp, Homo sapiens
ttcccccttgaggattgtggaa

SEQ ID NO: 3245488 - DNA, 22 bp, Homo sapiens
ttccccgcctgcagtcttctgg

SEQ ID NO: 3245489 - DNA, 17 bp, Homo sapiens
ttcccctccctggctcc

SEQ ID NO: 3245490 - DNA, 12 bp, Homo sapiens
ttcccctctctg

SEQ ID NO: 3245491 - DNA, 14 bp, Homo sapiens
ttcccctctctgcc

SEQ ID NO: 3245492 - DNA, 18 bp, Homo sapiens
ttcccctctctgcccctg

SEQ ID NO: 3245493 - DNA, 15 bp, Homo sapiens
ttcccctctgctgct

SEQ ID NO: 3245494 - DNA, 16 bp, Homo sapiens
ttcccctgtcctgtga

SEQ ID NO: 3245495 - DNA, 21 bp, Homo sapiens
ttcccctgtcctgtgaatgga

SEQ ID NO: 3245496 - DNA, 14 bp, Homo sapiens
ttccccttcctaag

SEQ ID NO: 3245497 - DNA, 13 bp, Homo sapiens
ttccccttgccct

SEQ ID NO: 3245498 - DNA, 21 bp, Homo sapiens
ttccccttgcccttgccctga

SEQ ID NO: 3245499 - DNA, 14 bp, Homo sapiens
ttccccttggcttc

SEQ ID NO: 3245500 - DNA, 17 bp, Homo sapiens
ttccccttttgcctggc

SEQ ID NO: 3245501 - DNA, 20 bp, Homo sapiens
ttccccttttgcctggctgt

SEQ ID NO: 3245502 - DNA, 21 bp, Homo sapiens
ttcccgccagagggcttgtga

SEQ ID NO: 3245503 - DNA, 22 bp, Homo sapiens
ttcccgcgggttccgcaggcag

SEQ ID NO: 3245504 - DNA, 12 bp, Homo sapiens
ttcccgctcagc

SEQ ID NO: 3245505 - DNA, 15 bp, Homo sapiens
ttcccgctcagccct

SEQ ID NO: 3245506 - DNA, 16 bp, Homo sapiens
ttcccgctcagccctc

SEQ ID NO: 3245507 - DNA, 20 bp, Homo sapiens
ttcccggagcacagccctgg

SEQ ID NO: 3245508 - DNA, 22 bp, Homo sapiens
ttctcaagttctaagattctaa

SEQ ID NO: 3245509 - DNA, 12 bp, Homo sapiens
ttctcacagcac

SEQ ID NO: 3245510 - DNA, 22 bp, Homo sapiens
ttctcacagcacatgctggcca

SEQ ID NO: 3245511 - DNA, 18 bp, Homo sapiens
ttctcactcctacctggt

SEQ ID NO: 3245512 - DNA, 14 bp, Homo sapiens
ttctcagatattta

SEQ ID NO: 3245513 - DNA, 15 bp, Homo sapiens
ttctcagatatttat

SEQ ID NO: 3245514 - DNA, 20 bp, Homo sapiens
ttctcagatatttatatttt

SEQ ID NO: 3245515 - DNA, 12 bp, Homo sapiens
ttctcagctccc

SEQ ID NO: 3245516 - DNA, 13 bp, Homo sapiens
ttctcagctccca

SEQ ID NO: 3245517 - DNA, 13 bp, Homo sapiens
ttctcagggctcc

SEQ ID NO: 3245518 - DNA, 15 bp, Homo sapiens
ttctcagggctcctg

SEQ ID NO: 3245519 - DNA, 18 bp, Homo sapiens
ttctcagggctcctgcct

SEQ ID NO: 3245520 - DNA, 16 bp, Homo sapiens
ttctcaggtgttgcca

SEQ ID NO: 3245521 - DNA, 19 bp, Homo sapiens
ttctcaggtgttgccaaat

SEQ ID NO: 3245522 - DNA, 22 bp, Homo sapiens
ttctcatagcattaactaatct

SEQ ID NO: 3245523 - DNA, 17 bp, Homo sapiens
ttctcatagccccggtg

SEQ ID NO: 3245524 - DNA, 17 bp, Homo sapiens
ttctcatcccacgcact

SEQ ID NO: 3245525 - DNA, 18 bp, Homo sapiens
ttctcatcttaaaaatat

SEQ ID NO: 3245526 - DNA, 18 bp, Homo sapiens
ttctcatcttgtgaaatg

SEQ ID NO: 3245527 - DNA, 22 bp, Homo sapiens
ttctcatgacggcttttgtcag

SEQ ID NO: 3245528 - DNA, 14 bp, Homo sapiens
ttctcatgatccaa

SEQ ID NO: 3245529 - DNA, 18 bp, Homo sapiens
ttctcattccaacagtga

SEQ ID NO: 3245530 - DNA, 20 bp, Homo sapiens
ttctcattgacttttataaa

SEQ ID NO: 3245531 - DNA, 20 bp, Homo sapiens
ttctccaaactgaagcagcc

SEQ ID NO: 3245532 - DNA, 14 bp, Homo sapiens
ttctccaaccccgg

SEQ ID NO: 3245533 - DNA, 13 bp, Homo sapiens
ttctccagccagc

SEQ ID NO: 3245534 - DNA, 14 bp, Homo sapiens
ttctccagccagca

SEQ ID NO: 3245535 - DNA, 17 bp, Homo sapiens
ttctccagcctggaccc

SEQ ID NO: 3245536 - DNA, 23 bp, Homo sapiens
ttctccagcctggacccccagct

SEQ ID NO: 3245537 - DNA, 13 bp, Homo sapiens
ttctccagctcag

SEQ ID NO: 3245538 - DNA, 19 bp, Homo sapiens
ttctccagctcagaaccca

SEQ ID NO: 3245539 - DNA, 12 bp, Homo sapiens
ttctccagctgg

SEQ ID NO: 3245540 - DNA, 22 bp, Homo sapiens
ttctcccacatgaggccatctc

SEQ ID NO: 3245541 - DNA, 20 bp, Homo sapiens
ttctcccagaatcccagccg

SEQ ID NO: 3245542 - DNA, 15 bp, Homo sapiens
ttctccccacagcct

SEQ ID NO: 3245543 - DNA, 16 bp, Homo sapiens
ttctccccacccaccc

SEQ ID NO: 3245544 - DNA, 12 bp, Homo sapiens
ttctccccagaa

SEQ ID NO: 3245545 - DNA, 20 bp, Homo sapiens
ttctcccccgacactgctgc

SEQ ID NO: 3245546 - DNA, 21 bp, Homo sapiens
ttctcccccgacactgctgca

SEQ ID NO: 3245547 - DNA, 14 bp, Homo sapiens
ttctccctttctct

SEQ ID NO: 3245548 - DNA, 14 bp, Homo sapiens
ttctccgccagcct

SEQ ID NO: 3245549 - DNA, 15 bp, Homo sapiens
ttctccgccagcctc

SEQ ID NO: 3245550 - DNA, 17 bp, Homo sapiens
ttctccgccagcctcct

SEQ ID NO: 3245551 - DNA, 17 bp, Homo sapiens
ttctccggggtctgtgc

SEQ ID NO: 3245552 - DNA, 21 bp, Homo sapiens
ttctccgggtgtggcctcagc

SEQ ID NO: 3245553 - DNA, 19 bp, Homo sapiens
ttctccgttagctcctgtg

SEQ ID NO: 3245554 - DNA, 19 bp, Homo sapiens
ttctcctcccttccttttc

SEQ ID NO: 3245555 - DNA, 18 bp, Homo sapiens
ttctcctgacccagtccc

SEQ ID NO: 3245556 - DNA, 22 bp, Homo sapiens
ttctcctgcgccccgcccacac

SEQ ID NO: 3245557 - DNA, 20 bp, Homo sapiens
ttctcctgtgaatggaggca

SEQ ID NO: 3245558 - DNA, 12 bp, Homo sapiens
ttctcctgtgct

SEQ ID NO: 3245559 - DNA, 16 bp, Homo sapiens
ttctccttccccagga

SEQ ID NO: 3245560 - DNA, 17 bp, Homo sapiens
ttctccttctccttccc

SEQ ID NO: 3245561 - DNA, 22 bp, Homo sapiens
ttctcctttcacaaccttctgt

SEQ ID NO: 3245562 - DNA, 13 bp, Homo sapiens
ttctcctttgcaa

SEQ ID NO: 3245563 - DNA, 13 bp, Homo sapiens
ttctccttttcct

SEQ ID NO: 3245564 - DNA, 20 bp, Homo sapiens
ttctctacagacttctccag

SEQ ID NO: 3245565 - DNA, 20 bp, Homo sapiens
ttctctacatgctctttttc

SEQ ID NO: 3245566 - DNA, 17 bp, Homo sapiens
ttctctagctctctagg

SEQ ID NO: 3245567 - DNA, 22 bp, Homo sapiens
ttctctagctctctaggcctct

SEQ ID NO: 3245568 - DNA, 12 bp, Homo sapiens
ttctctccagct

SEQ ID NO: 3245569 - DNA, 15 bp, Homo sapiens
ttctctcccatcctg

SEQ ID NO: 3245570 - DNA, 12 bp, Homo sapiens
ttctctcctccc

SEQ ID NO: 3245571 - DNA, 18 bp, Homo sapiens
ttctctctcctctctgct

SEQ ID NO: 3245572 - DNA, 13 bp, Homo sapiens
ttctctctctaag

SEQ ID NO: 3245573 - DNA, 18 bp, Homo sapiens
ttctctctctctcttcct

SEQ ID NO: 3245574 - DNA, 20 bp, Homo sapiens
ttctctctttatacagctgt

SEQ ID NO: 3245575 - DNA, 24 bp, Homo sapiens
ttctctgaacacaggcagctttct

SEQ ID NO: 3245576 - DNA, 11 bp, Homo sapiens
ttctctgactt

SEQ ID NO: 3245577 - DNA, 12 bp, Homo sapiens
ttctctgacttc

SEQ ID NO: 3245578 - DNA, 17 bp, Homo sapiens
ttctctgacttctgcct

SEQ ID NO: 3245579 - DNA, 11 bp, Homo sapiens
ttctctgcagt

SEQ ID NO: 3245580 - DNA, 14 bp, Homo sapiens
ttctctgcagtaaa

SEQ ID NO: 3245581 - DNA, 21 bp, Homo sapiens
ttctctgcagtaaaacacatt

SEQ ID NO: 3245582 - DNA, 22 bp, Homo sapiens
ttctctgccgctacctccctcc

SEQ ID NO: 3245583 - DNA, 20 bp, Homo sapiens
ttctctgcctttgacattta

SEQ ID NO: 3245584 - DNA, 11 bp, Homo sapiens
ttctctgctcc

SEQ ID NO: 3245585 - DNA, 22 bp, Homo sapiens
ttctctggaaaggggggagctg

SEQ ID NO: 3245586 - DNA, 13 bp, Homo sapiens
ttctctgtacttt

SEQ ID NO: 3245587 - DNA, 13 bp, Homo sapiens
ttctctgtagttc

SEQ ID NO: 3245588 - DNA, 15 bp, Homo sapiens
ttctctgtagttcct

SEQ ID NO: 3245589 - DNA, 14 bp, Homo sapiens
ttctctgtcctact

SEQ ID NO: 3245590 - DNA, 17 bp, Homo sapiens
ttctctgtgtctaagat

SEQ ID NO: 3245591 - DNA, 18 bp, Homo sapiens
ttctctgtgtctaagatt

SEQ ID NO: 3245592 - DNA, 20 bp, Homo sapiens
ttctctgtgtctaagattct

SEQ ID NO: 3245593 - DNA, 18 bp, Homo sapiens
ttctctgtgtttgttcct

SEQ ID NO: 3245594 - DNA, 24 bp, Homo sapiens
ttctctgtgtttgttcctacagcc

SEQ ID NO: 3245595 - DNA, 15 bp, Homo sapiens
ttctctgttcccttg

SEQ ID NO: 3245596 - DNA, 15 bp, Homo sapiens
ttctcttaatttaat

SEQ ID NO: 3245597 - DNA, 18 bp, Homo sapiens
ttctcttagcaactcaga

SEQ ID NO: 3245598 - DNA, 18 bp, Homo sapiens
ttctcttagctactgtat

SEQ ID NO: 3245599 - DNA, 22 bp, Homo sapiens
ttctcttaggtggctctgggaa

SEQ ID NO: 3245600 - DNA, 23 bp, Homo sapiens
ttctcttccctgcgcctgtgatg

SEQ ID NO: 3245601 - DNA, 16 bp, Homo sapiens
ttctcttctctgcaat

SEQ ID NO: 3245602 - DNA, 15 bp, Homo sapiens
ttctcttgaataaag

SEQ ID NO: 3245603 - DNA, 15 bp, Homo sapiens
ttctcttgagctggc

SEQ ID NO: 3245604 - DNA, 20 bp, Homo sapiens
ttctcttgagctggcctctc

SEQ ID NO: 3245605 - DNA, 18 bp, Homo sapiens
ttctcttgagtcacactg

SEQ ID NO: 3245606 - DNA, 17 bp, Homo sapiens
ttctcttgggaactgaa

SEQ ID NO: 3245607 - DNA, 22 bp, Homo sapiens
ttctcttgggaactgaactcac

SEQ ID NO: 3245608 - DNA, 19 bp, Homo sapiens
ttctctttaaaatatttgt

SEQ ID NO: 3245609 - DNA, 13 bp, Homo sapiens
ttctctttctctc

SEQ ID NO: 3245610 - DNA, 14 bp, Homo sapiens
ttctctttctctct

SEQ ID NO: 3245611 - DNA, 21 bp, Homo sapiens
ttctctttgtctgccttccca

SEQ ID NO: 3245612 - DNA, 15 bp, Homo sapiens
ttctcttttcctttg

SEQ ID NO: 3245613 - DNA, 16 bp, Homo sapiens
ttctgaaaattccaga

SEQ ID NO: 3245614 - DNA, 21 bp, Homo sapiens
ttctgaaacttcataaatgtt

SEQ ID NO: 3245615 - DNA, 20 bp, Homo sapiens
ttctgaaatttttttcctaa

SEQ ID NO: 3245616 - DNA, 14 bp, Homo sapiens
ttctgaactgttac

SEQ ID NO: 3245617 - DNA, 22 bp, Homo sapiens
ttctgaactgttacaacttgta

SEQ ID NO: 3245618 - DNA, 16 bp, Homo sapiens
ttctgaagactgagaa

SEQ ID NO: 3245619 - DNA, 15 bp, Homo sapiens
ttctgaataacttga

SEQ ID NO: 3245620 - DNA, 17 bp, Homo sapiens
ttctgaataatttctta

SEQ ID NO: 3245621 - DNA, 14 bp, Homo sapiens
ttctgaatgctgct

SEQ ID NO: 3245622 - DNA, 11 bp, Homo sapiens
ttctgaattca

SEQ ID NO: 3245623 - DNA, 19 bp, Homo sapiens
ttctgaattcaaagcttgt

SEQ ID NO: 3245624 - DNA, 14 bp, Homo sapiens
ttctgacaaactgt

SEQ ID NO: 3245625 - DNA, 20 bp, Homo sapiens
ttctgacaaactgtgtacat

SEQ ID NO: 3245626 - DNA, 13 bp, Homo sapiens
ttctgacatgcat

SEQ ID NO: 3245627 - DNA, 16 bp, Homo sapiens
ttctgacatgcattgt

SEQ ID NO: 3245628 - DNA, 18 bp, Homo sapiens
ttctgacatttatatttg

SEQ ID NO: 3245629 - DNA, 17 bp, Homo sapiens
ttctgacggccctgcaa

SEQ ID NO: 3245630 - DNA, 19 bp, Homo sapiens
ttctgactcggtttctcca

SEQ ID NO: 3245631 - DNA, 13 bp, Homo sapiens
ttctgactttact

SEQ ID NO: 3245632 - DNA, 13 bp, Homo sapiens
ttctgagaaggtg

SEQ ID NO: 3245633 - DNA, 12 bp, Homo sapiens
ttctgagaccag

SEQ ID NO: 3245634 - DNA, 19 bp, Homo sapiens
ttctgagcccgggctgcct

SEQ ID NO: 3245635 - DNA, 23 bp, Homo sapiens
ttgacacatccgccttttgtata

SEQ ID NO: 3245636 - DNA, 13 bp, Homo sapiens
ttgacaccaacca

SEQ ID NO: 3245637 - DNA, 12 bp, Homo sapiens
ttgacacctgct

SEQ ID NO: 3245638 - DNA, 23 bp, Homo sapiens
ttgacactagcccaatgaaatga

SEQ ID NO: 3245639 - DNA, 12 bp, Homo sapiens
ttgacactgagc

SEQ ID NO: 3245640 - DNA, 14 bp, Homo sapiens
ttgacactgctcta

SEQ ID NO: 3245641 - DNA, 12 bp, Homo sapiens
ttgacagggcac

SEQ ID NO: 3245642 - DNA, 20 bp, Homo sapiens
ttgacataacactataaagg

SEQ ID NO: 3245643 - DNA, 22 bp, Homo sapiens
ttgacataagatggttgaccaa

SEQ ID NO: 3245644 - DNA, 13 bp, Homo sapiens
ttgacatggaaat

SEQ ID NO: 3245645 - DNA, 19 bp, Homo sapiens
ttgacatgtgcaattgtga

SEQ ID NO: 3245646 - DNA, 22 bp, Homo sapiens
ttgacatgtggaaagtgaattt

SEQ ID NO: 3245647 - DNA, 22 bp, Homo sapiens
ttgacattaagaatgttggttt

SEQ ID NO: 3245648 - DNA, 11 bp, Homo sapiens
ttgacatttaa

SEQ ID NO: 3245649 - DNA, 14 bp, Homo sapiens
ttgaccaagaactg

SEQ ID NO: 3245650 - DNA, 18 bp, Homo sapiens
ttgaccaaggtgcttttc

SEQ ID NO: 3245651 - DNA, 17 bp, Homo sapiens
ttgaccccgatatattt

SEQ ID NO: 3245652 - DNA, 16 bp, Homo sapiens
ttgaccgtactctcac

SEQ ID NO: 3245653 - DNA, 15 bp, Homo sapiens
ttgacctctcagggc

SEQ ID NO: 3245654 - DNA, 15 bp, Homo sapiens
ttgacgattccttct

SEQ ID NO: 3245655 - DNA, 23 bp, Homo sapiens
ttgactaactcaaatacacattt

SEQ ID NO: 3245656 - DNA, 14 bp, Homo sapiens
ttgactcagaggct

SEQ ID NO: 3245657 - DNA, 22 bp, Homo sapiens
ttgactctaatatgattataca

SEQ ID NO: 3245658 - DNA, 20 bp, Homo sapiens
ttgactcttttgagtggtaa

SEQ ID NO: 3245659 - DNA, 21 bp, Homo sapiens
ttgactcttttgccattaaac

SEQ ID NO: 3245660 - DNA, 19 bp, Homo sapiens
ttgactgtctcacttttta

SEQ ID NO: 3245661 - DNA, 16 bp, Homo sapiens
ttgactttttgcattt

SEQ ID NO: 3245662 - DNA, 17 bp, Homo sapiens
ttgagaaccagtctcct

SEQ ID NO: 3245663 - DNA, 19 bp, Homo sapiens
ttgagaaccagtctcctca

SEQ ID NO: 3245664 - DNA, 21 bp, Homo sapiens
ttgagaagccttcagctccag

SEQ ID NO: 3245665 - DNA, 23 bp, Homo sapiens
ttgagaagccttcagctccaggg

SEQ ID NO: 3245666 - DNA, 20 bp, Homo sapiens
ttgagaatcccttaaaatta

SEQ ID NO: 3245667 - DNA, 22 bp, Homo sapiens
ttgagaatcccttaaaattacc

SEQ ID NO: 3245668 - DNA, 17 bp, Homo sapiens
ttgagaatggaaaccac

SEQ ID NO: 3245669 - DNA, 13 bp, Homo sapiens
ttgagaattttaa

SEQ ID NO: 3245670 - DNA, 20 bp, Homo sapiens
ttgagacaagccctggcaac

SEQ ID NO: 3245671 - DNA, 22 bp, Homo sapiens
ttgagacacggagcccagccct

SEQ ID NO: 3245672 - DNA, 12 bp, Homo sapiens
ttgagacagagt

SEQ ID NO: 3245673 - DNA, 16 bp, Homo sapiens
ttgagactatttaaac

SEQ ID NO: 3245674 - DNA, 10 bp, Homo sapiens
ttgagactgg

SEQ ID NO: 3245675 - DNA, 13 bp, Homo sapiens
ttgagacttaaaa

SEQ ID NO: 3245676 - DNA, 15 bp, Homo sapiens
ttgagactttttggt

SEQ ID NO: 3245677 - DNA, 17 bp, Homo sapiens
ttgagagaagagacaaa

SEQ ID NO: 3245678 - DNA, 15 bp, Homo sapiens
ttgagatggtaacag

SEQ ID NO: 3245679 - DNA, 17 bp, Homo sapiens
ttgagatggtgaggctg

SEQ ID NO: 3245680 - DNA, 20 bp, Homo sapiens
ttgagatgtgttcctcctgc

SEQ ID NO: 3245681 - DNA, 15 bp, Homo sapiens
ttgagattgccccag

SEQ ID NO: 3245682 - DNA, 19 bp, Homo sapiens
ttgagattgccccaggtct

SEQ ID NO: 3245683 - DNA, 16 bp, Homo sapiens
ttgagcagggctcagc

SEQ ID NO: 3245684 - DNA, 18 bp, Homo sapiens
ttgagccccaagtcctga

SEQ ID NO: 3245685 - DNA, 15 bp, Homo sapiens
ttgagccctggctgt

SEQ ID NO: 3245686 - DNA, 19 bp, Homo sapiens
ttgagccgggcccctgggc

SEQ ID NO: 3245687 - DNA, 12 bp, Homo sapiens
ttgagcctcccc

SEQ ID NO: 3245688 - DNA, 19 bp, Homo sapiens
ttgagctactggattctta

SEQ ID NO: 3245689 - DNA, 11 bp, Homo sapiens
ttgagctgcct

SEQ ID NO: 3245690 - DNA, 19 bp, Homo sapiens
ttgagctgccttccctagc

SEQ ID NO: 3245691 - DNA, 13 bp, Homo sapiens
ttgaggaaatatt

SEQ ID NO: 3245692 - DNA, 19 bp, Homo sapiens
ttgaggaactgtacagaaa

SEQ ID NO: 3245693 - DNA, 16 bp, Homo sapiens
ttgaggagccccagct

SEQ ID NO: 3245694 - DNA, 17 bp, Homo sapiens
ttgaggagctgcactga

SEQ ID NO: 3245695 - DNA, 15 bp, Homo sapiens
ttgaggagtttccta

SEQ ID NO: 3245696 - DNA, 21 bp, Homo sapiens
ttgaggatatattttcacttt

SEQ ID NO: 3245697 - DNA, 18 bp, Homo sapiens
ttgaggattgtggaaaac

SEQ ID NO: 3245698 - DNA, 13 bp, Homo sapiens
ttgaggcaagtgt

SEQ ID NO: 3245699 - DNA, 14 bp, Homo sapiens
ttgaggctgcagcg

SEQ ID NO: 3245700 - DNA, 17 bp, Homo sapiens
ttgaggcttctccttct

SEQ ID NO: 3245701 - DNA, 20 bp, Homo sapiens
ttgagggactgcctctgcca

SEQ ID NO: 3245702 - DNA, 23 bp, Homo sapiens
ttgagggcccagagcaggaagca

SEQ ID NO: 3245703 - DNA, 15 bp, Homo sapiens
ttgaggggattaata

SEQ ID NO: 3245704 - DNA, 22 bp, Homo sapiens
ttgaggggattaatatgaaaac

SEQ ID NO: 3245705 - DNA, 15 bp, Homo sapiens
ttgaggggctcctgg

SEQ ID NO: 3245706 - DNA, 16 bp, Homo sapiens
ttgaggggctcctgga

SEQ ID NO: 3245707 - DNA, 21 bp, Homo sapiens
ttgaggtagaccaggatttct

SEQ ID NO: 3245708 - DNA, 22 bp, Homo sapiens
ttgaggtcaagtaagaagacat

SEQ ID NO: 3245709 - DNA, 23 bp, Homo sapiens
ttgaggtcttttgacatgtggaa

SEQ ID NO: 3245710 - DNA, 21 bp, Homo sapiens
ttgaggtggtctgaatgttct

SEQ ID NO: 3245711 - DNA, 19 bp, Homo sapiens
ttgaggtggtgccttctca

SEQ ID NO: 3245712 - DNA, 22 bp, Homo sapiens
ttgaggtttttaaatatatatt

SEQ ID NO: 3245713 - DNA, 18 bp, Homo sapiens
ttgagtacagtgaggagg

SEQ ID NO: 3245714 - DNA, 19 bp, Homo sapiens
ttgagtagatattacttta

SEQ ID NO: 3245715 - DNA, 13 bp, Homo sapiens
ttgagtattgttt

SEQ ID NO: 3245716 - DNA, 15 bp, Homo sapiens
ttgagtattgtttaa

SEQ ID NO: 3245717 - DNA, 22 bp, Homo sapiens
ttgagtattgtttaaaatgtaa

SEQ ID NO: 3245718 - DNA, 12 bp, Homo sapiens
ttgagtcagaaa

SEQ ID NO: 3245719 - DNA, 21 bp, Homo sapiens
ttgagtcaggagcttattaca

SEQ ID NO: 3245720 - DNA, 23 bp, Homo sapiens
ttgagtcattgacttcattttat

SEQ ID NO: 3245721 - DNA, 17 bp, Homo sapiens
ttgagtctgtactaaac

SEQ ID NO: 3245722 - DNA, 21 bp, Homo sapiens
ttgagtgctgtctccatgttt

SEQ ID NO: 3245723 - DNA, 15 bp, Homo sapiens
ttgagtgtcttctaa

SEQ ID NO: 3245724 - DNA, 18 bp, Homo sapiens
ttgagtgttcctttttaa

SEQ ID NO: 3245725 - DNA, 23 bp, Homo sapiens
ttgagtgttcctttttaaatgtg

SEQ ID NO: 3245726 - DNA, 21 bp, Homo sapiens
ttgagttacattaaaataaac

SEQ ID NO: 3245727 - DNA, 18 bp, Homo sapiens
ttgagtttataattcagg

SEQ ID NO: 3245728 - DNA, 20 bp, Homo sapiens
ttgagttttatttattttat

SEQ ID NO: 3245729 - DNA, 12 bp, Homo sapiens
ttgataaagtaa

SEQ ID NO: 3245730 - DNA, 20 bp, Homo sapiens
ttgataaatatatatgatca

SEQ ID NO: 3245731 - DNA, 16 bp, Homo sapiens
ttgataatattagtga

SEQ ID NO: 3245732 - DNA, 18 bp, Homo sapiens
ttgataatattagtgatt

SEQ ID NO: 3245733 - DNA, 14 bp, Homo sapiens
ttgataatcttcag

SEQ ID NO: 3245734 - DNA, 16 bp, Homo sapiens
ttgataatcttcaggt

SEQ ID NO: 3245735 - DNA, 20 bp, Homo sapiens
ttgataatgttaaatttgta

SEQ ID NO: 3245736 - DNA, 22 bp, Homo sapiens
ttgataatgttaaatttgtaag

SEQ ID NO: 3245737 - DNA, 15 bp, Homo sapiens
ttgatacccccctct

SEQ ID NO: 3245738 - DNA, 16 bp, Homo sapiens
ttgatacccctgggga

SEQ ID NO: 3245739 - DNA, 23 bp, Homo sapiens
ttgatacccctggggaacatttc

SEQ ID NO: 3245740 - DNA, 18 bp, Homo sapiens
ttgatacttgttccagat

SEQ ID NO: 3245741 - DNA, 21 bp, Homo sapiens
ttgatagaaaggaacacgttt

SEQ ID NO: 3245742 - DNA, 14 bp, Homo sapiens
ttgatagctttatt

SEQ ID NO: 3245743 - DNA, 16 bp, Homo sapiens
ttgataggaactgtct

SEQ ID NO: 3245744 - DNA, 21 bp, Homo sapiens
ttgatataatttccatagtgt

SEQ ID NO: 3245745 - DNA, 15 bp, Homo sapiens
ttgatatacattgtg

SEQ ID NO: 3245746 - DNA, 13 bp, Homo sapiens
ttgatataccaaa

SEQ ID NO: 3245747 - DNA, 16 bp, Homo sapiens
ttgatatgagtataca

SEQ ID NO: 3245748 - DNA, 16 bp, Homo sapiens
ttgatatttgcattga

SEQ ID NO: 3245749 - DNA, 20 bp, Homo sapiens
ttgatatttttccatttatt

SEQ ID NO: 3245750 - DNA, 21 bp, Homo sapiens
ttgatcaaatatagaaagttg

SEQ ID NO: 3245751 - DNA, 18 bp, Homo sapiens
ttgatcatccctttctcc

SEQ ID NO: 3245752 - DNA, 17 bp, Homo sapiens
ttgatcatgtacttttt

SEQ ID NO: 3245753 - DNA, 23 bp, Homo sapiens
ttgatcccagaaagtatatactg

SEQ ID NO: 3245754 - DNA, 23 bp, Homo sapiens
ttgatccctaaccctacaaagag

SEQ ID NO: 3245755 - DNA, 21 bp, Homo sapiens
ttgatccctgttacccagaga

SEQ ID NO: 3245756 - DNA, 14 bp, Homo sapiens
ttgatctggacaga

SEQ ID NO: 3245757 - DNA, 14 bp, Homo sapiens
ttgatgaaatcatt

SEQ ID NO: 3245758 - DNA, 16 bp, Homo sapiens
ttgatgaagcaaggaa

SEQ ID NO: 3245759 - DNA, 21 bp, Homo sapiens
ttgatgaagcaaggaagatat

SEQ ID NO: 3245760 - DNA, 15 bp, Homo sapiens
ttgcttcttactgat

SEQ ID NO: 3245761 - DNA, 18 bp, Homo sapiens
ttgcttcttactgataat

SEQ ID NO: 3245762 - DNA, 19 bp, Homo sapiens
ttgcttgaacacagtattt

SEQ ID NO: 3245763 - DNA, 17 bp, Homo sapiens
ttgcttgtactgggaca

SEQ ID NO: 3245764 - DNA, 13 bp, Homo sapiens
ttgcttgtcattg

SEQ ID NO: 3245765 - DNA, 23 bp, Homo sapiens
ttgcttgttgggattcctgaccc

SEQ ID NO: 3245766 - DNA, 24 bp, Homo sapiens
ttgcttgttgggattcctgaccca

SEQ ID NO: 3245767 - DNA, 15 bp, Homo sapiens
ttgctttctgaaatt

SEQ ID NO: 3245768 - DNA, 14 bp, Homo sapiens
ttgctttgaagcag

SEQ ID NO: 3245769 - DNA, 15 bp, Homo sapiens
ttgctttgaagcagt

SEQ ID NO: 3245770 - DNA, 20 bp, Homo sapiens
ttgctttgggctttgcaggc

SEQ ID NO: 3245771 - DNA, 13 bp, Homo sapiens
ttgctttgtatgc

SEQ ID NO: 3245772 - DNA, 16 bp, Homo sapiens
ttgctttgtatgcact

SEQ ID NO: 3245773 - DNA, 15 bp, Homo sapiens
ttgcttttattttga

SEQ ID NO: 3245774 - DNA, 13 bp, Homo sapiens
ttgcttttgtgaa

SEQ ID NO: 3245775 - DNA, 15 bp, Homo sapiens
ttgcttttgtttttt

SEQ ID NO: 3245776 - DNA, 22 bp, Homo sapiens
ttgcttttgtttttttcctcat

SEQ ID NO: 3245777 - DNA, 19 bp, Homo sapiens
ttgctttttcacagtcact

SEQ ID NO: 3245778 - DNA, 15 bp, Homo sapiens
ttgcttttttccaaa

SEQ ID NO: 3245779 - DNA, 15 bp, Homo sapiens
ttggaaaaaatttgt

SEQ ID NO: 3245780 - DNA, 13 bp, Homo sapiens
ttggaaaaatggg

SEQ ID NO: 3245781 - DNA, 22 bp, Homo sapiens
ttggaaaaatgggtcttttata

SEQ ID NO: 3245782 - DNA, 19 bp, Homo sapiens
ttggaaaagaatacagaaa

SEQ ID NO: 3245783 - DNA, 22 bp, Homo sapiens
ttggaaagcatcacctcaggcc

SEQ ID NO: 3245784 - DNA, 17 bp, Homo sapiens
ttggaaagtacactctg

SEQ ID NO: 3245785 - DNA, 15 bp, Homo sapiens
ttggaaagtgccagc

SEQ ID NO: 3245786 - DNA, 21 bp, Homo sapiens
ttggaaataaagtcagatgga

SEQ ID NO: 3245787 - DNA, 13 bp, Homo sapiens
ttggaaatattca

SEQ ID NO: 3245788 - DNA, 21 bp, Homo sapiens
ttggaaatgtacttttggata

SEQ ID NO: 3245789 - DNA, 23 bp, Homo sapiens
ttggaaatgtacttttggataag

SEQ ID NO: 3245790 - DNA, 14 bp, Homo sapiens
ttggaacatttctt

SEQ ID NO: 3245791 - DNA, 22 bp, Homo sapiens
ttggaaccacggagatctcctt

SEQ ID NO: 3245792 - DNA, 13 bp, Homo sapiens
ttggaagagaaag

SEQ ID NO: 3245793 - DNA, 13 bp, Homo sapiens
ttggaaggggcct

SEQ ID NO: 3245794 - DNA, 17 bp, Homo sapiens
ttggaaggggccttgct

SEQ ID NO: 3245795 - DNA, 15 bp, Homo sapiens
ttggaagtacatgaa

SEQ ID NO: 3245796 - DNA, 16 bp, Homo sapiens
ttggaagttttcagga

SEQ ID NO: 3245797 - DNA, 13 bp, Homo sapiens
ttggaatattaaa

SEQ ID NO: 3245798 - DNA, 16 bp, Homo sapiens
ttggaatattaaaaaa

SEQ ID NO: 3245799 - DNA, 15 bp, Homo sapiens
ttggaatattacaat

SEQ ID NO: 3245800 - DNA, 18 bp, Homo sapiens
ttggaatatttgaataat

SEQ ID NO: 3245801 - DNA, 22 bp, Homo sapiens
ttggaatctagccgatggaaaa

SEQ ID NO: 3245802 - DNA, 23 bp, Homo sapiens
ttggaatggaactactgtacttt

SEQ ID NO: 3245803 - DNA, 19 bp, Homo sapiens
ttggaatttgtaacctcag

SEQ ID NO: 3245804 - DNA, 19 bp, Homo sapiens
ttggacaggagtcagtgtc

SEQ ID NO: 3245805 - DNA, 20 bp, Homo sapiens
ttggacaggagtcagtgtct

SEQ ID NO: 3245806 - DNA, 15 bp, Homo sapiens
ttggacagtttacca

SEQ ID NO: 3245807 - DNA, 14 bp, Homo sapiens
ttggaccccagctg

SEQ ID NO: 3245808 - DNA, 16 bp, Homo sapiens
ttggaccccagctggg

SEQ ID NO: 3245809 - DNA, 23 bp, Homo sapiens
ttggacctaaatggcctcatgtg

SEQ ID NO: 3245810 - DNA, 19 bp, Homo sapiens
ttggactcagcccacctgc

SEQ ID NO: 3245811 - DNA, 15 bp, Homo sapiens
ttggactctcaggga

SEQ ID NO: 3245812 - DNA, 17 bp, Homo sapiens
ttggactcttgctcttt

SEQ ID NO: 3245813 - DNA, 16 bp, Homo sapiens
ttggactgagatttct

SEQ ID NO: 3245814 - DNA, 17 bp, Homo sapiens
ttggactgagatttctt

SEQ ID NO: 3245815 - DNA, 20 bp, Homo sapiens
ttggacttcctggggccccg

SEQ ID NO: 3245816 - DNA, 23 bp, Homo sapiens
ttggactttcaaaattaaatctg

SEQ ID NO: 3245817 - DNA, 18 bp, Homo sapiens
ttggacttttcgttaaca

SEQ ID NO: 3245818 - DNA, 20 bp, Homo sapiens
ttggagaagcccgtgtgaga

SEQ ID NO: 3245819 - DNA, 13 bp, Homo sapiens
ttggagaatttag

SEQ ID NO: 3245820 - DNA, 18 bp, Homo sapiens
ttggagaatttaggtttt

SEQ ID NO: 3245821 - DNA, 18 bp, Homo sapiens
ttggagacacaactattt

SEQ ID NO: 3245822 - DNA, 20 bp, Homo sapiens
ttggagacacaactattttt

SEQ ID NO: 3245823 - DNA, 20 bp, Homo sapiens
ttggagactctgtggggcct

SEQ ID NO: 3245824 - DNA, 23 bp, Homo sapiens
ttggagactggggtggcctcaag

SEQ ID NO: 3245825 - DNA, 15 bp, Homo sapiens
ttggagagacacagc

SEQ ID NO: 3245826 - DNA, 23 bp, Homo sapiens
ttggagatacgtaaagccttgtt

SEQ ID NO: 3245827 - DNA, 22 bp, Homo sapiens
ttggagatgctgagggtgtttc

SEQ ID NO: 3245828 - DNA, 23 bp, Homo sapiens
ttggagcaggcaaaaaagggaca

SEQ ID NO: 3245829 - DNA, 12 bp, Homo sapiens
ttggagccactc

SEQ ID NO: 3245830 - DNA, 14 bp, Homo sapiens
ttggagcccgtgca

SEQ ID NO: 3245831 - DNA, 17 bp, Homo sapiens
ttggaggcctttcatcc

SEQ ID NO: 3245832 - DNA, 22 bp, Homo sapiens
ttggagggtgggagagcccagc

SEQ ID NO: 3245833 - DNA, 18 bp, Homo sapiens
ttggaggtgcttaagcag

SEQ ID NO: 3245834 - DNA, 12 bp, Homo sapiens
ttggataagtag

SEQ ID NO: 3245835 - DNA, 19 bp, Homo sapiens
ttggatacttggatttagt

SEQ ID NO: 3245836 - DNA, 19 bp, Homo sapiens
ttggatcttcaatggcttt

SEQ ID NO: 3245837 - DNA, 16 bp, Homo sapiens
ttggatggcttgtcta

SEQ ID NO: 3245838 - DNA, 21 bp, Homo sapiens
ttggatgggagtgagacagaa

SEQ ID NO: 3245839 - DNA, 14 bp, Homo sapiens
ttggatgggagtgg

SEQ ID NO: 3245840 - DNA, 21 bp, Homo sapiens
ttggatgggagtgggcacctc

SEQ ID NO: 3245841 - DNA, 23 bp, Homo sapiens
ttggatggggctggcatgttttc

SEQ ID NO: 3245842 - DNA, 15 bp, Homo sapiens
ttggatgtaatttag

SEQ ID NO: 3245843 - DNA, 14 bp, Homo sapiens
ttggattaatcttt

SEQ ID NO: 3245844 - DNA, 15 bp, Homo sapiens
ttggattatttaata

SEQ ID NO: 3245845 - DNA, 18 bp, Homo sapiens
ttggattatttaataaca

SEQ ID NO: 3245846 - DNA, 20 bp, Homo sapiens
ttggattatttaataacatt

SEQ ID NO: 3245847 - DNA, 15 bp, Homo sapiens
ttggattcttatgta

SEQ ID NO: 3245848 - DNA, 19 bp, Homo sapiens
ttggatttgctcattgctg

SEQ ID NO: 3245849 - DNA, 20 bp, Homo sapiens
ttggattttgcaaggtgcat

SEQ ID NO: 3245850 - DNA, 17 bp, Homo sapiens
ttggcaaaagccttgtg

SEQ ID NO: 3245851 - DNA, 15 bp, Homo sapiens
ttggcaacagaagca

SEQ ID NO: 3245852 - DNA, 19 bp, Homo sapiens
ttggcaacaggacagagtt

SEQ ID NO: 3245853 - DNA, 18 bp, Homo sapiens
ttggcaagaacttgttta

SEQ ID NO: 3245854 - DNA, 20 bp, Homo sapiens
ttggcaagaacttgtttaca

SEQ ID NO: 3245855 - DNA, 22 bp, Homo sapiens
ttggcaagaacttgtttacaac

SEQ ID NO: 3245856 - DNA, 16 bp, Homo sapiens
ttggcaatagtttgca

SEQ ID NO: 3245857 - DNA, 19 bp, Homo sapiens
ttggcaatttcctggccct

SEQ ID NO: 3245858 - DNA, 20 bp, Homo sapiens
ttggcaatttcctggccctc

SEQ ID NO: 3245859 - DNA, 22 bp, Homo sapiens
ttggcaccccagctaccccttc

SEQ ID NO: 3245860 - DNA, 15 bp, Homo sapiens
ttggcacttgtattt

SEQ ID NO: 3245861 - DNA, 17 bp, Homo sapiens
ttggcacttgtatttaa

SEQ ID NO: 3245862 - DNA, 14 bp, Homo sapiens
ttggcaggctggcc

SEQ ID NO: 3245863 - DNA, 20 bp, Homo sapiens
ttggcaggtcctggccagat

SEQ ID NO: 3245864 - DNA, 11 bp, Homo sapiens
ttggcagtgtt

SEQ ID NO: 3245865 - DNA, 12 bp, Homo sapiens
ttggcagtgttt

SEQ ID NO: 3245866 - DNA, 14 bp, Homo sapiens
ttggcagtttggta

SEQ ID NO: 3245867 - DNA, 11 bp, Homo sapiens
ttggcatttct

SEQ ID NO: 3245868 - DNA, 24 bp, Homo sapiens
ttggccaaagccaaagctaggcct

SEQ ID NO: 3245869 - DNA, 21 bp, Homo sapiens
ttggccacaacctgaaagaca

SEQ ID NO: 3245870 - DNA, 19 bp, Homo sapiens
ttggccctttccttccaga

SEQ ID NO: 3245871 - DNA, 21 bp, Homo sapiens
ttggccggctgtgctcagaga

SEQ ID NO: 3245872 - DNA, 15 bp, Homo sapiens
ttggcctcagctggc

SEQ ID NO: 3245873 - DNA, 16 bp, Homo sapiens
ttggcctcagctggct

SEQ ID NO: 3245874 - DNA, 20 bp, Homo sapiens
ttggcctcagggccaggaag

SEQ ID NO: 3245875 - DNA, 14 bp, Homo sapiens
ttggcctgctgtga

SEQ ID NO: 3245876 - DNA, 19 bp, Homo sapiens
ttggcctgtagagttgctg

SEQ ID NO: 3245877 - DNA, 22 bp, Homo sapiens
ttggcctgtctcatccccaggg

SEQ ID NO: 3245878 - DNA, 21 bp, Homo sapiens
ttggcctgtttgatgtatgtg

SEQ ID NO: 3245879 - DNA, 15 bp, Homo sapiens
ttggcgctattacaa

SEQ ID NO: 3245880 - DNA, 16 bp, Homo sapiens
ttggcgctattacaaa

SEQ ID NO: 3245881 - DNA, 22 bp, Homo sapiens
ttggcgtagcagagttaaatct

SEQ ID NO: 3245882 - DNA, 13 bp, Homo sapiens
ttggcgtggagca

SEQ ID NO: 3245883 - DNA, 14 bp, Homo sapiens
ttggcgtggagcag

SEQ ID NO: 3245884 - DNA, 22 bp, Homo sapiens
ttggctaggacccctccatgtg

SEQ ID NO: 3245885 - DNA, 14 bp, Homo sapiens
ttgtcaatattaaa

SEQ ID NO: 3245886 - DNA, 23 bp, Homo sapiens
ttgtcacaatcctaacacattat

SEQ ID NO: 3245887 - DNA, 16 bp, Homo sapiens
ttgtcacatcagataa

SEQ ID NO: 3245888 - DNA, 16 bp, Homo sapiens
ttgtcacattatttat

SEQ ID NO: 3245889 - DNA, 16 bp, Homo sapiens
ttgtcacctctgttaa

SEQ ID NO: 3245890 - DNA, 21 bp, Homo sapiens
ttgtcacctctgttaaggttg

SEQ ID NO: 3245891 - DNA, 22 bp, Homo sapiens
ttgtcactgacacaaaggaagt

SEQ ID NO: 3245892 - DNA, 16 bp, Homo sapiens
ttgtcactttttctga

SEQ ID NO: 3245893 - DNA, 16 bp, Homo sapiens
ttgtcagacataaagc

SEQ ID NO: 3245894 - DNA, 18 bp, Homo sapiens
ttgtcagacataaagcca

SEQ ID NO: 3245895 - DNA, 12 bp, Homo sapiens
ttgtcagacttt

SEQ ID NO: 3245896 - DNA, 15 bp, Homo sapiens
ttgtcagtatctgta

SEQ ID NO: 3245897 - DNA, 15 bp, Homo sapiens
ttgtcagtgacagta

SEQ ID NO: 3245898 - DNA, 21 bp, Homo sapiens
ttgtcatataagattcatatt

SEQ ID NO: 3245899 - DNA, 13 bp, Homo sapiens
ttgtcatttataa

SEQ ID NO: 3245900 - DNA, 13 bp, Homo sapiens
ttgtcattttatg

SEQ ID NO: 3245901 - DNA, 23 bp, Homo sapiens
ttgtcccagcctggggctccctc

SEQ ID NO: 3245902 - DNA, 21 bp, Homo sapiens
ttgtcccattttccccttcct

SEQ ID NO: 3245903 - DNA, 13 bp, Homo sapiens
ttgtccccagggc

SEQ ID NO: 3245904 - DNA, 15 bp, Homo sapiens
ttgtccccagggccc

SEQ ID NO: 3245905 - DNA, 20 bp, Homo sapiens
ttgtccccagggcccctccc

SEQ ID NO: 3245906 - DNA, 15 bp, Homo sapiens
ttgtccccgtggtct

SEQ ID NO: 3245907 - DNA, 18 bp, Homo sapiens
ttgtccgtgttcatacat

SEQ ID NO: 3245908 - DNA, 14 bp, Homo sapiens
ttgtcctgccagct

SEQ ID NO: 3245909 - DNA, 17 bp, Homo sapiens
ttgtcctgccagctgcc

SEQ ID NO: 3245910 - DNA, 20 bp, Homo sapiens
ttgtcctgcctgcaatattt

SEQ ID NO: 3245911 - DNA, 20 bp, Homo sapiens
ttgtcctttaaaaaagaaaa

SEQ ID NO: 3245912 - DNA, 15 bp, Homo sapiens
ttgtcgtggttctta

SEQ ID NO: 3245913 - DNA, 15 bp, Homo sapiens
ttgtctaaaatgtca

SEQ ID NO: 3245914 - DNA, 16 bp, Homo sapiens
ttgtctaaaatgtcag

SEQ ID NO: 3245915 - DNA, 18 bp, Homo sapiens
ttgtctagtcattgtcat

SEQ ID NO: 3245916 - DNA, 19 bp, Homo sapiens
ttgtctatgaagttgctgt

SEQ ID NO: 3245917 - DNA, 22 bp, Homo sapiens
ttgtctatgaagttgctgttta

SEQ ID NO: 3245918 - DNA, 16 bp, Homo sapiens
ttgtctattctgagcc

SEQ ID NO: 3245919 - DNA, 17 bp, Homo sapiens
ttgtctattctgagcct

SEQ ID NO: 3245920 - DNA, 13 bp, Homo sapiens
ttgtctcagggcc

SEQ ID NO: 3245921 - DNA, 15 bp, Homo sapiens
ttgtctctcttcaga

SEQ ID NO: 3245922 - DNA, 12 bp, Homo sapiens
ttgtctctgggc

SEQ ID NO: 3245923 - DNA, 15 bp, Homo sapiens
ttgtctgaaacattt

SEQ ID NO: 3245924 - DNA, 21 bp, Homo sapiens
ttgtctgaagtcactgcacag

SEQ ID NO: 3245925 - DNA, 17 bp, Homo sapiens
ttgtctgaatgtattta

SEQ ID NO: 3245926 - DNA, 18 bp, Homo sapiens
ttgtctgaatgtatttat

SEQ ID NO: 3245927 - DNA, 16 bp, Homo sapiens
ttgtctgatttcttag

SEQ ID NO: 3245928 - DNA, 19 bp, Homo sapiens
ttgtctgtgttgctgttta

SEQ ID NO: 3245929 - DNA, 21 bp, Homo sapiens
ttgtcttaccacagtgtttta

SEQ ID NO: 3245930 - DNA, 22 bp, Homo sapiens
ttgtcttaccacagtgttttat

SEQ ID NO: 3245931 - DNA, 13 bp, Homo sapiens
ttgtcttatatat

SEQ ID NO: 3245932 - DNA, 15 bp, Homo sapiens
ttgtcttatctggcc

SEQ ID NO: 3245933 - DNA, 13 bp, Homo sapiens
ttgtcttattctt

SEQ ID NO: 3245934 - DNA, 15 bp, Homo sapiens
ttgtcttattgaaaa

SEQ ID NO: 3245935 - DNA, 22 bp, Homo sapiens
ttgtcttgaatgtcttttgaat

SEQ ID NO: 3245936 - DNA, 22 bp, Homo sapiens
ttgtcttgtacttctgtgttca

SEQ ID NO: 3245937 - DNA, 13 bp, Homo sapiens
ttgtcttgtggag

SEQ ID NO: 3245938 - DNA, 21 bp, Homo sapiens
ttgtcttgttctgtcccttcc

SEQ ID NO: 3245939 - DNA, 22 bp, Homo sapiens
ttgtcttgttctgtcccttcca

SEQ ID NO: 3245940 - DNA, 15 bp, Homo sapiens
ttgtcttttagacaa

SEQ ID NO: 3245941 - DNA, 16 bp, Homo sapiens
ttgtcttttctgctga

SEQ ID NO: 3245942 - DNA, 13 bp, Homo sapiens
ttgtgaactcatt

SEQ ID NO: 3245943 - DNA, 21 bp, Homo sapiens
ttgtgaactggaagaaagcaa

SEQ ID NO: 3245944 - DNA, 17 bp, Homo sapiens
ttgtgaactttttgtag

SEQ ID NO: 3245945 - DNA, 23 bp, Homo sapiens
ttgtgaattaggctgtaactact

SEQ ID NO: 3245946 - DNA, 22 bp, Homo sapiens
ttgtgactatatagagatgttt

SEQ ID NO: 3245947 - DNA, 18 bp, Homo sapiens
ttgtgatgtcccaacttg

SEQ ID NO: 3245948 - DNA, 22 bp, Homo sapiens
ttgtgattatttcactttagat

SEQ ID NO: 3245949 - DNA, 23 bp, Homo sapiens
ttgtgatttctttaaaagaatga

SEQ ID NO: 3245950 - DNA, 21 bp, Homo sapiens
ttgtgcaaaagcttcaaatta

SEQ ID NO: 3245951 - DNA, 22 bp, Homo sapiens
ttgtgcaaaagcttcaaattaa

SEQ ID NO: 3245952 - DNA, 16 bp, Homo sapiens
ttgtgcacatttattt

SEQ ID NO: 3245953 - DNA, 18 bp, Homo sapiens
ttgtgcacatttatttcc

SEQ ID NO: 3245954 - DNA, 17 bp, Homo sapiens
ttgtgcatcctgtgaaa

SEQ ID NO: 3245955 - DNA, 14 bp, Homo sapiens
ttgtgcattctgga

SEQ ID NO: 3245956 - DNA, 16 bp, Homo sapiens
ttgtgcattctttggt

SEQ ID NO: 3245957 - DNA, 22 bp, Homo sapiens
ttgtgcattctttggtaatttt

SEQ ID NO: 3245958 - DNA, 15 bp, Homo sapiens
ttgtgcatttgtaaa

SEQ ID NO: 3245959 - DNA, 22 bp, Homo sapiens
ttgtgccctgcccccatctccc

SEQ ID NO: 3245960 - DNA, 23 bp, Homo sapiens
ttgtgctacatgacgacaaagct

SEQ ID NO: 3245961 - DNA, 14 bp, Homo sapiens
ttgtgctgatgaga

SEQ ID NO: 3245962 - DNA, 14 bp, Homo sapiens
ttgtgctgtgggca

SEQ ID NO: 3245963 - DNA, 21 bp, Homo sapiens
ttgtgcttcacagtagagcca

SEQ ID NO: 3245964 - DNA, 12 bp, Homo sapiens
ttgtgcttctcc

SEQ ID NO: 3245965 - DNA, 17 bp, Homo sapiens
ttgtgcttctccccaga

SEQ ID NO: 3245966 - DNA, 19 bp, Homo sapiens
ttgtgcttctccccagaat

SEQ ID NO: 3245967 - DNA, 15 bp, Homo sapiens
ttgtgctttgctctt

SEQ ID NO: 3245968 - DNA, 14 bp, Homo sapiens
ttgtgcttttcctg

SEQ ID NO: 3245969 - DNA, 22 bp, Homo sapiens
ttgtggaagcaaaaatctgaaa

SEQ ID NO: 3245970 - DNA, 18 bp, Homo sapiens
ttgtggaccaattattga

SEQ ID NO: 3245971 - DNA, 11 bp, Homo sapiens
ttgtggcctca

SEQ ID NO: 3245972 - DNA, 18 bp, Homo sapiens
ttgtggctcctatctgtg

SEQ ID NO: 3245973 - DNA, 15 bp, Homo sapiens
ttgtggctcttattt

SEQ ID NO: 3245974 - DNA, 17 bp, Homo sapiens
ttgtggtgtaaagctgg

SEQ ID NO: 3245975 - DNA, 19 bp, Homo sapiens
ttgtggtgtaaagctggcc

SEQ ID NO: 3245976 - DNA, 21 bp, Homo sapiens
ttgtggtgtaaagctggccct

SEQ ID NO: 3245977 - DNA, 20 bp, Homo sapiens
ttgtggtgtgaccatgttca

SEQ ID NO: 3245978 - DNA, 22 bp, Homo sapiens
ttgtggttccatgcagccttgg

SEQ ID NO: 3245979 - DNA, 16 bp, Homo sapiens
ttgtggttttatggag

SEQ ID NO: 3245980 - DNA, 17 bp, Homo sapiens
ttgtggttttcaaattg

SEQ ID NO: 3245981 - DNA, 16 bp, Homo sapiens
ttgtgtaaaaaatgga

SEQ ID NO: 3245982 - DNA, 18 bp, Homo sapiens
ttgtgtaaaaaatggaaa

SEQ ID NO: 3245983 - DNA, 20 bp, Homo sapiens
ttgtgtaagagaatgttgaa

SEQ ID NO: 3245984 - DNA, 14 bp, Homo sapiens
ttgtgtaataaagt

SEQ ID NO: 3245985 - DNA, 16 bp, Homo sapiens
ttgtgtaataaagtgt

SEQ ID NO: 3245986 - DNA, 19 bp, Homo sapiens
ttgtgtaatagaaaactga

SEQ ID NO: 3245987 - DNA, 24 bp, Homo sapiens
ttgtgtaatgaaaatgaatatcta

SEQ ID NO: 3245988 - DNA, 21 bp, Homo sapiens
ttgtgtacactttcattactt

SEQ ID NO: 3245989 - DNA, 23 bp, Homo sapiens
ttgtgtacagacttgttgtgact

SEQ ID NO: 3245990 - DNA, 20 bp, Homo sapiens
ttgtgtactgataaaatact

SEQ ID NO: 3245991 - DNA, 20 bp, Homo sapiens
ttgtgtatgtacttagctgt

SEQ ID NO: 3245992 - DNA, 23 bp, Homo sapiens
ttgtgtatgtacttagctgtact

SEQ ID NO: 3245993 - DNA, 15 bp, Homo sapiens
ttgtgtcaagacatt

SEQ ID NO: 3245994 - DNA, 20 bp, Homo sapiens
ttgtgtcagaaacatgaaat

SEQ ID NO: 3245995 - DNA, 16 bp, Homo sapiens
ttgtgtccctaatgtg

SEQ ID NO: 3245996 - DNA, 23 bp, Homo sapiens
ttgtgtctgtgccctccaaagag

SEQ ID NO: 3245997 - DNA, 15 bp, Homo sapiens
ttgtgtgaaattgca

SEQ ID NO: 3245998 - DNA, 17 bp, Homo sapiens
ttgtgtgaccaactgtg

SEQ ID NO: 3245999 - DNA, 20 bp, Homo sapiens
ttgtgtgatttcctaaacat

SEQ ID NO: 3246000 - DNA, 14 bp, Homo sapiens
ttgtgtgtatttgt

SEQ ID NO: 3246001 - DNA, 23 bp, Homo sapiens
ttgtgtgtatttgtattaataaa

SEQ ID NO: 3246002 - DNA, 13 bp, Homo sapiens
ttgtgtgtcttaa

SEQ ID NO: 3246003 - DNA, 15 bp, Homo sapiens
ttgtgtgttccaagt

SEQ ID NO: 3246004 - DNA, 22 bp, Homo sapiens
ttgtgtgttccaagtttccaaa

SEQ ID NO: 3246005 - DNA, 15 bp, Homo sapiens
ttgtgtgttgtctct

SEQ ID NO: 3246006 - DNA, 20 bp, Homo sapiens
ttgtgttaagtatgtgtaaa

SEQ ID NO: 3246007 - DNA, 13 bp, Homo sapiens
ttgtgttcacctt

SEQ ID NO: 3246008 - DNA, 20 bp, Homo sapiens
ttgtgttcccatttcagctg

SEQ ID NO: 3246009 - DNA, 16 bp, Homo sapiens
ttgtgttcctttttat

SEQ ID NO: 3246010 - DNA, 17 bp, Homo sapiens
tttaggaacttcagaga

SEQ ID NO: 3246011 - DNA, 18 bp, Homo sapiens
tttaggaatcctttggtg

SEQ ID NO: 3246012 - DNA, 16 bp, Homo sapiens
tttaggagaaaccagc

SEQ ID NO: 3246013 - DNA, 16 bp, Homo sapiens
tttaggcttgaaatct

SEQ ID NO: 3246014 - DNA, 19 bp, Homo sapiens
tttagggagagtcatattt

SEQ ID NO: 3246015 - DNA, 13 bp, Homo sapiens
tttagggcagctt

SEQ ID NO: 3246016 - DNA, 15 bp, Homo sapiens
tttagggcagcttgc

SEQ ID NO: 3246017 - DNA, 20 bp, Homo sapiens
tttagggctgtaaaatgcat

SEQ ID NO: 3246018 - DNA, 16 bp, Homo sapiens
tttagggtaaaaattg

SEQ ID NO: 3246019 - DNA, 22 bp, Homo sapiens
tttaggtttttgtttgtttcct

SEQ ID NO: 3246020 - DNA, 16 bp, Homo sapiens
tttagtagagacaggg

SEQ ID NO: 3246021 - DNA, 21 bp, Homo sapiens
tttagtccacggacccccaga

SEQ ID NO: 3246022 - DNA, 15 bp, Homo sapiens
tttagtcctgtactg

SEQ ID NO: 3246023 - DNA, 18 bp, Homo sapiens
tttagtcttgatgtggaa

SEQ ID NO: 3246024 - DNA, 16 bp, Homo sapiens
tttagtgaaaaactgc

SEQ ID NO: 3246025 - DNA, 17 bp, Homo sapiens
tttagtgccctgccccc

SEQ ID NO: 3246026 - DNA, 13 bp, Homo sapiens
tttagtgctgcat

SEQ ID NO: 3246027 - DNA, 19 bp, Homo sapiens
tttagtggaagcttctaaa

SEQ ID NO: 3246028 - DNA, 15 bp, Homo sapiens
tttagttatagtttc

SEQ ID NO: 3246029 - DNA, 14 bp, Homo sapiens
tttagttgaaaaat

SEQ ID NO: 3246030 - DNA, 18 bp, Homo sapiens
tttagttgaaaaatctag

SEQ ID NO: 3246031 - DNA, 18 bp, Homo sapiens
tttagttttatactatat

SEQ ID NO: 3246032 - DNA, 13 bp, Homo sapiens
tttagttttctct

SEQ ID NO: 3246033 - DNA, 14 bp, Homo sapiens
tttataaaaagata

SEQ ID NO: 3246034 - DNA, 14 bp, Homo sapiens
tttataaaacttct

SEQ ID NO: 3246035 - DNA, 23 bp, Homo sapiens
tttataaaagaataaaattgcac

SEQ ID NO: 3246036 - DNA, 14 bp, Homo sapiens
tttataaaattaga

SEQ ID NO: 3246037 - DNA, 17 bp, Homo sapiens
tttataaaattttgctt

SEQ ID NO: 3246038 - DNA, 12 bp, Homo sapiens
tttataaacaga

SEQ ID NO: 3246039 - DNA, 17 bp, Homo sapiens
tttataaccccagcctg

SEQ ID NO: 3246040 - DNA, 19 bp, Homo sapiens
tttataaccccagcctgac

SEQ ID NO: 3246041 - DNA, 18 bp, Homo sapiens
tttataactcatcataaa

SEQ ID NO: 3246042 - DNA, 20 bp, Homo sapiens
tttataactcatcataaaat

SEQ ID NO: 3246043 - DNA, 22 bp, Homo sapiens
tttataactcatcataaaataa

SEQ ID NO: 3246044 - DNA, 23 bp, Homo sapiens
tttataagcaaatttcaaaagac

SEQ ID NO: 3246045 - DNA, 16 bp, Homo sapiens
tttataagttcacaaa

SEQ ID NO: 3246046 - DNA, 21 bp, Homo sapiens
tttataatacagaatcttgtt

SEQ ID NO: 3246047 - DNA, 12 bp, Homo sapiens
tttataatctga

SEQ ID NO: 3246048 - DNA, 16 bp, Homo sapiens
tttataatctgaagat

SEQ ID NO: 3246049 - DNA, 23 bp, Homo sapiens
tttataattggtgctatttgaag

SEQ ID NO: 3246050 - DNA, 20 bp, Homo sapiens
tttataattgtacaaaatta

SEQ ID NO: 3246051 - DNA, 15 bp, Homo sapiens
tttatacaaattaga

SEQ ID NO: 3246052 - DNA, 19 bp, Homo sapiens
tttatacaaattagaaaat

SEQ ID NO: 3246053 - DNA, 16 bp, Homo sapiens
tttatacaatatcatc

SEQ ID NO: 3246054 - DNA, 18 bp, Homo sapiens
tttatacagctgtattgt

SEQ ID NO: 3246055 - DNA, 15 bp, Homo sapiens
tttatacgtgtagct

SEQ ID NO: 3246056 - DNA, 16 bp, Homo sapiens
tttatacgtgtagcta

SEQ ID NO: 3246057 - DNA, 13 bp, Homo sapiens
tttatactatatt

SEQ ID NO: 3246058 - DNA, 19 bp, Homo sapiens
tttatactccagtgtacat

SEQ ID NO: 3246059 - DNA, 15 bp, Homo sapiens
tttatactgcacagt

SEQ ID NO: 3246060 - DNA, 18 bp, Homo sapiens
tttatagaaggaatttgt

SEQ ID NO: 3246061 - DNA, 19 bp, Homo sapiens
tttatagaaggaatttgta

SEQ ID NO: 3246062 - DNA, 20 bp, Homo sapiens
tttatagctattactgtctg

SEQ ID NO: 3246063 - DNA, 21 bp, Homo sapiens
tttataggaatagaggaagaa

SEQ ID NO: 3246064 - DNA, 18 bp, Homo sapiens
tttataggtgagaaaaaa

SEQ ID NO: 3246065 - DNA, 15 bp, Homo sapiens
tttatagttaataat

SEQ ID NO: 3246066 - DNA, 17 bp, Homo sapiens
tttatagttaataatct

SEQ ID NO: 3246067 - DNA, 11 bp, Homo sapiens
tttatatactt

SEQ ID NO: 3246068 - DNA, 15 bp, Homo sapiens
tttatatatttataa

SEQ ID NO: 3246069 - DNA, 16 bp, Homo sapiens
tttatatctgtaatga

SEQ ID NO: 3246070 - DNA, 18 bp, Homo sapiens
tttatatctgtaatgata

SEQ ID NO: 3246071 - DNA, 14 bp, Homo sapiens
tttatatgaacata

SEQ ID NO: 3246072 - DNA, 14 bp, Homo sapiens
tttatatgaagaaa

SEQ ID NO: 3246073 - DNA, 17 bp, Homo sapiens
tttatatggcccagcct

SEQ ID NO: 3246074 - DNA, 12 bp, Homo sapiens
tttatatggcgt

SEQ ID NO: 3246075 - DNA, 23 bp, Homo sapiens
tttatatggcgttttgtctgtgt

SEQ ID NO: 3246076 - DNA, 18 bp, Homo sapiens
tttatatggggaatatat

SEQ ID NO: 3246077 - DNA, 23 bp, Homo sapiens
tttatattataactctgtataat

SEQ ID NO: 3246078 - DNA, 18 bp, Homo sapiens
tttatatttaattattaa

SEQ ID NO: 3246079 - DNA, 19 bp, Homo sapiens
tttatatttattgttagaa

SEQ ID NO: 3246080 - DNA, 22 bp, Homo sapiens
tttatatttgtgtattttcctg

SEQ ID NO: 3246081 - DNA, 12 bp, Homo sapiens
tttatattttta

SEQ ID NO: 3246082 - DNA, 22 bp, Homo sapiens
tttatcaaaccctagccttgct

SEQ ID NO: 3246083 - DNA, 14 bp, Homo sapiens
tttatcaaagcata

SEQ ID NO: 3246084 - DNA, 19 bp, Homo sapiens
tttatcaatgtgtctttct

SEQ ID NO: 3246085 - DNA, 17 bp, Homo sapiens
tttatcacacttctgtg

SEQ ID NO: 3246086 - DNA, 20 bp, Homo sapiens
tttatcactttttgaactaa

SEQ ID NO: 3246087 - DNA, 16 bp, Homo sapiens
tttatcagatacatca

SEQ ID NO: 3246088 - DNA, 20 bp, Homo sapiens
tttatcagatacatcactgc

SEQ ID NO: 3246089 - DNA, 13 bp, Homo sapiens
tttatcagtgaca

SEQ ID NO: 3246090 - DNA, 15 bp, Homo sapiens
tttatcatgacatgt

SEQ ID NO: 3246091 - DNA, 23 bp, Homo sapiens
tttatcatgacatgttatatatt

SEQ ID NO: 3246092 - DNA, 22 bp, Homo sapiens
tttatcatgcatgtcctgtaaa

SEQ ID NO: 3246093 - DNA, 12 bp, Homo sapiens
tttatcattttc

SEQ ID NO: 3246094 - DNA, 18 bp, Homo sapiens
tttatccaaaatgtgtat

SEQ ID NO: 3246095 - DNA, 15 bp, Homo sapiens
tttatccatttgtaa

SEQ ID NO: 3246096 - DNA, 16 bp, Homo sapiens
tttatcccaaagttgt

SEQ ID NO: 3246097 - DNA, 20 bp, Homo sapiens
tttatccctttacaatgtga

SEQ ID NO: 3246098 - DNA, 22 bp, Homo sapiens
tttatccctttacaatgtgaat

SEQ ID NO: 3246099 - DNA, 23 bp, Homo sapiens
tttatccctttacaatgtgaata

SEQ ID NO: 3246100 - DNA, 23 bp, Homo sapiens
tttatcctagtcattcttcccta

SEQ ID NO: 3246101 - DNA, 20 bp, Homo sapiens
tttatctaatacctctgtgt

SEQ ID NO: 3246102 - DNA, 14 bp, Homo sapiens
tttatctataattt

SEQ ID NO: 3246103 - DNA, 19 bp, Homo sapiens
tttatctataatttaccta

SEQ ID NO: 3246104 - DNA, 15 bp, Homo sapiens
tttatctatataaaa

SEQ ID NO: 3246105 - DNA, 18 bp, Homo sapiens
tttatctcagatgttaaa

SEQ ID NO: 3246106 - DNA, 13 bp, Homo sapiens
tttatctcctgtg

SEQ ID NO: 3246107 - DNA, 14 bp, Homo sapiens
tttatctctattta

SEQ ID NO: 3246108 - DNA, 15 bp, Homo sapiens
tttatctgcagaaca

SEQ ID NO: 3246109 - DNA, 15 bp, Homo sapiens
tttatcttgggactg

SEQ ID NO: 3246110 - DNA, 13 bp, Homo sapiens
tttatgaaaagag

SEQ ID NO: 3246111 - DNA, 18 bp, Homo sapiens
tttatgaaaggtttacat

SEQ ID NO: 3246112 - DNA, 18 bp, Homo sapiens
tttatgagtaactattat

SEQ ID NO: 3246113 - DNA, 18 bp, Homo sapiens
tttatgatcttttcagtg

SEQ ID NO: 3246114 - DNA, 17 bp, Homo sapiens
tttatgatgatgaaaat

SEQ ID NO: 3246115 - DNA, 18 bp, Homo sapiens
tttatgatttaataaaat

SEQ ID NO: 3246116 - DNA, 13 bp, Homo sapiens
tttatgcatttca

SEQ ID NO: 3246117 - DNA, 17 bp, Homo sapiens
tttatgctataaatttt

SEQ ID NO: 3246118 - DNA, 21 bp, Homo sapiens
tttatgctataaattttttga

SEQ ID NO: 3246119 - DNA, 23 bp, Homo sapiens
tttatgctataaattttttgaaa

SEQ ID NO: 3246120 - DNA, 14 bp, Homo sapiens
tttatgctcttttt

SEQ ID NO: 3246121 - DNA, 20 bp, Homo sapiens
tttatgctgtattttaacac

SEQ ID NO: 3246122 - DNA, 23 bp, Homo sapiens
tttatggaggatggagagagggg

SEQ ID NO: 3246123 - DNA, 18 bp, Homo sapiens
tttatgggcattgacaaa

SEQ ID NO: 3246124 - DNA, 21 bp, Homo sapiens
tttatggtaactgctttctgt

SEQ ID NO: 3246125 - DNA, 13 bp, Homo sapiens
tttatgtaatgaa

SEQ ID NO: 3246126 - DNA, 20 bp, Homo sapiens
tttatgtaatgaagtaaagc

SEQ ID NO: 3246127 - DNA, 14 bp, Homo sapiens
tttatgtagcacat

SEQ ID NO: 3246128 - DNA, 13 bp, Homo sapiens
tttatgtgctata

SEQ ID NO: 3246129 - DNA, 20 bp, Homo sapiens
tttatgtgtatatttgtaga

SEQ ID NO: 3246130 - DNA, 15 bp, Homo sapiens
tttatgttaaaagat

SEQ ID NO: 3246131 - DNA, 15 bp, Homo sapiens
tttattaaaaatgtt

SEQ ID NO: 3246132 - DNA, 16 bp, Homo sapiens
tttattaaaaatgttc

SEQ ID NO: 3246133 - DNA, 17 bp, Homo sapiens
tttattaaaaatgttct

SEQ ID NO: 3246134 - DNA, 21 bp, Homo sapiens
tttattaaaaatgttctcaaa

SEQ ID NO: 3246135 - DNA, 22 bp, Homo sapiens
tttattaaacagatttttacaa

SEQ ID NO: 3246136 - DNA, 13 bp, Homo sapiens
tttctgccctggc

SEQ ID NO: 3246137 - DNA, 14 bp, Homo sapiens
tttctgccctggct

SEQ ID NO: 3246138 - DNA, 18 bp, Homo sapiens
tttctggaatgtaatcaa

SEQ ID NO: 3246139 - DNA, 15 bp, Homo sapiens
tttctgggtcctgaa

SEQ ID NO: 3246140 - DNA, 17 bp, Homo sapiens
tttctggtagatagaaa

SEQ ID NO: 3246141 - DNA, 20 bp, Homo sapiens
tttctggtggtctgttggca

SEQ ID NO: 3246142 - DNA, 24 bp, Homo sapiens
tttctgtagtcatttactaaacat

SEQ ID NO: 3246143 - DNA, 17 bp, Homo sapiens
tttctgtatatactttt

SEQ ID NO: 3246144 - DNA, 14 bp, Homo sapiens
tttctgtcagaatg

SEQ ID NO: 3246145 - DNA, 15 bp, Homo sapiens
tttctgtcagaatgc

SEQ ID NO: 3246146 - DNA, 17 bp, Homo sapiens
tttctgtcagatgagaa

SEQ ID NO: 3246147 - DNA, 14 bp, Homo sapiens
tttctgtgcttgga

SEQ ID NO: 3246148 - DNA, 9 bp, Homo sapiens
tttctgttc

SEQ ID NO: 3246149 - DNA, 12 bp, Homo sapiens
tttctgttccaa

SEQ ID NO: 3246150 - DNA, 14 bp, Homo sapiens
tttctgttccaaat

SEQ ID NO: 3246151 - DNA, 15 bp, Homo sapiens
tttctgttccaaatt

SEQ ID NO: 3246152 - DNA, 14 bp, Homo sapiens
tttctgttctagtt

SEQ ID NO: 3246153 - DNA, 20 bp, Homo sapiens
tttctgttgaagattaacac

SEQ ID NO: 3246154 - DNA, 15 bp, Homo sapiens
tttctgttggtgtat

SEQ ID NO: 3246155 - DNA, 13 bp, Homo sapiens
tttcttaacttct

SEQ ID NO: 3246156 - DNA, 20 bp, Homo sapiens
tttcttagatggagaagttg

SEQ ID NO: 3246157 - DNA, 19 bp, Homo sapiens
tttcttagctttttaattg

SEQ ID NO: 3246158 - DNA, 21 bp, Homo sapiens
tttcttagctttttaattgtt

SEQ ID NO: 3246159 - DNA, 21 bp, Homo sapiens
tttcttagtgcttcagagttt

SEQ ID NO: 3246160 - DNA, 13 bp, Homo sapiens
tttcttataaatt

SEQ ID NO: 3246161 - DNA, 14 bp, Homo sapiens
tttcttattgcgct

SEQ ID NO: 3246162 - DNA, 17 bp, Homo sapiens
tttcttattgcgctgct

SEQ ID NO: 3246163 - DNA, 18 bp, Homo sapiens
tttcttatttaacttaac

SEQ ID NO: 3246164 - DNA, 16 bp, Homo sapiens
tttcttcaaaatgtat

SEQ ID NO: 3246165 - DNA, 18 bp, Homo sapiens
tttcttcaacatcaatgt

SEQ ID NO: 3246166 - DNA, 12 bp, Homo sapiens
tttcttcagaat

SEQ ID NO: 3246167 - DNA, 18 bp, Homo sapiens
tttcttcatgcaatgaca

SEQ ID NO: 3246168 - DNA, 22 bp, Homo sapiens
tttcttcatgcaatgacatctt

SEQ ID NO: 3246169 - DNA, 22 bp, Homo sapiens
tttcttcctaccaagtcaaact

SEQ ID NO: 3246170 - DNA, 23 bp, Homo sapiens
tttcttcctaccaagtcaaactt

SEQ ID NO: 3246171 - DNA, 11 bp, Homo sapiens
tttcttcctct

SEQ ID NO: 3246172 - DNA, 12 bp, Homo sapiens
tttcttcctggc

SEQ ID NO: 3246173 - DNA, 14 bp, Homo sapiens
tttcttcctttcta

SEQ ID NO: 3246174 - DNA, 15 bp, Homo sapiens
tttcttctagaagat

SEQ ID NO: 3246175 - DNA, 18 bp, Homo sapiens
tttcttctagaagataac

SEQ ID NO: 3246176 - DNA, 13 bp, Homo sapiens
tttcttcttcatg

SEQ ID NO: 3246177 - DNA, 17 bp, Homo sapiens
tttcttgatcttaaaga

SEQ ID NO: 3246178 - DNA, 18 bp, Homo sapiens
tttcttgatcttaaagat

SEQ ID NO: 3246179 - DNA, 22 bp, Homo sapiens
tttcttggggtactcttgatgt

SEQ ID NO: 3246180 - DNA, 15 bp, Homo sapiens
tttcttgtaaatgtt

SEQ ID NO: 3246181 - DNA, 20 bp, Homo sapiens
tttcttgtcattaacacatt

SEQ ID NO: 3246182 - DNA, 15 bp, Homo sapiens
tttcttgtctttcct

SEQ ID NO: 3246183 - DNA, 20 bp, Homo sapiens
tttcttgtggtgtaaagctg

SEQ ID NO: 3246184 - DNA, 17 bp, Homo sapiens
tttcttgttgcatcttt

SEQ ID NO: 3246185 - DNA, 20 bp, Homo sapiens
tttctttagagcattgccat

SEQ ID NO: 3246186 - DNA, 11 bp, Homo sapiens
tttctttatat

SEQ ID NO: 3246187 - DNA, 13 bp, Homo sapiens
tttctttgtggct

SEQ ID NO: 3246188 - DNA, 21 bp, Homo sapiens
tttcttttctaccctagccat

SEQ ID NO: 3246189 - DNA, 15 bp, Homo sapiens
tttcttttcttcctg

SEQ ID NO: 3246190 - DNA, 16 bp, Homo sapiens
tttcttttgttactgt

SEQ ID NO: 3246191 - DNA, 24 bp, Homo sapiens
tttcttttgttactgttcttgctg

SEQ ID NO: 3246192 - DNA, 22 bp, Homo sapiens
tttctttttaagtaatgtggaa

SEQ ID NO: 3246193 - DNA, 16 bp, Homo sapiens
tttcttttttaaatta

SEQ ID NO: 3246194 - DNA, 19 bp, Homo sapiens
tttgaaaacatgtttattt

SEQ ID NO: 3246195 - DNA, 15 bp, Homo sapiens
tttgaaaagctatta

SEQ ID NO: 3246196 - DNA, 20 bp, Homo sapiens
tttgaaaaggcggtactagt

SEQ ID NO: 3246197 - DNA, 15 bp, Homo sapiens
tttgaaacccacagt

SEQ ID NO: 3246198 - DNA, 16 bp, Homo sapiens
tttgaaacccacagtt

SEQ ID NO: 3246199 - DNA, 20 bp, Homo sapiens
tttgaaatacctcatgttta

SEQ ID NO: 3246200 - DNA, 19 bp, Homo sapiens
tttgaaatacctttgtagt

SEQ ID NO: 3246201 - DNA, 19 bp, Homo sapiens
tttgaaatactaaaagcaa

SEQ ID NO: 3246202 - DNA, 19 bp, Homo sapiens
tttgaaatagtctgtgtga

SEQ ID NO: 3246203 - DNA, 21 bp, Homo sapiens
tttgaaatagttcaaactgca

SEQ ID NO: 3246204 - DNA, 18 bp, Homo sapiens
tttgaaatcgttggaaaa

SEQ ID NO: 3246205 - DNA, 17 bp, Homo sapiens
tttgaaatgaaatttaa

SEQ ID NO: 3246206 - DNA, 20 bp, Homo sapiens
tttgaacacgaaagaaatgt

SEQ ID NO: 3246207 - DNA, 14 bp, Homo sapiens
tttgaacactggct

SEQ ID NO: 3246208 - DNA, 16 bp, Homo sapiens
tttgaacacttactgt

SEQ ID NO: 3246209 - DNA, 15 bp, Homo sapiens
tttgaacccctgtgt

SEQ ID NO: 3246210 - DNA, 17 bp, Homo sapiens
tttgaactgttagatgc

SEQ ID NO: 3246211 - DNA, 21 bp, Homo sapiens
tttgaagagttccaagttgaa

SEQ ID NO: 3246212 - DNA, 17 bp, Homo sapiens
tttgaagataataatct

SEQ ID NO: 3246213 - DNA, 19 bp, Homo sapiens
tttgaagcacaactccctt

SEQ ID NO: 3246214 - DNA, 15 bp, Homo sapiens
tttgaagcctgccct

SEQ ID NO: 3246215 - DNA, 16 bp, Homo sapiens
tttgaagctactgtgt

SEQ ID NO: 3246216 - DNA, 18 bp, Homo sapiens
tttgaagctgaaaatata

SEQ ID NO: 3246217 - DNA, 13 bp, Homo sapiens
tttgaaggaaaca

SEQ ID NO: 3246218 - DNA, 12 bp, Homo sapiens
tttgaaggcaaa

SEQ ID NO: 3246219 - DNA, 18 bp, Homo sapiens
tttgaagggagaagacac

SEQ ID NO: 3246220 - DNA, 22 bp, Homo sapiens
tttgaagggagaagacactgca

SEQ ID NO: 3246221 - DNA, 17 bp, Homo sapiens
tttgaaggttttaagtg

SEQ ID NO: 3246222 - DNA, 23 bp, Homo sapiens
tttgaatcgcttgcttgttgaaa

SEQ ID NO: 3246223 - DNA, 15 bp, Homo sapiens
tttgaatgaaaaatt

SEQ ID NO: 3246224 - DNA, 16 bp, Homo sapiens
tttgaattatgtgcac

SEQ ID NO: 3246225 - DNA, 18 bp, Homo sapiens
tttgaattgttttcttta

SEQ ID NO: 3246226 - DNA, 14 bp, Homo sapiens
tttgaattttgttt

SEQ ID NO: 3246227 - DNA, 13 bp, Homo sapiens
tttgacaactaaa

SEQ ID NO: 3246228 - DNA, 17 bp, Homo sapiens
tttgacaactaaaatta

SEQ ID NO: 3246229 - DNA, 13 bp, Homo sapiens
tttgacagtgttt

SEQ ID NO: 3246230 - DNA, 20 bp, Homo sapiens
tttgacattgcgtttgacct

SEQ ID NO: 3246231 - DNA, 16 bp, Homo sapiens
tttgacatttaattta

SEQ ID NO: 3246232 - DNA, 20 bp, Homo sapiens
tttgactaaagctatgttac

SEQ ID NO: 3246233 - DNA, 17 bp, Homo sapiens
tttgactaattttacat

SEQ ID NO: 3246234 - DNA, 21 bp, Homo sapiens
tttgactagggattcaggctg

SEQ ID NO: 3246235 - DNA, 19 bp, Homo sapiens
tttgactctggcaaagctt

SEQ ID NO: 3246236 - DNA, 15 bp, Homo sapiens
tttgactgaaaaaaa

SEQ ID NO: 3246237 - DNA, 18 bp, Homo sapiens
tttgactgtctcactttt

SEQ ID NO: 3246238 - DNA, 14 bp, Homo sapiens
tttgacttaatgtg

SEQ ID NO: 3246239 - DNA, 16 bp, Homo sapiens
tttgacttaatgtgat

SEQ ID NO: 3246240 - DNA, 18 bp, Homo sapiens
tttgacttagtaactttt

SEQ ID NO: 3246241 - DNA, 14 bp, Homo sapiens
tttgacttcagctg

SEQ ID NO: 3246242 - DNA, 17 bp, Homo sapiens
tttgacttgcatgaaga

SEQ ID NO: 3246243 - DNA, 16 bp, Homo sapiens
tttgagacaagccctg

SEQ ID NO: 3246244 - DNA, 18 bp, Homo sapiens
tttgagacaagccctggc

SEQ ID NO: 3246245 - DNA, 13 bp, Homo sapiens
tttgagacagagt

SEQ ID NO: 3246246 - DNA, 15 bp, Homo sapiens
tttgagacagtttct

SEQ ID NO: 3246247 - DNA, 16 bp, Homo sapiens
tttgagacagtttctt

SEQ ID NO: 3246248 - DNA, 17 bp, Homo sapiens
tttgagacagtttctta

SEQ ID NO: 3246249 - DNA, 18 bp, Homo sapiens
tttgagacagtttcttag

SEQ ID NO: 3246250 - DNA, 19 bp, Homo sapiens
tttgagacagtttcttagc

SEQ ID NO: 3246251 - DNA, 23 bp, Homo sapiens
tttgagacgcaccatgtgggcac

SEQ ID NO: 3246252 - DNA, 15 bp, Homo sapiens
tttgagcagggctca

SEQ ID NO: 3246253 - DNA, 21 bp, Homo sapiens
tttgaggaagtggctgtccct

SEQ ID NO: 3246254 - DNA, 21 bp, Homo sapiens
tttgaggatatattttcactt

SEQ ID NO: 3246255 - DNA, 22 bp, Homo sapiens
tttgaggatatattttcacttt

SEQ ID NO: 3246256 - DNA, 15 bp, Homo sapiens
tttgaggctgcagcg

SEQ ID NO: 3246257 - DNA, 21 bp, Homo sapiens
tttgagggactgcctctgcca

SEQ ID NO: 3246258 - DNA, 18 bp, Homo sapiens
tttgagggcccagccagg

SEQ ID NO: 3246259 - DNA, 23 bp, Homo sapiens
tttgagggcccagccaggagcag

SEQ ID NO: 3246260 - DNA, 16 bp, Homo sapiens
tttgaggggaaaacac

SEQ ID NO: 3246261 - DNA, 21 bp, Homo sapiens
tttgagtagatattactttat

SEQ ID NO: 3246262 - DNA, 14 bp, Homo sapiens
ttttcatgcacagt

SEQ ID NO: 3246263 - DNA, 21 bp, Homo sapiens
ttttcatggtgaaaatgtact

SEQ ID NO: 3246264 - DNA, 17 bp, Homo sapiens
ttttcattaaacttgaa

SEQ ID NO: 3246265 - DNA, 16 bp, Homo sapiens
ttttcattacaatgga

SEQ ID NO: 3246266 - DNA, 20 bp, Homo sapiens
ttttcattatgttcatgtaa

SEQ ID NO: 3246267 - DNA, 13 bp, Homo sapiens
ttttcattattgt

SEQ ID NO: 3246268 - DNA, 15 bp, Homo sapiens
ttttcatttgcctat

SEQ ID NO: 3246269 - DNA, 16 bp, Homo sapiens
ttttcatttgtacaag

SEQ ID NO: 3246270 - DNA, 17 bp, Homo sapiens
ttttcatttgttttgct

SEQ ID NO: 3246271 - DNA, 23 bp, Homo sapiens
ttttcatttgttttgcttttgtt

SEQ ID NO: 3246272 - DNA, 13 bp, Homo sapiens
ttttccaaaacaa

SEQ ID NO: 3246273 - DNA, 13 bp, Homo sapiens
ttttccaaactga

SEQ ID NO: 3246274 - DNA, 11 bp, Homo sapiens
ttttccaaatg

SEQ ID NO: 3246275 - DNA, 22 bp, Homo sapiens
ttttccaaatgtaataaacttt

SEQ ID NO: 3246276 - DNA, 14 bp, Homo sapiens
ttttccaactacta

SEQ ID NO: 3246277 - DNA, 20 bp, Homo sapiens
ttttccacattccagtgatg

SEQ ID NO: 3246278 - DNA, 15 bp, Homo sapiens
ttttccaccctggaa

SEQ ID NO: 3246279 - DNA, 13 bp, Homo sapiens
ttttccactttgt

SEQ ID NO: 3246280 - DNA, 13 bp, Homo sapiens
ttttccagtattg

SEQ ID NO: 3246281 - DNA, 15 bp, Homo sapiens
ttttccagtctcttg

SEQ ID NO: 3246282 - DNA, 17 bp, Homo sapiens
ttttccatcattttaca

SEQ ID NO: 3246283 - DNA, 16 bp, Homo sapiens
ttttccatgaaaacgt

SEQ ID NO: 3246284 - DNA, 20 bp, Homo sapiens
ttttccatgcgtgtttctga

SEQ ID NO: 3246285 - DNA, 13 bp, Homo sapiens
ttttccattgtca

SEQ ID NO: 3246286 - DNA, 14 bp, Homo sapiens
ttttcccaataaat

SEQ ID NO: 3246287 - DNA, 20 bp, Homo sapiens
ttttcccagatacttcccat

SEQ ID NO: 3246288 - DNA, 16 bp, Homo sapiens
ttttcccatgtattga

SEQ ID NO: 3246289 - DNA, 20 bp, Homo sapiens
ttttccccaaaccataaaac

SEQ ID NO: 3246290 - DNA, 19 bp, Homo sapiens
ttttccccaaccacagaga

SEQ ID NO: 3246291 - DNA, 17 bp, Homo sapiens
ttttcccctacagaatt

SEQ ID NO: 3246292 - DNA, 19 bp, Homo sapiens
ttttcccctacagaatttt

SEQ ID NO: 3246293 - DNA, 15 bp, Homo sapiens
ttttcccctgttaaa

SEQ ID NO: 3246294 - DNA, 13 bp, Homo sapiens
ttttccccttcct

SEQ ID NO: 3246295 - DNA, 15 bp, Homo sapiens
ttttccctgtacagt

SEQ ID NO: 3246296 - DNA, 16 bp, Homo sapiens
ttttcccttaaataca

SEQ ID NO: 3246297 - DNA, 16 bp, Homo sapiens
ttttccgttctgttct

SEQ ID NO: 3246298 - DNA, 14 bp, Homo sapiens
ttttcctaaatgca

SEQ ID NO: 3246299 - DNA, 17 bp, Homo sapiens
ttttcctatcatgttaa

SEQ ID NO: 3246300 - DNA, 18 bp, Homo sapiens
ttttcctcatgtaacatt

SEQ ID NO: 3246301 - DNA, 20 bp, Homo sapiens
ttttcctcatgtaacattgg

SEQ ID NO: 3246302 - DNA, 13 bp, Homo sapiens
ttttcctccctca

SEQ ID NO: 3246303 - DNA, 22 bp, Homo sapiens
ttttcctcccttgggttctgat

SEQ ID NO: 3246304 - DNA, 13 bp, Homo sapiens
ttttcctctgagc

SEQ ID NO: 3246305 - DNA, 19 bp, Homo sapiens
ttttcctggacttaaagaa

SEQ ID NO: 3246306 - DNA, 20 bp, Homo sapiens
ttttcctggacttaaagaaa

SEQ ID NO: 3246307 - DNA, 11 bp, Homo sapiens
ttttcctgtca

SEQ ID NO: 3246308 - DNA, 13 bp, Homo sapiens
ttttcctttctta

SEQ ID NO: 3246309 - DNA, 16 bp, Homo sapiens
ttttcgtgtggatctt

SEQ ID NO: 3246310 - DNA, 13 bp, Homo sapiens
ttttctaaaagct

SEQ ID NO: 3246311 - DNA, 14 bp, Homo sapiens
ttttctacagtggt

SEQ ID NO: 3246312 - DNA, 16 bp, Homo sapiens
ttttctaccctagcca

SEQ ID NO: 3246313 - DNA, 19 bp, Homo sapiens
ttttctagaaatacacttt

SEQ ID NO: 3246314 - DNA, 13 bp, Homo sapiens
ttttctagacttt

SEQ ID NO: 3246315 - DNA, 18 bp, Homo sapiens
ttttctagactttctgtt

SEQ ID NO: 3246316 - DNA, 20 bp, Homo sapiens
ttttctagtttcagtaaata

SEQ ID NO: 3246317 - DNA, 20 bp, Homo sapiens
ttttctattccttctggcct

SEQ ID NO: 3246318 - DNA, 15 bp, Homo sapiens
ttttctcaaaagcat

SEQ ID NO: 3246319 - DNA, 22 bp, Homo sapiens
ttttctcaaaagcatttatcat

SEQ ID NO: 3246320 - DNA, 23 bp, Homo sapiens
ttttctcaaagttttgaaaagct

SEQ ID NO: 3246321 - DNA, 12 bp, Homo sapiens
ttttctccagct

SEQ ID NO: 3246322 - DNA, 21 bp, Homo sapiens
ttttctccctttatgtatctc

SEQ ID NO: 3246323 - DNA, 21 bp, Homo sapiens
ttttctcctcactgtatccag

SEQ ID NO: 3246324 - DNA, 19 bp, Homo sapiens
ttttctcctcccaggaact

SEQ ID NO: 3246325 - DNA, 20 bp, Homo sapiens
ttttctctaatgcttgattt

SEQ ID NO: 3246326 - DNA, 16 bp, Homo sapiens
ttttctctggtaatat

SEQ ID NO: 3246327 - DNA, 22 bp, Homo sapiens
ttttctctttctccttagtctt

SEQ ID NO: 3246328 - DNA, 13 bp, Homo sapiens
ttttctgactaat

SEQ ID NO: 3246329 - DNA, 10 bp, Homo sapiens
ttttctgagc

SEQ ID NO: 3246330 - DNA, 12 bp, Homo sapiens
ttttctgagccc

SEQ ID NO: 3246331 - DNA, 13 bp, Homo sapiens
ttttctggattct

SEQ ID NO: 3246332 - DNA, 21 bp, Homo sapiens
ttttctggggcccaggaagcc

SEQ ID NO: 3246333 - DNA, 22 bp, Homo sapiens
ttttctgggtgtccaaaggaag

SEQ ID NO: 3246334 - DNA, 20 bp, Homo sapiens
ttttctggtagatagaaata

SEQ ID NO: 3246335 - DNA, 17 bp, Homo sapiens
ttttctggttctaacat

SEQ ID NO: 3246336 - DNA, 21 bp, Homo sapiens
ttttctgttgtacgtaaagct

SEQ ID NO: 3246337 - DNA, 15 bp, Homo sapiens
ttttctgtttaggaa

SEQ ID NO: 3246338 - DNA, 14 bp, Homo sapiens
ttttctgtttctgt

SEQ ID NO: 3246339 - DNA, 21 bp, Homo sapiens
ttttcttcaacatcaatgttc

SEQ ID NO: 3246340 - DNA, 14 bp, Homo sapiens
ttttcttcttccct

SEQ ID NO: 3246341 - DNA, 15 bp, Homo sapiens
ttttcttcttccctc

SEQ ID NO: 3246342 - DNA, 21 bp, Homo sapiens
ttttcttggcaaaagccttgt

SEQ ID NO: 3246343 - DNA, 15 bp, Homo sapiens
ttttcttgtaaatgt

SEQ ID NO: 3246344 - DNA, 13 bp, Homo sapiens
ttttcttgtaatt

SEQ ID NO: 3246345 - DNA, 18 bp, Homo sapiens
ttttctttaaagaagttg

SEQ ID NO: 3246346 - DNA, 15 bp, Homo sapiens
ttttctttaaagatg

SEQ ID NO: 3246347 - DNA, 18 bp, Homo sapiens
ttttctttaactgccgta

SEQ ID NO: 3246348 - DNA, 14 bp, Homo sapiens
ttttctttagtata

SEQ ID NO: 3246349 - DNA, 11 bp, Homo sapiens
ttttctttcac

SEQ ID NO: 3246350 - DNA, 17 bp, Homo sapiens
ttttctttgaatgcttt

SEQ ID NO: 3246351 - DNA, 12 bp, Homo sapiens
ttttctttgtgt

SEQ ID NO: 3246352 - DNA, 16 bp, Homo sapiens
ttttctttgtgtagct

SEQ ID NO: 3246353 - DNA, 17 bp, Homo sapiens
ttttcttttgttactgt

SEQ ID NO: 3246354 - DNA, 20 bp, Homo sapiens
ttttcttttttcttttggtc

SEQ ID NO: 3246355 - DNA, 23 bp, Homo sapiens
ttttgaaaagctattagccagga

SEQ ID NO: 3246356 - DNA, 12 bp, Homo sapiens
ttttgaaaaggc

SEQ ID NO: 3246357 - DNA, 19 bp, Homo sapiens
ttttgaaacaaacatggat

SEQ ID NO: 3246358 - DNA, 22 bp, Homo sapiens
ttttgaaacccacagttttagt

SEQ ID NO: 3246359 - DNA, 19 bp, Homo sapiens
ttttgaaatacctttgtag

SEQ ID NO: 3246360 - DNA, 22 bp, Homo sapiens
ttttgaaatattaaaccctgga

SEQ ID NO: 3246361 - DNA, 11 bp, Homo sapiens
ttttgaaatga

SEQ ID NO: 3246362 - DNA, 21 bp, Homo sapiens
ttttgaaatgaaatttaaaca

SEQ ID NO: 3246363 - DNA, 21 bp, Homo sapiens
ttttgaactaataaaagcata

SEQ ID NO: 3246364 - DNA, 18 bp, Homo sapiens
ttttgaactttgtaggac

SEQ ID NO: 3246365 - DNA, 17 bp, Homo sapiens
ttttgaagaatatttaa

SEQ ID NO: 3246366 - DNA, 19 bp, Homo sapiens
ttttgaagaatatttaaga

SEQ ID NO: 3246367 - DNA, 17 bp, Homo sapiens
ttttgaagccttttgtt

SEQ ID NO: 3246368 - DNA, 14 bp, Homo sapiens
ttttgaaggcaaaa

SEQ ID NO: 3246369 - DNA, 21 bp, Homo sapiens
ttttgaagggagaagacactg

SEQ ID NO: 3246370 - DNA, 11 bp, Homo sapiens
ttttgaagtgt

SEQ ID NO: 3246371 - DNA, 14 bp, Homo sapiens
ttttgaatttagtg

SEQ ID NO: 3246372 - DNA, 13 bp, Homo sapiens
ttttgacataaga

SEQ ID NO: 3246373 - DNA, 17 bp, Homo sapiens
ttttgagacagaatctc

SEQ ID NO: 3246374 - DNA, 21 bp, Homo sapiens
ttttgagctactggattctta

SEQ ID NO: 3246375 - DNA, 19 bp, Homo sapiens
ttttgagtagatattactt

SEQ ID NO: 3246376 - DNA, 19 bp, Homo sapiens
ttttgagtcattgacttca

SEQ ID NO: 3246377 - DNA, 15 bp, Homo sapiens
ttttgatagctttat

SEQ ID NO: 3246378 - DNA, 18 bp, Homo sapiens
ttttgatcatccctttct

SEQ ID NO: 3246379 - DNA, 17 bp, Homo sapiens
ttttgatccaagctggt

SEQ ID NO: 3246380 - DNA, 16 bp, Homo sapiens
ttttgatgagttgtga

SEQ ID NO: 3246381 - DNA, 15 bp, Homo sapiens
ttttgatgtttgtgg

SEQ ID NO: 3246382 - DNA, 13 bp, Homo sapiens
ttttgattaatgt

SEQ ID NO: 3246383 - DNA, 13 bp, Homo sapiens
ttttgattttgct

SEQ ID NO: 3246384 - DNA, 15 bp, Homo sapiens
ttttgattttgctga

SEQ ID NO: 3246385 - DNA, 21 bp, Homo sapiens
ttttgattttgtttactgaaa

SEQ ID NO: 3246386 - DNA, 21 bp, Homo sapiens
ttttgcaaaataagtaaataa

SEQ ID NO: 3246387 - DNA, 19 bp, Homo sapiens
ttttgcaaatataaacatc

SEQ ID NO: 3246388 - DNA, 19 bp, Homo sapiens
ttttgcaaatctaaagttg

SEQ ID NO: 3246389 - DNA, 13 bp, Homo sapiens
aggccgttcccct

SEQ ID NO: 3246390 - DNA, 16 bp, Homo sapiens
aggcctaggaggcccc

SEQ ID NO: 3246391 - DNA, 17 bp, Homo sapiens
aggcctaggtgcagctc

SEQ ID NO: 3246392 - DNA, 18 bp, Homo sapiens
aggcctaggtgcagctcc

SEQ ID NO: 3246393 - DNA, 16 bp, Homo sapiens
aggcctataatgaagc

SEQ ID NO: 3246394 - DNA, 22 bp, Homo sapiens
aggcctataatgaagctttata

SEQ ID NO: 3246395 - DNA, 17 bp, Homo sapiens
aggcctcacctctaccc

SEQ ID NO: 3246396 - DNA, 22 bp, Homo sapiens
aggcctcagtttctccatcagc

SEQ ID NO: 3246397 - DNA, 20 bp, Homo sapiens
aggcctccaacgcccctgtg

SEQ ID NO: 3246398 - DNA, 21 bp, Homo sapiens
aggcctccaacgcccctgtgg

SEQ ID NO: 3246399 - DNA, 23 bp, Homo sapiens
aggcctccaacgcccctgtggcc

SEQ ID NO: 3246400 - DNA, 11 bp, Homo sapiens
aggcctccagc

SEQ ID NO: 3246401 - DNA, 15 bp, Homo sapiens
aggcctccctagcca

SEQ ID NO: 3246402 - DNA, 22 bp, Homo sapiens
aggcctccctctctcttctgct

SEQ ID NO: 3246403 - DNA, 14 bp, Homo sapiens
aggcctccctgttt

SEQ ID NO: 3246404 - DNA, 15 bp, Homo sapiens
aggcctcctccccca

SEQ ID NO: 3246405 - DNA, 18 bp, Homo sapiens
aggcctctcttttccccg

SEQ ID NO: 3246406 - DNA, 16 bp, Homo sapiens
aggcctctgtgtcctt

SEQ ID NO: 3246407 - DNA, 19 bp, Homo sapiens
aggcctcttgtaaagactg

SEQ ID NO: 3246408 - DNA, 20 bp, Homo sapiens
aggcctcttgtgctcacgct

SEQ ID NO: 3246409 - DNA, 21 bp, Homo sapiens
aggcctcttgtgctcacgctc

SEQ ID NO: 3246410 - DNA, 21 bp, Homo sapiens
aggcctgacttctgctggcat

SEQ ID NO: 3246411 - DNA, 13 bp, Homo sapiens
aggcctgaggcct

SEQ ID NO: 3246412 - DNA, 19 bp, Homo sapiens
aggcctgcaaaccttcctg

SEQ ID NO: 3246413 - DNA, 13 bp, Homo sapiens
aggcctgcacagg

SEQ ID NO: 3246414 - DNA, 20 bp, Homo sapiens
aggcctggaaccagggagga

SEQ ID NO: 3246415 - DNA, 22 bp, Homo sapiens
aggcctggaaccagggaggaga

SEQ ID NO: 3246416 - DNA, 19 bp, Homo sapiens
aggcctggactttcctgca

SEQ ID NO: 3246417 - DNA, 15 bp, Homo sapiens
aggcctggagcccac

SEQ ID NO: 3246418 - DNA, 22 bp, Homo sapiens
aggcctggccagatgcaccagc

SEQ ID NO: 3246419 - DNA, 23 bp, Homo sapiens
aggcctggccagatgcaccagcc

SEQ ID NO: 3246420 - DNA, 20 bp, Homo sapiens
aggcctgggacccagctact

SEQ ID NO: 3246421 - DNA, 16 bp, Homo sapiens
aggcctgggtgctggc

SEQ ID NO: 3246422 - DNA, 23 bp, Homo sapiens
aggcctgggtgctggctgcccag

SEQ ID NO: 3246423 - DNA, 12 bp, Homo sapiens
aggcctgggtgg

SEQ ID NO: 3246424 - DNA, 23 bp, Homo sapiens
aggcctgggtggatcggcctcct

SEQ ID NO: 3246425 - DNA, 16 bp, Homo sapiens
aggcctgtccaccctg

SEQ ID NO: 3246426 - DNA, 18 bp, Homo sapiens
aggcctgtccaccctgcc

SEQ ID NO: 3246427 - DNA, 13 bp, Homo sapiens
aggccttccactg

SEQ ID NO: 3246428 - DNA, 16 bp, Homo sapiens
aggccttcctctctcc

SEQ ID NO: 3246429 - DNA, 15 bp, Homo sapiens
aggcgagtttcccca

SEQ ID NO: 3246430 - DNA, 15 bp, Homo sapiens
aggcgatgccacgct

SEQ ID NO: 3246431 - DNA, 13 bp, Homo sapiens
aggcgcggcctcc

SEQ ID NO: 3246432 - DNA, 16 bp, Homo sapiens
aggcggcgatttttgt

SEQ ID NO: 3246433 - DNA, 20 bp, Homo sapiens
aggcgggaggaggtgtgagg

SEQ ID NO: 3246434 - DNA, 21 bp, Homo sapiens
aggcgggcatggcgtggagga

SEQ ID NO: 3246435 - DNA, 21 bp, Homo sapiens
aggcgggccagccaggcgggc

SEQ ID NO: 3246436 - DNA, 23 bp, Homo sapiens
aggcgggccagccaggcgggctc

SEQ ID NO: 3246437 - DNA, 14 bp, Homo sapiens
aggcgggctcaagg

SEQ ID NO: 3246438 - DNA, 21 bp, Homo sapiens
aggcggtccccatccccacca

SEQ ID NO: 3246439 - DNA, 16 bp, Homo sapiens
aggcggtttcctgaat

SEQ ID NO: 3246440 - DNA, 19 bp, Homo sapiens
aggcgtgactcagcagcct

SEQ ID NO: 3246441 - DNA, 21 bp, Homo sapiens
aggctaagatgagatttgcca

SEQ ID NO: 3246442 - DNA, 18 bp, Homo sapiens
aggctaagttcagttctg

SEQ ID NO: 3246443 - DNA, 15 bp, Homo sapiens
aggctagcttctgct

SEQ ID NO: 3246444 - DNA, 18 bp, Homo sapiens
aggctagtccggacccac

SEQ ID NO: 3246445 - DNA, 22 bp, Homo sapiens
aggctatggacagggcatgcca

SEQ ID NO: 3246446 - DNA, 18 bp, Homo sapiens
aggctattattttcactg

SEQ ID NO: 3246447 - DNA, 19 bp, Homo sapiens
aggctattattttcactgt

SEQ ID NO: 3246448 - DNA, 16 bp, Homo sapiens
aggctatttgtaaatc

SEQ ID NO: 3246449 - DNA, 18 bp, Homo sapiens
aggctatttgttcagaga

SEQ ID NO: 3246450 - DNA, 15 bp, Homo sapiens
aggctcaacaataaa

SEQ ID NO: 3246451 - DNA, 12 bp, Homo sapiens
aggctcactgcc

SEQ ID NO: 3246452 - DNA, 15 bp, Homo sapiens
aggctcactgccagg

SEQ ID NO: 3246453 - DNA, 19 bp, Homo sapiens
aggctcactgccaggccag

SEQ ID NO: 3246454 - DNA, 20 bp, Homo sapiens
aggctcactgccaggccagc

SEQ ID NO: 3246455 - DNA, 21 bp, Homo sapiens
aggctcactgccaggccagcc

SEQ ID NO: 3246456 - DNA, 24 bp, Homo sapiens
aggctcactgccaggccagcctcc

SEQ ID NO: 3246457 - DNA, 18 bp, Homo sapiens
aggctcagtctcaggagc

SEQ ID NO: 3246458 - DNA, 17 bp, Homo sapiens
aggctccacttggtctg

SEQ ID NO: 3246459 - DNA, 22 bp, Homo sapiens
aggctccacttggtctgtgaga

SEQ ID NO: 3246460 - DNA, 13 bp, Homo sapiens
aggctccaggact

SEQ ID NO: 3246461 - DNA, 18 bp, Homo sapiens
aggctccaggactccact

SEQ ID NO: 3246462 - DNA, 13 bp, Homo sapiens
aggctccccaggg

SEQ ID NO: 3246463 - DNA, 14 bp, Homo sapiens
aggctccccagggc

SEQ ID NO: 3246464 - DNA, 15 bp, Homo sapiens
aggctccccagggct

SEQ ID NO: 3246465 - DNA, 16 bp, Homo sapiens
aggctcctgttttgca

SEQ ID NO: 3246466 - DNA, 17 bp, Homo sapiens
aggctctagatcataag

SEQ ID NO: 3246467 - DNA, 20 bp, Homo sapiens
aggctctatgagtctagatg

SEQ ID NO: 3246468 - DNA, 21 bp, Homo sapiens
aggctctatgagtctagatgt

SEQ ID NO: 3246469 - DNA, 23 bp, Homo sapiens
aggctctctctttctagaggtgc

SEQ ID NO: 3246470 - DNA, 13 bp, Homo sapiens
aggctctgaaata

SEQ ID NO: 3246471 - DNA, 18 bp, Homo sapiens
aggctctgaaataaaatg

SEQ ID NO: 3246472 - DNA, 12 bp, Homo sapiens
aggctctgaagg

SEQ ID NO: 3246473 - DNA, 19 bp, Homo sapiens
aggctctgagagtctagat

SEQ ID NO: 3246474 - DNA, 12 bp, Homo sapiens
aggctctgctgg

SEQ ID NO: 3246475 - DNA, 18 bp, Homo sapiens
aggctctggcccttgcct

SEQ ID NO: 3246476 - DNA, 22 bp, Homo sapiens
aggctctggcccttgcctttgt

SEQ ID NO: 3246477 - DNA, 18 bp, Homo sapiens
aggctctgggctcagggc

SEQ ID NO: 3246478 - DNA, 23 bp, Homo sapiens
aggctctgggctcagggctggag

SEQ ID NO: 3246479 - DNA, 20 bp, Homo sapiens
aaaaggcggtactagttcag

SEQ ID NO: 3246480 - DNA, 20 bp, Homo sapiens
aaaaggctaggtacacagct

SEQ ID NO: 3246481 - DNA, 14 bp, Homo sapiens
aaaaggctagttta

SEQ ID NO: 3246482 - DNA, 14 bp, Homo sapiens
aaaaggctgagaag

SEQ ID NO: 3246483 - DNA, 19 bp, Homo sapiens
aaaagggaagttgtgcctt

SEQ ID NO: 3246484 - DNA, 20 bp, Homo sapiens
aaaagggaagttgtgccttt

SEQ ID NO: 3246485 - DNA, 13 bp, Homo sapiens
aaaagggacagca

SEQ ID NO: 3246486 - DNA, 23 bp, Homo sapiens
aaaagggcagggcatctcctgtg

SEQ ID NO: 3246487 - DNA, 23 bp, Homo sapiens
aaaaggtagatcctgagatgatt

SEQ ID NO: 3246488 - DNA, 15 bp, Homo sapiens
aaaaggtataaataa

SEQ ID NO: 3246489 - DNA, 19 bp, Homo sapiens
aaaaggtatgcaatcaaat

SEQ ID NO: 3246490 - DNA, 21 bp, Homo sapiens
aaaaggtattttgaataccat

SEQ ID NO: 3246491 - DNA, 17 bp, Homo sapiens
aaaaggttaataaagta

SEQ ID NO: 3246492 - DNA, 19 bp, Homo sapiens
aaaaggttcactaaagcag

SEQ ID NO: 3246493 - DNA, 20 bp, Homo sapiens
aaaaggttgcctgaaaaatg

SEQ ID NO: 3246494 - DNA, 23 bp, Homo sapiens
aaaagtaagtaccactcaggcca

SEQ ID NO: 3246495 - DNA, 21 bp, Homo sapiens
aaaagtacatttaatacagca

SEQ ID NO: 3246496 - DNA, 15 bp, Homo sapiens
aaaagtagtaaattt

SEQ ID NO: 3246497 - DNA, 17 bp, Homo sapiens
aaaagtatattaaacaa

SEQ ID NO: 3246498 - DNA, 19 bp, Homo sapiens
aaaagtatttttttaagtt

SEQ ID NO: 3246499 - DNA, 19 bp, Homo sapiens
aaaagtcagactgctggga

SEQ ID NO: 3246500 - DNA, 13 bp, Homo sapiens
aaaagtcataaat

SEQ ID NO: 3246501 - DNA, 17 bp, Homo sapiens
aaaagtcataaatgcat

SEQ ID NO: 3246502 - DNA, 20 bp, Homo sapiens
aaaagtccataccttatata

SEQ ID NO: 3246503 - DNA, 16 bp, Homo sapiens
aaaagtcgttttccaa

SEQ ID NO: 3246504 - DNA, 20 bp, Homo sapiens
aaaagtgaatgaaagattaa

SEQ ID NO: 3246505 - DNA, 13 bp, Homo sapiens
aaaagtgacacag

SEQ ID NO: 3246506 - DNA, 14 bp, Homo sapiens
aaaagtgacacagc

SEQ ID NO: 3246507 - DNA, 15 bp, Homo sapiens
aaaagtgacacagca

SEQ ID NO: 3246508 - DNA, 17 bp, Homo sapiens
aaaagtgacacagcagc

SEQ ID NO: 3246509 - DNA, 21 bp, Homo sapiens
gatggcacttagctatcagaa

SEQ ID NO: 3246510 - DNA, 14 bp, Homo sapiens
gatggccaagagca

SEQ ID NO: 3246511 - DNA, 15 bp, Homo sapiens
gatggccaagagcat

SEQ ID NO: 3246512 - DNA, 18 bp, Homo sapiens
gatggccaagggggtgga

SEQ ID NO: 3246513 - DNA, 12 bp, Homo sapiens
gatggccagtgt

SEQ ID NO: 3246514 - DNA, 14 bp, Homo sapiens
gatggccataggag

SEQ ID NO: 3246515 - DNA, 13 bp, Homo sapiens
gatggcccctcca

SEQ ID NO: 3246516 - DNA, 15 bp, Homo sapiens
gatggcccctccact

SEQ ID NO: 3246517 - DNA, 20 bp, Homo sapiens
gatggcccggatgctgcttc

SEQ ID NO: 3246518 - DNA, 16 bp, Homo sapiens
gatggcctggaaccca

SEQ ID NO: 3246519 - DNA, 13 bp, Homo sapiens
gatggcgcgggag

SEQ ID NO: 3246520 - DNA, 16 bp, Homo sapiens
gatggcgcgggaggca

SEQ ID NO: 3246521 - DNA, 13 bp, Homo sapiens
gatggctgtgcct

SEQ ID NO: 3246522 - DNA, 17 bp, Homo sapiens
gatggctgtgcctctgc

SEQ ID NO: 3246523 - DNA, 20 bp, Homo sapiens
gatggctgtgcctctgcctg

SEQ ID NO: 3246524 - DNA, 16 bp, Homo sapiens
gatggcttatttttta

SEQ ID NO: 3246525 - DNA, 18 bp, Homo sapiens
gatggcttgacatgtgca

SEQ ID NO: 3246526 - DNA, 13 bp, Homo sapiens
gatggcttgtcta

SEQ ID NO: 3246527 - DNA, 20 bp, Homo sapiens
gatgggaatagggagacagg

SEQ ID NO: 3246528 - DNA, 19 bp, Homo sapiens
gatgggagtgggcacctca

SEQ ID NO: 3246529 - DNA, 22 bp, Homo sapiens
gatgggcaaagcttgtcaaaga

SEQ ID NO: 3246530 - DNA, 21 bp, Homo sapiens
gatgggcaacccccagcctgc

SEQ ID NO: 3246531 - DNA, 16 bp, Homo sapiens
gatgggcattgggctg

SEQ ID NO: 3246532 - DNA, 18 bp, Homo sapiens
gatgggcattgggctgac

SEQ ID NO: 3246533 - DNA, 21 bp, Homo sapiens
gatgggcattgggctgacacc

SEQ ID NO: 3246534 - DNA, 21 bp, Homo sapiens
gatgggctgtttcgtgtagtg

SEQ ID NO: 3246535 - DNA, 14 bp, Homo sapiens
gatgggctttctct

SEQ ID NO: 3246536 - DNA, 21 bp, Homo sapiens
gatggggcctccctccttggg

SEQ ID NO: 3246537 - DNA, 15 bp, Homo sapiens
gatggggctcccagc

SEQ ID NO: 3246538 - DNA, 21 bp, Homo sapiens
gatggggctcccagctccttt

SEQ ID NO: 3246539 - DNA, 19 bp, Homo sapiens
gatgggtgggggctcctgg

SEQ ID NO: 3246540 - DNA, 23 bp, Homo sapiens
gatgggtgggggctcctggtggc

SEQ ID NO: 3246541 - DNA, 21 bp, Homo sapiens
gatgggttctaattttggatg

SEQ ID NO: 3246542 - DNA, 22 bp, Homo sapiens
gatggtaagagaaaagagagaa

SEQ ID NO: 3246543 - DNA, 22 bp, Homo sapiens
gatggtatctgggtaagaagaa

SEQ ID NO: 3246544 - DNA, 16 bp, Homo sapiens
gatggtatttctttct

SEQ ID NO: 3246545 - DNA, 22 bp, Homo sapiens
gatggtggaccctactattcat

SEQ ID NO: 3246546 - DNA, 21 bp, Homo sapiens
gatggtggactacaaaataca

SEQ ID NO: 3246547 - DNA, 21 bp, Homo sapiens
gatggtgtctcttctttagaa

SEQ ID NO: 3246548 - DNA, 18 bp, Homo sapiens
gatggttacactgttaga

SEQ ID NO: 3246549 - DNA, 18 bp, Homo sapiens
gatggttcccctgttcac

SEQ ID NO: 3246550 - DNA, 17 bp, Homo sapiens
gatgtaattagctctgg

SEQ ID NO: 3246551 - DNA, 20 bp, Homo sapiens
gatgtaattagctctggggg

SEQ ID NO: 3246552 - DNA, 17 bp, Homo sapiens
gatgtacagtctgtcat

SEQ ID NO: 3246553 - DNA, 18 bp, Homo sapiens
gatgtacagtctgtcatg

SEQ ID NO: 3246554 - DNA, 14 bp, Homo sapiens
gatgtaccagtttg

SEQ ID NO: 3246555 - DNA, 19 bp, Homo sapiens
gatgtaccagtttgtccat

SEQ ID NO: 3246556 - DNA, 12 bp, Homo sapiens
gatgtagaactt

SEQ ID NO: 3246557 - DNA, 15 bp, Homo sapiens
gatgtagttctgcca

SEQ ID NO: 3246558 - DNA, 21 bp, Homo sapiens
gatgtatctgagttgccaaga

SEQ ID NO: 3246559 - DNA, 21 bp, Homo sapiens
gatgtatgtgtgaaacaatgt

SEQ ID NO: 3246560 - DNA, 19 bp, Homo sapiens
gatgtcagcttcccagcca

SEQ ID NO: 3246561 - DNA, 14 bp, Homo sapiens
gatgtccccaaagt

SEQ ID NO: 3246562 - DNA, 16 bp, Homo sapiens
gatgtcccctgcgggc

SEQ ID NO: 3246563 - DNA, 21 bp, Homo sapiens
gatgtccctgggccagggtct

SEQ ID NO: 3246564 - DNA, 22 bp, Homo sapiens
gatgtccctgggccagggtctg

SEQ ID NO: 3246565 - DNA, 20 bp, Homo sapiens
gatgtccctttcttggccag

SEQ ID NO: 3246566 - DNA, 22 bp, Homo sapiens
gatgtcttccttggagggggga

SEQ ID NO: 3246567 - DNA, 15 bp, Homo sapiens
gatgtcttctgcctg

SEQ ID NO: 3246568 - DNA, 20 bp, Homo sapiens
ctactctgtccaggccactg

SEQ ID NO: 3246569 - DNA, 12 bp, Homo sapiens
ctactctgtgtc

SEQ ID NO: 3246570 - DNA, 15 bp, Homo sapiens
ctactcttgtcattt

SEQ ID NO: 3246571 - DNA, 17 bp, Homo sapiens
ctactgataaagaaaga

SEQ ID NO: 3246572 - DNA, 17 bp, Homo sapiens
ctactgattgtttcatt

SEQ ID NO: 3246573 - DNA, 16 bp, Homo sapiens
ctactgatttttgtga

SEQ ID NO: 3246574 - DNA, 17 bp, Homo sapiens
ctactgcactccagcct

SEQ ID NO: 3246575 - DNA, 18 bp, Homo sapiens
ctactgcagcacctccag

SEQ ID NO: 3246576 - DNA, 17 bp, Homo sapiens
ctactgcagctttacat

SEQ ID NO: 3246577 - DNA, 15 bp, Homo sapiens
ctactgctaaatcct

SEQ ID NO: 3246578 - DNA, 21 bp, Homo sapiens
ctactggacttgaatggttaa

SEQ ID NO: 3246579 - DNA, 16 bp, Homo sapiens
ctactggattcttatt

SEQ ID NO: 3246580 - DNA, 12 bp, Homo sapiens
ctactggcagct

SEQ ID NO: 3246581 - DNA, 14 bp, Homo sapiens
ctactggcagctcc

SEQ ID NO: 3246582 - DNA, 22 bp, Homo sapiens
ctactggcagctcctctccttg

SEQ ID NO: 3246583 - DNA, 16 bp, Homo sapiens
ctactgtaattttata

SEQ ID NO: 3246584 - DNA, 17 bp, Homo sapiens
ctactgtaattttatat

SEQ ID NO: 3246585 - DNA, 12 bp, Homo sapiens
ctactgtacttt

SEQ ID NO: 3246586 - DNA, 16 bp, Homo sapiens
ctactgtactttgcca

SEQ ID NO: 3246587 - DNA, 21 bp, Homo sapiens
ctactgtactttgccattttt

SEQ ID NO: 3246588 - DNA, 20 bp, Homo sapiens
ctactgtcctacccaccctc

SEQ ID NO: 3246589 - DNA, 22 bp, Homo sapiens
ctactgtctttggaaaaatgtt

SEQ ID NO: 3246590 - DNA, 19 bp, Homo sapiens
ctactgtgtgtgtgaatga

SEQ ID NO: 3246591 - DNA, 19 bp, Homo sapiens
ctactgtgttcctggcaat

SEQ ID NO: 3246592 - DNA, 12 bp, Homo sapiens
ctactgttctaa

SEQ ID NO: 3246593 - DNA, 15 bp, Homo sapiens
ctactgttctaaagc

SEQ ID NO: 3246594 - DNA, 22 bp, Homo sapiens
ctactgttctaaagctctgaca

SEQ ID NO: 3246595 - DNA, 22 bp, Homo sapiens
ctacttcatagctccttggagc

SEQ ID NO: 3246596 - DNA, 13 bp, Homo sapiens
ctacttcctcctc

SEQ ID NO: 3246597 - DNA, 20 bp, Homo sapiens
ctacttcctcctccccactt

SEQ ID NO: 3246598 - DNA, 17 bp, Homo sapiens
ctacttctgtaattgtg

SEQ ID NO: 3246599 - DNA, 18 bp, Homo sapiens
ctacttctgtaattgtgt

SEQ ID NO: 3246600 - DNA, 22 bp, Homo sapiens
ctacttcttttgctcttagctg

SEQ ID NO: 3246601 - DNA, 15 bp, Homo sapiens
ctacttgagaggctg

SEQ ID NO: 3246602 - DNA, 20 bp, Homo sapiens
ctacttgataatattagtga

SEQ ID NO: 3246603 - DNA, 21 bp, Homo sapiens
ctacttgcttattacatttaa

SEQ ID NO: 3246604 - DNA, 22 bp, Homo sapiens
ctacttgcttattacatttaaa

SEQ ID NO: 3246605 - DNA, 12 bp, Homo sapiens
ctacttgggagg

SEQ ID NO: 3246606 - DNA, 20 bp, Homo sapiens
ctacttgggaggctgaggca

SEQ ID NO: 3246607 - DNA, 15 bp, Homo sapiens
ctacttggtttgtgt

SEQ ID NO: 3246608 - DNA, 18 bp, Homo sapiens
ctacttgtgactgaaggg

SEQ ID NO: 3246609 - DNA, 13 bp, Homo sapiens
ctactttccattt

SEQ ID NO: 3246610 - DNA, 17 bp, Homo sapiens
ctactttccatttggta

SEQ ID NO: 3246611 - DNA, 16 bp, Homo sapiens
ctactttctcctgaaa

SEQ ID NO: 3246612 - DNA, 14 bp, Homo sapiens
ctactttctctttt

SEQ ID NO: 3246613 - DNA, 18 bp, Homo sapiens
ctactttctctttttcgt

SEQ ID NO: 3246614 - DNA, 16 bp, Homo sapiens
ctactttgcttccgcc

SEQ ID NO: 3246615 - DNA, 20 bp, Homo sapiens
ctactttgttaggattttca

SEQ ID NO: 3246616 - DNA, 21 bp, Homo sapiens
ctacttttagttgactcacag

SEQ ID NO: 3246617 - DNA, 22 bp, Homo sapiens
ctacttttgcttttttatttac

SEQ ID NO: 3246618 - DNA, 22 bp, Homo sapiens
ctagaaaacaatgcaaaacctt

SEQ ID NO: 3246619 - DNA, 18 bp, Homo sapiens
ctagaaaaggcattttgg

SEQ ID NO: 3246620 - DNA, 18 bp, Homo sapiens
ctagaaacccaagctcct

SEQ ID NO: 3246621 - DNA, 22 bp, Homo sapiens
ctagaaagaaaagaccctgaga

SEQ ID NO: 3246622 - DNA, 22 bp, Homo sapiens
ctagaaagaagctcgccccacc

SEQ ID NO: 3246623 - DNA, 15 bp, Homo sapiens
ctagaaatatgattt

SEQ ID NO: 3246624 - DNA, 17 bp, Homo sapiens
ctagaaatatgatttta

SEQ ID NO: 3246625 - DNA, 21 bp, Homo sapiens
ctagaaatgcggtctggtctc

SEQ ID NO: 3246626 - DNA, 19 bp, Homo sapiens
ctagaacacaggcaaaatc

SEQ ID NO: 3246627 - DNA, 22 bp, Homo sapiens
ctagaacacaggcaaaatcctt

SEQ ID NO: 3246628 - DNA, 15 bp, Homo sapiens
ctagaacctgggctg

SEQ ID NO: 3246629 - DNA, 17 bp, Homo sapiens
ctagaacctgggctgtg

SEQ ID NO: 3246630 - DNA, 22 bp, Homo sapiens
ctagaaccttctagaacctggg

SEQ ID NO: 3246631 - DNA, 12 bp, Homo sapiens
ctagaactccct

SEQ ID NO: 3246632 - DNA, 13 bp, Homo sapiens
ctagaactccctt

SEQ ID NO: 3246633 - DNA, 18 bp, Homo sapiens
ctagaacttttttaaata

SEQ ID NO: 3246634 - DNA, 19 bp, Homo sapiens
ctagaacttttttaaataa

SEQ ID NO: 3246635 - DNA, 20 bp, Homo sapiens
ctagaacttttttaaataaa

SEQ ID NO: 3246636 - DNA, 13 bp, Homo sapiens
ctagaagaaaagc

SEQ ID NO: 3246637 - DNA, 12 bp, Homo sapiens
ctagaagaacaa

SEQ ID NO: 3246638 - DNA, 20 bp, Homo sapiens
ctagaagataacattttcaa

SEQ ID NO: 3246639 - DNA, 12 bp, Homo sapiens
ctagaagcacat

SEQ ID NO: 3246640 - DNA, 13 bp, Homo sapiens
ctagaagcacatg

SEQ ID NO: 3246641 - DNA, 16 bp, Homo sapiens
ctagaagctccatgga

SEQ ID NO: 3246642 - DNA, 18 bp, Homo sapiens
ctagaagtttcccttcct

SEQ ID NO: 3246643 - DNA, 20 bp, Homo sapiens
ctagaagtttcccttcctcc

SEQ ID NO: 3246644 - DNA, 18 bp, Homo sapiens
ctagaatactttttaaaa

SEQ ID NO: 3246645 - DNA, 13 bp, Homo sapiens
ctagaatctttat

SEQ ID NO: 3246646 - DNA, 20 bp, Homo sapiens
ctagaattagtatgtctgtt

SEQ ID NO: 3246647 - DNA, 21 bp, Homo sapiens
ctagaatttatcacacttctg

SEQ ID NO: 3246648 - DNA, 15 bp, Homo sapiens
ctagaatttattcaa

SEQ ID NO: 3246649 - DNA, 17 bp, Homo sapiens
ctagacaccaaagttct

SEQ ID NO: 3246650 - DNA, 19 bp, Homo sapiens
ctagacaccaaagttctaa

SEQ ID NO: 3246651 - DNA, 21 bp, Homo sapiens
ctagacaccaaagttctaata

SEQ ID NO: 3246652 - DNA, 18 bp, Homo sapiens
ctagacagatccccgttc

SEQ ID NO: 3246653 - DNA, 23 bp, Homo sapiens
ctagacagttagagactctgtca

SEQ ID NO: 3246654 - DNA, 17 bp, Homo sapiens
ctagacatggaggttct

SEQ ID NO: 3246655 - DNA, 19 bp, Homo sapiens
ctagacatggaggttctaa

SEQ ID NO: 3246656 - DNA, 23 bp, Homo sapiens
ctagacatggaggttctaaggcc

SEQ ID NO: 3246657 - DNA, 23 bp, Homo sapiens
ctagacccaggtggagggcacag

SEQ ID NO: 3246658 - DNA, 20 bp, Homo sapiens
ctagacgttcatttgtgtgc

SEQ ID NO: 3246659 - DNA, 16 bp, Homo sapiens
ctagactataaatgtt

SEQ ID NO: 3246660 - DNA, 24 bp, Homo sapiens
ctagactggagtgaggcttccagg

SEQ ID NO: 3246661 - DNA, 16 bp, Homo sapiens
ctagacttcccaacag

SEQ ID NO: 3246662 - DNA, 20 bp, Homo sapiens
ctagacttcccaacagcctt

SEQ ID NO: 3246663 - DNA, 14 bp, Homo sapiens
ctagacttgaaagt

SEQ ID NO: 3246664 - DNA, 15 bp, Homo sapiens
ctaaagtatagagaa

SEQ ID NO: 3246665 - DNA, 20 bp, Homo sapiens
ctaaagtatagagaaaagtg

SEQ ID NO: 3246666 - DNA, 16 bp, Homo sapiens
ctaaagtatgtaaagt

SEQ ID NO: 3246667 - DNA, 21 bp, Homo sapiens
ctaaagtgatgggctttctct

SEQ ID NO: 3246668 - DNA, 15 bp, Homo sapiens
ctaaagtgttggtct

SEQ ID NO: 3246669 - DNA, 17 bp, Homo sapiens
ctaaagtgttggtcttt

SEQ ID NO: 3246670 - DNA, 19 bp, Homo sapiens
ctaaagttctaagattctg

SEQ ID NO: 3246671 - DNA, 20 bp, Homo sapiens
ctaaagttctaagattctga

SEQ ID NO: 3246672 - DNA, 16 bp, Homo sapiens
ctaaataaagatattg

SEQ ID NO: 3246673 - DNA, 20 bp, Homo sapiens
ctaaataatgaataaactga

SEQ ID NO: 3246674 - DNA, 21 bp, Homo sapiens
ctaaataatgaataaactgaa

SEQ ID NO: 3246675 - DNA, 22 bp, Homo sapiens
ctaaatatccaaagactgtact

SEQ ID NO: 3246676 - DNA, 14 bp, Homo sapiens
ctaaatatctgtca

SEQ ID NO: 3246677 - DNA, 13 bp, Homo sapiens
ctaaatatttcct

SEQ ID NO: 3246678 - DNA, 15 bp, Homo sapiens
ctaaatatttcctta

SEQ ID NO: 3246679 - DNA, 22 bp, Homo sapiens
ctaaatatttccttaaactgtg

SEQ ID NO: 3246680 - DNA, 15 bp, Homo sapiens
ctaaatcagagacaa

SEQ ID NO: 3246681 - DNA, 14 bp, Homo sapiens
ctaaatgaatgttt

SEQ ID NO: 3246682 - DNA, 16 bp, Homo sapiens
ctaaatgaatgtttac

SEQ ID NO: 3246683 - DNA, 17 bp, Homo sapiens
ctaaatgcctagttttt

SEQ ID NO: 3246684 - DNA, 21 bp, Homo sapiens
ctaaatgtgcaatagaaggtg

SEQ ID NO: 3246685 - DNA, 16 bp, Homo sapiens
ctaaatgttgaaagat

SEQ ID NO: 3246686 - DNA, 16 bp, Homo sapiens
ctaaatgttggaatgt

SEQ ID NO: 3246687 - DNA, 19 bp, Homo sapiens
ctaaattacaattgtcatt

SEQ ID NO: 3246688 - DNA, 19 bp, Homo sapiens
ctaaattctttatttctgt

SEQ ID NO: 3246689 - DNA, 21 bp, Homo sapiens
ctaaattctttatttctgtca

SEQ ID NO: 3246690 - DNA, 17 bp, Homo sapiens
ctaaattgtatacattt

SEQ ID NO: 3246691 - DNA, 14 bp, Homo sapiens
ctaaatttcttttg

SEQ ID NO: 3246692 - DNA, 16 bp, Homo sapiens
ctaaatttgatactta

SEQ ID NO: 3246693 - DNA, 17 bp, Homo sapiens
ctaaatttgatacttat

SEQ ID NO: 3246694 - DNA, 19 bp, Homo sapiens
ctaaatttttaactgcctt

SEQ ID NO: 3246695 - DNA, 16 bp, Homo sapiens
ctaacaaaagatgaaa

SEQ ID NO: 3246696 - DNA, 13 bp, Homo sapiens
ctaacaaactaga

SEQ ID NO: 3246697 - DNA, 17 bp, Homo sapiens
ctaacaataatatttca

SEQ ID NO: 3246698 - DNA, 18 bp, Homo sapiens
ctaacaataatatttcaa

SEQ ID NO: 3246699 - DNA, 22 bp, Homo sapiens
ctaacaataatatttcaagtgc

SEQ ID NO: 3246700 - DNA, 13 bp, Homo sapiens
ctaacacaaggac

SEQ ID NO: 3246701 - DNA, 17 bp, Homo sapiens
ctaacacacacagaaaa

SEQ ID NO: 3246702 - DNA, 21 bp, Homo sapiens
ctaacaccagcgtttgagggg

SEQ ID NO: 3246703 - DNA, 17 bp, Homo sapiens
ctaacacctgcctaggt

SEQ ID NO: 3246704 - DNA, 23 bp, Homo sapiens
ctaacacggtgctcattttttct

SEQ ID NO: 3246705 - DNA, 18 bp, Homo sapiens
ctaacagatcagaacatg

SEQ ID NO: 3246706 - DNA, 15 bp, Homo sapiens
ctaacaggcactttg

SEQ ID NO: 3246707 - DNA, 23 bp, Homo sapiens
ctaacatataatgttgttattta

SEQ ID NO: 3246708 - DNA, 14 bp, Homo sapiens
ctaacatcccactt

SEQ ID NO: 3246709 - DNA, 17 bp, Homo sapiens
ctaacatgtcctgccta

SEQ ID NO: 3246710 - DNA, 16 bp, Homo sapiens
ctaacattatattgca

SEQ ID NO: 3246711 - DNA, 18 bp, Homo sapiens
ctaacattatattgcaat

SEQ ID NO: 3246712 - DNA, 21 bp, Homo sapiens
ctaacatttcccccgagctct

SEQ ID NO: 3246713 - DNA, 22 bp, Homo sapiens
ctaacatttcccccgagctctt

SEQ ID NO: 3246714 - DNA, 15 bp, Homo sapiens
ctaaccaagctgagt

SEQ ID NO: 3246715 - DNA, 12 bp, Homo sapiens
ctaaccacgctg

SEQ ID NO: 3246716 - DNA, 20 bp, Homo sapiens
ctaaccacgtctgtcttcac

SEQ ID NO: 3246717 - DNA, 21 bp, Homo sapiens
ctaaccacgtctgtcttcaca

SEQ ID NO: 3246718 - DNA, 15 bp, Homo sapiens
ctaaccaggcccagc

SEQ ID NO: 3246719 - DNA, 16 bp, Homo sapiens
ctaaccaggcccagcc

SEQ ID NO: 3246720 - DNA, 19 bp, Homo sapiens
ctaaccagtacctctgtat

SEQ ID NO: 3246721 - DNA, 20 bp, Homo sapiens
ctaaccattaagtcatgtgt

SEQ ID NO: 3246722 - DNA, 17 bp, Homo sapiens
ctaaccccaacgcacag

SEQ ID NO: 3246723 - DNA, 18 bp, Homo sapiens
ctaacctggacctggaac

SEQ ID NO: 3246724 - DNA, 15 bp, Homo sapiens
ctaacgggaggctgg

SEQ ID NO: 3246725 - DNA, 19 bp, Homo sapiens
ctaacgtgtcagaatcctt

SEQ ID NO: 3246726 - DNA, 17 bp, Homo sapiens
ctaacgttgagcccctg

SEQ ID NO: 3246727 - DNA, 21 bp, Homo sapiens
ctaactagaattagtatgtct

SEQ ID NO: 3246728 - DNA, 23 bp, Homo sapiens
ctaactagacaccaaagttctaa

SEQ ID NO: 3246729 - DNA, 15 bp, Homo sapiens
ctaactgaagagaca

SEQ ID NO: 3246730 - DNA, 14 bp, Homo sapiens
ctaactgtaaatca

SEQ ID NO: 3246731 - DNA, 17 bp, Homo sapiens
ctaactgtaaatcatgt

SEQ ID NO: 3246732 - DNA, 22 bp, Homo sapiens
ctaacttattttatttccatca

SEQ ID NO: 3246733 - DNA, 20 bp, Homo sapiens
ctaactttagaagtgcattt

SEQ ID NO: 3246734 - DNA, 23 bp, Homo sapiens
ctaactttagaagtgcatttctg

SEQ ID NO: 3246735 - DNA, 23 bp, Homo sapiens
ctaagaaacacatcaaataaact

SEQ ID NO: 3246736 - DNA, 19 bp, Homo sapiens
ctacaagctaaaattagat

SEQ ID NO: 3246737 - DNA, 15 bp, Homo sapiens
ctacaataaactggt

SEQ ID NO: 3246738 - DNA, 18 bp, Homo sapiens
ctacaatattttattcta

SEQ ID NO: 3246739 - DNA, 21 bp, Homo sapiens
ctacaatctctttttgtttgc

SEQ ID NO: 3246740 - DNA, 13 bp, Homo sapiens
ctacaatgtgaac

SEQ ID NO: 3246741 - DNA, 17 bp, Homo sapiens
ctacaatgtgaacttta

SEQ ID NO: 3246742 - DNA, 19 bp, Homo sapiens
ctacaatgtgaactttatt

SEQ ID NO: 3246743 - DNA, 21 bp, Homo sapiens
ctacaatttgttaattcctat

SEQ ID NO: 3246744 - DNA, 22 bp, Homo sapiens
ctacacactgtcatgcttcatc

SEQ ID NO: 3246745 - DNA, 21 bp, Homo sapiens
ctacacagtgggaactctgac

SEQ ID NO: 3246746 - DNA, 22 bp, Homo sapiens
ctacacagtgggaactctgaca

SEQ ID NO: 3246747 - DNA, 14 bp, Homo sapiens
ctacactccagcct

SEQ ID NO: 3246748 - DNA, 18 bp, Homo sapiens
ctacactccagcctgagc

SEQ ID NO: 3246749 - DNA, 23 bp, Homo sapiens
ctacagaagccaagctccctgga

SEQ ID NO: 3246750 - DNA, 14 bp, Homo sapiens
ctacagaagtggaa

SEQ ID NO: 3246751 - DNA, 15 bp, Homo sapiens
ctacagaggccatgg

SEQ ID NO: 3246752 - DNA, 19 bp, Homo sapiens
ctacagatcctttttccat

SEQ ID NO: 3246753 - DNA, 22 bp, Homo sapiens
ctacagatcctttttccatcat

SEQ ID NO: 3246754 - DNA, 18 bp, Homo sapiens
ctacagctaatcagcatt

SEQ ID NO: 3246755 - DNA, 22 bp, Homo sapiens
ctacagctaatcagcattctca

SEQ ID NO: 3246756 - DNA, 11 bp, Homo sapiens
ctacagctctt

SEQ ID NO: 3246757 - DNA, 19 bp, Homo sapiens
ctacagctttcttgctccc

SEQ ID NO: 3246758 - DNA, 20 bp, Homo sapiens
ctacagctttcttgctccct

SEQ ID NO: 3246759 - DNA, 19 bp, Homo sapiens
ctacagctttgatccctga

SEQ ID NO: 3246760 - DNA, 22 bp, Homo sapiens
ctacaggaagcaccccatgcca

SEQ ID NO: 3246761 - DNA, 21 bp, Homo sapiens
ctacaggagagggaagagtgc

SEQ ID NO: 3246762 - DNA, 17 bp, Homo sapiens
ctacaggaggggtctca

SEQ ID NO: 3246763 - DNA, 17 bp, Homo sapiens
ctacaggcacccaccat

SEQ ID NO: 3246764 - DNA, 22 bp, Homo sapiens
ctacaggtgtttgactttcaaa

SEQ ID NO: 3246765 - DNA, 19 bp, Homo sapiens
ctacagtgccaactcctca

SEQ ID NO: 3246766 - DNA, 18 bp, Homo sapiens
ctacagttttaactgtgg

SEQ ID NO: 3246767 - DNA, 20 bp, Homo sapiens
ctacagttttaactgtggat

SEQ ID NO: 3246768 - DNA, 20 bp, Homo sapiens
ctacataaactgactttatc

SEQ ID NO: 3246769 - DNA, 22 bp, Homo sapiens
ctacataagactggacatttaa

SEQ ID NO: 3246770 - DNA, 23 bp, Homo sapiens
ctacataagtaattcaagaaaac

SEQ ID NO: 3246771 - DNA, 18 bp, Homo sapiens
ctacatacaattccaaac

SEQ ID NO: 3246772 - DNA, 15 bp, Homo sapiens
ctacatcccagcctg

SEQ ID NO: 3246773 - DNA, 19 bp, Homo sapiens
ctacatcccagcctgtggt

SEQ ID NO: 3246774 - DNA, 14 bp, Homo sapiens
ctacatcttctgcc

SEQ ID NO: 3246775 - DNA, 21 bp, Homo sapiens
ctacatgacgacaaagctgct

SEQ ID NO: 3246776 - DNA, 15 bp, Homo sapiens
ctacatgactgggcc

SEQ ID NO: 3246777 - DNA, 17 bp, Homo sapiens
ctacatgagaacaaaca

SEQ ID NO: 3246778 - DNA, 17 bp, Homo sapiens
ctacatgcagcccatgc

SEQ ID NO: 3246779 - DNA, 14 bp, Homo sapiens
ctacatgctgaaaa

SEQ ID NO: 3246780 - DNA, 14 bp, Homo sapiens
ctacatgctggggt

SEQ ID NO: 3246781 - DNA, 15 bp, Homo sapiens
ctacatgctggggtc

SEQ ID NO: 3246782 - DNA, 13 bp, Homo sapiens
ctacatgtattgc

SEQ ID NO: 3246783 - DNA, 12 bp, Homo sapiens
ctacattcattt

SEQ ID NO: 3246784 - DNA, 20 bp, Homo sapiens
ctacattccctctcctgccc

SEQ ID NO: 3246785 - DNA, 22 bp, Homo sapiens
ctacattccctctcctgcccag

SEQ ID NO: 3246786 - DNA, 12 bp, Homo sapiens
ctaccaaaatgg

SEQ ID NO: 3246787 - DNA, 14 bp, Homo sapiens
ctaccaaagcacct

SEQ ID NO: 3246788 - DNA, 15 bp, Homo sapiens
ctaccaaagcacctt

SEQ ID NO: 3246789 - DNA, 22 bp, Homo sapiens
ctaccaaatgttaataaagccc

SEQ ID NO: 3246790 - DNA, 19 bp, Homo sapiens
ctaccaatgccaagataat

SEQ ID NO: 3246791 - DNA, 13 bp, Homo sapiens
ctaccacaaggaa

SEQ ID NO: 3246792 - DNA, 14 bp, Homo sapiens
ctaccacagtgtct

SEQ ID NO: 3246793 - DNA, 18 bp, Homo sapiens
ctaccacgggtctgccat

SEQ ID NO: 3246794 - DNA, 22 bp, Homo sapiens
ctaccacgggtctgccatgctc

SEQ ID NO: 3246795 - DNA, 15 bp, Homo sapiens
ctaccaggacagaac

SEQ ID NO: 3246796 - DNA, 15 bp, Homo sapiens
ctaccaggtgttcta

SEQ ID NO: 3246797 - DNA, 15 bp, Homo sapiens
ctacccagcgagccc

SEQ ID NO: 3246798 - DNA, 20 bp, Homo sapiens
ctacccaggaggctgaggtg

SEQ ID NO: 3246799 - DNA, 15 bp, Homo sapiens
ctacccatgagcctg

SEQ ID NO: 3246800 - DNA, 17 bp, Homo sapiens
ctaccccctaagagcca

SEQ ID NO: 3246801 - DNA, 18 bp, Homo sapiens
ctacccccttttcagctg

SEQ ID NO: 3246802 - DNA, 14 bp, Homo sapiens
ctaccctcccccag

SEQ ID NO: 3246803 - DNA, 19 bp, Homo sapiens
ctaccctcctgcactgttt

SEQ ID NO: 3246804 - DNA, 17 bp, Homo sapiens
ctaccctgctccctgct

SEQ ID NO: 3246805 - DNA, 23 bp, Homo sapiens
ctaccctgctccctgctttggct

SEQ ID NO: 3246806 - DNA, 19 bp, Homo sapiens
ctacccttcctgcatttct

SEQ ID NO: 3246807 - DNA, 18 bp, Homo sapiens
ctaccgaaaccttgcctt

SEQ ID NO: 3246808 - DNA, 13 bp, Homo sapiens
ctaccgagttcaa

SEQ ID NO: 3246809 - DNA, 12 bp, Homo sapiens
ctaccgccctgg

SEQ ID NO: 3246810 - DNA, 15 bp, Homo sapiens
ctaccgccctgggct

SEQ ID NO: 3246811 - DNA, 16 bp, Homo sapiens
ctaccgccctgggctg

SEQ ID NO: 3246812 - DNA, 21 bp, Homo sapiens
ctaccgccctgggctggactg

SEQ ID NO: 3246813 - DNA, 21 bp, Homo sapiens
ctacctacatgctgaaaaata

SEQ ID NO: 3246814 - DNA, 13 bp, Homo sapiens
ctacctcagcagc

SEQ ID NO: 3246815 - DNA, 17 bp, Homo sapiens
ctacctcaggcagctca

SEQ ID NO: 3246816 - DNA, 14 bp, Homo sapiens
ctacctcaggttgc

SEQ ID NO: 3246817 - DNA, 15 bp, Homo sapiens
ctacctcaggttgct

SEQ ID NO: 3246818 - DNA, 18 bp, Homo sapiens
ctacctcaggttgctggt

SEQ ID NO: 3246819 - DNA, 19 bp, Homo sapiens
ctacctcaggttgctggtt

SEQ ID NO: 3246820 - DNA, 20 bp, Homo sapiens
ctacctcaggttgctggttg

SEQ ID NO: 3246821 - DNA, 13 bp, Homo sapiens
ctacctccctccc

SEQ ID NO: 3246822 - DNA, 21 bp, Homo sapiens
ctacctccttagctttccctg

SEQ ID NO: 3246823 - DNA, 16 bp, Homo sapiens
ctacctctctgtccct

SEQ ID NO: 3246824 - DNA, 22 bp, Homo sapiens
cagctccccctgtcccctcagc

SEQ ID NO: 3246825 - DNA, 23 bp, Homo sapiens
cagctccctagactgcatcccgt

SEQ ID NO: 3246826 - DNA, 19 bp, Homo sapiens
cagctccctgccaaactga

SEQ ID NO: 3246827 - DNA, 17 bp, Homo sapiens
cagctcctcagcggctc

SEQ ID NO: 3246828 - DNA, 13 bp, Homo sapiens
cagctcctctcct

SEQ ID NO: 3246829 - DNA, 15 bp, Homo sapiens
cagctcctgtaacat

SEQ ID NO: 3246830 - DNA, 17 bp, Homo sapiens
cagctccttctgtccta

SEQ ID NO: 3246831 - DNA, 19 bp, Homo sapiens
cagctcctttctcctgtga

SEQ ID NO: 3246832 - DNA, 15 bp, Homo sapiens
cagcttcatttgtgt

SEQ ID NO: 3246833 - DNA, 19 bp, Homo sapiens
cagcttcccagccatgccc

SEQ ID NO: 3246834 - DNA, 22 bp, Homo sapiens
cagcttcccagccatgcccagg

SEQ ID NO: 3246835 - DNA, 20 bp, Homo sapiens
cagcttcgtttattttcaag

SEQ ID NO: 3246836 - DNA, 13 bp, Homo sapiens
cagcttctcctgc

SEQ ID NO: 3246837 - DNA, 13 bp, Homo sapiens
cagcttctctgca

SEQ ID NO: 3246838 - DNA, 14 bp, Homo sapiens
cagcttctctgcag

SEQ ID NO: 3246839 - DNA, 23 bp, Homo sapiens
cagcttctctgctagatttctac

SEQ ID NO: 3246840 - DNA, 20 bp, Homo sapiens
cagcttcttcctaggtccaa

SEQ ID NO: 3246841 - DNA, 19 bp, Homo sapiens
cagcttcttttgtctccca

SEQ ID NO: 3246842 - DNA, 20 bp, Homo sapiens
cagcttcttttgtctcccag

SEQ ID NO: 3246843 - DNA, 16 bp, Homo sapiens
cagcttgacctgaggc

SEQ ID NO: 3246844 - DNA, 21 bp, Homo sapiens
cagcttgacctgaggctgtgg

SEQ ID NO: 3246845 - DNA, 14 bp, Homo sapiens
cagcttgagccggg

SEQ ID NO: 3246846 - DNA, 22 bp, Homo sapiens
cagcttgagccgggcccctggg

SEQ ID NO: 3246847 - DNA, 15 bp, Homo sapiens
cagcttgagggttgg

SEQ ID NO: 3246848 - DNA, 18 bp, Homo sapiens
cagcttgagggttgggct

SEQ ID NO: 3246849 - DNA, 20 bp, Homo sapiens
cagcttgagggttgggctgg

SEQ ID NO: 3246850 - DNA, 18 bp, Homo sapiens
cagcttgagtttttagtg

SEQ ID NO: 3246851 - DNA, 16 bp, Homo sapiens
cagcttgccccggccc

SEQ ID NO: 3246852 - DNA, 14 bp, Homo sapiens
cagcttgcgaataa

SEQ ID NO: 3246853 - DNA, 16 bp, Homo sapiens
cagcttgcgaataaca

SEQ ID NO: 3246854 - DNA, 20 bp, Homo sapiens
cagcttggggccaccaaagc

SEQ ID NO: 3246855 - DNA, 22 bp, Homo sapiens
cagcttggggccaccaaagctg

SEQ ID NO: 3246856 - DNA, 18 bp, Homo sapiens
cagcttgtaaatagctca

SEQ ID NO: 3246857 - DNA, 15 bp, Homo sapiens
cagctttaaacaaat

SEQ ID NO: 3246858 - DNA, 21 bp, Homo sapiens
cagctttaaactcagggacag

SEQ ID NO: 3246859 - DNA, 22 bp, Homo sapiens
cagctttaaactcagggacaga

SEQ ID NO: 3246860 - DNA, 22 bp, Homo sapiens
cagctttactgccttcctcctt

SEQ ID NO: 3246861 - DNA, 19 bp, Homo sapiens
cagctttataacaaatgtg

SEQ ID NO: 3246862 - DNA, 13 bp, Homo sapiens
cagctttcagagc

SEQ ID NO: 3246863 - DNA, 19 bp, Homo sapiens
cagctttcagggccatggt

SEQ ID NO: 3246864 - DNA, 20 bp, Homo sapiens
cagctttcatgattagcaag

SEQ ID NO: 3246865 - DNA, 23 bp, Homo sapiens
cagctttgaggttgacctgtttc

SEQ ID NO: 3246866 - DNA, 20 bp, Homo sapiens
cagctttgatccctgacatc

SEQ ID NO: 3246867 - DNA, 12 bp, Homo sapiens
cagctttgcaaa

SEQ ID NO: 3246868 - DNA, 20 bp, Homo sapiens
cagctttgctccgctcccac

SEQ ID NO: 3246869 - DNA, 21 bp, Homo sapiens
cagctttgctccgctcccacc

SEQ ID NO: 3246870 - DNA, 23 bp, Homo sapiens
cagcttttacgtagtaaaagtca

SEQ ID NO: 3246871 - DNA, 12 bp, Homo sapiens
cagcttttgcaa

SEQ ID NO: 3246872 - DNA, 22 bp, Homo sapiens
cagctttttgatcctctactgt

SEQ ID NO: 3246873 - DNA, 19 bp, Homo sapiens
caggaaaaaaaattctgtt

SEQ ID NO: 3246874 - DNA, 22 bp, Homo sapiens
caggaaaacaaatcactgtatt

SEQ ID NO: 3246875 - DNA, 15 bp, Homo sapiens
caggaaaagctgctg

SEQ ID NO: 3246876 - DNA, 18 bp, Homo sapiens
caggaaaagctgctgaca

SEQ ID NO: 3246877 - DNA, 20 bp, Homo sapiens
caggaaaagctgctgacagt

SEQ ID NO: 3246878 - DNA, 19 bp, Homo sapiens
caggaaactccacatctgc

SEQ ID NO: 3246879 - DNA, 20 bp, Homo sapiens
caggaaactccacatctgcc

SEQ ID NO: 3246880 - DNA, 17 bp, Homo sapiens
caggaaagccctccccc

SEQ ID NO: 3246881 - DNA, 23 bp, Homo sapiens
caggaaagccctcccccttcccc

SEQ ID NO: 3246882 - DNA, 13 bp, Homo sapiens
caggaaatatata

SEQ ID NO: 3246883 - DNA, 17 bp, Homo sapiens
caggaaatatatatgtg

SEQ ID NO: 3246884 - DNA, 19 bp, Homo sapiens
caggaacaagtaatgtatt

SEQ ID NO: 3246885 - DNA, 14 bp, Homo sapiens
caggaacagctatg

SEQ ID NO: 3246886 - DNA, 16 bp, Homo sapiens
caggaacagtggctgg

SEQ ID NO: 3246887 - DNA, 18 bp, Homo sapiens
caggaacagtggctgggt

SEQ ID NO: 3246888 - DNA, 18 bp, Homo sapiens
caggaacgagcactggcc

SEQ ID NO: 3246889 - DNA, 21 bp, Homo sapiens
caggaactatggcaaggaact

SEQ ID NO: 3246890 - DNA, 22 bp, Homo sapiens
caggaactctggacccctgggc

SEQ ID NO: 3246891 - DNA, 23 bp, Homo sapiens
caggaactggggctttgccttgc

SEQ ID NO: 3246892 - DNA, 13 bp, Homo sapiens
caggaagaagaga

SEQ ID NO: 3246893 - DNA, 16 bp, Homo sapiens
caggaagaagagatgc

SEQ ID NO: 3246894 - DNA, 16 bp, Homo sapiens
caggaagataaaaatc

SEQ ID NO: 3246895 - DNA, 20 bp, Homo sapiens
caggaagcattcagagagca

SEQ ID NO: 3246896 - DNA, 12 bp, Homo sapiens
caggaagcccac

SEQ ID NO: 3246897 - DNA, 13 bp, Homo sapiens
caggaagcctgca

SEQ ID NO: 3246898 - DNA, 13 bp, Homo sapiens
caggaaggaaaac

SEQ ID NO: 3246899 - DNA, 21 bp, Homo sapiens
caggaaggacagactggccgg

SEQ ID NO: 3246900 - DNA, 22 bp, Homo sapiens
caggaaggacagactggccggg

SEQ ID NO: 3246901 - DNA, 13 bp, Homo sapiens
caggaaggagagc

SEQ ID NO: 3246902 - DNA, 15 bp, Homo sapiens
caggaaggagagcct

SEQ ID NO: 3246903 - DNA, 15 bp, Homo sapiens
caggaaggcagctgc

SEQ ID NO: 3246904 - DNA, 19 bp, Homo sapiens
caggaaggcagctgctctt

SEQ ID NO: 3246905 - DNA, 18 bp, Homo sapiens
caggaaggcctgggtgga

SEQ ID NO: 3246906 - DNA, 22 bp, Homo sapiens
caggaagggcctacagcccatt

SEQ ID NO: 3246907 - DNA, 15 bp, Homo sapiens
caggaagtacttcca

SEQ ID NO: 3246908 - DNA, 20 bp, Homo sapiens
caggaagtcagtcacgtttc

SEQ ID NO: 3246909 - DNA, 16 bp, Homo sapiens
caggaagtccagccac

SEQ ID NO: 3246910 - DNA, 12 bp, Homo sapiens
caggaataaggc

SEQ ID NO: 3246911 - DNA, 14 bp, Homo sapiens
caggaatgaagaac

SEQ ID NO: 3246912 - DNA, 16 bp, Homo sapiens
caggaatgaagaactg

SEQ ID NO: 3246913 - DNA, 21 bp, Homo sapiens
caggaatgaagaactgttgcc

SEQ ID NO: 3246914 - DNA, 17 bp, Homo sapiens
caggaatggaaagcgga

SEQ ID NO: 3246915 - DNA, 19 bp, Homo sapiens
caggaatggctgcaccttt

SEQ ID NO: 3246916 - DNA, 16 bp, Homo sapiens
caggaatgtctggagt

SEQ ID NO: 3246917 - DNA, 18 bp, Homo sapiens
caggaatgtctggagtgg

SEQ ID NO: 3246918 - DNA, 13 bp, Homo sapiens
caggaattagaga

SEQ ID NO: 3246919 - DNA, 21 bp, Homo sapiens
caggaattagagaagctgaaa

SEQ ID NO: 3246920 - DNA, 17 bp, Homo sapiens
caggacaaagggaggga

SEQ ID NO: 3246921 - DNA, 20 bp, Homo sapiens
caggacaaagggagggagca

SEQ ID NO: 3246922 - DNA, 21 bp, Homo sapiens
caggacaacacttcattttca

SEQ ID NO: 3246923 - DNA, 19 bp, Homo sapiens
caggacacatcccggcctc

SEQ ID NO: 3246924 - DNA, 14 bp, Homo sapiens
caggacaccacacc

SEQ ID NO: 3246925 - DNA, 19 bp, Homo sapiens
caggacaccacacccagcc

SEQ ID NO: 3246926 - DNA, 12 bp, Homo sapiens
caggacagagtt

SEQ ID NO: 3246927 - DNA, 21 bp, Homo sapiens
caggacagagttcacaggagg

SEQ ID NO: 3246928 - DNA, 16 bp, Homo sapiens
caggacagtgcttcag

SEQ ID NO: 3246929 - DNA, 15 bp, Homo sapiens
caggacattaaaaat

SEQ ID NO: 3246930 - DNA, 15 bp, Homo sapiens
caggaccaagccaca

SEQ ID NO: 3246931 - DNA, 14 bp, Homo sapiens
caggaccacacagt

SEQ ID NO: 3246932 - DNA, 14 bp, Homo sapiens
caggaccagctggg

SEQ ID NO: 3246933 - DNA, 12 bp, Homo sapiens
caggacccaggc

SEQ ID NO: 3246934 - DNA, 18 bp, Homo sapiens
caggacccaggccctcca

SEQ ID NO: 3246935 - DNA, 21 bp, Homo sapiens
caggacccaggccctccatgg

SEQ ID NO: 3246936 - DNA, 17 bp, Homo sapiens
caggacctcccttccga

SEQ ID NO: 3246937 - DNA, 15 bp, Homo sapiens
caggacctggcatca

SEQ ID NO: 3246938 - DNA, 14 bp, Homo sapiens
caggacgcttctga

SEQ ID NO: 3246939 - DNA, 22 bp, Homo sapiens
caggacgcttctgaatgctgct

SEQ ID NO: 3246940 - DNA, 17 bp, Homo sapiens
caggacgtctggggtgt

SEQ ID NO: 3246941 - DNA, 18 bp, Homo sapiens
caggactccactggacag

SEQ ID NO: 3246942 - DNA, 22 bp, Homo sapiens
caggactccactggacagaccc

SEQ ID NO: 3246943 - DNA, 18 bp, Homo sapiens
caggactccaggcccaag

SEQ ID NO: 3246944 - DNA, 21 bp, Homo sapiens
caggactccaggcccaaggct

SEQ ID NO: 3246945 - DNA, 16 bp, Homo sapiens
caggactccctcctca

SEQ ID NO: 3246946 - DNA, 19 bp, Homo sapiens
caggactccctcctcacct

SEQ ID NO: 3246947 - DNA, 22 bp, Homo sapiens
caggactccctcctcacctctg

SEQ ID NO: 3246948 - DNA, 14 bp, Homo sapiens
caggactgagcccc

SEQ ID NO: 3246949 - DNA, 19 bp, Homo sapiens
caggacttaacggctccag

SEQ ID NO: 3246950 - DNA, 21 bp, Homo sapiens
caggacttgctaaagcacttt

SEQ ID NO: 3246951 - DNA, 23 bp, Homo sapiens
caggagacactgtgctataaatc

SEQ ID NO: 3246952 - DNA, 22 bp, Homo sapiens
caggagacagaccacttgccac

SEQ ID NO: 3246953 - DNA, 15 bp, Homo sapiens
caggagacaggaagg

SEQ ID NO: 3246954 - DNA, 14 bp, Homo sapiens
caggagacattttc

SEQ ID NO: 3246955 - DNA, 13 bp, Homo sapiens
caggagagagaaa

SEQ ID NO: 3246956 - DNA, 16 bp, Homo sapiens
ctaaggacatttccca

SEQ ID NO: 3246957 - DNA, 17 bp, Homo sapiens
ctaaggacatttcccag

SEQ ID NO: 3246958 - DNA, 22 bp, Homo sapiens
ctaaggatggaaaggtgacagt

SEQ ID NO: 3246959 - DNA, 19 bp, Homo sapiens
ctaaggatgtcacagggcc

SEQ ID NO: 3246960 - DNA, 20 bp, Homo sapiens
ctaaggatttttcaagagat

SEQ ID NO: 3246961 - DNA, 20 bp, Homo sapiens
ctaaggcacccacaaataaa

SEQ ID NO: 3246962 - DNA, 22 bp, Homo sapiens
ctaaggccgtgtctctgaggac

SEQ ID NO: 3246963 - DNA, 21 bp, Homo sapiens
ctaaggcctaggattctaaaa

SEQ ID NO: 3246964 - DNA, 14 bp, Homo sapiens
ctaaggctcctcct

SEQ ID NO: 3246965 - DNA, 11 bp, Homo sapiens
ctaaggctctg

SEQ ID NO: 3246966 - DNA, 22 bp, Homo sapiens
ctaaggctctgagagtctagat

SEQ ID NO: 3246967 - DNA, 17 bp, Homo sapiens
ctaagggtcgaaagctc

SEQ ID NO: 3246968 - DNA, 18 bp, Homo sapiens
ctaagggtcgaaagctct

SEQ ID NO: 3246969 - DNA, 19 bp, Homo sapiens
ctaagggtcgaaagctcta

SEQ ID NO: 3246970 - DNA, 20 bp, Homo sapiens
ctaagggtgggtgctcagaa

SEQ ID NO: 3246971 - DNA, 20 bp, Homo sapiens
ctaaggtccggtgttctaag

SEQ ID NO: 3246972 - DNA, 17 bp, Homo sapiens
ctaagtaaataggaatt

SEQ ID NO: 3246973 - DNA, 18 bp, Homo sapiens
ctaagtaagtttcttcct

SEQ ID NO: 3246974 - DNA, 19 bp, Homo sapiens
ctaagtaagtttcttcctg

SEQ ID NO: 3246975 - DNA, 19 bp, Homo sapiens
ctaagtatttaaatgttct

SEQ ID NO: 3246976 - DNA, 14 bp, Homo sapiens
ctaagtgatataaa

SEQ ID NO: 3246977 - DNA, 21 bp, Homo sapiens
ctaagtgcccaaagtggggag

SEQ ID NO: 3246978 - DNA, 23 bp, Homo sapiens
ctaagtggattggctttgtgctt

SEQ ID NO: 3246979 - DNA, 21 bp, Homo sapiens
ctaagttataagactctcaca

SEQ ID NO: 3246980 - DNA, 16 bp, Homo sapiens
ctaagttatagtatat

SEQ ID NO: 3246981 - DNA, 20 bp, Homo sapiens
ctaagttatagtatatctgg

SEQ ID NO: 3246982 - DNA, 22 bp, Homo sapiens
ctaagttattttatgacatgaa

SEQ ID NO: 3246983 - DNA, 23 bp, Homo sapiens
ctaagttattttatgacatgaaa

SEQ ID NO: 3246984 - DNA, 15 bp, Homo sapiens
ctaagttcagttctg

SEQ ID NO: 3246985 - DNA, 20 bp, Homo sapiens
ctaagttcatgtttgtaaat

SEQ ID NO: 3246986 - DNA, 12 bp, Homo sapiens
ctaagtttctaa

SEQ ID NO: 3246987 - DNA, 14 bp, Homo sapiens
ctaagtttctaaga

SEQ ID NO: 3246988 - DNA, 18 bp, Homo sapiens
ctaagtttctaagattct

SEQ ID NO: 3246989 - DNA, 19 bp, Homo sapiens
ctaagtttctaagattcta

SEQ ID NO: 3246990 - DNA, 23 bp, Homo sapiens
ctaagtttctaagattctaaagg

SEQ ID NO: 3246991 - DNA, 14 bp, Homo sapiens
ctaataaactgtat

SEQ ID NO: 3246992 - DNA, 17 bp, Homo sapiens
ctaatacctctgtgtgc

SEQ ID NO: 3246993 - DNA, 13 bp, Homo sapiens
ctaatagaactca

SEQ ID NO: 3246994 - DNA, 23 bp, Homo sapiens
ctaatagcgggttactttcacat

SEQ ID NO: 3246995 - DNA, 11 bp, Homo sapiens
ctaatatattt

SEQ ID NO: 3246996 - DNA, 12 bp, Homo sapiens
ctaatatatttt

SEQ ID NO: 3246997 - DNA, 22 bp, Homo sapiens
ctaatatccccaaattagggca

SEQ ID NO: 3246998 - DNA, 13 bp, Homo sapiens
ctaatatggcaaa

SEQ ID NO: 3246999 - DNA, 20 bp, Homo sapiens
ctaatatggccacagtagtc

SEQ ID NO: 3247000 - DNA, 14 bp, Homo sapiens
ctaatattaaaaat

SEQ ID NO: 3247001 - DNA, 15 bp, Homo sapiens
ctaatattcacatgt

SEQ ID NO: 3247002 - DNA, 17 bp, Homo sapiens
ctaatattgcttcttgt

SEQ ID NO: 3247003 - DNA, 13 bp, Homo sapiens
ctaatcaaagcca

SEQ ID NO: 3247004 - DNA, 20 bp, Homo sapiens
ctaatcaaagccagggtctc

SEQ ID NO: 3247005 - DNA, 22 bp, Homo sapiens
ctaatcagaaatttttatcagt

SEQ ID NO: 3247006 - DNA, 21 bp, Homo sapiens
ctaatcagcattctcactcct

SEQ ID NO: 3247007 - DNA, 19 bp, Homo sapiens
ctaatcagggaggtcattt

SEQ ID NO: 3247008 - DNA, 18 bp, Homo sapiens
ctaatcagtgtctcacac

SEQ ID NO: 3247009 - DNA, 19 bp, Homo sapiens
ctaatccctgggcattgct

SEQ ID NO: 3247010 - DNA, 20 bp, Homo sapiens
ctaatctattgggttcatta

SEQ ID NO: 3247011 - DNA, 22 bp, Homo sapiens
ctaatctcatacctctgaccaa

SEQ ID NO: 3247012 - DNA, 15 bp, Homo sapiens
ctaatctcttattct

SEQ ID NO: 3247013 - DNA, 14 bp, Homo sapiens
ctaatctgtagggc

SEQ ID NO: 3247014 - DNA, 18 bp, Homo sapiens
ctaatgaagggaaaggat

SEQ ID NO: 3247015 - DNA, 23 bp, Homo sapiens
ctaatgaagggaaaggatatttt

SEQ ID NO: 3247016 - DNA, 13 bp, Homo sapiens
ctaatgagtattt

SEQ ID NO: 3247017 - DNA, 16 bp, Homo sapiens
ctaatgagtatttggt

SEQ ID NO: 3247018 - DNA, 16 bp, Homo sapiens
ctaatgcttgtttatg

SEQ ID NO: 3247019 - DNA, 14 bp, Homo sapiens
ctaatggagaagac

SEQ ID NO: 3247020 - DNA, 19 bp, Homo sapiens
ctaatgggtatttaaacaa

SEQ ID NO: 3247021 - DNA, 19 bp, Homo sapiens
ctaatgtaaactttgtcat

SEQ ID NO: 3247022 - DNA, 14 bp, Homo sapiens
ctaatgtactgcat

SEQ ID NO: 3247023 - DNA, 16 bp, Homo sapiens
ctaatgtactgcatat

SEQ ID NO: 3247024 - DNA, 17 bp, Homo sapiens
ctaatgtaggactgtat

SEQ ID NO: 3247025 - DNA, 18 bp, Homo sapiens
ctaatgtaggactgtata

SEQ ID NO: 3247026 - DNA, 18 bp, Homo sapiens
ctaatgtttatgagccag

SEQ ID NO: 3247027 - DNA, 14 bp, Homo sapiens
ctaattaaaattgt

SEQ ID NO: 3247028 - DNA, 17 bp, Homo sapiens
ctaattaaccttactaa

SEQ ID NO: 3247029 - DNA, 18 bp, Homo sapiens
ctaattaaccttactaat

SEQ ID NO: 3247030 - DNA, 21 bp, Homo sapiens
ctaattaatatattaaaattc

SEQ ID NO: 3247031 - DNA, 17 bp, Homo sapiens
ctaattaattgtaatct

SEQ ID NO: 3247032 - DNA, 19 bp, Homo sapiens
ctaattagggtacatttat

SEQ ID NO: 3247033 - DNA, 13 bp, Homo sapiens
ctaattatttaaa

SEQ ID NO: 3247034 - DNA, 22 bp, Homo sapiens
ctaattcacagtgctcttttct

SEQ ID NO: 3247035 - DNA, 10 bp, Homo sapiens
ctaattcata

SEQ ID NO: 3247036 - DNA, 17 bp, Homo sapiens
aggcctgggtgctggct

SEQ ID NO: 3247037 - DNA, 23 bp, Homo sapiens
aggcctgggtttgtacttccacc

SEQ ID NO: 3247038 - DNA, 19 bp, Homo sapiens
aggcctgtgctagaagctc

SEQ ID NO: 3247039 - DNA, 12 bp, Homo sapiens
aggcctgtgtgt

SEQ ID NO: 3247040 - DNA, 23 bp, Homo sapiens
aggcctgtgtgtgaaaggaagct

SEQ ID NO: 3247041 - DNA, 20 bp, Homo sapiens
aggcctgttgctatagagcc

SEQ ID NO: 3247042 - DNA, 19 bp, Homo sapiens
aggccttcctctctccaga

SEQ ID NO: 3247043 - DNA, 17 bp, Homo sapiens
aggcgaccgggcctccc

SEQ ID NO: 3247044 - DNA, 21 bp, Homo sapiens
aggcgcaggcgaccgggcctc

SEQ ID NO: 3247045 - DNA, 21 bp, Homo sapiens
aggcgcagtgcttctctacag

SEQ ID NO: 3247046 - DNA, 13 bp, Homo sapiens
aggcgcctggcac

SEQ ID NO: 3247047 - DNA, 14 bp, Homo sapiens
aggcgcctggcaca

SEQ ID NO: 3247048 - DNA, 15 bp, Homo sapiens
aggcgctgctggtgt

SEQ ID NO: 3247049 - DNA, 21 bp, Homo sapiens
aggcggcctttgttgctcagc

SEQ ID NO: 3247050 - DNA, 17 bp, Homo sapiens
aggcgggccagccaggc

SEQ ID NO: 3247051 - DNA, 21 bp, Homo sapiens
aggcggggggggcgcctggag

SEQ ID NO: 3247052 - DNA, 20 bp, Homo sapiens
aggcggtccccatccccacc

SEQ ID NO: 3247053 - DNA, 14 bp, Homo sapiens
aggcgttggtgcca

SEQ ID NO: 3247054 - DNA, 15 bp, Homo sapiens
aggcgttggtgccac

SEQ ID NO: 3247055 - DNA, 17 bp, Homo sapiens
aggctaacatcccactt

SEQ ID NO: 3247056 - DNA, 22 bp, Homo sapiens
aggctaagatgagatttgccag

SEQ ID NO: 3247057 - DNA, 23 bp, Homo sapiens
aggctaagatgagatttgccagc

SEQ ID NO: 3247058 - DNA, 14 bp, Homo sapiens
aggctaagctgccg

SEQ ID NO: 3247059 - DNA, 17 bp, Homo sapiens
aggctagcttctgcttt

SEQ ID NO: 3247060 - DNA, 14 bp, Homo sapiens
aggctagttccttt

SEQ ID NO: 3247061 - DNA, 15 bp, Homo sapiens
aggctatggttgcca

SEQ ID NO: 3247062 - DNA, 17 bp, Homo sapiens
aggctatgtgattacaa

SEQ ID NO: 3247063 - DNA, 15 bp, Homo sapiens
aggctattaaaaaag

SEQ ID NO: 3247064 - DNA, 21 bp, Homo sapiens
aggctatttgtaaatctgcca

SEQ ID NO: 3247065 - DNA, 19 bp, Homo sapiens
aggctcaacaataaaacat

SEQ ID NO: 3247066 - DNA, 22 bp, Homo sapiens
aggctcactgcaacttctgcct

SEQ ID NO: 3247067 - DNA, 17 bp, Homo sapiens
aggctcactgccaggcc

SEQ ID NO: 3247068 - DNA, 23 bp, Homo sapiens
aggctcactgccaggccagcctc

SEQ ID NO: 3247069 - DNA, 18 bp, Homo sapiens
aggctcagcggcgaccgc

SEQ ID NO: 3247070 - DNA, 22 bp, Homo sapiens
aggctccaccccatccagttca

SEQ ID NO: 3247071 - DNA, 14 bp, Homo sapiens
aggctccaggactc

SEQ ID NO: 3247072 - DNA, 17 bp, Homo sapiens
aggctccaggactccac

SEQ ID NO: 3247073 - DNA, 20 bp, Homo sapiens
aggctccaggactccactgg

SEQ ID NO: 3247074 - DNA, 23 bp, Homo sapiens
aggctccaggactccactggaca

SEQ ID NO: 3247075 - DNA, 14 bp, Homo sapiens
aggctccattagga

SEQ ID NO: 3247076 - DNA, 17 bp, Homo sapiens
aggctccccagggctcc

SEQ ID NO: 3247077 - DNA, 19 bp, Homo sapiens
aggctcctccttgcccaga

SEQ ID NO: 3247078 - DNA, 22 bp, Homo sapiens
aggctcctgttttgcacagcca

SEQ ID NO: 3247079 - DNA, 19 bp, Homo sapiens
aggctctatgagtctagat

SEQ ID NO: 3247080 - DNA, 13 bp, Homo sapiens
aggctctgagagt

SEQ ID NO: 3247081 - DNA, 20 bp, Homo sapiens
aggctctgagagtctagatt

SEQ ID NO: 3247082 - DNA, 17 bp, Homo sapiens
aggctctggcccttgcc

SEQ ID NO: 3247083 - DNA, 12 bp, Homo sapiens
aggctctgggct

SEQ ID NO: 3247084 - DNA, 16 bp, Homo sapiens
aggctctgggctcagg

SEQ ID NO: 3247085 - DNA, 20 bp, Homo sapiens
aggctctgggctcagggctg

SEQ ID NO: 3247086 - DNA, 22 bp, Homo sapiens
aggctctgggctcagggctgga

SEQ ID NO: 3247087 - DNA, 16 bp, Homo sapiens
aggctcttcctggacc

SEQ ID NO: 3247088 - DNA, 19 bp, Homo sapiens
aggctcttcctggacctga

SEQ ID NO: 3247089 - DNA, 13 bp, Homo sapiens
aggctcttctcct

SEQ ID NO: 3247090 - DNA, 13 bp, Homo sapiens
aggctgaaagagg

SEQ ID NO: 3247091 - DNA, 16 bp, Homo sapiens
aggctgaaagaggcca

SEQ ID NO: 3247092 - DNA, 17 bp, Homo sapiens
aggctgaaagaggccaa

SEQ ID NO: 3247093 - DNA, 17 bp, Homo sapiens
aggctgaactcttcaga

SEQ ID NO: 3247094 - DNA, 18 bp, Homo sapiens
aggctgaactcttcagaa

SEQ ID NO: 3247095 - DNA, 16 bp, Homo sapiens
aggctgaattacagtg

SEQ ID NO: 3247096 - DNA, 18 bp, Homo sapiens
aggctgaccaagagagaa

SEQ ID NO: 3247097 - DNA, 20 bp, Homo sapiens
aggctgaccaagagagaaag

SEQ ID NO: 3247098 - DNA, 20 bp, Homo sapiens
aggctgacgtgtgagggagg

SEQ ID NO: 3247099 - DNA, 16 bp, Homo sapiens
aggctgagactgcggg

SEQ ID NO: 3247100 - DNA, 17 bp, Homo sapiens
aggctgagactgcggga

SEQ ID NO: 3247101 - DNA, 13 bp, Homo sapiens
aggctgaggactt

SEQ ID NO: 3247102 - DNA, 18 bp, Homo sapiens
aggctgaggcaagagaat

SEQ ID NO: 3247103 - DNA, 14 bp, Homo sapiens
aggctgaggcctgg

SEQ ID NO: 3247104 - DNA, 22 bp, Homo sapiens
aggctgaggggaggatcactgg

SEQ ID NO: 3247105 - DNA, 17 bp, Homo sapiens
aggctgcactgcagtga

SEQ ID NO: 3247106 - DNA, 19 bp, Homo sapiens
aggctgcagagctgaccca

SEQ ID NO: 3247107 - DNA, 21 bp, Homo sapiens
aggctgcagaggcacctcaac

SEQ ID NO: 3247108 - DNA, 12 bp, Homo sapiens
aggctgcccctc

SEQ ID NO: 3247109 - DNA, 17 bp, Homo sapiens
aggctgcccctctcacc

SEQ ID NO: 3247110 - DNA, 17 bp, Homo sapiens
aggctgcgtctggaggg

SEQ ID NO: 3247111 - DNA, 15 bp, Homo sapiens
aggctgctaacctgg

SEQ ID NO: 3247112 - DNA, 16 bp, Homo sapiens
aggctgctctgcctgt

SEQ ID NO: 3247113 - DNA, 14 bp, Homo sapiens
aggctgcttagaat

SEQ ID NO: 3247114 - DNA, 15 bp, Homo sapiens
aggctggaggaaggg

SEQ ID NO: 3247115 - DNA, 20 bp, Homo sapiens
aggctggagtgcagtggcat

SEQ ID NO: 3247116 - DNA, 20 bp, Homo sapiens
aggctggagtggagtggcgt

SEQ ID NO: 3247117 - DNA, 16 bp, Homo sapiens
aggctggcagctctcc

SEQ ID NO: 3247118 - DNA, 21 bp, Homo sapiens
aggctggccagcaaggcaggt

SEQ ID NO: 3247119 - DNA, 15 bp, Homo sapiens
aggctggccagtcca

SEQ ID NO: 3247120 - DNA, 18 bp, Homo sapiens
aggctggccagtccaggc

SEQ ID NO: 3247121 - DNA, 21 bp, Homo sapiens
aggctggccagtccaggctgc

SEQ ID NO: 3247122 - DNA, 21 bp, Homo sapiens
aggctggcctatgtggtctaa

SEQ ID NO: 3247123 - DNA, 20 bp, Homo sapiens
aggctggcgcagccaaggcc

SEQ ID NO: 3247124 - DNA, 13 bp, Homo sapiens
aggctggcgtgca

SEQ ID NO: 3247125 - DNA, 12 bp, Homo sapiens
aggctgggagca

SEQ ID NO: 3247126 - DNA, 16 bp, Homo sapiens
aggctgggcagcccca

SEQ ID NO: 3247127 - DNA, 23 bp, Homo sapiens
aggctgggcagccccagagagag

SEQ ID NO: 3247128 - DNA, 10 bp, Homo sapiens
aggctgggcc

SEQ ID NO: 3247129 - DNA, 12 bp, Homo sapiens
aggctgggccat

SEQ ID NO: 3247130 - DNA, 14 bp, Homo sapiens
aggctgggcccctg

SEQ ID NO: 3247131 - DNA, 16 bp, Homo sapiens
aggctgggctgggtgg

SEQ ID NO: 3247132 - DNA, 19 bp, Homo sapiens
aggctgggctgggtggcac

SEQ ID NO: 3247133 - DNA, 22 bp, Homo sapiens
aggctgggctgggtggcacacc

SEQ ID NO: 3247134 - DNA, 18 bp, Homo sapiens
aggctgggcttcagtggc

SEQ ID NO: 3247135 - DNA, 20 bp, Homo sapiens
aggctgggcttcagtggcag

SEQ ID NO: 3247136 - DNA, 23 bp, Homo sapiens
aggctgggcttcagtggcagctg

SEQ ID NO: 3247137 - DNA, 12 bp, Homo sapiens
aggctggggcgg

SEQ ID NO: 3247138 - DNA, 23 bp, Homo sapiens
ggtgaggtctgttccttttatat

SEQ ID NO: 3247139 - DNA, 18 bp, Homo sapiens
ggtgagtccattctccca

SEQ ID NO: 3247140 - DNA, 21 bp, Homo sapiens
ggtgagtcccctactccctct

SEQ ID NO: 3247141 - DNA, 21 bp, Homo sapiens
ggtgagtttgagctgccttcc

SEQ ID NO: 3247142 - DNA, 14 bp, Homo sapiens
ggtgataagtggaa

SEQ ID NO: 3247143 - DNA, 18 bp, Homo sapiens
ggtgatgtagcccatcct

SEQ ID NO: 3247144 - DNA, 13 bp, Homo sapiens
ggtgattaaaaag

SEQ ID NO: 3247145 - DNA, 20 bp, Homo sapiens
ggtgattctaatcatctgca

SEQ ID NO: 3247146 - DNA, 23 bp, Homo sapiens
ggtgatttcagactgcagagggg

SEQ ID NO: 3247147 - DNA, 12 bp, Homo sapiens
ggtgcaaatcct

SEQ ID NO: 3247148 - DNA, 13 bp, Homo sapiens
ggtgcaaggaaaa

SEQ ID NO: 3247149 - DNA, 17 bp, Homo sapiens
ggtgcagagaagctgga

SEQ ID NO: 3247150 - DNA, 18 bp, Homo sapiens
ggtgcagcccttcctccc

SEQ ID NO: 3247151 - DNA, 14 bp, Homo sapiens
ggtgcaggtgggca

SEQ ID NO: 3247152 - DNA, 15 bp, Homo sapiens
ggtgcaggtgggcac

SEQ ID NO: 3247153 - DNA, 16 bp, Homo sapiens
ggtgcagtgtgaaaag

SEQ ID NO: 3247154 - DNA, 21 bp, Homo sapiens
ggtgcatttgagagaagccac

SEQ ID NO: 3247155 - DNA, 15 bp, Homo sapiens
ggtgccaactggtgt

SEQ ID NO: 3247156 - DNA, 23 bp, Homo sapiens
ggtgccaatttcaagttccaagt

SEQ ID NO: 3247157 - DNA, 15 bp, Homo sapiens
ggtgccaccaccctg

SEQ ID NO: 3247158 - DNA, 21 bp, Homo sapiens
ggtgccaccaccctgcccccc

SEQ ID NO: 3247159 - DNA, 16 bp, Homo sapiens
ggtgccactccctgag

SEQ ID NO: 3247160 - DNA, 19 bp, Homo sapiens
ggtgccactccctgagctt

SEQ ID NO: 3247161 - DNA, 23 bp, Homo sapiens
ggtgccacttcttaaaggcctgg

SEQ ID NO: 3247162 - DNA, 18 bp, Homo sapiens
ggtgccatgtctgcagtg

SEQ ID NO: 3247163 - DNA, 16 bp, Homo sapiens
ggtgccatttctgaac

SEQ ID NO: 3247164 - DNA, 14 bp, Homo sapiens
ggtgcccaagccag

SEQ ID NO: 3247165 - DNA, 21 bp, Homo sapiens
ggtgcccaagccagaggctgg

SEQ ID NO: 3247166 - DNA, 15 bp, Homo sapiens
ggtgccccacagcta

SEQ ID NO: 3247167 - DNA, 23 bp, Homo sapiens
ggtgccccacagctacctgagac

SEQ ID NO: 3247168 - DNA, 23 bp, Homo sapiens
ggtgccccctcctctcccatccc

SEQ ID NO: 3247169 - DNA, 13 bp, Homo sapiens
ggtgcctccaggt

SEQ ID NO: 3247170 - DNA, 17 bp, Homo sapiens
ggtgcctccaggtgtgc

SEQ ID NO: 3247171 - DNA, 21 bp, Homo sapiens
ggtgcctcccacacttgctgg

SEQ ID NO: 3247172 - DNA, 23 bp, Homo sapiens
ggtgcctcccacacttgctgggg

SEQ ID NO: 3247173 - DNA, 15 bp, Homo sapiens
ggtgcctgagaggca

SEQ ID NO: 3247174 - DNA, 19 bp, Homo sapiens
ggtgcctgagaggcaggca

SEQ ID NO: 3247175 - DNA, 15 bp, Homo sapiens
ggtgcgatctgggtt

SEQ ID NO: 3247176 - DNA, 12 bp, Homo sapiens
ggtgcgtggctg

SEQ ID NO: 3247177 - DNA, 15 bp, Homo sapiens
ggtgcgtggctgtgg

SEQ ID NO: 3247178 - DNA, 18 bp, Homo sapiens
ggtgcgtggctgtggcac

SEQ ID NO: 3247179 - DNA, 20 bp, Homo sapiens
ggtgcgtggctgtggcacag

SEQ ID NO: 3247180 - DNA, 23 bp, Homo sapiens
ggtgctcagaataaggcaggcat

SEQ ID NO: 3247181 - DNA, 12 bp, Homo sapiens
ggtgctctgtgt

SEQ ID NO: 3247182 - DNA, 13 bp, Homo sapiens
ggtgctctgtgtt

SEQ ID NO: 3247183 - DNA, 22 bp, Homo sapiens
ggtgctctgtgttcccagaggc

SEQ ID NO: 3247184 - DNA, 15 bp, Homo sapiens
ggtgctgcaggagtg

SEQ ID NO: 3247185 - DNA, 21 bp, Homo sapiens
ggtgctgcaggagtgtcctgc

SEQ ID NO: 3247186 - DNA, 15 bp, Homo sapiens
ggtgctgccatccag

SEQ ID NO: 3247187 - DNA, 16 bp, Homo sapiens
ggtgctgccctgtgta

SEQ ID NO: 3247188 - DNA, 16 bp, Homo sapiens
ggtgctgcctgaatcc

SEQ ID NO: 3247189 - DNA, 12 bp, Homo sapiens
ggtgctggagga

SEQ ID NO: 3247190 - DNA, 13 bp, Homo sapiens
ggtgctggtcccg

SEQ ID NO: 3247191 - DNA, 20 bp, Homo sapiens
ggtgcttaagcagaagcatt

SEQ ID NO: 3247192 - DNA, 15 bp, Homo sapiens
ggtgcttgtgtcact

SEQ ID NO: 3247193 - DNA, 21 bp, Homo sapiens
ggtgcttttatagaggctagc

SEQ ID NO: 3247194 - DNA, 21 bp, Homo sapiens
ggtgctttttataaaaagata

SEQ ID NO: 3247195 - DNA, 14 bp, Homo sapiens
ggtggaagggctgg

SEQ ID NO: 3247196 - DNA, 15 bp, Homo sapiens
ggtggaagggctggg

SEQ ID NO: 3247197 - DNA, 18 bp, Homo sapiens
ggtggacacaacagcagt

SEQ ID NO: 3247198 - DNA, 14 bp, Homo sapiens
ggtggacagtcctg

SEQ ID NO: 3247199 - DNA, 15 bp, Homo sapiens
ggtggacagtcctgg

SEQ ID NO: 3247200 - DNA, 18 bp, Homo sapiens
ggtggacagtcctgggag

SEQ ID NO: 3247201 - DNA, 19 bp, Homo sapiens
ggtggacttagaaagcagg

SEQ ID NO: 3247202 - DNA, 21 bp, Homo sapiens
ggtggacttagaaagcagggg

SEQ ID NO: 3247203 - DNA, 13 bp, Homo sapiens
ggtggagggcaca

SEQ ID NO: 3247204 - DNA, 18 bp, Homo sapiens
ggtggagggcacagccct

SEQ ID NO: 3247205 - DNA, 15 bp, Homo sapiens
ggtggagggggctgg

SEQ ID NO: 3247206 - DNA, 20 bp, Homo sapiens
ggtggaggttgcagtgagcc

SEQ ID NO: 3247207 - DNA, 15 bp, Homo sapiens
ggtggagtgagactg

SEQ ID NO: 3247208 - DNA, 17 bp, Homo sapiens
ggtggagtgagactgac

SEQ ID NO: 3247209 - DNA, 22 bp, Homo sapiens
ggtggatcacgaggtcaggaga

SEQ ID NO: 3247210 - DNA, 14 bp, Homo sapiens
ggtggatggcccca

SEQ ID NO: 3247211 - DNA, 12 bp, Homo sapiens
ggtggcaagtgc

SEQ ID NO: 3247212 - DNA, 19 bp, Homo sapiens
ggtggcaatgcttaaacta

SEQ ID NO: 3247213 - DNA, 23 bp, Homo sapiens
ggtggcacaggagtgtcctcttc

SEQ ID NO: 3247214 - DNA, 18 bp, Homo sapiens
ggtggcacaggccccctt

SEQ ID NO: 3247215 - DNA, 21 bp, Homo sapiens
ggtggcaccagatgcaacctc

SEQ ID NO: 3247216 - DNA, 13 bp, Homo sapiens
ggtggcacctcct

SEQ ID NO: 3247217 - DNA, 15 bp, Homo sapiens
ggtggcagccctgta

SEQ ID NO: 3247218 - DNA, 20 bp, Homo sapiens
ggtggcaggcacacagcagc

SEQ ID NO: 3247219 - DNA, 15 bp, Homo sapiens
ggtggcagtggaggt

SEQ ID NO: 3247220 - DNA, 16 bp, Homo sapiens
ggtggcatgaggaggt

SEQ ID NO: 3247221 - DNA, 22 bp, Homo sapiens
ggtggccactccagacccctgg

SEQ ID NO: 3247222 - DNA, 23 bp, Homo sapiens
ggtggccactccagacccctggc

SEQ ID NO: 3247223 - DNA, 19 bp, Homo sapiens
ggtggccatccctgggccc

SEQ ID NO: 3247224 - DNA, 14 bp, Homo sapiens
ggtggcccctgcct

SEQ ID NO: 3247225 - DNA, 21 bp, Homo sapiens
ggtggccgctgagtggcaggg

SEQ ID NO: 3247226 - DNA, 22 bp, Homo sapiens
ggtggccttctgctgcccaggc

SEQ ID NO: 3247227 - DNA, 21 bp, Homo sapiens
ggtggcgactctatagactct

SEQ ID NO: 3247228 - DNA, 12 bp, Homo sapiens
ggtggcgcccag

SEQ ID NO: 3247229 - DNA, 12 bp, Homo sapiens
ggtggcggcagg

SEQ ID NO: 3247230 - DNA, 13 bp, Homo sapiens
ggtggcggcaggg

SEQ ID NO: 3247231 - DNA, 19 bp, Homo sapiens
ggtggcgggcacctatagt

SEQ ID NO: 3247232 - DNA, 16 bp, Homo sapiens
ggtggctgccccggcc

SEQ ID NO: 3247233 - DNA, 18 bp, Homo sapiens
ggtggctgccccggcctc

SEQ ID NO: 3247234 - DNA, 13 bp, Homo sapiens
ggtggctgggcag

SEQ ID NO: 3247235 - DNA, 12 bp, Homo sapiens
ggtggctgggtt

SEQ ID NO: 3247236 - DNA, 22 bp, Homo sapiens
ggtggctttccttgtggcagag

SEQ ID NO: 3247237 - DNA, 21 bp, Homo sapiens
ggtgggaaccatgaagacagg

SEQ ID NO: 3247238 - DNA, 14 bp, Homo sapiens
ggtgggacagcctc

SEQ ID NO: 3247239 - DNA, 20 bp, Homo sapiens
ggtgggcagatcacgaggtc

SEQ ID NO: 3247240 - DNA, 16 bp, Homo sapiens
ggtgggcaggtggtgg

SEQ ID NO: 3247241 - DNA, 16 bp, Homo sapiens
ggtgggcatgccaccc

SEQ ID NO: 3247242 - DNA, 18 bp, Homo sapiens
ggtgggcatgccaccctc

SEQ ID NO: 3247243 - DNA, 12 bp, Homo sapiens
ggtgggcccagg

SEQ ID NO: 3247244 - DNA, 20 bp, Homo sapiens
ggtgggcccaggaccagctg

SEQ ID NO: 3247245 - DNA, 14 bp, Homo sapiens
ggtgggcctggcct

SEQ ID NO: 3247246 - DNA, 17 bp, Homo sapiens
ggtgggcctggcctgag

SEQ ID NO: 3247247 - DNA, 21 bp, Homo sapiens
ggtgggcgtggtcactgctgt

SEQ ID NO: 3247248 - DNA, 13 bp, Homo sapiens
ggtgggctctgtg

SEQ ID NO: 3247249 - DNA, 17 bp, Homo sapiens
ggtgggctgagccctgg

SEQ ID NO: 3247250 - DNA, 14 bp, Homo sapiens
ggtgggctggggct

SEQ ID NO: 3247251 - DNA, 20 bp, Homo sapiens
ggtggggacattgctctctg

SEQ ID NO: 3247252 - DNA, 19 bp, Homo sapiens
ggtggggaggcccaaatga

SEQ ID NO: 3247253 - DNA, 12 bp, Homo sapiens
ggtggggagggg

SEQ ID NO: 3247254 - DNA, 13 bp, Homo sapiens
ggtggggccaggc

SEQ ID NO: 3247255 - DNA, 14 bp, Homo sapiens
ggtggggccaggcc

SEQ ID NO: 3247256 - DNA, 19 bp, Homo sapiens
ggtggggccaggccaggac

SEQ ID NO: 3247257 - DNA, 21 bp, Homo sapiens
ggtggggccaggccaggacca

SEQ ID NO: 3247258 - DNA, 16 bp, Homo sapiens
ggtggggcgaggcagg

SEQ ID NO: 3247259 - DNA, 21 bp, Homo sapiens
ggtgggggctcctggtggcct

SEQ ID NO: 3247260 - DNA, 23 bp, Homo sapiens
ggtgggtccaggaaggcagctgc

SEQ ID NO: 3247261 - DNA, 21 bp, Homo sapiens
ggtgggtgaaggcctggctgg

SEQ ID NO: 3247262 - DNA, 19 bp, Homo sapiens
ggtgggtgctgccctgtgt

SEQ ID NO: 3247263 - DNA, 14 bp, Homo sapiens
ggtgggtggtgggg

SEQ ID NO: 3247264 - DNA, 16 bp, Homo sapiens
ggtgggtgtgggtgga

SEQ ID NO: 3247265 - DNA, 13 bp, Homo sapiens
ggtggtaaagaaa

SEQ ID NO: 3247266 - DNA, 16 bp, Homo sapiens
ggtggtaccctctgga

SEQ ID NO: 3247267 - DNA, 14 bp, Homo sapiens
ggtggtaggcctat

SEQ ID NO: 3247268 - DNA, 19 bp, Homo sapiens
ggtggtcctgactcaacat

SEQ ID NO: 3247269 - DNA, 15 bp, Homo sapiens
ggtggtctgaatgtt

SEQ ID NO: 3247270 - DNA, 22 bp, Homo sapiens
ggtggtctgttggcaggctggc

SEQ ID NO: 3247271 - DNA, 14 bp, Homo sapiens
ggtggtgacctctg

SEQ ID NO: 3247272 - DNA, 14 bp, Homo sapiens
ggtggtggcctggt

SEQ ID NO: 3247273 - DNA, 16 bp, Homo sapiens
ggtgtaaagctggccc

SEQ ID NO: 3247274 - DNA, 18 bp, Homo sapiens
ggtgtaataagacataac

SEQ ID NO: 3247275 - DNA, 15 bp, Homo sapiens
ggtgtacactaacat

SEQ ID NO: 3247276 - DNA, 16 bp, Homo sapiens
ggtgtacactaacatt

SEQ ID NO: 3247277 - DNA, 19 bp, Homo sapiens
ggtgtacactaacatttcc

SEQ ID NO: 3247278 - DNA, 12 bp, Homo sapiens
ggtgtagccagg

SEQ ID NO: 3247279 - DNA, 12 bp, Homo sapiens
ggtgtaggggcc

SEQ ID NO: 3247280 - DNA, 19 bp, Homo sapiens
ggtgtcacctgaagactca

SEQ ID NO: 3247281 - DNA, 23 bp, Homo sapiens
ggtgtcacttactgtttctgtca

SEQ ID NO: 3247282 - DNA, 14 bp, Homo sapiens
ggtgtcctgaccac

SEQ ID NO: 3247283 - DNA, 15 bp, Homo sapiens
ggtgtcctttcccct

SEQ ID NO: 3247284 - DNA, 23 bp, Homo sapiens
ggtgtcgccgcctgctccctgca

SEQ ID NO: 3247285 - DNA, 16 bp, Homo sapiens
ggtgtcgtctgtgaat

SEQ ID NO: 3247286 - DNA, 11 bp, Homo sapiens
ggtgtgaccat

SEQ ID NO: 3247287 - DNA, 21 bp, Homo sapiens
ggtgtgagaagtgccttctcc

SEQ ID NO: 3247288 - DNA, 22 bp, Homo sapiens
ggtgtgagaagtgccttctcct

SEQ ID NO: 3247289 - DNA, 24 bp, Homo sapiens
ggtgtgcacgtggcatgtggcctg

SEQ ID NO: 3247290 - DNA, 15 bp, Homo sapiens
ggtgtgcctgcagcc

SEQ ID NO: 3247291 - DNA, 19 bp, Homo sapiens
ggtgtgctgggagctccac

SEQ ID NO: 3247292 - DNA, 16 bp, Homo sapiens
ggtgtggagccgaggc

SEQ ID NO: 3247293 - DNA, 12 bp, Homo sapiens
ggtgtggctcct

SEQ ID NO: 3247294 - DNA, 15 bp, Homo sapiens
ggtgtggggtggggt

SEQ ID NO: 3247295 - DNA, 19 bp, Homo sapiens
ggtgtgggtggaagggctg

SEQ ID NO: 3247296 - DNA, 17 bp, Homo sapiens
ggtgtggtgcagtgtga

SEQ ID NO: 3247297 - DNA, 15 bp, Homo sapiens
ggtgtggtggctcat

SEQ ID NO: 3247298 - DNA, 18 bp, Homo sapiens
ggtgtgtccctggacaca

SEQ ID NO: 3247299 - DNA, 12 bp, Homo sapiens
ggtgtgtctgct

SEQ ID NO: 3247300 - DNA, 17 bp, Homo sapiens
ggtgttcccaggctgcc

SEQ ID NO: 3247301 - DNA, 13 bp, Homo sapiens
ggtgttcctggaa

SEQ ID NO: 3247302 - DNA, 22 bp, Homo sapiens
ggtgttcctggaagcaggtgct

SEQ ID NO: 3247303 - DNA, 11 bp, Homo sapiens
ggtgttctaag

SEQ ID NO: 3247304 - DNA, 14 bp, Homo sapiens
ggtgttgggagccc

SEQ ID NO: 3247305 - DNA, 16 bp, Homo sapiens
ggtgttgtatggctga

SEQ ID NO: 3247306 - DNA, 22 bp, Homo sapiens
ggtgttttcattcccccttcct

SEQ ID NO: 3247307 - DNA, 22 bp, Homo sapiens
ggtgttttttatgaagtgcgtg

SEQ ID NO: 3247308 - DNA, 21 bp, Homo sapiens
ggttaaaactgtacatttaaa

SEQ ID NO: 3247309 - DNA, 14 bp, Homo sapiens
ggttaaatactgtg

SEQ ID NO: 3247310 - DNA, 19 bp, Homo sapiens
ggttaaggtgggtccagga

SEQ ID NO: 3247311 - DNA, 12 bp, Homo sapiens
ggttaatggcta

SEQ ID NO: 3247312 - DNA, 15 bp, Homo sapiens
ggttacaaactgcaa

SEQ ID NO: 3247313 - DNA, 17 bp, Homo sapiens
ggttagcagagctggac

SEQ ID NO: 3247314 - DNA, 23 bp, Homo sapiens
ggttatacaataacccagttact

SEQ ID NO: 3247315 - DNA, 23 bp, Homo sapiens
ggttatctgcctggcctggctcc

SEQ ID NO: 3247316 - DNA, 18 bp, Homo sapiens
ggttatctttttaaaaac

SEQ ID NO: 3247317 - DNA, 12 bp, Homo sapiens
ggttatgaaaga

SEQ ID NO: 3247318 - DNA, 12 bp, Homo sapiens
ggttatttaaaa

SEQ ID NO: 3247319 - DNA, 17 bp, Homo sapiens
ggttatttaatcacagt

SEQ ID NO: 3247320 - DNA, 19 bp, Homo sapiens
ggttcacactcagaaagag

SEQ ID NO: 3247321 - DNA, 18 bp, Homo sapiens
ggttcagaattaaacttt

SEQ ID NO: 3247322 - DNA, 22 bp, Homo sapiens
ggttcagggttggcccctgccc

SEQ ID NO: 3247323 - DNA, 19 bp, Homo sapiens
ggttcatcagtgttaaaaa

SEQ ID NO: 3247324 - DNA, 16 bp, Homo sapiens
ggttcattattggaat

SEQ ID NO: 3247325 - DNA, 19 bp, Homo sapiens
ggttcattattggaattaa

SEQ ID NO: 3247326 - DNA, 20 bp, Homo sapiens
ggttccagcaattctcctgc

SEQ ID NO: 3247327 - DNA, 19 bp, Homo sapiens
ggttccatgcagccttggg

SEQ ID NO: 3247328 - DNA, 16 bp, Homo sapiens
ggttccatgcctgagg

SEQ ID NO: 3247329 - DNA, 18 bp, Homo sapiens
ggttccatttttcctctg

SEQ ID NO: 3247330 - DNA, 19 bp, Homo sapiens
ggttccatttttcctctgt

SEQ ID NO: 3247331 - DNA, 13 bp, Homo sapiens
ggttccctgttct

SEQ ID NO: 3247332 - DNA, 16 bp, Homo sapiens
ggttccctgttcttcc

SEQ ID NO: 3247333 - DNA, 18 bp, Homo sapiens
ggttcctatggctggcca

SEQ ID NO: 3247334 - DNA, 11 bp, Homo sapiens
ggttcctctct

SEQ ID NO: 3247335 - DNA, 18 bp, Homo sapiens
ggttcctctgcctgcccc

SEQ ID NO: 3247336 - DNA, 17 bp, Homo sapiens
ggttcctcttaggtcag

SEQ ID NO: 3247337 - DNA, 18 bp, Homo sapiens
ggttcctttgcaccctgt

SEQ ID NO: 3247338 - DNA, 13 bp, Homo sapiens
ggttctaaagttc

SEQ ID NO: 3247339 - DNA, 18 bp, Homo sapiens
ggttctaggcatctctgt

SEQ ID NO: 3247340 - DNA, 23 bp, Homo sapiens
ggttctaggcatctctgtacttt

SEQ ID NO: 3247341 - DNA, 19 bp, Homo sapiens
ggttctaggctaccagaag

SEQ ID NO: 3247342 - DNA, 13 bp, Homo sapiens
ggttctcagagcc

SEQ ID NO: 3247343 - DNA, 18 bp, Homo sapiens
ggttctccccctttctct

SEQ ID NO: 3247344 - DNA, 20 bp, Homo sapiens
ggttctccgttagctcctgt

SEQ ID NO: 3247345 - DNA, 19 bp, Homo sapiens
ggttctgcgccacttcctt

SEQ ID NO: 3247346 - DNA, 20 bp, Homo sapiens
ggttctgcgccacttccttt

SEQ ID NO: 3247347 - DNA, 19 bp, Homo sapiens
ggttctgcttcaaggcttc

SEQ ID NO: 3247348 - DNA, 23 bp, Homo sapiens
ggttctggttccatttttcctct

SEQ ID NO: 3247349 - DNA, 18 bp, Homo sapiens
ggttcttacttttcctgg

SEQ ID NO: 3247350 - DNA, 14 bp, Homo sapiens
ggttcttcctcacc

SEQ ID NO: 3247351 - DNA, 16 bp, Homo sapiens
ggttctttcttcctct

SEQ ID NO: 3247352 - DNA, 18 bp, Homo sapiens
ggttctttcttcctctgc

SEQ ID NO: 3247353 - DNA, 16 bp, Homo sapiens
ggttgaactctggtgg

SEQ ID NO: 3247354 - DNA, 14 bp, Homo sapiens
ggttgaagcaccaa

SEQ ID NO: 3247355 - DNA, 19 bp, Homo sapiens
ggttgaatatagcctgcct

SEQ ID NO: 3247356 - DNA, 20 bp, Homo sapiens
ggttgaatatagcctgcctc

SEQ ID NO: 3247357 - DNA, 22 bp, Homo sapiens
ggttgaatatagcctgcctcag

SEQ ID NO: 3247358 - DNA, 16 bp, Homo sapiens
ggttgaggggcctgga

SEQ ID NO: 3247359 - DNA, 19 bp, Homo sapiens
ggttgaggggctcctggaa

SEQ ID NO: 3247360 - DNA, 17 bp, Homo sapiens
ggttgatggaaaataaa

SEQ ID NO: 3247361 - DNA, 23 bp, Homo sapiens
ggttgcagagaagcatcctccac

SEQ ID NO: 3247362 - DNA, 14 bp, Homo sapiens
ggttgcctgggggc

SEQ ID NO: 3247363 - DNA, 13 bp, Homo sapiens
ggttgctccattt

SEQ ID NO: 3247364 - DNA, 13 bp, Homo sapiens
ggttgctggagcc

SEQ ID NO: 3247365 - DNA, 17 bp, Homo sapiens
ggttgctggttgctgtg

SEQ ID NO: 3247366 - DNA, 15 bp, Homo sapiens
ggttggcaacaggac

SEQ ID NO: 3247367 - DNA, 15 bp, Homo sapiens
ggttggggtgacagt

SEQ ID NO: 3247368 - DNA, 16 bp, Homo sapiens
ggttggtgcacagtga

SEQ ID NO: 3247369 - DNA, 10 bp, Homo sapiens
ggttgtcaat

SEQ ID NO: 3247370 - DNA, 15 bp, Homo sapiens
ggttgtgttgaggtt

SEQ ID NO: 3247371 - DNA, 15 bp, Homo sapiens
ggtttaaagagtcta

SEQ ID NO: 3247372 - DNA, 17 bp, Homo sapiens
ggtttaagaaatagaat

SEQ ID NO: 3247373 - DNA, 14 bp, Homo sapiens
ggtttacaggccct

SEQ ID NO: 3247374 - DNA, 18 bp, Homo sapiens
ggtttactcactgctgca

SEQ ID NO: 3247375 - DNA, 14 bp, Homo sapiens
ggtttactttcaaa

SEQ ID NO: 3247376 - DNA, 16 bp, Homo sapiens
ggtttagtcaatcact

SEQ ID NO: 3247377 - DNA, 14 bp, Homo sapiens
ggtttatgactctt

SEQ ID NO: 3247378 - DNA, 15 bp, Homo sapiens
ggtttatttttgtaa

SEQ ID NO: 3247379 - DNA, 17 bp, Homo sapiens
ggtttatttttgtaatg

SEQ ID NO: 3247380 - DNA, 16 bp, Homo sapiens
ggtttcaaagatgctg

SEQ ID NO: 3247381 - DNA, 20 bp, Homo sapiens
ggtttcacccttaacccaag

SEQ ID NO: 3247382 - DNA, 15 bp, Homo sapiens
ggtttcacctgggcc

SEQ ID NO: 3247383 - DNA, 16 bp, Homo sapiens
ggtttcatgttagtta

SEQ ID NO: 3247384 - DNA, 17 bp, Homo sapiens
ggtttcatgttcactgt

SEQ ID NO: 3247385 - DNA, 14 bp, Homo sapiens
ggtttccacatgct

SEQ ID NO: 3247386 - DNA, 16 bp, Homo sapiens
ggtttcccttgccctt

SEQ ID NO: 3247387 - DNA, 21 bp, Homo sapiens
ggtttcccttgccctttccat

SEQ ID NO: 3247388 - DNA, 14 bp, Homo sapiens
ggtttcctgcaggc

SEQ ID NO: 3247389 - DNA, 16 bp, Homo sapiens
ggtttcgactggtcca

SEQ ID NO: 3247390 - DNA, 17 bp, Homo sapiens
ggtttcgactggtccag

SEQ ID NO: 3247391 - DNA, 18 bp, Homo sapiens
ggtttcgactggtccagc

SEQ ID NO: 3247392 - DNA, 21 bp, Homo sapiens
ggtttcgactggtccagctct

SEQ ID NO: 3247393 - DNA, 23 bp, Homo sapiens
ggtttcgactggtccagctctga

SEQ ID NO: 3247394 - DNA, 15 bp, Homo sapiens
ggtttctttttaagt

SEQ ID NO: 3247395 - DNA, 19 bp, Homo sapiens
ggtttgacttgtttgtgca

SEQ ID NO: 3247396 - DNA, 14 bp, Homo sapiens
ggtttgcttgctct

SEQ ID NO: 3247397 - DNA, 19 bp, Homo sapiens
caagcgccagaaagagctg

SEQ ID NO: 3247398 - DNA, 15 bp, Homo sapiens
caagcgctcccagcc

SEQ ID NO: 3247399 - DNA, 16 bp, Homo sapiens
caagcgctcccagcct

SEQ ID NO: 3247400 - DNA, 17 bp, Homo sapiens
caagcgctcccagcctg

SEQ ID NO: 3247401 - DNA, 19 bp, Homo sapiens
caagcgctcccagcctgcc

SEQ ID NO: 3247402 - DNA, 18 bp, Homo sapiens
caagcgtgagccactgca

SEQ ID NO: 3247403 - DNA, 19 bp, Homo sapiens
caagctaggccccagaggc

SEQ ID NO: 3247404 - DNA, 17 bp, Homo sapiens
caagctatctaaagttt

SEQ ID NO: 3247405 - DNA, 15 bp, Homo sapiens
caagctcagaataga

SEQ ID NO: 3247406 - DNA, 21 bp, Homo sapiens
caagctccatctccactccag

SEQ ID NO: 3247407 - DNA, 13 bp, Homo sapiens
caagctccctgcc

SEQ ID NO: 3247408 - DNA, 16 bp, Homo sapiens
caagctccctggagcc

SEQ ID NO: 3247409 - DNA, 14 bp, Homo sapiens
caagctctcttgcc

SEQ ID NO: 3247410 - DNA, 16 bp, Homo sapiens
caagctctgctcctct

SEQ ID NO: 3247411 - DNA, 13 bp, Homo sapiens
caagctgaaattt

SEQ ID NO: 3247412 - DNA, 20 bp, Homo sapiens
caagctgaaattttagaaat

SEQ ID NO: 3247413 - DNA, 21 bp, Homo sapiens
caagctgaaattttagaaata

SEQ ID NO: 3247414 - DNA, 20 bp, Homo sapiens
ctggactggcgttcacctcc

SEQ ID NO: 3247415 - DNA, 21 bp, Homo sapiens
ctggactggctagagtcctca

SEQ ID NO: 3247416 - DNA, 14 bp, Homo sapiens
ctggactgggaggt

SEQ ID NO: 3247417 - DNA, 13 bp, Homo sapiens
ctggactgttcca

SEQ ID NO: 3247418 - DNA, 19 bp, Homo sapiens
ctggacttaaagaaaaaaa

SEQ ID NO: 3247419 - DNA, 18 bp, Homo sapiens
ctggacttaagcatctgg

SEQ ID NO: 3247420 - DNA, 18 bp, Homo sapiens
ctggacttctacctgccc

SEQ ID NO: 3247421 - DNA, 16 bp, Homo sapiens
ctggacttctgtgggc

SEQ ID NO: 3247422 - DNA, 20 bp, Homo sapiens
ctggacttctgtgggcccct

SEQ ID NO: 3247423 - DNA, 13 bp, Homo sapiens
ctggacttgagct

SEQ ID NO: 3247424 - DNA, 15 bp, Homo sapiens
ctggacttgagcttg

SEQ ID NO: 3247425 - DNA, 18 bp, Homo sapiens
ctggacttgagcttggca

SEQ ID NO: 3247426 - DNA, 14 bp, Homo sapiens
ctggacttggtaca

SEQ ID NO: 3247427 - DNA, 14 bp, Homo sapiens
ctggactttcctgc

SEQ ID NO: 3247428 - DNA, 15 bp, Homo sapiens
gggttggtgtgctga

SEQ ID NO: 3247429 - DNA, 15 bp, Homo sapiens
gggtttattcactga

SEQ ID NO: 3247430 - DNA, 21 bp, Homo sapiens
gggtttcacctgggccctgga

SEQ ID NO: 3247431 - DNA, 16 bp, Homo sapiens
gggtttcttaaatata

SEQ ID NO: 3247432 - DNA, 18 bp, Homo sapiens
gggtttggaccccagctg

SEQ ID NO: 3247433 - DNA, 20 bp, Homo sapiens
gggtttggaccccagctggg

SEQ ID NO: 3247434 - DNA, 17 bp, Homo sapiens
gggttttccaccctgga

SEQ ID NO: 3247435 - DNA, 13 bp, Homo sapiens
gggttttgtaatg

SEQ ID NO: 3247436 - DNA, 23 bp, Homo sapiens
gggtttttaatctttgtgacagg

SEQ ID NO: 3247437 - DNA, 18 bp, Homo sapiens
ggtaaaacagggccacat

SEQ ID NO: 3247438 - DNA, 13 bp, Homo sapiens
ggtaaaatacttc

SEQ ID NO: 3247439 - DNA, 23 bp, Homo sapiens
ggtaaaatacttttactctgcct

SEQ ID NO: 3247440 - DNA, 18 bp, Homo sapiens
ggtaaagttacactttta

SEQ ID NO: 3247441 - DNA, 16 bp, Homo sapiens
ggtaaatgtttctttt

SEQ ID NO: 3247442 - DNA, 15 bp, Homo sapiens
ggtaaattaagacat

SEQ ID NO: 3247443 - DNA, 15 bp, Homo sapiens
ggtaacagaacagct

SEQ ID NO: 3247444 - DNA, 19 bp, Homo sapiens
ggtaacagatttgctccta

SEQ ID NO: 3247445 - DNA, 13 bp, Homo sapiens
ggtaacaggcaga

SEQ ID NO: 3247446 - DNA, 14 bp, Homo sapiens
ggtaacaggcagat

SEQ ID NO: 3247447 - DNA, 12 bp, Homo sapiens
ggtaacagtggc

SEQ ID NO: 3247448 - DNA, 24 bp, Homo sapiens
ggtaacttttgtgaattaggctgt

SEQ ID NO: 3247449 - DNA, 15 bp, Homo sapiens
ggtaagaagaaagca

SEQ ID NO: 3247450 - DNA, 19 bp, Homo sapiens
ggtaagcaacatggctttg

SEQ ID NO: 3247451 - DNA, 20 bp, Homo sapiens
ggtaatcaatgaatattgaa

SEQ ID NO: 3247452 - DNA, 16 bp, Homo sapiens
ggtacagcgcggagga

SEQ ID NO: 3247453 - DNA, 16 bp, Homo sapiens
ggtacaggagaggcag

SEQ ID NO: 3247454 - DNA, 17 bp, Homo sapiens
ggtacaggagaggcagc

SEQ ID NO: 3247455 - DNA, 19 bp, Homo sapiens
ggtacatttataattgcat

SEQ ID NO: 3247456 - DNA, 21 bp, Homo sapiens
ggtaccaaggaaataaggaca

SEQ ID NO: 3247457 - DNA, 12 bp, Homo sapiens
ggtaccagctgc

SEQ ID NO: 3247458 - DNA, 14 bp, Homo sapiens
ggtaccagctgcgc

SEQ ID NO: 3247459 - DNA, 14 bp, Homo sapiens
ggtaccctcctggc

SEQ ID NO: 3247460 - DNA, 13 bp, Homo sapiens
ggtaccctctgga

SEQ ID NO: 3247461 - DNA, 12 bp, Homo sapiens
ggtacctgccct

SEQ ID NO: 3247462 - DNA, 17 bp, Homo sapiens
ggtacctgccctctatt

SEQ ID NO: 3247463 - DNA, 14 bp, Homo sapiens
ggtactaaatttaa

SEQ ID NO: 3247464 - DNA, 16 bp, Homo sapiens
ggtactctcctagaga

SEQ ID NO: 3247465 - DNA, 16 bp, Homo sapiens
ggtactcttgatgtga

SEQ ID NO: 3247466 - DNA, 18 bp, Homo sapiens
ggtactgactttgcttgc

SEQ ID NO: 3247467 - DNA, 16 bp, Homo sapiens
ggtacttgtggacaca

SEQ ID NO: 3247468 - DNA, 20 bp, Homo sapiens
ggtacttgtggacacagctc

SEQ ID NO: 3247469 - DNA, 22 bp, Homo sapiens
ggtacttgtggacacagctctt

SEQ ID NO: 3247470 - DNA, 21 bp, Homo sapiens
ggtactttattcttgctgggc

SEQ ID NO: 3247471 - DNA, 22 bp, Homo sapiens
ggtacttttatgatgtatattt

SEQ ID NO: 3247472 - DNA, 23 bp, Homo sapiens
ggtagaaatatctgaaaatgtat

SEQ ID NO: 3247473 - DNA, 18 bp, Homo sapiens
ggtagacctttattgggt

SEQ ID NO: 3247474 - DNA, 19 bp, Homo sapiens
ggtagagacccccaggcct

SEQ ID NO: 3247475 - DNA, 17 bp, Homo sapiens
ggtagaggcctggggcc

SEQ ID NO: 3247476 - DNA, 20 bp, Homo sapiens
ggtagaggctccccagggct

SEQ ID NO: 3247477 - DNA, 22 bp, Homo sapiens
ggtagaggctccccagggctcc

SEQ ID NO: 3247478 - DNA, 18 bp, Homo sapiens
ggtagatcgcttgagccc

SEQ ID NO: 3247479 - DNA, 19 bp, Homo sapiens
ggtagatcgcttgagccca

SEQ ID NO: 3247480 - DNA, 21 bp, Homo sapiens
ggtagatcgcttgagcccagg

SEQ ID NO: 3247481 - DNA, 12 bp, Homo sapiens
ggtagcagctgg

SEQ ID NO: 3247482 - DNA, 15 bp, Homo sapiens
ggtagcataaataaa

SEQ ID NO: 3247483 - DNA, 14 bp, Homo sapiens
ggtagccaggggga

SEQ ID NO: 3247484 - DNA, 18 bp, Homo sapiens
ggtagcttacctgacaca

SEQ ID NO: 3247485 - DNA, 19 bp, Homo sapiens
ggtaggaggtttggatggg

SEQ ID NO: 3247486 - DNA, 20 bp, Homo sapiens
ggtaggcccttgtcctgcca

SEQ ID NO: 3247487 - DNA, 14 bp, Homo sapiens
ggtagggaggcagc

SEQ ID NO: 3247488 - DNA, 15 bp, Homo sapiens
ggtagggaggcagcc

SEQ ID NO: 3247489 - DNA, 17 bp, Homo sapiens
ggtagggaggcagcctc

SEQ ID NO: 3247490 - DNA, 14 bp, Homo sapiens
ggtagggtaaatca

SEQ ID NO: 3247491 - DNA, 15 bp, Homo sapiens
ggtaggttcagccaa

SEQ ID NO: 3247492 - DNA, 17 bp, Homo sapiens
ggtaggttcagccaagg

SEQ ID NO: 3247493 - DNA, 19 bp, Homo sapiens
ggtaggttgggacaccagg

SEQ ID NO: 3247494 - DNA, 13 bp, Homo sapiens
ggtagtttctcat

SEQ ID NO: 3247495 - DNA, 22 bp, Homo sapiens
ggtataaaactttcctcgcctg

SEQ ID NO: 3247496 - DNA, 13 bp, Homo sapiens
ggtataaagacaa

SEQ ID NO: 3247497 - DNA, 15 bp, Homo sapiens
ggtataatgtttaaa

SEQ ID NO: 3247498 - DNA, 13 bp, Homo sapiens
ggtataggtctca

SEQ ID NO: 3247499 - DNA, 15 bp, Homo sapiens
ggtatatctgggctg

SEQ ID NO: 3247500 - DNA, 14 bp, Homo sapiens
ggtatcaaaattac

SEQ ID NO: 3247501 - DNA, 17 bp, Homo sapiens
ggtatcctgcccagtgt

SEQ ID NO: 3247502 - DNA, 18 bp, Homo sapiens
ggtatcctgcccagtgtt

SEQ ID NO: 3247503 - DNA, 16 bp, Homo sapiens
ggtatgtagccagctg

SEQ ID NO: 3247504 - DNA, 14 bp, Homo sapiens
ggtatgttcctaag

SEQ ID NO: 3247505 - DNA, 20 bp, Homo sapiens
ggtattacactgtatttgta

SEQ ID NO: 3247506 - DNA, 14 bp, Homo sapiens
ggtattagaaagtg

SEQ ID NO: 3247507 - DNA, 19 bp, Homo sapiens
ggtattccttttgtgtaca

SEQ ID NO: 3247508 - DNA, 23 bp, Homo sapiens
ggtatttattctctatttattgg

SEQ ID NO: 3247509 - DNA, 14 bp, Homo sapiens
ggtatttctccagt

SEQ ID NO: 3247510 - DNA, 15 bp, Homo sapiens
ggtatttctttctcg

SEQ ID NO: 3247511 - DNA, 19 bp, Homo sapiens
ggtcaagaaacagccagca

SEQ ID NO: 3247512 - DNA, 14 bp, Homo sapiens
ggtcaataaactta

SEQ ID NO: 3247513 - DNA, 15 bp, Homo sapiens
ggtcacagcggaggt

SEQ ID NO: 3247514 - DNA, 11 bp, Homo sapiens
ggtcacaggcc

SEQ ID NO: 3247515 - DNA, 14 bp, Homo sapiens
ggtcacaggcccag

SEQ ID NO: 3247516 - DNA, 15 bp, Homo sapiens
ggtcacaggcccaga

SEQ ID NO: 3247517 - DNA, 14 bp, Homo sapiens
ggtcactgctgtca

SEQ ID NO: 3247518 - DNA, 17 bp, Homo sapiens
ggtcactggctctccaa

SEQ ID NO: 3247519 - DNA, 22 bp, Homo sapiens
ggtcactgtgcactgccctgtt

SEQ ID NO: 3247520 - DNA, 13 bp, Homo sapiens
ggtcagagcctgc

SEQ ID NO: 3247521 - DNA, 17 bp, Homo sapiens
ggtcagagtgccactgc

SEQ ID NO: 3247522 - DNA, 16 bp, Homo sapiens
ggtcagcgttgcatgt

SEQ ID NO: 3247523 - DNA, 19 bp, Homo sapiens
ggtcaggaacagtggctgg

SEQ ID NO: 3247524 - DNA, 20 bp, Homo sapiens
ggtcaggaacagtggctggg

SEQ ID NO: 3247525 - DNA, 19 bp, Homo sapiens
ggtcaggaagcaggggtgg

SEQ ID NO: 3247526 - DNA, 17 bp, Homo sapiens
ggtcaggagatcgagac

SEQ ID NO: 3247527 - DNA, 21 bp, Homo sapiens
ggtcaggagttcctaaccagc

SEQ ID NO: 3247528 - DNA, 19 bp, Homo sapiens
ggtcaggatgcacatttct

SEQ ID NO: 3247529 - DNA, 17 bp, Homo sapiens
ggtcaggccctggaact

SEQ ID NO: 3247530 - DNA, 17 bp, Homo sapiens
ggtcaggctgggcagcc

SEQ ID NO: 3247531 - DNA, 23 bp, Homo sapiens
ggtcaggctgggcagccccagag

SEQ ID NO: 3247532 - DNA, 20 bp, Homo sapiens
ggtcagggagtgctggctca

SEQ ID NO: 3247533 - DNA, 14 bp, Homo sapiens
ggtcaggtttaaca

SEQ ID NO: 3247534 - DNA, 15 bp, Homo sapiens
ggtcaggtttaacat

SEQ ID NO: 3247535 - DNA, 18 bp, Homo sapiens
ggtcaggtttaacatttg

SEQ ID NO: 3247536 - DNA, 12 bp, Homo sapiens
ggtcagtgcctt

SEQ ID NO: 3247537 - DNA, 14 bp, Homo sapiens
ggtcagtgtggaga

SEQ ID NO: 3247538 - DNA, 17 bp, Homo sapiens
ggtcatgcagttcctgg

SEQ ID NO: 3247539 - DNA, 18 bp, Homo sapiens
ggtcatgcagttcctggc

SEQ ID NO: 3247540 - DNA, 24 bp, Homo sapiens
ggtcattgacctctcagggcctgg

SEQ ID NO: 3247541 - DNA, 14 bp, Homo sapiens
ggtcatttcttcag

SEQ ID NO: 3247542 - DNA, 11 bp, Homo sapiens
ggtccaaataa

SEQ ID NO: 3247543 - DNA, 14 bp, Homo sapiens
ggtccaagggccat

SEQ ID NO: 3247544 - DNA, 15 bp, Homo sapiens
ggtccacccaggagc

SEQ ID NO: 3247545 - DNA, 17 bp, Homo sapiens
ggtccacccaggagccc

SEQ ID NO: 3247546 - DNA, 19 bp, Homo sapiens
ggtccacccaggagccccg

SEQ ID NO: 3247547 - DNA, 22 bp, Homo sapiens
ggtccacccaggagccccgagg

SEQ ID NO: 3247548 - DNA, 21 bp, Homo sapiens
caagacacgtggcctcgtgag

SEQ ID NO: 3247549 - DNA, 16 bp, Homo sapiens
caagacagatgcccca

SEQ ID NO: 3247550 - DNA, 22 bp, Homo sapiens
caagacagatgccccagagctg

SEQ ID NO: 3247551 - DNA, 21 bp, Homo sapiens
caagacagtgagacagtctgg

SEQ ID NO: 3247552 - DNA, 17 bp, Homo sapiens
caagacattgtcaataa

SEQ ID NO: 3247553 - DNA, 18 bp, Homo sapiens
caagacattgtcaataaa

SEQ ID NO: 3247554 - DNA, 11 bp, Homo sapiens
caagaccaaaa

SEQ ID NO: 3247555 - DNA, 18 bp, Homo sapiens
caagaccaaaatgacaat

SEQ ID NO: 3247556 - DNA, 19 bp, Homo sapiens
caagaccaccacttcgaaa

SEQ ID NO: 3247557 - DNA, 14 bp, Homo sapiens
caagacccccagca

SEQ ID NO: 3247558 - DNA, 15 bp, Homo sapiens
caagacccccagcac

SEQ ID NO: 3247559 - DNA, 20 bp, Homo sapiens
caagacctcatctgtggagc

SEQ ID NO: 3247560 - DNA, 17 bp, Homo sapiens
caagacctgttggttcc

SEQ ID NO: 3247561 - DNA, 17 bp, Homo sapiens
caagactctagagtcca

SEQ ID NO: 3247562 - DNA, 13 bp, Homo sapiens
caagactgcaaac

SEQ ID NO: 3247563 - DNA, 14 bp, Homo sapiens
caagactgcaaact

SEQ ID NO: 3247564 - DNA, 22 bp, Homo sapiens
caagagaaaggcctgcacacaa

SEQ ID NO: 3247565 - DNA, 16 bp, Homo sapiens
caagagacatggaaga

SEQ ID NO: 3247566 - DNA, 18 bp, Homo sapiens
caagagacatggaagaga

SEQ ID NO: 3247567 - DNA, 13 bp, Homo sapiens
caagagagaaaga

SEQ ID NO: 3247568 - DNA, 14 bp, Homo sapiens
caagagagaaagaa

SEQ ID NO: 3247569 - DNA, 18 bp, Homo sapiens
caagagagacatggaaaa

SEQ ID NO: 3247570 - DNA, 12 bp, Homo sapiens
caagagaggaga

SEQ ID NO: 3247571 - DNA, 15 bp, Homo sapiens
caacctcagggctcc

SEQ ID NO: 3247572 - DNA, 17 bp, Homo sapiens
caacctccctcttgttt

SEQ ID NO: 3247573 - DNA, 20 bp, Homo sapiens
caacctccgcctcccaggtt

SEQ ID NO: 3247574 - DNA, 16 bp, Homo sapiens
caacctcctgtggaac

SEQ ID NO: 3247575 - DNA, 23 bp, Homo sapiens
caacctcctgtggaacccagcag

SEQ ID NO: 3247576 - DNA, 16 bp, Homo sapiens
caacctcttctggctc

SEQ ID NO: 3247577 - DNA, 15 bp, Homo sapiens
caacctgcactctac

SEQ ID NO: 3247578 - DNA, 23 bp, Homo sapiens
caacctgctctcctcttgccact

SEQ ID NO: 3247579 - DNA, 18 bp, Homo sapiens
caacctgggtccaaataa

SEQ ID NO: 3247580 - DNA, 16 bp, Homo sapiens
caacctggtcacagga

SEQ ID NO: 3247581 - DNA, 15 bp, Homo sapiens
caacctggtggcacc

SEQ ID NO: 3247582 - DNA, 20 bp, Homo sapiens
caacctgttacctactttga

SEQ ID NO: 3247583 - DNA, 20 bp, Homo sapiens
caacctgttcttagagtgta

SEQ ID NO: 3247584 - DNA, 24 bp, Homo sapiens
caacctgttcttagagtgtagctg

SEQ ID NO: 3247585 - DNA, 14 bp, Homo sapiens
caaccttcaaagaa

SEQ ID NO: 3247586 - DNA, 16 bp, Homo sapiens
caaccttcaaagaaac

SEQ ID NO: 3247587 - DNA, 13 bp, Homo sapiens
caaccttgtttat

SEQ ID NO: 3247588 - DNA, 13 bp, Homo sapiens
caacctttaaaat

SEQ ID NO: 3247589 - DNA, 24 bp, Homo sapiens
caacctttaaaattgtcacctctg

SEQ ID NO: 3247590 - DNA, 12 bp, Homo sapiens
caacgaccaggg

SEQ ID NO: 3247591 - DNA, 24 bp, Homo sapiens
caacgccaggaatcatgaagagac

SEQ ID NO: 3247592 - DNA, 16 bp, Homo sapiens
caacgcccctgtggcc

SEQ ID NO: 3247593 - DNA, 18 bp, Homo sapiens
caacgcccctgtggccaa

SEQ ID NO: 3247594 - DNA, 22 bp, Homo sapiens
caacgcccctgtggccaactgc

SEQ ID NO: 3247595 - DNA, 20 bp, Homo sapiens
caacggaaagtgctgtctta

SEQ ID NO: 3247596 - DNA, 20 bp, Homo sapiens
caacgggaccccctggccct

SEQ ID NO: 3247597 - DNA, 21 bp, Homo sapiens
caacgggattgaagggtcctg

SEQ ID NO: 3247598 - DNA, 15 bp, Homo sapiens
caacgtgagagaaag

SEQ ID NO: 3247599 - DNA, 17 bp, Homo sapiens
caacgtgagagaaagag

SEQ ID NO: 3247600 - DNA, 16 bp, Homo sapiens
tgctggaattctaaca

SEQ ID NO: 3247601 - DNA, 19 bp, Homo sapiens
tgctggactgtcatagaaa

SEQ ID NO: 3247602 - DNA, 13 bp, Homo sapiens
tgctggagaagag

SEQ ID NO: 3247603 - DNA, 18 bp, Homo sapiens
tgctggagaagagaggag

SEQ ID NO: 3247604 - DNA, 13 bp, Homo sapiens
tgctggagaggtt

SEQ ID NO: 3247605 - DNA, 16 bp, Homo sapiens
tgctggagggaggctg

SEQ ID NO: 3247606 - DNA, 15 bp, Homo sapiens
tgctggaggtgggag

SEQ ID NO: 3247607 - DNA, 15 bp, Homo sapiens
tgctggataaaatga

SEQ ID NO: 3247608 - DNA, 20 bp, Homo sapiens
tgctggatggagcccaggcg

SEQ ID NO: 3247609 - DNA, 16 bp, Homo sapiens
tgctggattaatgttt

SEQ ID NO: 3247610 - DNA, 13 bp, Homo sapiens
tgctggccagcac

SEQ ID NO: 3247611 - DNA, 14 bp, Homo sapiens
tgctggccagcacc

SEQ ID NO: 3247612 - DNA, 17 bp, Homo sapiens
tgctggccagcaccctc

SEQ ID NO: 3247613 - DNA, 18 bp, Homo sapiens
tgctggccagcaccctct

SEQ ID NO: 3247614 - DNA, 19 bp, Homo sapiens
tgctggccagcaccctctc

SEQ ID NO: 3247615 - DNA, 22 bp, Homo sapiens
tgctggccagcaccctctcctg

SEQ ID NO: 3247616 - DNA, 15 bp, Homo sapiens
tgctggccagcctgg

SEQ ID NO: 3247617 - DNA, 17 bp, Homo sapiens
tgctggccagcctgggg

SEQ ID NO: 3247618 - DNA, 21 bp, Homo sapiens
tgctggccagcctggggcctg

SEQ ID NO: 3247619 - DNA, 22 bp, Homo sapiens
tgctggccagcctggggcctgg

SEQ ID NO: 3247620 - DNA, 23 bp, Homo sapiens
tgctggccagcctggggcctggc

SEQ ID NO: 3247621 - DNA, 14 bp, Homo sapiens
tgctggccccagcc

SEQ ID NO: 3247622 - DNA, 18 bp, Homo sapiens
tgctggccccagccctgc

SEQ ID NO: 3247623 - DNA, 13 bp, Homo sapiens
tgctggcccccag

SEQ ID NO: 3247624 - DNA, 18 bp, Homo sapiens
tgctggcctggatctccc

SEQ ID NO: 3247625 - DNA, 19 bp, Homo sapiens
tgctggctcacagtacagc

SEQ ID NO: 3247626 - DNA, 15 bp, Homo sapiens
tgctggctctgagaa

SEQ ID NO: 3247627 - DNA, 18 bp, Homo sapiens
tgctggctctgagaatca

SEQ ID NO: 3247628 - DNA, 18 bp, Homo sapiens
tgctggctgttggctggg

SEQ ID NO: 3247629 - DNA, 21 bp, Homo sapiens
tgctggctgttggctgggggc

SEQ ID NO: 3247630 - DNA, 17 bp, Homo sapiens
tgctggcttccagcttc

SEQ ID NO: 3247631 - DNA, 16 bp, Homo sapiens
tgctgggaccagagcc

SEQ ID NO: 3247632 - DNA, 18 bp, Homo sapiens
tgctgggaccagagccag

SEQ ID NO: 3247633 - DNA, 16 bp, Homo sapiens
tgctgggactcagcct

SEQ ID NO: 3247634 - DNA, 15 bp, Homo sapiens
tgctgggagctccac

SEQ ID NO: 3247635 - DNA, 20 bp, Homo sapiens
tgctgggagctccactctgc

SEQ ID NO: 3247636 - DNA, 22 bp, Homo sapiens
tgctgggagctccactctgctt

SEQ ID NO: 3247637 - DNA, 16 bp, Homo sapiens
tgctgggattacagac

SEQ ID NO: 3247638 - DNA, 20 bp, Homo sapiens
tgctgggattacaggtgtga

SEQ ID NO: 3247639 - DNA, 20 bp, Homo sapiens
tgctgggccactggggactt

SEQ ID NO: 3247640 - DNA, 16 bp, Homo sapiens
tgctgggcctctgcct

SEQ ID NO: 3247641 - DNA, 15 bp, Homo sapiens
tgctgggctgggccc

SEQ ID NO: 3247642 - DNA, 12 bp, Homo sapiens
tgctggggcatg

SEQ ID NO: 3247643 - DNA, 18 bp, Homo sapiens
tgctggggcatgtgtgcc

SEQ ID NO: 3247644 - DNA, 23 bp, Homo sapiens
tgctggggccgccacggcctggc

SEQ ID NO: 3247645 - DNA, 15 bp, Homo sapiens
tgctggggcctcaga

SEQ ID NO: 3247646 - DNA, 20 bp, Homo sapiens
tgctggggctcacggggcct

SEQ ID NO: 3247647 - DNA, 20 bp, Homo sapiens
tgctgggggaatgagcccag

SEQ ID NO: 3247648 - DNA, 21 bp, Homo sapiens
tgctgggggaatgagcccaga

SEQ ID NO: 3247649 - DNA, 16 bp, Homo sapiens
tgctgggtaaactgtg

SEQ ID NO: 3247650 - DNA, 16 bp, Homo sapiens
tgctgggtgcctccca

SEQ ID NO: 3247651 - DNA, 14 bp, Homo sapiens
tgctgggttggtgc

SEQ ID NO: 3247652 - DNA, 18 bp, Homo sapiens
tgctgggttggtgcacag

SEQ ID NO: 3247653 - DNA, 21 bp, Homo sapiens
tgctgggttggtgcacagtga

SEQ ID NO: 3247654 - DNA, 19 bp, Homo sapiens
tgctggtaacagtggctgc

SEQ ID NO: 3247655 - DNA, 14 bp, Homo sapiens
tgctggtagagacc

SEQ ID NO: 3247656 - DNA, 19 bp, Homo sapiens
tgctggtcccggggccagc

SEQ ID NO: 3247657 - DNA, 22 bp, Homo sapiens
tgctggtgtcctgaccaccctc

SEQ ID NO: 3247658 - DNA, 20 bp, Homo sapiens
tgctggttcctgactggcaa

SEQ ID NO: 3247659 - DNA, 13 bp, Homo sapiens
tgctggttgctgt

SEQ ID NO: 3247660 - DNA, 22 bp, Homo sapiens
tgctggttttcctaaatgcagt

SEQ ID NO: 3247661 - DNA, 22 bp, Homo sapiens
tgctgtaaaattataaactttt

SEQ ID NO: 3247662 - DNA, 20 bp, Homo sapiens
tgctgtaaataagcccagtg

SEQ ID NO: 3247663 - DNA, 15 bp, Homo sapiens
tgctgtaaatacagg

SEQ ID NO: 3247664 - DNA, 20 bp, Homo sapiens
tgctgtaactgctgagccac

SEQ ID NO: 3247665 - DNA, 15 bp, Homo sapiens
tgctgtacatctatt

SEQ ID NO: 3247666 - DNA, 22 bp, Homo sapiens
tgctgtaccacatctgctctag

SEQ ID NO: 3247667 - DNA, 15 bp, Homo sapiens
tgctgtacccagatg

SEQ ID NO: 3247668 - DNA, 16 bp, Homo sapiens
tgctgtacccagatgc

SEQ ID NO: 3247669 - DNA, 15 bp, Homo sapiens
tgctgtacccttcca

SEQ ID NO: 3247670 - DNA, 14 bp, Homo sapiens
tgctgtactagaga

SEQ ID NO: 3247671 - DNA, 22 bp, Homo sapiens
tgctgtatatggaattctttta

SEQ ID NO: 3247672 - DNA, 20 bp, Homo sapiens
tgcgggaggccctggccctt

SEQ ID NO: 3247673 - DNA, 23 bp, Homo sapiens
tgcgggcgcgggcagccacccaa

SEQ ID NO: 3247674 - DNA, 15 bp, Homo sapiens
tgcgggtctgaagga

SEQ ID NO: 3247675 - DNA, 23 bp, Homo sapiens
tgcgggtggggcttggggctcac

SEQ ID NO: 3247676 - DNA, 19 bp, Homo sapiens
tgcggtcaggctgggcagc

SEQ ID NO: 3247677 - DNA, 18 bp, Homo sapiens
tgcggtccacccaggagc

SEQ ID NO: 3247678 - DNA, 21 bp, Homo sapiens
tgcggttaattttgaagtgct

SEQ ID NO: 3247679 - DNA, 19 bp, Homo sapiens
tgcgtatgtctgttaccat

SEQ ID NO: 3247680 - DNA, 15 bp, Homo sapiens
tgcgtcccagctgaa

SEQ ID NO: 3247681 - DNA, 21 bp, Homo sapiens
tgcgtcccagctgaaggcagt

SEQ ID NO: 3247682 - DNA, 13 bp, Homo sapiens
tgcgtccctgtac

SEQ ID NO: 3247683 - DNA, 18 bp, Homo sapiens
tgcgtcctgacgccctgc

SEQ ID NO: 3247684 - DNA, 19 bp, Homo sapiens
tgcgtcctgacgccctgcg

SEQ ID NO: 3247685 - DNA, 15 bp, Homo sapiens
tgcgtctggaggggc

SEQ ID NO: 3247686 - DNA, 20 bp, Homo sapiens
tgcgtctggaggggcccctg

SEQ ID NO: 3247687 - DNA, 12 bp, Homo sapiens
tgcgtgaatgta

SEQ ID NO: 3247688 - DNA, 20 bp, Homo sapiens
tgcgtgaatgtatgtaatgt

SEQ ID NO: 3247689 - DNA, 18 bp, Homo sapiens
tgcgtgccgcctgctcct

SEQ ID NO: 3247690 - DNA, 18 bp, Homo sapiens
tgcgtgccgtgtgagtgt

SEQ ID NO: 3247691 - DNA, 19 bp, Homo sapiens
tgcgtgccgtgtgagtgtg

SEQ ID NO: 3247692 - DNA, 23 bp, Homo sapiens
tgcgtgccgtgtgagtgtgacag

SEQ ID NO: 3247693 - DNA, 17 bp, Homo sapiens
tgcgtggactctgcaca

SEQ ID NO: 3247694 - DNA, 21 bp, Homo sapiens
tgcgtggcctgagtcctggtc

SEQ ID NO: 3247695 - DNA, 21 bp, Homo sapiens
tgcgtggctgtggcacagact

SEQ ID NO: 3247696 - DNA, 19 bp, Homo sapiens
tgcgtgtcaatttccctca

SEQ ID NO: 3247697 - DNA, 20 bp, Homo sapiens
tgcgtgtgtagagttaagaa

SEQ ID NO: 3247698 - DNA, 14 bp, Homo sapiens
tgcgttggagccac

SEQ ID NO: 3247699 - DNA, 15 bp, Homo sapiens
tgcgttggagccact

SEQ ID NO: 3247700 - DNA, 13 bp, Homo sapiens
tgctaaaaaaagt

SEQ ID NO: 3247701 - DNA, 23 bp, Homo sapiens
tgctaaaaatgagcttgattaaa

SEQ ID NO: 3247702 - DNA, 17 bp, Homo sapiens
tgctaaagcactttgca

SEQ ID NO: 3247703 - DNA, 16 bp, Homo sapiens
tgctaaattctatgtt

SEQ ID NO: 3247704 - DNA, 15 bp, Homo sapiens
tgctaaattttcagt

SEQ ID NO: 3247705 - DNA, 21 bp, Homo sapiens
tgctaaattttcagtagggct

SEQ ID NO: 3247706 - DNA, 13 bp, Homo sapiens
tgctaaccttttc

SEQ ID NO: 3247707 - DNA, 19 bp, Homo sapiens
tgctaaggctcctccttgc

SEQ ID NO: 3247708 - DNA, 16 bp, Homo sapiens
tgctaagtccatcacc

SEQ ID NO: 3247709 - DNA, 16 bp, Homo sapiens
tgctaagtctttccca

SEQ ID NO: 3247710 - DNA, 23 bp, Homo sapiens
tgctaagtgcttattacatttta

SEQ ID NO: 3247711 - DNA, 20 bp, Homo sapiens
tgctaataaacactggctct

SEQ ID NO: 3247712 - DNA, 20 bp, Homo sapiens
tgctaatcaaagccagggtc

SEQ ID NO: 3247713 - DNA, 22 bp, Homo sapiens
tgctaatcatgtgggtgagcca

SEQ ID NO: 3247714 - DNA, 23 bp, Homo sapiens
tgctaatgcaaattaaaacatat

SEQ ID NO: 3247715 - DNA, 18 bp, Homo sapiens
tgctaatttatcctgaaa

SEQ ID NO: 3247716 - DNA, 22 bp, Homo sapiens
tgctaattttctcaaaagcatt

SEQ ID NO: 3247717 - DNA, 19 bp, Homo sapiens
tgctacaaatttatgcatt

SEQ ID NO: 3247718 - DNA, 20 bp, Homo sapiens
tgctacaaatttatgcattt

SEQ ID NO: 3247719 - DNA, 22 bp, Homo sapiens
tgctacaaatttatgcatttca

SEQ ID NO: 3247720 - DNA, 16 bp, Homo sapiens
taaatagtagaaaaat

SEQ ID NO: 3247721 - DNA, 13 bp, Homo sapiens
taaatataattct

SEQ ID NO: 3247722 - DNA, 18 bp, Homo sapiens
taaatataattctgtaaa

SEQ ID NO: 3247723 - DNA, 13 bp, Homo sapiens
taaatatatataa

SEQ ID NO: 3247724 - DNA, 14 bp, Homo sapiens
taaatatatatgat

SEQ ID NO: 3247725 - DNA, 21 bp, Homo sapiens
taaatatatattttgtacttt

SEQ ID NO: 3247726 - DNA, 20 bp, Homo sapiens
taaatatatgtctgataatg

SEQ ID NO: 3247727 - DNA, 17 bp, Homo sapiens
taaatatatttaagata

SEQ ID NO: 3247728 - DNA, 22 bp, Homo sapiens
taaatatccaaagactgtactg

SEQ ID NO: 3247729 - DNA, 18 bp, Homo sapiens
taaatatgaaccctttgt

SEQ ID NO: 3247730 - DNA, 13 bp, Homo sapiens
taaatatgtcaga

SEQ ID NO: 3247731 - DNA, 13 bp, Homo sapiens
taaatattctata

SEQ ID NO: 3247732 - DNA, 19 bp, Homo sapiens
taaatatttactctttgca

SEQ ID NO: 3247733 - DNA, 12 bp, Homo sapiens
taaatatttcct

SEQ ID NO: 3247734 - DNA, 13 bp, Homo sapiens
taaatatttcctt

SEQ ID NO: 3247735 - DNA, 14 bp, Homo sapiens
taaatatttcctta

SEQ ID NO: 3247736 - DNA, 15 bp, Homo sapiens
taaatatttccttaa

SEQ ID NO: 3247737 - DNA, 19 bp, Homo sapiens
taaatatttggtctctatt

SEQ ID NO: 3247738 - DNA, 16 bp, Homo sapiens
taaatattttctattt

SEQ ID NO: 3247739 - DNA, 17 bp, Homo sapiens
taaatcacacattcagt

SEQ ID NO: 3247740 - DNA, 17 bp, Homo sapiens
taaatcataaagtcagt

SEQ ID NO: 3247741 - DNA, 12 bp, Homo sapiens
taaatcatgtat

SEQ ID NO: 3247742 - DNA, 15 bp, Homo sapiens
taaatcatgtatgtt

SEQ ID NO: 3247743 - DNA, 16 bp, Homo sapiens
taaatcatgtatgtta

SEQ ID NO: 3247744 - DNA, 19 bp, Homo sapiens
taaatcatgtatgttatga

SEQ ID NO: 3247745 - DNA, 18 bp, Homo sapiens
taaatcctagacttgaaa

SEQ ID NO: 3247746 - DNA, 14 bp, Homo sapiens
taaatctaaatcta

SEQ ID NO: 3247747 - DNA, 19 bp, Homo sapiens
taaatctatttattaatat

SEQ ID NO: 3247748 - DNA, 18 bp, Homo sapiens
taaatctgttgccaagct

SEQ ID NO: 3247749 - DNA, 19 bp, Homo sapiens
taaatcttaaaaagttgtt

SEQ ID NO: 3247750 - DNA, 12 bp, Homo sapiens
taaatgaaagaa

SEQ ID NO: 3247751 - DNA, 13 bp, Homo sapiens
taaatgaaagaag

SEQ ID NO: 3247752 - DNA, 16 bp, Homo sapiens
taaatgaaattgtaaa

SEQ ID NO: 3247753 - DNA, 14 bp, Homo sapiens
taaatgaatatttt

SEQ ID NO: 3247754 - DNA, 21 bp, Homo sapiens
taaatgaatattttgataata

SEQ ID NO: 3247755 - DNA, 20 bp, Homo sapiens
taaatgaattaaatattgaa

SEQ ID NO: 3247756 - DNA, 14 bp, Homo sapiens
taaatgatctgcct

SEQ ID NO: 3247757 - DNA, 17 bp, Homo sapiens
taaatgattcttagtga

SEQ ID NO: 3247758 - DNA, 19 bp, Homo sapiens
taaatgcaaagttctgtgt

SEQ ID NO: 3247759 - DNA, 10 bp, Homo sapiens
taaatgcata

SEQ ID NO: 3247760 - DNA, 15 bp, Homo sapiens
taaatgccctcttct

SEQ ID NO: 3247761 - DNA, 21 bp, Homo sapiens
taaatgcctcttaaattatat

SEQ ID NO: 3247762 - DNA, 14 bp, Homo sapiens
taaatgccttgtat

SEQ ID NO: 3247763 - DNA, 16 bp, Homo sapiens
taaatgccttgtataa

SEQ ID NO: 3247764 - DNA, 13 bp, Homo sapiens
taaatgcctttat

SEQ ID NO: 3247765 - DNA, 21 bp, Homo sapiens
taaatgctttgtgtgattgaa

SEQ ID NO: 3247766 - DNA, 23 bp, Homo sapiens
taaatggcctcatgtggctggaa

SEQ ID NO: 3247767 - DNA, 14 bp, Homo sapiens
taaatggggcccat

SEQ ID NO: 3247768 - DNA, 17 bp, Homo sapiens
taaatggggctcacaaa

SEQ ID NO: 3247769 - DNA, 17 bp, Homo sapiens
taaatggtgtacataat

SEQ ID NO: 3247770 - DNA, 21 bp, Homo sapiens
taaatggtgtacataatgtat

SEQ ID NO: 3247771 - DNA, 18 bp, Homo sapiens
taaatggtttctgaaaat

SEQ ID NO: 3247772 - DNA, 21 bp, Homo sapiens
taaatggtttctgaaaatgtt

SEQ ID NO: 3247773 - DNA, 13 bp, Homo sapiens
taaatgtaaagat

SEQ ID NO: 3247774 - DNA, 17 bp, Homo sapiens
taaatgtacctgatgta

SEQ ID NO: 3247775 - DNA, 17 bp, Homo sapiens
taaatgtatatacacat

SEQ ID NO: 3247776 - DNA, 19 bp, Homo sapiens
taaatgtatcttattcaca

SEQ ID NO: 3247777 - DNA, 19 bp, Homo sapiens
taaatgtatttaattaaat

SEQ ID NO: 3247778 - DNA, 14 bp, Homo sapiens
taaatgtccctaat

SEQ ID NO: 3247779 - DNA, 22 bp, Homo sapiens
taaatgtctctttaatgtcaca

SEQ ID NO: 3247780 - DNA, 13 bp, Homo sapiens
taaatgtcttata

SEQ ID NO: 3247781 - DNA, 22 bp, Homo sapiens
taaatgtgcaatagaaggtgat

SEQ ID NO: 3247782 - DNA, 12 bp, Homo sapiens
taaatgtttaaa

SEQ ID NO: 3247783 - DNA, 18 bp, Homo sapiens
taaatgtttaaatataaa

SEQ ID NO: 3247784 - DNA, 19 bp, Homo sapiens
taaatgtttatactgtatt

SEQ ID NO: 3247785 - DNA, 21 bp, Homo sapiens
taaatgtttcttttaaagacc

SEQ ID NO: 3247786 - DNA, 19 bp, Homo sapiens
taaatgtttcttttgtttg

SEQ ID NO: 3247787 - DNA, 10 bp, Homo sapiens
taaatgtttg

SEQ ID NO: 3247788 - DNA, 11 bp, Homo sapiens
taaatgtttga

SEQ ID NO: 3247789 - DNA, 17 bp, Homo sapiens
taaatgtttgacacaat

SEQ ID NO: 3247790 - DNA, 19 bp, Homo sapiens
taacttcttatggaattga

SEQ ID NO: 3247791 - DNA, 12 bp, Homo sapiens
taacttcttgct

SEQ ID NO: 3247792 - DNA, 15 bp, Homo sapiens
taacttcttgcttct

SEQ ID NO: 3247793 - DNA, 20 bp, Homo sapiens
taacttcttgcttctttcta

SEQ ID NO: 3247794 - DNA, 12 bp, Homo sapiens
taactttaagtt

SEQ ID NO: 3247795 - DNA, 16 bp, Homo sapiens
taactttactctgtgt

SEQ ID NO: 3247796 - DNA, 21 bp, Homo sapiens
taactttatcacattatttgc

SEQ ID NO: 3247797 - DNA, 17 bp, Homo sapiens
taactttattctttgtt

SEQ ID NO: 3247798 - DNA, 23 bp, Homo sapiens
taactttcagaagagatgggctt

SEQ ID NO: 3247799 - DNA, 15 bp, Homo sapiens
taactttcagaggca

SEQ ID NO: 3247800 - DNA, 23 bp, Homo sapiens
taacttttaatccctatgtttgt

SEQ ID NO: 3247801 - DNA, 20 bp, Homo sapiens
taacttttcaatgacatttt

SEQ ID NO: 3247802 - DNA, 12 bp, Homo sapiens
taacttttcctt

SEQ ID NO: 3247803 - DNA, 22 bp, Homo sapiens
taacttttccttgtatgttctt

SEQ ID NO: 3247804 - DNA, 12 bp, Homo sapiens
taacttttgtga

SEQ ID NO: 3247805 - DNA, 16 bp, Homo sapiens
taactttttatttcta

SEQ ID NO: 3247806 - DNA, 18 bp, Homo sapiens
taacttttttgagtcatt

SEQ ID NO: 3247807 - DNA, 22 bp, Homo sapiens
taacttttttgtgtatgtactt

SEQ ID NO: 3247808 - DNA, 19 bp, Homo sapiens
taagaaaagattttaatca

SEQ ID NO: 3247809 - DNA, 14 bp, Homo sapiens
taagaaaagcactt

SEQ ID NO: 3247810 - DNA, 19 bp, Homo sapiens
taagaaaatacaataaact

SEQ ID NO: 3247811 - DNA, 21 bp, Homo sapiens
taagaaacacagggttttgta

SEQ ID NO: 3247812 - DNA, 16 bp, Homo sapiens
taagaaacagagcagt

SEQ ID NO: 3247813 - DNA, 14 bp, Homo sapiens
taagaaacttttgt

SEQ ID NO: 3247814 - DNA, 24 bp, Homo sapiens
taagaaagactatctaaatgttga

SEQ ID NO: 3247815 - DNA, 20 bp, Homo sapiens
taagaaatgtattcctgaaa

SEQ ID NO: 3247816 - DNA, 16 bp, Homo sapiens
taagaacatcataaaa

SEQ ID NO: 3247817 - DNA, 15 bp, Homo sapiens
taagaaccttaatga

SEQ ID NO: 3247818 - DNA, 12 bp, Homo sapiens
taagaactgctt

SEQ ID NO: 3247819 - DNA, 18 bp, Homo sapiens
taagaactgcttcatgtg

SEQ ID NO: 3247820 - DNA, 12 bp, Homo sapiens
taagaactgtgg

SEQ ID NO: 3247821 - DNA, 17 bp, Homo sapiens
taagaagaagttcatgt

SEQ ID NO: 3247822 - DNA, 14 bp, Homo sapiens
taagaagacatgaa

SEQ ID NO: 3247823 - DNA, 19 bp, Homo sapiens
taagaagccctgcagagca

SEQ ID NO: 3247824 - DNA, 18 bp, Homo sapiens
taagaagctgttgtacat

SEQ ID NO: 3247825 - DNA, 22 bp, Homo sapiens
taagaagctgttgtacatttat

SEQ ID NO: 3247826 - DNA, 16 bp, Homo sapiens
taagaagcttctaata

SEQ ID NO: 3247827 - DNA, 22 bp, Homo sapiens
taagaagcttctaataaattat

SEQ ID NO: 3247828 - DNA, 16 bp, Homo sapiens
taagaagttagaaggc

SEQ ID NO: 3247829 - DNA, 17 bp, Homo sapiens
taagaagttgtttgagg

SEQ ID NO: 3247830 - DNA, 13 bp, Homo sapiens
taagaataataaa

SEQ ID NO: 3247831 - DNA, 14 bp, Homo sapiens
taagaataataaaa

SEQ ID NO: 3247832 - DNA, 23 bp, Homo sapiens
taagaataccacatcaaataaga

SEQ ID NO: 3247833 - DNA, 19 bp, Homo sapiens
taagaatatgtttccttgt

SEQ ID NO: 3247834 - DNA, 17 bp, Homo sapiens
taagaatcagagtagaa

SEQ ID NO: 3247835 - DNA, 18 bp, Homo sapiens
taagaatcagagtagaaa

SEQ ID NO: 3247836 - DNA, 18 bp, Homo sapiens
taagaatgttggtttact

SEQ ID NO: 3247837 - DNA, 19 bp, Homo sapiens
taagaatgttggtttactt

SEQ ID NO: 3247838 - DNA, 21 bp, Homo sapiens
taagaatgttggtttactttc

SEQ ID NO: 3247839 - DNA, 18 bp, Homo sapiens
taagaattcaaactgggg

SEQ ID NO: 3247840 - DNA, 13 bp, Homo sapiens
taagaattctgat

SEQ ID NO: 3247841 - DNA, 18 bp, Homo sapiens
taagaattctgattgatt

SEQ ID NO: 3247842 - DNA, 13 bp, Homo sapiens
taagaattgacca

SEQ ID NO: 3247843 - DNA, 19 bp, Homo sapiens
taagaattgaccatctgct

SEQ ID NO: 3247844 - DNA, 19 bp, Homo sapiens
taagaattgagtaatggtg

SEQ ID NO: 3247845 - DNA, 16 bp, Homo sapiens
taagacaatagtattt

SEQ ID NO: 3247846 - DNA, 13 bp, Homo sapiens
taagacagtgtac

SEQ ID NO: 3247847 - DNA, 14 bp, Homo sapiens
taagacagtgtaca

SEQ ID NO: 3247848 - DNA, 20 bp, Homo sapiens
taagacataacgtttttcct

SEQ ID NO: 3247849 - DNA, 21 bp, Homo sapiens
taagacataacgtttttcctt

SEQ ID NO: 3247850 - DNA, 21 bp, Homo sapiens
taagacatgtgaggaggaaaa

SEQ ID NO: 3247851 - DNA, 15 bp, Homo sapiens
taagacatttgtata

SEQ ID NO: 3247852 - DNA, 17 bp, Homo sapiens
taagacatttgtatatt

SEQ ID NO: 3247853 - DNA, 15 bp, Homo sapiens
taagacattttcatg

SEQ ID NO: 3247854 - DNA, 21 bp, Homo sapiens
taagacattttcatgcttcca

SEQ ID NO: 3247855 - DNA, 22 bp, Homo sapiens
taagacccttattgctgtcctg

SEQ ID NO: 3247856 - DNA, 19 bp, Homo sapiens
taagaccgtgtcccaagga

SEQ ID NO: 3247857 - DNA, 15 bp, Homo sapiens
taagactcaaatgtt

SEQ ID NO: 3247858 - DNA, 15 bp, Homo sapiens
taaagaccagaaatt

SEQ ID NO: 3247859 - DNA, 19 bp, Homo sapiens
taaagaccctcctattcta

SEQ ID NO: 3247860 - DNA, 13 bp, Homo sapiens
taaagagaaactt

SEQ ID NO: 3247861 - DNA, 14 bp, Homo sapiens
taaagagaaacttt

SEQ ID NO: 3247862 - DNA, 15 bp, Homo sapiens
taaagagaaactttg

SEQ ID NO: 3247863 - DNA, 12 bp, Homo sapiens
taaagagagaat

SEQ ID NO: 3247864 - DNA, 19 bp, Homo sapiens
taaagagcccttgcctccc

SEQ ID NO: 3247865 - DNA, 20 bp, Homo sapiens
taaagaggctgaaagaggcc

SEQ ID NO: 3247866 - DNA, 18 bp, Homo sapiens
taaagagtctagattcaa

SEQ ID NO: 3247867 - DNA, 19 bp, Homo sapiens
taaagagtctagattcaaa

SEQ ID NO: 3247868 - DNA, 20 bp, Homo sapiens
taaagataacccttattcca

SEQ ID NO: 3247869 - DNA, 18 bp, Homo sapiens
taaagataattgctattt

SEQ ID NO: 3247870 - DNA, 20 bp, Homo sapiens
taaagatatcagagctctta

SEQ ID NO: 3247871 - DNA, 16 bp, Homo sapiens
taaagatatggagaat

SEQ ID NO: 3247872 - DNA, 17 bp, Homo sapiens
taaagatatggagaatt

SEQ ID NO: 3247873 - DNA, 22 bp, Homo sapiens
taaagatatttttatctttata

SEQ ID NO: 3247874 - DNA, 18 bp, Homo sapiens
taaagatcaagtgggcct

SEQ ID NO: 3247875 - DNA, 17 bp, Homo sapiens
taaagatgaactctgaa

SEQ ID NO: 3247876 - DNA, 13 bp, Homo sapiens
taaagatgagttg

SEQ ID NO: 3247877 - DNA, 21 bp, Homo sapiens
taaagatgcaaggaccaggac

SEQ ID NO: 3247878 - DNA, 18 bp, Homo sapiens
taaagatggagtttctaa

SEQ ID NO: 3247879 - DNA, 20 bp, Homo sapiens
taaagatggtcgtgtgtgtg

SEQ ID NO: 3247880 - DNA, 20 bp, Homo sapiens
taaagattctatagttctag

SEQ ID NO: 3247881 - DNA, 21 bp, Homo sapiens
taaagattctatagttctaga

SEQ ID NO: 3247882 - DNA, 17 bp, Homo sapiens
taaagattctctttaaa

SEQ ID NO: 3247883 - DNA, 23 bp, Homo sapiens
taaagattctctttaaaaaagac

SEQ ID NO: 3247884 - DNA, 21 bp, Homo sapiens
taaagcaaaaaatgaatgtct

SEQ ID NO: 3247885 - DNA, 22 bp, Homo sapiens
taaagcaactgttatgaaataa

SEQ ID NO: 3247886 - DNA, 15 bp, Homo sapiens
taaagcactttgcac

SEQ ID NO: 3247887 - DNA, 16 bp, Homo sapiens
taaagcactttgcact

SEQ ID NO: 3247888 - DNA, 10 bp, Homo sapiens
taaagcagcc

SEQ ID NO: 3247889 - DNA, 17 bp, Homo sapiens
taaagcataagtataca

SEQ ID NO: 3247890 - DNA, 17 bp, Homo sapiens
taaagccagcctgacct

SEQ ID NO: 3247891 - DNA, 16 bp, Homo sapiens
taaagctatgttacat

SEQ ID NO: 3247892 - DNA, 19 bp, Homo sapiens
taaagctcaaatgaaatgt

SEQ ID NO: 3247893 - DNA, 23 bp, Homo sapiens
taaagctgcctgtagttaggaaa

SEQ ID NO: 3247894 - DNA, 23 bp, Homo sapiens
taaagctggaacatttgatattt

SEQ ID NO: 3247895 - DNA, 11 bp, Homo sapiens
taaagctggcc

SEQ ID NO: 3247896 - DNA, 13 bp, Homo sapiens
taaagctggccct

SEQ ID NO: 3247897 - DNA, 14 bp, Homo sapiens
taaagctggccctg

SEQ ID NO: 3247898 - DNA, 16 bp, Homo sapiens
taaagctggccctgcc

SEQ ID NO: 3247899 - DNA, 19 bp, Homo sapiens
taaagctggccctgcctcc

SEQ ID NO: 3247900 - DNA, 22 bp, Homo sapiens
taaagctggccctgcctcctgg

SEQ ID NO: 3247901 - DNA, 22 bp, Homo sapiens
taaagcttactctgtccattta

SEQ ID NO: 3247902 - DNA, 23 bp, Homo sapiens
taaagcttgtggccccttttact

SEQ ID NO: 3247903 - DNA, 15 bp, Homo sapiens
taaagcttttggaag

SEQ ID NO: 3247904 - DNA, 22 bp, Homo sapiens
taaaggagaaggcatgaaattg

SEQ ID NO: 3247905 - DNA, 23 bp, Homo sapiens
taaaggataatggtgaacatttt

SEQ ID NO: 3247906 - DNA, 22 bp, Homo sapiens
taaaggatgtgattgtggaatg

SEQ ID NO: 3247907 - DNA, 10 bp, Homo sapiens
taaaggcagc

SEQ ID NO: 3247908 - DNA, 15 bp, Homo sapiens
taaaggcagctgcct

SEQ ID NO: 3247909 - DNA, 20 bp, Homo sapiens
taaaggcagctgcctctgct

SEQ ID NO: 3247910 - DNA, 21 bp, Homo sapiens
taaaggcagctgcctctgctc

SEQ ID NO: 3247911 - DNA, 15 bp, Homo sapiens
taaaggcccagcccc

SEQ ID NO: 3247912 - DNA, 17 bp, Homo sapiens
taaaggcccagccccta

SEQ ID NO: 3247913 - DNA, 11 bp, Homo sapiens
taaaggcctcc

SEQ ID NO: 3247914 - DNA, 22 bp, Homo sapiens
taaagggatatttttttctatt

SEQ ID NO: 3247915 - DNA, 19 bp, Homo sapiens
taaagggcccaatgaatta

SEQ ID NO: 3247916 - DNA, 21 bp, Homo sapiens
taaagggcccaatgaattatt

SEQ ID NO: 3247917 - DNA, 15 bp, Homo sapiens
taaagggcctgcctg

SEQ ID NO: 3247918 - DNA, 21 bp, Homo sapiens
taaaggtccacaggtctagac

SEQ ID NO: 3247919 - DNA, 20 bp, Homo sapiens
taaaggtggtgaggcaataa

SEQ ID NO: 3247920 - DNA, 20 bp, Homo sapiens
taaaggttgacaataaatgt

SEQ ID NO: 3247921 - DNA, 13 bp, Homo sapiens
taaagtaaagcta

SEQ ID NO: 3247922 - DNA, 14 bp, Homo sapiens
taaagtaaagctaa

SEQ ID NO: 3247923 - DNA, 13 bp, Homo sapiens
taaagtaaatctc

SEQ ID NO: 3247924 - DNA, 18 bp, Homo sapiens
taaagtaatttctaaagc

SEQ ID NO: 3247925 - DNA, 13 bp, Homo sapiens
taaagtagaagag

SEQ ID NO: 3247926 - DNA, 15 bp, Homo sapiens
taaagtataatgttt

SEQ ID NO: 3247927 - DNA, 17 bp, Homo sapiens
taaagtatatatttatt

SEQ ID NO: 3247928 - DNA, 13 bp, Homo sapiens
taaagtatgtaaa

SEQ ID NO: 3247929 - DNA, 21 bp, Homo sapiens
taaagtatgtaaagtatgtaa

SEQ ID NO: 3247930 - DNA, 22 bp, Homo sapiens
taaagtattcaacaatttcaat

SEQ ID NO: 3247931 - DNA, 23 bp, Homo sapiens
taaagtattctttttctttttta

SEQ ID NO: 3247932 - DNA, 20 bp, Homo sapiens
aactgcaaaaaaagcctcca

SEQ ID NO: 3247933 - DNA, 22 bp, Homo sapiens
aactgcaaaaaaagcctccaag

SEQ ID NO: 3247934 - DNA, 18 bp, Homo sapiens
aactgcaataacttctga

SEQ ID NO: 3247935 - DNA, 19 bp, Homo sapiens
aactgcaataacttctgac

SEQ ID NO: 3247936 - DNA, 16 bp, Homo sapiens
aactgcaatagagact

SEQ ID NO: 3247937 - DNA, 18 bp, Homo sapiens
aactgcaatagagactgt

SEQ ID NO: 3247938 - DNA, 16 bp, Homo sapiens
aactgcaggccctggc

SEQ ID NO: 3247939 - DNA, 18 bp, Homo sapiens
aactgcaggccctggcct

SEQ ID NO: 3247940 - DNA, 23 bp, Homo sapiens
aactgcaggccctggcctcccct

SEQ ID NO: 3247941 - DNA, 21 bp, Homo sapiens
aactgcatggacctaacattc

SEQ ID NO: 3247942 - DNA, 14 bp, Homo sapiens
aactgcattagaaa

SEQ ID NO: 3247943 - DNA, 22 bp, Homo sapiens
aactgccattattttctgtcag

SEQ ID NO: 3247944 - DNA, 16 bp, Homo sapiens
aactgcccccaacttt

SEQ ID NO: 3247945 - DNA, 13 bp, Homo sapiens
aactgcccccact

SEQ ID NO: 3247946 - DNA, 16 bp, Homo sapiens
aactgccgtaatttaa

SEQ ID NO: 3247947 - DNA, 16 bp, Homo sapiens
aactgcctactccaaa

SEQ ID NO: 3247948 - DNA, 15 bp, Homo sapiens
aactgcctctttcct

SEQ ID NO: 3247949 - DNA, 22 bp, Homo sapiens
aactgctaaattctatgttaaa

SEQ ID NO: 3247950 - DNA, 17 bp, Homo sapiens
aactgctcttgaacatt

SEQ ID NO: 3247951 - DNA, 12 bp, Homo sapiens
aactgctgagcc

SEQ ID NO: 3247952 - DNA, 23 bp, Homo sapiens
aactgctggacgtctttcttttt

SEQ ID NO: 3247953 - DNA, 21 bp, Homo sapiens
aactgctggagtctggcttta

SEQ ID NO: 3247954 - DNA, 15 bp, Homo sapiens
aactgctgtaaaatt

SEQ ID NO: 3247955 - DNA, 16 bp, Homo sapiens
aactgctgtaaacaca

SEQ ID NO: 3247956 - DNA, 15 bp, Homo sapiens
aactgctttcaagtc

SEQ ID NO: 3247957 - DNA, 14 bp, Homo sapiens
aactgctttctgtt

SEQ ID NO: 3247958 - DNA, 15 bp, Homo sapiens
aactgctttctgttc

SEQ ID NO: 3247959 - DNA, 21 bp, Homo sapiens
aactgcttttcctcaagcaat

SEQ ID NO: 3247960 - DNA, 14 bp, Homo sapiens
aactggaattaaaa

SEQ ID NO: 3247961 - DNA, 20 bp, Homo sapiens
aactggccccggatcagagc

SEQ ID NO: 3247962 - DNA, 18 bp, Homo sapiens
aactggccctatttagat

SEQ ID NO: 3247963 - DNA, 15 bp, Homo sapiens
aactggcctaaattt

SEQ ID NO: 3247964 - DNA, 18 bp, Homo sapiens
aactggcctaaatttctt

SEQ ID NO: 3247965 - DNA, 13 bp, Homo sapiens
aactgggataact

SEQ ID NO: 3247966 - DNA, 14 bp, Homo sapiens
aactgggataactg

SEQ ID NO: 3247967 - DNA, 19 bp, Homo sapiens
aactgggataactgatttc

SEQ ID NO: 3247968 - DNA, 15 bp, Homo sapiens
aactgggctgggcct

SEQ ID NO: 3247969 - DNA, 19 bp, Homo sapiens
aactggggctttgccttgc

SEQ ID NO: 3247970 - DNA, 20 bp, Homo sapiens
aactggggctttgccttgca

SEQ ID NO: 3247971 - DNA, 14 bp, Homo sapiens
aactgtaaagatgt

SEQ ID NO: 3247972 - DNA, 13 bp, Homo sapiens
aactgtaaataaa

SEQ ID NO: 3247973 - DNA, 12 bp, Homo sapiens
aactgtaaatca

SEQ ID NO: 3247974 - DNA, 14 bp, Homo sapiens
aactgtacatttaa

SEQ ID NO: 3247975 - DNA, 18 bp, Homo sapiens
aactgtacatttaaaatt

SEQ ID NO: 3247976 - DNA, 18 bp, Homo sapiens
aactgtacttttaaggca

SEQ ID NO: 3247977 - DNA, 16 bp, Homo sapiens
aactgtagaaatgatg

SEQ ID NO: 3247978 - DNA, 18 bp, Homo sapiens
aactgtagctcaagttta

SEQ ID NO: 3247979 - DNA, 19 bp, Homo sapiens
aactgtatgtgtgtaggtt

SEQ ID NO: 3247980 - DNA, 21 bp, Homo sapiens
tcccccaacccacctctggcc

SEQ ID NO: 3247981 - DNA, 15 bp, Homo sapiens
tcccccaaccccagc

SEQ ID NO: 3247982 - DNA, 12 bp, Homo sapiens
tcccccaactct

SEQ ID NO: 3247983 - DNA, 18 bp, Homo sapiens
tcccccaactctgagccc

SEQ ID NO: 3247984 - DNA, 19 bp, Homo sapiens
tcccccacagtttgatgtc

SEQ ID NO: 3247985 - DNA, 22 bp, Homo sapiens
tcccccaccagctaaggacatt

SEQ ID NO: 3247986 - DNA, 17 bp, Homo sapiens
tcccccaccctccatgc

SEQ ID NO: 3247987 - DNA, 19 bp, Homo sapiens
tcccccaccggtccagctg

SEQ ID NO: 3247988 - DNA, 19 bp, Homo sapiens
ggccccgggacccacggag

SEQ ID NO: 3247989 - DNA, 20 bp, Homo sapiens
ggccccgggacccacggagc

SEQ ID NO: 3247990 - DNA, 17 bp, Homo sapiens
ggccccgggctggagaa

SEQ ID NO: 3247991 - DNA, 18 bp, Homo sapiens
ggccccgggctggagaaa

SEQ ID NO: 3247992 - DNA, 15 bp, Homo sapiens
ggccccggggctggc

SEQ ID NO: 3247993 - DNA, 19 bp, Homo sapiens
ggccccggggctggcaagc

SEQ ID NO: 3247994 - DNA, 13 bp, Homo sapiens
ggcccctccacgc

SEQ ID NO: 3247995 - DNA, 18 bp, Homo sapiens
ggcccctccacgcctcct

SEQ ID NO: 3247996 - DNA, 17 bp, Homo sapiens
ggcccctcctagaccca

SEQ ID NO: 3247997 - DNA, 14 bp, Homo sapiens
ggcccctctgacct

SEQ ID NO: 3247998 - DNA, 20 bp, Homo sapiens
ggcccctcttattcctctag

SEQ ID NO: 3247999 - DNA, 13 bp, Homo sapiens
ggcccctgaggac

SEQ ID NO: 3248000 - DNA, 16 bp, Homo sapiens
ggcccctgccaccctg

SEQ ID NO: 3248001 - DNA, 18 bp, Homo sapiens
ggcccctgccaccctggg

SEQ ID NO: 3248002 - DNA, 13 bp, Homo sapiens
ggcccctgcccgg

SEQ ID NO: 3248003 - DNA, 12 bp, Homo sapiens
ggcccctggcag

SEQ ID NO: 3248004 - DNA, 21 bp, Homo sapiens
ggcccctggcagcacagccca

SEQ ID NO: 3248005 - DNA, 23 bp, Homo sapiens
ggcccctggcagcacagcccagg

SEQ ID NO: 3248006 - DNA, 20 bp, Homo sapiens
ggcccctgggatgggaccag

SEQ ID NO: 3248007 - DNA, 20 bp, Homo sapiens
ggcccctgggcttggcctgc

SEQ ID NO: 3248008 - DNA, 22 bp, Homo sapiens
ggcccctgggcttggcctgctg

SEQ ID NO: 3248009 - DNA, 22 bp, Homo sapiens
ggcccgcaccccggcctcaggg

SEQ ID NO: 3248010 - DNA, 15 bp, Homo sapiens
ggcccgcagtgctgg

SEQ ID NO: 3248011 - DNA, 15 bp, Homo sapiens
ggcccggatgctgct

SEQ ID NO: 3248012 - DNA, 14 bp, Homo sapiens
ggcccggcagggcg

SEQ ID NO: 3248013 - DNA, 20 bp, Homo sapiens
ggcccggccacacccagcgg

SEQ ID NO: 3248014 - DNA, 19 bp, Homo sapiens
ggcccggccagcgggcaca

SEQ ID NO: 3248015 - DNA, 22 bp, Homo sapiens
ggcccggccagcgggcacaggg

SEQ ID NO: 3248016 - DNA, 19 bp, Homo sapiens
ctatgttgcccaggcaggt

SEQ ID NO: 3248017 - DNA, 14 bp, Homo sapiens
ctatgtttgcactt

SEQ ID NO: 3248018 - DNA, 21 bp, Homo sapiens
ctatgtttgtctcacttttca

SEQ ID NO: 3248019 - DNA, 13 bp, Homo sapiens
ctatgtttgtgtg

SEQ ID NO: 3248020 - DNA, 17 bp, Homo sapiens
gttaatgtatataaaaa

SEQ ID NO: 3248021 - DNA, 11 bp, Homo sapiens
gttaatgtatt

SEQ ID NO: 3248022 - DNA, 20 bp, Homo sapiens
gttaatgtatttgttcatgt

SEQ ID NO: 3248023 - DNA, 23 bp, Homo sapiens
gttaatgtatttgttcatgtttg

SEQ ID NO: 3248024 - DNA, 15 bp, Homo sapiens
gttaatgttatatca

SEQ ID NO: 3248025 - DNA, 13 bp, Homo sapiens
gttaattcaccta

SEQ ID NO: 3248026 - DNA, 21 bp, Homo sapiens
gttaattcagcactgatttca

SEQ ID NO: 3248027 - DNA, 20 bp, Homo sapiens
gttaatttttccaactacta

SEQ ID NO: 3248028 - DNA, 13 bp, Homo sapiens
gttacaaactgca

SEQ ID NO: 3248029 - DNA, 15 bp, Homo sapiens
gttacaaactgcaat

SEQ ID NO: 3248030 - DNA, 16 bp, Homo sapiens
gttacaaactgcaata

SEQ ID NO: 3248031 - DNA, 21 bp, Homo sapiens
gttacaaactgcaatagagac

SEQ ID NO: 3248032 - DNA, 21 bp, Homo sapiens
gttacacactttttaagaaat

SEQ ID NO: 3248033 - DNA, 15 bp, Homo sapiens
tttctaactatataa

SEQ ID NO: 3248034 - DNA, 13 bp, Homo sapiens
tttctaagagaag

SEQ ID NO: 3248035 - DNA, 13 bp, Homo sapiens
tttctaagattct

SEQ ID NO: 3248036 - DNA, 15 bp, Homo sapiens
tttctaagattctaa

SEQ ID NO: 3248037 - DNA, 17 bp, Homo sapiens
tttctaagattctaaag

SEQ ID NO: 3248038 - DNA, 21 bp, Homo sapiens
tttctaaggaatgcacaaatt

SEQ ID NO: 3248039 - DNA, 13 bp, Homo sapiens
tttctaataaact

SEQ ID NO: 3248040 - DNA, 15 bp, Homo sapiens
tttctaatgtgtgaa

SEQ ID NO: 3248041 - DNA, 14 bp, Homo sapiens
tttctaatgtttct

SEQ ID NO: 3248042 - DNA, 15 bp, Homo sapiens
tttctaattaacctt

SEQ ID NO: 3248043 - DNA, 23 bp, Homo sapiens
tttctacaaagcactagagaatg

SEQ ID NO: 3248044 - DNA, 21 bp, Homo sapiens
tttctacaatgtgaactttat

SEQ ID NO: 3248045 - DNA, 21 bp, Homo sapiens
tttctacaattaatagtttgt

SEQ ID NO: 3248046 - DNA, 15 bp, Homo sapiens
tttctacatgactgg

SEQ ID NO: 3248047 - DNA, 19 bp, Homo sapiens
tttctacatgactgggcct

SEQ ID NO: 3248048 - DNA, 21 bp, Homo sapiens
tttctacccaacggccctgca

SEQ ID NO: 3248049 - DNA, 22 bp, Homo sapiens
tttctacccagcgagccctggt

SEQ ID NO: 3248050 - DNA, 15 bp, Homo sapiens
tttctaccctagcca

SEQ ID NO: 3248051 - DNA, 15 bp, Homo sapiens
tttctactctgaact

SEQ ID NO: 3248052 - DNA, 17 bp, Homo sapiens
tttctactctgaactaa

SEQ ID NO: 3248053 - DNA, 13 bp, Homo sapiens
tttctagaaagag

SEQ ID NO: 3248054 - DNA, 16 bp, Homo sapiens
ttttacaagatccatt

SEQ ID NO: 3248055 - DNA, 18 bp, Homo sapiens
ttttacaataaataatct

SEQ ID NO: 3248056 - DNA, 14 bp, Homo sapiens
ttttacacagcacc

SEQ ID NO: 3248057 - DNA, 16 bp, Homo sapiens
ttttacagctgcctgc

SEQ ID NO: 3248058 - DNA, 18 bp, Homo sapiens
ttttacagtatccaaaaa

SEQ ID NO: 3248059 - DNA, 21 bp, Homo sapiens
ttttacatttggattagaaat

SEQ ID NO: 3248060 - DNA, 16 bp, Homo sapiens
ttttaccaaagcatca

SEQ ID NO: 3248061 - DNA, 19 bp, Homo sapiens
ttttacctaccacagtgtc

SEQ ID NO: 3248062 - DNA, 20 bp, Homo sapiens
ttttacctaccacagtgtct

SEQ ID NO: 3248063 - DNA, 19 bp, Homo sapiens
ttttactaagttttcaaat

SEQ ID NO: 3248064 - DNA, 22 bp, Homo sapiens
ttttactaccaatgccaagata

SEQ ID NO: 3248065 - DNA, 20 bp, Homo sapiens
ttttactcattgaaatgtca

SEQ ID NO: 3248066 - DNA, 22 bp, Homo sapiens
ttttactctatgccccaaatat

SEQ ID NO: 3248067 - DNA, 12 bp, Homo sapiens
ttttactctgcc

SEQ ID NO: 3248068 - DNA, 13 bp, Homo sapiens
ttttactctgcct

SEQ ID NO: 3248069 - DNA, 22 bp, Homo sapiens
ttttactctgcctacagaactt

SEQ ID NO: 3248070 - DNA, 14 bp, Homo sapiens
ttttactgaacaat

SEQ ID NO: 3248071 - DNA, 17 bp, Homo sapiens
ttttactgtcagattaa

SEQ ID NO: 3248072 - DNA, 13 bp, Homo sapiens
ttttactgtctat

SEQ ID NO: 3248073 - DNA, 21 bp, Homo sapiens
ttttagacagtctcactttgt

SEQ ID NO: 3248074 - DNA, 20 bp, Homo sapiens
ttttagattgagaaatgtgt

SEQ ID NO: 3248075 - DNA, 11 bp, Homo sapiens
ttttagcattt

SEQ ID NO: 3248076 - DNA, 18 bp, Homo sapiens
ttttagccagagatgcaa

SEQ ID NO: 3248077 - DNA, 19 bp, Homo sapiens
ttttagccataattttgca

SEQ ID NO: 3248078 - DNA, 20 bp, Homo sapiens
ttttaggaaaatcactttgt

SEQ ID NO: 3248079 - DNA, 23 bp, Homo sapiens
ttttaggagctaaggctctatga

SEQ ID NO: 3248080 - DNA, 17 bp, Homo sapiens
ttttaggcactcttaaa

SEQ ID NO: 3248081 - DNA, 16 bp, Homo sapiens
ttttaggctgttcctt

SEQ ID NO: 3248082 - DNA, 15 bp, Homo sapiens
ttttaggcttgaaat

SEQ ID NO: 3248083 - DNA, 15 bp, Homo sapiens
ttttaggtagaaaaa

SEQ ID NO: 3248084 - DNA, 15 bp, Homo sapiens
ttttaggttctaaag

SEQ ID NO: 3248085 - DNA, 16 bp, Homo sapiens
ttttaggttctaaagt

SEQ ID NO: 3248086 - DNA, 14 bp, Homo sapiens
ttttagtaagttaa

SEQ ID NO: 3248087 - DNA, 14 bp, Homo sapiens
ttttagtaatctgt

SEQ ID NO: 3248088 - DNA, 16 bp, Homo sapiens
ttttagtaatctgtac

SEQ ID NO: 3248089 - DNA, 14 bp, Homo sapiens
ttttagtaatttct

SEQ ID NO: 3248090 - DNA, 15 bp, Homo sapiens
ttttagtagagacag

SEQ ID NO: 3248091 - DNA, 13 bp, Homo sapiens
ttttagtccaaat

SEQ ID NO: 3248092 - DNA, 14 bp, Homo sapiens
ttttagtgcttttg

SEQ ID NO: 3248093 - DNA, 18 bp, Homo sapiens
ttttagtgtgtgcataat

SEQ ID NO: 3248094 - DNA, 14 bp, Homo sapiens
ttttataaaaagat

SEQ ID NO: 3248095 - DNA, 20 bp, Homo sapiens
ttttataaatataagccttt

SEQ ID NO: 3248096 - DNA, 21 bp, Homo sapiens
ttttataacatctttattgaa

SEQ ID NO: 3248097 - DNA, 19 bp, Homo sapiens
ttttatactgcacagtggc

SEQ ID NO: 3248098 - DNA, 19 bp, Homo sapiens
ttttatagcttaactaatt

SEQ ID NO: 3248099 - DNA, 18 bp, Homo sapiens
ttttataggaaaaaaact

SEQ ID NO: 3248100 - DNA, 15 bp, Homo sapiens
ttttataggagagat

SEQ ID NO: 3248101 - DNA, 13 bp, Homo sapiens
ttttatatctttt

SEQ ID NO: 3248102 - DNA, 17 bp, Homo sapiens
ttttatatgatggggga

SEQ ID NO: 3248103 - DNA, 13 bp, Homo sapiens
ttttatatgcttt

SEQ ID NO: 3248104 - DNA, 17 bp, Homo sapiens
ttttatattaaaataag

SEQ ID NO: 3248105 - DNA, 17 bp, Homo sapiens
ttttatattaatgtact

SEQ ID NO: 3248106 - DNA, 19 bp, Homo sapiens
ttttatattactgacattt

SEQ ID NO: 3248107 - DNA, 21 bp, Homo sapiens
ttttatattgtttttgtattt

SEQ ID NO: 3248108 - DNA, 12 bp, Homo sapiens
ttttatatttaa

SEQ ID NO: 3248109 - DNA, 13 bp, Homo sapiens
ttttatatttaaa

SEQ ID NO: 3248110 - DNA, 23 bp, Homo sapiens
ttttatatttagttatagtttca

SEQ ID NO: 3248111 - DNA, 12 bp, Homo sapiens
ttttatatttgt

SEQ ID NO: 3248112 - DNA, 13 bp, Homo sapiens
ttttatatttgta

SEQ ID NO: 3248113 - DNA, 13 bp, Homo sapiens
ttttatcatgaat

SEQ ID NO: 3248114 - DNA, 14 bp, Homo sapiens
ttttatcatgaatt

SEQ ID NO: 3248115 - DNA, 17 bp, Homo sapiens
ttttatcatgacatgtt

SEQ ID NO: 3248116 - DNA, 16 bp, Homo sapiens
ttttatcatgcatgtc

SEQ ID NO: 3248117 - DNA, 13 bp, Homo sapiens
ttttatctgcaga

SEQ ID NO: 3248118 - DNA, 18 bp, Homo sapiens
ttttatctggtgcctcct

SEQ ID NO: 3248119 - DNA, 14 bp, Homo sapiens
ttttatgaagaaaa

SEQ ID NO: 3248120 - DNA, 24 bp, Homo sapiens
ttttatgctcttttttactcattg

SEQ ID NO: 3248121 - DNA, 20 bp, Homo sapiens
ttttatggttccaatgaaat

SEQ ID NO: 3248122 - DNA, 21 bp, Homo sapiens
ttttatggttccaatgaaata

SEQ ID NO: 3248123 - DNA, 17 bp, Homo sapiens
ttttattaaacattttc

SEQ ID NO: 3248124 - DNA, 22 bp, Homo sapiens
ttttattaagctttttggaatc

SEQ ID NO: 3248125 - DNA, 13 bp, Homo sapiens
ttttattaattta

SEQ ID NO: 3248126 - DNA, 16 bp, Homo sapiens
ttttattataaattct

SEQ ID NO: 3248127 - DNA, 14 bp, Homo sapiens
ttttattatgagct

SEQ ID NO: 3248128 - DNA, 14 bp, Homo sapiens
ttttattatgcatt

SEQ ID NO: 3248129 - DNA, 12 bp, Homo sapiens
ttttattattgt

SEQ ID NO: 3248130 - DNA, 14 bp, Homo sapiens
ttttattattgtgg

SEQ ID NO: 3248131 - DNA, 14 bp, Homo sapiens
ttttattcaagtta

SEQ ID NO: 3248132 - DNA, 14 bp, Homo sapiens
ttttattctgactt

SEQ ID NO: 3248133 - DNA, 13 bp, Homo sapiens
ttttattcttttt

SEQ ID NO: 3248134 - DNA, 18 bp, Homo sapiens
ttttattgacacagaaaa

SEQ ID NO: 3248135 - DNA, 14 bp, Homo sapiens
ttttatttctaagt

SEQ ID NO: 3248136 - DNA, 13 bp, Homo sapiens
ttttatttctcgg

SEQ ID NO: 3248137 - DNA, 15 bp, Homo sapiens
ttttatttgcatgtg

SEQ ID NO: 3248138 - DNA, 11 bp, Homo sapiens
ttttattttac

SEQ ID NO: 3248139 - DNA, 12 bp, Homo sapiens
ttttattttgct

SEQ ID NO: 3248140 - DNA, 14 bp, Homo sapiens
ttttattttgctga

SEQ ID NO: 3248141 - DNA, 15 bp, Homo sapiens
ttttattttgctgag

SEQ ID NO: 3248142 - DNA, 20 bp, Homo sapiens
ttttattttgctgagttgtt

SEQ ID NO: 3248143 - DNA, 13 bp, Homo sapiens
ttttatttttcta

SEQ ID NO: 3248144 - DNA, 12 bp, Homo sapiens
ttttatttttga

SEQ ID NO: 3248145 - DNA, 17 bp, Homo sapiens
ttttcaacgcagccctg

SEQ ID NO: 3248146 - DNA, 14 bp, Homo sapiens
ttttcaagaaatga

SEQ ID NO: 3248147 - DNA, 13 bp, Homo sapiens
ttttcaaggaagg

SEQ ID NO: 3248148 - DNA, 21 bp, Homo sapiens
ttttcaagtttacacttcata

SEQ ID NO: 3248149 - DNA, 13 bp, Homo sapiens
ttttcaatatgca

SEQ ID NO: 3248150 - DNA, 17 bp, Homo sapiens
ttttcaatatgcaagca

SEQ ID NO: 3248151 - DNA, 23 bp, Homo sapiens
ttttcaatcaactttactgtaat

SEQ ID NO: 3248152 - DNA, 18 bp, Homo sapiens
ttttcaatgaattttata

SEQ ID NO: 3248153 - DNA, 11 bp, Homo sapiens
ttttcaatgtg

SEQ ID NO: 3248154 - DNA, 20 bp, Homo sapiens
ttttcacaatgtcagtattt

SEQ ID NO: 3248155 - DNA, 12 bp, Homo sapiens
ttttcacatttt

SEQ ID NO: 3248156 - DNA, 21 bp, Homo sapiens
ttttcactggagttacattaa

SEQ ID NO: 3248157 - DNA, 13 bp, Homo sapiens
ttttcacttctgt

SEQ ID NO: 3248158 - DNA, 14 bp, Homo sapiens
ttttcacttgtatt

SEQ ID NO: 3248159 - DNA, 18 bp, Homo sapiens
ttttcactttgtgattat

SEQ ID NO: 3248160 - DNA, 15 bp, Homo sapiens
ttttcagaaaatatt

SEQ ID NO: 3248161 - DNA, 17 bp, Homo sapiens
ttttcagaacctcttcc

SEQ ID NO: 3248162 - DNA, 18 bp, Homo sapiens
ttttcagaacctcttccc

SEQ ID NO: 3248163 - DNA, 22 bp, Homo sapiens
ttttcagagatttatataaatg

SEQ ID NO: 3248164 - DNA, 13 bp, Homo sapiens
ttttcagctgagc

SEQ ID NO: 3248165 - DNA, 15 bp, Homo sapiens
ttttcagtatactgt

SEQ ID NO: 3248166 - DNA, 18 bp, Homo sapiens
ttttcagtatactgtgtg

SEQ ID NO: 3248167 - DNA, 19 bp, Homo sapiens
ttttcagtatactgtgtgg

SEQ ID NO: 3248168 - DNA, 12 bp, Homo sapiens
ttttcagttgtt

SEQ ID NO: 3248169 - DNA, 15 bp, Homo sapiens
ttttcagttgttctt

SEQ ID NO: 3248170 - DNA, 13 bp, Homo sapiens
ttttcatattgtg

SEQ ID NO: 3248171 - DNA, 16 bp, Homo sapiens
ttttcatattgtgcca

SEQ ID NO: 3248172 - DNA, 19 bp, Homo sapiens
ttttcatattgtgccaata

SEQ ID NO: 3248173 - DNA, 13 bp, Homo sapiens
ttttcatgaaaat

SEQ ID NO: 3248174 - DNA, 19 bp, Homo sapiens
ttttcatggaagtggcagt

SEQ ID NO: 3248175 - DNA, 20 bp, Homo sapiens
ttttcatggcccttcaaatt

SEQ ID NO: 3248176 - DNA, 13 bp, Homo sapiens
ttttcattaaact

SEQ ID NO: 3248177 - DNA, 16 bp, Homo sapiens
ttttcatttgcctatt

SEQ ID NO: 3248178 - DNA, 11 bp, Homo sapiens
ttttcatttgt

SEQ ID NO: 3248179 - DNA, 15 bp, Homo sapiens
ttttccaaaataatt

SEQ ID NO: 3248180 - DNA, 19 bp, Homo sapiens
ttttccaaagagtgatagt

SEQ ID NO: 3248181 - DNA, 18 bp, Homo sapiens
ttttccaactactaatag

SEQ ID NO: 3248182 - DNA, 19 bp, Homo sapiens
ttttggcaaaactctactt

SEQ ID NO: 3248183 - DNA, 19 bp, Homo sapiens
ttttggcactgagatattt

SEQ ID NO: 3248184 - DNA, 22 bp, Homo sapiens
ttttggcacttgccattccaaa

SEQ ID NO: 3248185 - DNA, 16 bp, Homo sapiens
ttttggcctgtttgat

SEQ ID NO: 3248186 - DNA, 17 bp, Homo sapiens
ttttggcgaatctcaaa

SEQ ID NO: 3248187 - DNA, 22 bp, Homo sapiens
ttttggctgaaattctcctgga

SEQ ID NO: 3248188 - DNA, 17 bp, Homo sapiens
ttttggcttcatttcaa

SEQ ID NO: 3248189 - DNA, 11 bp, Homo sapiens
ttttgggactt

SEQ ID NO: 3248190 - DNA, 12 bp, Homo sapiens
ttttgggatgtc

SEQ ID NO: 3248191 - DNA, 18 bp, Homo sapiens
ttttggggaaaaaagcac

SEQ ID NO: 3248192 - DNA, 19 bp, Homo sapiens
ttttggggaaaaaagcaca

SEQ ID NO: 3248193 - DNA, 15 bp, Homo sapiens
ttttggggagccaga

SEQ ID NO: 3248194 - DNA, 19 bp, Homo sapiens
ttttgggggtttttaatct

SEQ ID NO: 3248195 - DNA, 19 bp, Homo sapiens
ttttggggttgtgttgtca

SEQ ID NO: 3248196 - DNA, 23 bp, Homo sapiens
ttttggtattacactgtatttgt

SEQ ID NO: 3248197 - DNA, 15 bp, Homo sapiens
ttttggtctgtgtga

SEQ ID NO: 3248198 - DNA, 14 bp, Homo sapiens
ttttggtggatgta

SEQ ID NO: 3248199 - DNA, 14 bp, Homo sapiens
ttttggttaagttg

SEQ ID NO: 3248200 - DNA, 18 bp, Homo sapiens
ttttgtaaactcaaaata

SEQ ID NO: 3248201 - DNA, 19 bp, Homo sapiens
ttttgtaaagaaatttact

SEQ ID NO: 3248202 - DNA, 11 bp, Homo sapiens
ttttgtaacta

SEQ ID NO: 3248203 - DNA, 14 bp, Homo sapiens
ttttgtacaattac

SEQ ID NO: 3248204 - DNA, 17 bp, Homo sapiens
ttttgtacaattactaa

SEQ ID NO: 3248205 - DNA, 11 bp, Homo sapiens
ttttgtacata

SEQ ID NO: 3248206 - DNA, 18 bp, Homo sapiens
ttttgtacatctggctta

SEQ ID NO: 3248207 - DNA, 15 bp, Homo sapiens
ttttgtactgaatct

SEQ ID NO: 3248208 - DNA, 16 bp, Homo sapiens
ttttgtactgtaaaga

SEQ ID NO: 3248209 - DNA, 22 bp, Homo sapiens
ttttgtaggggtcaaagaaatg

SEQ ID NO: 3248210 - DNA, 19 bp, Homo sapiens
ttttgtatacaaatatatt

SEQ ID NO: 3248211 - DNA, 17 bp, Homo sapiens
ttttgtatatacagtta

SEQ ID NO: 3248212 - DNA, 19 bp, Homo sapiens
ttttgtatatacagttatt

SEQ ID NO: 3248213 - DNA, 22 bp, Homo sapiens
ttttgtatatacagttattttg

SEQ ID NO: 3248214 - DNA, 14 bp, Homo sapiens
ttttgtatcttggg

SEQ ID NO: 3248215 - DNA, 18 bp, Homo sapiens
ttttgtatgttatgaaca

SEQ ID NO: 3248216 - DNA, 18 bp, Homo sapiens
ttttgtattttcatgaaa

SEQ ID NO: 3248217 - DNA, 18 bp, Homo sapiens
ttttgtatttttaatggg

SEQ ID NO: 3248218 - DNA, 18 bp, Homo sapiens
ttttgtcactttttctga

SEQ ID NO: 3248219 - DNA, 16 bp, Homo sapiens
ttttgtcatataagat

SEQ ID NO: 3248220 - DNA, 23 bp, Homo sapiens
ttttgtcccattttccccttcct

SEQ ID NO: 3248221 - DNA, 24 bp, Homo sapiens
ttttgtgaaatgaaaacatgtaat

SEQ ID NO: 3248222 - DNA, 14 bp, Homo sapiens
ttttgtgaactttt

SEQ ID NO: 3248223 - DNA, 18 bp, Homo sapiens
ttttgtgaagtattcaca

SEQ ID NO: 3248224 - DNA, 18 bp, Homo sapiens
ttttgtgatgatgctgtg

SEQ ID NO: 3248225 - DNA, 16 bp, Homo sapiens
ttttgtgatttagaac

SEQ ID NO: 3248226 - DNA, 19 bp, Homo sapiens
ttttgtgatttagaactgt

SEQ ID NO: 3248227 - DNA, 22 bp, Homo sapiens
ttttgtgcaaaagcttcaaatt

SEQ ID NO: 3248228 - DNA, 12 bp, Homo sapiens
ttttgtgcattt

SEQ ID NO: 3248229 - DNA, 22 bp, Homo sapiens
ttttgtgcatttgtaaatgctg

SEQ ID NO: 3248230 - DNA, 22 bp, Homo sapiens
ttttgtgctcaaaataaaaagc

SEQ ID NO: 3248231 - DNA, 15 bp, Homo sapiens
ttttgtgctgcttct

SEQ ID NO: 3248232 - DNA, 17 bp, Homo sapiens
ttttgtggtttggaata

SEQ ID NO: 3248233 - DNA, 16 bp, Homo sapiens
ttttgtgtatgtactt

SEQ ID NO: 3248234 - DNA, 17 bp, Homo sapiens
ttttgtgtatgtactta

SEQ ID NO: 3248235 - DNA, 14 bp, Homo sapiens
ttttgtgtgaaatt

SEQ ID NO: 3248236 - DNA, 15 bp, Homo sapiens
ttttgtgtgaaattg

SEQ ID NO: 3248237 - DNA, 22 bp, Homo sapiens
ttttgtgtgcctggtagaaact

SEQ ID NO: 3248238 - DNA, 13 bp, Homo sapiens
ttttgttaaagct

SEQ ID NO: 3248239 - DNA, 16 bp, Homo sapiens
ttttgttacctttatg

SEQ ID NO: 3248240 - DNA, 14 bp, Homo sapiens
ttttgttactgttc

SEQ ID NO: 3248241 - DNA, 16 bp, Homo sapiens
ttttgttactgttctt

SEQ ID NO: 3248242 - DNA, 20 bp, Homo sapiens
ttttgttactgttcttgctg

SEQ ID NO: 3248243 - DNA, 12 bp, Homo sapiens
ttttgttataga

SEQ ID NO: 3248244 - DNA, 16 bp, Homo sapiens
ttttgttatagaatac

SEQ ID NO: 3248245 - DNA, 14 bp, Homo sapiens
ttttgttattccat

SEQ ID NO: 3248246 - DNA, 18 bp, Homo sapiens
ttttgttcaatgttccat

SEQ ID NO: 3248247 - DNA, 20 bp, Homo sapiens
ttttgttccaatgtcaatgt

SEQ ID NO: 3248248 - DNA, 15 bp, Homo sapiens
ttttgttctgtattt

SEQ ID NO: 3248249 - DNA, 20 bp, Homo sapiens
ttttgtttgatgcaggcact

SEQ ID NO: 3248250 - DNA, 15 bp, Homo sapiens
ttttgtttgccagga

SEQ ID NO: 3248251 - DNA, 20 bp, Homo sapiens
ttttgtttgtctctcctttt

SEQ ID NO: 3248252 - DNA, 12 bp, Homo sapiens
ttttgttttgca

SEQ ID NO: 3248253 - DNA, 15 bp, Homo sapiens
ttttgttttgttgga

SEQ ID NO: 3248254 - DNA, 16 bp, Homo sapiens
ttttgtttttgcatga

SEQ ID NO: 3248255 - DNA, 16 bp, Homo sapiens
ttttgtttttgtaatg

SEQ ID NO: 3248256 - DNA, 14 bp, Homo sapiens
tttttaaaaaaaga

SEQ ID NO: 3248257 - DNA, 19 bp, Homo sapiens
tttttaaaaaatattttct

SEQ ID NO: 3248258 - DNA, 12 bp, Homo sapiens
tttttaaaattt

SEQ ID NO: 3248259 - DNA, 19 bp, Homo sapiens
tttttaaacaaacattgtg

SEQ ID NO: 3248260 - DNA, 12 bp, Homo sapiens
tttttaaagatc

SEQ ID NO: 3248261 - DNA, 12 bp, Homo sapiens
tttttaaagcaa

SEQ ID NO: 3248262 - DNA, 18 bp, Homo sapiens
tttttaaataaaagcaca

SEQ ID NO: 3248263 - DNA, 20 bp, Homo sapiens
tttttaaattttatttcctg

SEQ ID NO: 3248264 - DNA, 23 bp, Homo sapiens
tttttaactgattcttatgatta

SEQ ID NO: 3248265 - DNA, 17 bp, Homo sapiens
tttttaagaatatctgt

SEQ ID NO: 3248266 - DNA, 18 bp, Homo sapiens
tttttaagaatatctgta

SEQ ID NO: 3248267 - DNA, 13 bp, Homo sapiens
tttttaagatttt

SEQ ID NO: 3248268 - DNA, 18 bp, Homo sapiens
tttttaagctgtttccat

SEQ ID NO: 3248269 - DNA, 16 bp, Homo sapiens
tttttaagcttcagtt

SEQ ID NO: 3248270 - DNA, 14 bp, Homo sapiens
tttttaatttaaca

SEQ ID NO: 3248271 - DNA, 21 bp, Homo sapiens
tttttaatttaacaaactaaa

SEQ ID NO: 3248272 - DNA, 21 bp, Homo sapiens
tttttaatttattattgaaat

SEQ ID NO: 3248273 - DNA, 22 bp, Homo sapiens
tttttaatttgatgaaagctga

SEQ ID NO: 3248274 - DNA, 19 bp, Homo sapiens
tttttaattttgtgttgct

SEQ ID NO: 3248275 - DNA, 21 bp, Homo sapiens
tttttacagcattgtctttgc

SEQ ID NO: 3248276 - DNA, 22 bp, Homo sapiens
tttttacagcattgtctttgct

SEQ ID NO: 3248277 - DNA, 17 bp, Homo sapiens
tttttactcattgaaat

SEQ ID NO: 3248278 - DNA, 21 bp, Homo sapiens
tttttactcattgaaatgtca

SEQ ID NO: 3248279 - DNA, 22 bp, Homo sapiens
tttttacttaacaaccaacttg

SEQ ID NO: 3248280 - DNA, 20 bp, Homo sapiens
tttttagatgaccaaaactt

SEQ ID NO: 3248281 - DNA, 19 bp, Homo sapiens
tttttagattgagaaatgt

SEQ ID NO: 3248282 - DNA, 21 bp, Homo sapiens
tttttagtggaagcttctaaa

SEQ ID NO: 3248283 - DNA, 12 bp, Homo sapiens
tttttagttaaa

SEQ ID NO: 3248284 - DNA, 18 bp, Homo sapiens
tttttagttcaatacagt

SEQ ID NO: 3248285 - DNA, 18 bp, Homo sapiens
tttttatatagcttgaaa

SEQ ID NO: 3248286 - DNA, 14 bp, Homo sapiens
tttttatatataca

SEQ ID NO: 3248287 - DNA, 15 bp, Homo sapiens
tttttatatttagtt

SEQ ID NO: 3248288 - DNA, 17 bp, Homo sapiens
tttttatcatgcatgtc

SEQ ID NO: 3248289 - DNA, 17 bp, Homo sapiens
tttttatcttgggactg

SEQ ID NO: 3248290 - DNA, 19 bp, Homo sapiens
tttttatgaagaaaaagta

SEQ ID NO: 3248291 - DNA, 12 bp, Homo sapiens
tttttatgtgat

SEQ ID NO: 3248292 - DNA, 16 bp, Homo sapiens
tttttatgtgatcaat

SEQ ID NO: 3248293 - DNA, 14 bp, Homo sapiens
tttttattaattta

SEQ ID NO: 3248294 - DNA, 13 bp, Homo sapiens
tttttatttacat

SEQ ID NO: 3248295 - DNA, 12 bp, Homo sapiens
tttttatttcta

SEQ ID NO: 3248296 - DNA, 18 bp, Homo sapiens
tttttattttaggcactg

SEQ ID NO: 3248297 - DNA, 9 bp, Homo sapiens
tttttcaac

SEQ ID NO: 3248298 - DNA, 14 bp, Homo sapiens
tttttcaagagatc

SEQ ID NO: 3248299 - DNA, 13 bp, Homo sapiens
tttttcaaggaag

SEQ ID NO: 3248300 - DNA, 13 bp, Homo sapiens
tttcaaaaatgct

SEQ ID NO: 3248301 - DNA, 23 bp, Homo sapiens
tttcaaaaatgctgttaatgtat

SEQ ID NO: 3248302 - DNA, 13 bp, Homo sapiens
tttcaaaagacat

SEQ ID NO: 3248303 - DNA, 20 bp, Homo sapiens
tttcaaaaggtattatacat

SEQ ID NO: 3248304 - DNA, 13 bp, Homo sapiens
tttcaaaatatat

SEQ ID NO: 3248305 - DNA, 13 bp, Homo sapiens
tttcaaaatgctt

SEQ ID NO: 3248306 - DNA, 16 bp, Homo sapiens
tttcaaacttactatt

SEQ ID NO: 3248307 - DNA, 23 bp, Homo sapiens
tttcaaagacaatcactgaaaca

SEQ ID NO: 3248308 - DNA, 22 bp, Homo sapiens
tttcaaagctaaaatatataat

SEQ ID NO: 3248309 - DNA, 21 bp, Homo sapiens
tttcaaagtaaaggcctcctc

SEQ ID NO: 3248310 - DNA, 12 bp, Homo sapiens
tttcaaagtttt

SEQ ID NO: 3248311 - DNA, 16 bp, Homo sapiens
tttcaacatgagtgta

SEQ ID NO: 3248312 - DNA, 16 bp, Homo sapiens
tttcaacgcagccctg

SEQ ID NO: 3248313 - DNA, 21 bp, Homo sapiens
tttcaacgcagccctgctttg

SEQ ID NO: 3248314 - DNA, 20 bp, Homo sapiens
tttcaagcagcatcttctgg

SEQ ID NO: 3248315 - DNA, 22 bp, Homo sapiens
tttcaagcagtcgtgcctgtgt

SEQ ID NO: 3248316 - DNA, 17 bp, Homo sapiens
tttcaaggaaggttcat

SEQ ID NO: 3248317 - DNA, 18 bp, Homo sapiens
tttcaaggcactctagat

SEQ ID NO: 3248318 - DNA, 15 bp, Homo sapiens
tttcaaggtttgtgc

SEQ ID NO: 3248319 - DNA, 20 bp, Homo sapiens
tttcaagtcaaattaataat

SEQ ID NO: 3248320 - DNA, 19 bp, Homo sapiens
tttcaagtctgactctcca

SEQ ID NO: 3248321 - DNA, 15 bp, Homo sapiens
tttcaagtgcctaga

SEQ ID NO: 3248322 - DNA, 21 bp, Homo sapiens
tttcaagtgcctagactgtta

SEQ ID NO: 3248323 - DNA, 23 bp, Homo sapiens
tttcaagtgcctagactgttact

SEQ ID NO: 3248324 - DNA, 18 bp, Homo sapiens
tttcaagttattcaaatt

SEQ ID NO: 3248325 - DNA, 12 bp, Homo sapiens
tttcaagtttac

SEQ ID NO: 3248326 - DNA, 17 bp, Homo sapiens
tttcaagttttaaagtt

SEQ ID NO: 3248327 - DNA, 22 bp, Homo sapiens
tttcaataaaagataaattatt

SEQ ID NO: 3248328 - DNA, 17 bp, Homo sapiens
tttcaatactgtcccac

SEQ ID NO: 3248329 - DNA, 12 bp, Homo sapiens
tttcaatatgca

SEQ ID NO: 3248330 - DNA, 20 bp, Homo sapiens
tttcaatcaactttactgta

SEQ ID NO: 3248331 - DNA, 22 bp, Homo sapiens
tttcaatcaactttactgtaat

SEQ ID NO: 3248332 - DNA, 21 bp, Homo sapiens
tttcaatcactgtcctccaca

SEQ ID NO: 3248333 - DNA, 23 bp, Homo sapiens
tttcaatcactgtcctccacaca

SEQ ID NO: 3248334 - DNA, 13 bp, Homo sapiens
tttcaatcattga

SEQ ID NO: 3248335 - DNA, 18 bp, Homo sapiens
tttcaatcattgaagtat

SEQ ID NO: 3248336 - DNA, 14 bp, Homo sapiens
tttcaatgacattt

SEQ ID NO: 3248337 - DNA, 16 bp, Homo sapiens
tttcaatgtagtctgt

SEQ ID NO: 3248338 - DNA, 22 bp, Homo sapiens
tttcaatgtgattctaatgtct

SEQ ID NO: 3248339 - DNA, 19 bp, Homo sapiens
tttcaatgtgtataaattg

SEQ ID NO: 3248340 - DNA, 21 bp, Homo sapiens
tttcaattcagattgtcttgc

SEQ ID NO: 3248341 - DNA, 14 bp, Homo sapiens
tttcaattgacaaa

SEQ ID NO: 3248342 - DNA, 15 bp, Homo sapiens
tttcaattgacaaat

SEQ ID NO: 3248343 - DNA, 13 bp, Homo sapiens
tttcacaacattt

SEQ ID NO: 3248344 - DNA, 20 bp, Homo sapiens
tttcacaccggaaggttttt

SEQ ID NO: 3248345 - DNA, 13 bp, Homo sapiens
tttcacagctcct

SEQ ID NO: 3248346 - DNA, 18 bp, Homo sapiens
tttcacaggctgtaaatt

SEQ ID NO: 3248347 - DNA, 20 bp, Homo sapiens
tttcacaggctgtaaattga

SEQ ID NO: 3248348 - DNA, 18 bp, Homo sapiens
tttcacatagctgtctag

SEQ ID NO: 3248349 - DNA, 16 bp, Homo sapiens
tttcacattcttggct

SEQ ID NO: 3248350 - DNA, 16 bp, Homo sapiens
tttcacattgaatcat

SEQ ID NO: 3248351 - DNA, 15 bp, Homo sapiens
tttcacattgtttgc

SEQ ID NO: 3248352 - DNA, 22 bp, Homo sapiens
tttcacattttttttctttttc

SEQ ID NO: 3248353 - DNA, 19 bp, Homo sapiens
tttcaccaaaatttctaca

SEQ ID NO: 3248354 - DNA, 16 bp, Homo sapiens
tttcacctgtgacaaa

SEQ ID NO: 3248355 - DNA, 22 bp, Homo sapiens
tttcacctgtttttaagctgtt

SEQ ID NO: 3248356 - DNA, 20 bp, Homo sapiens
tttcacgcctgaggcaatta

SEQ ID NO: 3248357 - DNA, 16 bp, Homo sapiens
tttcacgtcttggtgc

SEQ ID NO: 3248358 - DNA, 21 bp, Homo sapiens
tttcactagagacaaatcttt

SEQ ID NO: 3248359 - DNA, 15 bp, Homo sapiens
tttcactaggaaaat

SEQ ID NO: 3248360 - DNA, 19 bp, Homo sapiens
tttcactatcttcttcaaa

SEQ ID NO: 3248361 - DNA, 18 bp, Homo sapiens
tttcactgctggctgcct

SEQ ID NO: 3248362 - DNA, 24 bp, Homo sapiens
tttcactgctggctgccttagaac

SEQ ID NO: 3248363 - DNA, 17 bp, Homo sapiens
tttcactggagttacat

SEQ ID NO: 3248364 - DNA, 18 bp, Homo sapiens
tttcactggagttacatt

SEQ ID NO: 3248365 - DNA, 24 bp, Homo sapiens
tttcactgtagaatgatttcatgc

SEQ ID NO: 3248366 - DNA, 15 bp, Homo sapiens
tttcacttaaggaga

SEQ ID NO: 3248367 - DNA, 18 bp, Homo sapiens
tttcacttgaaagatttt

SEQ ID NO: 3248368 - DNA, 23 bp, Homo sapiens
tttcacttgaaagattttattgt

SEQ ID NO: 3248369 - DNA, 13 bp, Homo sapiens
tttcacttgtatt

SEQ ID NO: 3248370 - DNA, 17 bp, Homo sapiens
tttcacttgtattgact

SEQ ID NO: 3248371 - DNA, 19 bp, Homo sapiens
tttcacttgtattgacttt

SEQ ID NO: 3248372 - DNA, 12 bp, Homo sapiens
tttcactttaga

SEQ ID NO: 3248373 - DNA, 21 bp, Homo sapiens
tttcactttcacatagatgtc

SEQ ID NO: 3248374 - DNA, 22 bp, Homo sapiens
tttcactttgctctcaattaaa

SEQ ID NO: 3248375 - DNA, 16 bp, Homo sapiens
tttcacttttgttctg

SEQ ID NO: 3248376 - DNA, 22 bp, Homo sapiens
tttcagaaatataacacatttt

SEQ ID NO: 3248377 - DNA, 17 bp, Homo sapiens
tttcagaatctgaatgt

SEQ ID NO: 3248378 - DNA, 20 bp, Homo sapiens
tttcagagaccttaatttat

SEQ ID NO: 3248379 - DNA, 22 bp, Homo sapiens
tttcagagtgactacacacagt

SEQ ID NO: 3248380 - DNA, 15 bp, Homo sapiens
tttcagatatatatc

SEQ ID NO: 3248381 - DNA, 16 bp, Homo sapiens
tttcagatatcaaaat

SEQ ID NO: 3248382 - DNA, 22 bp, Homo sapiens
tttcagatatcaaaattctagc

SEQ ID NO: 3248383 - DNA, 12 bp, Homo sapiens
tttcagatgtct

SEQ ID NO: 3248384 - DNA, 20 bp, Homo sapiens
tttcagatgtcttctgcctg

SEQ ID NO: 3248385 - DNA, 21 bp, Homo sapiens
tttcagatgtcttctgcctgt

SEQ ID NO: 3248386 - DNA, 20 bp, Homo sapiens
tttcagattcccagagcaaa

SEQ ID NO: 3248387 - DNA, 18 bp, Homo sapiens
tttcagcgactccgttgg

SEQ ID NO: 3248388 - DNA, 11 bp, Homo sapiens
tttcagctctc

SEQ ID NO: 3248389 - DNA, 12 bp, Homo sapiens
tttcagctctct

SEQ ID NO: 3248390 - DNA, 13 bp, Homo sapiens
tttcagctgagcc

SEQ ID NO: 3248391 - DNA, 23 bp, Homo sapiens
tttcaggaaatctacttcctaca

SEQ ID NO: 3248392 - DNA, 16 bp, Homo sapiens
tttcaggatactctgt

SEQ ID NO: 3248393 - DNA, 22 bp, Homo sapiens
tttcaggcaggcacctagcaat

SEQ ID NO: 3248394 - DNA, 19 bp, Homo sapiens
tttcaggcattggatattt

SEQ ID NO: 3248395 - DNA, 19 bp, Homo sapiens
tttcagggagaaactccaa

SEQ ID NO: 3248396 - DNA, 21 bp, Homo sapiens
tttcaggggtcgtcaccacct

SEQ ID NO: 3248397 - DNA, 22 bp, Homo sapiens
tttcagggttttctgagggaaa

SEQ ID NO: 3248398 - DNA, 18 bp, Homo sapiens
tttcaggtgtttagttgc

SEQ ID NO: 3248399 - DNA, 20 bp, Homo sapiens
tttcagtaataaaacatctt

SEQ ID NO: 3248400 - DNA, 15 bp, Homo sapiens
tttcagtcaaaactt

SEQ ID NO: 3248401 - DNA, 17 bp, Homo sapiens
tttcagtgcatcattac

SEQ ID NO: 3248402 - DNA, 19 bp, Homo sapiens
tttcagtgtagttaattta

SEQ ID NO: 3248403 - DNA, 17 bp, Homo sapiens
tttcagtttttcatttg

SEQ ID NO: 3248404 - DNA, 19 bp, Homo sapiens
tttcagtttttcatttgtt

SEQ ID NO: 3248405 - DNA, 20 bp, Homo sapiens
tttcagtttttcatttgttt

SEQ ID NO: 3248406 - DNA, 19 bp, Homo sapiens
tttcatactaccctttgct

SEQ ID NO: 3248407 - DNA, 19 bp, Homo sapiens
tttcatactatttagattt

SEQ ID NO: 3248408 - DNA, 14 bp, Homo sapiens
tttcatagttcaga

SEQ ID NO: 3248409 - DNA, 15 bp, Homo sapiens
tttcatagttcagaa

SEQ ID NO: 3248410 - DNA, 15 bp, Homo sapiens
tttcatatgttgctc

SEQ ID NO: 3248411 - DNA, 13 bp, Homo sapiens
tttcatcactggg

SEQ ID NO: 3248412 - DNA, 23 bp, Homo sapiens
tttcatccaaaatattttttgca

SEQ ID NO: 3248413 - DNA, 15 bp, Homo sapiens
tttcatccttcccca

SEQ ID NO: 3248414 - DNA, 14 bp, Homo sapiens
tttcatctggggat

SEQ ID NO: 3248415 - DNA, 16 bp, Homo sapiens
tttcatgattagaaat

SEQ ID NO: 3248416 - DNA, 21 bp, Homo sapiens
tttcatgattagcaagttaca

SEQ ID NO: 3248417 - DNA, 16 bp, Homo sapiens
tttcatgctatctctg

SEQ ID NO: 3248418 - DNA, 21 bp, Homo sapiens
tttcatggtgaaaatgtactg

SEQ ID NO: 3248419 - DNA, 22 bp, Homo sapiens
tttcatggtgaaaatgtactga

SEQ ID NO: 3248420 - DNA, 22 bp, Homo sapiens
tttcatgtagccagcagaactg

SEQ ID NO: 3248421 - DNA, 17 bp, Homo sapiens
tttcatgtctttactgg

SEQ ID NO: 3248422 - DNA, 19 bp, Homo sapiens
tttcatgtgtgtgagtttg

SEQ ID NO: 3248423 - DNA, 19 bp, Homo sapiens
tttcatgttcactgtgagt

SEQ ID NO: 3248424 - DNA, 17 bp, Homo sapiens
tttcatgttttgtgact

SEQ ID NO: 3248425 - DNA, 15 bp, Homo sapiens
tttcatgtttttgat

SEQ ID NO: 3248426 - DNA, 21 bp, Homo sapiens
tttcattaaacttgaagcagt

SEQ ID NO: 3248427 - DNA, 14 bp, Homo sapiens
tttcattacaatgg

SEQ ID NO: 3248428 - DNA, 16 bp, Homo sapiens
tttcttcctctgctga

SEQ ID NO: 3248429 - DNA, 13 bp, Homo sapiens
tttcttctgccct

SEQ ID NO: 3248430 - DNA, 14 bp, Homo sapiens
tttcttctgccctt

SEQ ID NO: 3248431 - DNA, 23 bp, Homo sapiens
tttcttctgtatttttttttcta

SEQ ID NO: 3248432 - DNA, 13 bp, Homo sapiens
tttcttcttccct

SEQ ID NO: 3248433 - DNA, 16 bp, Homo sapiens
tttcttgacaagctga

SEQ ID NO: 3248434 - DNA, 16 bp, Homo sapiens
tttcttgccccagtgt

SEQ ID NO: 3248435 - DNA, 18 bp, Homo sapiens
tttcttgccccagtgtgg

SEQ ID NO: 3248436 - DNA, 13 bp, Homo sapiens
tttcttgctagta

SEQ ID NO: 3248437 - DNA, 13 bp, Homo sapiens
tttcttgctccct

SEQ ID NO: 3248438 - DNA, 11 bp, Homo sapiens
tttcttgctgg

SEQ ID NO: 3248439 - DNA, 19 bp, Homo sapiens
tttcttggcccccttccca

SEQ ID NO: 3248440 - DNA, 14 bp, Homo sapiens
tttcttgtaaatgt

SEQ ID NO: 3248441 - DNA, 19 bp, Homo sapiens
tttcttgtaaatgtttctt

SEQ ID NO: 3248442 - DNA, 23 bp, Homo sapiens
tttcttgtggtgtaaagctggcc

SEQ ID NO: 3248443 - DNA, 12 bp, Homo sapiens
tttcttgtttat

SEQ ID NO: 3248444 - DNA, 13 bp, Homo sapiens
tttctttaaagat

SEQ ID NO: 3248445 - DNA, 12 bp, Homo sapiens
tttctttaactg

SEQ ID NO: 3248446 - DNA, 15 bp, Homo sapiens
tttctttaagaaagt

SEQ ID NO: 3248447 - DNA, 16 bp, Homo sapiens
tttctttaagaaagta

SEQ ID NO: 3248448 - DNA, 20 bp, Homo sapiens
tttctttaagataatagttt

SEQ ID NO: 3248449 - DNA, 20 bp, Homo sapiens
tttctttccaaaacatttct

SEQ ID NO: 3248450 - DNA, 19 bp, Homo sapiens
tttctttccatttacagtc

SEQ ID NO: 3248451 - DNA, 13 bp, Homo sapiens
tttctttctagtg

SEQ ID NO: 3248452 - DNA, 16 bp, Homo sapiens
tttctttgaatgcttt

SEQ ID NO: 3248453 - DNA, 17 bp, Homo sapiens
tttctttggtgcctttc

SEQ ID NO: 3248454 - DNA, 21 bp, Homo sapiens
tttctttggtgcctttcctgt

SEQ ID NO: 3248455 - DNA, 13 bp, Homo sapiens
tttctttgtttct

SEQ ID NO: 3248456 - DNA, 17 bp, Homo sapiens
tttcttttacagactag

SEQ ID NO: 3248457 - DNA, 9 bp, Homo sapiens
tttcttttc

SEQ ID NO: 3248458 - DNA, 14 bp, Homo sapiens
tttcttttcacata

SEQ ID NO: 3248459 - DNA, 14 bp, Homo sapiens
tttcttttgtaatt

SEQ ID NO: 3248460 - DNA, 14 bp, Homo sapiens
tttcttttgttact

SEQ ID NO: 3248461 - DNA, 17 bp, Homo sapiens
tttcttttttaaaatca

SEQ ID NO: 3248462 - DNA, 18 bp, Homo sapiens
tttcttttttaaattaat

SEQ ID NO: 3248463 - DNA, 15 bp, Homo sapiens
tttcttttttatctt

SEQ ID NO: 3248464 - DNA, 23 bp, Homo sapiens
tttcttttttcctctgagttctg

SEQ ID NO: 3248465 - DNA, 22 bp, Homo sapiens
tttcttttttttttctgttgaa

SEQ ID NO: 3248466 - DNA, 12 bp, Homo sapiens
tttgaaaaatat

SEQ ID NO: 3248467 - DNA, 13 bp, Homo sapiens
tttgaaaagctat

SEQ ID NO: 3248468 - DNA, 14 bp, Homo sapiens
tttgaaaagctatt

SEQ ID NO: 3248469 - DNA, 16 bp, Homo sapiens
tttgaaaagcttctta

SEQ ID NO: 3248470 - DNA, 22 bp, Homo sapiens
tttgaaaagcttcttaattaat

SEQ ID NO: 3248471 - DNA, 16 bp, Homo sapiens
tttgaaaagtatcagg

SEQ ID NO: 3248472 - DNA, 24 bp, Homo sapiens
tttgaaacaactttctcttgtaaa

SEQ ID NO: 3248473 - DNA, 13 bp, Homo sapiens
tttgaaagaagca

SEQ ID NO: 3248474 - DNA, 13 bp, Homo sapiens
tttgaaatacctc

SEQ ID NO: 3248475 - DNA, 18 bp, Homo sapiens
tttgaaatacctcatgtt

SEQ ID NO: 3248476 - DNA, 14 bp, Homo sapiens
tttgaaatactaaa

SEQ ID NO: 3248477 - DNA, 18 bp, Homo sapiens
tttgaaatactaaaagca

SEQ ID NO: 3248478 - DNA, 20 bp, Homo sapiens
tttgaaatccagaagtttta

SEQ ID NO: 3248479 - DNA, 14 bp, Homo sapiens
tttgaaatcgttgg

SEQ ID NO: 3248480 - DNA, 23 bp, Homo sapiens
tttgaacactggctaaagataat

SEQ ID NO: 3248481 - DNA, 22 bp, Homo sapiens
tttgaacatgtgccttttctga

SEQ ID NO: 3248482 - DNA, 15 bp, Homo sapiens
tttgaactaagaaac

SEQ ID NO: 3248483 - DNA, 17 bp, Homo sapiens
tttgaactaagaaactt

SEQ ID NO: 3248484 - DNA, 17 bp, Homo sapiens
tttgaactggcaattgt

SEQ ID NO: 3248485 - DNA, 18 bp, Homo sapiens
tttgaagaacatgtgaga

SEQ ID NO: 3248486 - DNA, 17 bp, Homo sapiens
tttgaagaatatttaag

SEQ ID NO: 3248487 - DNA, 18 bp, Homo sapiens
tttgaagaatatttaaga

SEQ ID NO: 3248488 - DNA, 11 bp, Homo sapiens
tttgaagctga

SEQ ID NO: 3248489 - DNA, 16 bp, Homo sapiens
tttgaagtgctgttta

SEQ ID NO: 3248490 - DNA, 16 bp, Homo sapiens
tttgaatattactcct

SEQ ID NO: 3248491 - DNA, 16 bp, Homo sapiens
tttgaatattagcatt

SEQ ID NO: 3248492 - DNA, 14 bp, Homo sapiens
tttgaatgaaaaat

SEQ ID NO: 3248493 - DNA, 21 bp, Homo sapiens
tttgaatgaaaaatttaagca

SEQ ID NO: 3248494 - DNA, 24 bp, Homo sapiens
tttgaatgaaaaatttaagcattg

SEQ ID NO: 3248495 - DNA, 13 bp, Homo sapiens
tttgaatgaaaac

SEQ ID NO: 3248496 - DNA, 22 bp, Homo sapiens
tttgaatgctaagaatgcatta

SEQ ID NO: 3248497 - DNA, 20 bp, Homo sapiens
tttgaatgttatttgttatt

SEQ ID NO: 3248498 - DNA, 16 bp, Homo sapiens
tttgaattgttttctt

SEQ ID NO: 3248499 - DNA, 20 bp, Homo sapiens
tttgacaacgtttcagcgac

SEQ ID NO: 3248500 - DNA, 20 bp, Homo sapiens
tttgacacctcttttttcgt

SEQ ID NO: 3248501 - DNA, 16 bp, Homo sapiens
tttgacatggaaatga

SEQ ID NO: 3248502 - DNA, 14 bp, Homo sapiens
tttgacatttcctt

SEQ ID NO: 3248503 - DNA, 20 bp, Homo sapiens
tttgacatttggtggtactt

SEQ ID NO: 3248504 - DNA, 21 bp, Homo sapiens
tttgaccccgatatattttag

SEQ ID NO: 3248505 - DNA, 13 bp, Homo sapiens
tttgaccttttat

SEQ ID NO: 3248506 - DNA, 14 bp, Homo sapiens
tttgacggatgatt

SEQ ID NO: 3248507 - DNA, 19 bp, Homo sapiens
tttgactaacaagaatgta

SEQ ID NO: 3248508 - DNA, 15 bp, Homo sapiens
tttgactcagaggct

SEQ ID NO: 3248509 - DNA, 22 bp, Homo sapiens
tttgactcagaggctgggagca

SEQ ID NO: 3248510 - DNA, 20 bp, Homo sapiens
tttgactctggcaaagcttt

SEQ ID NO: 3248511 - DNA, 14 bp, Homo sapiens
tttgacttggaaaa

SEQ ID NO: 3248512 - DNA, 17 bp, Homo sapiens
tttgagaaaaaggaaaa

SEQ ID NO: 3248513 - DNA, 15 bp, Homo sapiens
tttgagacaagccct

SEQ ID NO: 3248514 - DNA, 17 bp, Homo sapiens
tttgagacaagccctgg

SEQ ID NO: 3248515 - DNA, 18 bp, Homo sapiens
tttgagagaagccacgct

SEQ ID NO: 3248516 - DNA, 16 bp, Homo sapiens
tttgagagttctaaat

SEQ ID NO: 3248517 - DNA, 23 bp, Homo sapiens
tttgagcaaagaaacttgtgctt

SEQ ID NO: 3248518 - DNA, 21 bp, Homo sapiens
tttgagcctcagaccccaggt

SEQ ID NO: 3248519 - DNA, 18 bp, Homo sapiens
tttgagctactggattct

SEQ ID NO: 3248520 - DNA, 20 bp, Homo sapiens
tttgagctactggattctta

SEQ ID NO: 3248521 - DNA, 14 bp, Homo sapiens
tttgagctgccttc

SEQ ID NO: 3248522 - DNA, 17 bp, Homo sapiens
tttgagctgccttccct

SEQ ID NO: 3248523 - DNA, 22 bp, Homo sapiens
tttgaggaagtggctgtccctg

SEQ ID NO: 3248524 - DNA, 17 bp, Homo sapiens
tttgaggagcatgtttt

SEQ ID NO: 3248525 - DNA, 14 bp, Homo sapiens
tttgaggattcctg

SEQ ID NO: 3248526 - DNA, 17 bp, Homo sapiens
tttgaggcaaattaact

SEQ ID NO: 3248527 - DNA, 19 bp, Homo sapiens
tttgaggcaaattaactgt

SEQ ID NO: 3248528 - DNA, 20 bp, Homo sapiens
tttgaggcaaattaactgta

SEQ ID NO: 3248529 - DNA, 20 bp, Homo sapiens
tttgagggactgcctctgcc

SEQ ID NO: 3248530 - DNA, 20 bp, Homo sapiens
tttgaggtcaagtaagaaga

SEQ ID NO: 3248531 - DNA, 12 bp, Homo sapiens
tttgagtcattg

SEQ ID NO: 3248532 - DNA, 15 bp, Homo sapiens
tttgagtcattgact

SEQ ID NO: 3248533 - DNA, 15 bp, Homo sapiens
tttgagtgatcatta

SEQ ID NO: 3248534 - DNA, 13 bp, Homo sapiens
tttgagttctaca

SEQ ID NO: 3248535 - DNA, 23 bp, Homo sapiens
tttgataatgttaaatttgtaag

SEQ ID NO: 3248536 - DNA, 17 bp, Homo sapiens
tttgatacttatatttt

SEQ ID NO: 3248537 - DNA, 16 bp, Homo sapiens
tttgatataccaaatt

SEQ ID NO: 3248538 - DNA, 21 bp, Homo sapiens
tttgatataccaaattaaaaa

SEQ ID NO: 3248539 - DNA, 22 bp, Homo sapiens
tttgatataccaaattaaaaaa

SEQ ID NO: 3248540 - DNA, 13 bp, Homo sapiens
tttgatatttgca

SEQ ID NO: 3248541 - DNA, 16 bp, Homo sapiens
tttgatgaaagctgat

SEQ ID NO: 3248542 - DNA, 20 bp, Homo sapiens
tttgatgagatattaaattc

SEQ ID NO: 3248543 - DNA, 15 bp, Homo sapiens
tttgatgagttgtga

SEQ ID NO: 3248544 - DNA, 16 bp, Homo sapiens
tttgatgcatgtcttt

SEQ ID NO: 3248545 - DNA, 22 bp, Homo sapiens
tttgatgcatgtcttttaaaat

SEQ ID NO: 3248546 - DNA, 16 bp, Homo sapiens
tttgatgccaagaaag

SEQ ID NO: 3248547 - DNA, 12 bp, Homo sapiens
tttgatgtatgt

SEQ ID NO: 3248548 - DNA, 17 bp, Homo sapiens
tttgatgtatgtgtgaa

SEQ ID NO: 3248549 - DNA, 14 bp, Homo sapiens
tttgatgtgacaat

SEQ ID NO: 3248550 - DNA, 19 bp, Homo sapiens
tttgatgtgacaataatat

SEQ ID NO: 3248551 - DNA, 13 bp, Homo sapiens
tttgatgtgactt

SEQ ID NO: 3248552 - DNA, 23 bp, Homo sapiens
tttgatgtgtgggcttctgagtt

SEQ ID NO: 3248553 - DNA, 17 bp, Homo sapiens
tttgatgtttgtggcct

SEQ ID NO: 3248554 - DNA, 23 bp, Homo sapiens
tttgattattatgtttattacaa

SEQ ID NO: 3248555 - DNA, 15 bp, Homo sapiens
tttgattcatagtaa

SEQ ID NO: 3248556 - DNA, 12 bp, Homo sapiens
tttgattctcct

SEQ ID NO: 3248557 - DNA, 15 bp, Homo sapiens
tttgattctgtgtgt

SEQ ID NO: 3248558 - DNA, 20 bp, Homo sapiens
tttgcaataacttctatatt

SEQ ID NO: 3248559 - DNA, 12 bp, Homo sapiens
tttgcaatagca

SEQ ID NO: 3248560 - DNA, 15 bp, Homo sapiens
tttgcaatagcagtt

SEQ ID NO: 3248561 - DNA, 19 bp, Homo sapiens
tttgcaatggctatatggc

SEQ ID NO: 3248562 - DNA, 14 bp, Homo sapiens
tttgcaatgtcaca

SEQ ID NO: 3248563 - DNA, 18 bp, Homo sapiens
tttgcacaagttccctgg

SEQ ID NO: 3248564 - DNA, 19 bp, Homo sapiens
tttgcacatgtttcctcta

SEQ ID NO: 3248565 - DNA, 17 bp, Homo sapiens
tttgcaccaaagacatc

SEQ ID NO: 3248566 - DNA, 15 bp, Homo sapiens
tttgcacccctccca

SEQ ID NO: 3248567 - DNA, 16 bp, Homo sapiens
tttgcacccctcccat

SEQ ID NO: 3248568 - DNA, 22 bp, Homo sapiens
tttgcaccctgtagatgttcta

SEQ ID NO: 3248569 - DNA, 18 bp, Homo sapiens
tttgcacgtttggtttgc

SEQ ID NO: 3248570 - DNA, 14 bp, Homo sapiens
tttgcactgagggc

SEQ ID NO: 3248571 - DNA, 17 bp, Homo sapiens
tttgcagaagagggtgt

SEQ ID NO: 3248572 - DNA, 21 bp, Homo sapiens
tttgcagcagtgagtctcttc

SEQ ID NO: 3248573 - DNA, 13 bp, Homo sapiens
tttgcaggctctg

SEQ ID NO: 3248574 - DNA, 17 bp, Homo sapiens
tttgcagtaactgtttt

SEQ ID NO: 3248575 - DNA, 20 bp, Homo sapiens
tttgcatactgaaaatccaa

SEQ ID NO: 3248576 - DNA, 12 bp, Homo sapiens
tttgcatgaaat

SEQ ID NO: 3248577 - DNA, 17 bp, Homo sapiens
tttgcatgatatcttca

SEQ ID NO: 3248578 - DNA, 20 bp, Homo sapiens
tttgcatgcatgcaaatgag

SEQ ID NO: 3248579 - DNA, 17 bp, Homo sapiens
tttgcatgtcgcacaat

SEQ ID NO: 3248580 - DNA, 19 bp, Homo sapiens
tttgcatgtcgcacaatgt

SEQ ID NO: 3248581 - DNA, 18 bp, Homo sapiens
tttgcattaaattcacaa

SEQ ID NO: 3248582 - DNA, 21 bp, Homo sapiens
tttgcattaaattcacaaact

SEQ ID NO: 3248583 - DNA, 22 bp, Homo sapiens
tttgcattaaattcacaaactt

SEQ ID NO: 3248584 - DNA, 14 bp, Homo sapiens
tttgcattcctaca

SEQ ID NO: 3248585 - DNA, 23 bp, Homo sapiens
tttgcattgaggaaatattaatt

SEQ ID NO: 3248586 - DNA, 16 bp, Homo sapiens
tttgcatttaaaacag

SEQ ID NO: 3248587 - DNA, 23 bp, Homo sapiens
tttgcatttatttatacagtgcc

SEQ ID NO: 3248588 - DNA, 19 bp, Homo sapiens
tttgccaaaaaaaaaagaa

SEQ ID NO: 3248589 - DNA, 17 bp, Homo sapiens
tttgccaaggcaaaaaa

SEQ ID NO: 3248590 - DNA, 13 bp, Homo sapiens
tttgccacagctt

SEQ ID NO: 3248591 - DNA, 18 bp, Homo sapiens
tttgccacagcttttgca

SEQ ID NO: 3248592 - DNA, 19 bp, Homo sapiens
tttgccagactctaggtta

SEQ ID NO: 3248593 - DNA, 17 bp, Homo sapiens
tttgccaggacatgcaa

SEQ ID NO: 3248594 - DNA, 22 bp, Homo sapiens
tttgccatgttggccaggctgg

SEQ ID NO: 3248595 - DNA, 14 bp, Homo sapiens
tttgccatttgata

SEQ ID NO: 3248596 - DNA, 19 bp, Homo sapiens
tttgccatttttctataaa

SEQ ID NO: 3248597 - DNA, 14 bp, Homo sapiens
tttgcccaacacca

SEQ ID NO: 3248598 - DNA, 18 bp, Homo sapiens
tttgcccatttacacttt

SEQ ID NO: 3248599 - DNA, 19 bp, Homo sapiens
tttgcccatttacactttt

SEQ ID NO: 3248600 - DNA, 13 bp, Homo sapiens
tttgcctggctgt

SEQ ID NO: 3248601 - DNA, 18 bp, Homo sapiens
tttgcctggttttgtctt

SEQ ID NO: 3248602 - DNA, 17 bp, Homo sapiens
tttgccttgcagaactg

SEQ ID NO: 3248603 - DNA, 22 bp, Homo sapiens
tttgccttgcagaactgccatt

SEQ ID NO: 3248604 - DNA, 14 bp, Homo sapiens
tttgcctttaacag

SEQ ID NO: 3248605 - DNA, 15 bp, Homo sapiens
tttgcctttctggga

SEQ ID NO: 3248606 - DNA, 22 bp, Homo sapiens
tttgcggccagtattagactgg

SEQ ID NO: 3248607 - DNA, 17 bp, Homo sapiens
tttgctacaaatttatg

SEQ ID NO: 3248608 - DNA, 18 bp, Homo sapiens
tttgctacaaatttatgc

SEQ ID NO: 3248609 - DNA, 21 bp, Homo sapiens
tttgctactgttgtaagaatt

SEQ ID NO: 3248610 - DNA, 12 bp, Homo sapiens
tttgctatgtaa

SEQ ID NO: 3248611 - DNA, 15 bp, Homo sapiens
tttgctatgtaaggg

SEQ ID NO: 3248612 - DNA, 13 bp, Homo sapiens
tttgctattgaca

SEQ ID NO: 3248613 - DNA, 19 bp, Homo sapiens
tttgctcttttaagcagtc

SEQ ID NO: 3248614 - DNA, 19 bp, Homo sapiens
tttgctgagttgttctaac

SEQ ID NO: 3248615 - DNA, 19 bp, Homo sapiens
tttgctgcactttttactt

SEQ ID NO: 3248616 - DNA, 10 bp, Homo sapiens
tttgctgcca

SEQ ID NO: 3248617 - DNA, 22 bp, Homo sapiens
tttgctgctatgaaaatgagca

SEQ ID NO: 3248618 - DNA, 16 bp, Homo sapiens
tttgctggaagaaact

SEQ ID NO: 3248619 - DNA, 15 bp, Homo sapiens
tttgctggaataagt

SEQ ID NO: 3248620 - DNA, 18 bp, Homo sapiens
tttgctgtatatttgtga

SEQ ID NO: 3248621 - DNA, 12 bp, Homo sapiens
tttgctgtcaca

SEQ ID NO: 3248622 - DNA, 14 bp, Homo sapiens
tttgctgtctctta

SEQ ID NO: 3248623 - DNA, 15 bp, Homo sapiens
tttgctgtgaggaat

SEQ ID NO: 3248624 - DNA, 17 bp, Homo sapiens
tttgcttattgttccaa

SEQ ID NO: 3248625 - DNA, 19 bp, Homo sapiens
tttgcttgctcatatgcat

SEQ ID NO: 3248626 - DNA, 18 bp, Homo sapiens
tttgcttttgtatatcct

SEQ ID NO: 3248627 - DNA, 14 bp, Homo sapiens
tttgctttttgcta

SEQ ID NO: 3248628 - DNA, 21 bp, Homo sapiens
tttggaaaaatgggtctttta

SEQ ID NO: 3248629 - DNA, 22 bp, Homo sapiens
tttggaaaaatgggtcttttat

SEQ ID NO: 3248630 - DNA, 20 bp, Homo sapiens
tttggaaaagtggcgtggga

SEQ ID NO: 3248631 - DNA, 13 bp, Homo sapiens
tttggaaccttgt

SEQ ID NO: 3248632 - DNA, 13 bp, Homo sapiens
tttggaagttatt

SEQ ID NO: 3248633 - DNA, 18 bp, Homo sapiens
tttggaagtttgtgttct

SEQ ID NO: 3248634 - DNA, 13 bp, Homo sapiens
tttggaatacttt

SEQ ID NO: 3248635 - DNA, 15 bp, Homo sapiens
tttggaatattaaaa

SEQ ID NO: 3248636 - DNA, 19 bp, Homo sapiens
tttggaatatttgaataat

SEQ ID NO: 3248637 - DNA, 16 bp, Homo sapiens
tttggaccccagctgg

SEQ ID NO: 3248638 - DNA, 18 bp, Homo sapiens
tttggactccatctctca

SEQ ID NO: 3248639 - DNA, 22 bp, Homo sapiens
tttggagaacgccagtctccca

SEQ ID NO: 3248640 - DNA, 23 bp, Homo sapiens
tttggagactggggtggcctcaa

SEQ ID NO: 3248641 - DNA, 21 bp, Homo sapiens
tttggagcctcccttctgcct

SEQ ID NO: 3248642 - DNA, 22 bp, Homo sapiens
tttggaggctggagtaatcaga

SEQ ID NO: 3248643 - DNA, 14 bp, Homo sapiens
tttggaggtgctta

SEQ ID NO: 3248644 - DNA, 21 bp, Homo sapiens
tttggagtcagtaggtccaag

SEQ ID NO: 3248645 - DNA, 17 bp, Homo sapiens
tttggagtcccctcacc

SEQ ID NO: 3248646 - DNA, 21 bp, Homo sapiens
tttggatatttttgtacttga

SEQ ID NO: 3248647 - DNA, 17 bp, Homo sapiens
tttggatcttgaatgtg

SEQ ID NO: 3248648 - DNA, 23 bp, Homo sapiens
tttggatggggctggcatgtttt

SEQ ID NO: 3248649 - DNA, 14 bp, Homo sapiens
tttggattaaatta

SEQ ID NO: 3248650 - DNA, 15 bp, Homo sapiens
tttggattagaaatt

SEQ ID NO: 3248651 - DNA, 15 bp, Homo sapiens
tttggattctaaata

SEQ ID NO: 3248652 - DNA, 18 bp, Homo sapiens
tttggattctaaatacat

SEQ ID NO: 3248653 - DNA, 23 bp, Homo sapiens
tttggattctcttagctactgta

SEQ ID NO: 3248654 - DNA, 16 bp, Homo sapiens
tttggatttgacattg

SEQ ID NO: 3248655 - DNA, 18 bp, Homo sapiens
tttggcaagaacttgttt

SEQ ID NO: 3248656 - DNA, 23 bp, Homo sapiens
tttggcaagaacttgtttacaac

SEQ ID NO: 3248657 - DNA, 14 bp, Homo sapiens
tttggcaaggaaag

SEQ ID NO: 3248658 - DNA, 19 bp, Homo sapiens
tttggcaatttcctggccc

SEQ ID NO: 3248659 - DNA, 16 bp, Homo sapiens
tttggcacttgtattt

SEQ ID NO: 3248660 - DNA, 14 bp, Homo sapiens
tttggcatctcctg

SEQ ID NO: 3248661 - DNA, 19 bp, Homo sapiens
tttggcctgtttgatgtat

SEQ ID NO: 3248662 - DNA, 19 bp, Homo sapiens
tttggcgctattacaaata

SEQ ID NO: 3248663 - DNA, 13 bp, Homo sapiens
tttggctagagtt

SEQ ID NO: 3248664 - DNA, 23 bp, Homo sapiens
tttggctctcctcagaagaaaga

SEQ ID NO: 3248665 - DNA, 21 bp, Homo sapiens
tttggctgaaattctcctgga

SEQ ID NO: 3248666 - DNA, 20 bp, Homo sapiens
tttggctgacttcatctggg

SEQ ID NO: 3248667 - DNA, 21 bp, Homo sapiens
tttggctgacttcatctgggg

SEQ ID NO: 3248668 - DNA, 15 bp, Homo sapiens
tttggcttataaaca

SEQ ID NO: 3248669 - DNA, 14 bp, Homo sapiens
tttggcttccatga

SEQ ID NO: 3248670 - DNA, 23 bp, Homo sapiens
tttgggaaagatggataaactga

SEQ ID NO: 3248671 - DNA, 24 bp, Homo sapiens
tttgggaaagatggataaactgag

SEQ ID NO: 3248672 - DNA, 20 bp, Homo sapiens
tttgggaggaggaaaagaaa

SEQ ID NO: 3248673 - DNA, 17 bp, Homo sapiens
tttgggaggctgaggtg

SEQ ID NO: 3248674 - DNA, 14 bp, Homo sapiens
tttgtgctgtgggc

SEQ ID NO: 3248675 - DNA, 17 bp, Homo sapiens
tttgtgctgtgggcagc

SEQ ID NO: 3248676 - DNA, 11 bp, Homo sapiens
tttgtggaaaa

SEQ ID NO: 3248677 - DNA, 14 bp, Homo sapiens
tttgtggcctcaga

SEQ ID NO: 3248678 - DNA, 14 bp, Homo sapiens
tttgtggtcacagc

SEQ ID NO: 3248679 - DNA, 19 bp, Homo sapiens
tttgtggttgtagaaggag

SEQ ID NO: 3248680 - DNA, 19 bp, Homo sapiens
tttgtgtaatagaaaactg

SEQ ID NO: 3248681 - DNA, 16 bp, Homo sapiens
tttgtgtaatgaaaat

SEQ ID NO: 3248682 - DNA, 13 bp, Homo sapiens
tttgtgtgatttc

SEQ ID NO: 3248683 - DNA, 15 bp, Homo sapiens
tttgtgtgatttcct

SEQ ID NO: 3248684 - DNA, 17 bp, Homo sapiens
tttgtgtgttgtctctt

SEQ ID NO: 3248685 - DNA, 17 bp, Homo sapiens
tttgtgtgttgtcttga

SEQ ID NO: 3248686 - DNA, 18 bp, Homo sapiens
tttgtgtgttgtcttgaa

SEQ ID NO: 3248687 - DNA, 12 bp, Homo sapiens
tttgtgttctgt

SEQ ID NO: 3248688 - DNA, 14 bp, Homo sapiens
tttgtgttcttctt

SEQ ID NO: 3248689 - DNA, 14 bp, Homo sapiens
tttgtgttgctaaa

SEQ ID NO: 3248690 - DNA, 15 bp, Homo sapiens
tttgtgttgtacaat

SEQ ID NO: 3248691 - DNA, 20 bp, Homo sapiens
tttgttaaaaatattttctg

SEQ ID NO: 3248692 - DNA, 12 bp, Homo sapiens
tttgttaaagct

SEQ ID NO: 3248693 - DNA, 24 bp, Homo sapiens
tttgttacctccaacagaactaaa

SEQ ID NO: 3248694 - DNA, 13 bp, Homo sapiens
tttgttaccttta

SEQ ID NO: 3248695 - DNA, 13 bp, Homo sapiens
tttgttactgttc

SEQ ID NO: 3248696 - DNA, 14 bp, Homo sapiens
tttgttactgttct

SEQ ID NO: 3248697 - DNA, 14 bp, Homo sapiens
tttgttagcaaaga

SEQ ID NO: 3248698 - DNA, 15 bp, Homo sapiens
tttgttagttcctgt

SEQ ID NO: 3248699 - DNA, 21 bp, Homo sapiens
tttgttagttcctgtatgaaa

SEQ ID NO: 3248700 - DNA, 19 bp, Homo sapiens
tttgttatagaatactttt

SEQ ID NO: 3248701 - DNA, 12 bp, Homo sapiens
tttgttatgaca

SEQ ID NO: 3248702 - DNA, 23 bp, Homo sapiens
tttgttattccatcaataaatgc

SEQ ID NO: 3248703 - DNA, 16 bp, Homo sapiens
tttgttattgttttgt

SEQ ID NO: 3248704 - DNA, 20 bp, Homo sapiens
tttgttattttcagtatttt

SEQ ID NO: 3248705 - DNA, 21 bp, Homo sapiens
tttgttcaatgttccattctt

SEQ ID NO: 3248706 - DNA, 19 bp, Homo sapiens
tttgttcatcctattgttg

SEQ ID NO: 3248707 - DNA, 15 bp, Homo sapiens
tttgttcatgtttgg

SEQ ID NO: 3248708 - DNA, 19 bp, Homo sapiens
tttgttctcagctccccct

SEQ ID NO: 3248709 - DNA, 15 bp, Homo sapiens
tttgttctgttctgg

SEQ ID NO: 3248710 - DNA, 12 bp, Homo sapiens
tttgttctgttt

SEQ ID NO: 3248711 - DNA, 12 bp, Homo sapiens
tttgttcttaca

SEQ ID NO: 3248712 - DNA, 15 bp, Homo sapiens
tttgttcttacacat

SEQ ID NO: 3248713 - DNA, 13 bp, Homo sapiens
tttgttcttatga

SEQ ID NO: 3248714 - DNA, 15 bp, Homo sapiens
tttgttgaaattatg

SEQ ID NO: 3248715 - DNA, 15 bp, Homo sapiens
tttgttgaagtttga

SEQ ID NO: 3248716 - DNA, 20 bp, Homo sapiens
tttgttgacagcaaaatgtt

SEQ ID NO: 3248717 - DNA, 15 bp, Homo sapiens
tttgttgtaaaacaa

SEQ ID NO: 3248718 - DNA, 18 bp, Homo sapiens
tttgttgtacttaaatgg

SEQ ID NO: 3248719 - DNA, 22 bp, Homo sapiens
tttgttgtggccaatgtcgaaa

SEQ ID NO: 3248720 - DNA, 21 bp, Homo sapiens
tttgtttaatttttatttctt

SEQ ID NO: 3248721 - DNA, 22 bp, Homo sapiens
tttgtttcaatgaggtgtccaa

SEQ ID NO: 3248722 - DNA, 12 bp, Homo sapiens
tttgtttcccta

SEQ ID NO: 3248723 - DNA, 15 bp, Homo sapiens
tttgtttcctttgtt

SEQ ID NO: 3248724 - DNA, 15 bp, Homo sapiens
tttgttttagaacca

SEQ ID NO: 3248725 - DNA, 14 bp, Homo sapiens
tttgttttgttgga

SEQ ID NO: 3248726 - DNA, 16 bp, Homo sapiens
tttgtttttattttca

SEQ ID NO: 3248727 - DNA, 13 bp, Homo sapiens
tttgtttttctca

SEQ ID NO: 3248728 - DNA, 18 bp, Homo sapiens
tttgtttttgcatgaaat

SEQ ID NO: 3248729 - DNA, 18 bp, Homo sapiens
ttttaaaaaaagaaaatg

SEQ ID NO: 3248730 - DNA, 15 bp, Homo sapiens
ttttaaaaactcctt

SEQ ID NO: 3248731 - DNA, 18 bp, Homo sapiens
ttttaaaaactcttcagt

SEQ ID NO: 3248732 - DNA, 23 bp, Homo sapiens
ttttaaaaagaaactatttttgt

SEQ ID NO: 3248733 - DNA, 14 bp, Homo sapiens
ttttaaaaatacat

SEQ ID NO: 3248734 - DNA, 17 bp, Homo sapiens
ttttaaaaatagacact

SEQ ID NO: 3248735 - DNA, 20 bp, Homo sapiens
ttttaaaaattggaaactga

SEQ ID NO: 3248736 - DNA, 13 bp, Homo sapiens
ttttaaaagaaat

SEQ ID NO: 3248737 - DNA, 22 bp, Homo sapiens
ttttaaaagttgttaccaaata

SEQ ID NO: 3248738 - DNA, 13 bp, Homo sapiens
ttttaaaagtttc

SEQ ID NO: 3248739 - DNA, 15 bp, Homo sapiens
ttttaaaagtttcaa

SEQ ID NO: 3248740 - DNA, 19 bp, Homo sapiens
ttttaaaagttttgttctt

SEQ ID NO: 3248741 - DNA, 21 bp, Homo sapiens
ttttaaaatatttgaatgaaa

SEQ ID NO: 3248742 - DNA, 19 bp, Homo sapiens
ttttaaaatcactaacatt

SEQ ID NO: 3248743 - DNA, 20 bp, Homo sapiens
ttttaaaatcactaacatta

SEQ ID NO: 3248744 - DNA, 19 bp, Homo sapiens
ttttaaacagtgagcctga

SEQ ID NO: 3248745 - DNA, 12 bp, Homo sapiens
ttttaaactcat

SEQ ID NO: 3248746 - DNA, 20 bp, Homo sapiens
ttttaaactgtgtacataac

SEQ ID NO: 3248747 - DNA, 23 bp, Homo sapiens
ttttaaactgtgtacataactga

SEQ ID NO: 3248748 - DNA, 19 bp, Homo sapiens
ttttaaagaaaaatatgat

SEQ ID NO: 3248749 - DNA, 11 bp, Homo sapiens
ttttaaagaat

SEQ ID NO: 3248750 - DNA, 23 bp, Homo sapiens
ttttaaagaccctcctattctat

SEQ ID NO: 3248751 - DNA, 20 bp, Homo sapiens
ttttaaagatctgtaagtaa

SEQ ID NO: 3248752 - DNA, 19 bp, Homo sapiens
ttttaaaggcattagagtc

SEQ ID NO: 3248753 - DNA, 19 bp, Homo sapiens
ttttaaagtaaatctcttt

SEQ ID NO: 3248754 - DNA, 16 bp, Homo sapiens
ttttaaagtatatatt

SEQ ID NO: 3248755 - DNA, 12 bp, Homo sapiens
ttttaaagttca

SEQ ID NO: 3248756 - DNA, 18 bp, Homo sapiens
ttttaaagttcattgcaa

SEQ ID NO: 3248757 - DNA, 14 bp, Homo sapiens
ttttaaagttttgt

SEQ ID NO: 3248758 - DNA, 23 bp, Homo sapiens
ttttaaagttttgtacaaagttt

SEQ ID NO: 3248759 - DNA, 16 bp, Homo sapiens
ttttaaataaaagcac

SEQ ID NO: 3248760 - DNA, 17 bp, Homo sapiens
ttttaaataaaagcaca

SEQ ID NO: 3248761 - DNA, 17 bp, Homo sapiens
ttttaaataaaagcagc

SEQ ID NO: 3248762 - DNA, 13 bp, Homo sapiens
ttttaaataaact

SEQ ID NO: 3248763 - DNA, 14 bp, Homo sapiens
ttttaaatataaat

SEQ ID NO: 3248764 - DNA, 13 bp, Homo sapiens
ttttaaatgtgaa

SEQ ID NO: 3248765 - DNA, 20 bp, Homo sapiens
ttttaaattcccgttttgtc

SEQ ID NO: 3248766 - DNA, 13 bp, Homo sapiens
ttttaaattctga

SEQ ID NO: 3248767 - DNA, 19 bp, Homo sapiens
ttttaacaataactactgt

SEQ ID NO: 3248768 - DNA, 15 bp, Homo sapiens
ttttaacactttgta

SEQ ID NO: 3248769 - DNA, 12 bp, Homo sapiens
ttttaacagcat

SEQ ID NO: 3248770 - DNA, 21 bp, Homo sapiens
ttttaacatcagaactgaaat

SEQ ID NO: 3248771 - DNA, 19 bp, Homo sapiens
ttttaacattttgttctta

SEQ ID NO: 3248772 - DNA, 14 bp, Homo sapiens
ttttaacctgtttt

SEQ ID NO: 3248773 - DNA, 16 bp, Homo sapiens
ttttaactagaattta

SEQ ID NO: 3248774 - DNA, 12 bp, Homo sapiens
ttttaactcacc

SEQ ID NO: 3248775 - DNA, 14 bp, Homo sapiens
ttttaactgtggat

SEQ ID NO: 3248776 - DNA, 16 bp, Homo sapiens
ttttaagaggcagggt

SEQ ID NO: 3248777 - DNA, 13 bp, Homo sapiens
ttttaagattgta

SEQ ID NO: 3248778 - DNA, 12 bp, Homo sapiens
ttttaagatttt

SEQ ID NO: 3248779 - DNA, 20 bp, Homo sapiens
ttttaagggtttgtggaaaa

SEQ ID NO: 3248780 - DNA, 21 bp, Homo sapiens
ttttaaggtctttcagtactt

SEQ ID NO: 3248781 - DNA, 14 bp, Homo sapiens
ttttaagtaatgtg

SEQ ID NO: 3248782 - DNA, 17 bp, Homo sapiens
ttttaagtaatgtggaa

SEQ ID NO: 3248783 - DNA, 17 bp, Homo sapiens
ttttaagtgctttgtaa

SEQ ID NO: 3248784 - DNA, 15 bp, Homo sapiens
ttttaagtggtttga

SEQ ID NO: 3248785 - DNA, 14 bp, Homo sapiens
ttttaataaattga

SEQ ID NO: 3248786 - DNA, 12 bp, Homo sapiens
ttttaatacagg

SEQ ID NO: 3248787 - DNA, 18 bp, Homo sapiens
ttttaatagtgctttttt

SEQ ID NO: 3248788 - DNA, 15 bp, Homo sapiens
ttttaatattactgt

SEQ ID NO: 3248789 - DNA, 22 bp, Homo sapiens
ttttaatcagacaaagtaattc

SEQ ID NO: 3248790 - DNA, 22 bp, Homo sapiens
ttttaatgatctcggatgacca

SEQ ID NO: 3248791 - DNA, 15 bp, Homo sapiens
ttttaatgatgacaa

SEQ ID NO: 3248792 - DNA, 14 bp, Homo sapiens
ttttaatgtacaag

SEQ ID NO: 3248793 - DNA, 13 bp, Homo sapiens
ttttaatgtgaag

SEQ ID NO: 3248794 - DNA, 19 bp, Homo sapiens
ttttaatgtgaagacattt

SEQ ID NO: 3248795 - DNA, 17 bp, Homo sapiens
ttttaattattattctt

SEQ ID NO: 3248796 - DNA, 22 bp, Homo sapiens
ttttaattccaatatgatgact

SEQ ID NO: 3248797 - DNA, 16 bp, Homo sapiens
ttttaatttaaagctt

SEQ ID NO: 3248798 - DNA, 14 bp, Homo sapiens
ttttaatttaacaa

SEQ ID NO: 3248799 - DNA, 21 bp, Homo sapiens
ttttaatttaacaaactaaaa

SEQ ID NO: 3248800 - DNA, 15 bp, Homo sapiens
ttttaatttatttgt

SEQ ID NO: 3248801 - DNA, 15 bp, Homo sapiens
ttttaatttgatgaa

SEQ ID NO: 3248802 - DNA, 13 bp, Homo sapiens
ttttaattttgat

SEQ ID NO: 3248803 - DNA, 23 bp, Homo sapiens
ttttaattttgatatacattgtg

SEQ ID NO: 3248804 - DNA, 10 bp, Homo sapiens
ttttacaaaa

SEQ ID NO: 3248805 - DNA, 23 bp, Homo sapiens
ttgtgacaggaaagccctccccc

SEQ ID NO: 3248806 - DNA, 19 bp, Homo sapiens
ttgtgactagaaattctta

SEQ ID NO: 3248807 - DNA, 14 bp, Homo sapiens
ttgtgactgaaggg

SEQ ID NO: 3248808 - DNA, 11 bp, Homo sapiens
ttgtgagagcg

SEQ ID NO: 3248809 - DNA, 23 bp, Homo sapiens
ttgtgagataaaactctcctttt

SEQ ID NO: 3248810 - DNA, 12 bp, Homo sapiens
ttgtgagatggg

SEQ ID NO: 3248811 - DNA, 18 bp, Homo sapiens
ttgtgagccaccacgtcc

SEQ ID NO: 3248812 - DNA, 13 bp, Homo sapiens
ttgtgataattta

SEQ ID NO: 3248813 - DNA, 14 bp, Homo sapiens
ttgtgataatttaa

SEQ ID NO: 3248814 - DNA, 20 bp, Homo sapiens
ttgtgatagctaacatttta

SEQ ID NO: 3248815 - DNA, 23 bp, Homo sapiens
ttgtgatcagaccataatgttac

SEQ ID NO: 3248816 - DNA, 20 bp, Homo sapiens
ttgtgatgaatcaatgaaaa

SEQ ID NO: 3248817 - DNA, 16 bp, Homo sapiens
ttgtgatgatgctgtg

SEQ ID NO: 3248818 - DNA, 22 bp, Homo sapiens
ttgtgatgtcccaacttgtaaa

SEQ ID NO: 3248819 - DNA, 18 bp, Homo sapiens
ttgtgattatttcacttt

SEQ ID NO: 3248820 - DNA, 23 bp, Homo sapiens
ttgtgattatttcactttagatg

SEQ ID NO: 3248821 - DNA, 19 bp, Homo sapiens
ttgtgattcaatctgtaaa

SEQ ID NO: 3248822 - DNA, 23 bp, Homo sapiens
ttgtgattcaatctgtaaactgt

SEQ ID NO: 3248823 - DNA, 14 bp, Homo sapiens
ttgtgatttcttta

SEQ ID NO: 3248824 - DNA, 21 bp, Homo sapiens
ttgtgcataatgctttggaaa

SEQ ID NO: 3248825 - DNA, 17 bp, Homo sapiens
ttgtgcattctttggta

SEQ ID NO: 3248826 - DNA, 20 bp, Homo sapiens
ttgtgcccagggttttgccc

SEQ ID NO: 3248827 - DNA, 16 bp, Homo sapiens
ttgtgccttttatagc

SEQ ID NO: 3248828 - DNA, 16 bp, Homo sapiens
ttgtgctagaaatttt

SEQ ID NO: 3248829 - DNA, 18 bp, Homo sapiens
ttgtgctagaaattttca

SEQ ID NO: 3248830 - DNA, 13 bp, Homo sapiens
ttgtgctatttaa

SEQ ID NO: 3248831 - DNA, 15 bp, Homo sapiens
ttgtgctcagcatga

SEQ ID NO: 3248832 - DNA, 18 bp, Homo sapiens
ttgtgctggatggagccc

SEQ ID NO: 3248833 - DNA, 21 bp, Homo sapiens
ttgtgctgtgggcagcaccct

SEQ ID NO: 3248834 - DNA, 16 bp, Homo sapiens
ttgtgcttcacagtag

SEQ ID NO: 3248835 - DNA, 11 bp, Homo sapiens
ttgtgcttctc

SEQ ID NO: 3248836 - DNA, 16 bp, Homo sapiens
ttgtgcttctccccag

SEQ ID NO: 3248837 - DNA, 18 bp, Homo sapiens
ttgtgcttctccccagaa

SEQ ID NO: 3248838 - DNA, 15 bp, Homo sapiens
ttgtgcttttcctga

SEQ ID NO: 3248839 - DNA, 21 bp, Homo sapiens
ttgtggaaaatgaaaattagg

SEQ ID NO: 3248840 - DNA, 18 bp, Homo sapiens
ttgtggaaagcctctgct

SEQ ID NO: 3248841 - DNA, 20 bp, Homo sapiens
ttgtggattataaaaaatgt

SEQ ID NO: 3248842 - DNA, 20 bp, Homo sapiens
ttgtggccccttttactttt

SEQ ID NO: 3248843 - DNA, 13 bp, Homo sapiens
ttgtggcctcaga

SEQ ID NO: 3248844 - DNA, 14 bp, Homo sapiens
ttgtggctgggggc

SEQ ID NO: 3248845 - DNA, 16 bp, Homo sapiens
ttgtgggcataaactg

SEQ ID NO: 3248846 - DNA, 20 bp, Homo sapiens
ttgtggggacccaggctccg

SEQ ID NO: 3248847 - DNA, 13 bp, Homo sapiens
ttgtgggtgggag

SEQ ID NO: 3248848 - DNA, 11 bp, Homo sapiens
ttgtggtgtga

SEQ ID NO: 3248849 - DNA, 13 bp, Homo sapiens
ttgtggtgtgacc

SEQ ID NO: 3248850 - DNA, 15 bp, Homo sapiens
ttgtggttctatttt

SEQ ID NO: 3248851 - DNA, 16 bp, Homo sapiens
ttgtggttctatttta

SEQ ID NO: 3248852 - DNA, 20 bp, Homo sapiens
ttgtggttctattttacttt

SEQ ID NO: 3248853 - DNA, 15 bp, Homo sapiens
ttgtggttttatgga

SEQ ID NO: 3248854 - DNA, 19 bp, Homo sapiens
ttgtgtaataaagtgtttt

SEQ ID NO: 3248855 - DNA, 21 bp, Homo sapiens
ttgtgtaatagaaaactgaaa

SEQ ID NO: 3248856 - DNA, 14 bp, Homo sapiens
ttgtgtagcctttt

SEQ ID NO: 3248857 - DNA, 21 bp, Homo sapiens
tttaacaataactactgtgtt

SEQ ID NO: 3248858 - DNA, 23 bp, Homo sapiens
tttaacaataactactgtgttcc

SEQ ID NO: 3248859 - DNA, 23 bp, Homo sapiens
tttaacaatttcctttatattta

SEQ ID NO: 3248860 - DNA, 15 bp, Homo sapiens
tttaacactttgtat

SEQ ID NO: 3248861 - DNA, 21 bp, Homo sapiens
tttaacagaaactttcaaaag

SEQ ID NO: 3248862 - DNA, 19 bp, Homo sapiens
tttaacatagtaattctta

SEQ ID NO: 3248863 - DNA, 21 bp, Homo sapiens
tttaacatcagaactgaaata

SEQ ID NO: 3248864 - DNA, 12 bp, Homo sapiens
tttaacattatt

SEQ ID NO: 3248865 - DNA, 13 bp, Homo sapiens
tttaacatttgcc

SEQ ID NO: 3248866 - DNA, 21 bp, Homo sapiens
tttaacatttgccttgcagaa

SEQ ID NO: 3248867 - DNA, 22 bp, Homo sapiens
tttaacatttgccttgcagaac

SEQ ID NO: 3248868 - DNA, 11 bp, Homo sapiens
tttaacatttt

SEQ ID NO: 3248869 - DNA, 23 bp, Homo sapiens
tttaaccggtaagagtttcagtt

SEQ ID NO: 3248870 - DNA, 13 bp, Homo sapiens
tttaacctgtttt

SEQ ID NO: 3248871 - DNA, 18 bp, Homo sapiens
tttaacctgttttgttaa

SEQ ID NO: 3248872 - DNA, 16 bp, Homo sapiens
tttaacctttgataga

SEQ ID NO: 3248873 - DNA, 14 bp, Homo sapiens
tttaactaaatttt

SEQ ID NO: 3248874 - DNA, 17 bp, Homo sapiens
tttaactaaattttaaa

SEQ ID NO: 3248875 - DNA, 18 bp, Homo sapiens
tttaactgaaaatgtaaa

SEQ ID NO: 3248876 - DNA, 21 bp, Homo sapiens
tttaactgccgtaatttaact

SEQ ID NO: 3248877 - DNA, 14 bp, Homo sapiens
tttaactgccttgt

SEQ ID NO: 3248878 - DNA, 13 bp, Homo sapiens
tttaactgtggat

SEQ ID NO: 3248879 - DNA, 15 bp, Homo sapiens
tttaactgtggatat

SEQ ID NO: 3248880 - DNA, 18 bp, Homo sapiens
tttaactttaagtttcag

SEQ ID NO: 3248881 - DNA, 15 bp, Homo sapiens
tttaacttttctacc

SEQ ID NO: 3248882 - DNA, 18 bp, Homo sapiens
tttaagaaaaaataacac

SEQ ID NO: 3248883 - DNA, 11 bp, Homo sapiens
tttaagaaaat

SEQ ID NO: 3248884 - DNA, 14 bp, Homo sapiens
tttaagaaatagaa

SEQ ID NO: 3248885 - DNA, 19 bp, Homo sapiens
tttaagaatagttctaaaa

SEQ ID NO: 3248886 - DNA, 20 bp, Homo sapiens
tttaagaatagttctaaaat

SEQ ID NO: 3248887 - DNA, 12 bp, Homo sapiens
tttaagaattct

SEQ ID NO: 3248888 - DNA, 15 bp, Homo sapiens
tttaagaattctgta

SEQ ID NO: 3248889 - DNA, 20 bp, Homo sapiens
tttaagaattgagtaatggt

SEQ ID NO: 3248890 - DNA, 12 bp, Homo sapiens
tttaagagactc

SEQ ID NO: 3248891 - DNA, 18 bp, Homo sapiens
tttaagaggaatttataa

SEQ ID NO: 3248892 - DNA, 15 bp, Homo sapiens
tttaagataattata

SEQ ID NO: 3248893 - DNA, 21 bp, Homo sapiens
tttaagatagacttattcttt

SEQ ID NO: 3248894 - DNA, 22 bp, Homo sapiens
tttaagatatccatctttttct

SEQ ID NO: 3248895 - DNA, 23 bp, Homo sapiens
tttaagatatccatctttttctt

SEQ ID NO: 3248896 - DNA, 18 bp, Homo sapiens
tttaagattgtaaaaata

SEQ ID NO: 3248897 - DNA, 13 bp, Homo sapiens
tttaagcagctct

SEQ ID NO: 3248898 - DNA, 13 bp, Homo sapiens
tttaagcattgtt

SEQ ID NO: 3248899 - DNA, 21 bp, Homo sapiens
tttaagcattgtttgcttatt

SEQ ID NO: 3248900 - DNA, 23 bp, Homo sapiens
tttaagcattgtttgcttattgt

SEQ ID NO: 3248901 - DNA, 18 bp, Homo sapiens
tttaagccttcaaaacta

SEQ ID NO: 3248902 - DNA, 16 bp, Homo sapiens
tttaagctatcagcaa

SEQ ID NO: 3248903 - DNA, 20 bp, Homo sapiens
tttaagctccttgagtaaaa

SEQ ID NO: 3248904 - DNA, 12 bp, Homo sapiens
tttaagctgttt

SEQ ID NO: 3248905 - DNA, 14 bp, Homo sapiens
tttaagcttcagtt

SEQ ID NO: 3248906 - DNA, 15 bp, Homo sapiens
tttaaggaaactaga

SEQ ID NO: 3248907 - DNA, 20 bp, Homo sapiens
tttaagggcatgccttgtgc

SEQ ID NO: 3248908 - DNA, 20 bp, Homo sapiens
tttaagggtttgtggaaaat

SEQ ID NO: 3248909 - DNA, 22 bp, Homo sapiens
tttaagggtttgtggaaaatga

SEQ ID NO: 3248910 - DNA, 15 bp, Homo sapiens
tttaagtaagacttt

SEQ ID NO: 3248911 - DNA, 21 bp, Homo sapiens
tttaagtaagacttttattaa

SEQ ID NO: 3248912 - DNA, 16 bp, Homo sapiens
tttaagtaatgtggaa

SEQ ID NO: 3248913 - DNA, 13 bp, Homo sapiens
tttaagtatttat

SEQ ID NO: 3248914 - DNA, 14 bp, Homo sapiens
tttaagtatttata

SEQ ID NO: 3248915 - DNA, 21 bp, Homo sapiens
tttaagtcaacactatatatt

SEQ ID NO: 3248916 - DNA, 19 bp, Homo sapiens
tttaagtcattttcatgtg

SEQ ID NO: 3248917 - DNA, 19 bp, Homo sapiens
tttaagttttgattaatgt

SEQ ID NO: 3248918 - DNA, 21 bp, Homo sapiens
tttaagttttgattaatgttt

SEQ ID NO: 3248919 - DNA, 17 bp, Homo sapiens
tttaataaaataattct

SEQ ID NO: 3248920 - DNA, 20 bp, Homo sapiens
tttaataaaataattctaaa

SEQ ID NO: 3248921 - DNA, 21 bp, Homo sapiens
tttaataaatgacaaatgtat

SEQ ID NO: 3248922 - DNA, 20 bp, Homo sapiens
tttaataaattgcttactga

SEQ ID NO: 3248923 - DNA, 12 bp, Homo sapiens
tttaataacatt

SEQ ID NO: 3248924 - DNA, 15 bp, Homo sapiens
tttaataacattacc

SEQ ID NO: 3248925 - DNA, 22 bp, Homo sapiens
tttaataacattaccttactgt

SEQ ID NO: 3248926 - DNA, 16 bp, Homo sapiens
tttaataataatctag

SEQ ID NO: 3248927 - DNA, 14 bp, Homo sapiens
tttaatacagggta

SEQ ID NO: 3248928 - DNA, 15 bp, Homo sapiens
tttaatagaaataaa

SEQ ID NO: 3248929 - DNA, 19 bp, Homo sapiens
tttaatagaatataattat

SEQ ID NO: 3248930 - DNA, 21 bp, Homo sapiens
tttaatatctggcactgttaa

SEQ ID NO: 3248931 - DNA, 15 bp, Homo sapiens
tttaatatcttcagc

SEQ ID NO: 3248932 - DNA, 15 bp, Homo sapiens
tttaatattgagaaa

SEQ ID NO: 3248933 - DNA, 13 bp, Homo sapiens
tttaatatttaaa

SEQ ID NO: 3248934 - DNA, 12 bp, Homo sapiens
tttaatcagaaa

SEQ ID NO: 3248935 - DNA, 13 bp, Homo sapiens
tttaatccatttt

SEQ ID NO: 3248936 - DNA, 15 bp, Homo sapiens
tttaatcctgtacca

SEQ ID NO: 3248937 - DNA, 21 bp, Homo sapiens
tttaatgaaagactgtacaaa

SEQ ID NO: 3248938 - DNA, 23 bp, Homo sapiens
tttaatgccgatatactctagat

SEQ ID NO: 3248939 - DNA, 15 bp, Homo sapiens
tttaatgctatttga

SEQ ID NO: 3248940 - DNA, 21 bp, Homo sapiens
tttaatggacatgagataatg

SEQ ID NO: 3248941 - DNA, 22 bp, Homo sapiens
tttaatggacttatttcttcaa

SEQ ID NO: 3248942 - DNA, 18 bp, Homo sapiens
tttaatggatatttctca

SEQ ID NO: 3248943 - DNA, 21 bp, Homo sapiens
tttaatgtaaagaacttaaat

SEQ ID NO: 3248944 - DNA, 21 bp, Homo sapiens
tttaatgtaatagggaaaatt

SEQ ID NO: 3248945 - DNA, 14 bp, Homo sapiens
tttaatgtacaagt

SEQ ID NO: 3248946 - DNA, 19 bp, Homo sapiens
tttaatgtctcctttgctc

SEQ ID NO: 3248947 - DNA, 21 bp, Homo sapiens
tttaatgtgaacttgtagctg

SEQ ID NO: 3248948 - DNA, 13 bp, Homo sapiens
tttaatgtgatga

SEQ ID NO: 3248949 - DNA, 21 bp, Homo sapiens
tttaatgtgatgatgtaattg

SEQ ID NO: 3248950 - DNA, 22 bp, Homo sapiens
tttaatgtgatgatgtaattga

SEQ ID NO: 3248951 - DNA, 13 bp, Homo sapiens
tttaattaaataa

SEQ ID NO: 3248952 - DNA, 19 bp, Homo sapiens
tttaattaattaagtatct

SEQ ID NO: 3248953 - DNA, 16 bp, Homo sapiens
tttaattactgttttc

SEQ ID NO: 3248954 - DNA, 15 bp, Homo sapiens
tttaattattttaaa

SEQ ID NO: 3248955 - DNA, 17 bp, Homo sapiens
tttaattcaccaaagta

SEQ ID NO: 3248956 - DNA, 21 bp, Homo sapiens
tttaattccaatatgatgact

SEQ ID NO: 3248957 - DNA, 12 bp, Homo sapiens
tttaattctctc

SEQ ID NO: 3248958 - DNA, 18 bp, Homo sapiens
tttaattctttctatttt

SEQ ID NO: 3248959 - DNA, 14 bp, Homo sapiens
tttaattgattatt

SEQ ID NO: 3248960 - DNA, 16 bp, Homo sapiens
tttaattgtaaactgt

SEQ ID NO: 3248961 - DNA, 24 bp, Homo sapiens
tttaattgttgtttctttctagtg

SEQ ID NO: 3248962 - DNA, 16 bp, Homo sapiens
tttaatttatgagttt

SEQ ID NO: 3248963 - DNA, 14 bp, Homo sapiens
tttaatttatttca

SEQ ID NO: 3248964 - DNA, 18 bp, Homo sapiens
tttaatttgatgaaagct

SEQ ID NO: 3248965 - DNA, 21 bp, Homo sapiens
tttacaagaagtttattctca

SEQ ID NO: 3248966 - DNA, 17 bp, Homo sapiens
tttacaagatccatttg

SEQ ID NO: 3248967 - DNA, 14 bp, Homo sapiens
tttacaatgtgaat

SEQ ID NO: 3248968 - DNA, 15 bp, Homo sapiens
tttacaatgtgaata

SEQ ID NO: 3248969 - DNA, 14 bp, Homo sapiens
tttacaccacactt

SEQ ID NO: 3248970 - DNA, 16 bp, Homo sapiens
tttacactctttgtaa

SEQ ID NO: 3248971 - DNA, 16 bp, Homo sapiens
tttacagcactactct

SEQ ID NO: 3248972 - DNA, 18 bp, Homo sapiens
tttacagcactactctgt

SEQ ID NO: 3248973 - DNA, 19 bp, Homo sapiens
tttacagcattgtctttgc

SEQ ID NO: 3248974 - DNA, 15 bp, Homo sapiens
tttacagctgtgtta

SEQ ID NO: 3248975 - DNA, 19 bp, Homo sapiens
tttacagctttacacacac

SEQ ID NO: 3248976 - DNA, 23 bp, Homo sapiens
tttacaggaaaaaaaattctgtt

SEQ ID NO: 3248977 - DNA, 22 bp, Homo sapiens
tttacaggccctgctcctgcag

SEQ ID NO: 3248978 - DNA, 22 bp, Homo sapiens
tttacagggagcctcctgccca

SEQ ID NO: 3248979 - DNA, 19 bp, Homo sapiens
tttacagtgaaaatgtaag

SEQ ID NO: 3248980 - DNA, 23 bp, Homo sapiens
tttacagtgaaaatgtaagctgt

SEQ ID NO: 3248981 - DNA, 21 bp, Homo sapiens
tttacagtgaccttttcttca

SEQ ID NO: 3248982 - DNA, 17 bp, Homo sapiens
tttacataagaaatgta

SEQ ID NO: 3248983 - DNA, 14 bp, Homo sapiens
tttacatactttat

SEQ ID NO: 3248984 - DNA, 20 bp, Homo sapiens
tttacatgtcatttgactgt

SEQ ID NO: 3248985 - DNA, 21 bp, Homo sapiens
tttacatgtgatgttttagtg

SEQ ID NO: 3248986 - DNA, 19 bp, Homo sapiens
tttacatgtgtagcctatg

SEQ ID NO: 3248987 - DNA, 21 bp, Homo sapiens
tttacatgtgtagcctatgtt

SEQ ID NO: 3248988 - DNA, 16 bp, Homo sapiens
tttacattcaactttt

SEQ ID NO: 3248989 - DNA, 16 bp, Homo sapiens
tttacattcatcaata

SEQ ID NO: 3248990 - DNA, 16 bp, Homo sapiens
tttacattgttgagct

SEQ ID NO: 3248991 - DNA, 10 bp, Homo sapiens
tttacatttc

SEQ ID NO: 3248992 - DNA, 12 bp, Homo sapiens
tttaccaaagca

SEQ ID NO: 3248993 - DNA, 16 bp, Homo sapiens
tttaccatttgtaata

SEQ ID NO: 3248994 - DNA, 19 bp, Homo sapiens
tttaccatttgtaataaag

SEQ ID NO: 3248995 - DNA, 23 bp, Homo sapiens
tttacccagaatgtcagattcct

SEQ ID NO: 3248996 - DNA, 22 bp, Homo sapiens
tttaccctaatgtcttcataaa

SEQ ID NO: 3248997 - DNA, 13 bp, Homo sapiens
tttacccttcagg

SEQ ID NO: 3248998 - DNA, 15 bp, Homo sapiens
tttaccctttataga

SEQ ID NO: 3248999 - DNA, 16 bp, Homo sapiens
tttaccctttatagaa

SEQ ID NO: 3249000 - DNA, 21 bp, Homo sapiens
tttacctactgtgtcttggaa

SEQ ID NO: 3249001 - DNA, 13 bp, Homo sapiens
tttacctagaaga

SEQ ID NO: 3249002 - DNA, 13 bp, Homo sapiens
tttacctgagacc

SEQ ID NO: 3249003 - DNA, 18 bp, Homo sapiens
tttaccttcaaactttag

SEQ ID NO: 3249004 - DNA, 20 bp, Homo sapiens
tttactaaagatatcagagc

SEQ ID NO: 3249005 - DNA, 22 bp, Homo sapiens
tttactaagccacaagaaattt

SEQ ID NO: 3249006 - DNA, 13 bp, Homo sapiens
tttactcacagca

SEQ ID NO: 3249007 - DNA, 18 bp, Homo sapiens
tttactcattgaaatgtc

SEQ ID NO: 3249008 - DNA, 20 bp, Homo sapiens
tttactcccttcctggcctc

SEQ ID NO: 3249009 - DNA, 22 bp, Homo sapiens
tttactctatgccccaaatata

SEQ ID NO: 3249010 - DNA, 12 bp, Homo sapiens
tttactctgtgt

SEQ ID NO: 3249011 - DNA, 19 bp, Homo sapiens
tttactctgtgtttaaaaa

SEQ ID NO: 3249012 - DNA, 14 bp, Homo sapiens
tttactctttgcaa

SEQ ID NO: 3249013 - DNA, 14 bp, Homo sapiens
tttactgagcttct

SEQ ID NO: 3249014 - DNA, 17 bp, Homo sapiens
tttactggacctgaaat

SEQ ID NO: 3249015 - DNA, 23 bp, Homo sapiens
tttactgtaatataaagtattca

SEQ ID NO: 3249016 - DNA, 23 bp, Homo sapiens
tttactgtctattaatattcagg

SEQ ID NO: 3249017 - DNA, 17 bp, Homo sapiens
tttactgtgaaactggc

SEQ ID NO: 3249018 - DNA, 22 bp, Homo sapiens
tttactgtttgatataccaaat

SEQ ID NO: 3249019 - DNA, 16 bp, Homo sapiens
tttacttatcttatgc

SEQ ID NO: 3249020 - DNA, 18 bp, Homo sapiens
tttacttgcattgaatat

SEQ ID NO: 3249021 - DNA, 17 bp, Homo sapiens
tttacttgtggtgtgac

SEQ ID NO: 3249022 - DNA, 22 bp, Homo sapiens
tttactttattaatatgagtta

SEQ ID NO: 3249023 - DNA, 12 bp, Homo sapiens
tttactttcaaa

SEQ ID NO: 3249024 - DNA, 12 bp, Homo sapiens
tttactttggcc

SEQ ID NO: 3249025 - DNA, 23 bp, Homo sapiens
tttagaaaaaagtttacaacata

SEQ ID NO: 3249026 - DNA, 22 bp, Homo sapiens
tttagaaaagggagtttaaaaa

SEQ ID NO: 3249027 - DNA, 19 bp, Homo sapiens
tttagaaatactgcaagaa

SEQ ID NO: 3249028 - DNA, 20 bp, Homo sapiens
tttagaaatactgcaagaaa

SEQ ID NO: 3249029 - DNA, 14 bp, Homo sapiens
tttagaagcctgca

SEQ ID NO: 3249030 - DNA, 18 bp, Homo sapiens
tttagaatggttgagtta

SEQ ID NO: 3249031 - DNA, 23 bp, Homo sapiens
tttagaatggttgagttacatta

SEQ ID NO: 3249032 - DNA, 13 bp, Homo sapiens
tttagaattctaa

SEQ ID NO: 3249033 - DNA, 19 bp, Homo sapiens
tttagacaactagatttgt

SEQ ID NO: 3249034 - DNA, 19 bp, Homo sapiens
tttagacaccttcattttg

SEQ ID NO: 3249035 - DNA, 11 bp, Homo sapiens
tttagacagta

SEQ ID NO: 3249036 - DNA, 13 bp, Homo sapiens
tttagaccaagga

SEQ ID NO: 3249037 - DNA, 18 bp, Homo sapiens
tttagagaactgtggccg

SEQ ID NO: 3249038 - DNA, 21 bp, Homo sapiens
tttagagatgaattaaattta

SEQ ID NO: 3249039 - DNA, 18 bp, Homo sapiens
tttagaggcattgttagt

SEQ ID NO: 3249040 - DNA, 21 bp, Homo sapiens
tttagagtaaataaactgttt

SEQ ID NO: 3249041 - DNA, 20 bp, Homo sapiens
tttagatcaaggcaaaaata

SEQ ID NO: 3249042 - DNA, 21 bp, Homo sapiens
tttagatgataaagagacagt

SEQ ID NO: 3249043 - DNA, 11 bp, Homo sapiens
tttagatgctg

SEQ ID NO: 3249044 - DNA, 17 bp, Homo sapiens
tttagatggttacactg

SEQ ID NO: 3249045 - DNA, 20 bp, Homo sapiens
tttagatttcaagaaaaaat

SEQ ID NO: 3249046 - DNA, 14 bp, Homo sapiens
tttagcacaaaaaa

SEQ ID NO: 3249047 - DNA, 13 bp, Homo sapiens
tttagcaccccca

SEQ ID NO: 3249048 - DNA, 21 bp, Homo sapiens
tttagcacgtttaaagttctg

SEQ ID NO: 3249049 - DNA, 15 bp, Homo sapiens
tttagccaaaccctt

SEQ ID NO: 3249050 - DNA, 11 bp, Homo sapiens
tttagccagtg

SEQ ID NO: 3249051 - DNA, 13 bp, Homo sapiens
tttagccagtgac

SEQ ID NO: 3249052 - DNA, 16 bp, Homo sapiens
tttagccctttaaaac

SEQ ID NO: 3249053 - DNA, 15 bp, Homo sapiens
tttagcctagttcat

SEQ ID NO: 3249054 - DNA, 18 bp, Homo sapiens
tttagctagtatcttcaa

SEQ ID NO: 3249055 - DNA, 16 bp, Homo sapiens
tttagctctgttcttt

SEQ ID NO: 3249056 - DNA, 17 bp, Homo sapiens
tttagctctgttcttta

SEQ ID NO: 3249057 - DNA, 16 bp, Homo sapiens
tttaggaacttcagag

SEQ ID NO: 3249058 - DNA, 14 bp, Homo sapiens
tttaggaagaagtg

SEQ ID NO: 3249059 - DNA, 17 bp, Homo sapiens
tttaggagattttaggt

SEQ ID NO: 3249060 - DNA, 18 bp, Homo sapiens
tttaggctgttccttgta

SEQ ID NO: 3249061 - DNA, 16 bp, Homo sapiens
tttagggccaggcagg

SEQ ID NO: 3249062 - DNA, 16 bp, Homo sapiens
tttaggggtgaaggag

SEQ ID NO: 3249063 - DNA, 14 bp, Homo sapiens
tttagggtactaaa

SEQ ID NO: 3249064 - DNA, 20 bp, Homo sapiens
tttagggtactaaatttaaa

SEQ ID NO: 3249065 - DNA, 15 bp, Homo sapiens
tttaggtaagaagtt

SEQ ID NO: 3249066 - DNA, 22 bp, Homo sapiens
tttaggtgttgattttctgttg

SEQ ID NO: 3249067 - DNA, 12 bp, Homo sapiens
tttaggttctaa

SEQ ID NO: 3249068 - DNA, 14 bp, Homo sapiens
tttaggttctaaag

SEQ ID NO: 3249069 - DNA, 14 bp, Homo sapiens
tttagtaatctgta

SEQ ID NO: 3249070 - DNA, 19 bp, Homo sapiens
tttagtaatctgtacattt

SEQ ID NO: 3249071 - DNA, 13 bp, Homo sapiens
tttagtaatttct

SEQ ID NO: 3249072 - DNA, 15 bp, Homo sapiens
tttagtagagacagg

SEQ ID NO: 3249073 - DNA, 22 bp, Homo sapiens
tttagtatcagtgttttaaatt

SEQ ID NO: 3249074 - DNA, 11 bp, Homo sapiens
tttagttcttt

SEQ ID NO: 3249075 - DNA, 19 bp, Homo sapiens
tttagttgcagaaacattt

SEQ ID NO: 3249076 - DNA, 22 bp, Homo sapiens
tttagttttaaaagtctatgat

SEQ ID NO: 3249077 - DNA, 15 bp, Homo sapiens
tttagtttttgttct

SEQ ID NO: 3249078 - DNA, 16 bp, Homo sapiens
tttagtttttgttctt

SEQ ID NO: 3249079 - DNA, 22 bp, Homo sapiens
tttataaaagtgttcattgttt

SEQ ID NO: 3249080 - DNA, 22 bp, Homo sapiens
tttataaaattagaaagcaact

SEQ ID NO: 3249081 - DNA, 23 bp, Homo sapiens
tttataaacagaaatggaaagca

SEQ ID NO: 3249082 - DNA, 23 bp, Homo sapiens
tttataaacagacaatatgtgag

SEQ ID NO: 3249083 - DNA, 12 bp, Homo sapiens
tttataaagcat

SEQ ID NO: 3249084 - DNA, 22 bp, Homo sapiens
tttataaatataagccttttat

SEQ ID NO: 3249085 - DNA, 20 bp, Homo sapiens
tttataacatctttattgaa

SEQ ID NO: 3249086 - DNA, 16 bp, Homo sapiens
tttataaccccagcct

SEQ ID NO: 3249087 - DNA, 14 bp, Homo sapiens
tttataactaacat

SEQ ID NO: 3249088 - DNA, 21 bp, Homo sapiens
tttataactcatcataaaata

SEQ ID NO: 3249089 - DNA, 17 bp, Homo sapiens
tttataagcaaatttca

SEQ ID NO: 3249090 - DNA, 18 bp, Homo sapiens
tttataagttcacaaaat

SEQ ID NO: 3249091 - DNA, 18 bp, Homo sapiens
tttataatagcaactttt

SEQ ID NO: 3249092 - DNA, 22 bp, Homo sapiens
tttataattggtgctatttgaa

SEQ ID NO: 3249093 - DNA, 15 bp, Homo sapiens
tttataattgtacaa

SEQ ID NO: 3249094 - DNA, 17 bp, Homo sapiens
tttataattgtacaaaa

SEQ ID NO: 3249095 - DNA, 16 bp, Homo sapiens
tttataattttctgaa

SEQ ID NO: 3249096 - DNA, 21 bp, Homo sapiens
tttatacagctgtattgtctg

SEQ ID NO: 3249097 - DNA, 18 bp, Homo sapiens
tttatacccccaggaaac

SEQ ID NO: 3249098 - DNA, 13 bp, Homo sapiens
tttatactataaa

SEQ ID NO: 3249099 - DNA, 20 bp, Homo sapiens
tttatactctttctgtatat

SEQ ID NO: 3249100 - DNA, 20 bp, Homo sapiens
tttatactgggtttcaagaa

SEQ ID NO: 3249101 - DNA, 19 bp, Homo sapiens
tttatactgtatttctaag

SEQ ID NO: 3249102 - DNA, 16 bp, Homo sapiens
tttatactgtttactg

SEQ ID NO: 3249103 - DNA, 21 bp, Homo sapiens
tttatactttgcaatccaaat

SEQ ID NO: 3249104 - DNA, 17 bp, Homo sapiens
tttatagctattactgt

SEQ ID NO: 3249105 - DNA, 16 bp, Homo sapiens
tttatagctcagttta

SEQ ID NO: 3249106 - DNA, 21 bp, Homo sapiens
tttataggactgttctttgct

SEQ ID NO: 3249107 - DNA, 15 bp, Homo sapiens
tttataggtgaaaga

SEQ ID NO: 3249108 - DNA, 16 bp, Homo sapiens
tttataggtgagaaaa

SEQ ID NO: 3249109 - DNA, 16 bp, Homo sapiens
tttatagtatgtgact

SEQ ID NO: 3249110 - DNA, 18 bp, Homo sapiens
tttatagtatgtgacttt

SEQ ID NO: 3249111 - DNA, 22 bp, Homo sapiens
tttatagtatgtgacttttctg

SEQ ID NO: 3249112 - DNA, 19 bp, Homo sapiens
tttatagtttgtacatgca

SEQ ID NO: 3249113 - DNA, 14 bp, Homo sapiens
tttatataaatgta

SEQ ID NO: 3249114 - DNA, 16 bp, Homo sapiens
tttatatagcttgaaa

SEQ ID NO: 3249115 - DNA, 19 bp, Homo sapiens
tttatatagcttgaaacat

SEQ ID NO: 3249116 - DNA, 13 bp, Homo sapiens
tttatatatgtat

SEQ ID NO: 3249117 - DNA, 16 bp, Homo sapiens
tttatatattatgtga

SEQ ID NO: 3249118 - DNA, 20 bp, Homo sapiens
tttatatattatgtgaagaa

SEQ ID NO: 3249119 - DNA, 21 bp, Homo sapiens
tttatatattatgtgaagaat

SEQ ID NO: 3249120 - DNA, 13 bp, Homo sapiens
tttatatatttat

SEQ ID NO: 3249121 - DNA, 17 bp, Homo sapiens
tttatatcagcctgagt

SEQ ID NO: 3249122 - DNA, 17 bp, Homo sapiens
tttatatcatgcaaaat

SEQ ID NO: 3249123 - DNA, 14 bp, Homo sapiens
tttatatctttatt

SEQ ID NO: 3249124 - DNA, 12 bp, Homo sapiens
tttatatctttt

SEQ ID NO: 3249125 - DNA, 17 bp, Homo sapiens
tttatatcttttggtta

SEQ ID NO: 3249126 - DNA, 21 bp, Homo sapiens
tttatatgaagaaaatcactt

SEQ ID NO: 3249127 - DNA, 18 bp, Homo sapiens
tttatatgccctcaagta

SEQ ID NO: 3249128 - DNA, 20 bp, Homo sapiens
tttatatgcttactgatata

SEQ ID NO: 3249129 - DNA, 21 bp, Homo sapiens
tttatatggcgttttgtctgt

SEQ ID NO: 3249130 - DNA, 13 bp, Homo sapiens
tttatatgttgta

SEQ ID NO: 3249131 - DNA, 16 bp, Homo sapiens
tttatattaatgtact

SEQ ID NO: 3249132 - DNA, 20 bp, Homo sapiens
tttatattctgaaaggaaat

SEQ ID NO: 3249133 - DNA, 17 bp, Homo sapiens
tttatatttaattatta

SEQ ID NO: 3249134 - DNA, 14 bp, Homo sapiens
tttatatttagtga

SEQ ID NO: 3249135 - DNA, 20 bp, Homo sapiens
tttatatttattgttagaaa

SEQ ID NO: 3249136 - DNA, 18 bp, Homo sapiens
tttatatttggaaagaga

SEQ ID NO: 3249137 - DNA, 19 bp, Homo sapiens
tttatatttggggtccttt

SEQ ID NO: 3249138 - DNA, 17 bp, Homo sapiens
tttatatttttgtacat

SEQ ID NO: 3249139 - DNA, 23 bp, Homo sapiens
tttatatttttgtacatattgtt

SEQ ID NO: 3249140 - DNA, 22 bp, Homo sapiens
tttatcaaacagaattttaaag

SEQ ID NO: 3249141 - DNA, 22 bp, Homo sapiens
tttatcaaagcatagatgtttt

SEQ ID NO: 3249142 - DNA, 18 bp, Homo sapiens
tttatcacacttctgtga

SEQ ID NO: 3249143 - DNA, 19 bp, Homo sapiens
tttatcactttttgaacta

SEQ ID NO: 3249144 - DNA, 13 bp, Homo sapiens
tttatcagataca

SEQ ID NO: 3249145 - DNA, 20 bp, Homo sapiens
tttatcagggaaactaagat

SEQ ID NO: 3249146 - DNA, 21 bp, Homo sapiens
tttatcagtgacagagttcac

SEQ ID NO: 3249147 - DNA, 16 bp, Homo sapiens
tttatcatgcatgtcc

SEQ ID NO: 3249148 - DNA, 17 bp, Homo sapiens
tttatccaaaatgtgta

SEQ ID NO: 3249149 - DNA, 14 bp, Homo sapiens
tttatccacaggaa

SEQ ID NO: 3249150 - DNA, 18 bp, Homo sapiens
tttatcccaaagttgttg

SEQ ID NO: 3249151 - DNA, 21 bp, Homo sapiens
tttatcccaaagttgttgtaa

SEQ ID NO: 3249152 - DNA, 17 bp, Homo sapiens
tttatccctttacaatg

SEQ ID NO: 3249153 - DNA, 19 bp, Homo sapiens
tttatcctgaaatttcaga

SEQ ID NO: 3249154 - DNA, 22 bp, Homo sapiens
tttatctacccaagggcagaaa

SEQ ID NO: 3249155 - DNA, 16 bp, Homo sapiens
tttatctcagatgtta

SEQ ID NO: 3249156 - DNA, 19 bp, Homo sapiens
tttatctcagatgttaaaa

SEQ ID NO: 3249157 - DNA, 21 bp, Homo sapiens
tttatctcagatgttaaaata

SEQ ID NO: 3249158 - DNA, 12 bp, Homo sapiens
tttatctcctgc

SEQ ID NO: 3249159 - DNA, 13 bp, Homo sapiens
tttatctgattaa

SEQ ID NO: 3249160 - DNA, 19 bp, Homo sapiens
tttatctgtagtaaactat

SEQ ID NO: 3249161 - DNA, 12 bp, Homo sapiens
tttatctttata

SEQ ID NO: 3249162 - DNA, 14 bp, Homo sapiens
tttatctttataca

SEQ ID NO: 3249163 - DNA, 19 bp, Homo sapiens
tttatgaaaataaatagct

SEQ ID NO: 3249164 - DNA, 21 bp, Homo sapiens
tttatgaagaaaaagtacaat

SEQ ID NO: 3249165 - DNA, 17 bp, Homo sapiens
tttatgaatatcattga

SEQ ID NO: 3249166 - DNA, 14 bp, Homo sapiens
tttatgaatgggtg

SEQ ID NO: 3249167 - DNA, 12 bp, Homo sapiens
tttatgagccag

SEQ ID NO: 3249168 - DNA, 19 bp, Homo sapiens
tttatgagccagacaaatg

SEQ ID NO: 3249169 - DNA, 20 bp, Homo sapiens
tttatgagtaactattatta

SEQ ID NO: 3249170 - DNA, 19 bp, Homo sapiens
tttatgataatagattctc

SEQ ID NO: 3249171 - DNA, 16 bp, Homo sapiens
tttatgatatccctga

SEQ ID NO: 3249172 - DNA, 14 bp, Homo sapiens
tttatgcagataga

SEQ ID NO: 3249173 - DNA, 15 bp, Homo sapiens
tttatgcatttcatt

SEQ ID NO: 3249174 - DNA, 16 bp, Homo sapiens
tttatgcatttcattc

SEQ ID NO: 3249175 - DNA, 19 bp, Homo sapiens
tttatgccttcttattgct

SEQ ID NO: 3249176 - DNA, 17 bp, Homo sapiens
tttatgcctttctctcc

SEQ ID NO: 3249177 - DNA, 14 bp, Homo sapiens
tttatgctgtattt

SEQ ID NO: 3249178 - DNA, 18 bp, Homo sapiens
tttatggaccacttttat

SEQ ID NO: 3249179 - DNA, 15 bp, Homo sapiens
tttatggatgattaa

SEQ ID NO: 3249180 - DNA, 22 bp, Homo sapiens
tttatggccacatttaatatct

SEQ ID NO: 3249181 - DNA, 12 bp, Homo sapiens
tttatggcctca

SEQ ID NO: 3249182 - DNA, 16 bp, Homo sapiens
tttatggctagacagg

SEQ ID NO: 3249183 - DNA, 13 bp, Homo sapiens
tttatgggagaat

SEQ ID NO: 3249184 - DNA, 19 bp, Homo sapiens
tttatggtgtgttcctaac

SEQ ID NO: 3249185 - DNA, 22 bp, Homo sapiens
tttatggtgtgttcctaacata

SEQ ID NO: 3249186 - DNA, 18 bp, Homo sapiens
tttatgtagcttgacaat

SEQ ID NO: 3249187 - DNA, 12 bp, Homo sapiens
tttatgtatctc

SEQ ID NO: 3249188 - DNA, 16 bp, Homo sapiens
tttatgtgatcaattt

SEQ ID NO: 3249189 - DNA, 21 bp, Homo sapiens
tttatgtgctctcatcagaaa

SEQ ID NO: 3249190 - DNA, 17 bp, Homo sapiens
tttatgtgtagttgtct

SEQ ID NO: 3249191 - DNA, 18 bp, Homo sapiens
tttatgtgtatatttgta

SEQ ID NO: 3249192 - DNA, 17 bp, Homo sapiens
tttatgttttgtttctg

SEQ ID NO: 3249193 - DNA, 20 bp, Homo sapiens
tttatgttttgtttctgaaa

SEQ ID NO: 3249194 - DNA, 18 bp, Homo sapiens
tttattaaaaatgttctc

SEQ ID NO: 3249195 - DNA, 23 bp, Homo sapiens
tttattaaacagatttttacaaa

SEQ ID NO: 3249196 - DNA, 17 bp, Homo sapiens
tttattaaacattttca

SEQ ID NO: 3249197 - DNA, 19 bp, Homo sapiens
tttattaaataaaatcaat

SEQ ID NO: 3249198 - DNA, 13 bp, Homo sapiens
tttattaaatttg

SEQ ID NO: 3249199 - DNA, 12 bp, Homo sapiens
tttattaagatg

SEQ ID NO: 3249200 - DNA, 22 bp, Homo sapiens
tttattaataaaacaaaatgtt

SEQ ID NO: 3249201 - DNA, 13 bp, Homo sapiens
tttattaatctta

SEQ ID NO: 3249202 - DNA, 12 bp, Homo sapiens
tttattaatttg

SEQ ID NO: 3249203 - DNA, 15 bp, Homo sapiens
tttattaatttgaaa

SEQ ID NO: 3249204 - DNA, 23 bp, Homo sapiens
tttattaccccctccttcagaca

SEQ ID NO: 3249205 - DNA, 13 bp, Homo sapiens
tttattacctctg

SEQ ID NO: 3249206 - DNA, 22 bp, Homo sapiens
tttattagaataatttcatact

SEQ ID NO: 3249207 - DNA, 17 bp, Homo sapiens
tttattatgcattatat

SEQ ID NO: 3249208 - DNA, 14 bp, Homo sapiens
tttattattgaaga

SEQ ID NO: 3249209 - DNA, 17 bp, Homo sapiens
tttattcaaacttttat

SEQ ID NO: 3249210 - DNA, 14 bp, Homo sapiens
tttattcacatata

SEQ ID NO: 3249211 - DNA, 21 bp, Homo sapiens
tttattcagcttcatttgtgt

SEQ ID NO: 3249212 - DNA, 22 bp, Homo sapiens
tttattcagcttcatttgtgtc

SEQ ID NO: 3249213 - DNA, 12 bp, Homo sapiens
tttattcataat

SEQ ID NO: 3249214 - DNA, 22 bp, Homo sapiens
tttattcattggtctaatttat

SEQ ID NO: 3249215 - DNA, 23 bp, Homo sapiens
tttattccagaatgctgtacatc

SEQ ID NO: 3249216 - DNA, 19 bp, Homo sapiens
tttattccatattcatgta

SEQ ID NO: 3249217 - DNA, 14 bp, Homo sapiens
tttattccctgccc

SEQ ID NO: 3249218 - DNA, 14 bp, Homo sapiens
tttattccttgtga

SEQ ID NO: 3249219 - DNA, 13 bp, Homo sapiens
tttattgacacag

SEQ ID NO: 3249220 - DNA, 22 bp, Homo sapiens
tttattgactttgacaattact

SEQ ID NO: 3249221 - DNA, 12 bp, Homo sapiens
tttattgcattg

SEQ ID NO: 3249222 - DNA, 19 bp, Homo sapiens
tttattgctgtgtaacact

SEQ ID NO: 3249223 - DNA, 18 bp, Homo sapiens
tttattggaagtgttcaa

SEQ ID NO: 3249224 - DNA, 12 bp, Homo sapiens
tttattgtacag

SEQ ID NO: 3249225 - DNA, 13 bp, Homo sapiens
tttattgtacaga

SEQ ID NO: 3249226 - DNA, 22 bp, Homo sapiens
tttattgtgggccatgaaccaa

SEQ ID NO: 3249227 - DNA, 17 bp, Homo sapiens
tttattgtgtttttaat

SEQ ID NO: 3249228 - DNA, 14 bp, Homo sapiens
tttatttacatttt

SEQ ID NO: 3249229 - DNA, 15 bp, Homo sapiens
tttatttataaacta

SEQ ID NO: 3249230 - DNA, 14 bp, Homo sapiens
tttatttatttaca

SEQ ID NO: 3249231 - DNA, 13 bp, Homo sapiens
tttatttcacata

SEQ ID NO: 3249232 - DNA, 13 bp, Homo sapiens
tttatttcctccc

SEQ ID NO: 3249233 - DNA, 16 bp, Homo sapiens
tttatttctaagtatt

SEQ ID NO: 3249234 - DNA, 20 bp, Homo sapiens
tttatttctaagtatttaaa

SEQ ID NO: 3249235 - DNA, 13 bp, Homo sapiens
tttatttctctct

SEQ ID NO: 3249236 - DNA, 15 bp, Homo sapiens
tttatttctctctta

SEQ ID NO: 3249237 - DNA, 15 bp, Homo sapiens
tttatttgtaatttt

SEQ ID NO: 3249238 - DNA, 21 bp, Homo sapiens
tttattttcagtatactgtgt

SEQ ID NO: 3249239 - DNA, 15 bp, Homo sapiens
tttattttcctaaag

SEQ ID NO: 3249240 - DNA, 19 bp, Homo sapiens
tttattttgaaaagcttct

SEQ ID NO: 3249241 - DNA, 18 bp, Homo sapiens
tttattttgctgagttgt

SEQ ID NO: 3249242 - DNA, 21 bp, Homo sapiens
tttattttggcttcatttcaa

SEQ ID NO: 3249243 - DNA, 15 bp, Homo sapiens
tttatttttcatatt

SEQ ID NO: 3249244 - DNA, 14 bp, Homo sapiens
tttatttttttcta

SEQ ID NO: 3249245 - DNA, 17 bp, Homo sapiens
ttgtttaatgtgaactt

SEQ ID NO: 3249246 - DNA, 23 bp, Homo sapiens
ttgtttaatgtgaacttgtagct

SEQ ID NO: 3249247 - DNA, 20 bp, Homo sapiens
ttgtttattctttttaaagt

SEQ ID NO: 3249248 - DNA, 20 bp, Homo sapiens
ttgtttatttatcagtgaca

SEQ ID NO: 3249249 - DNA, 17 bp, Homo sapiens
ttgtttctccccctggg

SEQ ID NO: 3249250 - DNA, 17 bp, Homo sapiens
ttgtttctctgttgtaa

SEQ ID NO: 3249251 - DNA, 18 bp, Homo sapiens
ttgtttctgagaaaagaa

SEQ ID NO: 3249252 - DNA, 15 bp, Homo sapiens
ttgtttcttccaaag

SEQ ID NO: 3249253 - DNA, 19 bp, Homo sapiens
ttgtttcttccaaagcaca

SEQ ID NO: 3249254 - DNA, 18 bp, Homo sapiens
ttgtttcttctgtcttta

SEQ ID NO: 3249255 - DNA, 23 bp, Homo sapiens
ttgtttgaggcaaattaactgta

SEQ ID NO: 3249256 - DNA, 22 bp, Homo sapiens
ttgtttgatctacttcatagct

SEQ ID NO: 3249257 - DNA, 15 bp, Homo sapiens
ttgtttgccatactt

SEQ ID NO: 3249258 - DNA, 16 bp, Homo sapiens
ttgtttgggatcagct

SEQ ID NO: 3249259 - DNA, 21 bp, Homo sapiens
ttgtttgggtatcctgcccag

SEQ ID NO: 3249260 - DNA, 16 bp, Homo sapiens
ttgttttatatacctg

SEQ ID NO: 3249261 - DNA, 19 bp, Homo sapiens
ttgttttatcatgacatgt

SEQ ID NO: 3249262 - DNA, 14 bp, Homo sapiens
ttgttttctctgtg

SEQ ID NO: 3249263 - DNA, 17 bp, Homo sapiens
ttgttttctgactaatt

SEQ ID NO: 3249264 - DNA, 18 bp, Homo sapiens
ttgttttctgactaatta

SEQ ID NO: 3249265 - DNA, 20 bp, Homo sapiens
ttgttttcttctgtatgtta

SEQ ID NO: 3249266 - DNA, 14 bp, Homo sapiens
ttgttttgaaaata

SEQ ID NO: 3249267 - DNA, 22 bp, Homo sapiens
ttgttttggctgaaattctcct

SEQ ID NO: 3249268 - DNA, 18 bp, Homo sapiens
ttgttttgggtgaatctt

SEQ ID NO: 3249269 - DNA, 19 bp, Homo sapiens
ttgttttgggtgaatcttg

SEQ ID NO: 3249270 - DNA, 18 bp, Homo sapiens
ttgtttttattttcaaga

SEQ ID NO: 3249271 - DNA, 16 bp, Homo sapiens
ttgttttttaaagcaa

SEQ ID NO: 3249272 - DNA, 18 bp, Homo sapiens
ttgttttttaaagcaagt

SEQ ID NO: 3249273 - DNA, 18 bp, Homo sapiens
ttgttttttttttccact

SEQ ID NO: 3249274 - DNA, 21 bp, Homo sapiens
tttaaaaaaacaaataaataa

SEQ ID NO: 3249275 - DNA, 13 bp, Homo sapiens
tttaaaaaaagaa

SEQ ID NO: 3249276 - DNA, 16 bp, Homo sapiens
tttaaaaaaatttaag

SEQ ID NO: 3249277 - DNA, 17 bp, Homo sapiens
tttaaaaaaatttaagt

SEQ ID NO: 3249278 - DNA, 23 bp, Homo sapiens
tttaaaaaacaaaaaccagcagg

SEQ ID NO: 3249279 - DNA, 18 bp, Homo sapiens
tttaaaaaagactgaaca

SEQ ID NO: 3249280 - DNA, 22 bp, Homo sapiens
tttaaaaaatatttattaaata

SEQ ID NO: 3249281 - DNA, 17 bp, Homo sapiens
tttaaaaaatattttct

SEQ ID NO: 3249282 - DNA, 23 bp, Homo sapiens
tttaaaaaattatggaatatcat

SEQ ID NO: 3249283 - DNA, 13 bp, Homo sapiens
tttaaaaactctt

SEQ ID NO: 3249284 - DNA, 17 bp, Homo sapiens
tttaaaaactcttcagt

SEQ ID NO: 3249285 - DNA, 17 bp, Homo sapiens
tttaaaaagaaatctgg

SEQ ID NO: 3249286 - DNA, 13 bp, Homo sapiens
tttaaaaagctca

SEQ ID NO: 3249287 - DNA, 13 bp, Homo sapiens
tttaaaaaggaaa

SEQ ID NO: 3249288 - DNA, 23 bp, Homo sapiens
tttaaaaagttgtagcagattgt

SEQ ID NO: 3249289 - DNA, 17 bp, Homo sapiens
tttaaaaatagacactc

SEQ ID NO: 3249290 - DNA, 15 bp, Homo sapiens
tttaaaaatatatat

SEQ ID NO: 3249291 - DNA, 17 bp, Homo sapiens
tttaaaaatatttcaga

SEQ ID NO: 3249292 - DNA, 19 bp, Homo sapiens
tttaaaaatggtatcaaaa

SEQ ID NO: 3249293 - DNA, 22 bp, Homo sapiens
tttaaaaatggtatcaaaatta

SEQ ID NO: 3249294 - DNA, 16 bp, Homo sapiens
tttaaaaattgtttct

SEQ ID NO: 3249295 - DNA, 21 bp, Homo sapiens
tttaaaacccatttaaatttt

SEQ ID NO: 3249296 - DNA, 15 bp, Homo sapiens
tttaaaactgttgga

SEQ ID NO: 3249297 - DNA, 16 bp, Homo sapiens
tttaaaagaaatttat

SEQ ID NO: 3249298 - DNA, 22 bp, Homo sapiens
tttaaaagcacaatcactaaac

SEQ ID NO: 3249299 - DNA, 14 bp, Homo sapiens
tttaaaagcctgct

SEQ ID NO: 3249300 - DNA, 18 bp, Homo sapiens
tttaaaaggtagagtctt

SEQ ID NO: 3249301 - DNA, 14 bp, Homo sapiens
tttaaaagtctatt

SEQ ID NO: 3249302 - DNA, 20 bp, Homo sapiens
tttaaaagtttcaatgtgat

SEQ ID NO: 3249303 - DNA, 16 bp, Homo sapiens
tttaaaataaaatgaa

SEQ ID NO: 3249304 - DNA, 18 bp, Homo sapiens
tttaaaataaaatgaaaa

SEQ ID NO: 3249305 - DNA, 22 bp, Homo sapiens
tttaaaataaaatgaaaattgt

SEQ ID NO: 3249306 - DNA, 17 bp, Homo sapiens
tttaaaataaattccta

SEQ ID NO: 3249307 - DNA, 19 bp, Homo sapiens
tttaaaataaattcctaca

SEQ ID NO: 3249308 - DNA, 24 bp, Homo sapiens
tttaaaataaattcctacaactta

SEQ ID NO: 3249309 - DNA, 16 bp, Homo sapiens
tttaaaatatttatct

SEQ ID NO: 3249310 - DNA, 22 bp, Homo sapiens
tttaaaatatttgaatgaaaac

SEQ ID NO: 3249311 - DNA, 20 bp, Homo sapiens
tttaaaatatttgtctttaa

SEQ ID NO: 3249312 - DNA, 12 bp, Homo sapiens
tttaaaatgtaa

SEQ ID NO: 3249313 - DNA, 10 bp, Homo sapiens
tttaaaatta

SEQ ID NO: 3249314 - DNA, 15 bp, Homo sapiens
tttaaaattcagttt

SEQ ID NO: 3249315 - DNA, 18 bp, Homo sapiens
tttaaaattgctatgtta

SEQ ID NO: 3249316 - DNA, 23 bp, Homo sapiens
tttaaaattgctatgttactatt

SEQ ID NO: 3249317 - DNA, 19 bp, Homo sapiens
tttaaaatttaagtatctt

SEQ ID NO: 3249318 - DNA, 17 bp, Homo sapiens
tttaaaattttgtatgt

SEQ ID NO: 3249319 - DNA, 18 bp, Homo sapiens
tttaaacaaacattgtgt

SEQ ID NO: 3249320 - DNA, 23 bp, Homo sapiens
tttaaacaaacattgtgttgaca

SEQ ID NO: 3249321 - DNA, 12 bp, Homo sapiens
tttaaacaaatt

SEQ ID NO: 3249322 - DNA, 14 bp, Homo sapiens
tttaaacaaattca

SEQ ID NO: 3249323 - DNA, 23 bp, Homo sapiens
tttaaacaaattcatattctgtc

SEQ ID NO: 3249324 - DNA, 23 bp, Homo sapiens
tttaaacacacagatacacacac

SEQ ID NO: 3249325 - DNA, 14 bp, Homo sapiens
tttaaacacctcct

SEQ ID NO: 3249326 - DNA, 16 bp, Homo sapiens
tttaaacaggcccagc

SEQ ID NO: 3249327 - DNA, 17 bp, Homo sapiens
tttaaacagtatttcat

SEQ ID NO: 3249328 - DNA, 16 bp, Homo sapiens
tttaaacatagaaagt

SEQ ID NO: 3249329 - DNA, 14 bp, Homo sapiens
tttaaacattaaaa

SEQ ID NO: 3249330 - DNA, 16 bp, Homo sapiens
tttaaacctttttctt

SEQ ID NO: 3249331 - DNA, 17 bp, Homo sapiens
tttaaacgcttcttatg

SEQ ID NO: 3249332 - DNA, 15 bp, Homo sapiens
tttaaactgattcat

SEQ ID NO: 3249333 - DNA, 13 bp, Homo sapiens
tttaaagaaagtg

SEQ ID NO: 3249334 - DNA, 16 bp, Homo sapiens
tttaaagaaagtgtat

SEQ ID NO: 3249335 - DNA, 13 bp, Homo sapiens
tttaaagaatgct

SEQ ID NO: 3249336 - DNA, 14 bp, Homo sapiens
tttaaagagaggtt

SEQ ID NO: 3249337 - DNA, 18 bp, Homo sapiens
tttaaagagtctagattc

SEQ ID NO: 3249338 - DNA, 21 bp, Homo sapiens
tttaaagagtctagattcaaa

SEQ ID NO: 3249339 - DNA, 19 bp, Homo sapiens
tttaaagcaattgcataat

SEQ ID NO: 3249340 - DNA, 18 bp, Homo sapiens
tttaaagcttactctgtc

SEQ ID NO: 3249341 - DNA, 17 bp, Homo sapiens
tttaaagtaaatctctt

SEQ ID NO: 3249342 - DNA, 13 bp, Homo sapiens
tttaaagtaattt

SEQ ID NO: 3249343 - DNA, 12 bp, Homo sapiens
tttaaagtactt

SEQ ID NO: 3249344 - DNA, 15 bp, Homo sapiens
tttaaagtatgcatt

SEQ ID NO: 3249345 - DNA, 18 bp, Homo sapiens
tttaaagtgattaaacgt

SEQ ID NO: 3249346 - DNA, 20 bp, Homo sapiens
tttaaagtgtttctgttatt

SEQ ID NO: 3249347 - DNA, 21 bp, Homo sapiens
tttaaagttctgtgtatttaa

SEQ ID NO: 3249348 - DNA, 16 bp, Homo sapiens
tttaaataaaagcaca

SEQ ID NO: 3249349 - DNA, 12 bp, Homo sapiens
tttaaataaaat

SEQ ID NO: 3249350 - DNA, 14 bp, Homo sapiens
tttaaataaaatca

SEQ ID NO: 3249351 - DNA, 12 bp, Homo sapiens
tttaaataaact

SEQ ID NO: 3249352 - DNA, 14 bp, Homo sapiens
tttaaataaacttt

SEQ ID NO: 3249353 - DNA, 15 bp, Homo sapiens
tttaaataaactttt

SEQ ID NO: 3249354 - DNA, 22 bp, Homo sapiens
tttaaataaactttttttcaat

SEQ ID NO: 3249355 - DNA, 18 bp, Homo sapiens
tttaaataaatgttattg

SEQ ID NO: 3249356 - DNA, 11 bp, Homo sapiens
tttaaatacat

SEQ ID NO: 3249357 - DNA, 13 bp, Homo sapiens
tttaaatataatt

SEQ ID NO: 3249358 - DNA, 15 bp, Homo sapiens
tttaaatataattct

SEQ ID NO: 3249359 - DNA, 16 bp, Homo sapiens
tttaaatatatatttt

SEQ ID NO: 3249360 - DNA, 13 bp, Homo sapiens
tttaaatattttc

SEQ ID NO: 3249361 - DNA, 14 bp, Homo sapiens
tttaaatcatgtat

SEQ ID NO: 3249362 - DNA, 20 bp, Homo sapiens
tttaaatcatgtatgttatg

SEQ ID NO: 3249363 - DNA, 21 bp, Homo sapiens
tttaaatcatgtatgttatga

SEQ ID NO: 3249364 - DNA, 19 bp, Homo sapiens
tttaaatctaaatctattt

SEQ ID NO: 3249365 - DNA, 20 bp, Homo sapiens
tttaaattaatatctttctg

SEQ ID NO: 3249366 - DNA, 21 bp, Homo sapiens
tttaaattcacaatagaaact

SEQ ID NO: 3249367 - DNA, 11 bp, Homo sapiens
tttaaattgtg

SEQ ID NO: 3249368 - DNA, 20 bp, Homo sapiens
tttaaattttaaaaagcagc

SEQ ID NO: 3249369 - DNA, 14 bp, Homo sapiens
tttaaattttcacc

SEQ ID NO: 3249370 - DNA, 18 bp, Homo sapiens
tttaaatttttttcctta

SEQ ID NO: 3249371 - DNA, 12 bp, Homo sapiens
tttaacaaacta

SEQ ID NO: 3249372 - DNA, 15 bp, Homo sapiens
tttaacaaactaaaa

SEQ ID NO: 3249373 - DNA, 17 bp, Homo sapiens
tttaacaaactaaaaat

SEQ ID NO: 3249374 - DNA, 19 bp, Homo sapiens
ttggtaaaaatgctgctct

SEQ ID NO: 3249375 - DNA, 20 bp, Homo sapiens
ttggtaaaaatgctgctctc

SEQ ID NO: 3249376 - DNA, 19 bp, Homo sapiens
ttggtaaaactcactgtga

SEQ ID NO: 3249377 - DNA, 14 bp, Homo sapiens
ttggtaaatgtttc

SEQ ID NO: 3249378 - DNA, 19 bp, Homo sapiens
ttggtaacacaaattttca

SEQ ID NO: 3249379 - DNA, 22 bp, Homo sapiens
ttggtacagttgcaggagcgtg

SEQ ID NO: 3249380 - DNA, 20 bp, Homo sapiens
ttggtacatggccagtgtga

SEQ ID NO: 3249381 - DNA, 22 bp, Homo sapiens
ttggtactactagatgtcttta

SEQ ID NO: 3249382 - DNA, 19 bp, Homo sapiens
ttggtagatgcatgacttg

SEQ ID NO: 3249383 - DNA, 18 bp, Homo sapiens
ttggtaggcttatcaaaa

SEQ ID NO: 3249384 - DNA, 12 bp, Homo sapiens
ttggtatatttt

SEQ ID NO: 3249385 - DNA, 16 bp, Homo sapiens
ttggtattaataaaaa

SEQ ID NO: 3249386 - DNA, 18 bp, Homo sapiens
ttggtattaataaaaaga

SEQ ID NO: 3249387 - DNA, 21 bp, Homo sapiens
ttggtattatataattcaagg

SEQ ID NO: 3249388 - DNA, 17 bp, Homo sapiens
ttggtcagagccactct

SEQ ID NO: 3249389 - DNA, 12 bp, Homo sapiens
ttggtcagcttt

SEQ ID NO: 3249390 - DNA, 13 bp, Homo sapiens
ttggtccaaaaaa

SEQ ID NO: 3249391 - DNA, 15 bp, Homo sapiens
ttggtccctggtccc

SEQ ID NO: 3249392 - DNA, 13 bp, Homo sapiens
ttggtctattttc

SEQ ID NO: 3249393 - DNA, 18 bp, Homo sapiens
ttggtctctatttcattt

SEQ ID NO: 3249394 - DNA, 17 bp, Homo sapiens
ttggtctgggacttcct

SEQ ID NO: 3249395 - DNA, 16 bp, Homo sapiens
ttggtctgtgagatgc

SEQ ID NO: 3249396 - DNA, 13 bp, Homo sapiens
ttggtctgtgtga

SEQ ID NO: 3249397 - DNA, 15 bp, Homo sapiens
ttggtgactgtccca

SEQ ID NO: 3249398 - DNA, 17 bp, Homo sapiens
ttggtgataagtggaaa

SEQ ID NO: 3249399 - DNA, 16 bp, Homo sapiens
ttggtgattcaaatgg

SEQ ID NO: 3249400 - DNA, 14 bp, Homo sapiens
ttggtgcctttcct

SEQ ID NO: 3249401 - DNA, 20 bp, Homo sapiens
ttggtgcgggcacaataaat

SEQ ID NO: 3249402 - DNA, 19 bp, Homo sapiens
ttggtgctatttgaagaaa

SEQ ID NO: 3249403 - DNA, 15 bp, Homo sapiens
ttggtgctgatggag

SEQ ID NO: 3249404 - DNA, 20 bp, Homo sapiens
ttggtggagagtggaaggac

SEQ ID NO: 3249405 - DNA, 14 bp, Homo sapiens
ttggtggatgtaaa

SEQ ID NO: 3249406 - DNA, 21 bp, Homo sapiens
ttggtggcagattttacaaaa

SEQ ID NO: 3249407 - DNA, 12 bp, Homo sapiens
ttggtggttttt

SEQ ID NO: 3249408 - DNA, 20 bp, Homo sapiens
ttggtgtaaagccaacaccc

SEQ ID NO: 3249409 - DNA, 12 bp, Homo sapiens
ttggtgtactgg

SEQ ID NO: 3249410 - DNA, 13 bp, Homo sapiens
ttggtgtgtccca

SEQ ID NO: 3249411 - DNA, 14 bp, Homo sapiens
ttggtgttcctgga

SEQ ID NO: 3249412 - DNA, 12 bp, Homo sapiens
ttggttaaaaat

SEQ ID NO: 3249413 - DNA, 22 bp, Homo sapiens
ttggttaacaataaagtgacaa

SEQ ID NO: 3249414 - DNA, 17 bp, Homo sapiens
ttggttcatcagtgtta

SEQ ID NO: 3249415 - DNA, 14 bp, Homo sapiens
ttggttcctctctg

SEQ ID NO: 3249416 - DNA, 14 bp, Homo sapiens
ttggttctaaggac

SEQ ID NO: 3249417 - DNA, 19 bp, Homo sapiens
ttggttctgcttcaataaa

SEQ ID NO: 3249418 - DNA, 20 bp, Homo sapiens
ttggttgcattattatcatt

SEQ ID NO: 3249419 - DNA, 12 bp, Homo sapiens
ttggttgtcaat

SEQ ID NO: 3249420 - DNA, 18 bp, Homo sapiens
ttggttgtcaatattaaa

SEQ ID NO: 3249421 - DNA, 17 bp, Homo sapiens
ttggtttaaagaaagtg

SEQ ID NO: 3249422 - DNA, 15 bp, Homo sapiens
ttggtttactttcaa

SEQ ID NO: 3249423 - DNA, 16 bp, Homo sapiens
ttggtttactttcaaa

SEQ ID NO: 3249424 - DNA, 14 bp, Homo sapiens
ttggtttgtatgag

SEQ ID NO: 3249425 - DNA, 16 bp, Homo sapiens
ttggtttgtatgagat

SEQ ID NO: 3249426 - DNA, 19 bp, Homo sapiens
ttggttttaaaagcacaat

SEQ ID NO: 3249427 - DNA, 16 bp, Homo sapiens
ttgtaaaaaaaaatgc

SEQ ID NO: 3249428 - DNA, 17 bp, Homo sapiens
ttgtaaaaaaaaatgcc

SEQ ID NO: 3249429 - DNA, 23 bp, Homo sapiens
ttgtaaaaaaaaatgcctttgag

SEQ ID NO: 3249430 - DNA, 16 bp, Homo sapiens
ttgtaaaaaaagcaaa

SEQ ID NO: 3249431 - DNA, 18 bp, Homo sapiens
ttgtaaaaaaagcaaaaa

SEQ ID NO: 3249432 - DNA, 19 bp, Homo sapiens
ttgtaaaaacagcattgct

SEQ ID NO: 3249433 - DNA, 12 bp, Homo sapiens
ttgtaaaaagaa

SEQ ID NO: 3249434 - DNA, 14 bp, Homo sapiens
ttgtaaaaatatac

SEQ ID NO: 3249435 - DNA, 18 bp, Homo sapiens
ttgtaaaacaaaatttga

SEQ ID NO: 3249436 - DNA, 23 bp, Homo sapiens
ttgtcaccagttaaaagcatttt

SEQ ID NO: 3249437 - DNA, 16 bp, Homo sapiens
ttgtcactgacacaaa

SEQ ID NO: 3249438 - DNA, 14 bp, Homo sapiens
ttgtcactttttct

SEQ ID NO: 3249439 - DNA, 18 bp, Homo sapiens
ttgtcagactttaaagaa

SEQ ID NO: 3249440 - DNA, 18 bp, Homo sapiens
ttgtcagccatcgtcctg

SEQ ID NO: 3249441 - DNA, 19 bp, Homo sapiens
ttgtcagccatcgtcctgg

SEQ ID NO: 3249442 - DNA, 21 bp, Homo sapiens
ttgtcagccatcgtcctggga

SEQ ID NO: 3249443 - DNA, 12 bp, Homo sapiens
ttgtcagctact

SEQ ID NO: 3249444 - DNA, 16 bp, Homo sapiens
ttgtcagtatggcttt

SEQ ID NO: 3249445 - DNA, 14 bp, Homo sapiens
ttgtcagtattttt

SEQ ID NO: 3249446 - DNA, 18 bp, Homo sapiens
ttgtcatggttacaaact

SEQ ID NO: 3249447 - DNA, 16 bp, Homo sapiens
ttgtcatgtttattct

SEQ ID NO: 3249448 - DNA, 22 bp, Homo sapiens
ttgtccaattgttgacagttct

SEQ ID NO: 3249449 - DNA, 17 bp, Homo sapiens
ttgtcccagcctggggc

SEQ ID NO: 3249450 - DNA, 22 bp, Homo sapiens
ttgtcccattttccccttcctc

SEQ ID NO: 3249451 - DNA, 15 bp, Homo sapiens
ttgtccctgtgccta

SEQ ID NO: 3249452 - DNA, 13 bp, Homo sapiens
ttgtccctttccc

SEQ ID NO: 3249453 - DNA, 15 bp, Homo sapiens
ttgtcctgccagctg

SEQ ID NO: 3249454 - DNA, 21 bp, Homo sapiens
ttgtcctgccagctgccttcc

SEQ ID NO: 3249455 - DNA, 16 bp, Homo sapiens
ttgtccttcagagctc

SEQ ID NO: 3249456 - DNA, 17 bp, Homo sapiens
ttgtcctttcccttcag

SEQ ID NO: 3249457 - DNA, 17 bp, Homo sapiens
ttgtccttttatttctc

SEQ ID NO: 3249458 - DNA, 16 bp, Homo sapiens
ttgtccttttgtcttc

SEQ ID NO: 3249459 - DNA, 17 bp, Homo sapiens
ttgtccttttgtcttct

SEQ ID NO: 3249460 - DNA, 20 bp, Homo sapiens
ttgtcgggcaccagccagcg

SEQ ID NO: 3249461 - DNA, 13 bp, Homo sapiens
ttgtcgtttttat

SEQ ID NO: 3249462 - DNA, 15 bp, Homo sapiens
ttgtctaactcagaa

SEQ ID NO: 3249463 - DNA, 18 bp, Homo sapiens
ttgtctattctgagcctt

SEQ ID NO: 3249464 - DNA, 13 bp, Homo sapiens
ttgtctattttaa

SEQ ID NO: 3249465 - DNA, 18 bp, Homo sapiens
ttgtctatttttgtctta

SEQ ID NO: 3249466 - DNA, 13 bp, Homo sapiens
ttgtctcactttt

SEQ ID NO: 3249467 - DNA, 11 bp, Homo sapiens
ttgtctcagaa

SEQ ID NO: 3249468 - DNA, 12 bp, Homo sapiens
ttgtctcagaag

SEQ ID NO: 3249469 - DNA, 17 bp, Homo sapiens
ttgtctcctactcctga

SEQ ID NO: 3249470 - DNA, 13 bp, Homo sapiens
ttgtctccttcca

SEQ ID NO: 3249471 - DNA, 13 bp, Homo sapiens
ttgtctctccttt

SEQ ID NO: 3249472 - DNA, 21 bp, Homo sapiens
ttgtctctccttttcttttgt

SEQ ID NO: 3249473 - DNA, 15 bp, Homo sapiens
ttgtctgaacttgca

SEQ ID NO: 3249474 - DNA, 17 bp, Homo sapiens
ttgtctgaagtcactgc

SEQ ID NO: 3249475 - DNA, 14 bp, Homo sapiens
ttgtctgaggcctc

SEQ ID NO: 3249476 - DNA, 20 bp, Homo sapiens
ttgtctgatttatggttttt

SEQ ID NO: 3249477 - DNA, 23 bp, Homo sapiens
ttgtctgatttttaaagtacttt

SEQ ID NO: 3249478 - DNA, 18 bp, Homo sapiens
ttgtctgtctacatttct

SEQ ID NO: 3249479 - DNA, 15 bp, Homo sapiens
ttgtctgtgttgctg

SEQ ID NO: 3249480 - DNA, 16 bp, Homo sapiens
ttgtctgtgttgctgt

SEQ ID NO: 3249481 - DNA, 18 bp, Homo sapiens
ttgtctgtgttgctgttt

SEQ ID NO: 3249482 - DNA, 18 bp, Homo sapiens
ttgtcttcagcagtcaat

SEQ ID NO: 3249483 - DNA, 15 bp, Homo sapiens
ttgtcttgaatgtct

SEQ ID NO: 3249484 - DNA, 17 bp, Homo sapiens
ttgtcttgtacttctgt

SEQ ID NO: 3249485 - DNA, 18 bp, Homo sapiens
ttgtcttgtacttctgtg

SEQ ID NO: 3249486 - DNA, 13 bp, Homo sapiens
ttgtcttgttctg

SEQ ID NO: 3249487 - DNA, 14 bp, Homo sapiens
ttgtcttgttctgt

SEQ ID NO: 3249488 - DNA, 13 bp, Homo sapiens
ttgtctttatatg

SEQ ID NO: 3249489 - DNA, 14 bp, Homo sapiens
ttgtctttatatga

SEQ ID NO: 3249490 - DNA, 16 bp, Homo sapiens
ttgtctttatatgaac

SEQ ID NO: 3249491 - DNA, 19 bp, Homo sapiens
ttgtctttatatgaacata

SEQ ID NO: 3249492 - DNA, 13 bp, Homo sapiens
ttgtctttcagga

SEQ ID NO: 3249493 - DNA, 19 bp, Homo sapiens
ttgtctttgctgtactctt

SEQ ID NO: 3249494 - DNA, 14 bp, Homo sapiens
ttgtcttttctgct

SEQ ID NO: 3249495 - DNA, 12 bp, Homo sapiens
ttgtctttttat

SEQ ID NO: 3249496 - DNA, 17 bp, Homo sapiens
ttgtctttttataaaaa

SEQ ID NO: 3249497 - DNA, 17 bp, Homo sapiens
ttgtgaaacacagctgt

SEQ ID NO: 3249498 - DNA, 23 bp, Homo sapiens
ttgtgaaatgaaaacatgtaata

SEQ ID NO: 3249499 - DNA, 15 bp, Homo sapiens
ttgtgaactgctgga

SEQ ID NO: 3249500 - DNA, 19 bp, Homo sapiens
ttgtgaactggaagaaagc

SEQ ID NO: 3249501 - DNA, 19 bp, Homo sapiens
ttgtgaagaaaaataaagt

SEQ ID NO: 3249502 - DNA, 18 bp, Homo sapiens
ttgtgaaggattatggaa

SEQ ID NO: 3249503 - DNA, 13 bp, Homo sapiens
ttgtgaaggcagg

SEQ ID NO: 3249504 - DNA, 18 bp, Homo sapiens
ttgtgaagtattcacaaa

SEQ ID NO: 3249505 - DNA, 15 bp, Homo sapiens
ttgtgaatgcttctc

SEQ ID NO: 3249506 - DNA, 14 bp, Homo sapiens
ttgtgaatggattg

SEQ ID NO: 3249507 - DNA, 21 bp, Homo sapiens
ttgtgacaggaaagccctccc

SEQ ID NO: 3249508 - DNA, 22 bp, Homo sapiens
ttgtgacaggaaagccctcccc

SEQ ID NO: 3249509 - DNA, 22 bp, Homo sapiens
ttctacatgactgggcctccct

SEQ ID NO: 3249510 - DNA, 17 bp, Homo sapiens
ttctacattaacttgaa

SEQ ID NO: 3249511 - DNA, 15 bp, Homo sapiens
ttctacattgacaca

SEQ ID NO: 3249512 - DNA, 14 bp, Homo sapiens
ttctacatttcacc

SEQ ID NO: 3249513 - DNA, 22 bp, Homo sapiens
ttctaccatgaacagaaaacat

SEQ ID NO: 3249514 - DNA, 14 bp, Homo sapiens
ttctaccatttcag

SEQ ID NO: 3249515 - DNA, 12 bp, Homo sapiens
ttctacccagcg

SEQ ID NO: 3249516 - DNA, 21 bp, Homo sapiens
ttctacccagcgagccctggt

SEQ ID NO: 3249517 - DNA, 18 bp, Homo sapiens
ttctaccggagagagaat

SEQ ID NO: 3249518 - DNA, 18 bp, Homo sapiens
ttctaccttgaggtcttt

SEQ ID NO: 3249519 - DNA, 19 bp, Homo sapiens
ttctaccttgaggtctttt

SEQ ID NO: 3249520 - DNA, 20 bp, Homo sapiens
ttctacggatcatcaacaag

SEQ ID NO: 3249521 - DNA, 14 bp, Homo sapiens
ttctactatataca

SEQ ID NO: 3249522 - DNA, 15 bp, Homo sapiens
ttctactatatacat

SEQ ID NO: 3249523 - DNA, 22 bp, Homo sapiens
ttctacttgcttattacattta

SEQ ID NO: 3249524 - DNA, 19 bp, Homo sapiens
ttctagaaagagaaacagt

SEQ ID NO: 3249525 - DNA, 14 bp, Homo sapiens
ttctagaaccactt

SEQ ID NO: 3249526 - DNA, 22 bp, Homo sapiens
ttctagaacctgggctgtgctg

SEQ ID NO: 3249527 - DNA, 22 bp, Homo sapiens
ttctagaagataacattttcaa

SEQ ID NO: 3249528 - DNA, 15 bp, Homo sapiens
ttctagaagcacatg

SEQ ID NO: 3249529 - DNA, 16 bp, Homo sapiens
ttctagaagcacatgt

SEQ ID NO: 3249530 - DNA, 22 bp, Homo sapiens
ttctagaattataagtcacaaa

SEQ ID NO: 3249531 - DNA, 23 bp, Homo sapiens
ttctagacatggaggttctaagg

SEQ ID NO: 3249532 - DNA, 15 bp, Homo sapiens
ttctagaggcctcag

SEQ ID NO: 3249533 - DNA, 23 bp, Homo sapiens
ttctagatcagatgctccaagat

SEQ ID NO: 3249534 - DNA, 22 bp, Homo sapiens
ttctagatgattaaataagatt

SEQ ID NO: 3249535 - DNA, 18 bp, Homo sapiens
ttctagcaattttctttg

SEQ ID NO: 3249536 - DNA, 18 bp, Homo sapiens
ttctagctagaaatatga

SEQ ID NO: 3249537 - DNA, 12 bp, Homo sapiens
ttctagctgttg

SEQ ID NO: 3249538 - DNA, 21 bp, Homo sapiens
ttctaggatagttgatgcatg

SEQ ID NO: 3249539 - DNA, 23 bp, Homo sapiens
ttctaggcactgtagttctaaga

SEQ ID NO: 3249540 - DNA, 19 bp, Homo sapiens
ttctaggcatctctgtact

SEQ ID NO: 3249541 - DNA, 15 bp, Homo sapiens
ttctaggttctaaaa

SEQ ID NO: 3249542 - DNA, 21 bp, Homo sapiens
ttctagtctcctttgcactga

SEQ ID NO: 3249543 - DNA, 23 bp, Homo sapiens
ttctagtctcctttgcactgagg

SEQ ID NO: 3249544 - DNA, 15 bp, Homo sapiens
ttctagtggtctttg

SEQ ID NO: 3249545 - DNA, 19 bp, Homo sapiens
ttctagtggtctttgtaag

SEQ ID NO: 3249546 - DNA, 17 bp, Homo sapiens
ttctagttttttttcta

SEQ ID NO: 3249547 - DNA, 15 bp, Homo sapiens
ttctataaatcagta

SEQ ID NO: 3249548 - DNA, 14 bp, Homo sapiens
ttctataacagata

SEQ ID NO: 3249549 - DNA, 13 bp, Homo sapiens
ttctatacaaata

SEQ ID NO: 3249550 - DNA, 21 bp, Homo sapiens
ttctatacaaatataaatctt

SEQ ID NO: 3249551 - DNA, 14 bp, Homo sapiens
ttctatagccaact

SEQ ID NO: 3249552 - DNA, 21 bp, Homo sapiens
ttctatataaaatgtattcaa

SEQ ID NO: 3249553 - DNA, 17 bp, Homo sapiens
ttctatcagttatcctt

SEQ ID NO: 3249554 - DNA, 19 bp, Homo sapiens
ttctatcatttttgtacag

SEQ ID NO: 3249555 - DNA, 20 bp, Homo sapiens
ttctatcatttttgtacagt

SEQ ID NO: 3249556 - DNA, 17 bp, Homo sapiens
ttctatccaaacatgta

SEQ ID NO: 3249557 - DNA, 20 bp, Homo sapiens
ttctatccaaacatgtattt

SEQ ID NO: 3249558 - DNA, 22 bp, Homo sapiens
ttctatgatccttttttgtcat

SEQ ID NO: 3249559 - DNA, 18 bp, Homo sapiens
ttctatgcaagccttgct

SEQ ID NO: 3249560 - DNA, 15 bp, Homo sapiens
ttctatggctttcaa

SEQ ID NO: 3249561 - DNA, 17 bp, Homo sapiens
ttctatggctttcaaag

SEQ ID NO: 3249562 - DNA, 12 bp, Homo sapiens
ttctatgttaaa

SEQ ID NO: 3249563 - DNA, 17 bp, Homo sapiens
ttctatgttaaatactg

SEQ ID NO: 3249564 - DNA, 20 bp, Homo sapiens
ttctatgttaaatactgtgc

SEQ ID NO: 3249565 - DNA, 18 bp, Homo sapiens
ttctatgtttttttaatt

SEQ ID NO: 3249566 - DNA, 21 bp, Homo sapiens
ttctatgtttttttaattaaa

SEQ ID NO: 3249567 - DNA, 18 bp, Homo sapiens
ttctattatggaaaactg

SEQ ID NO: 3249568 - DNA, 14 bp, Homo sapiens
ttctattccttctg

SEQ ID NO: 3249569 - DNA, 19 bp, Homo sapiens
ttctattgttactctggtt

SEQ ID NO: 3249570 - DNA, 17 bp, Homo sapiens
ttctattgtttattctt

SEQ ID NO: 3249571 - DNA, 22 bp, Homo sapiens
ttctattttaagactgatttta

SEQ ID NO: 3249572 - DNA, 13 bp, Homo sapiens
ttctattttgtaa

SEQ ID NO: 3249573 - DNA, 16 bp, Homo sapiens
ttctattttgtaaact

SEQ ID NO: 3249574 - DNA, 14 bp, Homo sapiens
ttctatttttatca

SEQ ID NO: 3249575 - DNA, 18 bp, Homo sapiens
ttctatttttatcatgaa

SEQ ID NO: 3249576 - DNA, 20 bp, Homo sapiens
ttctatttttatcatgaatt

SEQ ID NO: 3249577 - DNA, 18 bp, Homo sapiens
ttctatttttcaatcatc

SEQ ID NO: 3249578 - DNA, 20 bp, Homo sapiens
ttctcaaaagcatttatcat

SEQ ID NO: 3249579 - DNA, 21 bp, Homo sapiens
ttctcaaaagcatttatcatt

SEQ ID NO: 3249580 - DNA, 18 bp, Homo sapiens
ttctcaaagatctgaatt

SEQ ID NO: 3249581 - DNA, 20 bp, Homo sapiens
ttctcaaaggccctcagtga

SEQ ID NO: 3249582 - DNA, 14 bp, Homo sapiens
ttctcaaagtttta

SEQ ID NO: 3249583 - DNA, 19 bp, Homo sapiens
ttctcaaagttttattata

SEQ ID NO: 3249584 - DNA, 15 bp, Homo sapiens
ttctcaagtgcctta

SEQ ID NO: 3249585 - DNA, 14 bp, Homo sapiens
ttctcaagttctaa

SEQ ID NO: 3249586 - DNA, 17 bp, Homo sapiens
ttctcaagttctaagat

SEQ ID NO: 3249587 - DNA, 14 bp, Homo sapiens
ttctcacacccacc

SEQ ID NO: 3249588 - DNA, 15 bp, Homo sapiens
ttctcacacccaccg

SEQ ID NO: 3249589 - DNA, 21 bp, Homo sapiens
ttctcacactggtctgctgtc

SEQ ID NO: 3249590 - DNA, 18 bp, Homo sapiens
ttctcacatctgtccaga

SEQ ID NO: 3249591 - DNA, 18 bp, Homo sapiens
ttctcacctgctccagga

SEQ ID NO: 3249592 - DNA, 18 bp, Homo sapiens
ttctcactgttccctctg

SEQ ID NO: 3249593 - DNA, 22 bp, Homo sapiens
ttctcagaatctcaaataacta

SEQ ID NO: 3249594 - DNA, 17 bp, Homo sapiens
ttctcagagcatgtgtc

SEQ ID NO: 3249595 - DNA, 15 bp, Homo sapiens
ttctcagagccaagt

SEQ ID NO: 3249596 - DNA, 13 bp, Homo sapiens
ttctcagctcccc

SEQ ID NO: 3249597 - DNA, 14 bp, Homo sapiens
ttctcagctccccc

SEQ ID NO: 3249598 - DNA, 16 bp, Homo sapiens
ttctcagctccccctg

SEQ ID NO: 3249599 - DNA, 18 bp, Homo sapiens
ttctcagctccccctgtc

SEQ ID NO: 3249600 - DNA, 20 bp, Homo sapiens
ttctcagctccccctgtccc

SEQ ID NO: 3249601 - DNA, 16 bp, Homo sapiens
ttctcagggctcctgc

SEQ ID NO: 3249602 - DNA, 12 bp, Homo sapiens
ttctcagtgtgc

SEQ ID NO: 3249603 - DNA, 15 bp, Homo sapiens
ttctcagtttgtata

SEQ ID NO: 3249604 - DNA, 14 bp, Homo sapiens
ttctcagttttcat

SEQ ID NO: 3249605 - DNA, 13 bp, Homo sapiens
ttctcatagcatt

SEQ ID NO: 3249606 - DNA, 14 bp, Homo sapiens
ttctcatagcatta

SEQ ID NO: 3249607 - DNA, 17 bp, Homo sapiens
ttctcatagcattaact

SEQ ID NO: 3249608 - DNA, 18 bp, Homo sapiens
ttctcatagcattaacta

SEQ ID NO: 3249609 - DNA, 20 bp, Homo sapiens
ttctcataggaaaagtacat

SEQ ID NO: 3249610 - DNA, 16 bp, Homo sapiens
ttctcattttcttttc

SEQ ID NO: 3249611 - DNA, 13 bp, Homo sapiens
ttctccaaataaa

SEQ ID NO: 3249612 - DNA, 13 bp, Homo sapiens
ttctccaccctgc

SEQ ID NO: 3249613 - DNA, 18 bp, Homo sapiens
ttctccagaatgtaagaa

SEQ ID NO: 3249614 - DNA, 19 bp, Homo sapiens
ttctccagacccaccacac

SEQ ID NO: 3249615 - DNA, 20 bp, Homo sapiens
ttctccagctcagaacccag

SEQ ID NO: 3249616 - DNA, 15 bp, Homo sapiens
ttctccagctgggct

SEQ ID NO: 3249617 - DNA, 20 bp, Homo sapiens
ttctccaggtctcacgggca

SEQ ID NO: 3249618 - DNA, 13 bp, Homo sapiens
ttctccatcagct

SEQ ID NO: 3249619 - DNA, 19 bp, Homo sapiens
ttctcccaggtaccagctg

SEQ ID NO: 3249620 - DNA, 13 bp, Homo sapiens
ttctccccagaat

SEQ ID NO: 3249621 - DNA, 22 bp, Homo sapiens
ttctccccatccccttcctaaa

SEQ ID NO: 3249622 - DNA, 16 bp, Homo sapiens
ttctgcttcagcctcc

SEQ ID NO: 3249623 - DNA, 19 bp, Homo sapiens
ttctgcttcagcctcccga

SEQ ID NO: 3249624 - DNA, 18 bp, Homo sapiens
ttctgcttgtgttaagta

SEQ ID NO: 3249625 - DNA, 17 bp, Homo sapiens
ttctgctttatcttttc

SEQ ID NO: 3249626 - DNA, 15 bp, Homo sapiens
ttctgctttctttga

SEQ ID NO: 3249627 - DNA, 19 bp, Homo sapiens
ttctgctttctttgattct

SEQ ID NO: 3249628 - DNA, 19 bp, Homo sapiens
ttctgcttttctgccctgg

SEQ ID NO: 3249629 - DNA, 18 bp, Homo sapiens
ttctggaaggctggctga

SEQ ID NO: 3249630 - DNA, 19 bp, Homo sapiens
ttctggaaggctggctgag

SEQ ID NO: 3249631 - DNA, 17 bp, Homo sapiens
ttctggaatacatgaaa

SEQ ID NO: 3249632 - DNA, 14 bp, Homo sapiens
ttctggaatttgtt

SEQ ID NO: 3249633 - DNA, 18 bp, Homo sapiens
ttctggaatttgttcaag

SEQ ID NO: 3249634 - DNA, 21 bp, Homo sapiens
ttctggaatttgttcaagttt

SEQ ID NO: 3249635 - DNA, 11 bp, Homo sapiens
ttctggactgg

SEQ ID NO: 3249636 - DNA, 21 bp, Homo sapiens
ttctggactggcgttcacctc

SEQ ID NO: 3249637 - DNA, 19 bp, Homo sapiens
ttctggaggaaagggagga

SEQ ID NO: 3249638 - DNA, 10 bp, Homo sapiens
ttctggctca

SEQ ID NO: 3249639 - DNA, 16 bp, Homo sapiens
ttctggctctcccatt

SEQ ID NO: 3249640 - DNA, 18 bp, Homo sapiens
ttctggctgaaaaaggcc

SEQ ID NO: 3249641 - DNA, 19 bp, Homo sapiens
ttctgggaagcttgagcct

SEQ ID NO: 3249642 - DNA, 22 bp, Homo sapiens
ttctgggaagcttgagcctccc

SEQ ID NO: 3249643 - DNA, 12 bp, Homo sapiens
ttcctgggcctg

SEQ ID NO: 3249644 - DNA, 18 bp, Homo sapiens
ttcctggtacccagccat

SEQ ID NO: 3249645 - DNA, 15 bp, Homo sapiens
ttcctggtgactcct

SEQ ID NO: 3249646 - DNA, 14 bp, Homo sapiens
ttcctgtatgttgt

SEQ ID NO: 3249647 - DNA, 13 bp, Homo sapiens
ttcctgtcagtgt

SEQ ID NO: 3249648 - DNA, 16 bp, Homo sapiens
ttcctgtcagtgtttt

SEQ ID NO: 3249649 - DNA, 20 bp, Homo sapiens
ttcctgtctagtctctcctg

SEQ ID NO: 3249650 - DNA, 22 bp, Homo sapiens
ttcctgtgctaagtctttccca

SEQ ID NO: 3249651 - DNA, 17 bp, Homo sapiens
ttcctgtgtgtactctg

SEQ ID NO: 3249652 - DNA, 21 bp, Homo sapiens
ttcctgtgtgtccaaaactgc

SEQ ID NO: 3249653 - DNA, 21 bp, Homo sapiens
ttcctgttcagcattcttagc

SEQ ID NO: 3249654 - DNA, 19 bp, Homo sapiens
ttcctgttcagtaataaaa

SEQ ID NO: 3249655 - DNA, 15 bp, Homo sapiens
ttccttacccaaact

SEQ ID NO: 3249656 - DNA, 13 bp, Homo sapiens
ttccttacctttt

SEQ ID NO: 3249657 - DNA, 11 bp, Homo sapiens
ttccttcctaa

SEQ ID NO: 3249658 - DNA, 18 bp, Homo sapiens
ttccttcggtcttttgta

SEQ ID NO: 3249659 - DNA, 15 bp, Homo sapiens
ttccttctctgaaca

SEQ ID NO: 3249660 - DNA, 17 bp, Homo sapiens
ttccttctctgaacaca

SEQ ID NO: 3249661 - DNA, 13 bp, Homo sapiens
ttccttctggcct

SEQ ID NO: 3249662 - DNA, 14 bp, Homo sapiens
ttccttctggcctt

SEQ ID NO: 3249663 - DNA, 20 bp, Homo sapiens
ttccttctgggactggacag

SEQ ID NO: 3249664 - DNA, 12 bp, Homo sapiens
ttccttctttga

SEQ ID NO: 3249665 - DNA, 13 bp, Homo sapiens
ttccttctttgat

SEQ ID NO: 3249666 - DNA, 19 bp, Homo sapiens
ttccttctttgataatgtt

SEQ ID NO: 3249667 - DNA, 22 bp, Homo sapiens
ttccttctttgataatgttaaa

SEQ ID NO: 3249668 - DNA, 18 bp, Homo sapiens
ttccttgaccttcctctg

SEQ ID NO: 3249669 - DNA, 24 bp, Homo sapiens
ttccttgagacacggagcccagcc

SEQ ID NO: 3249670 - DNA, 13 bp, Homo sapiens
ttccttgatcatt

SEQ ID NO: 3249671 - DNA, 13 bp, Homo sapiens
ttccttgccccac

SEQ ID NO: 3249672 - DNA, 19 bp, Homo sapiens
ttccttgccccacagttgt

SEQ ID NO: 3249673 - DNA, 18 bp, Homo sapiens
ttccttgctgtcctaggc

SEQ ID NO: 3249674 - DNA, 15 bp, Homo sapiens
ttccttggctttatg

SEQ ID NO: 3249675 - DNA, 23 bp, Homo sapiens
ttccttggtcctagtaagaagac

SEQ ID NO: 3249676 - DNA, 12 bp, Homo sapiens
ttccttgtactc

SEQ ID NO: 3249677 - DNA, 14 bp, Homo sapiens
ttccttgtactctt

SEQ ID NO: 3249678 - DNA, 16 bp, Homo sapiens
ttcctttaaaaaaatt

SEQ ID NO: 3249679 - DNA, 14 bp, Homo sapiens
ttcctttccccagc

SEQ ID NO: 3249680 - DNA, 16 bp, Homo sapiens
ttcctttccccagccc

SEQ ID NO: 3249681 - DNA, 10 bp, Homo sapiens
ttcctttctc

SEQ ID NO: 3249682 - DNA, 15 bp, Homo sapiens
ttcctttctctttct

SEQ ID NO: 3249683 - DNA, 16 bp, Homo sapiens
ttcctttgcaccctgt

SEQ ID NO: 3249684 - DNA, 18 bp, Homo sapiens
ttcctttgcaccctgtag

SEQ ID NO: 3249685 - DNA, 15 bp, Homo sapiens
ttccttttggaacat

SEQ ID NO: 3249686 - DNA, 19 bp, Homo sapiens
ttcctttttaaatgtgaat

SEQ ID NO: 3249687 - DNA, 15 bp, Homo sapiens
ttccttttttgtcta

SEQ ID NO: 3249688 - DNA, 19 bp, Homo sapiens
ttccttttttgtctatgaa

SEQ ID NO: 3249689 - DNA, 22 bp, Homo sapiens
ttcgaaacctgggattcaggaa

SEQ ID NO: 3249690 - DNA, 22 bp, Homo sapiens
ttcgaagccttgcctaaattta

SEQ ID NO: 3249691 - DNA, 17 bp, Homo sapiens
ttcgaatggggtagaaa

SEQ ID NO: 3249692 - DNA, 15 bp, Homo sapiens
ttcgacatatttcct

SEQ ID NO: 3249693 - DNA, 19 bp, Homo sapiens
ttcgactggtccagctctg

SEQ ID NO: 3249694 - DNA, 22 bp, Homo sapiens
ttcgactggtccagctctgaca

SEQ ID NO: 3249695 - DNA, 16 bp, Homo sapiens
ttcgagaccagcctcg

SEQ ID NO: 3249696 - DNA, 18 bp, Homo sapiens
ttcgatctcattcagtat

SEQ ID NO: 3249697 - DNA, 15 bp, Homo sapiens
ttcgatttctacctc

SEQ ID NO: 3249698 - DNA, 19 bp, Homo sapiens
ttcgcatggtcacacactg

SEQ ID NO: 3249699 - DNA, 20 bp, Homo sapiens
ttcgcatggtcacacactga

SEQ ID NO: 3249700 - DNA, 23 bp, Homo sapiens
ttcgcatggtcacacactgatgc

SEQ ID NO: 3249701 - DNA, 16 bp, Homo sapiens
ttcgcctttgtcttgt

SEQ ID NO: 3249702 - DNA, 20 bp, Homo sapiens
ttcgcctttgtcttgtactt

SEQ ID NO: 3249703 - DNA, 15 bp, Homo sapiens
ttcgctcctgtgtct

SEQ ID NO: 3249704 - DNA, 19 bp, Homo sapiens
ttcgctgctctagctggca

SEQ ID NO: 3249705 - DNA, 17 bp, Homo sapiens
ttcgctggctcctaccc

SEQ ID NO: 3249706 - DNA, 15 bp, Homo sapiens
ttcgctgtgttcatg

SEQ ID NO: 3249707 - DNA, 19 bp, Homo sapiens
ttcggaactgtcctttcct

SEQ ID NO: 3249708 - DNA, 17 bp, Homo sapiens
ttcggacagacatatgg

SEQ ID NO: 3249709 - DNA, 17 bp, Homo sapiens
ttcggccccatgtatct

SEQ ID NO: 3249710 - DNA, 18 bp, Homo sapiens
ttcggccccatgtatctc

SEQ ID NO: 3249711 - DNA, 16 bp, Homo sapiens
ttcggctctgggtggg

SEQ ID NO: 3249712 - DNA, 13 bp, Homo sapiens
ttcgggctgtgcc

SEQ ID NO: 3249713 - DNA, 21 bp, Homo sapiens
ttcggggcgatgctccctcag

SEQ ID NO: 3249714 - DNA, 14 bp, Homo sapiens
ttcggtcttttgta

SEQ ID NO: 3249715 - DNA, 19 bp, Homo sapiens
ttcggttctccagaatgta

SEQ ID NO: 3249716 - DNA, 13 bp, Homo sapiens
ttcgtaacacagc

SEQ ID NO: 3249717 - DNA, 19 bp, Homo sapiens
ttcgtacataataagtttc

SEQ ID NO: 3249718 - DNA, 13 bp, Homo sapiens
ttcgtatgaaaat

SEQ ID NO: 3249719 - DNA, 12 bp, Homo sapiens
ttcgtctgttgt

SEQ ID NO: 3249720 - DNA, 14 bp, Homo sapiens
ttcgtcttcactct

SEQ ID NO: 3249721 - DNA, 13 bp, Homo sapiens
ttcgtcttctaat

SEQ ID NO: 3249722 - DNA, 15 bp, Homo sapiens
ttcgtgagctgggga

SEQ ID NO: 3249723 - DNA, 18 bp, Homo sapiens
ttcgtgagctggggactc

SEQ ID NO: 3249724 - DNA, 13 bp, Homo sapiens
ttcgtggggaggt

SEQ ID NO: 3249725 - DNA, 20 bp, Homo sapiens
ttcgtgtagtggaagagcag

SEQ ID NO: 3249726 - DNA, 17 bp, Homo sapiens
ttcgtgtctctcccacc

SEQ ID NO: 3249727 - DNA, 20 bp, Homo sapiens
ttcgttccctgattatttat

SEQ ID NO: 3249728 - DNA, 14 bp, Homo sapiens
ttcgtttctgtata

SEQ ID NO: 3249729 - DNA, 22 bp, Homo sapiens
ttcgttttggttaagttggctt

SEQ ID NO: 3249730 - DNA, 18 bp, Homo sapiens
ttctaaaaattgtgatca

SEQ ID NO: 3249731 - DNA, 21 bp, Homo sapiens
ttctaaaatcttatagttcta

SEQ ID NO: 3249732 - DNA, 19 bp, Homo sapiens
ttctaaaatgtgatgttct

SEQ ID NO: 3249733 - DNA, 23 bp, Homo sapiens
ttctaaaatgtgatgttctaagg

SEQ ID NO: 3249734 - DNA, 22 bp, Homo sapiens
ttctaaacaagaaccatttgca

SEQ ID NO: 3249735 - DNA, 23 bp, Homo sapiens
ttctaaacccaatccaaatggcg

SEQ ID NO: 3249736 - DNA, 13 bp, Homo sapiens
ttctaaagataat

SEQ ID NO: 3249737 - DNA, 16 bp, Homo sapiens
ttctaaagattctata

SEQ ID NO: 3249738 - DNA, 22 bp, Homo sapiens
ttctaaagattctatagttcta

SEQ ID NO: 3249739 - DNA, 12 bp, Homo sapiens
ttctaaagtgtt

SEQ ID NO: 3249740 - DNA, 16 bp, Homo sapiens
ttctaaagttctaaga

SEQ ID NO: 3249741 - DNA, 17 bp, Homo sapiens
ttctaaagttctaagat

SEQ ID NO: 3249742 - DNA, 20 bp, Homo sapiens
ttctaaagttctaagattct

SEQ ID NO: 3249743 - DNA, 23 bp, Homo sapiens
ttctaaatacatgccacatcaaa

SEQ ID NO: 3249744 - DNA, 15 bp, Homo sapiens
ttctaaatgaatgtt

SEQ ID NO: 3249745 - DNA, 19 bp, Homo sapiens
ttctaacaaaaaaatatat

SEQ ID NO: 3249746 - DNA, 18 bp, Homo sapiens
ttctaagaaaagcatttt

SEQ ID NO: 3249747 - DNA, 12 bp, Homo sapiens
ttctaagactca

SEQ ID NO: 3249748 - DNA, 20 bp, Homo sapiens
ttctaagactcaaatgttct

SEQ ID NO: 3249749 - DNA, 20 bp, Homo sapiens
ttctaagacttactctaaga

SEQ ID NO: 3249750 - DNA, 19 bp, Homo sapiens
ttctaagatgtgatattct

SEQ ID NO: 3249751 - DNA, 12 bp, Homo sapiens
ttctaagattct

SEQ ID NO: 3249752 - DNA, 16 bp, Homo sapiens
ttctaagattctaaag

SEQ ID NO: 3249753 - DNA, 17 bp, Homo sapiens
ttctaagattctaatga

SEQ ID NO: 3249754 - DNA, 19 bp, Homo sapiens
ttctaagattctaatgatg

SEQ ID NO: 3249755 - DNA, 14 bp, Homo sapiens
ttctaagattctga

SEQ ID NO: 3249756 - DNA, 21 bp, Homo sapiens
ttctaagccagttttcatttt

SEQ ID NO: 3249757 - DNA, 14 bp, Homo sapiens
ttctaaggaatgca

SEQ ID NO: 3249758 - DNA, 17 bp, Homo sapiens
ttctaaggaatgcacaa

SEQ ID NO: 3249759 - DNA, 23 bp, Homo sapiens
ttctaaggacctgaaattccaaa

SEQ ID NO: 3249760 - DNA, 15 bp, Homo sapiens
ttctaaggcctagga

SEQ ID NO: 3249761 - DNA, 22 bp, Homo sapiens
ttctaaggcctaggattctaaa

SEQ ID NO: 3249762 - DNA, 16 bp, Homo sapiens
ttctaaggctctgaga

SEQ ID NO: 3249763 - DNA, 20 bp, Homo sapiens
ttctaaggctctgagagtct

SEQ ID NO: 3249764 - DNA, 21 bp, Homo sapiens
ttctaagttcatgtttgtaaa

SEQ ID NO: 3249765 - DNA, 18 bp, Homo sapiens
ttctaagtttctaagatt

SEQ ID NO: 3249766 - DNA, 21 bp, Homo sapiens
ttctaagtttctaagattcta

SEQ ID NO: 3249767 - DNA, 22 bp, Homo sapiens
ttctaataaatatactatgaaa

SEQ ID NO: 3249768 - DNA, 16 bp, Homo sapiens
ttctaataaattatac

SEQ ID NO: 3249769 - DNA, 19 bp, Homo sapiens
ttcacctgtgacaaaggat

SEQ ID NO: 3249770 - DNA, 23 bp, Homo sapiens
ttcacctgttaaggtggaaaatg

SEQ ID NO: 3249771 - DNA, 12 bp, Homo sapiens
ttcacctgttat

SEQ ID NO: 3249772 - DNA, 22 bp, Homo sapiens
ttcacctgtttttaagctgttt

SEQ ID NO: 3249773 - DNA, 22 bp, Homo sapiens
ttcacgtcttggtgccttttgt

SEQ ID NO: 3249774 - DNA, 19 bp, Homo sapiens
ttcacgtttttctggacca

SEQ ID NO: 3249775 - DNA, 17 bp, Homo sapiens
ttcactactttaataaa

SEQ ID NO: 3249776 - DNA, 13 bp, Homo sapiens
ttcactagctttg

SEQ ID NO: 3249777 - DNA, 14 bp, Homo sapiens
ttcactcactgtca

SEQ ID NO: 3249778 - DNA, 23 bp, Homo sapiens
ttcactccggtgtgcctgcagcc

SEQ ID NO: 3249779 - DNA, 15 bp, Homo sapiens
ttcactctccagggt

SEQ ID NO: 3249780 - DNA, 12 bp, Homo sapiens
ttcactctctga

SEQ ID NO: 3249781 - DNA, 13 bp, Homo sapiens
ttcactctctgaa

SEQ ID NO: 3249782 - DNA, 23 bp, Homo sapiens
ttcactcttaggcactttggggg

SEQ ID NO: 3249783 - DNA, 15 bp, Homo sapiens
ttcactgagctcccc

SEQ ID NO: 3249784 - DNA, 18 bp, Homo sapiens
ttcactgagctccccaga

SEQ ID NO: 3249785 - DNA, 17 bp, Homo sapiens
ttcactggagttacatt

SEQ ID NO: 3249786 - DNA, 19 bp, Homo sapiens
ttcactggtctctaagtgt

SEQ ID NO: 3249787 - DNA, 15 bp, Homo sapiens
ttcactgtagaatga

SEQ ID NO: 3249788 - DNA, 13 bp, Homo sapiens
ttcactgtataaa

SEQ ID NO: 3249789 - DNA, 16 bp, Homo sapiens
ttcactgttccctctg

SEQ ID NO: 3249790 - DNA, 19 bp, Homo sapiens
ttcactgtttcatctaagt

SEQ ID NO: 3249791 - DNA, 23 bp, Homo sapiens
ttcactgtttcatctaagtgcct

SEQ ID NO: 3249792 - DNA, 21 bp, Homo sapiens
ttcacttgatgatacaatgaa

SEQ ID NO: 3249793 - DNA, 12 bp, Homo sapiens
ttcacttgtatt

SEQ ID NO: 3249794 - DNA, 21 bp, Homo sapiens
ttcacttgtattgactttatg

SEQ ID NO: 3249795 - DNA, 24 bp, Homo sapiens
ttcactttaaagcaattgcataat

SEQ ID NO: 3249796 - DNA, 14 bp, Homo sapiens
ttcactttgaaaaa

SEQ ID NO: 3249797 - DNA, 13 bp, Homo sapiens
ttcacttttgttc

SEQ ID NO: 3249798 - DNA, 17 bp, Homo sapiens
ttcacttttgttctgct

SEQ ID NO: 3249799 - DNA, 20 bp, Homo sapiens
ttcagaaacccggcttcctg

SEQ ID NO: 3249800 - DNA, 16 bp, Homo sapiens
ttcagaaactacagac

SEQ ID NO: 3249801 - DNA, 16 bp, Homo sapiens
ttcagaaagacttggt

SEQ ID NO: 3249802 - DNA, 20 bp, Homo sapiens
ttcagaaatataacacattt

SEQ ID NO: 3249803 - DNA, 19 bp, Homo sapiens
ttcagaaatctggagctgg

SEQ ID NO: 3249804 - DNA, 21 bp, Homo sapiens
ttcagaaattggaacagaatg

SEQ ID NO: 3249805 - DNA, 22 bp, Homo sapiens
ttcagaacaactgcaaagaaag

SEQ ID NO: 3249806 - DNA, 22 bp, Homo sapiens
ttcagaacacacagactttctg

SEQ ID NO: 3249807 - DNA, 16 bp, Homo sapiens
ttcagaacctcttccc

SEQ ID NO: 3249808 - DNA, 18 bp, Homo sapiens
ttcagaacctcttcccca

SEQ ID NO: 3249809 - DNA, 19 bp, Homo sapiens
ttcagaacctcttccccag

SEQ ID NO: 3249810 - DNA, 19 bp, Homo sapiens
ttcagaactgcccttgctg

SEQ ID NO: 3249811 - DNA, 11 bp, Homo sapiens
ttcagaagacc

SEQ ID NO: 3249812 - DNA, 20 bp, Homo sapiens
ttcagaagtttggcaatagt

SEQ ID NO: 3249813 - DNA, 23 bp, Homo sapiens
ttcagaagtttggcaatagtttg

SEQ ID NO: 3249814 - DNA, 15 bp, Homo sapiens
ttcagaatctgaatg

SEQ ID NO: 3249815 - DNA, 18 bp, Homo sapiens
ttcagaatctgaatgtaa

SEQ ID NO: 3249816 - DNA, 14 bp, Homo sapiens
ttcagagagctggt

SEQ ID NO: 3249817 - DNA, 22 bp, Homo sapiens
ttcagagccagtgaaggagcca

SEQ ID NO: 3249818 - DNA, 18 bp, Homo sapiens
ttcagagcccccagccct

SEQ ID NO: 3249819 - DNA, 20 bp, Homo sapiens
ttcagagcccccagccctgg

SEQ ID NO: 3249820 - DNA, 16 bp, Homo sapiens
ttcagaggctgaggtg

SEQ ID NO: 3249821 - DNA, 16 bp, Homo sapiens
ttcagagtttgtgtgt

SEQ ID NO: 3249822 - DNA, 17 bp, Homo sapiens
ttcagagtttgtgtgta

SEQ ID NO: 3249823 - DNA, 22 bp, Homo sapiens
ttcagagtttgtgtgtatttgt

SEQ ID NO: 3249824 - DNA, 16 bp, Homo sapiens
ttcagatatcaaaatt

SEQ ID NO: 3249825 - DNA, 17 bp, Homo sapiens
ttcagatatcaaaattc

SEQ ID NO: 3249826 - DNA, 22 bp, Homo sapiens
ttcagatatcaaaattctagct

SEQ ID NO: 3249827 - DNA, 21 bp, Homo sapiens
ttcagatcaaaatgcctttca

SEQ ID NO: 3249828 - DNA, 15 bp, Homo sapiens
ttcagatcactgaat

SEQ ID NO: 3249829 - DNA, 14 bp, Homo sapiens
ttcagatgtcttct

SEQ ID NO: 3249830 - DNA, 17 bp, Homo sapiens
ttcagatgtcttctgcc

SEQ ID NO: 3249831 - DNA, 23 bp, Homo sapiens
ttcagatgtgcatttcacctgtg

SEQ ID NO: 3249832 - DNA, 14 bp, Homo sapiens
ttcagattgtcttg

SEQ ID NO: 3249833 - DNA, 20 bp, Homo sapiens
ttcagattttaaaaagtctt

SEQ ID NO: 3249834 - DNA, 17 bp, Homo sapiens
ttcagcacccccaccca

SEQ ID NO: 3249835 - DNA, 18 bp, Homo sapiens
ttcagcacccccacccac

SEQ ID NO: 3249836 - DNA, 21 bp, Homo sapiens
ttcagcacccccacccacctc

SEQ ID NO: 3249837 - DNA, 16 bp, Homo sapiens
ttcagcactgtccctt

SEQ ID NO: 3249838 - DNA, 17 bp, Homo sapiens
ttcagcagcaaattttc

SEQ ID NO: 3249839 - DNA, 16 bp, Homo sapiens
ttcagcagtcaataca

SEQ ID NO: 3249840 - DNA, 19 bp, Homo sapiens
ttcagcatccgcaggtgct

SEQ ID NO: 3249841 - DNA, 23 bp, Homo sapiens
ttcagcatccgcaggtgctggtc

SEQ ID NO: 3249842 - DNA, 20 bp, Homo sapiens
ttcagcatctaaagcagcag

SEQ ID NO: 3249843 - DNA, 19 bp, Homo sapiens
ttcagcattattcctccag

SEQ ID NO: 3249844 - DNA, 17 bp, Homo sapiens
ttcagcattccctccca

SEQ ID NO: 3249845 - DNA, 19 bp, Homo sapiens
ttcagcattcttagcctgt

SEQ ID NO: 3249846 - DNA, 13 bp, Homo sapiens
ttcagccttggga

SEQ ID NO: 3249847 - DNA, 14 bp, Homo sapiens
ttcagctaagctag

SEQ ID NO: 3249848 - DNA, 16 bp, Homo sapiens
ttcagctactttccat

SEQ ID NO: 3249849 - DNA, 20 bp, Homo sapiens
ttcagctactttccatttgg

SEQ ID NO: 3249850 - DNA, 15 bp, Homo sapiens
ttcagctccagctca

SEQ ID NO: 3249851 - DNA, 15 bp, Homo sapiens
ttcagctctctgtat

SEQ ID NO: 3249852 - DNA, 16 bp, Homo sapiens
ttcagctctctgtata

SEQ ID NO: 3249853 - DNA, 11 bp, Homo sapiens
ttcagctctgg

SEQ ID NO: 3249854 - DNA, 13 bp, Homo sapiens
ttcagctgagccc

SEQ ID NO: 3249855 - DNA, 14 bp, Homo sapiens
ttcagctgagccct

SEQ ID NO: 3249856 - DNA, 16 bp, Homo sapiens
ttcagctgagccctgg

SEQ ID NO: 3249857 - DNA, 19 bp, Homo sapiens
ttcagctgagccctgggga

SEQ ID NO: 3249858 - DNA, 17 bp, Homo sapiens
ttcagctgcctgaaaca

SEQ ID NO: 3249859 - DNA, 17 bp, Homo sapiens
ttcagctgctcagaatt

SEQ ID NO: 3249860 - DNA, 18 bp, Homo sapiens
ttcagctgtcctccctcc

SEQ ID NO: 3249861 - DNA, 22 bp, Homo sapiens
ttcagcttcgtttattttcaag

SEQ ID NO: 3249862 - DNA, 23 bp, Homo sapiens
ttcaggaagcaggtgtcctttcc

SEQ ID NO: 3249863 - DNA, 14 bp, Homo sapiens
ttcaggaatttaaa

SEQ ID NO: 3249864 - DNA, 17 bp, Homo sapiens
ttcaggacaacacttca

SEQ ID NO: 3249865 - DNA, 14 bp, Homo sapiens
ttcaggagcgcaag

SEQ ID NO: 3249866 - DNA, 17 bp, Homo sapiens
ttcaggagcgcaagata

SEQ ID NO: 3249867 - DNA, 14 bp, Homo sapiens
ttcaggaggctgga

SEQ ID NO: 3249868 - DNA, 21 bp, Homo sapiens
ttcaggatactctgtcagatg

SEQ ID NO: 3249869 - DNA, 20 bp, Homo sapiens
ttcaggcgattctcctgcct

SEQ ID NO: 3249870 - DNA, 16 bp, Homo sapiens
ttcaggctcttctcct

SEQ ID NO: 3249871 - DNA, 19 bp, Homo sapiens
ttcaggcttcctgcaattt

SEQ ID NO: 3249872 - DNA, 22 bp, Homo sapiens
ttcagggaatttcaggaactag

SEQ ID NO: 3249873 - DNA, 16 bp, Homo sapiens
ttcagggagaaactcc

SEQ ID NO: 3249874 - DNA, 23 bp, Homo sapiens
ttcagggagaaactccaaagtcc

SEQ ID NO: 3249875 - DNA, 16 bp, Homo sapiens
ttcagggccagaagga

SEQ ID NO: 3249876 - DNA, 17 bp, Homo sapiens
ttcaggggactcagccc

SEQ ID NO: 3249877 - DNA, 19 bp, Homo sapiens
ttcaggggactcagccctg

SEQ ID NO: 3249878 - DNA, 17 bp, Homo sapiens
ttcaggggatgggtgtg

SEQ ID NO: 3249879 - DNA, 17 bp, Homo sapiens
ttccatgtatcttttga

SEQ ID NO: 3249880 - DNA, 17 bp, Homo sapiens
ttccatgtcgcctctgc

SEQ ID NO: 3249881 - DNA, 18 bp, Homo sapiens
ttccatgtcgcctctgca

SEQ ID NO: 3249882 - DNA, 18 bp, Homo sapiens
ttccatgtgaacagcata

SEQ ID NO: 3249883 - DNA, 15 bp, Homo sapiens
ttccattaacaaatg

SEQ ID NO: 3249884 - DNA, 17 bp, Homo sapiens
ttccattaacaaatgct

SEQ ID NO: 3249885 - DNA, 14 bp, Homo sapiens
ttccattatgattc

SEQ ID NO: 3249886 - DNA, 13 bp, Homo sapiens
ttccattccagaa

SEQ ID NO: 3249887 - DNA, 16 bp, Homo sapiens
ttccattccattgttt

SEQ ID NO: 3249888 - DNA, 23 bp, Homo sapiens
ttccatttacagtctctttcttc

SEQ ID NO: 3249889 - DNA, 19 bp, Homo sapiens
ttccatttatgctggttaa

SEQ ID NO: 3249890 - DNA, 12 bp, Homo sapiens
ttccatttccaa

SEQ ID NO: 3249891 - DNA, 13 bp, Homo sapiens
ttccatttggtat

SEQ ID NO: 3249892 - DNA, 13 bp, Homo sapiens
ttccattttaatt

SEQ ID NO: 3249893 - DNA, 12 bp, Homo sapiens
ttccattttatg

SEQ ID NO: 3249894 - DNA, 14 bp, Homo sapiens
ttccattttatgca

SEQ ID NO: 3249895 - DNA, 16 bp, Homo sapiens
ttccattttatgcaga

SEQ ID NO: 3249896 - DNA, 18 bp, Homo sapiens
ttccattttcccccacta

SEQ ID NO: 3249897 - DNA, 19 bp, Homo sapiens
ttccatttttcctctgttc

SEQ ID NO: 3249898 - DNA, 14 bp, Homo sapiens
ttcccaagctctgc

SEQ ID NO: 3249899 - DNA, 15 bp, Homo sapiens
ttcccaagctctgct

SEQ ID NO: 3249900 - DNA, 16 bp, Homo sapiens
ttcccaagctctgctc

SEQ ID NO: 3249901 - DNA, 17 bp, Homo sapiens
ttcccaaggccttaagc

SEQ ID NO: 3249902 - DNA, 17 bp, Homo sapiens
ttcccaagtcagacaga

SEQ ID NO: 3249903 - DNA, 20 bp, Homo sapiens
ttcccaatagcaacgtagct

SEQ ID NO: 3249904 - DNA, 14 bp, Homo sapiens
ttcccacctccctg

SEQ ID NO: 3249905 - DNA, 21 bp, Homo sapiens
ttcccacctccctgcccaggc

SEQ ID NO: 3249906 - DNA, 14 bp, Homo sapiens
ttcccacgaggaat

SEQ ID NO: 3249907 - DNA, 15 bp, Homo sapiens
ttcccactgtttaag

SEQ ID NO: 3249908 - DNA, 17 bp, Homo sapiens
ttcccactttcccaccc

SEQ ID NO: 3249909 - DNA, 14 bp, Homo sapiens
ttcccagaggcaga

SEQ ID NO: 3249910 - DNA, 18 bp, Homo sapiens
ttcccagccatgcccagg

SEQ ID NO: 3249911 - DNA, 20 bp, Homo sapiens
ttcccagccatgcccaggac

SEQ ID NO: 3249912 - DNA, 14 bp, Homo sapiens
ttcccagctccccc

SEQ ID NO: 3249913 - DNA, 18 bp, Homo sapiens
ttcccagctccccccgcc

SEQ ID NO: 3249914 - DNA, 11 bp, Homo sapiens
ttcccataatt

SEQ ID NO: 3249915 - DNA, 18 bp, Homo sapiens
ttcccataattttcttca

SEQ ID NO: 3249916 - DNA, 14 bp, Homo sapiens
ttcccatcgctgtc

SEQ ID NO: 3249917 - DNA, 15 bp, Homo sapiens
ttcccatcgctgtca

SEQ ID NO: 3249918 - DNA, 13 bp, Homo sapiens
ttcccatgactgc

SEQ ID NO: 3249919 - DNA, 19 bp, Homo sapiens
ttcccatgactgcacccag

SEQ ID NO: 3249920 - DNA, 22 bp, Homo sapiens
ttcccatgactgcacccagctc

SEQ ID NO: 3249921 - DNA, 17 bp, Homo sapiens
ttcccattgtggctcct

SEQ ID NO: 3249922 - DNA, 16 bp, Homo sapiens
ttccccaaaccataaa

SEQ ID NO: 3249923 - DNA, 18 bp, Homo sapiens
ttccccaaccacttcatt

SEQ ID NO: 3249924 - DNA, 23 bp, Homo sapiens
ttccccactgacagcctcccacc

SEQ ID NO: 3249925 - DNA, 12 bp, Homo sapiens
ttccccagcatc

SEQ ID NO: 3249926 - DNA, 12 bp, Homo sapiens
ttccccagccca

SEQ ID NO: 3249927 - DNA, 13 bp, Homo sapiens
ttccccagcccag

SEQ ID NO: 3249928 - DNA, 15 bp, Homo sapiens
ttccccagcccaggg

SEQ ID NO: 3249929 - DNA, 19 bp, Homo sapiens
ttccccagctttgctgcct

SEQ ID NO: 3249930 - DNA, 19 bp, Homo sapiens
ttccccatccctgtcattt

SEQ ID NO: 3249931 - DNA, 17 bp, Homo sapiens
ttccccatcttctaaac

SEQ ID NO: 3249932 - DNA, 18 bp, Homo sapiens
ttccccatcttctaaacc

SEQ ID NO: 3249933 - DNA, 17 bp, Homo sapiens
ttcccccaacctcagac

SEQ ID NO: 3249934 - DNA, 17 bp, Homo sapiens
ttcccccactactgcag

SEQ ID NO: 3249935 - DNA, 17 bp, Homo sapiens
ttcccccacttcccctc

SEQ ID NO: 3249936 - DNA, 19 bp, Homo sapiens
ttcccccaggcgcctgcgc

SEQ ID NO: 3249937 - DNA, 21 bp, Homo sapiens
ttcccccagtacctccaagca

SEQ ID NO: 3249938 - DNA, 17 bp, Homo sapiens
ttcccccatgtggctga

SEQ ID NO: 3249939 - DNA, 18 bp, Homo sapiens
ttccccccactctcccca

SEQ ID NO: 3249940 - DNA, 19 bp, Homo sapiens
ttccccccactctccccac

SEQ ID NO: 3249941 - DNA, 21 bp, Homo sapiens
ttccccccatgttgtaatgct

SEQ ID NO: 3249942 - DNA, 16 bp, Homo sapiens
ttcccccccctttcct

SEQ ID NO: 3249943 - DNA, 17 bp, Homo sapiens
ttcccccccctttccta

SEQ ID NO: 3249944 - DNA, 19 bp, Homo sapiens
ttcccccccctttcctaaa

SEQ ID NO: 3249945 - DNA, 19 bp, Homo sapiens
ttcccccgagctcttggcc

SEQ ID NO: 3249946 - DNA, 13 bp, Homo sapiens
ttcccccgccgct

SEQ ID NO: 3249947 - DNA, 23 bp, Homo sapiens
ttcccccgccgcttttctcctct

SEQ ID NO: 3249948 - DNA, 13 bp, Homo sapiens
ttccccctcctca

SEQ ID NO: 3249949 - DNA, 17 bp, Homo sapiens
ttcccccttccaaataa

SEQ ID NO: 3249950 - DNA, 23 bp, Homo sapiens
ttcccccttgaggattgtggaaa

SEQ ID NO: 3249951 - DNA, 19 bp, Homo sapiens
ttccccgatgtcccctgcg

SEQ ID NO: 3249952 - DNA, 15 bp, Homo sapiens
ttccccgcctgcagt

SEQ ID NO: 3249953 - DNA, 15 bp, Homo sapiens
ttcccctaagtggat

SEQ ID NO: 3249954 - DNA, 19 bp, Homo sapiens
ttcccctacacctccctcc

SEQ ID NO: 3249955 - DNA, 19 bp, Homo sapiens
ttcccctcactggatgaaa

SEQ ID NO: 3249956 - DNA, 17 bp, Homo sapiens
ttcccctccaagaccct

SEQ ID NO: 3249957 - DNA, 23 bp, Homo sapiens
ttcccctccaagaccctgtgttc

SEQ ID NO: 3249958 - DNA, 13 bp, Homo sapiens
ttcccctccacca

SEQ ID NO: 3249959 - DNA, 14 bp, Homo sapiens
ttcccctcccacct

SEQ ID NO: 3249960 - DNA, 19 bp, Homo sapiens
ttcccctcccacctctcct

SEQ ID NO: 3249961 - DNA, 17 bp, Homo sapiens
ttcccctcccctccttg

SEQ ID NO: 3249962 - DNA, 16 bp, Homo sapiens
ttcccctccctggctc

SEQ ID NO: 3249963 - DNA, 18 bp, Homo sapiens
ttcccctccttctccctt

SEQ ID NO: 3249964 - DNA, 17 bp, Homo sapiens
ttcccctctctgcccct

SEQ ID NO: 3249965 - DNA, 14 bp, Homo sapiens
ttcccctctgctgc

SEQ ID NO: 3249966 - DNA, 18 bp, Homo sapiens
ttcccctctgctgctgtc

SEQ ID NO: 3249967 - DNA, 11 bp, Homo sapiens
ttcccctggcc

SEQ ID NO: 3249968 - DNA, 12 bp, Homo sapiens
ttcccctggcct

SEQ ID NO: 3249969 - DNA, 17 bp, Homo sapiens
ttcccctgtcctgtgaa

SEQ ID NO: 3249970 - DNA, 17 bp, Homo sapiens
ttcccctgttcactcta

SEQ ID NO: 3249971 - DNA, 17 bp, Homo sapiens
ttccccttactctcaca

SEQ ID NO: 3249972 - DNA, 13 bp, Homo sapiens
ttccccttcccct

SEQ ID NO: 3249973 - DNA, 12 bp, Homo sapiens
ttccccttccta

SEQ ID NO: 3249974 - DNA, 14 bp, Homo sapiens
ttccccttgccctt

SEQ ID NO: 3249975 - DNA, 20 bp, Homo sapiens
ttccccttgcccttgccctg

SEQ ID NO: 3249976 - DNA, 22 bp, Homo sapiens
ttccccttgcccttgccctgac

SEQ ID NO: 3249977 - DNA, 23 bp, Homo sapiens
ttccccttgcccttgccctgacc

SEQ ID NO: 3249978 - DNA, 17 bp, Homo sapiens
ttcccctttccccactc

SEQ ID NO: 3249979 - DNA, 18 bp, Homo sapiens
ttccccttttgcctggct

SEQ ID NO: 3249980 - DNA, 18 bp, Homo sapiens
ttcccgctcagccctccc

SEQ ID NO: 3249981 - DNA, 18 bp, Homo sapiens
ttcccggagcacagccct

SEQ ID NO: 3249982 - DNA, 23 bp, Homo sapiens
ttcccggagcacagccctgggag

SEQ ID NO: 3249983 - DNA, 19 bp, Homo sapiens
ttcccggtcccgagtacag

SEQ ID NO: 3249984 - DNA, 20 bp, Homo sapiens
ttcccgtctcagaatctaaa

SEQ ID NO: 3249985 - DNA, 22 bp, Homo sapiens
ttcccgtggtctccttgcactt

SEQ ID NO: 3249986 - DNA, 22 bp, Homo sapiens
ttccctaaaatacatttaaaac

SEQ ID NO: 3249987 - DNA, 14 bp, Homo sapiens
ttccctacttcctg

SEQ ID NO: 3249988 - DNA, 13 bp, Homo sapiens
ttccctatctttt

SEQ ID NO: 3249989 - DNA, 22 bp, Homo sapiens
ttccctcaggttctattttctt

SEQ ID NO: 3249990 - DNA, 16 bp, Homo sapiens
ttccctcatcctttca

SEQ ID NO: 3249991 - DNA, 19 bp, Homo sapiens
ttccctcccagaggagcca

SEQ ID NO: 3249992 - DNA, 19 bp, Homo sapiens
ttccctctaaatgtatatg

SEQ ID NO: 3249993 - DNA, 14 bp, Homo sapiens
ttccctctcatctc

SEQ ID NO: 3249994 - DNA, 13 bp, Homo sapiens
ttccctctgctca

SEQ ID NO: 3249995 - DNA, 14 bp, Homo sapiens
ttccctctgctcag

SEQ ID NO: 3249996 - DNA, 15 bp, Homo sapiens
ttccctctgctcagc

SEQ ID NO: 3249997 - DNA, 17 bp, Homo sapiens
ttccctctgctcagcca

SEQ ID NO: 3249998 - DNA, 15 bp, Homo sapiens
ttccctctgctcctg

SEQ ID NO: 3249999 - DNA, 13 bp, Homo sapiens
ttccctctggctt

SEQ ID NO: 3250000 - DNA, 16 bp, Homo sapiens
ttccctctttggctcc

SEQ ID NO: 3250001 - DNA, 16 bp, Homo sapiens
ttccctgcaccctgga

SEQ ID NO: 3250002 - DNA, 12 bp, Homo sapiens
ttccctgcacta

SEQ ID NO: 3250003 - DNA, 23 bp, Homo sapiens
ttccctgcagggcgcccctggga

SEQ ID NO: 3250004 - DNA, 12 bp, Homo sapiens
ttccctgcccaa

SEQ ID NO: 3250005 - DNA, 17 bp, Homo sapiens
ttccctgcccaaaccct

SEQ ID NO: 3250006 - DNA, 14 bp, Homo sapiens
ttccctgcctctca

SEQ ID NO: 3250007 - DNA, 14 bp, Homo sapiens
ttccctgtcagagg

SEQ ID NO: 3250008 - DNA, 15 bp, Homo sapiens
ttccctgttctccct

SEQ ID NO: 3250009 - DNA, 15 bp, Homo sapiens
ttcccttccactgcc

SEQ ID NO: 3250010 - DNA, 10 bp, Homo sapiens
tgttccaaat

SEQ ID NO: 3250011 - DNA, 17 bp, Homo sapiens
tgttccaaatgaatgtt

SEQ ID NO: 3250012 - DNA, 17 bp, Homo sapiens
tgttccaaattcagttt

SEQ ID NO: 3250013 - DNA, 21 bp, Homo sapiens
tgttccaaattcagtttcata

SEQ ID NO: 3250014 - DNA, 14 bp, Homo sapiens
tgttccaagacatt

SEQ ID NO: 3250015 - DNA, 18 bp, Homo sapiens
tgttccaatgtcaatgtg

SEQ ID NO: 3250016 - DNA, 20 bp, Homo sapiens
tgttccacaagttaaataaa

SEQ ID NO: 3250017 - DNA, 17 bp, Homo sapiens
tgttccagattcctatg

SEQ ID NO: 3250018 - DNA, 23 bp, Homo sapiens
tgttccagctgaggcagggggat

SEQ ID NO: 3250019 - DNA, 22 bp, Homo sapiens
tgttccattgcctcttttcaca

SEQ ID NO: 3250020 - DNA, 17 bp, Homo sapiens
tgttcccatttcagctg

SEQ ID NO: 3250021 - DNA, 13 bp, Homo sapiens
tgttccccatctg

SEQ ID NO: 3250022 - DNA, 14 bp, Homo sapiens
tgttcccccagggg

SEQ ID NO: 3250023 - DNA, 17 bp, Homo sapiens
tgttcccctaagtggat

SEQ ID NO: 3250024 - DNA, 18 bp, Homo sapiens
tgttcccctgtcctgtga

SEQ ID NO: 3250025 - DNA, 21 bp, Homo sapiens
tgttcccgattcacgtttttc

SEQ ID NO: 3250026 - DNA, 12 bp, Homo sapiens
tgttccctctgg

SEQ ID NO: 3250027 - DNA, 15 bp, Homo sapiens
tgttccctctggctt

SEQ ID NO: 3250028 - DNA, 15 bp, Homo sapiens
tgttcctacagcccc

SEQ ID NO: 3250029 - DNA, 13 bp, Homo sapiens
tgttcctcctgct

SEQ ID NO: 3250030 - DNA, 21 bp, Homo sapiens
tgttcctgcagccccagaaga

SEQ ID NO: 3250031 - DNA, 14 bp, Homo sapiens
tgttcctggaagca

SEQ ID NO: 3250032 - DNA, 14 bp, Homo sapiens
tgttcctggcaata

SEQ ID NO: 3250033 - DNA, 19 bp, Homo sapiens
tgttcctggcagtttaaaa

SEQ ID NO: 3250034 - DNA, 18 bp, Homo sapiens
tgttcctttgttaaattt

SEQ ID NO: 3250035 - DNA, 15 bp, Homo sapiens
tgttcgggtgtgggt

SEQ ID NO: 3250036 - DNA, 22 bp, Homo sapiens
tgttctaaaatgtcaaggcagt

SEQ ID NO: 3250037 - DNA, 13 bp, Homo sapiens
tgttctaaagctc

SEQ ID NO: 3250038 - DNA, 16 bp, Homo sapiens
tgttctaaggctctga

SEQ ID NO: 3250039 - DNA, 19 bp, Homo sapiens
tgttctaaggctctgagag

SEQ ID NO: 3250040 - DNA, 17 bp, Homo sapiens
tgttctaagtttctaag

SEQ ID NO: 3250041 - DNA, 18 bp, Homo sapiens
tgttctaagtttctaaga

SEQ ID NO: 3250042 - DNA, 19 bp, Homo sapiens
tgttctaagtttctaagat

SEQ ID NO: 3250043 - DNA, 22 bp, Homo sapiens
tgttctaagtttctaagattct

SEQ ID NO: 3250044 - DNA, 14 bp, Homo sapiens
tgttctatccaaac

SEQ ID NO: 3250045 - DNA, 14 bp, Homo sapiens
tgttctatgaacaa

SEQ ID NO: 3250046 - DNA, 16 bp, Homo sapiens
tgttctatttttcaat

SEQ ID NO: 3250047 - DNA, 12 bp, Homo sapiens
tgttctcagatt

SEQ ID NO: 3250048 - DNA, 14 bp, Homo sapiens
tgttctcagctccc

SEQ ID NO: 3250049 - DNA, 15 bp, Homo sapiens
tgttctcagctcccc

SEQ ID NO: 3250050 - DNA, 16 bp, Homo sapiens
tgttctcatttgatca

SEQ ID NO: 3250051 - DNA, 21 bp, Homo sapiens
tgttctccataggagggaagg

SEQ ID NO: 3250052 - DNA, 20 bp, Homo sapiens
tgttctccctttctctctcc

SEQ ID NO: 3250053 - DNA, 15 bp, Homo sapiens
tgttctcttcttcat

SEQ ID NO: 3250054 - DNA, 20 bp, Homo sapiens
tgttctcttcttcattctat

SEQ ID NO: 3250055 - DNA, 18 bp, Homo sapiens
tgttctgaataatttctt

SEQ ID NO: 3250056 - DNA, 15 bp, Homo sapiens
tgttctgacattaac

SEQ ID NO: 3250057 - DNA, 17 bp, Homo sapiens
tgttctgacattaacag

SEQ ID NO: 3250058 - DNA, 20 bp, Homo sapiens
tgttctgacattaacagttt

SEQ ID NO: 3250059 - DNA, 18 bp, Homo sapiens
tgttctgaccctgcttca

SEQ ID NO: 3250060 - DNA, 16 bp, Homo sapiens
tgttctgagaactgac

SEQ ID NO: 3250061 - DNA, 23 bp, Homo sapiens
tgttctgcaaaaatatttataaa

SEQ ID NO: 3250062 - DNA, 14 bp, Homo sapiens
tgttctgcactgaa

SEQ ID NO: 3250063 - DNA, 15 bp, Homo sapiens
tgttctgcatggatt

SEQ ID NO: 3250064 - DNA, 16 bp, Homo sapiens
tgttctgcatggattc

SEQ ID NO: 3250065 - DNA, 17 bp, Homo sapiens
tgttctgcatggattca

SEQ ID NO: 3250066 - DNA, 14 bp, Homo sapiens
tgttctgcccccag

SEQ ID NO: 3250067 - DNA, 22 bp, Homo sapiens
tgttctgcccccagcccaaagg

SEQ ID NO: 3250068 - DNA, 16 bp, Homo sapiens
tgttctgttctggggg

SEQ ID NO: 3250069 - DNA, 17 bp, Homo sapiens
tgttctgtttggcactt

SEQ ID NO: 3250070 - DNA, 19 bp, Homo sapiens
tgttctgtttgttattgtt

SEQ ID NO: 3250071 - DNA, 17 bp, Homo sapiens
tgttcttaattgcactc

SEQ ID NO: 3250072 - DNA, 18 bp, Homo sapiens
tgttcttaattgcactct

SEQ ID NO: 3250073 - DNA, 17 bp, Homo sapiens
tgttcttacctgtatgt

SEQ ID NO: 3250074 - DNA, 22 bp, Homo sapiens
tgttcttacctgtatgtctcca

SEQ ID NO: 3250075 - DNA, 21 bp, Homo sapiens
tgttcttcaagccagctctag

SEQ ID NO: 3250076 - DNA, 14 bp, Homo sapiens
tgttcttccccaca

SEQ ID NO: 3250077 - DNA, 14 bp, Homo sapiens
tgttcttgctgcta

SEQ ID NO: 3250078 - DNA, 15 bp, Homo sapiens
tgttcttgctgctag

SEQ ID NO: 3250079 - DNA, 17 bp, Homo sapiens
tgttcttgctgctagaa

SEQ ID NO: 3250080 - DNA, 22 bp, Homo sapiens
tgttcttgctgctagaactttt

SEQ ID NO: 3250081 - DNA, 13 bp, Homo sapiens
tgttgaaaaaatt

SEQ ID NO: 3250082 - DNA, 20 bp, Homo sapiens
ttaaattttagtacattttc

SEQ ID NO: 3250083 - DNA, 16 bp, Homo sapiens
ttaaattttcacctgt

SEQ ID NO: 3250084 - DNA, 23 bp, Homo sapiens
ttaacaaacatcactctgctgct

SEQ ID NO: 3250085 - DNA, 19 bp, Homo sapiens
ttaacaaactaaaaatatt

SEQ ID NO: 3250086 - DNA, 14 bp, Homo sapiens
ttaacaaatctaat

SEQ ID NO: 3250087 - DNA, 22 bp, Homo sapiens
ttaacaacaataacactgtctc

SEQ ID NO: 3250088 - DNA, 19 bp, Homo sapiens
ttaacaagaggggaaaaca

SEQ ID NO: 3250089 - DNA, 22 bp, Homo sapiens
ttaacaaggaatgcctgtgcca

SEQ ID NO: 3250090 - DNA, 23 bp, Homo sapiens
ttaacaataactactgtgttcct

SEQ ID NO: 3250091 - DNA, 17 bp, Homo sapiens
ttaacaatctaacaata

SEQ ID NO: 3250092 - DNA, 12 bp, Homo sapiens
ttaacaatgcaa

SEQ ID NO: 3250093 - DNA, 19 bp, Homo sapiens
ttaacaatgcaacttttaa

SEQ ID NO: 3250094 - DNA, 23 bp, Homo sapiens
ttaacaatgcaacttttaattac

SEQ ID NO: 3250095 - DNA, 17 bp, Homo sapiens
ttaacagaaactttcaa

SEQ ID NO: 3250096 - DNA, 21 bp, Homo sapiens
ttaacagaaactttcaaaagg

SEQ ID NO: 3250097 - DNA, 21 bp, Homo sapiens
ttaacagcatgctgctttgcc

SEQ ID NO: 3250098 - DNA, 15 bp, Homo sapiens
ttaacagtcatttaa

SEQ ID NO: 3250099 - DNA, 17 bp, Homo sapiens
ttaacagtcatttaaaa

SEQ ID NO: 3250100 - DNA, 13 bp, Homo sapiens
ttaacagttttcc

SEQ ID NO: 3250101 - DNA, 20 bp, Homo sapiens
ttaacagttttccatgaaaa

SEQ ID NO: 3250102 - DNA, 14 bp, Homo sapiens
ttaacatccctcct

SEQ ID NO: 3250103 - DNA, 17 bp, Homo sapiens
ttaacatctattataaa

SEQ ID NO: 3250104 - DNA, 13 bp, Homo sapiens
ttaacattccaag

SEQ ID NO: 3250105 - DNA, 14 bp, Homo sapiens
ttaacattctgtaa

SEQ ID NO: 3250106 - DNA, 20 bp, Homo sapiens
ttaacattgaccaagaactg

SEQ ID NO: 3250107 - DNA, 17 bp, Homo sapiens
ttaacattttgttctta

SEQ ID NO: 3250108 - DNA, 19 bp, Homo sapiens
ttaaccattgtcttgttct

SEQ ID NO: 3250109 - DNA, 21 bp, Homo sapiens
ttaaccggtaagagtttcagt

SEQ ID NO: 3250110 - DNA, 20 bp, Homo sapiens
ttaacctactaatagtttgt

SEQ ID NO: 3250111 - DNA, 22 bp, Homo sapiens
ttaacctagatgtttaacaaat

SEQ ID NO: 3250112 - DNA, 15 bp, Homo sapiens
ttaacctcagtgtca

SEQ ID NO: 3250113 - DNA, 15 bp, Homo sapiens
ttaacctctgctttt

SEQ ID NO: 3250114 - DNA, 13 bp, Homo sapiens
ttaacctggtgct

SEQ ID NO: 3250115 - DNA, 12 bp, Homo sapiens
ttaacctttgat

SEQ ID NO: 3250116 - DNA, 14 bp, Homo sapiens
ttaacctttgctat

SEQ ID NO: 3250117 - DNA, 18 bp, Homo sapiens
ttaacctttttgtaaata

SEQ ID NO: 3250118 - DNA, 21 bp, Homo sapiens
ttaacctttttgtaaatactg

SEQ ID NO: 3250119 - DNA, 13 bp, Homo sapiens
ttaactacattta

SEQ ID NO: 3250120 - DNA, 14 bp, Homo sapiens
ttaactacatttat

SEQ ID NO: 3250121 - DNA, 15 bp, Homo sapiens
ttaactataaatatg

SEQ ID NO: 3250122 - DNA, 20 bp, Homo sapiens
ttaactatgacagatatatt

SEQ ID NO: 3250123 - DNA, 15 bp, Homo sapiens
ttaactgaaaatgta

SEQ ID NO: 3250124 - DNA, 19 bp, Homo sapiens
ttaactgaaaatgtaaatt

SEQ ID NO: 3250125 - DNA, 16 bp, Homo sapiens
ttaactgaacaatggc

SEQ ID NO: 3250126 - DNA, 12 bp, Homo sapiens
ttaactgccttt

SEQ ID NO: 3250127 - DNA, 21 bp, Homo sapiens
ttaactgtagtgcctcctaat

SEQ ID NO: 3250128 - DNA, 15 bp, Homo sapiens
ttaactgtggatatt

SEQ ID NO: 3250129 - DNA, 17 bp, Homo sapiens
ttaacttatttagagat

SEQ ID NO: 3250130 - DNA, 19 bp, Homo sapiens
ttaacttgtttggtagtta

SEQ ID NO: 3250131 - DNA, 14 bp, Homo sapiens
ttaactttaatgtt

SEQ ID NO: 3250132 - DNA, 14 bp, Homo sapiens
ttaactttattaca

SEQ ID NO: 3250133 - DNA, 23 bp, Homo sapiens
ttaactttattacaatttgtatt

SEQ ID NO: 3250134 - DNA, 22 bp, Homo sapiens
ttaactttttttcttctacttt

SEQ ID NO: 3250135 - DNA, 20 bp, Homo sapiens
ttaagaaaaaataacacaca

SEQ ID NO: 3250136 - DNA, 21 bp, Homo sapiens
ttaagaaaaaataacacacat

SEQ ID NO: 3250137 - DNA, 14 bp, Homo sapiens
ttaagaaaagcact

SEQ ID NO: 3250138 - DNA, 16 bp, Homo sapiens
ttaagaaaagcacttt

SEQ ID NO: 3250139 - DNA, 18 bp, Homo sapiens
ttaagaaaatacaataaa

SEQ ID NO: 3250140 - DNA, 19 bp, Homo sapiens
ttaagaaaatacaataaac

SEQ ID NO: 3250141 - DNA, 14 bp, Homo sapiens
ttaagaaacactga

SEQ ID NO: 3250142 - DNA, 15 bp, Homo sapiens
ttaagaaatagaatt

SEQ ID NO: 3250143 - DNA, 12 bp, Homo sapiens
ttaagaactgct

SEQ ID NO: 3250144 - DNA, 11 bp, Homo sapiens
ttaagaagctg

SEQ ID NO: 3250145 - DNA, 21 bp, Homo sapiens
ttaagaagctgttgtacattt

SEQ ID NO: 3250146 - DNA, 23 bp, Homo sapiens
ttaagaagctgttgtacatttat

SEQ ID NO: 3250147 - DNA, 14 bp, Homo sapiens
ttaagaaggcaaaa

SEQ ID NO: 3250148 - DNA, 14 bp, Homo sapiens
ttaagaattctgta

SEQ ID NO: 3250149 - DNA, 14 bp, Homo sapiens
ttaagaattgacca

SEQ ID NO: 3250150 - DNA, 19 bp, Homo sapiens
ttaagacaagcctggcaac

SEQ ID NO: 3250151 - DNA, 15 bp, Homo sapiens
ttaagacaccaaata

SEQ ID NO: 3250152 - DNA, 14 bp, Homo sapiens
ttaagacagtgtac

SEQ ID NO: 3250153 - DNA, 16 bp, Homo sapiens
ttaagacagtgtacaa

SEQ ID NO: 3250154 - DNA, 20 bp, Homo sapiens
ttaagacagtgtacaaaact

SEQ ID NO: 3250155 - DNA, 23 bp, Homo sapiens
ttaagacagtgtacaaaactgta

SEQ ID NO: 3250156 - DNA, 16 bp, Homo sapiens
ttacataggtatatat

SEQ ID NO: 3250157 - DNA, 15 bp, Homo sapiens
ttacatcttctgtga

SEQ ID NO: 3250158 - DNA, 18 bp, Homo sapiens
ttacatcttctgtgaaat

SEQ ID NO: 3250159 - DNA, 17 bp, Homo sapiens
ttacatgaattgcattt

SEQ ID NO: 3250160 - DNA, 23 bp, Homo sapiens
ttacatgctgctatacacaagca

SEQ ID NO: 3250161 - DNA, 22 bp, Homo sapiens
ttacatggttaaggtaaagtaa

SEQ ID NO: 3250162 - DNA, 16 bp, Homo sapiens
ttacatgtaatttgat

SEQ ID NO: 3250163 - DNA, 20 bp, Homo sapiens
ttacatgtaatttgatgagg

SEQ ID NO: 3250164 - DNA, 13 bp, Homo sapiens
ttacattgtaaat

SEQ ID NO: 3250165 - DNA, 20 bp, Homo sapiens
ttacatttggattagaaatt

SEQ ID NO: 3250166 - DNA, 14 bp, Homo sapiens
ttacatttttacaa

SEQ ID NO: 3250167 - DNA, 21 bp, Homo sapiens
ttaccaaaaataaatatatct

SEQ ID NO: 3250168 - DNA, 20 bp, Homo sapiens
ttaccaaagagatattgata

SEQ ID NO: 3250169 - DNA, 19 bp, Homo sapiens
ttaccaaatacacatttca

SEQ ID NO: 3250170 - DNA, 12 bp, Homo sapiens
ttaccaacctgt

SEQ ID NO: 3250171 - DNA, 13 bp, Homo sapiens
ttaccaacctgtt

SEQ ID NO: 3250172 - DNA, 14 bp, Homo sapiens
ttaccaactttctg

SEQ ID NO: 3250173 - DNA, 15 bp, Homo sapiens
ttaccagacaaaaaa

SEQ ID NO: 3250174 - DNA, 19 bp, Homo sapiens
ttaccagatgctgactggc

SEQ ID NO: 3250175 - DNA, 23 bp, Homo sapiens
ttaccattaattacatacagatt

SEQ ID NO: 3250176 - DNA, 12 bp, Homo sapiens
ttaccattagca

SEQ ID NO: 3250177 - DNA, 19 bp, Homo sapiens
ttaccattagcataatttt

SEQ ID NO: 3250178 - DNA, 24 bp, Homo sapiens
ttacccaaaaactaaatctctaat

SEQ ID NO: 3250179 - DNA, 22 bp, Homo sapiens
ttacccacctagaacactaact

SEQ ID NO: 3250180 - DNA, 18 bp, Homo sapiens
ttacccactgtcaggcct

SEQ ID NO: 3250181 - DNA, 19 bp, Homo sapiens
ttacccactgtcaggcctc

SEQ ID NO: 3250182 - DNA, 22 bp, Homo sapiens
ttacccagagaatatatacatt

SEQ ID NO: 3250183 - DNA, 16 bp, Homo sapiens
ttaccccttagcctcc

SEQ ID NO: 3250184 - DNA, 17 bp, Homo sapiens
ttacccggtttcttttt

SEQ ID NO: 3250185 - DNA, 16 bp, Homo sapiens
ttaccctctgcagaac

SEQ ID NO: 3250186 - DNA, 22 bp, Homo sapiens
ttaccctctgcagaacagtgaa

SEQ ID NO: 3250187 - DNA, 22 bp, Homo sapiens
ttaccctgcgattttgcctgtg

SEQ ID NO: 3250188 - DNA, 22 bp, Homo sapiens
ttaccgtcacactcttcagtga

SEQ ID NO: 3250189 - DNA, 18 bp, Homo sapiens
ttacctaaacagatataa

SEQ ID NO: 3250190 - DNA, 19 bp, Homo sapiens
ttacctaaacagatataaa

SEQ ID NO: 3250191 - DNA, 13 bp, Homo sapiens
ttacctactttga

SEQ ID NO: 3250192 - DNA, 14 bp, Homo sapiens
ttacctagaaatct

SEQ ID NO: 3250193 - DNA, 15 bp, Homo sapiens
ttacctcttaacaat

SEQ ID NO: 3250194 - DNA, 12 bp, Homo sapiens
ttacctctttaa

SEQ ID NO: 3250195 - DNA, 12 bp, Homo sapiens
ttacctgacaca

SEQ ID NO: 3250196 - DNA, 14 bp, Homo sapiens
ttacctgcaggctg

SEQ ID NO: 3250197 - DNA, 12 bp, Homo sapiens
ttacctgccaat

SEQ ID NO: 3250198 - DNA, 21 bp, Homo sapiens
ttacctggcttatttaatatg

SEQ ID NO: 3250199 - DNA, 12 bp, Homo sapiens
ttacctgtggat

SEQ ID NO: 3250200 - DNA, 13 bp, Homo sapiens
ttacctgtggata

SEQ ID NO: 3250201 - DNA, 18 bp, Homo sapiens
ttaccttatagttactgt

SEQ ID NO: 3250202 - DNA, 20 bp, Homo sapiens
ttaccttattggatatttga

SEQ ID NO: 3250203 - DNA, 17 bp, Homo sapiens
ttacctttatctttcac

SEQ ID NO: 3250204 - DNA, 13 bp, Homo sapiens
ttacctttcatac

SEQ ID NO: 3250205 - DNA, 14 bp, Homo sapiens
ttacctttctctct

SEQ ID NO: 3250206 - DNA, 15 bp, Homo sapiens
ttacctttttatttg

SEQ ID NO: 3250207 - DNA, 20 bp, Homo sapiens
ttacctttttatttgcatgt

SEQ ID NO: 3250208 - DNA, 20 bp, Homo sapiens
ttacctttttgtatgtgaac

SEQ ID NO: 3250209 - DNA, 16 bp, Homo sapiens
ttacgacccaggacaa

SEQ ID NO: 3250210 - DNA, 20 bp, Homo sapiens
ttacgcacacgtacttaaat

SEQ ID NO: 3250211 - DNA, 23 bp, Homo sapiens
ttacggactctggatatttgcac

SEQ ID NO: 3250212 - DNA, 15 bp, Homo sapiens
ttacgttctttcact

SEQ ID NO: 3250213 - DNA, 23 bp, Homo sapiens
ttactaaaaagtaccagcatgtt

SEQ ID NO: 3250214 - DNA, 22 bp, Homo sapiens
ttactaaattacgtatgcaagt

SEQ ID NO: 3250215 - DNA, 21 bp, Homo sapiens
ttactaaggcaggtgggcaga

SEQ ID NO: 3250216 - DNA, 15 bp, Homo sapiens
ttactagcttttcaa

SEQ ID NO: 3250217 - DNA, 22 bp, Homo sapiens
ttactatatatatatgcctttt

SEQ ID NO: 3250218 - DNA, 17 bp, Homo sapiens
ttactattttctacaat

SEQ ID NO: 3250219 - DNA, 21 bp, Homo sapiens
ttactattttctacaattaat

SEQ ID NO: 3250220 - DNA, 12 bp, Homo sapiens
ttactcactgct

SEQ ID NO: 3250221 - DNA, 13 bp, Homo sapiens
ttactcagggctc

SEQ ID NO: 3250222 - DNA, 12 bp, Homo sapiens
ttactcaggttt

SEQ ID NO: 3250223 - DNA, 20 bp, Homo sapiens
ttactcattaaaaataatag

SEQ ID NO: 3250224 - DNA, 15 bp, Homo sapiens
ttactcattactgca

SEQ ID NO: 3250225 - DNA, 23 bp, Homo sapiens
ttactcattactgcaaattgatt

SEQ ID NO: 3250226 - DNA, 13 bp, Homo sapiens
ttactcattgaaa

SEQ ID NO: 3250227 - DNA, 22 bp, Homo sapiens
ttactccaggttattgcaataa

SEQ ID NO: 3250228 - DNA, 16 bp, Homo sapiens
ttactcccttcctggc

SEQ ID NO: 3250229 - DNA, 22 bp, Homo sapiens
ttactcctatttttgtaaactg

SEQ ID NO: 3250230 - DNA, 21 bp, Homo sapiens
ttactcctgaagtgagtttta

SEQ ID NO: 3250231 - DNA, 12 bp, Homo sapiens
ttactctaagat

SEQ ID NO: 3250232 - DNA, 19 bp, Homo sapiens
ttactctaagatcttagat

SEQ ID NO: 3250233 - DNA, 22 bp, Homo sapiens
ttactctaagatcttagattct

SEQ ID NO: 3250234 - DNA, 21 bp, Homo sapiens
ttactctatgccccaaatata

SEQ ID NO: 3250235 - DNA, 14 bp, Homo sapiens
ttactctgcctaca

SEQ ID NO: 3250236 - DNA, 16 bp, Homo sapiens
ttactctgtgtttaaa

SEQ ID NO: 3250237 - DNA, 14 bp, Homo sapiens
ttactctttgcaaa

SEQ ID NO: 3250238 - DNA, 21 bp, Homo sapiens
ttactctttttctaaagtgtt

SEQ ID NO: 3250239 - DNA, 21 bp, Homo sapiens
ttactgaagaaatctttccag

SEQ ID NO: 3250240 - DNA, 14 bp, Homo sapiens
ttactgacatttct

SEQ ID NO: 3250241 - DNA, 13 bp, Homo sapiens
ttactgagcttct

SEQ ID NO: 3250242 - DNA, 14 bp, Homo sapiens
ttactgataatttt

SEQ ID NO: 3250243 - DNA, 14 bp, Homo sapiens
ttactgatcatgca

SEQ ID NO: 3250244 - DNA, 14 bp, Homo sapiens
ttactgcaaattga

SEQ ID NO: 3250245 - DNA, 18 bp, Homo sapiens
ttactgccttcctcctta

SEQ ID NO: 3250246 - DNA, 15 bp, Homo sapiens
ttactggacctgaaa

SEQ ID NO: 3250247 - DNA, 16 bp, Homo sapiens
ttactggataaattgt

SEQ ID NO: 3250248 - DNA, 16 bp, Homo sapiens
ttactggcctttttca

SEQ ID NO: 3250249 - DNA, 16 bp, Homo sapiens
ttactggcttctcttg

SEQ ID NO: 3250250 - DNA, 17 bp, Homo sapiens
ttactggtccaaaagat

SEQ ID NO: 3250251 - DNA, 23 bp, Homo sapiens
ttactggtttccccagggaagga

SEQ ID NO: 3250252 - DNA, 19 bp, Homo sapiens
ttactgtaactgtcagtgt

SEQ ID NO: 3250253 - DNA, 20 bp, Homo sapiens
ttactgtaatataaagtatt

SEQ ID NO: 3250254 - DNA, 21 bp, Homo sapiens
ttactgtatatgtattccctt

SEQ ID NO: 3250255 - DNA, 23 bp, Homo sapiens
ttactgtatatgtattcccttgt

SEQ ID NO: 3250256 - DNA, 23 bp, Homo sapiens
ttactgtcaaggctgcttagaat

SEQ ID NO: 3250257 - DNA, 14 bp, Homo sapiens
ttactgtcaataaa

SEQ ID NO: 3250258 - DNA, 20 bp, Homo sapiens
ttactgtcaataaacagctt

SEQ ID NO: 3250259 - DNA, 19 bp, Homo sapiens
ttactgtcagattaaatta

SEQ ID NO: 3250260 - DNA, 21 bp, Homo sapiens
ttactgtcagattaaattaca

SEQ ID NO: 3250261 - DNA, 23 bp, Homo sapiens
ttactgtctggttttaacaattt

SEQ ID NO: 3250262 - DNA, 17 bp, Homo sapiens
ttactgtcttttctatt

SEQ ID NO: 3250263 - DNA, 12 bp, Homo sapiens
ttactgttcttg

SEQ ID NO: 3250264 - DNA, 18 bp, Homo sapiens
ttactgttcttgctgcta

SEQ ID NO: 3250265 - DNA, 22 bp, Homo sapiens
ttactgttcttgctgctagaac

SEQ ID NO: 3250266 - DNA, 15 bp, Homo sapiens
ttactgttgcactga

SEQ ID NO: 3250267 - DNA, 16 bp, Homo sapiens
ttactgtttatttctg

SEQ ID NO: 3250268 - DNA, 18 bp, Homo sapiens
ttactgtttatttctgtt

SEQ ID NO: 3250269 - DNA, 20 bp, Homo sapiens
ttactgttttaattgtagtt

SEQ ID NO: 3250270 - DNA, 13 bp, Homo sapiens
ttacttagcatgc

SEQ ID NO: 3250271 - DNA, 16 bp, Homo sapiens
ttacttatcttatgcc

SEQ ID NO: 3250272 - DNA, 19 bp, Homo sapiens
ttacttccagcaagcaaag

SEQ ID NO: 3250273 - DNA, 15 bp, Homo sapiens
ttacttcctatcaag

SEQ ID NO: 3250274 - DNA, 14 bp, Homo sapiens
ttacttgcttctct

SEQ ID NO: 3250275 - DNA, 15 bp, Homo sapiens
ttacttgctttcaat

SEQ ID NO: 3250276 - DNA, 22 bp, Homo sapiens
ttacttgctttcaattgacaaa

SEQ ID NO: 3250277 - DNA, 16 bp, Homo sapiens
ttacttgtctgaggcc

SEQ ID NO: 3250278 - DNA, 15 bp, Homo sapiens
ttacttgtggtgtga

SEQ ID NO: 3250279 - DNA, 11 bp, Homo sapiens
ttactttctgt

SEQ ID NO: 3250280 - DNA, 18 bp, Homo sapiens
ttactttctgttgccaca

SEQ ID NO: 3250281 - DNA, 20 bp, Homo sapiens
ttactttggcaatttcctgg

SEQ ID NO: 3250282 - DNA, 21 bp, Homo sapiens
ttactttggggctaatttaac

SEQ ID NO: 3250283 - DNA, 14 bp, Homo sapiens
ttactttgtgttca

SEQ ID NO: 3250284 - DNA, 19 bp, Homo sapiens
ttacttttaaactgtgtac

SEQ ID NO: 3250285 - DNA, 16 bp, Homo sapiens
ttaatgctgccttttc

SEQ ID NO: 3250286 - DNA, 21 bp, Homo sapiens
ttaatggacttatttcttcaa

SEQ ID NO: 3250287 - DNA, 19 bp, Homo sapiens
ttaatggctagtactgtat

SEQ ID NO: 3250288 - DNA, 19 bp, Homo sapiens
ttaatgggggtagcagctg

SEQ ID NO: 3250289 - DNA, 20 bp, Homo sapiens
ttaatgtaaagaacttaaat

SEQ ID NO: 3250290 - DNA, 21 bp, Homo sapiens
ttaatgtacaagttttgtata

SEQ ID NO: 3250291 - DNA, 17 bp, Homo sapiens
ttaatgtatttgttcat

SEQ ID NO: 3250292 - DNA, 21 bp, Homo sapiens
ttaatgtatttgttcatgttt

SEQ ID NO: 3250293 - DNA, 19 bp, Homo sapiens
ttaatgtgaacttgtagct

SEQ ID NO: 3250294 - DNA, 17 bp, Homo sapiens
ttaatgtttattcctga

SEQ ID NO: 3250295 - DNA, 16 bp, Homo sapiens
ttaatgtttcttaaat

SEQ ID NO: 3250296 - DNA, 15 bp, Homo sapiens
ttaatgttttcaaaa

SEQ ID NO: 3250297 - DNA, 15 bp, Homo sapiens
ttaatgttttcatta

SEQ ID NO: 3250298 - DNA, 13 bp, Homo sapiens
ttaatgttttgta

SEQ ID NO: 3250299 - DNA, 17 bp, Homo sapiens
ttaattaaatgtattta

SEQ ID NO: 3250300 - DNA, 21 bp, Homo sapiens
ttaattaaatttcacaatata

SEQ ID NO: 3250301 - DNA, 16 bp, Homo sapiens
ttaattaagactgaaa

SEQ ID NO: 3250302 - DNA, 13 bp, Homo sapiens
ttaattaatttga

SEQ ID NO: 3250303 - DNA, 16 bp, Homo sapiens
ttaattaatttgatta

SEQ ID NO: 3250304 - DNA, 20 bp, Homo sapiens
ttaattaatttgattaacaa

SEQ ID NO: 3250305 - DNA, 20 bp, Homo sapiens
ttaattaatttggagcacaa

SEQ ID NO: 3250306 - DNA, 17 bp, Homo sapiens
ttaattaccttattgga

SEQ ID NO: 3250307 - DNA, 21 bp, Homo sapiens
ttaattactcagcagaatggt

SEQ ID NO: 3250308 - DNA, 13 bp, Homo sapiens
ttaattatgtgca

SEQ ID NO: 3250309 - DNA, 18 bp, Homo sapiens
ttaattattaactacatt

SEQ ID NO: 3250310 - DNA, 19 bp, Homo sapiens
ttaattattataaaaatat

SEQ ID NO: 3250311 - DNA, 22 bp, Homo sapiens
ttaattcagcactgatttcaca

SEQ ID NO: 3250312 - DNA, 15 bp, Homo sapiens
ttaattcctatgaag

SEQ ID NO: 3250313 - DNA, 17 bp, Homo sapiens
ttaattctctttcaaag

SEQ ID NO: 3250314 - DNA, 19 bp, Homo sapiens
ttaattcttcacctttgta

SEQ ID NO: 3250315 - DNA, 22 bp, Homo sapiens
ttaattgattattctgattcca

SEQ ID NO: 3250316 - DNA, 12 bp, Homo sapiens
ttaattgtaaac

SEQ ID NO: 3250317 - DNA, 14 bp, Homo sapiens
ttaattgtaatctg

SEQ ID NO: 3250318 - DNA, 12 bp, Homo sapiens
ttaattgtcatg

SEQ ID NO: 3250319 - DNA, 19 bp, Homo sapiens
ttaattgttttgcactttt

SEQ ID NO: 3250320 - DNA, 16 bp, Homo sapiens
ttaatttaaagcttac

SEQ ID NO: 3250321 - DNA, 19 bp, Homo sapiens
ttaatttaacaaactaaaa

SEQ ID NO: 3250322 - DNA, 14 bp, Homo sapiens
ttaatttatatgta

SEQ ID NO: 3250323 - DNA, 15 bp, Homo sapiens
ttaatttatctaaat

SEQ ID NO: 3250324 - DNA, 18 bp, Homo sapiens
ttaatttatgagtttttg

SEQ ID NO: 3250325 - DNA, 18 bp, Homo sapiens
ttaatttcggttatagct

SEQ ID NO: 3250326 - DNA, 14 bp, Homo sapiens
ttaatttcttcaaa

SEQ ID NO: 3250327 - DNA, 17 bp, Homo sapiens
ttaatttcttcaaaatg

SEQ ID NO: 3250328 - DNA, 18 bp, Homo sapiens
ttaatttcttcaaaatgt

SEQ ID NO: 3250329 - DNA, 18 bp, Homo sapiens
ttaatttgatgaaagctg

SEQ ID NO: 3250330 - DNA, 19 bp, Homo sapiens
ttaatttgattaacaaata

SEQ ID NO: 3250331 - DNA, 22 bp, Homo sapiens
ttaatttgcaaccatcagaatt

SEQ ID NO: 3250332 - DNA, 21 bp, Homo sapiens
ttaatttgtaaacttctgaag

SEQ ID NO: 3250333 - DNA, 16 bp, Homo sapiens
ttaattttaaagtgca

SEQ ID NO: 3250334 - DNA, 13 bp, Homo sapiens
ttagagaagctga

SEQ ID NO: 3250335 - DNA, 19 bp, Homo sapiens
ttagagaatatatttttga

SEQ ID NO: 3250336 - DNA, 20 bp, Homo sapiens
ttagagacaaaccttaaaac

SEQ ID NO: 3250337 - DNA, 15 bp, Homo sapiens
ttagagcattgccat

SEQ ID NO: 3250338 - DNA, 15 bp, Homo sapiens
ttagagccttttatc

SEQ ID NO: 3250339 - DNA, 16 bp, Homo sapiens
ttagaggaaaatgagt

SEQ ID NO: 3250340 - DNA, 21 bp, Homo sapiens
ttagagtaaataaactgttta

SEQ ID NO: 3250341 - DNA, 14 bp, Homo sapiens
ttagagtcagcctt

SEQ ID NO: 3250342 - DNA, 24 bp, Homo sapiens
ttagataacgcttaaaggaagtca

SEQ ID NO: 3250343 - DNA, 15 bp, Homo sapiens
ttagataatttgaaa

SEQ ID NO: 3250344 - DNA, 12 bp, Homo sapiens
ttagatattgct

SEQ ID NO: 3250345 - DNA, 21 bp, Homo sapiens
ttagatattgctactataatc

SEQ ID NO: 3250346 - DNA, 17 bp, Homo sapiens
ttagatcttatattggt

SEQ ID NO: 3250347 - DNA, 23 bp, Homo sapiens
ttagatggaaaaatgtgaaaaaa

SEQ ID NO: 3250348 - DNA, 16 bp, Homo sapiens
ttagatggttacactg

SEQ ID NO: 3250349 - DNA, 22 bp, Homo sapiens
ttagatgttccagtaatctaat

SEQ ID NO: 3250350 - DNA, 13 bp, Homo sapiens
ttagattgagaaa

SEQ ID NO: 3250351 - DNA, 18 bp, Homo sapiens
ttagattttctggttcta

SEQ ID NO: 3250352 - DNA, 21 bp, Homo sapiens
ttagcaaggtcatttcttcag

SEQ ID NO: 3250353 - DNA, 23 bp, Homo sapiens
ttagcaataaataacacttgtca

SEQ ID NO: 3250354 - DNA, 13 bp, Homo sapiens
ttagcacagattt

SEQ ID NO: 3250355 - DNA, 20 bp, Homo sapiens
ttagcacagattttaattgt

SEQ ID NO: 3250356 - DNA, 18 bp, Homo sapiens
ttagcacgtttaaagttc

SEQ ID NO: 3250357 - DNA, 22 bp, Homo sapiens
ttagcacgtttaaagttctgtg

SEQ ID NO: 3250358 - DNA, 14 bp, Homo sapiens
ttagcactgttgat

SEQ ID NO: 3250359 - DNA, 21 bp, Homo sapiens
ttagcactgttgatgtatctg

SEQ ID NO: 3250360 - DNA, 14 bp, Homo sapiens
ttagcagatgtggt

SEQ ID NO: 3250361 - DNA, 21 bp, Homo sapiens
ttagcagcagcctttaatgca

SEQ ID NO: 3250362 - DNA, 15 bp, Homo sapiens
ttagcataattttgt

SEQ ID NO: 3250363 - DNA, 16 bp, Homo sapiens
ttagcatgtttgctga

SEQ ID NO: 3250364 - DNA, 16 bp, Homo sapiens
ttagccagagatgcaa

SEQ ID NO: 3250365 - DNA, 15 bp, Homo sapiens
ttagccaggatcatg

SEQ ID NO: 3250366 - DNA, 23 bp, Homo sapiens
ttagccaggatcatggtgtaata

SEQ ID NO: 3250367 - DNA, 16 bp, Homo sapiens
ttagccagtgaaacac

SEQ ID NO: 3250368 - DNA, 12 bp, Homo sapiens
ttagccagtgac

SEQ ID NO: 3250369 - DNA, 20 bp, Homo sapiens
ttagccatctaatgcttgtt

SEQ ID NO: 3250370 - DNA, 21 bp, Homo sapiens
ttagccgcaccctgcacctgc

SEQ ID NO: 3250371 - DNA, 15 bp, Homo sapiens
ttagcctccctgaaa

SEQ ID NO: 3250372 - DNA, 23 bp, Homo sapiens
ttagcctggagcacctttccttc

SEQ ID NO: 3250373 - DNA, 16 bp, Homo sapiens
ttagcctttgccctgt

SEQ ID NO: 3250374 - DNA, 14 bp, Homo sapiens
ttagcggagacgga

SEQ ID NO: 3250375 - DNA, 21 bp, Homo sapiens
ttagctaaacggattccaaag

SEQ ID NO: 3250376 - DNA, 18 bp, Homo sapiens
ttagctactgtatgcaaa

SEQ ID NO: 3250377 - DNA, 14 bp, Homo sapiens
ttagctcccagcta

SEQ ID NO: 3250378 - DNA, 15 bp, Homo sapiens
ttagctcccagctag

SEQ ID NO: 3250379 - DNA, 13 bp, Homo sapiens
ttagctcctgtgg

SEQ ID NO: 3250380 - DNA, 15 bp, Homo sapiens
ttagctctggggggc

SEQ ID NO: 3250381 - DNA, 16 bp, Homo sapiens
ttagctctggggggca

SEQ ID NO: 3250382 - DNA, 23 bp, Homo sapiens
ttagctgatgaacttattctgta

SEQ ID NO: 3250383 - DNA, 16 bp, Homo sapiens
ttagctggcattacag

SEQ ID NO: 3250384 - DNA, 10 bp, Homo sapiens
ttagctgtgc

SEQ ID NO: 3250385 - DNA, 15 bp, Homo sapiens
ttagctgtgtgaaat

SEQ ID NO: 3250386 - DNA, 20 bp, Homo sapiens
ttagctttattatggcttgt

SEQ ID NO: 3250387 - DNA, 16 bp, Homo sapiens
ttagctttttctcaga

SEQ ID NO: 3250388 - DNA, 18 bp, Homo sapiens
ttaggaaaatcactttgt

SEQ ID NO: 3250389 - DNA, 11 bp, Homo sapiens
ttaggaaataa

SEQ ID NO: 3250390 - DNA, 12 bp, Homo sapiens
ttaggaaataaa

SEQ ID NO: 3250391 - DNA, 17 bp, Homo sapiens
ttaggaacttcagagat

SEQ ID NO: 3250392 - DNA, 20 bp, Homo sapiens
ttaggaagtgtaacagctga

SEQ ID NO: 3250393 - DNA, 21 bp, Homo sapiens
ttaggaagtgtaacagctgag

SEQ ID NO: 3250394 - DNA, 19 bp, Homo sapiens
ttaggaattaagttatctt

SEQ ID NO: 3250395 - DNA, 21 bp, Homo sapiens
ttaggacaatcagtcccctcc

SEQ ID NO: 3250396 - DNA, 17 bp, Homo sapiens
ttaggagacgctgcact

SEQ ID NO: 3250397 - DNA, 23 bp, Homo sapiens
ttaggagattttaggtgttgatt

SEQ ID NO: 3250398 - DNA, 15 bp, Homo sapiens
ttaggagctaaggct

SEQ ID NO: 3250399 - DNA, 17 bp, Homo sapiens
ttaggagctaaggctct

SEQ ID NO: 3250400 - DNA, 17 bp, Homo sapiens
ttaggaggctcaacaat

SEQ ID NO: 3250401 - DNA, 21 bp, Homo sapiens
ttaggagttcgagaccagcct

SEQ ID NO: 3250402 - DNA, 18 bp, Homo sapiens
ttaggatggggctcccag

SEQ ID NO: 3250403 - DNA, 22 bp, Homo sapiens
ttaggatggggctcccagctcc

SEQ ID NO: 3250404 - DNA, 15 bp, Homo sapiens
ttaggcagattgaaa

SEQ ID NO: 3250405 - DNA, 10 bp, Homo sapiens
ttaggccccg

SEQ ID NO: 3250406 - DNA, 16 bp, Homo sapiens
ttaggccccgtggtga

SEQ ID NO: 3250407 - DNA, 14 bp, Homo sapiens
ttaggcctctgaga

SEQ ID NO: 3250408 - DNA, 22 bp, Homo sapiens
ttaggctatttgtaaatctgcc

SEQ ID NO: 3250409 - DNA, 23 bp, Homo sapiens
ttaggctatttgtaaatctgcca

SEQ ID NO: 3250410 - DNA, 13 bp, Homo sapiens
ttaggctgtaaag

SEQ ID NO: 3250411 - DNA, 14 bp, Homo sapiens
ttaggctgttcctt

SEQ ID NO: 3250412 - DNA, 16 bp, Homo sapiens
ttaggcttttaagaaa

SEQ ID NO: 3250413 - DNA, 13 bp, Homo sapiens
ttagggagaaaat

SEQ ID NO: 3250414 - DNA, 21 bp, Homo sapiens
ttagggagagtcatattttga

SEQ ID NO: 3250415 - DNA, 15 bp, Homo sapiens
ttaggggggaaagtc

SEQ ID NO: 3250416 - DNA, 14 bp, Homo sapiens
ttagggtacattta

SEQ ID NO: 3250417 - DNA, 15 bp, Homo sapiens
ttagggtactaaatt

SEQ ID NO: 3250418 - DNA, 15 bp, Homo sapiens
ttagggtcagccatt

SEQ ID NO: 3250419 - DNA, 14 bp, Homo sapiens
ttaggtagaaaaac

SEQ ID NO: 3250420 - DNA, 12 bp, Homo sapiens
ttaggtctggtt

SEQ ID NO: 3250421 - DNA, 18 bp, Homo sapiens
ttaggtgcaatttcaagg

SEQ ID NO: 3250422 - DNA, 22 bp, Homo sapiens
ttaggtgcaatttcaaggttct

SEQ ID NO: 3250423 - DNA, 17 bp, Homo sapiens
ttatccatattgagtca

SEQ ID NO: 3250424 - DNA, 19 bp, Homo sapiens
ttatccatattgagtcaaa

SEQ ID NO: 3250425 - DNA, 15 bp, Homo sapiens
ttatccctcacctgt

SEQ ID NO: 3250426 - DNA, 20 bp, Homo sapiens
ttatccctcacctgtagcag

SEQ ID NO: 3250427 - DNA, 23 bp, Homo sapiens
ttatcccttccttttagcctagt

SEQ ID NO: 3250428 - DNA, 22 bp, Homo sapiens
ttatcctagattatatcaaagt

SEQ ID NO: 3250429 - DNA, 15 bp, Homo sapiens
ttatcctctttgtaa

SEQ ID NO: 3250430 - DNA, 16 bp, Homo sapiens
ttatcctctttgtaat

SEQ ID NO: 3250431 - DNA, 13 bp, Homo sapiens
ttatcgaaataac

SEQ ID NO: 3250432 - DNA, 15 bp, Homo sapiens
ttatcgaaataacaa

SEQ ID NO: 3250433 - DNA, 24 bp, Homo sapiens
ttatcggcccatagctaataagta

SEQ ID NO: 3250434 - DNA, 23 bp, Homo sapiens
ttatcgggaacagtgtttcccat

SEQ ID NO: 3250435 - DNA, 23 bp, Homo sapiens
ttatcgggagcagtgtcttccat

SEQ ID NO: 3250436 - DNA, 15 bp, Homo sapiens
ttatctaaaagaaat

SEQ ID NO: 3250437 - DNA, 15 bp, Homo sapiens
ttatctaaattaaag

SEQ ID NO: 3250438 - DNA, 19 bp, Homo sapiens
ttatctaatacctctgtgt

SEQ ID NO: 3250439 - DNA, 23 bp, Homo sapiens
ttatctacccaagggcagaaagt

SEQ ID NO: 3250440 - DNA, 19 bp, Homo sapiens
ttatctatacatatcttta

SEQ ID NO: 3250441 - DNA, 15 bp, Homo sapiens
ttatctatataaaat

SEQ ID NO: 3250442 - DNA, 16 bp, Homo sapiens
ttatctatataaaata

SEQ ID NO: 3250443 - DNA, 12 bp, Homo sapiens
ttatctattaaa

SEQ ID NO: 3250444 - DNA, 19 bp, Homo sapiens
ttatctcagtcatgcataa

SEQ ID NO: 3250445 - DNA, 20 bp, Homo sapiens
ttatctcagtcatgcataaa

SEQ ID NO: 3250446 - DNA, 20 bp, Homo sapiens
ttatctcttttatatttgta

SEQ ID NO: 3250447 - DNA, 12 bp, Homo sapiens
ttatctgagttg

SEQ ID NO: 3250448 - DNA, 19 bp, Homo sapiens
ttatctgtgcgtgaaacac

SEQ ID NO: 3250449 - DNA, 12 bp, Homo sapiens
ttatcttagctg

SEQ ID NO: 3250450 - DNA, 18 bp, Homo sapiens
ttatcttctcaagttcta

SEQ ID NO: 3250451 - DNA, 16 bp, Homo sapiens
ttatcttgtctctggg

SEQ ID NO: 3250452 - DNA, 17 bp, Homo sapiens
ttatcttgtctctgggc

SEQ ID NO: 3250453 - DNA, 14 bp, Homo sapiens
ttatcttttcataa

SEQ ID NO: 3250454 - DNA, 15 bp, Homo sapiens
ttatgaaaataaata

SEQ ID NO: 3250455 - DNA, 18 bp, Homo sapiens
ttatgaaaataaatagct

SEQ ID NO: 3250456 - DNA, 20 bp, Homo sapiens
ttatgaagtgcgtgaatgta

SEQ ID NO: 3250457 - DNA, 13 bp, Homo sapiens
ttatgaatcagtg

SEQ ID NO: 3250458 - DNA, 17 bp, Homo sapiens
ttatgacagccatttgt

SEQ ID NO: 3250459 - DNA, 18 bp, Homo sapiens
ttatgacctcttccttta

SEQ ID NO: 3250460 - DNA, 15 bp, Homo sapiens
ttatgagatctaatg

SEQ ID NO: 3250461 - DNA, 16 bp, Homo sapiens
ttatgagatctaatgt

SEQ ID NO: 3250462 - DNA, 13 bp, Homo sapiens
ttatgagtttttg

SEQ ID NO: 3250463 - DNA, 23 bp, Homo sapiens
ttatgagtttttgatagctttat

SEQ ID NO: 3250464 - DNA, 19 bp, Homo sapiens
ttatgatattgtttaaaat

SEQ ID NO: 3250465 - DNA, 19 bp, Homo sapiens
ttatgatctatttgtagat

SEQ ID NO: 3250466 - DNA, 16 bp, Homo sapiens
ttatgatgcatacagt

SEQ ID NO: 3250467 - DNA, 18 bp, Homo sapiens
ttatgatgcatacagttt

SEQ ID NO: 3250468 - DNA, 20 bp, Homo sapiens
ttatgcaattaggtttttcc

SEQ ID NO: 3250469 - DNA, 23 bp, Homo sapiens
ttatgcagaagcatattttgctg

SEQ ID NO: 3250470 - DNA, 16 bp, Homo sapiens
ttatgcggttaatttt

SEQ ID NO: 3250471 - DNA, 19 bp, Homo sapiens
ttatgcggttaattttgaa

SEQ ID NO: 3250472 - DNA, 19 bp, Homo sapiens
ttatgctctcactgtttgt

SEQ ID NO: 3250473 - DNA, 20 bp, Homo sapiens
ttatgctcttttttactcat

SEQ ID NO: 3250474 - DNA, 14 bp, Homo sapiens
ttatgctgagtatg

SEQ ID NO: 3250475 - DNA, 21 bp, Homo sapiens
ttatgcttccacaggcaaaac

SEQ ID NO: 3250476 - DNA, 21 bp, Homo sapiens
ttatgcttccattaacaaatg

SEQ ID NO: 3250477 - DNA, 22 bp, Homo sapiens
ttatggaagattttaaattcac

SEQ ID NO: 3250478 - DNA, 23 bp, Homo sapiens
ttatggaatatcatctgtcatta

SEQ ID NO: 3250479 - DNA, 23 bp, Homo sapiens
ttatggaattgatttgcattgaa

SEQ ID NO: 3250480 - DNA, 19 bp, Homo sapiens
ttatggagacctctccttc

SEQ ID NO: 3250481 - DNA, 16 bp, Homo sapiens
ttatggatgattaaat

SEQ ID NO: 3250482 - DNA, 20 bp, Homo sapiens
ttatggatgattaaatttta

SEQ ID NO: 3250483 - DNA, 17 bp, Homo sapiens
ttatggccacagcccat

SEQ ID NO: 3250484 - DNA, 11 bp, Homo sapiens
ttatggcctca

SEQ ID NO: 3250485 - DNA, 13 bp, Homo sapiens
ttatggcttgtga

SEQ ID NO: 3250486 - DNA, 15 bp, Homo sapiens
ttatggcttgtgaac

SEQ ID NO: 3250487 - DNA, 16 bp, Homo sapiens
ttatggcttgtgaact

SEQ ID NO: 3250488 - DNA, 12 bp, Homo sapiens
ttatgggagaat

SEQ ID NO: 3250489 - DNA, 18 bp, Homo sapiens
ttatgggatgtaaacaat

SEQ ID NO: 3250490 - DNA, 11 bp, Homo sapiens
ttatggttttg

SEQ ID NO: 3250491 - DNA, 20 bp, Homo sapiens
ttatgtactagtgttctgtt

SEQ ID NO: 3250492 - DNA, 13 bp, Homo sapiens
ttatgtactgtac

SEQ ID NO: 3250493 - DNA, 18 bp, Homo sapiens
ttatgtactgtactaatt

SEQ ID NO: 3250494 - DNA, 13 bp, Homo sapiens
ttatgtacttgat

SEQ ID NO: 3250495 - DNA, 13 bp, Homo sapiens
ttatgtagagttt

SEQ ID NO: 3250496 - DNA, 15 bp, Homo sapiens
ttatgtagatgtgca

SEQ ID NO: 3250497 - DNA, 16 bp, Homo sapiens
ttatgtagatgtgcat

SEQ ID NO: 3250498 - DNA, 15 bp, Homo sapiens
ttatgtagtaattga

SEQ ID NO: 3250499 - DNA, 19 bp, Homo sapiens
ttatgtagtaattgacatg

SEQ ID NO: 3250500 - DNA, 21 bp, Homo sapiens
ttatgtagtttttatatgttg

SEQ ID NO: 3250501 - DNA, 17 bp, Homo sapiens
ttatgtctagaaagtaa

SEQ ID NO: 3250502 - DNA, 17 bp, Homo sapiens
ttatgtctatttaagcc

SEQ ID NO: 3250503 - DNA, 16 bp, Homo sapiens
ttatgtcttcttttgt

SEQ ID NO: 3250504 - DNA, 22 bp, Homo sapiens
ttatgtgaagaatttagatctt

SEQ ID NO: 3250505 - DNA, 13 bp, Homo sapiens
ttatgtgagagaa

SEQ ID NO: 3250506 - DNA, 21 bp, Homo sapiens
ttatgtggcttgtttatcctt

SEQ ID NO: 3250507 - DNA, 16 bp, Homo sapiens
ttatgtggttttagat

SEQ ID NO: 3250508 - DNA, 17 bp, Homo sapiens
ttatgtgtgcatgtgtg

SEQ ID NO: 3250509 - DNA, 18 bp, Homo sapiens
ttatgtgtgcatgtgtgt

SEQ ID NO: 3250510 - DNA, 20 bp, Homo sapiens
ttatgtgtgcatgtgtgtat

SEQ ID NO: 3250511 - DNA, 20 bp, Homo sapiens
ttatgttcctcaaggtccat

SEQ ID NO: 3250512 - DNA, 21 bp, Homo sapiens
ttatgttgttcaaatgcattt

SEQ ID NO: 3250513 - DNA, 16 bp, Homo sapiens
ttatgttttcaactca

SEQ ID NO: 3250514 - DNA, 15 bp, Homo sapiens
ttatgttttgtttct

SEQ ID NO: 3250515 - DNA, 14 bp, Homo sapiens
ttattaaaatgatt

SEQ ID NO: 3250516 - DNA, 19 bp, Homo sapiens
ttattaaaatgattgtaaa

SEQ ID NO: 3250517 - DNA, 16 bp, Homo sapiens
ttattaaacattttca

SEQ ID NO: 3250518 - DNA, 19 bp, Homo sapiens
ttattaaataaaatcaatt

SEQ ID NO: 3250519 - DNA, 20 bp, Homo sapiens
ttattaaataaaatcaattt

SEQ ID NO: 3250520 - DNA, 14 bp, Homo sapiens
ttcaaagtgtatat

SEQ ID NO: 3250521 - DNA, 23 bp, Homo sapiens
ttcaaagtgtatatttattcata

SEQ ID NO: 3250522 - DNA, 16 bp, Homo sapiens
ttcaaagttttgttgt

SEQ ID NO: 3250523 - DNA, 20 bp, Homo sapiens
ttcaaagttttgttgtactt

SEQ ID NO: 3250524 - DNA, 21 bp, Homo sapiens
ttcaaagttttgttgtactta

SEQ ID NO: 3250525 - DNA, 12 bp, Homo sapiens
ttcaaatacaaa

SEQ ID NO: 3250526 - DNA, 18 bp, Homo sapiens
ttcaaatacaaagtaaat

SEQ ID NO: 3250527 - DNA, 13 bp, Homo sapiens
ttcaaatcagtga

SEQ ID NO: 3250528 - DNA, 16 bp, Homo sapiens
ttcaaatccttccaaa

SEQ ID NO: 3250529 - DNA, 17 bp, Homo sapiens
ttcaaatccttccaaaa

SEQ ID NO: 3250530 - DNA, 23 bp, Homo sapiens
ttcaaatccttccaaaaattatt

SEQ ID NO: 3250531 - DNA, 22 bp, Homo sapiens
ttcaaatgatttttacaagttt

SEQ ID NO: 3250532 - DNA, 13 bp, Homo sapiens
ttcaaatgcattt

SEQ ID NO: 3250533 - DNA, 14 bp, Homo sapiens
ttcaaatgcatttt

SEQ ID NO: 3250534 - DNA, 13 bp, Homo sapiens
ttcaaatgttaga

SEQ ID NO: 3250535 - DNA, 14 bp, Homo sapiens
ttcaaatgttagat

SEQ ID NO: 3250536 - DNA, 16 bp, Homo sapiens
ttcaaatgttagatat

SEQ ID NO: 3250537 - DNA, 16 bp, Homo sapiens
ttcaaattcttctgaa

SEQ ID NO: 3250538 - DNA, 19 bp, Homo sapiens
ttcaaattcttctgaactc

SEQ ID NO: 3250539 - DNA, 18 bp, Homo sapiens
ttcaaattggactttcaa

SEQ ID NO: 3250540 - DNA, 15 bp, Homo sapiens
ttcaaatttgtacag

SEQ ID NO: 3250541 - DNA, 15 bp, Homo sapiens
ttcaacatcaatgtt

SEQ ID NO: 3250542 - DNA, 16 bp, Homo sapiens
ttcaacatcaatgttc

SEQ ID NO: 3250543 - DNA, 19 bp, Homo sapiens
ttcaacatcaatgttcatt

SEQ ID NO: 3250544 - DNA, 21 bp, Homo sapiens
ttcaacatcaatgttcattgt

SEQ ID NO: 3250545 - DNA, 22 bp, Homo sapiens
ttcaaccagcctacaagctggc

SEQ ID NO: 3250546 - DNA, 17 bp, Homo sapiens
ttcaaccattccccatg

SEQ ID NO: 3250547 - DNA, 22 bp, Homo sapiens
ttcaacctggtggcaccagatg

SEQ ID NO: 3250548 - DNA, 14 bp, Homo sapiens
ttcaacgcagccct

SEQ ID NO: 3250549 - DNA, 18 bp, Homo sapiens
ttcaactattttattatc

SEQ ID NO: 3250550 - DNA, 13 bp, Homo sapiens
ttcaactgctttg

SEQ ID NO: 3250551 - DNA, 13 bp, Homo sapiens
ttcaacttttcta

SEQ ID NO: 3250552 - DNA, 15 bp, Homo sapiens
ttcaagaaaatcttt

SEQ ID NO: 3250553 - DNA, 12 bp, Homo sapiens
ttcaagaaactg

SEQ ID NO: 3250554 - DNA, 13 bp, Homo sapiens
ttcaagaaactga

SEQ ID NO: 3250555 - DNA, 23 bp, Homo sapiens
ttcaagaaactgaggaattttct

SEQ ID NO: 3250556 - DNA, 22 bp, Homo sapiens
ttcaagaaagcttcaaactgca

SEQ ID NO: 3250557 - DNA, 13 bp, Homo sapiens
ttcaagaaaggaa

SEQ ID NO: 3250558 - DNA, 18 bp, Homo sapiens
ttcaagaccttctcccca

SEQ ID NO: 3250559 - DNA, 16 bp, Homo sapiens
ttcaagacgaggggca

SEQ ID NO: 3250560 - DNA, 12 bp, Homo sapiens
ttcaagcaaaca

SEQ ID NO: 3250561 - DNA, 13 bp, Homo sapiens
ttcaagcaaacat

SEQ ID NO: 3250562 - DNA, 15 bp, Homo sapiens
ttcaagcaaacatca

SEQ ID NO: 3250563 - DNA, 16 bp, Homo sapiens
ttcaagcagcatcttc

SEQ ID NO: 3250564 - DNA, 18 bp, Homo sapiens
ttcaagcagtcgtgcctg

SEQ ID NO: 3250565 - DNA, 17 bp, Homo sapiens
ttcaagccagctctagg

SEQ ID NO: 3250566 - DNA, 15 bp, Homo sapiens
ttcaagcctgtggga

SEQ ID NO: 3250567 - DNA, 21 bp, Homo sapiens
ttcaagcgattcttctgcttc

SEQ ID NO: 3250568 - DNA, 22 bp, Homo sapiens
ttcaagctattctcatgcctca

SEQ ID NO: 3250569 - DNA, 14 bp, Homo sapiens
ttcaagctatttaa

SEQ ID NO: 3250570 - DNA, 20 bp, Homo sapiens
ttcaaggaaaaatgctgctt

SEQ ID NO: 3250571 - DNA, 19 bp, Homo sapiens
ttcaaggaatttcttaact

SEQ ID NO: 3250572 - DNA, 17 bp, Homo sapiens
ttcaaggcactctagat

SEQ ID NO: 3250573 - DNA, 21 bp, Homo sapiens
ttcaaggcactctagattcca

SEQ ID NO: 3250574 - DNA, 16 bp, Homo sapiens
ttcaaggcttccactg

SEQ ID NO: 3250575 - DNA, 17 bp, Homo sapiens
ttcaaggtggccaaatt

SEQ ID NO: 3250576 - DNA, 12 bp, Homo sapiens
ttcaagtgccaa

SEQ ID NO: 3250577 - DNA, 18 bp, Homo sapiens
ttcaagtggggctcgcca

SEQ ID NO: 3250578 - DNA, 22 bp, Homo sapiens
ttcaagtggggctcgccatgcc

SEQ ID NO: 3250579 - DNA, 13 bp, Homo sapiens
ttcaagttaaagt

SEQ ID NO: 3250580 - DNA, 16 bp, Homo sapiens
ttcaagttagctcagg

SEQ ID NO: 3250581 - DNA, 12 bp, Homo sapiens
ttcaagttattc

SEQ ID NO: 3250582 - DNA, 13 bp, Homo sapiens
ttcaagttattca

SEQ ID NO: 3250583 - DNA, 16 bp, Homo sapiens
ttcaagttattcaaat

SEQ ID NO: 3250584 - DNA, 17 bp, Homo sapiens
ttcaagttattcaaatt

SEQ ID NO: 3250585 - DNA, 14 bp, Homo sapiens
ttcaagttattgta

SEQ ID NO: 3250586 - DNA, 20 bp, Homo sapiens
ttcaagttattgtacagctg

SEQ ID NO: 3250587 - DNA, 12 bp, Homo sapiens
ttcaagttgtaa

SEQ ID NO: 3250588 - DNA, 16 bp, Homo sapiens
ttcaagttgtgtctga

SEQ ID NO: 3250589 - DNA, 15 bp, Homo sapiens
ttcaagttttaaagt

SEQ ID NO: 3250590 - DNA, 16 bp, Homo sapiens
ttcaagttttaaagtt

SEQ ID NO: 3250591 - DNA, 22 bp, Homo sapiens
ttcaagttttgggtatgtttaa

SEQ ID NO: 3250592 - DNA, 18 bp, Homo sapiens
ttcaataaagcatttata

SEQ ID NO: 3250593 - DNA, 22 bp, Homo sapiens
ttcaatactgctgaaacagaca

SEQ ID NO: 3250594 - DNA, 22 bp, Homo sapiens
ttcaatactgtatgccttctgt

SEQ ID NO: 3250595 - DNA, 21 bp, Homo sapiens
ttcaatcaactttactgtaat

SEQ ID NO: 3250596 - DNA, 12 bp, Homo sapiens
ttcaatcactgt

SEQ ID NO: 3250597 - DNA, 14 bp, Homo sapiens
ttcaatcatcaaaa

SEQ ID NO: 3250598 - DNA, 17 bp, Homo sapiens
ttcaatctgtaaactgt

SEQ ID NO: 3250599 - DNA, 18 bp, Homo sapiens
ttcaatctgtaaactgtg

SEQ ID NO: 3250600 - DNA, 14 bp, Homo sapiens
ttcaatctgtgtaa

SEQ ID NO: 3250601 - DNA, 17 bp, Homo sapiens
ttcaatgggctcttcca

SEQ ID NO: 3250602 - DNA, 21 bp, Homo sapiens
ttcaatgtgattctaatgtct

SEQ ID NO: 3250603 - DNA, 14 bp, Homo sapiens
ttcaatgtgtataa

SEQ ID NO: 3250604 - DNA, 19 bp, Homo sapiens
ttcaatgtgtataaattgt

SEQ ID NO: 3250605 - DNA, 14 bp, Homo sapiens
ttcaatgtttgaaa

SEQ ID NO: 3250606 - DNA, 13 bp, Homo sapiens
ttcaattcctggg

SEQ ID NO: 3250607 - DNA, 14 bp, Homo sapiens
ttcaattgtaaatt

SEQ ID NO: 3250608 - DNA, 19 bp, Homo sapiens
ttcacaaactacctctgga

SEQ ID NO: 3250609 - DNA, 14 bp, Homo sapiens
ttcacaagcctcct

SEQ ID NO: 3250610 - DNA, 20 bp, Homo sapiens
ttcacaagcctcctgtacct

SEQ ID NO: 3250611 - DNA, 15 bp, Homo sapiens
ttcacaataaaagct

SEQ ID NO: 3250612 - DNA, 14 bp, Homo sapiens
ttcacacaaagcct

SEQ ID NO: 3250613 - DNA, 16 bp, Homo sapiens
ttcacacaaagcctgt

SEQ ID NO: 3250614 - DNA, 12 bp, Homo sapiens
ttcacagctcct

SEQ ID NO: 3250615 - DNA, 13 bp, Homo sapiens
ttcacagctcctc

SEQ ID NO: 3250616 - DNA, 15 bp, Homo sapiens
ttcacagctcctccc

SEQ ID NO: 3250617 - DNA, 12 bp, Homo sapiens
ttcacaggaggc

SEQ ID NO: 3250618 - DNA, 15 bp, Homo sapiens
ttcacaggctgtaaa

SEQ ID NO: 3250619 - DNA, 23 bp, Homo sapiens
ttcacaggctgtaaattgaactt

SEQ ID NO: 3250620 - DNA, 15 bp, Homo sapiens
ttcacaggtcaataa

SEQ ID NO: 3250621 - DNA, 17 bp, Homo sapiens
ttcacagtagagccagc

SEQ ID NO: 3250622 - DNA, 18 bp, Homo sapiens
ttcacagtagagccagct

SEQ ID NO: 3250623 - DNA, 20 bp, Homo sapiens
ttcacagtagagccagcttg

SEQ ID NO: 3250624 - DNA, 12 bp, Homo sapiens
ttcacagtgttt

SEQ ID NO: 3250625 - DNA, 17 bp, Homo sapiens
ttcacataccctccccc

SEQ ID NO: 3250626 - DNA, 17 bp, Homo sapiens
ttcacatagatgtccct

SEQ ID NO: 3250627 - DNA, 17 bp, Homo sapiens
ttcacattaaaaaatga

SEQ ID NO: 3250628 - DNA, 12 bp, Homo sapiens
tgtcaaaataaa

SEQ ID NO: 3250629 - DNA, 19 bp, Homo sapiens
tgtcaaattttcaaataat

SEQ ID NO: 3250630 - DNA, 15 bp, Homo sapiens
tgtcaactatgatat

SEQ ID NO: 3250631 - DNA, 14 bp, Homo sapiens
tgtcaacttctggc

SEQ ID NO: 3250632 - DNA, 15 bp, Homo sapiens
tgtcaacttctggct

SEQ ID NO: 3250633 - DNA, 18 bp, Homo sapiens
tgtcaacttctggctcct

SEQ ID NO: 3250634 - DNA, 19 bp, Homo sapiens
tgtcaagaagatgatcaga

SEQ ID NO: 3250635 - DNA, 19 bp, Homo sapiens
tgtcaagtctctgctggcc

SEQ ID NO: 3250636 - DNA, 16 bp, Homo sapiens
tgtcaagttgtgcttg

SEQ ID NO: 3250637 - DNA, 17 bp, Homo sapiens
tgtcaagttgtgcttgt

SEQ ID NO: 3250638 - DNA, 21 bp, Homo sapiens
tgtcaataaacagcttcatgc

SEQ ID NO: 3250639 - DNA, 17 bp, Homo sapiens
tgtcaatattaaataca

SEQ ID NO: 3250640 - DNA, 19 bp, Homo sapiens
tgtcaatattaaatacaga

SEQ ID NO: 3250641 - DNA, 13 bp, Homo sapiens
tgtcaatgtaaag

SEQ ID NO: 3250642 - DNA, 18 bp, Homo sapiens
tgtcacaacctctctgat

SEQ ID NO: 3250643 - DNA, 16 bp, Homo sapiens
tgtcacaatgagattg

SEQ ID NO: 3250644 - DNA, 21 bp, Homo sapiens
tgtcacaatgagattgaattt

SEQ ID NO: 3250645 - DNA, 13 bp, Homo sapiens
tgtcacacacttt

SEQ ID NO: 3250646 - DNA, 14 bp, Homo sapiens
tgtcacagaaatca

SEQ ID NO: 3250647 - DNA, 19 bp, Homo sapiens
tgtcacagaaatcagagga

SEQ ID NO: 3250648 - DNA, 12 bp, Homo sapiens
tgtcacaggcag

SEQ ID NO: 3250649 - DNA, 17 bp, Homo sapiens
tgtctcaagagggcact

SEQ ID NO: 3250650 - DNA, 20 bp, Homo sapiens
tgtctcaagagggcactggt

SEQ ID NO: 3250651 - DNA, 14 bp, Homo sapiens
tgtctcacttttta

SEQ ID NO: 3250652 - DNA, 20 bp, Homo sapiens
tgtctcagacttttgtacat

SEQ ID NO: 3250653 - DNA, 14 bp, Homo sapiens
tgtctcagcctccc

SEQ ID NO: 3250654 - DNA, 15 bp, Homo sapiens
tgtctcagcctccca

SEQ ID NO: 3250655 - DNA, 17 bp, Homo sapiens
tgtctcaggtccctgca

SEQ ID NO: 3250656 - DNA, 14 bp, Homo sapiens
tgtctcctactcct

SEQ ID NO: 3250657 - DNA, 18 bp, Homo sapiens
tgtctcctttgctcttgc

SEQ ID NO: 3250658 - DNA, 16 bp, Homo sapiens
tgtctctaacttattt

SEQ ID NO: 3250659 - DNA, 12 bp, Homo sapiens
tgtctctacaaa

SEQ ID NO: 3250660 - DNA, 22 bp, Homo sapiens
tgtctctacaaaaaataaaata

SEQ ID NO: 3250661 - DNA, 11 bp, Homo sapiens
tgtctctccca

SEQ ID NO: 3250662 - DNA, 16 bp, Homo sapiens
tgtctctccttttctt

SEQ ID NO: 3250663 - DNA, 21 bp, Homo sapiens
tgtctctccttttcttttgtt

SEQ ID NO: 3250664 - DNA, 22 bp, Homo sapiens
tgtctctccttttcttttgtta

SEQ ID NO: 3250665 - DNA, 18 bp, Homo sapiens
tgtctctcttcagactct

SEQ ID NO: 3250666 - DNA, 19 bp, Homo sapiens
tgtctctcttcagactctc

SEQ ID NO: 3250667 - DNA, 18 bp, Homo sapiens
tgtctctgcatctgactc

SEQ ID NO: 3250668 - DNA, 11 bp, Homo sapiens
tgtctctgctc

SEQ ID NO: 3250669 - DNA, 22 bp, Homo sapiens
tgtctctgctcgccctcctttc

SEQ ID NO: 3250670 - DNA, 11 bp, Homo sapiens
tgtctctgggg

SEQ ID NO: 3250671 - DNA, 18 bp, Homo sapiens
tgtctctgttcagatgtg

SEQ ID NO: 3250672 - DNA, 14 bp, Homo sapiens
tgtctcttccatgc

SEQ ID NO: 3250673 - DNA, 13 bp, Homo sapiens
tgtctcttctgag

SEQ ID NO: 3250674 - DNA, 16 bp, Homo sapiens
tgtctcttctgagcta

SEQ ID NO: 3250675 - DNA, 15 bp, Homo sapiens
tgtctcttctgagga

SEQ ID NO: 3250676 - DNA, 22 bp, Homo sapiens
tgtctctttaatgtcacaggca

SEQ ID NO: 3250677 - DNA, 23 bp, Homo sapiens
tgtctctttggcgacctcctttc

SEQ ID NO: 3250678 - DNA, 19 bp, Homo sapiens
tgtctgaaacatttcataa

SEQ ID NO: 3250679 - DNA, 16 bp, Homo sapiens
tgtctgaagtcactgc

SEQ ID NO: 3250680 - DNA, 19 bp, Homo sapiens
tgtctgaagtcactgcaca

SEQ ID NO: 3250681 - DNA, 15 bp, Homo sapiens
tgtctgaatgtattt

SEQ ID NO: 3250682 - DNA, 16 bp, Homo sapiens
tggcgtaatgggcctg

SEQ ID NO: 3250683 - DNA, 13 bp, Homo sapiens
tggcgtggaggag

SEQ ID NO: 3250684 - DNA, 22 bp, Homo sapiens
tggctaaagataattgctattt

SEQ ID NO: 3250685 - DNA, 14 bp, Homo sapiens
tggctaagcctctg

SEQ ID NO: 3250686 - DNA, 11 bp, Homo sapiens
tggctaataaa

SEQ ID NO: 3250687 - DNA, 15 bp, Homo sapiens
tggctaataaactgt

SEQ ID NO: 3250688 - DNA, 17 bp, Homo sapiens
tggctaataaactgtat

SEQ ID NO: 3250689 - DNA, 22 bp, Homo sapiens
tggctaataaactgtattaaat

SEQ ID NO: 3250690 - DNA, 16 bp, Homo sapiens
tggctaataaggcttt

SEQ ID NO: 3250691 - DNA, 17 bp, Homo sapiens
tggctaatgtactgcat

SEQ ID NO: 3250692 - DNA, 22 bp, Homo sapiens
tggctacatcccagcctgtggt

SEQ ID NO: 3250693 - DNA, 19 bp, Homo sapiens
tggctagaggccagcccca

SEQ ID NO: 3250694 - DNA, 23 bp, Homo sapiens
tggctagaggccagccccaccca

SEQ ID NO: 3250695 - DNA, 16 bp, Homo sapiens
tggctaggcctttcct

SEQ ID NO: 3250696 - DNA, 15 bp, Homo sapiens
tggctagtactgtat

SEQ ID NO: 3250697 - DNA, 19 bp, Homo sapiens
tggctagtactgtattggc

SEQ ID NO: 3250698 - DNA, 24 bp, Homo sapiens
tggctatcaaaagaaatagaaaag

SEQ ID NO: 3250699 - DNA, 22 bp, Homo sapiens
tggctatttgaaatactaaaag

SEQ ID NO: 3250700 - DNA, 18 bp, Homo sapiens
tggctcaagtcctctttt

SEQ ID NO: 3250701 - DNA, 19 bp, Homo sapiens
tggctcagagcttgaagat

SEQ ID NO: 3250702 - DNA, 20 bp, Homo sapiens
tggctcagagcttgaagatt

SEQ ID NO: 3250703 - DNA, 22 bp, Homo sapiens
tggctcatttgcttttgtcact

SEQ ID NO: 3250704 - DNA, 16 bp, Homo sapiens
tggctccacacctcca

SEQ ID NO: 3250705 - DNA, 21 bp, Homo sapiens
tggctccatgattctctgagt

SEQ ID NO: 3250706 - DNA, 16 bp, Homo sapiens
tggctcccacaggagt

SEQ ID NO: 3250707 - DNA, 22 bp, Homo sapiens
tggctccccacgagtcacctgc

SEQ ID NO: 3250708 - DNA, 23 bp, Homo sapiens
tggctccccacgagtcacctgca

SEQ ID NO: 3250709 - DNA, 15 bp, Homo sapiens
tggctccctcctcca

SEQ ID NO: 3250710 - DNA, 17 bp, Homo sapiens
tggctccctcctccagg

SEQ ID NO: 3250711 - DNA, 19 bp, Homo sapiens
tggctccctcctccaggcc

SEQ ID NO: 3250712 - DNA, 21 bp, Homo sapiens
tggctccctcctccaggcctg

SEQ ID NO: 3250713 - DNA, 18 bp, Homo sapiens
tggctcctaccccatctc

SEQ ID NO: 3250714 - DNA, 18 bp, Homo sapiens
tggctcctatctgtgttt

SEQ ID NO: 3250715 - DNA, 18 bp, Homo sapiens
tggctcctcccggtgccc

SEQ ID NO: 3250716 - DNA, 23 bp, Homo sapiens
tggctcctgaggggcatctgccc

SEQ ID NO: 3250717 - DNA, 20 bp, Homo sapiens
tggctcgaatctctgtgcct

SEQ ID NO: 3250718 - DNA, 21 bp, Homo sapiens
tggctcgaatctctgtgcctt

SEQ ID NO: 3250719 - DNA, 19 bp, Homo sapiens
tggctctaattcacagtgc

SEQ ID NO: 3250720 - DNA, 16 bp, Homo sapiens
tggctctcagaaggta

SEQ ID NO: 3250721 - DNA, 13 bp, Homo sapiens
tggctctccaagt

SEQ ID NO: 3250722 - DNA, 14 bp, Homo sapiens
tggctctccaagtg

SEQ ID NO: 3250723 - DNA, 15 bp, Homo sapiens
tggctctccaagtgc

SEQ ID NO: 3250724 - DNA, 14 bp, Homo sapiens
tggctctctccagg

SEQ ID NO: 3250725 - DNA, 15 bp, Homo sapiens
tggctctctccagga

SEQ ID NO: 3250726 - DNA, 14 bp, Homo sapiens
tggctctgagaatc

SEQ ID NO: 3250727 - DNA, 22 bp, Homo sapiens
tggctctgaggtgcctgtccca

SEQ ID NO: 3250728 - DNA, 14 bp, Homo sapiens
tggctctggagaca

SEQ ID NO: 3250729 - DNA, 22 bp, Homo sapiens
tggctctggagacagccccaga

SEQ ID NO: 3250730 - DNA, 15 bp, Homo sapiens
tggctcttatttctg

SEQ ID NO: 3250731 - DNA, 19 bp, Homo sapiens
tggctcttgatacccccct

SEQ ID NO: 3250732 - DNA, 21 bp, Homo sapiens
tggctcttgatacccccctct

SEQ ID NO: 3250733 - DNA, 15 bp, Homo sapiens
tggctctttcagaga

SEQ ID NO: 3250734 - DNA, 16 bp, Homo sapiens
tggctctttgggctgg

SEQ ID NO: 3250735 - DNA, 15 bp, Homo sapiens
tggctgaaaaaggcc

SEQ ID NO: 3250736 - DNA, 17 bp, Homo sapiens
tggctgaaaatgcaaag

SEQ ID NO: 3250737 - DNA, 19 bp, Homo sapiens
tggctgaaaatgcaaagct

SEQ ID NO: 3250738 - DNA, 23 bp, Homo sapiens
tggctgaaaatgcaaagctgaag

SEQ ID NO: 3250739 - DNA, 16 bp, Homo sapiens
tggctgaaattctcct

SEQ ID NO: 3250740 - DNA, 21 bp, Homo sapiens
tggctgaaattctcctggagg

SEQ ID NO: 3250741 - DNA, 20 bp, Homo sapiens
tggctgacttacatcatgtg

SEQ ID NO: 3250742 - DNA, 19 bp, Homo sapiens
tggctgagatatgaacata

SEQ ID NO: 3250743 - DNA, 23 bp, Homo sapiens
tggctgagggcagctgcgcgggc

SEQ ID NO: 3250744 - DNA, 20 bp, Homo sapiens
tggctgaggttcctctgcct

SEQ ID NO: 3250745 - DNA, 21 bp, Homo sapiens
tggctgaggttcctctgcctg

SEQ ID NO: 3250746 - DNA, 22 bp, Homo sapiens
tggctgaggttcctctgcctgc

SEQ ID NO: 3250747 - DNA, 20 bp, Homo sapiens
tggctgatttatttctacta

SEQ ID NO: 3250748 - DNA, 13 bp, Homo sapiens
tggctgcagggag

SEQ ID NO: 3250749 - DNA, 22 bp, Homo sapiens
tggctgccaggcgttggtgcca

SEQ ID NO: 3250750 - DNA, 13 bp, Homo sapiens
tggctgcccagga

SEQ ID NO: 3250751 - DNA, 18 bp, Homo sapiens
tggctgccccggcctcct

SEQ ID NO: 3250752 - DNA, 13 bp, Homo sapiens
tggctgccctggc

SEQ ID NO: 3250753 - DNA, 14 bp, Homo sapiens
tggctgccctggcc

SEQ ID NO: 3250754 - DNA, 16 bp, Homo sapiens
tggctgctgcccccac

SEQ ID NO: 3250755 - DNA, 18 bp, Homo sapiens
tgtctgaggcctcatccc

SEQ ID NO: 3250756 - DNA, 15 bp, Homo sapiens
tgtctgagtgaacct

SEQ ID NO: 3250757 - DNA, 16 bp, Homo sapiens
tgtctgcagtgtgccc

SEQ ID NO: 3250758 - DNA, 19 bp, Homo sapiens
tgtctgcagtgtgcccccc

SEQ ID NO: 3250759 - DNA, 21 bp, Homo sapiens
tgtctgccctctgggtccctc

SEQ ID NO: 3250760 - DNA, 16 bp, Homo sapiens
tgtctgctaatgtaaa

SEQ ID NO: 3250761 - DNA, 20 bp, Homo sapiens
tgtctgctttaaagggcctg

SEQ ID NO: 3250762 - DNA, 22 bp, Homo sapiens
tgtctgctttaaagggcctgcc

SEQ ID NO: 3250763 - DNA, 13 bp, Homo sapiens
tgtctggagcggc

SEQ ID NO: 3250764 - DNA, 19 bp, Homo sapiens
tgtctggctgaggatttca

SEQ ID NO: 3250765 - DNA, 21 bp, Homo sapiens
tgtctggctttttcctctgag

SEQ ID NO: 3250766 - DNA, 19 bp, Homo sapiens
tgtctgggattaagggcaa

SEQ ID NO: 3250767 - DNA, 21 bp, Homo sapiens
tgtctgggattaagggcaaat

SEQ ID NO: 3250768 - DNA, 21 bp, Homo sapiens
tgtctggtggtggcaccatct

SEQ ID NO: 3250769 - DNA, 15 bp, Homo sapiens
tgtctggttttaaca

SEQ ID NO: 3250770 - DNA, 13 bp, Homo sapiens
tgtctgtaatcat

SEQ ID NO: 3250771 - DNA, 15 bp, Homo sapiens
tgtctgtacacgtgt

SEQ ID NO: 3250772 - DNA, 23 bp, Homo sapiens
tgtctgtagctcctcaactcacc

SEQ ID NO: 3250773 - DNA, 21 bp, Homo sapiens
tgtctgtcaccagctatctgt

SEQ ID NO: 3250774 - DNA, 21 bp, Homo sapiens
tgtctgtcccggggtcctgtg

SEQ ID NO: 3250775 - DNA, 17 bp, Homo sapiens
tgtctgtcctgatttct

SEQ ID NO: 3250776 - DNA, 14 bp, Homo sapiens
tgtctgtgaacaga

SEQ ID NO: 3250777 - DNA, 19 bp, Homo sapiens
tgtctgtgaacagagagac

SEQ ID NO: 3250778 - DNA, 20 bp, Homo sapiens
tgtctgtggatggtcattgc

SEQ ID NO: 3250779 - DNA, 17 bp, Homo sapiens
tgtctgtgttgctgttt

SEQ ID NO: 3250780 - DNA, 19 bp, Homo sapiens
tgtctgtgttgctgtttag

SEQ ID NO: 3250781 - DNA, 20 bp, Homo sapiens
tgtctgtgttttgaaagaat

SEQ ID NO: 3250782 - DNA, 13 bp, Homo sapiens
tgtctgttctaca

SEQ ID NO: 3250783 - DNA, 21 bp, Homo sapiens
tgtctgttctacatagatgct

SEQ ID NO: 3250784 - DNA, 13 bp, Homo sapiens
tgtcttaaaaggt

SEQ ID NO: 3250785 - DNA, 15 bp, Homo sapiens
tgtcttaattattat

SEQ ID NO: 3250786 - DNA, 14 bp, Homo sapiens
tgtcttatatagca

SEQ ID NO: 3250787 - DNA, 22 bp, Homo sapiens
tgtcttatatatatttctttgt

SEQ ID NO: 3250788 - DNA, 12 bp, Homo sapiens
tgtcttattctt

SEQ ID NO: 3250789 - DNA, 13 bp, Homo sapiens
tgtcttcaatgat

SEQ ID NO: 3250790 - DNA, 15 bp, Homo sapiens
tgtcttcaatgatca

SEQ ID NO: 3250791 - DNA, 23 bp, Homo sapiens
tgtcttcagcagtcaatacaaat

SEQ ID NO: 3250792 - DNA, 23 bp, Homo sapiens
tgtcttcatttcattgtatgatg

SEQ ID NO: 3250793 - DNA, 13 bp, Homo sapiens
tgtcttccaagga

SEQ ID NO: 3250794 - DNA, 16 bp, Homo sapiens
tgtcttccatgtatct

SEQ ID NO: 3250795 - DNA, 16 bp, Homo sapiens
tgtcttctctgtctca

SEQ ID NO: 3250796 - DNA, 14 bp, Homo sapiens
tgtcttctgcctgt

SEQ ID NO: 3250797 - DNA, 18 bp, Homo sapiens
tgtcttctgcctgttata

SEQ ID NO: 3250798 - DNA, 13 bp, Homo sapiens
tgtcttctgggca

SEQ ID NO: 3250799 - DNA, 13 bp, Homo sapiens
tgtcttcttttgt

SEQ ID NO: 3250800 - DNA, 14 bp, Homo sapiens
tgtcttcttttgtg

SEQ ID NO: 3250801 - DNA, 23 bp, Homo sapiens
tgtcttcttttgtggtgtcttcc

SEQ ID NO: 3250802 - DNA, 18 bp, Homo sapiens
tgtcttgatgactgctga

SEQ ID NO: 3250803 - DNA, 13 bp, Homo sapiens
tgtcttggacact

SEQ ID NO: 3250804 - DNA, 13 bp, Homo sapiens
tgtcttgggcaga

SEQ ID NO: 3250805 - DNA, 21 bp, Homo sapiens
tgtcttgggcagagctggctc

SEQ ID NO: 3250806 - DNA, 17 bp, Homo sapiens
tgtcttgtacatgtgta

SEQ ID NO: 3250807 - DNA, 12 bp, Homo sapiens
tgtcttgtactt

SEQ ID NO: 3250808 - DNA, 15 bp, Homo sapiens
tgtcttgtacttctg

SEQ ID NO: 3250809 - DNA, 16 bp, Homo sapiens
tgtctttaaaagagag

SEQ ID NO: 3250810 - DNA, 15 bp, Homo sapiens
tgtctttaagaacta

SEQ ID NO: 3250811 - DNA, 19 bp, Homo sapiens
tgtctttaggcagcagctt

SEQ ID NO: 3250812 - DNA, 21 bp, Homo sapiens
tgtctttaggcagcagctttt

SEQ ID NO: 3250813 - DNA, 18 bp, Homo sapiens
tgtctttatagatgtaca

SEQ ID NO: 3250814 - DNA, 12 bp, Homo sapiens
tgtctttatatg

SEQ ID NO: 3250815 - DNA, 15 bp, Homo sapiens
tgtctttctaagaaa

SEQ ID NO: 3250816 - DNA, 16 bp, Homo sapiens
tgtctttctaagaaat

SEQ ID NO: 3250817 - DNA, 12 bp, Homo sapiens
tgtctttctgag

SEQ ID NO: 3250818 - DNA, 15 bp, Homo sapiens
tgtctttctgagcac

SEQ ID NO: 3250819 - DNA, 21 bp, Homo sapiens
tgtctttggaaaaatgtttgt

SEQ ID NO: 3250820 - DNA, 19 bp, Homo sapiens
tgtctttgttggaaaagaa

SEQ ID NO: 3250821 - DNA, 20 bp, Homo sapiens
tgtcttttaaaatgcaatgt

SEQ ID NO: 3250822 - DNA, 14 bp, Homo sapiens
tgtcttttagacaa

SEQ ID NO: 3250823 - DNA, 16 bp, Homo sapiens
tgtcttttatatttgt

SEQ ID NO: 3250824 - DNA, 18 bp, Homo sapiens
tgtcttttatatttgtat

SEQ ID NO: 3250825 - DNA, 13 bp, Homo sapiens
tgtcttttctgct

SEQ ID NO: 3250826 - DNA, 18 bp, Homo sapiens
tgtcttttctgctgagga

SEQ ID NO: 3250827 - DNA, 14 bp, Homo sapiens
tgtcttttcttggc

SEQ ID NO: 3250828 - DNA, 15 bp, Homo sapiens
tgtcttttcttggca

SEQ ID NO: 3250829 - DNA, 13 bp, Homo sapiens
tgtcttttgaata

SEQ ID NO: 3250830 - DNA, 17 bp, Homo sapiens
tgtctttttctggactg

SEQ ID NO: 3250831 - DNA, 16 bp, Homo sapiens
tgtcttttttcactac

SEQ ID NO: 3250832 - DNA, 19 bp, Homo sapiens
tgtgaaaaaaatgagactt

SEQ ID NO: 3250833 - DNA, 22 bp, Homo sapiens
tgtgaaaaagatgccaattatt

SEQ ID NO: 3250834 - DNA, 13 bp, Homo sapiens
tgtgaaaaatctg
